United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 66

SEQ ID NO: 2365716 - RNA, 20 nt, Bordetella pertussis
cugcgagagauagcccagca

SEQ ID NO: 2365717 - RNA, 17 nt, Bordetella pertussis
cugcgagccgccgcccu

SEQ ID NO: 2365718 - RNA, 18 nt, Bordetella pertussis
cugcgagccuucggccgg

SEQ ID NO: 2365719 - RNA, 19 nt, Bordetella pertussis
cugcgagccuucggccggc

SEQ ID NO: 2365720 - RNA, 17 nt, Bordetella pertussis
cugcgcacccgccugga

SEQ ID NO: 2365721 - RNA, 21 nt, Bordetella pertussis
cugcgcacccgccuggacggc

SEQ ID NO: 2365722 - RNA, 21 nt, Bordetella pertussis
cugcgcaccggccggccgggc

SEQ ID NO: 2365723 - RNA, 13 nt, Bordetella pertussis
cugcgcagcagcg

SEQ ID NO: 2365724 - RNA, 23 nt, Bordetella pertussis
cugcgcagcagcgcgguggccag

SEQ ID NO: 2365725 - RNA, 15 nt, Bordetella pertussis
cugcgcagcagggcg

SEQ ID NO: 2365726 - RNA, 13 nt, Bordetella pertussis
cugcgcagcgacu

SEQ ID NO: 2365727 - RNA, 13 nt, Bordetella pertussis
cugcgcaggcgcc

SEQ ID NO: 2365728 - RNA, 17 nt, Bordetella pertussis
cugcgcaggcgccgcag

SEQ ID NO: 2365729 - RNA, 16 nt, Bordetella pertussis
cugcgcaggucggcca

SEQ ID NO: 2365730 - RNA, 18 nt, Bordetella pertussis
cugcgcaggucggccagg

SEQ ID NO: 2365731 - RNA, 22 nt, Bordetella pertussis
cugcgcaggucggccaggacgg

SEQ ID NO: 2365732 - RNA, 19 nt, Bordetella pertussis
cugcgcaucgaucagcgcg

SEQ ID NO: 2365733 - RNA, 16 nt, Bordetella pertussis
cugcgcaugcgccugu

SEQ ID NO: 2365734 - RNA, 19 nt, Bordetella pertussis
cugcgcauggcgucaagcc

SEQ ID NO: 2365735 - RNA, 18 nt, Bordetella pertussis
cugcgcaugggcgcaggc

SEQ ID NO: 2365736 - RNA, 20 nt, Bordetella pertussis
cugcgcaugggcgcaggccg

SEQ ID NO: 2365737 - RNA, 17 nt, Bordetella pertussis
cugcgcauggucgcgau

SEQ ID NO: 2365738 - RNA, 21 nt, Bordetella pertussis
cugcgccaauuguccuggucg

SEQ ID NO: 2365739 - RNA, 13 nt, Bordetella pertussis
cugcgccaccgca

SEQ ID NO: 2365740 - RNA, 18 nt, Bordetella pertussis
cugcgccaccgcaugggg

SEQ ID NO: 2365741 - RNA, 15 nt, Bordetella pertussis
cugcgccaccuggcg

SEQ ID NO: 2365742 - RNA, 21 nt, Bordetella pertussis
cugcgccaccuggcgcccggc

SEQ ID NO: 2365743 - RNA, 14 nt, Bordetella pertussis
cugcgccacgucca

SEQ ID NO: 2365744 - RNA, 17 nt, Bordetella pertussis
cugcgccacguccagca

SEQ ID NO: 2365745 - RNA, 21 nt, Bordetella pertussis
cugcgccacguccagcacggc

SEQ ID NO: 2365746 - RNA, 22 nt, Bordetella pertussis
cugcgccacguccagcacggcc

SEQ ID NO: 2365747 - RNA, 14 nt, Bordetella pertussis
cugcgccagccgcg

SEQ ID NO: 2365748 - RNA, 13 nt, Bordetella pertussis
cugcgccagcgga

SEQ ID NO: 2365749 - RNA, 12 nt, Bordetella pertussis
cugcgccagcuc

SEQ ID NO: 2365750 - RNA, 16 nt, Bordetella pertussis
cugcgccagcuccagc

SEQ ID NO: 2365751 - RNA, 20 nt, Bordetella pertussis
cugcgccagcuuggccaggc

SEQ ID NO: 2365752 - RNA, 22 nt, Bordetella pertussis
cugcgccagcuuggccaggcug

SEQ ID NO: 2365753 - RNA, 14 nt, Bordetella pertussis
cugcgccagguggg

SEQ ID NO: 2365754 - RNA, 15 nt, Bordetella pertussis
cugcgccaggugggc

SEQ ID NO: 2365755 - RNA, 14 nt, Bordetella pertussis
cugcgccauggcgc

SEQ ID NO: 2365756 - RNA, 17 nt, Bordetella pertussis
cugcgccauguggcgac

SEQ ID NO: 2365757 - RNA, 14 nt, Bordetella pertussis
cugcgccgaggccu

SEQ ID NO: 2365758 - RNA, 19 nt, Bordetella pertussis
cugcgccgaggccugcugu

SEQ ID NO: 2365759 - RNA, 23 nt, Bordetella pertussis
cugcgccgaggccugcugugcga

SEQ ID NO: 2365760 - RNA, 15 nt, Bordetella pertussis
cugcgccgaggcggg

SEQ ID NO: 2365761 - RNA, 19 nt, Bordetella pertussis
cugcgccgaggcgggcagc

SEQ ID NO: 2365762 - RNA, 20 nt, Bordetella pertussis
cugcgccgaggcgggcagca

SEQ ID NO: 2365763 - RNA, 16 nt, Bordetella pertussis
cugcgccgccgcgcgc

SEQ ID NO: 2365764 - RNA, 22 nt, Bordetella pertussis
cugcgccgccgcgcgcuggcug

SEQ ID NO: 2365765 - RNA, 22 nt, Bordetella pertussis
cugcgccgccgcguggcggcgc

SEQ ID NO: 2365766 - RNA, 14 nt, Bordetella pertussis
cugcgccgcggcgc

SEQ ID NO: 2365767 - RNA, 21 nt, Bordetella pertussis
cugcgccggcauggccaaugc

SEQ ID NO: 2365768 - RNA, 15 nt, Bordetella pertussis
cugcgccggcggcac

SEQ ID NO: 2365769 - RNA, 14 nt, Bordetella pertussis
cugcgccgggcgcg

SEQ ID NO: 2365770 - RNA, 16 nt, Bordetella pertussis
cugcgccgggcgcggc

SEQ ID NO: 2365771 - RNA, 20 nt, Bordetella pertussis
cugcgccgggcgcggccagg

SEQ ID NO: 2365772 - RNA, 22 nt, Bordetella pertussis
cugcgccgggcgcggccaggcg

SEQ ID NO: 2365773 - RNA, 13 nt, Bordetella pertussis
cugcgccgggucc

SEQ ID NO: 2365774 - RNA, 16 nt, Bordetella pertussis
cugcgccggguccggc

SEQ ID NO: 2365775 - RNA, 18 nt, Bordetella pertussis
cugcgccggguccggccg

SEQ ID NO: 2365776 - RNA, 19 nt, Bordetella pertussis
cugcgccggguccggccgc

SEQ ID NO: 2365777 - RNA, 22 nt, Bordetella pertussis
cugcgccgucugugcgccccgc

SEQ ID NO: 2365778 - RNA, 12 nt, Bordetella pertussis
cugcgccugcug

SEQ ID NO: 2365779 - RNA, 20 nt, Bordetella pertussis
cugcgccugcuggucggccu

SEQ ID NO: 2365780 - RNA, 23 nt, Bordetella pertussis
cugcgccugcuggucggccucgu

SEQ ID NO: 2365781 - RNA, 16 nt, Bordetella pertussis
cugcgccuggccgcgc

SEQ ID NO: 2365782 - RNA, 17 nt, Bordetella pertussis
cugcgccugggcggcgc

SEQ ID NO: 2365783 - RNA, 18 nt, Bordetella pertussis
cugcgccugggcggcgca

SEQ ID NO: 2365784 - RNA, 16 nt, Bordetella pertussis
cugcgccuuccgggcg

SEQ ID NO: 2365785 - RNA, 16 nt, Bordetella pertussis
cugcgccuuggcgcgc

SEQ ID NO: 2365786 - RNA, 18 nt, Bordetella pertussis
cugcgccuuggcgcgcag

SEQ ID NO: 2365787 - RNA, 19 nt, Bordetella pertussis
cugcgccuuggcgcgcaga

SEQ ID NO: 2365788 - RNA, 21 nt, Bordetella pertussis
cugcgcgaaacccccugggug

SEQ ID NO: 2365789 - RNA, 14 nt, Bordetella pertussis
cugcgcgaaacggc

SEQ ID NO: 2365790 - RNA, 16 nt, Bordetella pertussis
cugcgcgaaacggccg

SEQ ID NO: 2365791 - RNA, 19 nt, Bordetella pertussis
cugcgcgaaacggccgggu

SEQ ID NO: 2365792 - RNA, 21 nt, Bordetella pertussis
cugcgcgaaacggccgggucc

SEQ ID NO: 2365793 - RNA, 15 nt, Bordetella pertussis
cugcgcgaccgccgc

SEQ ID NO: 2365794 - RNA, 21 nt, Bordetella pertussis
cugcgcgaccuccaguaucgu

SEQ ID NO: 2365795 - RNA, 22 nt, Bordetella pertussis
cugcgcgaggaccaauaccuga

SEQ ID NO: 2365796 - RNA, 21 nt, Bordetella pertussis
cugcgcgaggugggcggcagc

SEQ ID NO: 2365797 - RNA, 21 nt, Bordetella pertussis
cugcgcgaugagcuggcgcag

SEQ ID NO: 2365798 - RNA, 17 nt, Bordetella pertussis
cugcgcgaugcgcgcgu

SEQ ID NO: 2365799 - RNA, 18 nt, Bordetella pertussis
cugcgcgcccgugucggu

SEQ ID NO: 2365800 - RNA, 11 nt, Bordetella pertussis
cugcgcgccga

SEQ ID NO: 2365801 - RNA, 15 nt, Bordetella pertussis
cugcgcgccgccggu

SEQ ID NO: 2365802 - RNA, 16 nt, Bordetella pertussis
cugcgcgccgccucga

SEQ ID NO: 2365803 - RNA, 17 nt, Bordetella pertussis
cugcgcgccgccucgau

SEQ ID NO: 2365804 - RNA, 11 nt, Bordetella pertussis
cugcgcgccgg

SEQ ID NO: 2365805 - RNA, 16 nt, Bordetella pertussis
cugcgcgccggcaugg

SEQ ID NO: 2365806 - RNA, 13 nt, Bordetella pertussis
cugcgcgccggcg

SEQ ID NO: 2365807 - RNA, 22 nt, Bordetella pertussis
cugcgcgccggcgccuuggccu

SEQ ID NO: 2365808 - RNA, 12 nt, Bordetella pertussis
cugcgcgccggg

SEQ ID NO: 2365809 - RNA, 19 nt, Bordetella pertussis
cugcgcgccuggcacgacg

SEQ ID NO: 2365810 - RNA, 12 nt, Bordetella pertussis
cugcgcgcgcag

SEQ ID NO: 2365811 - RNA, 12 nt, Bordetella pertussis
cugcgcgcgcca

SEQ ID NO: 2365812 - RNA, 14 nt, Bordetella pertussis
cugcgcgcgccagc

SEQ ID NO: 2365813 - RNA, 18 nt, Bordetella pertussis
cugcgcgcgccagcgccu

SEQ ID NO: 2365814 - RNA, 20 nt, Bordetella pertussis
cugcgcgcgcuggggcagca

SEQ ID NO: 2365815 - RNA, 15 nt, Bordetella pertussis
cugcgcgcggccugg

SEQ ID NO: 2365816 - RNA, 16 nt, Bordetella pertussis
cugcgcgcggccuggc

SEQ ID NO: 2365817 - RNA, 20 nt, Bordetella pertussis
cugcgcgcgguguucgagcc

SEQ ID NO: 2365818 - RNA, 19 nt, Bordetella pertussis
cugcgcggccgagcgggcc

SEQ ID NO: 2365819 - RNA, 22 nt, Bordetella pertussis
cugcgcggccucguaggccauc

SEQ ID NO: 2365820 - RNA, 13 nt, Bordetella pertussis
cugcgcggcggcu

SEQ ID NO: 2365821 - RNA, 22 nt, Bordetella pertussis
cugcgcggcggcuugccgucga

SEQ ID NO: 2365822 - RNA, 21 nt, Bordetella pertussis
cugcgcggcgggccccgcagg

SEQ ID NO: 2365823 - RNA, 12 nt, Bordetella pertussis
cugcgcggcggu

SEQ ID NO: 2365824 - RNA, 20 nt, Bordetella pertussis
cugcgcggcuuuuucucggc

SEQ ID NO: 2365825 - RNA, 18 nt, Bordetella pertussis
cugcgcggguccggcgug

SEQ ID NO: 2365826 - RNA, 21 nt, Bordetella pertussis
cugcgcguacguggcgcggcu

SEQ ID NO: 2365827 - RNA, 14 nt, Bordetella pertussis
cugcgcguccuggc

SEQ ID NO: 2365828 - RNA, 17 nt, Bordetella pertussis
cugcgcgucgacagcau

SEQ ID NO: 2365829 - RNA, 22 nt, Bordetella pertussis
cugcgcguugagcagcaugugc

SEQ ID NO: 2365830 - RNA, 19 nt, Bordetella pertussis
cugcgcuaugggggcgagc

SEQ ID NO: 2365831 - RNA, 22 nt, Bordetella pertussis
cugcgcugcucguccacggccu

SEQ ID NO: 2365832 - RNA, 17 nt, Bordetella pertussis
cugcgcuugaccgccuc

SEQ ID NO: 2365833 - RNA, 20 nt, Bordetella pertussis
cugcgcuugaccgccucgau

SEQ ID NO: 2365834 - RNA, 13 nt, Bordetella pertussis
cugcggaaacaga

SEQ ID NO: 2365835 - RNA, 23 nt, Bordetella pertussis
cugcggacccaguucggccgcca

SEQ ID NO: 2365836 - RNA, 15 nt, Bordetella pertussis
cugcggacggcgggc

SEQ ID NO: 2365837 - RNA, 16 nt, Bordetella pertussis
cugcggcaccucggcc

SEQ ID NO: 2365838 - RNA, 21 nt, Bordetella pertussis
cugcggcacgaucggcgccug

SEQ ID NO: 2365839 - RNA, 22 nt, Bordetella pertussis
cugcggcacgaucggcgccugg

SEQ ID NO: 2365840 - RNA, 17 nt, Bordetella pertussis
cugcggcacggccagcg

SEQ ID NO: 2365841 - RNA, 14 nt, Bordetella pertussis
cugcggcagcgacu

SEQ ID NO: 2365842 - RNA, 14 nt, Bordetella pertussis
cugcggcaggccgc

SEQ ID NO: 2365843 - RNA, 13 nt, Bordetella pertussis
cugcggccccggc

SEQ ID NO: 2365844 - RNA, 15 nt, Bordetella pertussis
cugcggcccgagcca

SEQ ID NO: 2365845 - RNA, 21 nt, Bordetella pertussis
cugcggcgauuucuacgccga

SEQ ID NO: 2365846 - RNA, 12 nt, Bordetella pertussis
cugcggcgccag

SEQ ID NO: 2365847 - RNA, 15 nt, Bordetella pertussis
cugcggcgccagcgc

SEQ ID NO: 2365848 - RNA, 17 nt, Bordetella pertussis
cugcggcgccagcgccg

SEQ ID NO: 2365849 - RNA, 15 nt, Bordetella pertussis
cugcggcgccugggc

SEQ ID NO: 2365850 - RNA, 20 nt, Bordetella pertussis
cugcggcgccugggccuucu

SEQ ID NO: 2365851 - RNA, 12 nt, Bordetella pertussis
cugcggcgcggc

SEQ ID NO: 2365852 - RNA, 15 nt, Bordetella pertussis
cugcggcgcggccag

SEQ ID NO: 2365853 - RNA, 17 nt, Bordetella pertussis
cugcggcgcggccagca

SEQ ID NO: 2365854 - RNA, 15 nt, Bordetella pertussis
cugcggcgcggccga

SEQ ID NO: 2365855 - RNA, 16 nt, Bordetella pertussis
cugcggcgcggccgac

SEQ ID NO: 2365856 - RNA, 17 nt, Bordetella pertussis
cugcggcgcggccgacg

SEQ ID NO: 2365857 - RNA, 13 nt, Bordetella pertussis
cugcggcgcggcg

SEQ ID NO: 2365858 - RNA, 23 nt, Bordetella pertussis
cugcggcgcggcgcgugccagca

SEQ ID NO: 2365859 - RNA, 18 nt, Bordetella pertussis
cugcggcgcggugucgga

SEQ ID NO: 2365860 - RNA, 23 nt, Bordetella pertussis
cugcggcgcggugucggacaacu

SEQ ID NO: 2365861 - RNA, 14 nt, Bordetella pertussis
cugcggcguggcgu

SEQ ID NO: 2365862 - RNA, 15 nt, Bordetella pertussis
cugcggcuccugcug

SEQ ID NO: 2365863 - RNA, 19 nt, Bordetella pertussis
cugcggcuccugcuggcgc

SEQ ID NO: 2365864 - RNA, 18 nt, Bordetella pertussis
cugcggcucgaggaacca

SEQ ID NO: 2365865 - RNA, 19 nt, Bordetella pertussis
cugcggcuugggcccggcg

SEQ ID NO: 2365866 - RNA, 21 nt, Bordetella pertussis
cugcggcuugggcccggcgua

SEQ ID NO: 2365867 - RNA, 15 nt, Bordetella pertussis
cugcgggccgcacag

SEQ ID NO: 2365868 - RNA, 14 nt, Bordetella pertussis
cugcgggccggcgc

SEQ ID NO: 2365869 - RNA, 16 nt, Bordetella pertussis
cugcgggccggcgccg

SEQ ID NO: 2365870 - RNA, 17 nt, Bordetella pertussis
cugcgggccggcgccgg

SEQ ID NO: 2365871 - RNA, 22 nt, Bordetella pertussis
cugcgggccgggcaggccgcgc

SEQ ID NO: 2365872 - RNA, 19 nt, Bordetella pertussis
cugcgggcgcaagccagca

SEQ ID NO: 2365873 - RNA, 17 nt, Bordetella pertussis
cugcgggcgcagcgccg

SEQ ID NO: 2365874 - RNA, 16 nt, Bordetella pertussis
cugcggggacaggcac

SEQ ID NO: 2365875 - RNA, 17 nt, Bordetella pertussis
cugcggggacaggcacc

SEQ ID NO: 2365876 - RNA, 21 nt, Bordetella pertussis
cugcggggacaggcacccggg

SEQ ID NO: 2365877 - RNA, 15 nt, Bordetella pertussis
cugcgggggcaggca

SEQ ID NO: 2365878 - RNA, 16 nt, Bordetella pertussis
cugcgggggcaggcac

SEQ ID NO: 2365879 - RNA, 18 nt, Bordetella pertussis
cugcgggggcaggcacgc

SEQ ID NO: 2365880 - RNA, 13 nt, Bordetella pertussis
cugcggugccugu

SEQ ID NO: 2365881 - RNA, 14 nt, Bordetella pertussis
cugcguaggcaggg

SEQ ID NO: 2365882 - RNA, 18 nt, Bordetella pertussis
cugcgucacgaaagcgcc

SEQ ID NO: 2365883 - RNA, 22 nt, Bordetella pertussis
cugcgucacgaaagcgcccagg

SEQ ID NO: 2365884 - RNA, 18 nt, Bordetella pertussis
cugcguccaccaccaggc

SEQ ID NO: 2365885 - RNA, 24 nt, Bordetella pertussis
cugcguccaccaccaggccggcca

SEQ ID NO: 2365886 - RNA, 22 nt, Bordetella pertussis
cugcguccuugaggaacuggac

SEQ ID NO: 2365887 - RNA, 17 nt, Bordetella pertussis
cugcgucgccuggucga

SEQ ID NO: 2365888 - RNA, 18 nt, Bordetella pertussis
cugcgucugcgugccgga

SEQ ID NO: 2365889 - RNA, 12 nt, Bordetella pertussis
cugcgugcgcgg

SEQ ID NO: 2365890 - RNA, 13 nt, Bordetella pertussis
cugcgugcgcggc

SEQ ID NO: 2365891 - RNA, 15 nt, Bordetella pertussis
cugcgugcgcggcgu

SEQ ID NO: 2365892 - RNA, 16 nt, Bordetella pertussis
cugcgugcgcggcgug

SEQ ID NO: 2365893 - RNA, 17 nt, Bordetella pertussis
cugcgugcgcggcgugu

SEQ ID NO: 2365894 - RNA, 15 nt, Bordetella pertussis
cugcgugcgggacag

SEQ ID NO: 2365895 - RNA, 16 nt, Bordetella pertussis
cugcguggcggcgucg

SEQ ID NO: 2365896 - RNA, 16 nt, Bordetella pertussis
cugcguggcgggccgc

SEQ ID NO: 2365897 - RNA, 21 nt, Bordetella pertussis
cugcguggcgggccgcgccgc

SEQ ID NO: 2365898 - RNA, 17 nt, Bordetella pertussis
cugcgugguauuggugg

SEQ ID NO: 2365899 - RNA, 14 nt, Bordetella pertussis
cugcgugugccgcc

SEQ ID NO: 2365900 - RNA, 22 nt, Bordetella pertussis
cugcuacaccgugcuggccgac

SEQ ID NO: 2365901 - RNA, 22 nt, Bordetella pertussis
cugcuaguacaccgucgcgcgc

SEQ ID NO: 2365902 - RNA, 20 nt, Bordetella pertussis
cugcuaugccguggacgugc

SEQ ID NO: 2365903 - RNA, 14 nt, Bordetella pertussis
cugcucaacggcca

SEQ ID NO: 2365904 - RNA, 17 nt, Bordetella pertussis
cugcucaacggccacca

SEQ ID NO: 2365905 - RNA, 13 nt, Bordetella pertussis
cugcuugagcacc

SEQ ID NO: 2365906 - RNA, 22 nt, Bordetella pertussis
cugcuugagcgaaauggcggcc

SEQ ID NO: 2365907 - RNA, 15 nt, Bordetella pertussis
cugcuugaggccgcg

SEQ ID NO: 2365908 - RNA, 18 nt, Bordetella pertussis
cugcuugaggccgcgcgc

SEQ ID NO: 2365909 - RNA, 23 nt, Bordetella pertussis
cugcuugaggccgcgcgccucga

SEQ ID NO: 2365910 - RNA, 13 nt, Bordetella pertussis
cugcuugcccagc

SEQ ID NO: 2365911 - RNA, 14 nt, Bordetella pertussis
cugcuugcccagca

SEQ ID NO: 2365912 - RNA, 14 nt, Bordetella pertussis
cugcuugcccagcg

SEQ ID NO: 2365913 - RNA, 18 nt, Bordetella pertussis
cugcuugcccaggccggc

SEQ ID NO: 2365914 - RNA, 19 nt, Bordetella pertussis
cugcuugcccaggccggcg

SEQ ID NO: 2365915 - RNA, 20 nt, Bordetella pertussis
cugcuugcccaggccggcgc

SEQ ID NO: 2365916 - RNA, 16 nt, Bordetella pertussis
cugcuuggcgcgcagc

SEQ ID NO: 2365917 - RNA, 17 nt, Bordetella pertussis
cuggaacaccaugcccg

SEQ ID NO: 2365918 - RNA, 13 nt, Bordetella pertussis
cuggaacauggcc

SEQ ID NO: 2365919 - RNA, 17 nt, Bordetella pertussis
cuggaacauggcccggu

SEQ ID NO: 2365920 - RNA, 14 nt, Bordetella pertussis
cuggaacggugcga

SEQ ID NO: 2365921 - RNA, 22 nt, Bordetella pertussis
cuggaagaacaccguuuccaag

SEQ ID NO: 2365922 - RNA, 18 nt, Bordetella pertussis
cuggaagacguggcccgc

SEQ ID NO: 2365923 - RNA, 20 nt, Bordetella pertussis
cuggaagauguaccagccca

SEQ ID NO: 2365924 - RNA, 13 nt, Bordetella pertussis
cuggaagcgcgcc

SEQ ID NO: 2365925 - RNA, 14 nt, Bordetella pertussis
cuggaagcgcgcca

SEQ ID NO: 2365926 - RNA, 16 nt, Bordetella pertussis
cuggaagcgcgccagg

SEQ ID NO: 2365927 - RNA, 21 nt, Bordetella pertussis
cuggaagcgcgccaggcgcau

SEQ ID NO: 2365928 - RNA, 16 nt, Bordetella pertussis
cuggaagcugcggccg

SEQ ID NO: 2365929 - RNA, 17 nt, Bordetella pertussis
cuggaagcugcggccgg

SEQ ID NO: 2365930 - RNA, 16 nt, Bordetella pertussis
cuggaagugaugccgc

SEQ ID NO: 2365931 - RNA, 22 nt, Bordetella pertussis
cuggaagugaugccgccggcgg

SEQ ID NO: 2365932 - RNA, 18 nt, Bordetella pertussis
cuggaauacgccguugcg

SEQ ID NO: 2365933 - RNA, 13 nt, Bordetella pertussis
cuggaaugucacc

SEQ ID NO: 2365934 - RNA, 16 nt, Bordetella pertussis
cuggacccgcucgacc

SEQ ID NO: 2365935 - RNA, 16 nt, Bordetella pertussis
cuggacccggagcugc

SEQ ID NO: 2365936 - RNA, 14 nt, Bordetella pertussis
cuggaccgcgccug

SEQ ID NO: 2365937 - RNA, 17 nt, Bordetella pertussis
cuggaccgcgccugggg

SEQ ID NO: 2365938 - RNA, 18 nt, Bordetella pertussis
cuggaccgcgcgcgacga

SEQ ID NO: 2365939 - RNA, 22 nt, Bordetella pertussis
cuggaccgcgcgcgacgacagc

SEQ ID NO: 2365940 - RNA, 23 nt, Bordetella pertussis
cuggaccgcgcgcgacgacagcg

SEQ ID NO: 2365941 - RNA, 17 nt, Bordetella pertussis
cuggaccugagccaggc

SEQ ID NO: 2365942 - RNA, 20 nt, Bordetella pertussis
cuggaccugagccaggcgcc

SEQ ID NO: 2365943 - RNA, 13 nt, Bordetella pertussis
cuggaccuggacg

SEQ ID NO: 2365944 - RNA, 14 nt, Bordetella pertussis
cuggaccuggacga

SEQ ID NO: 2365945 - RNA, 15 nt, Bordetella pertussis
cuggaccuggacgag

SEQ ID NO: 2365946 - RNA, 16 nt, Bordetella pertussis
cuggacgcccuggcgc

SEQ ID NO: 2365947 - RNA, 20 nt, Bordetella pertussis
cuggacgcgccgaacaccag

SEQ ID NO: 2365948 - RNA, 11 nt, Bordetella pertussis
cuggacgcgcg

SEQ ID NO: 2365949 - RNA, 13 nt, Bordetella pertussis
cuggacgcgcgcg

SEQ ID NO: 2365950 - RNA, 16 nt, Bordetella pertussis
cuggacgcgcgcggcg

SEQ ID NO: 2365951 - RNA, 17 nt, Bordetella pertussis
cuggacgcgcgcggcga

SEQ ID NO: 2365952 - RNA, 20 nt, Bordetella pertussis
cuggacgcuuucggggcgca

SEQ ID NO: 2365953 - RNA, 21 nt, Bordetella pertussis
cuggacgcuuucggggcgcaa

SEQ ID NO: 2365954 - RNA, 18 nt, Bordetella pertussis
cuggacguaguugguggc

SEQ ID NO: 2365955 - RNA, 19 nt, Bordetella pertussis
cuggacgucugagcgccgg

SEQ ID NO: 2365956 - RNA, 20 nt, Bordetella pertussis
cuggacuguccggcaacacc

SEQ ID NO: 2365957 - RNA, 14 nt, Bordetella pertussis
cuggacuugcggca

SEQ ID NO: 2365958 - RNA, 23 nt, Bordetella pertussis
cuggagaacgagccggccgcgcc

SEQ ID NO: 2365959 - RNA, 18 nt, Bordetella pertussis
cuggagaucgccgagcgg

SEQ ID NO: 2365960 - RNA, 20 nt, Bordetella pertussis
cuggagaucgccgccgaagc

SEQ ID NO: 2365961 - RNA, 12 nt, Bordetella pertussis
cuggagaugggu

SEQ ID NO: 2365962 - RNA, 23 nt, Bordetella pertussis
cuggagauggguacagcgcgccc

SEQ ID NO: 2365963 - RNA, 17 nt, Bordetella pertussis
cuggagcgccacgccgu

SEQ ID NO: 2365964 - RNA, 18 nt, Bordetella pertussis
cuggagcgcggcggcgug

SEQ ID NO: 2365965 - RNA, 16 nt, Bordetella pertussis
cuggagcggccuggcc

SEQ ID NO: 2365966 - RNA, 20 nt, Bordetella pertussis
cuggagcggccuggccccgc

SEQ ID NO: 2365967 - RNA, 17 nt, Bordetella pertussis
cuggagcucgggugggc

SEQ ID NO: 2365968 - RNA, 21 nt, Bordetella pertussis
cuggagcucgggugggccggc

SEQ ID NO: 2365969 - RNA, 15 nt, Bordetella pertussis
cuggagcucuauguc

SEQ ID NO: 2365970 - RNA, 16 nt, Bordetella pertussis
cuggagcuuggccggu

SEQ ID NO: 2365971 - RNA, 11 nt, Bordetella pertussis
cuggaggccgg

SEQ ID NO: 2365972 - RNA, 22 nt, Bordetella pertussis
cuggauauccacgccuucggcg

SEQ ID NO: 2365973 - RNA, 16 nt, Bordetella pertussis
cuggauauggcgccgc

SEQ ID NO: 2365974 - RNA, 17 nt, Bordetella pertussis
cuggaucaccgccggcg

SEQ ID NO: 2365975 - RNA, 15 nt, Bordetella pertussis
cuggaucaggauggg

SEQ ID NO: 2365976 - RNA, 19 nt, Bordetella pertussis
cuggaucaggaugggcgcg

SEQ ID NO: 2365977 - RNA, 17 nt, Bordetella pertussis
cuggauccggcgcuggc

SEQ ID NO: 2365978 - RNA, 13 nt, Bordetella pertussis
cuggaucgcgccc

SEQ ID NO: 2365979 - RNA, 16 nt, Bordetella pertussis
cuggaucgcgcccagc

SEQ ID NO: 2365980 - RNA, 17 nt, Bordetella pertussis
cuggaucgcgcccagcg

SEQ ID NO: 2365981 - RNA, 16 nt, Bordetella pertussis
cuggaucuuggccugu

SEQ ID NO: 2365982 - RNA, 20 nt, Bordetella pertussis
cuggaugccaugccgggcaa

SEQ ID NO: 2365983 - RNA, 21 nt, Bordetella pertussis
cuggaugccaugccgggcaag

SEQ ID NO: 2365984 - RNA, 14 nt, Bordetella pertussis
cuggauggccugcu

SEQ ID NO: 2365985 - RNA, 15 nt, Bordetella pertussis
cuggauggccugcuc

SEQ ID NO: 2365986 - RNA, 20 nt, Bordetella pertussis
cuggauggccugcucgccca

SEQ ID NO: 2365987 - RNA, 16 nt, Bordetella pertussis
cuggauggccugggug

SEQ ID NO: 2365988 - RNA, 18 nt, Bordetella pertussis
cuggauggccuggguggc

SEQ ID NO: 2365989 - RNA, 20 nt, Bordetella pertussis
cuggauggccuggguggccu

SEQ ID NO: 2365990 - RNA, 21 nt, Bordetella pertussis
cuggauggccuggguggccug

SEQ ID NO: 2365991 - RNA, 17 nt, Bordetella pertussis
cuggauggcggccgcca

SEQ ID NO: 2365992 - RNA, 22 nt, Bordetella pertussis
cuggauggcucgggcagcagca

SEQ ID NO: 2365993 - RNA, 19 nt, Bordetella pertussis
cuggauggucacgcccagg

SEQ ID NO: 2365994 - RNA, 18 nt, Bordetella pertussis
cuggauggugccgccgcc

SEQ ID NO: 2365995 - RNA, 21 nt, Bordetella pertussis
cuggauggugccgccgcccga

SEQ ID NO: 2365996 - RNA, 21 nt, Bordetella pertussis
cuggauguacgucagcaugca

SEQ ID NO: 2365997 - RNA, 15 nt, Bordetella pertussis
cuggaugugcaggcc

SEQ ID NO: 2365998 - RNA, 20 nt, Bordetella pertussis
cuggcaaugcguggccggcg

SEQ ID NO: 2365999 - RNA, 21 nt, Bordetella pertussis
cuggcaaugcguggccggcgg

SEQ ID NO: 2366000 - RNA, 18 nt, Bordetella pertussis
cuggcaaugguccagcag

SEQ ID NO: 2366001 - RNA, 13 nt, Bordetella pertussis
cuggcacaccagc

SEQ ID NO: 2366002 - RNA, 13 nt, Bordetella pertussis
cuggcacaucggc

SEQ ID NO: 2366003 - RNA, 15 nt, Bordetella pertussis
cuggcacaucggccc

SEQ ID NO: 2366004 - RNA, 22 nt, Bordetella pertussis
cuggcacaucggcccuggcaag

SEQ ID NO: 2366005 - RNA, 18 nt, Bordetella pertussis
cuggcaccaauccccccc

SEQ ID NO: 2366006 - RNA, 12 nt, Bordetella pertussis
cuggcacccgca

SEQ ID NO: 2366007 - RNA, 14 nt, Bordetella pertussis
cuggcaccgcgacg

SEQ ID NO: 2366008 - RNA, 20 nt, Bordetella pertussis
cuggcaccgcgacgaccccg

SEQ ID NO: 2366009 - RNA, 16 nt, Bordetella pertussis
cuggcaccggccaagc

SEQ ID NO: 2366010 - RNA, 15 nt, Bordetella pertussis
cuggcaccggccgac

SEQ ID NO: 2366011 - RNA, 15 nt, Bordetella pertussis
cuggcaccugccgac

SEQ ID NO: 2366012 - RNA, 16 nt, Bordetella pertussis
cuggcaccugccgacu

SEQ ID NO: 2366013 - RNA, 14 nt, Bordetella pertussis
cuggcacgcgcuga

SEQ ID NO: 2366014 - RNA, 23 nt, Bordetella pertussis
cuggcagaccgagcgcgcccgcu

SEQ ID NO: 2366015 - RNA, 21 nt, Bordetella pertussis
cuggcagacguacuugaucug

SEQ ID NO: 2366016 - RNA, 16 nt, Bordetella pertussis
cuggcagaugcgcgcc

SEQ ID NO: 2366017 - RNA, 17 nt, Bordetella pertussis
cuggcagaugcgcgcca

SEQ ID NO: 2366018 - RNA, 22 nt, Bordetella pertussis
cuggccggcgcugggcaggcug

SEQ ID NO: 2366019 - RNA, 19 nt, Bordetella pertussis
cuggccggcguggccugcc

SEQ ID NO: 2366020 - RNA, 20 nt, Bordetella pertussis
cuggccggcuugcauggugc

SEQ ID NO: 2366021 - RNA, 20 nt, Bordetella pertussis
cuggccggggaagccgccgg

SEQ ID NO: 2366022 - RNA, 22 nt, Bordetella pertussis
cuggccggggaagccgccggcg

SEQ ID NO: 2366023 - RNA, 21 nt, Bordetella pertussis
cuggccggugaugcggcgcgc

SEQ ID NO: 2366024 - RNA, 18 nt, Bordetella pertussis
cuggccguacauggccag

SEQ ID NO: 2366025 - RNA, 13 nt, Bordetella pertussis
cuggccgucgccg

SEQ ID NO: 2366026 - RNA, 19 nt, Bordetella pertussis
cuggccgucgccgcccugc

SEQ ID NO: 2366027 - RNA, 23 nt, Bordetella pertussis
cuggccgucgccgcccugcugcc

SEQ ID NO: 2366028 - RNA, 16 nt, Bordetella pertussis
cuggccugccgcgccg

SEQ ID NO: 2366029 - RNA, 21 nt, Bordetella pertussis
cuggccugccgcgccgaccgg

SEQ ID NO: 2366030 - RNA, 15 nt, Bordetella pertussis
cuggccugcgccgcc

SEQ ID NO: 2366031 - RNA, 16 nt, Bordetella pertussis
cuggccugcgccgccg

SEQ ID NO: 2366032 - RNA, 18 nt, Bordetella pertussis
cuggccugcgccgccgcg

SEQ ID NO: 2366033 - RNA, 22 nt, Bordetella pertussis
cuggccugcgccgccgcgcgcu

SEQ ID NO: 2366034 - RNA, 14 nt, Bordetella pertussis
cuggccuggccgcc

SEQ ID NO: 2366035 - RNA, 15 nt, Bordetella pertussis
cuggccuggccgccg

SEQ ID NO: 2366036 - RNA, 16 nt, Bordetella pertussis
cuggccuggccgccgg

SEQ ID NO: 2366037 - RNA, 20 nt, Bordetella pertussis
cuggccugucugguggcgau

SEQ ID NO: 2366038 - RNA, 12 nt, Bordetella pertussis
cuggccuuccug

SEQ ID NO: 2366039 - RNA, 18 nt, Bordetella pertussis
cuggccuuccugcugaca

SEQ ID NO: 2366040 - RNA, 22 nt, Bordetella pertussis
cuggccuugauguauggcugca

SEQ ID NO: 2366041 - RNA, 23 nt, Bordetella pertussis
cuggccuugcgcuuuuuucucca

SEQ ID NO: 2366042 - RNA, 22 nt, Bordetella pertussis
cuggcgaacaguugcaccagug

SEQ ID NO: 2366043 - RNA, 20 nt, Bordetella pertussis
cuggcgaagaacaccgccgc

SEQ ID NO: 2366044 - RNA, 22 nt, Bordetella pertussis
cuggcgaagaacaccgccgcgc

SEQ ID NO: 2366045 - RNA, 15 nt, Bordetella pertussis
cuggcgaccggcggc

SEQ ID NO: 2366046 - RNA, 17 nt, Bordetella pertussis
cuggcgaggaccugacc

SEQ ID NO: 2366047 - RNA, 19 nt, Bordetella pertussis
cuggcgaucaccgacagcg

SEQ ID NO: 2366048 - RNA, 16 nt, Bordetella pertussis
cuggcgaucacggcca

SEQ ID NO: 2366049 - RNA, 15 nt, Bordetella pertussis
cuggcgaucaggccg

SEQ ID NO: 2366050 - RNA, 17 nt, Bordetella pertussis
cuggcgaucaggccgcc

SEQ ID NO: 2366051 - RNA, 19 nt, Bordetella pertussis
cuggcgaucaggccgcccc

SEQ ID NO: 2366052 - RNA, 14 nt, Bordetella pertussis
cuggcgaugcccac

SEQ ID NO: 2366053 - RNA, 18 nt, Bordetella pertussis
cuggcgaugcccaccagc

SEQ ID NO: 2366054 - RNA, 21 nt, Bordetella pertussis
cuggcgaugcccaccagccgc

SEQ ID NO: 2366055 - RNA, 18 nt, Bordetella pertussis
cuggcgaugcgggccacg

SEQ ID NO: 2366056 - RNA, 19 nt, Bordetella pertussis
cuggcgaugcgggccacgc

SEQ ID NO: 2366057 - RNA, 20 nt, Bordetella pertussis
cuggcgaugcgggccacgcc

SEQ ID NO: 2366058 - RNA, 15 nt, Bordetella pertussis
cuggcgauggccuga

SEQ ID NO: 2366059 - RNA, 14 nt, Bordetella pertussis
cuggcgauggugga

SEQ ID NO: 2366060 - RNA, 21 nt, Bordetella pertussis
cuggcgcaaggacgcguccuc

SEQ ID NO: 2366061 - RNA, 13 nt, Bordetella pertussis
cuggcgcaaggcg

SEQ ID NO: 2366062 - RNA, 16 nt, Bordetella pertussis
cuggcgcaaggcgucg

SEQ ID NO: 2366063 - RNA, 21 nt, Bordetella pertussis
cuggcgcaaggcgucgggcac

SEQ ID NO: 2366064 - RNA, 22 nt, Bordetella pertussis
cuggcgcaaggcgucgggcacg

SEQ ID NO: 2366065 - RNA, 18 nt, Bordetella pertussis
cuggcgcaccaggcuggg

SEQ ID NO: 2366066 - RNA, 19 nt, Bordetella pertussis
cuggcgcaccaggcugggg

SEQ ID NO: 2366067 - RNA, 14 nt, Bordetella pertussis
cuggcgcagcacgc

SEQ ID NO: 2366068 - RNA, 16 nt, Bordetella pertussis
cuggcgcagcacgccg

SEQ ID NO: 2366069 - RNA, 17 nt, Bordetella pertussis
cuggcgcagcacgccgc

SEQ ID NO: 2366070 - RNA, 20 nt, Bordetella pertussis
cuggcgcagcacgccgcgcc

SEQ ID NO: 2366071 - RNA, 12 nt, Bordetella pertussis
cuggcgcagcag

SEQ ID NO: 2366072 - RNA, 15 nt, Bordetella pertussis
cuggcgcagcagcgc

SEQ ID NO: 2366073 - RNA, 18 nt, Bordetella pertussis
cuggcgcagcagcgccgg

SEQ ID NO: 2366074 - RNA, 19 nt, Bordetella pertussis
cuggcgcagcagcgccggc

SEQ ID NO: 2366075 - RNA, 15 nt, Bordetella pertussis
cuggcgcagcaggcg

SEQ ID NO: 2366076 - RNA, 18 nt, Bordetella pertussis
cuggcgcagcaggcgcgc

SEQ ID NO: 2366077 - RNA, 21 nt, Bordetella pertussis
cuggcgcagcaggcgcgcggc

SEQ ID NO: 2366078 - RNA, 12 nt, Bordetella pertussis
cuggcgcagcau

SEQ ID NO: 2366079 - RNA, 15 nt, Bordetella pertussis
cuggcgcaggccggc

SEQ ID NO: 2366080 - RNA, 18 nt, Bordetella pertussis
cuggcgcaggccggcggc

SEQ ID NO: 2366081 - RNA, 12 nt, Bordetella pertussis
cuggcgcagggc

SEQ ID NO: 2366082 - RNA, 16 nt, Bordetella pertussis
cuggcgcagggcauac

SEQ ID NO: 2366083 - RNA, 17 nt, Bordetella pertussis
cuggcgcaguaucccgg

SEQ ID NO: 2366084 - RNA, 22 nt, Bordetella pertussis
cuggcgcaguaucccggccagg

SEQ ID NO: 2366085 - RNA, 16 nt, Bordetella pertussis
cuggcgcaugacggcg

SEQ ID NO: 2366086 - RNA, 13 nt, Bordetella pertussis
cuggcgcauggcc

SEQ ID NO: 2366087 - RNA, 18 nt, Bordetella pertussis
cuggcgcauggccggcgu

SEQ ID NO: 2366088 - RNA, 19 nt, Bordetella pertussis
cuggcgcauggccggcgug

SEQ ID NO: 2366089 - RNA, 18 nt, Bordetella pertussis
cuggcgccaacccgccau

SEQ ID NO: 2366090 - RNA, 22 nt, Bordetella pertussis
cuggcgccaacccgccauccug

SEQ ID NO: 2366091 - RNA, 13 nt, Bordetella pertussis
cuggcgccccuuc

SEQ ID NO: 2366092 - RNA, 21 nt, Bordetella pertussis
cuggcgccccuuccacccgca

SEQ ID NO: 2366093 - RNA, 19 nt, Bordetella pertussis
cuggcgcccgacggcgccg

SEQ ID NO: 2366094 - RNA, 17 nt, Bordetella pertussis
cuggcgcccgccugcgc

SEQ ID NO: 2366095 - RNA, 12 nt, Bordetella pertussis
cuggcgcccggc

SEQ ID NO: 2366096 - RNA, 13 nt, Bordetella pertussis
cuggcgcccggcg

SEQ ID NO: 2366097 - RNA, 20 nt, Bordetella pertussis
cuggcgcccggcggcgcgcu

SEQ ID NO: 2366098 - RNA, 16 nt, Bordetella pertussis
cuggcgccguucgucg

SEQ ID NO: 2366099 - RNA, 19 nt, Bordetella pertussis
cuggcgccguucgucgcgc

SEQ ID NO: 2366100 - RNA, 20 nt, Bordetella pertussis
cuggcgccguucgucgcgca

SEQ ID NO: 2366101 - RNA, 19 nt, Bordetella pertussis
cuggcgcgacgccugcgcc

SEQ ID NO: 2366102 - RNA, 21 nt, Bordetella pertussis
cuggcgcgagaaccaggccac

SEQ ID NO: 2366103 - RNA, 18 nt, Bordetella pertussis
cuggcgcgagaccacgau

SEQ ID NO: 2366104 - RNA, 17 nt, Bordetella pertussis
cuggcgcgaggcggcga

SEQ ID NO: 2366105 - RNA, 23 nt, Bordetella pertussis
cuggcgcgaggcggcgacgcagc

SEQ ID NO: 2366106 - RNA, 22 nt, Bordetella pertussis
cuggcgcgauagcgcuugccug

SEQ ID NO: 2366107 - RNA, 19 nt, Bordetella pertussis
cuggcgcgcaccaucgccg

SEQ ID NO: 2366108 - RNA, 20 nt, Bordetella pertussis
cuggcgcgcaccaucgccga

SEQ ID NO: 2366109 - RNA, 16 nt, Bordetella pertussis
cuggcgcgcaccaugg

SEQ ID NO: 2366110 - RNA, 15 nt, Bordetella pertussis
cuggcgcgcaucggc

SEQ ID NO: 2366111 - RNA, 17 nt, Bordetella pertussis
cuggcgcgcaucggcgc

SEQ ID NO: 2366112 - RNA, 20 nt, Bordetella pertussis
cuggcgcgcaucggcgccga

SEQ ID NO: 2366113 - RNA, 16 nt, Bordetella pertussis
cuggcgcgccaggcga

SEQ ID NO: 2366114 - RNA, 14 nt, Bordetella pertussis
cuggcgcgcccacu

SEQ ID NO: 2366115 - RNA, 20 nt, Bordetella pertussis
cuggcgcgccgccucgcgcu

SEQ ID NO: 2366116 - RNA, 14 nt, Bordetella pertussis
cuggcgcgcgacca

SEQ ID NO: 2366117 - RNA, 16 nt, Bordetella pertussis
cuggcgcgcgaccagg

SEQ ID NO: 2366118 - RNA, 17 nt, Bordetella pertussis
cuggcgcgcgaccaggc

SEQ ID NO: 2366119 - RNA, 19 nt, Bordetella pertussis
cuggcgcgcgaccaggcug

SEQ ID NO: 2366120 - RNA, 15 nt, Bordetella pertussis
cuggcgcgcgacggc

SEQ ID NO: 2366121 - RNA, 17 nt, Bordetella pertussis
cuggcgcgcgacggcgc

SEQ ID NO: 2366122 - RNA, 17 nt, Bordetella pertussis
cuggcgcgcgcaagccg

SEQ ID NO: 2366123 - RNA, 13 nt, Bordetella pertussis
cuggcgcgcggcc

SEQ ID NO: 2366124 - RNA, 19 nt, Bordetella pertussis
cuggcgcgcggccgcgucg

SEQ ID NO: 2366125 - RNA, 21 nt, Bordetella pertussis
cuggcgcgcggccugggcggc

SEQ ID NO: 2366126 - RNA, 16 nt, Bordetella pertussis
cuggcgcgcggcuggc

SEQ ID NO: 2366127 - RNA, 22 nt, Bordetella pertussis
cuggcgcgcguugaccgccucg

SEQ ID NO: 2366128 - RNA, 11 nt, Bordetella pertussis
cuggcgcggcg

SEQ ID NO: 2366129 - RNA, 23 nt, Bordetella pertussis
cuggcgcggcgccugcgcgcgcu

SEQ ID NO: 2366130 - RNA, 21 nt, Bordetella pertussis
cuggcuucgucgccggcguug

SEQ ID NO: 2366131 - RNA, 15 nt, Bordetella pertussis
cuggcuucguuggug

SEQ ID NO: 2366132 - RNA, 22 nt, Bordetella pertussis
cuggcuucguuggugucggcgg

SEQ ID NO: 2366133 - RNA, 12 nt, Bordetella pertussis
cuggcuuggccg

SEQ ID NO: 2366134 - RNA, 16 nt, Bordetella pertussis
cuggcuuucgccgcgg

SEQ ID NO: 2366135 - RNA, 18 nt, Bordetella pertussis
cuggcuuucgccgcgggc

SEQ ID NO: 2366136 - RNA, 23 nt, Bordetella pertussis
cuggcuuucgccgcgggccugcu

SEQ ID NO: 2366137 - RNA, 15 nt, Bordetella pertussis
cugggacaggcacac

SEQ ID NO: 2366138 - RNA, 16 nt, Bordetella pertussis
cugggacaggcacacc

SEQ ID NO: 2366139 - RNA, 17 nt, Bordetella pertussis
cugggacaggcacaccg

SEQ ID NO: 2366140 - RNA, 16 nt, Bordetella pertussis
cugggacaggcccagc

SEQ ID NO: 2366141 - RNA, 16 nt, Bordetella pertussis
cugggagagccggcca

SEQ ID NO: 2366142 - RNA, 19 nt, Bordetella pertussis
cugggagcgcgggccgccg

SEQ ID NO: 2366143 - RNA, 16 nt, Bordetella pertussis
cugggauggguacgcc

SEQ ID NO: 2366144 - RNA, 17 nt, Bordetella pertussis
cugggauuccugggugc

SEQ ID NO: 2366145 - RNA, 22 nt, Bordetella pertussis
cugggcacauccagcgccagca

SEQ ID NO: 2366146 - RNA, 16 nt, Bordetella pertussis
cugggcaucaacacgc

SEQ ID NO: 2366147 - RNA, 19 nt, Bordetella pertussis
cugggcaucaacacgcugg

SEQ ID NO: 2366148 - RNA, 15 nt, Bordetella pertussis
cugggcaugcacgau

SEQ ID NO: 2366149 - RNA, 20 nt, Bordetella pertussis
cugggcaugggcggcccggc

SEQ ID NO: 2366150 - RNA, 16 nt, Bordetella pertussis
cugggccacagggcga

SEQ ID NO: 2366151 - RNA, 23 nt, Bordetella pertussis
cugggccacagggcgaaggccag

SEQ ID NO: 2366152 - RNA, 15 nt, Bordetella pertussis
cugggccaccuuggu

SEQ ID NO: 2366153 - RNA, 19 nt, Bordetella pertussis
cugggccagaccgcgcgca

SEQ ID NO: 2366154 - RNA, 14 nt, Bordetella pertussis
cugggccagcagcu

SEQ ID NO: 2366155 - RNA, 19 nt, Bordetella pertussis
cugggccagcagcuggcgc

SEQ ID NO: 2366156 - RNA, 19 nt, Bordetella pertussis
cugggccagcaggcucagc

SEQ ID NO: 2366157 - RNA, 17 nt, Bordetella pertussis
cugggccagcaucggca

SEQ ID NO: 2366158 - RNA, 16 nt, Bordetella pertussis
cugggccagccagcgc

SEQ ID NO: 2366159 - RNA, 14 nt, Bordetella pertussis
cugggccaggaccg

SEQ ID NO: 2366160 - RNA, 15 nt, Bordetella pertussis
cugggccaggccggc

SEQ ID NO: 2366161 - RNA, 17 nt, Bordetella pertussis
cugggccaggccggccu

SEQ ID NO: 2366162 - RNA, 23 nt, Bordetella pertussis
cugggccaggccggccuuggcca

SEQ ID NO: 2366163 - RNA, 23 nt, Bordetella pertussis
cugggccaugccguccugcugcg

SEQ ID NO: 2366164 - RNA, 22 nt, Bordetella pertussis
cugggccaugcguaucggcagc

SEQ ID NO: 2366165 - RNA, 15 nt, Bordetella pertussis
cugggccgccugcug

SEQ ID NO: 2366166 - RNA, 18 nt, Bordetella pertussis
cugggccgccugcugggc

SEQ ID NO: 2366167 - RNA, 21 nt, Bordetella pertussis
cugggccgccugcugggccgc

SEQ ID NO: 2366168 - RNA, 15 nt, Bordetella pertussis
cugggccggcgcgcg

SEQ ID NO: 2366169 - RNA, 19 nt, Bordetella pertussis
cugggccggcgcgcgcagg

SEQ ID NO: 2366170 - RNA, 14 nt, Bordetella pertussis
cugggccgggugau

SEQ ID NO: 2366171 - RNA, 21 nt, Bordetella pertussis
cugggccgucaugcgccgucc

SEQ ID NO: 2366172 - RNA, 14 nt, Bordetella pertussis
cugggccucggcca

SEQ ID NO: 2366173 - RNA, 21 nt, Bordetella pertussis
cugggccucggccagcugggc

SEQ ID NO: 2366174 - RNA, 17 nt, Bordetella pertussis
cugggccugcggcguca

SEQ ID NO: 2366175 - RNA, 22 nt, Bordetella pertussis
cugggccugcggcgucaggccg

SEQ ID NO: 2366176 - RNA, 19 nt, Bordetella pertussis
cugggccuguacuggaugu

SEQ ID NO: 2366177 - RNA, 17 nt, Bordetella pertussis
cugggcgaaacggccag

SEQ ID NO: 2366178 - RNA, 18 nt, Bordetella pertussis
cugggcgaaacggccagc

SEQ ID NO: 2366179 - RNA, 20 nt, Bordetella pertussis
cugggcgaaacggccagcgu

SEQ ID NO: 2366180 - RNA, 18 nt, Bordetella pertussis
cugggcgaauccaccggc

SEQ ID NO: 2366181 - RNA, 21 nt, Bordetella pertussis
cugggcgaauccaccggcgcg

SEQ ID NO: 2366182 - RNA, 22 nt, Bordetella pertussis
cugggcgaauccaccggcgcgc

SEQ ID NO: 2366183 - RNA, 23 nt, Bordetella pertussis
cugggcgaauccaccggcgcgcg

SEQ ID NO: 2366184 - RNA, 20 nt, Bordetella pertussis
cugggcgagguagggcgcgg

SEQ ID NO: 2366185 - RNA, 22 nt, Bordetella pertussis
cugggcgagguagggcgcggcc

SEQ ID NO: 2366186 - RNA, 23 nt, Bordetella pertussis
cugggcgaucuucagcaccagcu

SEQ ID NO: 2366187 - RNA, 14 nt, Bordetella pertussis
cugggcgccagcag

SEQ ID NO: 2366188 - RNA, 21 nt, Bordetella pertussis
cugggcgccagcagcacgucg

SEQ ID NO: 2366189 - RNA, 20 nt, Bordetella pertussis
cugggcgccaugcgcccggc

SEQ ID NO: 2366190 - RNA, 17 nt, Bordetella pertussis
cugggcgccggccagga

SEQ ID NO: 2366191 - RNA, 18 nt, Bordetella pertussis
cugggcgccggccaggau

SEQ ID NO: 2366192 - RNA, 13 nt, Bordetella pertussis
cugggcgccggcg

SEQ ID NO: 2366193 - RNA, 15 nt, Bordetella pertussis
cugggcgccggcggc

SEQ ID NO: 2366194 - RNA, 22 nt, Bordetella pertussis
cugggcgcgaugggccugccca

SEQ ID NO: 2366195 - RNA, 13 nt, Bordetella pertussis
cugggcgcgccgc

SEQ ID NO: 2366196 - RNA, 14 nt, Bordetella pertussis
cugggcgcgccgcu

SEQ ID NO: 2366197 - RNA, 22 nt, Bordetella pertussis
cugggcgcgccgcugcagcgcu

SEQ ID NO: 2366198 - RNA, 13 nt, Bordetella pertussis
cugggcgcgcgcc

SEQ ID NO: 2366199 - RNA, 14 nt, Bordetella pertussis
cugggcgcggcggu

SEQ ID NO: 2366200 - RNA, 18 nt, Bordetella pertussis
cugggcgcggcgguggcg

SEQ ID NO: 2366201 - RNA, 17 nt, Bordetella pertussis
cugggcgcgguccagca

SEQ ID NO: 2366202 - RNA, 22 nt, Bordetella pertussis
cugggcgcgguccagcaaggcg

SEQ ID NO: 2366203 - RNA, 12 nt, Bordetella pertussis
cugggcggccuu

SEQ ID NO: 2366204 - RNA, 16 nt, Bordetella pertussis
cugggcggccuuggcc

SEQ ID NO: 2366205 - RNA, 17 nt, Bordetella pertussis
cugggcggccuuggccg

SEQ ID NO: 2366206 - RNA, 20 nt, Bordetella pertussis
cugggcggccuuggccgcag

SEQ ID NO: 2366207 - RNA, 16 nt, Bordetella pertussis
cugggcggcgcagucg

SEQ ID NO: 2366208 - RNA, 15 nt, Bordetella pertussis
cugggcggcgcgcuc

SEQ ID NO: 2366209 - RNA, 12 nt, Bordetella pertussis
cugggcggcggc

SEQ ID NO: 2366210 - RNA, 13 nt, Bordetella pertussis
cugggcggcggcg

SEQ ID NO: 2366211 - RNA, 13 nt, Bordetella pertussis
cugggcggcgggc

SEQ ID NO: 2366212 - RNA, 19 nt, Bordetella pertussis
cugggcggcgugaccgcga

SEQ ID NO: 2366213 - RNA, 17 nt, Bordetella pertussis
cugggcgggccguugcg

SEQ ID NO: 2366214 - RNA, 15 nt, Bordetella pertussis
cugggcgucccaggc

SEQ ID NO: 2366215 - RNA, 22 nt, Bordetella pertussis
cugggcgucgaaggcggccggc

SEQ ID NO: 2366216 - RNA, 17 nt, Bordetella pertussis
cugggcgucguccugca

SEQ ID NO: 2366217 - RNA, 21 nt, Bordetella pertussis
cugggcgugaaaggccagcgg

SEQ ID NO: 2366218 - RNA, 22 nt, Bordetella pertussis
cugggcuguauagaugcgcggg

SEQ ID NO: 2366219 - RNA, 22 nt, Bordetella pertussis
cugggcuugccggugcucggcc

SEQ ID NO: 2366220 - RNA, 21 nt, Bordetella pertussis
cugggcuuuggcuuggcgaau

SEQ ID NO: 2366221 - RNA, 18 nt, Bordetella pertussis
cuggggaagcgcucgucg

SEQ ID NO: 2366222 - RNA, 14 nt, Bordetella pertussis
cuggggacgggcgc

SEQ ID NO: 2366223 - RNA, 13 nt, Bordetella pertussis
cuggggcagcagg

SEQ ID NO: 2366224 - RNA, 15 nt, Bordetella pertussis
cuggggcaggacgcc

SEQ ID NO: 2366225 - RNA, 19 nt, Bordetella pertussis
cuggggcaggacgccggcg

SEQ ID NO: 2366226 - RNA, 13 nt, Bordetella pertussis
cuggggcaggcac

SEQ ID NO: 2366227 - RNA, 17 nt, Bordetella pertussis
cuggggccgagcgugcc

SEQ ID NO: 2366228 - RNA, 20 nt, Bordetella pertussis
cuggggccgagcgugccggg

SEQ ID NO: 2366229 - RNA, 15 nt, Bordetella pertussis
cuggggccgcgcgcc

SEQ ID NO: 2366230 - RNA, 12 nt, Bordetella pertussis
cuggggccgcgg

SEQ ID NO: 2366231 - RNA, 16 nt, Bordetella pertussis
cuggggcgggcgcugc

SEQ ID NO: 2366232 - RNA, 22 nt, Bordetella pertussis
cuggggcgggcgcugcgcgaac

SEQ ID NO: 2366233 - RNA, 17 nt, Bordetella pertussis
cuggggcgggcgggcgc

SEQ ID NO: 2366234 - RNA, 18 nt, Bordetella pertussis
cuggggcgggcgggcgca

SEQ ID NO: 2366235 - RNA, 19 nt, Bordetella pertussis
cuggggcgggcgggcgcaa

SEQ ID NO: 2366236 - RNA, 14 nt, Bordetella pertussis
cuggggcugcuggg

SEQ ID NO: 2366237 - RNA, 16 nt, Bordetella pertussis
cuggggcugcugggcc

SEQ ID NO: 2366238 - RNA, 13 nt, Bordetella pertussis
cuggggcuggcau

SEQ ID NO: 2366239 - RNA, 17 nt, Bordetella pertussis
cugggggacuggcaccc

SEQ ID NO: 2366240 - RNA, 19 nt, Bordetella pertussis
cugggggacuggcacccgc

SEQ ID NO: 2366241 - RNA, 21 nt, Bordetella pertussis
cugggggacuggcacccgcaa

SEQ ID NO: 2366242 - RNA, 18 nt, Bordetella pertussis
cugggggcuggaggcgca

SEQ ID NO: 2366243 - RNA, 16 nt, Bordetella pertussis
cugguugaccgagccc

SEQ ID NO: 2366244 - RNA, 15 nt, Bordetella pertussis
cugguuggccacauc

SEQ ID NO: 2366245 - RNA, 16 nt, Bordetella pertussis
cugguuggccgccugg

SEQ ID NO: 2366246 - RNA, 22 nt, Bordetella pertussis
cugguuguccaccacccaggcc

SEQ ID NO: 2366247 - RNA, 23 nt, Bordetella pertussis
cugguuguccaccacccaggccc

SEQ ID NO: 2366248 - RNA, 17 nt, Bordetella pertussis
cugguuuuucgaagagc

SEQ ID NO: 2366249 - RNA, 12 nt, Bordetella pertussis
cuguaacaacac

SEQ ID NO: 2366250 - RNA, 20 nt, Bordetella pertussis
cuguaacaacacguacgacc

SEQ ID NO: 2366251 - RNA, 21 nt, Bordetella pertussis
cuguacaagcgcacgcugggc

SEQ ID NO: 2366252 - RNA, 13 nt, Bordetella pertussis
cuguaccagcaug

SEQ ID NO: 2366253 - RNA, 14 nt, Bordetella pertussis
cuguaccagcaugu

SEQ ID NO: 2366254 - RNA, 14 nt, Bordetella pertussis
cuguaccgccgggu

SEQ ID NO: 2366255 - RNA, 13 nt, Bordetella pertussis
cuguaccgcgcga

SEQ ID NO: 2366256 - RNA, 16 nt, Bordetella pertussis
cuguaccgguagcccg

SEQ ID NO: 2366257 - RNA, 13 nt, Bordetella pertussis
cuguaccuggcga

SEQ ID NO: 2366258 - RNA, 14 nt, Bordetella pertussis
cuguacggccggcu

SEQ ID NO: 2366259 - RNA, 13 nt, Bordetella pertussis
cuguagaggcgcg

SEQ ID NO: 2366260 - RNA, 22 nt, Bordetella pertussis
cuguagaggcgcggcucgccgg

SEQ ID NO: 2366261 - RNA, 16 nt, Bordetella pertussis
cuguagcgcagccccg

SEQ ID NO: 2366262 - RNA, 21 nt, Bordetella pertussis
cuguagcgguagccggcgugg

SEQ ID NO: 2366263 - RNA, 18 nt, Bordetella pertussis
cuguaggcgccggcgccg

SEQ ID NO: 2366264 - RNA, 22 nt, Bordetella pertussis
cuguaggcgccggcgccgggca

SEQ ID NO: 2366265 - RNA, 18 nt, Bordetella pertussis
cuguaucguugucgcgcc

SEQ ID NO: 2366266 - RNA, 20 nt, Bordetella pertussis
cuguaucguugucgcgccgc

SEQ ID NO: 2366267 - RNA, 15 nt, Bordetella pertussis
cuguaucugcgccgu

SEQ ID NO: 2366268 - RNA, 14 nt, Bordetella pertussis
cuguaucuggccug

SEQ ID NO: 2366269 - RNA, 16 nt, Bordetella pertussis
cuguaucuggccuguc

SEQ ID NO: 2366270 - RNA, 18 nt, Bordetella pertussis
cuguaugccguaggcgcc

SEQ ID NO: 2366271 - RNA, 16 nt, Bordetella pertussis
cugucaauagguugua

SEQ ID NO: 2366272 - RNA, 18 nt, Bordetella pertussis
cugucauacgccaugaac

SEQ ID NO: 2366273 - RNA, 17 nt, Bordetella pertussis
cuguccaagcgcguggc

SEQ ID NO: 2366274 - RNA, 18 nt, Bordetella pertussis
cuguccaagcgcguggcc

SEQ ID NO: 2366275 - RNA, 22 nt, Bordetella pertussis
cuguccaagcgcguggccauca

SEQ ID NO: 2366276 - RNA, 17 nt, Bordetella pertussis
cuguccaggccggggcc

SEQ ID NO: 2366277 - RNA, 18 nt, Bordetella pertussis
cuguccagucuggauggc

SEQ ID NO: 2366278 - RNA, 22 nt, Bordetella pertussis
cuguccauauauauagggccau

SEQ ID NO: 2366279 - RNA, 19 nt, Bordetella pertussis
cugucccaaccgggacagg

SEQ ID NO: 2366280 - RNA, 22 nt, Bordetella pertussis
cugucccaaccgggacaggcac

SEQ ID NO: 2366281 - RNA, 23 nt, Bordetella pertussis
cugucccaaccgggacaggcacc

SEQ ID NO: 2366282 - RNA, 16 nt, Bordetella pertussis
cugucccaauccgcga

SEQ ID NO: 2366283 - RNA, 19 nt, Bordetella pertussis
cugucccagcggggacagg

SEQ ID NO: 2366284 - RNA, 23 nt, Bordetella pertussis
cugucccagcggggacaggcacc

SEQ ID NO: 2366285 - RNA, 19 nt, Bordetella pertussis
cuguccccaccgggacagg

SEQ ID NO: 2366286 - RNA, 14 nt, Bordetella pertussis
cuguccccacgggg

SEQ ID NO: 2366287 - RNA, 20 nt, Bordetella pertussis
cuguccccacguggacaggc

SEQ ID NO: 2366288 - RNA, 15 nt, Bordetella pertussis
cuguccccacugggg

SEQ ID NO: 2366289 - RNA, 23 nt, Bordetella pertussis
cuguccccacugggggacuggca

SEQ ID NO: 2366290 - RNA, 18 nt, Bordetella pertussis
cuguccccgaaggggacu

SEQ ID NO: 2366291 - RNA, 16 nt, Bordetella pertussis
cuguccccgcacgggg

SEQ ID NO: 2366292 - RNA, 17 nt, Bordetella pertussis
cuguccccgcacgggga

SEQ ID NO: 2366293 - RNA, 21 nt, Bordetella pertussis
cuguccccgcacggggacagg

SEQ ID NO: 2366294 - RNA, 17 nt, Bordetella pertussis
cuguccccgcagggaca

SEQ ID NO: 2366295 - RNA, 19 nt, Bordetella pertussis
cuguccccgcagggacagg

SEQ ID NO: 2366296 - RNA, 19 nt, Bordetella pertussis
cuguccccgccgggacagg

SEQ ID NO: 2366297 - RNA, 23 nt, Bordetella pertussis
cuguccccgcggaggugucgccg

SEQ ID NO: 2366298 - RNA, 14 nt, Bordetella pertussis
cuguccccgcgggg

SEQ ID NO: 2366299 - RNA, 20 nt, Bordetella pertussis
cuguccccgcggggacaggc

SEQ ID NO: 2366300 - RNA, 22 nt, Bordetella pertussis
cuguccccgcggggacaggcac

SEQ ID NO: 2366301 - RNA, 23 nt, Bordetella pertussis
cuguccccgcggggacuggcucc

SEQ ID NO: 2366302 - RNA, 16 nt, Bordetella pertussis
cuguccccgcugcggc

SEQ ID NO: 2366303 - RNA, 20 nt, Bordetella pertussis
cuguccccgcugcggcaagg

SEQ ID NO: 2366304 - RNA, 14 nt, Bordetella pertussis
cuguccccgcuggg

SEQ ID NO: 2366305 - RNA, 19 nt, Bordetella pertussis
cuguccccgcugggacagg

SEQ ID NO: 2366306 - RNA, 19 nt, Bordetella pertussis
cuguccccgucgggacagg

SEQ ID NO: 2366307 - RNA, 16 nt, Bordetella pertussis
cuguccccguggggac

SEQ ID NO: 2366308 - RNA, 17 nt, Bordetella pertussis
cuguccccguggggaca

SEQ ID NO: 2366309 - RNA, 23 nt, Bordetella pertussis
cuguccccguggggacagauacc

SEQ ID NO: 2366310 - RNA, 20 nt, Bordetella pertussis
cuguccccguggggacaggc

SEQ ID NO: 2366311 - RNA, 15 nt, Bordetella pertussis
cugucccgacgggga

SEQ ID NO: 2366312 - RNA, 17 nt, Bordetella pertussis
cugucccgacggggaca

SEQ ID NO: 2366313 - RNA, 19 nt, Bordetella pertussis
cugucccgacggggacagg

SEQ ID NO: 2366314 - RNA, 20 nt, Bordetella pertussis
cugucccgacggggacaggc

SEQ ID NO: 2366315 - RNA, 17 nt, Bordetella pertussis
cugucccgcacgcagcc

SEQ ID NO: 2366316 - RNA, 17 nt, Bordetella pertussis
cugucccggcggggaca

SEQ ID NO: 2366317 - RNA, 18 nt, Bordetella pertussis
cugucccggcggggacag

SEQ ID NO: 2366318 - RNA, 22 nt, Bordetella pertussis
cugucccggcggggacaggcgc

SEQ ID NO: 2366319 - RNA, 23 nt, Bordetella pertussis
cugucccggcggggacaggcgcc

SEQ ID NO: 2366320 - RNA, 19 nt, Bordetella pertussis
cugucccggcugggacagg

SEQ ID NO: 2366321 - RNA, 19 nt, Bordetella pertussis
cugucccugccgggacagg

SEQ ID NO: 2366322 - RNA, 23 nt, Bordetella pertussis
cugucccugccgggacaggcacc

SEQ ID NO: 2366323 - RNA, 13 nt, Bordetella pertussis
cuguccggcgcuc

SEQ ID NO: 2366324 - RNA, 16 nt, Bordetella pertussis
cuguccggcgcuggcu

SEQ ID NO: 2366325 - RNA, 17 nt, Bordetella pertussis
cuguccggcgcuggcuu

SEQ ID NO: 2366326 - RNA, 20 nt, Bordetella pertussis
cuguccgucucgguggagga

SEQ ID NO: 2366327 - RNA, 16 nt, Bordetella pertussis
cuguccuucguggcgc

SEQ ID NO: 2366328 - RNA, 22 nt, Bordetella pertussis
cugucgaccggaaucaccgccg

SEQ ID NO: 2366329 - RNA, 15 nt, Bordetella pertussis
cugucgaccucgucg

SEQ ID NO: 2366330 - RNA, 24 nt, Bordetella pertussis
cugucgagguaagugggcugcggc

SEQ ID NO: 2366331 - RNA, 13 nt, Bordetella pertussis
cugucgcaggcgc

SEQ ID NO: 2366332 - RNA, 19 nt, Bordetella pertussis
cugucgcaguagcguugca

SEQ ID NO: 2366333 - RNA, 19 nt, Bordetella pertussis
cugucgcagucggggccgc

SEQ ID NO: 2366334 - RNA, 14 nt, Bordetella pertussis
cugucgccacgggc

SEQ ID NO: 2366335 - RNA, 12 nt, Bordetella pertussis
cugucgcgcgca

SEQ ID NO: 2366336 - RNA, 15 nt, Bordetella pertussis
cugucgcgcuacagc

SEQ ID NO: 2366337 - RNA, 19 nt, Bordetella pertussis
cugucgcgcuacagcgugg

SEQ ID NO: 2366338 - RNA, 14 nt, Bordetella pertussis
cugucgcgcugcuu

SEQ ID NO: 2366339 - RNA, 23 nt, Bordetella pertussis
cugucggccgaaccgcgcagccg

SEQ ID NO: 2366340 - RNA, 16 nt, Bordetella pertussis
cugucggcgcuggcca

SEQ ID NO: 2366341 - RNA, 15 nt, Bordetella pertussis
cugucggcguuccug

SEQ ID NO: 2366342 - RNA, 20 nt, Bordetella pertussis
cugucggcguuccuggcgcu

SEQ ID NO: 2366343 - RNA, 23 nt, Bordetella pertussis
cugucggugauccacugcagcag

SEQ ID NO: 2366344 - RNA, 20 nt, Bordetella pertussis
cugucggugaugauccugcu

SEQ ID NO: 2366345 - RNA, 22 nt, Bordetella pertussis
cugucggugaugauccugcugg

SEQ ID NO: 2366346 - RNA, 16 nt, Bordetella pertussis
cugugcaagcgaaagu

SEQ ID NO: 2366347 - RNA, 22 nt, Bordetella pertussis
cugugcagccacgccuggccgc

SEQ ID NO: 2366348 - RNA, 19 nt, Bordetella pertussis
cugugccccacacgcgcgc

SEQ ID NO: 2366349 - RNA, 14 nt, Bordetella pertussis
cugugcccgcccca

SEQ ID NO: 2366350 - RNA, 19 nt, Bordetella pertussis
cugugcgacgauccggcga

SEQ ID NO: 2366351 - RNA, 18 nt, Bordetella pertussis
cugugcgauggcacggca

SEQ ID NO: 2366352 - RNA, 17 nt, Bordetella pertussis
cugugcgccggggcgcc

SEQ ID NO: 2366353 - RNA, 22 nt, Bordetella pertussis
cuguggacgccgccggcccagg

SEQ ID NO: 2366354 - RNA, 15 nt, Bordetella pertussis
cuguggcgcacccug

SEQ ID NO: 2366355 - RNA, 20 nt, Bordetella pertussis
cuuccuugaccaccuugccc

SEQ ID NO: 2366356 - RNA, 21 nt, Bordetella pertussis
cuuccuugccauccagccagg

SEQ ID NO: 2366357 - RNA, 16 nt, Bordetella pertussis
cuuccuugcgaugcca

SEQ ID NO: 2366358 - RNA, 17 nt, Bordetella pertussis
cuucgacagcgcgcagg

SEQ ID NO: 2366359 - RNA, 22 nt, Bordetella pertussis
cuucgacccggacaacgcgcgc

SEQ ID NO: 2366360 - RNA, 19 nt, Bordetella pertussis
cuucgacgcggcggccggu

SEQ ID NO: 2366361 - RNA, 15 nt, Bordetella pertussis
cuucgacguccagcc

SEQ ID NO: 2366362 - RNA, 17 nt, Bordetella pertussis
cuucgacguccagcccg

SEQ ID NO: 2366363 - RNA, 12 nt, Bordetella pertussis
cuucgagcacca

SEQ ID NO: 2366364 - RNA, 15 nt, Bordetella pertussis
cuucgagcaccaugc

SEQ ID NO: 2366365 - RNA, 15 nt, Bordetella pertussis
cuucgagccgguaca

SEQ ID NO: 2366366 - RNA, 15 nt, Bordetella pertussis
cuucgagcgacggca

SEQ ID NO: 2366367 - RNA, 18 nt, Bordetella pertussis
cuucgagcgcgacgaacu

SEQ ID NO: 2366368 - RNA, 14 nt, Bordetella pertussis
cuucgagcgcggcg

SEQ ID NO: 2366369 - RNA, 18 nt, Bordetella pertussis
cuucgagcgcggcgcgcg

SEQ ID NO: 2366370 - RNA, 15 nt, Bordetella pertussis
cuucgaggccggcgu

SEQ ID NO: 2366371 - RNA, 18 nt, Bordetella pertussis
cuucgaucaugcccgcca

SEQ ID NO: 2366372 - RNA, 15 nt, Bordetella pertussis
cuucgaucgccuggg

SEQ ID NO: 2366373 - RNA, 21 nt, Bordetella pertussis
cuucgaucuucucgccgcgcg

SEQ ID NO: 2366374 - RNA, 14 nt, Bordetella pertussis
cuucgaugaugagc

SEQ ID NO: 2366375 - RNA, 19 nt, Bordetella pertussis
cuucgaugaugagcgcgcc

SEQ ID NO: 2366376 - RNA, 23 nt, Bordetella pertussis
cuucgaugcuggcgcggaccugc

SEQ ID NO: 2366377 - RNA, 20 nt, Bordetella pertussis
cuucgcccccgauccccugc

SEQ ID NO: 2366378 - RNA, 21 nt, Bordetella pertussis
cuucgcccgcauagacgccga

SEQ ID NO: 2366379 - RNA, 20 nt, Bordetella pertussis
cuucgccgaccagcucgacg

SEQ ID NO: 2366380 - RNA, 21 nt, Bordetella pertussis
cuucgccgaucgagcaggccg

SEQ ID NO: 2366381 - RNA, 16 nt, Bordetella pertussis
cuucgccgaugaccag

SEQ ID NO: 2366382 - RNA, 14 nt, Bordetella pertussis
cuucgccgcgcaca

SEQ ID NO: 2366383 - RNA, 13 nt, Bordetella pertussis
cuucgccuggccg

SEQ ID NO: 2366384 - RNA, 21 nt, Bordetella pertussis
cuucgcgaaagcgcugcgccg

SEQ ID NO: 2366385 - RNA, 19 nt, Bordetella pertussis
cuucgcgauccagcagcgu

SEQ ID NO: 2366386 - RNA, 20 nt, Bordetella pertussis
cuucgcgauccagcagcgug

SEQ ID NO: 2366387 - RNA, 17 nt, Bordetella pertussis
cuucgcgcagcaaguca

SEQ ID NO: 2366388 - RNA, 22 nt, Bordetella pertussis
cuucgcggcuggucgccgucag

SEQ ID NO: 2366389 - RNA, 17 nt, Bordetella pertussis
cuucgcgguacgcccag

SEQ ID NO: 2366390 - RNA, 21 nt, Bordetella pertussis
cuucgcgguacgcccagcugg

SEQ ID NO: 2366391 - RNA, 21 nt, Bordetella pertussis
cuucgcgguaggacggcagca

SEQ ID NO: 2366392 - RNA, 20 nt, Bordetella pertussis
cuucggcaaccgcgccucgu

SEQ ID NO: 2366393 - RNA, 18 nt, Bordetella pertussis
cuucggcauguaggccuc

SEQ ID NO: 2366394 - RNA, 17 nt, Bordetella pertussis
cuucggccgccagccgg

SEQ ID NO: 2366395 - RNA, 23 nt, Bordetella pertussis
cuucggccgccagccggcccagc

SEQ ID NO: 2366396 - RNA, 13 nt, Bordetella pertussis
cuucggccggcug

SEQ ID NO: 2366397 - RNA, 13 nt, Bordetella pertussis
cuucggccgucag

SEQ ID NO: 2366398 - RNA, 20 nt, Bordetella pertussis
cuucggccgucagcagcagg

SEQ ID NO: 2366399 - RNA, 17 nt, Bordetella pertussis
cuucggccugcgccacc

SEQ ID NO: 2366400 - RNA, 21 nt, Bordetella pertussis
cuucggccugcgccaccagcu

SEQ ID NO: 2366401 - RNA, 20 nt, Bordetella pertussis
cuucggcgacuucggcggcc

SEQ ID NO: 2366402 - RNA, 14 nt, Bordetella pertussis
cuucggcgaucugg

SEQ ID NO: 2366403 - RNA, 16 nt, Bordetella pertussis
cuucggcgcgcacgcu

SEQ ID NO: 2366404 - RNA, 15 nt, Bordetella pertussis
cuucggcgcgcgccg

SEQ ID NO: 2366405 - RNA, 23 nt, Bordetella pertussis
cuucggcgcggcgggcucagccc

SEQ ID NO: 2366406 - RNA, 19 nt, Bordetella pertussis
cuucggcggccagccggcg

SEQ ID NO: 2366407 - RNA, 23 nt, Bordetella pertussis
cuucggcggccagccggcgcgcc

SEQ ID NO: 2366408 - RNA, 13 nt, Bordetella pertussis
cuucggcggccgc

SEQ ID NO: 2366409 - RNA, 13 nt, Bordetella pertussis
cuucggcggccug

SEQ ID NO: 2366410 - RNA, 18 nt, Bordetella pertussis
cuucggcggccugcuugg

SEQ ID NO: 2366411 - RNA, 22 nt, Bordetella pertussis
cuucggcggccugcuuggcagc

SEQ ID NO: 2366412 - RNA, 15 nt, Bordetella pertussis
cuucggcggcgcgcu

SEQ ID NO: 2366413 - RNA, 21 nt, Bordetella pertussis
cuucggcguaaggcugcagcu

SEQ ID NO: 2366414 - RNA, 18 nt, Bordetella pertussis
cuucggcguacugcugca

SEQ ID NO: 2366415 - RNA, 22 nt, Bordetella pertussis
cuucggcguacugcugcaagga

SEQ ID NO: 2366416 - RNA, 23 nt, Bordetella pertussis
cuucggcguacugcugcaaggac

SEQ ID NO: 2366417 - RNA, 18 nt, Bordetella pertussis
cuucgggauuucgcuggc

SEQ ID NO: 2366418 - RNA, 23 nt, Bordetella pertussis
cuucgggcgguuuuuucuugccg

SEQ ID NO: 2366419 - RNA, 21 nt, Bordetella pertussis
cuucggucacacugggcggcg

SEQ ID NO: 2366420 - RNA, 17 nt, Bordetella pertussis
cuucggucacguucagc

SEQ ID NO: 2366421 - RNA, 20 nt, Bordetella pertussis
cuucggucagcugcuguugg

SEQ ID NO: 2366422 - RNA, 21 nt, Bordetella pertussis
cuucgguggcccgccauugca

SEQ ID NO: 2366423 - RNA, 23 nt, Bordetella pertussis
cuucguaaacaucgcgcauggcg

SEQ ID NO: 2366424 - RNA, 15 nt, Bordetella pertussis
cuucguacagccugc

SEQ ID NO: 2366425 - RNA, 18 nt, Bordetella pertussis
cuucguacagccugcccu

SEQ ID NO: 2366426 - RNA, 14 nt, Bordetella pertussis
cuucguccggcgcg

SEQ ID NO: 2366427 - RNA, 18 nt, Bordetella pertussis
cuucguccugccauugcg

SEQ ID NO: 2366428 - RNA, 15 nt, Bordetella pertussis
cuucgucggcgucga

SEQ ID NO: 2366429 - RNA, 13 nt, Bordetella pertussis
cuucgucgggcag

SEQ ID NO: 2366430 - RNA, 21 nt, Bordetella pertussis
cuucgugcagcgcgugggcca

SEQ ID NO: 2366431 - RNA, 13 nt, Bordetella pertussis
cuucgugcggccg

SEQ ID NO: 2366432 - RNA, 15 nt, Bordetella pertussis
cuucgugcggccgca

SEQ ID NO: 2366433 - RNA, 16 nt, Bordetella pertussis
cuucgugcggccgcag

SEQ ID NO: 2366434 - RNA, 14 nt, Bordetella pertussis
cuucguggcgcagc

SEQ ID NO: 2366435 - RNA, 15 nt, Bordetella pertussis
cuucguggcgcagcu

SEQ ID NO: 2366436 - RNA, 18 nt, Bordetella pertussis
cuucguggcgcagcuccg

SEQ ID NO: 2366437 - RNA, 22 nt, Bordetella pertussis
cuucguguucgcggccggacag

SEQ ID NO: 2366438 - RNA, 23 nt, Bordetella pertussis
cuucguguucgcggccggacagg

SEQ ID NO: 2366439 - RNA, 17 nt, Bordetella pertussis
cuucguugucgcgcgcg

SEQ ID NO: 2366440 - RNA, 19 nt, Bordetella pertussis
cuucuacccgcucaccuuu

SEQ ID NO: 2366441 - RNA, 20 nt, Bordetella pertussis
cuucuaggagacggucaccg

SEQ ID NO: 2366442 - RNA, 17 nt, Bordetella pertussis
cuucucacugcccgcgc

SEQ ID NO: 2366443 - RNA, 19 nt, Bordetella pertussis
cuucucacugcccgcgccg

SEQ ID NO: 2366444 - RNA, 20 nt, Bordetella pertussis
cuucucacugcccgcgccgu

SEQ ID NO: 2366445 - RNA, 14 nt, Bordetella pertussis
cuucucgaccaggc

SEQ ID NO: 2366446 - RNA, 16 nt, Bordetella pertussis
cuucucgacggcgcgc

SEQ ID NO: 2366447 - RNA, 13 nt, Bordetella pertussis
cuucucgccgcgc

SEQ ID NO: 2366448 - RNA, 17 nt, Bordetella pertussis
cuucucggugcgccgcc

SEQ ID NO: 2366449 - RNA, 18 nt, Bordetella pertussis
cuucucggugcgccgccg

SEQ ID NO: 2366450 - RNA, 18 nt, Bordetella pertussis
cuucucguccgauggcga

SEQ ID NO: 2366451 - RNA, 18 nt, Bordetella pertussis
cuucugccagacggccag

SEQ ID NO: 2366452 - RNA, 21 nt, Bordetella pertussis
cuucugccagacggccagcgc

SEQ ID NO: 2366453 - RNA, 15 nt, Bordetella pertussis
cuucugccgccaggc

SEQ ID NO: 2366454 - RNA, 22 nt, Bordetella pertussis
cuucugcgcguucaugucgguc

SEQ ID NO: 2366455 - RNA, 19 nt, Bordetella pertussis
cuucuggacuugcggcacg

SEQ ID NO: 2366456 - RNA, 20 nt, Bordetella pertussis
cuucuggaucaccgccggcg

SEQ ID NO: 2366457 - RNA, 21 nt, Bordetella pertussis
cuucuggaucaccgccggcgg

SEQ ID NO: 2366458 - RNA, 23 nt, Bordetella pertussis
cuucuggaucaccgccggcggcg

SEQ ID NO: 2366459 - RNA, 14 nt, Bordetella pertussis
cuucugggucagcu

SEQ ID NO: 2366460 - RNA, 14 nt, Bordetella pertussis
cuucugggucggca

SEQ ID NO: 2366461 - RNA, 21 nt, Bordetella pertussis
cuucuucacguagccggccag

SEQ ID NO: 2366462 - RNA, 14 nt, Bordetella pertussis
cuucuucagcaugg

SEQ ID NO: 2366463 - RNA, 17 nt, Bordetella pertussis
cuucuucagcuugguca

SEQ ID NO: 2366464 - RNA, 19 nt, Bordetella pertussis
cuucuuccaggcgcccgcc

SEQ ID NO: 2366465 - RNA, 18 nt, Bordetella pertussis
cuucuucgagcaauugcc

SEQ ID NO: 2366466 - RNA, 17 nt, Bordetella pertussis
cuucuucgucgcgccag

SEQ ID NO: 2366467 - RNA, 15 nt, Bordetella pertussis
cuugccggccuggcg

SEQ ID NO: 2366468 - RNA, 20 nt, Bordetella pertussis
cuugccggcgcucagcgacg

SEQ ID NO: 2366469 - RNA, 15 nt, Bordetella pertussis
cuugccgggcucgau

SEQ ID NO: 2366470 - RNA, 23 nt, Bordetella pertussis
cuugccgggcucgaugaccagca

SEQ ID NO: 2366471 - RNA, 17 nt, Bordetella pertussis
cuugccggugcucggcc

SEQ ID NO: 2366472 - RNA, 20 nt, Bordetella pertussis
cuugccggugcucggccagc

SEQ ID NO: 2366473 - RNA, 21 nt, Bordetella pertussis
cuugccggugcucggccagcg

SEQ ID NO: 2366474 - RNA, 20 nt, Bordetella pertussis
cuugccgguggacggccagc

SEQ ID NO: 2366475 - RNA, 21 nt, Bordetella pertussis
cuugccgguggacggccagca

SEQ ID NO: 2366476 - RNA, 19 nt, Bordetella pertussis
cuugccguagcgcguggcc

SEQ ID NO: 2366477 - RNA, 22 nt, Bordetella pertussis
cuugccguagcgcguggccagc

SEQ ID NO: 2366478 - RNA, 23 nt, Bordetella pertussis
cuugccguagcgcguggccagca

SEQ ID NO: 2366479 - RNA, 13 nt, Bordetella pertussis
cuugccguucagg

SEQ ID NO: 2366480 - RNA, 20 nt, Bordetella pertussis
cuugccguucagguucauca

SEQ ID NO: 2366481 - RNA, 16 nt, Bordetella pertussis
cuugccugacgugcgc

SEQ ID NO: 2366482 - RNA, 18 nt, Bordetella pertussis
cuugccugacgugcgcca

SEQ ID NO: 2366483 - RNA, 14 nt, Bordetella pertussis
cuugccuuccagga

SEQ ID NO: 2366484 - RNA, 23 nt, Bordetella pertussis
cuugccuuccaggaacuccagga

SEQ ID NO: 2366485 - RNA, 19 nt, Bordetella pertussis
cuugcgaacggccgcccgg

SEQ ID NO: 2366486 - RNA, 20 nt, Bordetella pertussis
cuugcgaacggccgcccggc

SEQ ID NO: 2366487 - RNA, 14 nt, Bordetella pertussis
cuugcgaggcccgg

SEQ ID NO: 2366488 - RNA, 15 nt, Bordetella pertussis
cuugcgaggcccggc

SEQ ID NO: 2366489 - RNA, 20 nt, Bordetella pertussis
cuugcgauaggugcgcagcc

SEQ ID NO: 2366490 - RNA, 21 nt, Bordetella pertussis
cuugcgauaggugcgcagccg

SEQ ID NO: 2366491 - RNA, 13 nt, Bordetella pertussis
cuugcgaugccag

SEQ ID NO: 2366492 - RNA, 22 nt, Bordetella pertussis
cuugcgcaagccggccgcgccg

SEQ ID NO: 2366493 - RNA, 20 nt, Bordetella pertussis
cuugcgcaaguucaucaucg

SEQ ID NO: 2366494 - RNA, 23 nt, Bordetella pertussis
cuugcgcaaguucaucaucgccg

SEQ ID NO: 2366495 - RNA, 16 nt, Bordetella pertussis
cuugcgcagggcgggc

SEQ ID NO: 2366496 - RNA, 23 nt, Bordetella pertussis
cuugcgcauacgcggguucgacg

SEQ ID NO: 2366497 - RNA, 15 nt, Bordetella pertussis
cuugcgccacgcccg

SEQ ID NO: 2366498 - RNA, 14 nt, Bordetella pertussis
cuugcgccagccac

SEQ ID NO: 2366499 - RNA, 17 nt, Bordetella pertussis
cuugcgcgaaggccgcc

SEQ ID NO: 2366500 - RNA, 14 nt, Bordetella pertussis
cuugcgcgacagca

SEQ ID NO: 2366501 - RNA, 17 nt, Bordetella pertussis
cuugcgcgacagcaggc

SEQ ID NO: 2366502 - RNA, 18 nt, Bordetella pertussis
cuugcgcgacagcaggcc

SEQ ID NO: 2366503 - RNA, 19 nt, Bordetella pertussis
cuugcgcgcccccacgccg

SEQ ID NO: 2366504 - RNA, 12 nt, Bordetella pertussis
cuugcgcgccgc

SEQ ID NO: 2366505 - RNA, 13 nt, Bordetella pertussis
cuugcgcgccgca

SEQ ID NO: 2366506 - RNA, 15 nt, Bordetella pertussis
cuugcgcgccugcug

SEQ ID NO: 2366507 - RNA, 16 nt, Bordetella pertussis
cuugcgcgccuuggcg

SEQ ID NO: 2366508 - RNA, 16 nt, Bordetella pertussis
cuugcgcgcgccggac

SEQ ID NO: 2366509 - RNA, 24 nt, Bordetella pertussis
cuugcgcggcgcgucgcgcgccag

SEQ ID NO: 2366510 - RNA, 17 nt, Bordetella pertussis
cuugcgcguaggcgcgc

SEQ ID NO: 2366511 - RNA, 17 nt, Bordetella pertussis
cuugcgcguccaggcca

SEQ ID NO: 2366512 - RNA, 15 nt, Bordetella pertussis
cuugcgcucgcccag

SEQ ID NO: 2366513 - RNA, 16 nt, Bordetella pertussis
cuugcgcucgcccagc

SEQ ID NO: 2366514 - RNA, 20 nt, Bordetella pertussis
cuugcgcucgcccagcaccu

SEQ ID NO: 2366515 - RNA, 19 nt, Bordetella pertussis
cuugcgcuggcgcgcggcc

SEQ ID NO: 2366516 - RNA, 20 nt, Bordetella pertussis
cuugcggcccuugcgcgaac

SEQ ID NO: 2366517 - RNA, 13 nt, Bordetella pertussis
cuugcggccgccg

SEQ ID NO: 2366518 - RNA, 21 nt, Bordetella pertussis
cuugcggcgaugcacccaggc

SEQ ID NO: 2366519 - RNA, 20 nt, Bordetella pertussis
cuugcggcgcuggcuggacg

SEQ ID NO: 2366520 - RNA, 17 nt, Bordetella pertussis
cuugcgggccggcuggg

SEQ ID NO: 2366521 - RNA, 18 nt, Bordetella pertussis
cuugcgggccggcugggc

SEQ ID NO: 2366522 - RNA, 15 nt, Bordetella pertussis
cuugcggguccagca

SEQ ID NO: 2366523 - RNA, 16 nt, Bordetella pertussis
cuugcugcccgacggc

SEQ ID NO: 2366524 - RNA, 24 nt, Bordetella pertussis
cuuggacgcgcuguaggcgccggc

SEQ ID NO: 2366525 - RNA, 21 nt, Bordetella pertussis
cuuggaguucuucuuggccag

SEQ ID NO: 2366526 - RNA, 16 nt, Bordetella pertussis
cuuggcaaccucgccg

SEQ ID NO: 2366527 - RNA, 20 nt, Bordetella pertussis
cuuggcaaccucgccgcgcc

SEQ ID NO: 2366528 - RNA, 14 nt, Bordetella pertussis
cuuggcagccuugg

SEQ ID NO: 2366529 - RNA, 19 nt, Bordetella pertussis
cuuggcagccuuggucagc

SEQ ID NO: 2366530 - RNA, 22 nt, Bordetella pertussis
cuuggcaggcgucuugccggag

SEQ ID NO: 2366531 - RNA, 17 nt, Bordetella pertussis
cuuggccaccacgccca

SEQ ID NO: 2366532 - RNA, 18 nt, Bordetella pertussis
cuuggccaccacgcccau

SEQ ID NO: 2366533 - RNA, 21 nt, Bordetella pertussis
cuuggccagaucgucgaacuu

SEQ ID NO: 2366534 - RNA, 14 nt, Bordetella pertussis
cuuggccagcuggc

SEQ ID NO: 2366535 - RNA, 15 nt, Bordetella pertussis
cuuggccagcuggcg

SEQ ID NO: 2366536 - RNA, 18 nt, Bordetella pertussis
cuuggcccacucaugcgc

SEQ ID NO: 2366537 - RNA, 22 nt, Bordetella pertussis
cuuggcccacucaugcgcugca

SEQ ID NO: 2366538 - RNA, 19 nt, Bordetella pertussis
cuuggcccggcgggaacag

SEQ ID NO: 2366539 - RNA, 19 nt, Bordetella pertussis
cuuggcccugcagcggcca

SEQ ID NO: 2366540 - RNA, 12 nt, Bordetella pertussis
cuuggccgccac

SEQ ID NO: 2366541 - RNA, 15 nt, Bordetella pertussis
cuuggccgccacgcu

SEQ ID NO: 2366542 - RNA, 16 nt, Bordetella pertussis
cuuggccugggccgac

SEQ ID NO: 2366543 - RNA, 23 nt, Bordetella pertussis
cuuggccugggcgcgguccagca

SEQ ID NO: 2366544 - RNA, 17 nt, Bordetella pertussis
cuuggcgaacaccaggg

SEQ ID NO: 2366545 - RNA, 13 nt, Bordetella pertussis
cuuggcgaucucg

SEQ ID NO: 2366546 - RNA, 20 nt, Bordetella pertussis
cuuggcgaucucguccugca

SEQ ID NO: 2366547 - RNA, 15 nt, Bordetella pertussis
cuuggcgccggcgau

SEQ ID NO: 2366548 - RNA, 16 nt, Bordetella pertussis
cuuggcgcgcagcagc

SEQ ID NO: 2366549 - RNA, 17 nt, Bordetella pertussis
cuuggcgcgcagcagcg

SEQ ID NO: 2366550 - RNA, 13 nt, Bordetella pertussis
cuuggcgcgccgg

SEQ ID NO: 2366551 - RNA, 14 nt, Bordetella pertussis
cuuggcgcgccgga

SEQ ID NO: 2366552 - RNA, 20 nt, Bordetella pertussis
cuuggcgcgguccacgcccu

SEQ ID NO: 2366553 - RNA, 22 nt, Bordetella pertussis
cuuggcggccuugcgggccggc

SEQ ID NO: 2366554 - RNA, 13 nt, Bordetella pertussis
cuuggcggcuggc

SEQ ID NO: 2366555 - RNA, 19 nt, Bordetella pertussis
cuuggcggcuggcgcggcc

SEQ ID NO: 2366556 - RNA, 17 nt, Bordetella pertussis
cuuggcgugcaggcugg

SEQ ID NO: 2366557 - RNA, 17 nt, Bordetella pertussis
cuuggcgugcuugccgc

SEQ ID NO: 2366558 - RNA, 20 nt, Bordetella pertussis
cuuggcuugcagcgccucgg

SEQ ID NO: 2366559 - RNA, 16 nt, Bordetella pertussis
cuugggacgcuucgag

SEQ ID NO: 2366560 - RNA, 14 nt, Bordetella pertussis
cuugggaucggcca

SEQ ID NO: 2366561 - RNA, 22 nt, Bordetella pertussis
cuugggaugcaggucggggcgc

SEQ ID NO: 2366562 - RNA, 22 nt, Bordetella pertussis
cuugggcaaaaaaagaggccac

SEQ ID NO: 2366563 - RNA, 18 nt, Bordetella pertussis
cuugggcaucaggggcuc

SEQ ID NO: 2366564 - RNA, 17 nt, Bordetella pertussis
cuugggccgcgccugca

SEQ ID NO: 2366565 - RNA, 21 nt, Bordetella pertussis
cuugggcgccugcggggccgc

SEQ ID NO: 2366566 - RNA, 18 nt, Bordetella pertussis
cuugggcuugauggccag

SEQ ID NO: 2366567 - RNA, 20 nt, Bordetella pertussis
cuugggcuugauggccagcg

SEQ ID NO: 2366568 - RNA, 12 nt, Bordetella pertussis
cuuggggcggcc

SEQ ID NO: 2366569 - RNA, 20 nt, Bordetella pertussis
cuuggggcggcccagcggca

SEQ ID NO: 2366570 - RNA, 15 nt, Bordetella pertussis
cuuggggcggcccgg

SEQ ID NO: 2366571 - RNA, 20 nt, Bordetella pertussis
cuuggggcggcccggcggca

SEQ ID NO: 2366572 - RNA, 22 nt, Bordetella pertussis
cuuggggcggcccggcggcaaa

SEQ ID NO: 2366573 - RNA, 22 nt, Bordetella pertussis
cuugggggcccacaugccgugc

SEQ ID NO: 2366574 - RNA, 18 nt, Bordetella pertussis
cuuggggucccacugcca

SEQ ID NO: 2366575 - RNA, 21 nt, Bordetella pertussis
cuuggucagcaucagcagacc

SEQ ID NO: 2366576 - RNA, 22 nt, Bordetella pertussis
cuuggucagcaucagcagaccc

SEQ ID NO: 2366577 - RNA, 13 nt, Bordetella pertussis
cuuggucagcgaa

SEQ ID NO: 2366578 - RNA, 20 nt, Bordetella pertussis
cuuggugccguaauccgugg

SEQ ID NO: 2366579 - RNA, 12 nt, Bordetella pertussis
gaaaugccggcg

SEQ ID NO: 2366580 - RNA, 19 nt, Bordetella pertussis
gaaaugcgcguuggccuga

SEQ ID NO: 2366581 - RNA, 20 nt, Bordetella pertussis
gaaaugcuggucgcgcaccu

SEQ ID NO: 2366582 - RNA, 13 nt, Bordetella pertussis
gaaauggcggcgg

SEQ ID NO: 2366583 - RNA, 23 nt, Bordetella pertussis
gaaaugguguacagccgccuggc

SEQ ID NO: 2366584 - RNA, 19 nt, Bordetella pertussis
gaaauuggggccgccugga

SEQ ID NO: 2366585 - RNA, 16 nt, Bordetella pertussis
gaacaacacgaugauc

SEQ ID NO: 2366586 - RNA, 23 nt, Bordetella pertussis
gaacaacacgaugaucgcgccga

SEQ ID NO: 2366587 - RNA, 15 nt, Bordetella pertussis
gaacaaggcgguggc

SEQ ID NO: 2366588 - RNA, 16 nt, Bordetella pertussis
gaacaaggcgguggcc

SEQ ID NO: 2366589 - RNA, 19 nt, Bordetella pertussis
gaacaagguacccgcgccg

SEQ ID NO: 2366590 - RNA, 17 nt, Bordetella pertussis
gaacaagguccaggccc

SEQ ID NO: 2366591 - RNA, 15 nt, Bordetella pertussis
gaacaccagcaagcc

SEQ ID NO: 2366592 - RNA, 21 nt, Bordetella pertussis
gaacaccagguuuuccacagc

SEQ ID NO: 2366593 - RNA, 17 nt, Bordetella pertussis
gaacaccccggucagca

SEQ ID NO: 2366594 - RNA, 19 nt, Bordetella pertussis
gaacaccccggucagcagg

SEQ ID NO: 2366595 - RNA, 20 nt, Bordetella pertussis
gaacaccccggucagcaggg

SEQ ID NO: 2366596 - RNA, 14 nt, Bordetella pertussis
gaacaccggcaggc

SEQ ID NO: 2366597 - RNA, 13 nt, Bordetella pertussis
gaacaccggcgcg

SEQ ID NO: 2366598 - RNA, 14 nt, Bordetella pertussis
gaacaccggcgcgc

SEQ ID NO: 2366599 - RNA, 22 nt, Bordetella pertussis
gaacaccggcgcgccuggcgcg

SEQ ID NO: 2366600 - RNA, 15 nt, Bordetella pertussis
gaacaccggcuuggc

SEQ ID NO: 2366601 - RNA, 19 nt, Bordetella pertussis
gaacaccguuuccaagcgc

SEQ ID NO: 2366602 - RNA, 14 nt, Bordetella pertussis
gaacacgacgaagg

SEQ ID NO: 2366603 - RNA, 13 nt, Bordetella pertussis
gaacacgaugaag

SEQ ID NO: 2366604 - RNA, 16 nt, Bordetella pertussis
gaacacgccgaccgga

SEQ ID NO: 2366605 - RNA, 14 nt, Bordetella pertussis
gaacacgcgcgccg

SEQ ID NO: 2366606 - RNA, 13 nt, Bordetella pertussis
gaacagcagaugg

SEQ ID NO: 2366607 - RNA, 14 nt, Bordetella pertussis
gaacagcagauggc

SEQ ID NO: 2366608 - RNA, 17 nt, Bordetella pertussis
gaacagcauggcggcgc

SEQ ID NO: 2366609 - RNA, 13 nt, Bordetella pertussis
gaacagccagggc

SEQ ID NO: 2366610 - RNA, 14 nt, Bordetella pertussis
gaacagccagggca

SEQ ID NO: 2366611 - RNA, 18 nt, Bordetella pertussis
gaacagccagggcagggc

SEQ ID NO: 2366612 - RNA, 16 nt, Bordetella pertussis
gaacagccgccccagc

SEQ ID NO: 2366613 - RNA, 18 nt, Bordetella pertussis
gaacagccgccccagcag

SEQ ID NO: 2366614 - RNA, 20 nt, Bordetella pertussis
gaacagccgccccagcagca

SEQ ID NO: 2366615 - RNA, 13 nt, Bordetella pertussis
gaacagccgcugc

SEQ ID NO: 2366616 - RNA, 13 nt, Bordetella pertussis
gaacagccugccc

SEQ ID NO: 2366617 - RNA, 15 nt, Bordetella pertussis
gaacagcgccaggcu

SEQ ID NO: 2366618 - RNA, 18 nt, Bordetella pertussis
gaacagcggaucgccggu

SEQ ID NO: 2366619 - RNA, 16 nt, Bordetella pertussis
gaacagcggcacgccg

SEQ ID NO: 2366620 - RNA, 18 nt, Bordetella pertussis
gaacagcggcacgccggc

SEQ ID NO: 2366621 - RNA, 14 nt, Bordetella pertussis
gaacagcguccagc

SEQ ID NO: 2366622 - RNA, 19 nt, Bordetella pertussis
gaacagcguccagccgccc

SEQ ID NO: 2366623 - RNA, 20 nt, Bordetella pertussis
gaacagcguccagccgcccg

SEQ ID NO: 2366624 - RNA, 19 nt, Bordetella pertussis
gaacagcuggaagcgcgcc

SEQ ID NO: 2366625 - RNA, 20 nt, Bordetella pertussis
gaacagcuggaagcgcgcca

SEQ ID NO: 2366626 - RNA, 20 nt, Bordetella pertussis
gaacagcuugcuguccaguc

SEQ ID NO: 2366627 - RNA, 13 nt, Bordetella pertussis
gaacaggccggcc

SEQ ID NO: 2366628 - RNA, 13 nt, Bordetella pertussis
gaacaggcgcgcc

SEQ ID NO: 2366629 - RNA, 14 nt, Bordetella pertussis
gaacaggcgcgcca

SEQ ID NO: 2366630 - RNA, 16 nt, Bordetella pertussis
gaacaggcgcgccagc

SEQ ID NO: 2366631 - RNA, 21 nt, Bordetella pertussis
gaacaggcggcugaagaagcc

SEQ ID NO: 2366632 - RNA, 22 nt, Bordetella pertussis
gaacaggcggcugaagaagccc

SEQ ID NO: 2366633 - RNA, 14 nt, Bordetella pertussis
gaacaggcggucuu

SEQ ID NO: 2366634 - RNA, 14 nt, Bordetella pertussis
gaacaggcugcgca

SEQ ID NO: 2366635 - RNA, 18 nt, Bordetella pertussis
gaacagggcgcgacgcca

SEQ ID NO: 2366636 - RNA, 13 nt, Bordetella pertussis
gaacagggugccg

SEQ ID NO: 2366637 - RNA, 19 nt, Bordetella pertussis
gaacagggugccgcccuug

SEQ ID NO: 2366638 - RNA, 22 nt, Bordetella pertussis
gaacagguacccccagcggcgc

SEQ ID NO: 2366639 - RNA, 16 nt, Bordetella pertussis
gaacagguugaagccg

SEQ ID NO: 2366640 - RNA, 16 nt, Bordetella pertussis
gaacaucggcagcgag

SEQ ID NO: 2366641 - RNA, 17 nt, Bordetella pertussis
gaacaucggcagcgagg

SEQ ID NO: 2366642 - RNA, 19 nt, Bordetella pertussis
gaacauggccgagaugccg

SEQ ID NO: 2366643 - RNA, 18 nt, Bordetella pertussis
gaacauguccaccagccg

SEQ ID NO: 2366644 - RNA, 19 nt, Bordetella pertussis
gaacauguccaccagccgg

SEQ ID NO: 2366645 - RNA, 21 nt, Bordetella pertussis
gaaccacaggguggcgcccag

SEQ ID NO: 2366646 - RNA, 19 nt, Bordetella pertussis
gaaccagcgcaccaccagc

SEQ ID NO: 2366647 - RNA, 15 nt, Bordetella pertussis
gaaccagcggcuggc

SEQ ID NO: 2366648 - RNA, 14 nt, Bordetella pertussis
gaaccaggccaccg

SEQ ID NO: 2366649 - RNA, 20 nt, Bordetella pertussis
gaaccaggccacgaugaugg

SEQ ID NO: 2366650 - RNA, 18 nt, Bordetella pertussis
gaaccaggccgccagggc

SEQ ID NO: 2366651 - RNA, 13 nt, Bordetella pertussis
gaaccaggccugc

SEQ ID NO: 2366652 - RNA, 16 nt, Bordetella pertussis
gaaccagugcaggggg

SEQ ID NO: 2366653 - RNA, 22 nt, Bordetella pertussis
gaaccagugcaggggguggcgg

SEQ ID NO: 2366654 - RNA, 23 nt, Bordetella pertussis
gaaccagugcaggggguggcggc

SEQ ID NO: 2366655 - RNA, 20 nt, Bordetella pertussis
gaaccauugcagggugucgg

SEQ ID NO: 2366656 - RNA, 13 nt, Bordetella pertussis
gaacccaugcagu

SEQ ID NO: 2366657 - RNA, 20 nt, Bordetella pertussis
gaaccccgccuucgucgagg

SEQ ID NO: 2366658 - RNA, 11 nt, Bordetella pertussis
gaaccccuccg

SEQ ID NO: 2366659 - RNA, 18 nt, Bordetella pertussis
gaacccgaacgcgugcac

SEQ ID NO: 2366660 - RNA, 19 nt, Bordetella pertussis
gaacccgauaugccaagga

SEQ ID NO: 2366661 - RNA, 19 nt, Bordetella pertussis
gaacccgcccgaaccggca

SEQ ID NO: 2366662 - RNA, 13 nt, Bordetella pertussis
gaacccggccggc

SEQ ID NO: 2366663 - RNA, 17 nt, Bordetella pertussis
gaacccggccggcgccg

SEQ ID NO: 2366664 - RNA, 17 nt, Bordetella pertussis
gaaccgaaaugccgcag

SEQ ID NO: 2366665 - RNA, 21 nt, Bordetella pertussis
gaaccgaaaugccgcagcacc

SEQ ID NO: 2366666 - RNA, 19 nt, Bordetella pertussis
gaaccgaauuccggcucgg

SEQ ID NO: 2366667 - RNA, 20 nt, Bordetella pertussis
gaaccgcaacgccagcaggc

SEQ ID NO: 2366668 - RNA, 22 nt, Bordetella pertussis
gaaccgcaccggaggcgccgcg

SEQ ID NO: 2366669 - RNA, 17 nt, Bordetella pertussis
gaaccgcagaagcagcc

SEQ ID NO: 2366670 - RNA, 19 nt, Bordetella pertussis
gaaccgcagaagcagccgc

SEQ ID NO: 2366671 - RNA, 16 nt, Bordetella pertussis
gaaccgcagcgccacc

SEQ ID NO: 2366672 - RNA, 18 nt, Bordetella pertussis
gaaccgccgcaagacggc

SEQ ID NO: 2366673 - RNA, 17 nt, Bordetella pertussis
gaaccgccuucgggcgg

SEQ ID NO: 2366674 - RNA, 13 nt, Bordetella pertussis
gaaccgcgcagcc

SEQ ID NO: 2366675 - RNA, 16 nt, Bordetella pertussis
gaaccgcgcagccgcu

SEQ ID NO: 2366676 - RNA, 21 nt, Bordetella pertussis
gaaccgcgcagccgcuucacg

SEQ ID NO: 2366677 - RNA, 20 nt, Bordetella pertussis
gaaccgcucagcccuugacg

SEQ ID NO: 2366678 - RNA, 14 nt, Bordetella pertussis
gaaccggugcuggu

SEQ ID NO: 2366679 - RNA, 15 nt, Bordetella pertussis
gaaccgguuggccag

SEQ ID NO: 2366680 - RNA, 16 nt, Bordetella pertussis
gaaccgguuggccagc

SEQ ID NO: 2366681 - RNA, 14 nt, Bordetella pertussis
gaaccugcuggccg

SEQ ID NO: 2366682 - RNA, 17 nt, Bordetella pertussis
gaaccugcuggccgccg

SEQ ID NO: 2366683 - RNA, 19 nt, Bordetella pertussis
gaaccugcuggccgccggc

SEQ ID NO: 2366684 - RNA, 19 nt, Bordetella pertussis
gaacgaauaaucgccggug

SEQ ID NO: 2366685 - RNA, 18 nt, Bordetella pertussis
gaacgacacccggucggc

SEQ ID NO: 2366686 - RNA, 14 nt, Bordetella pertussis
gaacgacagaccgu

SEQ ID NO: 2366687 - RNA, 16 nt, Bordetella pertussis
gaacgacgguacaccu

SEQ ID NO: 2366688 - RNA, 16 nt, Bordetella pertussis
gaacgacucgucgacc

SEQ ID NO: 2366689 - RNA, 19 nt, Bordetella pertussis
gaacgacuuggcgcaaacc

SEQ ID NO: 2366690 - RNA, 18 nt, Bordetella pertussis
gaacgacuugggcaguuc

SEQ ID NO: 2366691 - RNA, 19 nt, Bordetella pertussis
gaacgagccggccgcgccc

SEQ ID NO: 2366692 - RNA, 17 nt, Bordetella pertussis
gaagacauggcgcgcgc

SEQ ID NO: 2366693 - RNA, 21 nt, Bordetella pertussis
gaagaccgugaucggcgcaac

SEQ ID NO: 2366694 - RNA, 19 nt, Bordetella pertussis
gaagaccucggcgcucagg

SEQ ID NO: 2366695 - RNA, 17 nt, Bordetella pertussis
gaagacgaagucccagc

SEQ ID NO: 2366696 - RNA, 22 nt, Bordetella pertussis
gaagacgaagucccagccggcc

SEQ ID NO: 2366697 - RNA, 23 nt, Bordetella pertussis
gaagacgaucucacagacgauca

SEQ ID NO: 2366698 - RNA, 14 nt, Bordetella pertussis
gaagacgauggcga

SEQ ID NO: 2366699 - RNA, 17 nt, Bordetella pertussis
gaagacgccggucgaca

SEQ ID NO: 2366700 - RNA, 16 nt, Bordetella pertussis
gaagagcagaagcauu

SEQ ID NO: 2366701 - RNA, 14 nt, Bordetella pertussis
gaagagggcggggc

SEQ ID NO: 2366702 - RNA, 14 nt, Bordetella pertussis
gaagaucggcccgg

SEQ ID NO: 2366703 - RNA, 16 nt, Bordetella pertussis
gaagauguggucggcg

SEQ ID NO: 2366704 - RNA, 22 nt, Bordetella pertussis
gaagauguggucggcgccgagg

SEQ ID NO: 2366705 - RNA, 14 nt, Bordetella pertussis
gaagauucccgcgc

SEQ ID NO: 2366706 - RNA, 18 nt, Bordetella pertussis
gaagcaaacaggcugcug

SEQ ID NO: 2366707 - RNA, 15 nt, Bordetella pertussis
gaagcaaugcagcgc

SEQ ID NO: 2366708 - RNA, 14 nt, Bordetella pertussis
gaagcacugcaggc

SEQ ID NO: 2366709 - RNA, 14 nt, Bordetella pertussis
gaagcagcccagca

SEQ ID NO: 2366710 - RNA, 16 nt, Bordetella pertussis
gaagcagcccagcacg

SEQ ID NO: 2366711 - RNA, 20 nt, Bordetella pertussis
gaagcagcccagcacgacga

SEQ ID NO: 2366712 - RNA, 16 nt, Bordetella pertussis
gaagcagccgcgcucg

SEQ ID NO: 2366713 - RNA, 17 nt, Bordetella pertussis
gaagcaggugaugcgcg

SEQ ID NO: 2366714 - RNA, 20 nt, Bordetella pertussis
gaagccaccgucucgcccau

SEQ ID NO: 2366715 - RNA, 18 nt, Bordetella pertussis
gaagccaucgacaagcgc

SEQ ID NO: 2366716 - RNA, 22 nt, Bordetella pertussis
gaagcccaguucgguguugaga

SEQ ID NO: 2366717 - RNA, 13 nt, Bordetella pertussis
gaagcccauggcg

SEQ ID NO: 2366718 - RNA, 21 nt, Bordetella pertussis
gaagcccccgcgcugcgcccg

SEQ ID NO: 2366719 - RNA, 14 nt, Bordetella pertussis
gaagcccgagcggc

SEQ ID NO: 2366720 - RNA, 13 nt, Bordetella pertussis
gaagccgaugcgc

SEQ ID NO: 2366721 - RNA, 21 nt, Bordetella pertussis
gaagccgaugcgccgcgcuuc

SEQ ID NO: 2366722 - RNA, 20 nt, Bordetella pertussis
gaagccgaugucgaacagcu

SEQ ID NO: 2366723 - RNA, 14 nt, Bordetella pertussis
gaagccgcagcggc

SEQ ID NO: 2366724 - RNA, 13 nt, Bordetella pertussis
gaagccgccggcg

SEQ ID NO: 2366725 - RNA, 13 nt, Bordetella pertussis
gaagccggcccgu

SEQ ID NO: 2366726 - RNA, 14 nt, Bordetella pertussis
gaagccggcgccau

SEQ ID NO: 2366727 - RNA, 15 nt, Bordetella pertussis
gaagccgggcggcga

SEQ ID NO: 2366728 - RNA, 21 nt, Bordetella pertussis
gaagccguaguugaugcuugc

SEQ ID NO: 2366729 - RNA, 22 nt, Bordetella pertussis
gaagccguccuuggcgccggcg

SEQ ID NO: 2366730 - RNA, 21 nt, Bordetella pertussis
gaagccuaggcugcagccagu

SEQ ID NO: 2366731 - RNA, 13 nt, Bordetella pertussis
gaagccugcgcgc

SEQ ID NO: 2366732 - RNA, 15 nt, Bordetella pertussis
gaagccuucuucugc

SEQ ID NO: 2366733 - RNA, 22 nt, Bordetella pertussis
gaagccuucuucugcaucggca

SEQ ID NO: 2366734 - RNA, 16 nt, Bordetella pertussis
gaagccuugcgcggcc

SEQ ID NO: 2366735 - RNA, 22 nt, Bordetella pertussis
gaagcgagugcgccccgccacg

SEQ ID NO: 2366736 - RNA, 13 nt, Bordetella pertussis
gaagcgcagcacc

SEQ ID NO: 2366737 - RNA, 14 nt, Bordetella pertussis
gaagcgcagcacca

SEQ ID NO: 2366738 - RNA, 16 nt, Bordetella pertussis
gaagcgcagcaccagg

SEQ ID NO: 2366739 - RNA, 18 nt, Bordetella pertussis
gaagcgcagcaccgcgcg

SEQ ID NO: 2366740 - RNA, 13 nt, Bordetella pertussis
gaagcgcagcaga

SEQ ID NO: 2366741 - RNA, 20 nt, Bordetella pertussis
gaagcgcagcagauugccgc

SEQ ID NO: 2366742 - RNA, 16 nt, Bordetella pertussis
gaagcgcaggccuucg

SEQ ID NO: 2366743 - RNA, 15 nt, Bordetella pertussis
gaagcgcaugucgaa

SEQ ID NO: 2366744 - RNA, 13 nt, Bordetella pertussis
gaagcgcccuggc

SEQ ID NO: 2366745 - RNA, 14 nt, Bordetella pertussis
gaagcgcccuggcg

SEQ ID NO: 2366746 - RNA, 22 nt, Bordetella pertussis
gaagcgcccuggcguggcgcgc

SEQ ID NO: 2366747 - RNA, 12 nt, Bordetella pertussis
gaagcgcgccgc

SEQ ID NO: 2366748 - RNA, 13 nt, Bordetella pertussis
gaagcgcgccgcg

SEQ ID NO: 2366749 - RNA, 15 nt, Bordetella pertussis
gaagcgcgccgcgcg

SEQ ID NO: 2366750 - RNA, 23 nt, Bordetella pertussis
gaagcgcgccucgugcgaggcca

SEQ ID NO: 2366751 - RNA, 17 nt, Bordetella pertussis
gaagcgcucgcgcaggc

SEQ ID NO: 2366752 - RNA, 19 nt, Bordetella pertussis
gaagcggaaacgcgcgcgc

SEQ ID NO: 2366753 - RNA, 20 nt, Bordetella pertussis
gaagcggaugcgccgcccca

SEQ ID NO: 2366754 - RNA, 17 nt, Bordetella pertussis
gaagcggauguccggcg

SEQ ID NO: 2366755 - RNA, 19 nt, Bordetella pertussis
gaagcggauguccggcgcg

SEQ ID NO: 2366756 - RNA, 13 nt, Bordetella pertussis
gaagcggcaucgu

SEQ ID NO: 2366757 - RNA, 14 nt, Bordetella pertussis
gaagcggcgcacca

SEQ ID NO: 2366758 - RNA, 17 nt, Bordetella pertussis
gaagcggcgcaccagcg

SEQ ID NO: 2366759 - RNA, 17 nt, Bordetella pertussis
gaagcggcucaggcgcg

SEQ ID NO: 2366760 - RNA, 14 nt, Bordetella pertussis
gaagcgggccugcc

SEQ ID NO: 2366761 - RNA, 20 nt, Bordetella pertussis
gaagcggucgauguccagcg

SEQ ID NO: 2366762 - RNA, 15 nt, Bordetella pertussis
gaagcgucggccugc

SEQ ID NO: 2366763 - RNA, 19 nt, Bordetella pertussis
gaagcugacgaaacgcgcg

SEQ ID NO: 2366764 - RNA, 14 nt, Bordetella pertussis
gaagcugcccagca

SEQ ID NO: 2366765 - RNA, 22 nt, Bordetella pertussis
gaagcugccgugguacguggac

SEQ ID NO: 2366766 - RNA, 22 nt, Bordetella pertussis
gaagcuguagcgguagccggcg

SEQ ID NO: 2366767 - RNA, 14 nt, Bordetella pertussis
gaagcugucggcgc

SEQ ID NO: 2366768 - RNA, 18 nt, Bordetella pertussis
gaagcugucggcgcuggc

SEQ ID NO: 2366769 - RNA, 21 nt, Bordetella pertussis
gaaggaccucgcgccggucac

SEQ ID NO: 2366770 - RNA, 19 nt, Bordetella pertussis
gaaggcagcgcggccggca

SEQ ID NO: 2366771 - RNA, 14 nt, Bordetella pertussis
gaaggcagcggcac

SEQ ID NO: 2366772 - RNA, 10 nt, Bordetella pertussis
gaaggccacg

SEQ ID NO: 2366773 - RNA, 20 nt, Bordetella pertussis
gaaggccacgcgggcguggu

SEQ ID NO: 2366774 - RNA, 22 nt, Bordetella pertussis
gaaggcccgcgucuuggcgggc

SEQ ID NO: 2366775 - RNA, 23 nt, Bordetella pertussis
gaaggcccgcgucuuggcgggca

SEQ ID NO: 2366776 - RNA, 11 nt, Bordetella pertussis
gaaggcccggu

SEQ ID NO: 2366777 - RNA, 23 nt, Bordetella pertussis
gaaggccgccgcgcccagcagcg

SEQ ID NO: 2366778 - RNA, 14 nt, Bordetella pertussis
gaaggccgccgcgu

SEQ ID NO: 2366779 - RNA, 18 nt, Bordetella pertussis
gaaggccuuggccugggc

SEQ ID NO: 2366780 - RNA, 21 nt, Bordetella pertussis
gaaggccuuggccugggccga

SEQ ID NO: 2366781 - RNA, 20 nt, Bordetella pertussis
gaaggcgaccggcaccuggg

SEQ ID NO: 2366782 - RNA, 15 nt, Bordetella pertussis
gaaggcgagcgcggc

SEQ ID NO: 2366783 - RNA, 16 nt, Bordetella pertussis
gaaggcgagcgcggca

SEQ ID NO: 2366784 - RNA, 21 nt, Bordetella pertussis
gaaggcgaucugcggcguggc

SEQ ID NO: 2366785 - RNA, 16 nt, Bordetella pertussis
gaaggcgaugggcacc

SEQ ID NO: 2366786 - RNA, 14 nt, Bordetella pertussis
gaaggcgcccgggc

SEQ ID NO: 2366787 - RNA, 19 nt, Bordetella pertussis
gaaggcgcccgggcugccg

SEQ ID NO: 2366788 - RNA, 20 nt, Bordetella pertussis
gaaggcgcccgggcugccgu

SEQ ID NO: 2366789 - RNA, 13 nt, Bordetella pertussis
gaaggcgccgacg

SEQ ID NO: 2366790 - RNA, 13 nt, Bordetella pertussis
gaaggcgccgacu

SEQ ID NO: 2366791 - RNA, 14 nt, Bordetella pertussis
gaaggcgccggcca

SEQ ID NO: 2366792 - RNA, 20 nt, Bordetella pertussis
gaaggcgccggccaggcccu

SEQ ID NO: 2366793 - RNA, 12 nt, Bordetella pertussis
gaaggcgcggcc

SEQ ID NO: 2366794 - RNA, 13 nt, Bordetella pertussis
gaaggcgcggccg

SEQ ID NO: 2366795 - RNA, 16 nt, Bordetella pertussis
gaaggcgcggccgggc

SEQ ID NO: 2366796 - RNA, 15 nt, Bordetella pertussis
gaaggcgcggcugcg

SEQ ID NO: 2366797 - RNA, 14 nt, Bordetella pertussis
gaaggcggccggca

SEQ ID NO: 2366798 - RNA, 15 nt, Bordetella pertussis
gaaggcggccggcag

SEQ ID NO: 2366799 - RNA, 19 nt, Bordetella pertussis
gaaggcgguguagaccacc

SEQ ID NO: 2366800 - RNA, 21 nt, Bordetella pertussis
gaaggcgguguagaccaccag

SEQ ID NO: 2366801 - RNA, 13 nt, Bordetella pertussis
gaaggcgucggcc

SEQ ID NO: 2366802 - RNA, 20 nt, Bordetella pertussis
gaaggcgugcgugacgcugg

SEQ ID NO: 2366803 - RNA, 20 nt, Bordetella pertussis
gaaggcgugcugaacgcgcg

SEQ ID NO: 2366804 - RNA, 21 nt, Bordetella pertussis
gaaggcgugcugaacgcgcgu

SEQ ID NO: 2366805 - RNA, 16 nt, Bordetella pertussis
gaaggcuucgucgacc

SEQ ID NO: 2366806 - RNA, 17 nt, Bordetella pertussis
gacagaguuauuuuccg

SEQ ID NO: 2366807 - RNA, 19 nt, Bordetella pertussis
gacagaguuauuuuccgga

SEQ ID NO: 2366808 - RNA, 19 nt, Bordetella pertussis
gacagauaccgccuuggcc

SEQ ID NO: 2366809 - RNA, 18 nt, Bordetella pertussis
gacagauccagcgcggcc

SEQ ID NO: 2366810 - RNA, 19 nt, Bordetella pertussis
gacagauccagcgcggcca

SEQ ID NO: 2366811 - RNA, 21 nt, Bordetella pertussis
gacagauccagcgcggccacg

SEQ ID NO: 2366812 - RNA, 11 nt, Bordetella pertussis
gacagaugccg

SEQ ID NO: 2366813 - RNA, 20 nt, Bordetella pertussis
gacagauggcgcuugugcgu

SEQ ID NO: 2366814 - RNA, 19 nt, Bordetella pertussis
gacagcaagaaucggggcg

SEQ ID NO: 2366815 - RNA, 23 nt, Bordetella pertussis
gacagcaagaaucggggcguagc

SEQ ID NO: 2366816 - RNA, 15 nt, Bordetella pertussis
gacagcaagggcguc

SEQ ID NO: 2366817 - RNA, 21 nt, Bordetella pertussis
gacagcaaugacgacgccggc

SEQ ID NO: 2366818 - RNA, 15 nt, Bordetella pertussis
gacagcacauggcgc

SEQ ID NO: 2366819 - RNA, 17 nt, Bordetella pertussis
gacagcaccgacaggcc

SEQ ID NO: 2366820 - RNA, 19 nt, Bordetella pertussis
gacagcaccgacaggccga

SEQ ID NO: 2366821 - RNA, 13 nt, Bordetella pertussis
gacagcacgcccg

SEQ ID NO: 2366822 - RNA, 19 nt, Bordetella pertussis
gacagcacgcccgccagca

SEQ ID NO: 2366823 - RNA, 22 nt, Bordetella pertussis
gacagcacgcccgccagcagcu

SEQ ID NO: 2366824 - RNA, 23 nt, Bordetella pertussis
gacagcacgcccgccagcagcuc

SEQ ID NO: 2366825 - RNA, 10 nt, Bordetella pertussis
gacagcagca

SEQ ID NO: 2366826 - RNA, 20 nt, Bordetella pertussis
gacagcagcaugcggcccgc

SEQ ID NO: 2366827 - RNA, 15 nt, Bordetella pertussis
gacagcagcccgcug

SEQ ID NO: 2366828 - RNA, 16 nt, Bordetella pertussis
gacagcagcccgcugg

SEQ ID NO: 2366829 - RNA, 17 nt, Bordetella pertussis
gacagcagcccgcuggc

SEQ ID NO: 2366830 - RNA, 23 nt, Bordetella pertussis
gacagcagcccgcuggccgaucu

SEQ ID NO: 2366831 - RNA, 14 nt, Bordetella pertussis
gacagcaggccggu

SEQ ID NO: 2366832 - RNA, 15 nt, Bordetella pertussis
gacagcagggccagg

SEQ ID NO: 2366833 - RNA, 16 nt, Bordetella pertussis
gacagcagggccaggc

SEQ ID NO: 2366834 - RNA, 17 nt, Bordetella pertussis
gacagcagggccaggcc

SEQ ID NO: 2366835 - RNA, 19 nt, Bordetella pertussis
gacagcagggccaggccca

SEQ ID NO: 2366836 - RNA, 19 nt, Bordetella pertussis
gacagcagggucggcccca

SEQ ID NO: 2366837 - RNA, 18 nt, Bordetella pertussis
gacagcaguucggccggc

SEQ ID NO: 2366838 - RNA, 22 nt, Bordetella pertussis
gacagcaguucggccggcggcc

SEQ ID NO: 2366839 - RNA, 17 nt, Bordetella pertussis
gacagcaugaacggcag

SEQ ID NO: 2366840 - RNA, 20 nt, Bordetella pertussis
gacagcaugaacggcagcgc

SEQ ID NO: 2366841 - RNA, 23 nt, Bordetella pertussis
gacagccacgcgcgauccgcgcc

SEQ ID NO: 2366842 - RNA, 20 nt, Bordetella pertussis
gacagccaggccagcgccag

SEQ ID NO: 2366843 - RNA, 12 nt, Bordetella pertussis
gacagccccagc

SEQ ID NO: 2366844 - RNA, 15 nt, Bordetella pertussis
gacagccccagcagc

SEQ ID NO: 2366845 - RNA, 20 nt, Bordetella pertussis
gacagccccagcagcacgcc

SEQ ID NO: 2366846 - RNA, 22 nt, Bordetella pertussis
gacagccccagcagcacgccca

SEQ ID NO: 2366847 - RNA, 15 nt, Bordetella pertussis
gacagcccgcgcugg

SEQ ID NO: 2366848 - RNA, 20 nt, Bordetella pertussis
gacagcccgcgcuggcgcag

SEQ ID NO: 2366849 - RNA, 22 nt, Bordetella pertussis
gacagcccgcgcuggcgcagca

SEQ ID NO: 2366850 - RNA, 13 nt, Bordetella pertussis
gacagccgcgcca

SEQ ID NO: 2366851 - RNA, 16 nt, Bordetella pertussis
gacagccgcgccagcg

SEQ ID NO: 2366852 - RNA, 18 nt, Bordetella pertussis
gacagccgcgccagcgcc

SEQ ID NO: 2366853 - RNA, 20 nt, Bordetella pertussis
gacagccgcuaugacgaccg

SEQ ID NO: 2366854 - RNA, 22 nt, Bordetella pertussis
gacagccuuuccuccugccggc

SEQ ID NO: 2366855 - RNA, 23 nt, Bordetella pertussis
gacagccuuuccuccugccggcg

SEQ ID NO: 2366856 - RNA, 17 nt, Bordetella pertussis
gacagcgacagccaggc

SEQ ID NO: 2366857 - RNA, 18 nt, Bordetella pertussis
gacagcgacagccaggcc

SEQ ID NO: 2366858 - RNA, 20 nt, Bordetella pertussis
gacagcgacagccaggccag

SEQ ID NO: 2366859 - RNA, 12 nt, Bordetella pertussis
gacagcgccagc

SEQ ID NO: 2366860 - RNA, 14 nt, Bordetella pertussis
gacagcgccagccc

SEQ ID NO: 2366861 - RNA, 20 nt, Bordetella pertussis
gacagcgcgcccgcuugcgc

SEQ ID NO: 2366862 - RNA, 22 nt, Bordetella pertussis
gacagcgcucuauucggccaac

SEQ ID NO: 2366863 - RNA, 15 nt, Bordetella pertussis
gacagcgcugguggc

SEQ ID NO: 2366864 - RNA, 15 nt, Bordetella pertussis
gacagcggcgagcgc

SEQ ID NO: 2366865 - RNA, 18 nt, Bordetella pertussis
gacagcggcgagcgcggc

SEQ ID NO: 2366866 - RNA, 15 nt, Bordetella pertussis
gacagcgucgagcug

SEQ ID NO: 2366867 - RNA, 22 nt, Bordetella pertussis
gacagcuugaugggcgaggcga

SEQ ID NO: 2366868 - RNA, 18 nt, Bordetella pertussis
gacaggaacuccggcggc

SEQ ID NO: 2366869 - RNA, 21 nt, Bordetella pertussis
gacaggaaggcgagcgcggca

SEQ ID NO: 2366870 - RNA, 17 nt, Bordetella pertussis
gacaggaugggcgcuug

SEQ ID NO: 2366871 - RNA, 11 nt, Bordetella pertussis
gacaggcacac

SEQ ID NO: 2366872 - RNA, 17 nt, Bordetella pertussis
gacaggcacacccuccu

SEQ ID NO: 2366873 - RNA, 16 nt, Bordetella pertussis
gacaggcacacucugu

SEQ ID NO: 2366874 - RNA, 23 nt, Bordetella pertussis
gacaggcacccccgaccgagcca

SEQ ID NO: 2366875 - RNA, 18 nt, Bordetella pertussis
gacaggcaccccucccug

SEQ ID NO: 2366876 - RNA, 18 nt, Bordetella pertussis
gacaggcacccgcgcgca

SEQ ID NO: 2366877 - RNA, 20 nt, Bordetella pertussis
gacaggcacccgcgcgcagc

SEQ ID NO: 2366878 - RNA, 21 nt, Bordetella pertussis
gacaggcacccgcgcgcagcg

SEQ ID NO: 2366879 - RNA, 19 nt, Bordetella pertussis
gacaggcacccugccgugg

SEQ ID NO: 2366880 - RNA, 14 nt, Bordetella pertussis
gacaggcacccugu

SEQ ID NO: 2366881 - RNA, 21 nt, Bordetella pertussis
gacaggcacccuugccgcagg

SEQ ID NO: 2366882 - RNA, 20 nt, Bordetella pertussis
gacaggcacccuugccgcgg

SEQ ID NO: 2366883 - RNA, 23 nt, Bordetella pertussis
gacaggcacccuuuugccgcagg

SEQ ID NO: 2366884 - RNA, 13 nt, Bordetella pertussis
gacaggcaccgcc

SEQ ID NO: 2366885 - RNA, 14 nt, Bordetella pertussis
gacaggcaccgccg

SEQ ID NO: 2366886 - RNA, 18 nt, Bordetella pertussis
gacaggcaccgccgcaca

SEQ ID NO: 2366887 - RNA, 21 nt, Bordetella pertussis
gacaggcaccugcgguguccc

SEQ ID NO: 2366888 - RNA, 22 nt, Bordetella pertussis
gacaggcaccuuggcccggcgg

SEQ ID NO: 2366889 - RNA, 23 nt, Bordetella pertussis
gacaggcaccuuggcccggcggg

SEQ ID NO: 2366890 - RNA, 16 nt, Bordetella pertussis
gacaggcacgcgccga

SEQ ID NO: 2366891 - RNA, 18 nt, Bordetella pertussis
gacaggcacgcgccgacu

SEQ ID NO: 2366892 - RNA, 12 nt, Bordetella pertussis
gacaggcacucu

SEQ ID NO: 2366893 - RNA, 17 nt, Bordetella pertussis
gacaggcagacgaugcc

SEQ ID NO: 2366894 - RNA, 16 nt, Bordetella pertussis
gacaggccagugccug

SEQ ID NO: 2366895 - RNA, 17 nt, Bordetella pertussis
gacaggcccgcggccgc

SEQ ID NO: 2366896 - RNA, 18 nt, Bordetella pertussis
gacaggcccucggugcgg

SEQ ID NO: 2366897 - RNA, 22 nt, Bordetella pertussis
gacaggcccucggugcggaaga

SEQ ID NO: 2366898 - RNA, 19 nt, Bordetella pertussis
gacaggccgaugcuggucg

SEQ ID NO: 2366899 - RNA, 20 nt, Bordetella pertussis
gacaggccgaugcuggucgc

SEQ ID NO: 2366900 - RNA, 22 nt, Bordetella pertussis
gacaggccgaugcuggucgcca

SEQ ID NO: 2366901 - RNA, 14 nt, Bordetella pertussis
gacaggcgcagcuc

SEQ ID NO: 2366902 - RNA, 12 nt, Bordetella pertussis
gacaggcgcccg

SEQ ID NO: 2366903 - RNA, 21 nt, Bordetella pertussis
gacaggcgcccgugcgcggcg

SEQ ID NO: 2366904 - RNA, 14 nt, Bordetella pertussis
gacaggcgccgcaa

SEQ ID NO: 2366905 - RNA, 19 nt, Bordetella pertussis
gacaggcgccgcaacaggc

SEQ ID NO: 2366906 - RNA, 23 nt, Bordetella pertussis
gacaggcgccgcaacaggcagcu

SEQ ID NO: 2366907 - RNA, 14 nt, Bordetella pertussis
gacaggcgccucgc

SEQ ID NO: 2366908 - RNA, 21 nt, Bordetella pertussis
gacaggcgccucgcgacggcc

SEQ ID NO: 2366909 - RNA, 21 nt, Bordetella pertussis
gacaggcgcgcaggcgggccu

SEQ ID NO: 2366910 - RNA, 14 nt, Bordetella pertussis
gacaggcggugcgc

SEQ ID NO: 2366911 - RNA, 20 nt, Bordetella pertussis
gacaggcggugcgcgcggcc

SEQ ID NO: 2366912 - RNA, 21 nt, Bordetella pertussis
gacaggcggugcgcgcggccg

SEQ ID NO: 2366913 - RNA, 17 nt, Bordetella pertussis
gacaggcgugcgcagcu

SEQ ID NO: 2366914 - RNA, 16 nt, Bordetella pertussis
gacaggcucccgcugg

SEQ ID NO: 2366915 - RNA, 22 nt, Bordetella pertussis
gacaggcucccgcuggcggcac

SEQ ID NO: 2366916 - RNA, 20 nt, Bordetella pertussis
gacaggcucuuuucauuugg

SEQ ID NO: 2366917 - RNA, 23 nt, Bordetella pertussis
gacagggccgcgagcaugcgcag

SEQ ID NO: 2366918 - RNA, 22 nt, Bordetella pertussis
gaccagcgcggccgucaccgcc

SEQ ID NO: 2366919 - RNA, 19 nt, Bordetella pertussis
gaccagcggaucgccgggc

SEQ ID NO: 2366920 - RNA, 23 nt, Bordetella pertussis
gaccagcggaucgccgggcaggc

SEQ ID NO: 2366921 - RNA, 23 nt, Bordetella pertussis
gaccagcggcgugaugcccaggc

SEQ ID NO: 2366922 - RNA, 17 nt, Bordetella pertussis
gaccagcucgacgccau

SEQ ID NO: 2366923 - RNA, 17 nt, Bordetella pertussis
gaccagcuucugcgccu

SEQ ID NO: 2366924 - RNA, 22 nt, Bordetella pertussis
gaccagcuucugcgccugcugg

SEQ ID NO: 2366925 - RNA, 17 nt, Bordetella pertussis
gaccagcuugucgacca

SEQ ID NO: 2366926 - RNA, 20 nt, Bordetella pertussis
gaccaggaccuguacuggcu

SEQ ID NO: 2366927 - RNA, 18 nt, Bordetella pertussis
gaccaggaugaugcagca

SEQ ID NO: 2366928 - RNA, 19 nt, Bordetella pertussis
gaccaggaugaugcagcac

SEQ ID NO: 2366929 - RNA, 20 nt, Bordetella pertussis
gaccaggaugaugcagcaca

SEQ ID NO: 2366930 - RNA, 22 nt, Bordetella pertussis
gaccaggaugaugcagcacacg

SEQ ID NO: 2366931 - RNA, 13 nt, Bordetella pertussis
gaccaggccggcg

SEQ ID NO: 2366932 - RNA, 15 nt, Bordetella pertussis
gaccaggccggcggc

SEQ ID NO: 2366933 - RNA, 17 nt, Bordetella pertussis
gaccaggccggcggcgg

SEQ ID NO: 2366934 - RNA, 14 nt, Bordetella pertussis
gaccaggcgggcau

SEQ ID NO: 2366935 - RNA, 19 nt, Bordetella pertussis
gaccaggcgggcaucgccc

SEQ ID NO: 2366936 - RNA, 22 nt, Bordetella pertussis
gaccaggcgggcaucgcccacc

SEQ ID NO: 2366937 - RNA, 16 nt, Bordetella pertussis
gaccaggcugcgcgcc

SEQ ID NO: 2366938 - RNA, 17 nt, Bordetella pertussis
gaccaggcugcgcgccg

SEQ ID NO: 2366939 - RNA, 21 nt, Bordetella pertussis
gaccaggcuggagucgggcug

SEQ ID NO: 2366940 - RNA, 17 nt, Bordetella pertussis
gaccagggcgccgaccg

SEQ ID NO: 2366941 - RNA, 18 nt, Bordetella pertussis
gaccagggcgccgaccgg

SEQ ID NO: 2366942 - RNA, 21 nt, Bordetella pertussis
gaccagggcggugggcagcgc

SEQ ID NO: 2366943 - RNA, 19 nt, Bordetella pertussis
gaccagguaucgacccagg

SEQ ID NO: 2366944 - RNA, 19 nt, Bordetella pertussis
gaccaggucgccguacucg

SEQ ID NO: 2366945 - RNA, 23 nt, Bordetella pertussis
gaccaggucgccguacucgccgg

SEQ ID NO: 2366946 - RNA, 12 nt, Bordetella pertussis
gaccaggugcgg

SEQ ID NO: 2366947 - RNA, 18 nt, Bordetella pertussis
gaccaggugcgggccgcu

SEQ ID NO: 2366948 - RNA, 19 nt, Bordetella pertussis
gaccaggugcgggccgcuc

SEQ ID NO: 2366949 - RNA, 16 nt, Bordetella pertussis
gaccagucgacccacc

SEQ ID NO: 2366950 - RNA, 20 nt, Bordetella pertussis
gaccagucgacccaccuggc

SEQ ID NO: 2366951 - RNA, 18 nt, Bordetella pertussis
gaccaguucgcgcagcgc

SEQ ID NO: 2366952 - RNA, 20 nt, Bordetella pertussis
gaccaguucgcgcagcgccg

SEQ ID NO: 2366953 - RNA, 16 nt, Bordetella pertussis
gaccaguucggccagc

SEQ ID NO: 2366954 - RNA, 20 nt, Bordetella pertussis
gaccaguucggccagcagcu

SEQ ID NO: 2366955 - RNA, 16 nt, Bordetella pertussis
gaccaucacgagcagg

SEQ ID NO: 2366956 - RNA, 22 nt, Bordetella pertussis
gaccaucaucaacuucaucguc

SEQ ID NO: 2366957 - RNA, 12 nt, Bordetella pertussis
gaccaucgcgca

SEQ ID NO: 2366958 - RNA, 13 nt, Bordetella pertussis
gaccaucgcgcac

SEQ ID NO: 2366959 - RNA, 14 nt, Bordetella pertussis
gaccaugccggccu

SEQ ID NO: 2366960 - RNA, 14 nt, Bordetella pertussis
gaccaugcgcaccg

SEQ ID NO: 2366961 - RNA, 13 nt, Bordetella pertussis
gaccaugcgcugg

SEQ ID NO: 2366962 - RNA, 21 nt, Bordetella pertussis
gaccaugcgcugggcaugggc

SEQ ID NO: 2366963 - RNA, 14 nt, Bordetella pertussis
gaccaugcggccgu

SEQ ID NO: 2366964 - RNA, 17 nt, Bordetella pertussis
gaccauguccgcgccca

SEQ ID NO: 2366965 - RNA, 20 nt, Bordetella pertussis
gaccauguggcagauggcgg

SEQ ID NO: 2366966 - RNA, 20 nt, Bordetella pertussis
gaccauuucgauuucggcgg

SEQ ID NO: 2366967 - RNA, 22 nt, Bordetella pertussis
gaccauuucgauuucggcggcc

SEQ ID NO: 2366968 - RNA, 22 nt, Bordetella pertussis
gacccacagguuggccgcgacg

SEQ ID NO: 2366969 - RNA, 18 nt, Bordetella pertussis
gacccacuugagcagcgc

SEQ ID NO: 2366970 - RNA, 20 nt, Bordetella pertussis
gacccagaacccggccggcg

SEQ ID NO: 2366971 - RNA, 22 nt, Bordetella pertussis
gacccagaacccggccggcgcc

SEQ ID NO: 2366972 - RNA, 22 nt, Bordetella pertussis
gacccagcaccgagcugccgcc

SEQ ID NO: 2366973 - RNA, 15 nt, Bordetella pertussis
gacccaggccggcgc

SEQ ID NO: 2366974 - RNA, 19 nt, Bordetella pertussis
gacccaggccggcgccagc

SEQ ID NO: 2366975 - RNA, 22 nt, Bordetella pertussis
gacccagucgcaguucggccuc

SEQ ID NO: 2366976 - RNA, 17 nt, Bordetella pertussis
gacccaguucggccgcc

SEQ ID NO: 2366977 - RNA, 21 nt, Bordetella pertussis
gacccaguucggccgccaggu

SEQ ID NO: 2366978 - RNA, 21 nt, Bordetella pertussis
gacccauaccagcccggcgcg

SEQ ID NO: 2366979 - RNA, 13 nt, Bordetella pertussis
gacccccggcccg

SEQ ID NO: 2366980 - RNA, 17 nt, Bordetella pertussis
gacccccggcccgcgcc

SEQ ID NO: 2366981 - RNA, 23 nt, Bordetella pertussis
gaccccgaagcacagaugcacca

SEQ ID NO: 2366982 - RNA, 22 nt, Bordetella pertussis
gaccccgccgugccgggccugg

SEQ ID NO: 2366983 - RNA, 23 nt, Bordetella pertussis
gaccccgccgugccgggccuggu

SEQ ID NO: 2366984 - RNA, 17 nt, Bordetella pertussis
gaccccgucgaccgcgg

SEQ ID NO: 2366985 - RNA, 21 nt, Bordetella pertussis
gaccccguggucgccagcacg

SEQ ID NO: 2366986 - RNA, 23 nt, Bordetella pertussis
gaccccguggucgccagcacgcg

SEQ ID NO: 2366987 - RNA, 14 nt, Bordetella pertussis
gacccgaaccgauu

SEQ ID NO: 2366988 - RNA, 14 nt, Bordetella pertussis
gacccgaaggcgcg

SEQ ID NO: 2366989 - RNA, 15 nt, Bordetella pertussis
gacccgaaggcgcgg

SEQ ID NO: 2366990 - RNA, 17 nt, Bordetella pertussis
gacccgaaggcgcggcc

SEQ ID NO: 2366991 - RNA, 22 nt, Bordetella pertussis
gacccgaaggcgcggccgggcu

SEQ ID NO: 2366992 - RNA, 22 nt, Bordetella pertussis
gacccgauagccgcgcgccugc

SEQ ID NO: 2366993 - RNA, 13 nt, Bordetella pertussis
gacccgaugcgcc

SEQ ID NO: 2366994 - RNA, 20 nt, Bordetella pertussis
gacccgcaaaaccgggcccg

SEQ ID NO: 2366995 - RNA, 21 nt, Bordetella pertussis
gacccgcaaaaccgggcccgg

SEQ ID NO: 2366996 - RNA, 16 nt, Bordetella pertussis
gacccgcgcccagcug

SEQ ID NO: 2366997 - RNA, 17 nt, Bordetella pertussis
gacccgcgccgcaggcc

SEQ ID NO: 2366998 - RNA, 15 nt, Bordetella pertussis
gacccgcgccucggc

SEQ ID NO: 2366999 - RNA, 12 nt, Bordetella pertussis
gacccgcggccc

SEQ ID NO: 2367000 - RNA, 17 nt, Bordetella pertussis
gacccgcggcccuugcg

SEQ ID NO: 2367001 - RNA, 19 nt, Bordetella pertussis
gacccgcggcccuugcgcg

SEQ ID NO: 2367002 - RNA, 19 nt, Bordetella pertussis
gacccgcucgaccuugucg

SEQ ID NO: 2367003 - RNA, 14 nt, Bordetella pertussis
gacccgcucggcca

SEQ ID NO: 2367004 - RNA, 23 nt, Bordetella pertussis
gacccgcucggccacgcgcaacg

SEQ ID NO: 2367005 - RNA, 15 nt, Bordetella pertussis
gacccgcuggcuggc

SEQ ID NO: 2367006 - RNA, 16 nt, Bordetella pertussis
gacccggacaacgcgc

SEQ ID NO: 2367007 - RNA, 21 nt, Bordetella pertussis
gacccggacaacgcgcgccac

SEQ ID NO: 2367008 - RNA, 21 nt, Bordetella pertussis
gacccggaugccaccucgcuu

SEQ ID NO: 2367009 - RNA, 14 nt, Bordetella pertussis
gacccgggccgcug

SEQ ID NO: 2367010 - RNA, 16 nt, Bordetella pertussis
gacccgggccgcuggc

SEQ ID NO: 2367011 - RNA, 17 nt, Bordetella pertussis
gacccgggccgcuggcc

SEQ ID NO: 2367012 - RNA, 19 nt, Bordetella pertussis
gacccgggccgcuggcccg

SEQ ID NO: 2367013 - RNA, 23 nt, Bordetella pertussis
gacccggggcaggaagccggccc

SEQ ID NO: 2367014 - RNA, 19 nt, Bordetella pertussis
gacccguggcccgggugcc

SEQ ID NO: 2367015 - RNA, 20 nt, Bordetella pertussis
gacccguggcccgggugccu

SEQ ID NO: 2367016 - RNA, 15 nt, Bordetella pertussis
gacccguuugcgcag

SEQ ID NO: 2367017 - RNA, 17 nt, Bordetella pertussis
gacccguuugcgcagcu

SEQ ID NO: 2367018 - RNA, 18 nt, Bordetella pertussis
gacccguuugcgcagcuc

SEQ ID NO: 2367019 - RNA, 12 nt, Bordetella pertussis
gacccuccucgc

SEQ ID NO: 2367020 - RNA, 22 nt, Bordetella pertussis
gacccuccucgcuuuaccagcu

SEQ ID NO: 2367021 - RNA, 23 nt, Bordetella pertussis
gacccuccucgcuuuaccagcug

SEQ ID NO: 2367022 - RNA, 12 nt, Bordetella pertussis
gacccugcccgg

SEQ ID NO: 2367023 - RNA, 14 nt, Bordetella pertussis
gacccugcccggca

SEQ ID NO: 2367024 - RNA, 14 nt, Bordetella pertussis
gacccugcgcaccc

SEQ ID NO: 2367025 - RNA, 19 nt, Bordetella pertussis
gacccugcgcacccgccug

SEQ ID NO: 2367026 - RNA, 16 nt, Bordetella pertussis
gacccuggccgaacgc

SEQ ID NO: 2367027 - RNA, 22 nt, Bordetella pertussis
gacccuggccgaacgccgccgc

SEQ ID NO: 2367028 - RNA, 12 nt, Bordetella pertussis
gacccuggcgcg

SEQ ID NO: 2367029 - RNA, 13 nt, Bordetella pertussis
gacccuggcgcgc

SEQ ID NO: 2367030 - RNA, 21 nt, Bordetella pertussis
gaccgggucgucgggcggcgc

SEQ ID NO: 2367031 - RNA, 20 nt, Bordetella pertussis
gaccggguugcccggcaggc

SEQ ID NO: 2367032 - RNA, 23 nt, Bordetella pertussis
gaccggguugcccggcaggcaca

SEQ ID NO: 2367033 - RNA, 17 nt, Bordetella pertussis
gaccguagcgcaggcgc

SEQ ID NO: 2367034 - RNA, 19 nt, Bordetella pertussis
gaccgucagcaugccguug

SEQ ID NO: 2367035 - RNA, 19 nt, Bordetella pertussis
gaccguccauggcgugcca

SEQ ID NO: 2367036 - RNA, 14 nt, Bordetella pertussis
gaccgugccgccga

SEQ ID NO: 2367037 - RNA, 16 nt, Bordetella pertussis
gaccgugccgccgagg

SEQ ID NO: 2367038 - RNA, 21 nt, Bordetella pertussis
gaccguuaucugcguuuucug

SEQ ID NO: 2367039 - RNA, 14 nt, Bordetella pertussis
gaccuccaggccca

SEQ ID NO: 2367040 - RNA, 19 nt, Bordetella pertussis
gaccuccaggcccaggcga

SEQ ID NO: 2367041 - RNA, 19 nt, Bordetella pertussis
gaccuccggcaacagcagg

SEQ ID NO: 2367042 - RNA, 14 nt, Bordetella pertussis
gaccuccugguccg

SEQ ID NO: 2367043 - RNA, 22 nt, Bordetella pertussis
gaccuccugguccgugaagccg

SEQ ID NO: 2367044 - RNA, 13 nt, Bordetella pertussis
gaccucgcccagg

SEQ ID NO: 2367045 - RNA, 17 nt, Bordetella pertussis
gaccucgcccaggccgg

SEQ ID NO: 2367046 - RNA, 21 nt, Bordetella pertussis
gaccucgcgccggucacgcug

SEQ ID NO: 2367047 - RNA, 20 nt, Bordetella pertussis
gaccucgcgcugcagcauga

SEQ ID NO: 2367048 - RNA, 24 nt, Bordetella pertussis
gaccucggcggcgucgcuggcagc

SEQ ID NO: 2367049 - RNA, 17 nt, Bordetella pertussis
gaccucuucguugucgc

SEQ ID NO: 2367050 - RNA, 24 nt, Bordetella pertussis
gaccugaauccguaagcgcuggac

SEQ ID NO: 2367051 - RNA, 16 nt, Bordetella pertussis
gaccugacccccgaac

SEQ ID NO: 2367052 - RNA, 19 nt, Bordetella pertussis
gaccugacccccgaacugg

SEQ ID NO: 2367053 - RNA, 21 nt, Bordetella pertussis
gaccugacccccgaacugggc

SEQ ID NO: 2367054 - RNA, 21 nt, Bordetella pertussis
gaccugagccaggcgcccggc

SEQ ID NO: 2367055 - RNA, 13 nt, Bordetella pertussis
gaccugaucgcgc

SEQ ID NO: 2367056 - RNA, 17 nt, Bordetella pertussis
gaccugaucgcgcagcg

SEQ ID NO: 2367057 - RNA, 18 nt, Bordetella pertussis
gaccugaucgcgcagcgc

SEQ ID NO: 2367058 - RNA, 23 nt, Bordetella pertussis
gaccugaucgcgcagcgccuggc

SEQ ID NO: 2367059 - RNA, 15 nt, Bordetella pertussis
gaccugcaaccccac

SEQ ID NO: 2367060 - RNA, 20 nt, Bordetella pertussis
gaccugcaaccccaccggca

SEQ ID NO: 2367061 - RNA, 19 nt, Bordetella pertussis
gaccugcacgauggcgccg

SEQ ID NO: 2367062 - RNA, 21 nt, Bordetella pertussis
gaccugcacgauggcgccggc

SEQ ID NO: 2367063 - RNA, 22 nt, Bordetella pertussis
gaccugcacgauggcgccggcu

SEQ ID NO: 2367064 - RNA, 21 nt, Bordetella pertussis
gaccugcccgagaccgcccgc

SEQ ID NO: 2367065 - RNA, 18 nt, Bordetella pertussis
gaccugccgcccgagcug

SEQ ID NO: 2367066 - RNA, 22 nt, Bordetella pertussis
gaccugccgcccgagcuggccg

SEQ ID NO: 2367067 - RNA, 19 nt, Bordetella pertussis
gaccugccguucgcgcugc

SEQ ID NO: 2367068 - RNA, 14 nt, Bordetella pertussis
gaccugcgacagca

SEQ ID NO: 2367069 - RNA, 15 nt, Bordetella pertussis
gaccugcgacagcac

SEQ ID NO: 2367070 - RNA, 21 nt, Bordetella pertussis
gaccugcgcaccggccggccg

SEQ ID NO: 2367071 - RNA, 14 nt, Bordetella pertussis
gaccugcgccaggu

SEQ ID NO: 2367072 - RNA, 22 nt, Bordetella pertussis
gaccugcgccaggugcuugcgg

SEQ ID NO: 2367073 - RNA, 16 nt, Bordetella pertussis
gaccugcgcgaagcgc

SEQ ID NO: 2367074 - RNA, 17 nt, Bordetella pertussis
gaccugcgcgaccgccg

SEQ ID NO: 2367075 - RNA, 15 nt, Bordetella pertussis
gaccugcgcgccggc

SEQ ID NO: 2367076 - RNA, 15 nt, Bordetella pertussis
gaccugcgggccgca

SEQ ID NO: 2367077 - RNA, 13 nt, Bordetella pertussis
gaccugcgggcgc

SEQ ID NO: 2367078 - RNA, 21 nt, Bordetella pertussis
gaccugcgggcgcagcgccgc

SEQ ID NO: 2367079 - RNA, 16 nt, Bordetella pertussis
gaccugcucgagcggc

SEQ ID NO: 2367080 - RNA, 17 nt, Bordetella pertussis
gaccugcucgagcggcg

SEQ ID NO: 2367081 - RNA, 22 nt, Bordetella pertussis
gaccugcucgagcggcggaaug

SEQ ID NO: 2367082 - RNA, 18 nt, Bordetella pertussis
gaccugcucgucgccaug

SEQ ID NO: 2367083 - RNA, 22 nt, Bordetella pertussis
gaccugcucgucgccaugcggc

SEQ ID NO: 2367084 - RNA, 10 nt, Bordetella pertussis
gaccugcugg

SEQ ID NO: 2367085 - RNA, 13 nt, Bordetella pertussis
gaccugcuggcgc

SEQ ID NO: 2367086 - RNA, 14 nt, Bordetella pertussis
gaccugcuggcgcg

SEQ ID NO: 2367087 - RNA, 17 nt, Bordetella pertussis
gaccugcuguucaccuu

SEQ ID NO: 2367088 - RNA, 11 nt, Bordetella pertussis
gaccugcuuga

SEQ ID NO: 2367089 - RNA, 11 nt, Bordetella pertussis
gaccugcuugc

SEQ ID NO: 2367090 - RNA, 14 nt, Bordetella pertussis
gaccugcuugccca

SEQ ID NO: 2367091 - RNA, 16 nt, Bordetella pertussis
gaccugcuugcccagc

SEQ ID NO: 2367092 - RNA, 17 nt, Bordetella pertussis
gaccugcuugcccagca

SEQ ID NO: 2367093 - RNA, 18 nt, Bordetella pertussis
gaccuggacgagggccgc

SEQ ID NO: 2367094 - RNA, 18 nt, Bordetella pertussis
gaccuggaucacgugcca

SEQ ID NO: 2367095 - RNA, 20 nt, Bordetella pertussis
gaccuggcgcccgacggcgc

SEQ ID NO: 2367096 - RNA, 14 nt, Bordetella pertussis
gaccuggcgcgcga

SEQ ID NO: 2367097 - RNA, 16 nt, Bordetella pertussis
gaccugggccagcagg

SEQ ID NO: 2367098 - RNA, 16 nt, Bordetella pertussis
gaccugggccugguac

SEQ ID NO: 2367099 - RNA, 19 nt, Bordetella pertussis
gaccuggggguucgugggc

SEQ ID NO: 2367100 - RNA, 20 nt, Bordetella pertussis
gaccuggucgaucagccccu

SEQ ID NO: 2367101 - RNA, 15 nt, Bordetella pertussis
gaccuggucggccuu

SEQ ID NO: 2367102 - RNA, 17 nt, Bordetella pertussis
gaccuggucggccuuca

SEQ ID NO: 2367103 - RNA, 21 nt, Bordetella pertussis
gaccuggugcaccacgcgcuc

SEQ ID NO: 2367104 - RNA, 19 nt, Bordetella pertussis
gaccuggugugccuguccc

SEQ ID NO: 2367105 - RNA, 17 nt, Bordetella pertussis
gaccuguacuggcuggu

SEQ ID NO: 2367106 - RNA, 15 nt, Bordetella pertussis
gaccuguggcgcacc

SEQ ID NO: 2367107 - RNA, 21 nt, Bordetella pertussis
gaccuguggcgcacccugcag

SEQ ID NO: 2367108 - RNA, 23 nt, Bordetella pertussis
gaccuuacggauaauugggcggc

SEQ ID NO: 2367109 - RNA, 22 nt, Bordetella pertussis
gaccuucggccaaucggccugc

SEQ ID NO: 2367110 - RNA, 22 nt, Bordetella pertussis
gaccuugagaugccagcggcgc

SEQ ID NO: 2367111 - RNA, 20 nt, Bordetella pertussis
gaccuugagcacgcuggcgu

SEQ ID NO: 2367112 - RNA, 15 nt, Bordetella pertussis
gaccuugcgaggccc

SEQ ID NO: 2367113 - RNA, 15 nt, Bordetella pertussis
gaccuugcuggaccg

SEQ ID NO: 2367114 - RNA, 23 nt, Bordetella pertussis
gaccuugcuggaccgcgccuggg

SEQ ID NO: 2367115 - RNA, 13 nt, Bordetella pertussis
gaccuuggcggcu

SEQ ID NO: 2367116 - RNA, 18 nt, Bordetella pertussis
gaccuuggcggcuggcgc

SEQ ID NO: 2367117 - RNA, 21 nt, Bordetella pertussis
gaccuuggcggcuggcgcggc

SEQ ID NO: 2367118 - RNA, 20 nt, Bordetella pertussis
gaccuuggcuugcagcgccu

SEQ ID NO: 2367119 - RNA, 14 nt, Bordetella pertussis
gaccuugggaugca

SEQ ID NO: 2367120 - RNA, 13 nt, Bordetella pertussis
gaccuugugcggc

SEQ ID NO: 2367121 - RNA, 17 nt, Bordetella pertussis
gacgaaacccgggccgu

SEQ ID NO: 2367122 - RNA, 18 nt, Bordetella pertussis
gacgaaagcggcaaagcc

SEQ ID NO: 2367123 - RNA, 21 nt, Bordetella pertussis
gacgaaauagccgaccacccg

SEQ ID NO: 2367124 - RNA, 21 nt, Bordetella pertussis
gacgaaaugcgugacacggcc

SEQ ID NO: 2367125 - RNA, 22 nt, Bordetella pertussis
gacgaaaugcgugacacggcca

SEQ ID NO: 2367126 - RNA, 13 nt, Bordetella pertussis
gacgaacaacacg

SEQ ID NO: 2367127 - RNA, 16 nt, Bordetella pertussis
gacgaacaaggccgga

SEQ ID NO: 2367128 - RNA, 15 nt, Bordetella pertussis
gacgaacaggccgcc

SEQ ID NO: 2367129 - RNA, 19 nt, Bordetella pertussis
gacgaacugaucggcaagg

SEQ ID NO: 2367130 - RNA, 17 nt, Bordetella pertussis
gacgaagaacaccauca

SEQ ID NO: 2367131 - RNA, 19 nt, Bordetella pertussis
gacgaagccggaaccgcga

SEQ ID NO: 2367132 - RNA, 15 nt, Bordetella pertussis
gacgaaggcgccggc

SEQ ID NO: 2367133 - RNA, 22 nt, Bordetella pertussis
gacgaagguuucguagccgccg

SEQ ID NO: 2367134 - RNA, 16 nt, Bordetella pertussis
gacgaauacgcuggcg

SEQ ID NO: 2367135 - RNA, 18 nt, Bordetella pertussis
gacgaauacgcuggcgcg

SEQ ID NO: 2367136 - RNA, 18 nt, Bordetella pertussis
gacgaauggguccgcgug

SEQ ID NO: 2367137 - RNA, 18 nt, Bordetella pertussis
gacgaauuucucggccag

SEQ ID NO: 2367138 - RNA, 22 nt, Bordetella pertussis
gacgacaaacccgacgaugauc

SEQ ID NO: 2367139 - RNA, 13 nt, Bordetella pertussis
gacgacagcggcg

SEQ ID NO: 2367140 - RNA, 19 nt, Bordetella pertussis
gacgacagcggcgagcgcg

SEQ ID NO: 2367141 - RNA, 22 nt, Bordetella pertussis
gacgaccaacucgaggcggcgc

SEQ ID NO: 2367142 - RNA, 17 nt, Bordetella pertussis
gacgccgaacacaucga

SEQ ID NO: 2367143 - RNA, 21 nt, Bordetella pertussis
gacgccgaacacaucgagggc

SEQ ID NO: 2367144 - RNA, 22 nt, Bordetella pertussis
gacgccgaacacaucgagggcg

SEQ ID NO: 2367145 - RNA, 13 nt, Bordetella pertussis
gacgccgaccgcg

SEQ ID NO: 2367146 - RNA, 15 nt, Bordetella pertussis
gacgccgaccucggc

SEQ ID NO: 2367147 - RNA, 19 nt, Bordetella pertussis
gacgccgaccucggcaccg

SEQ ID NO: 2367148 - RNA, 18 nt, Bordetella pertussis
gacgccgacgaugccggu

SEQ ID NO: 2367149 - RNA, 22 nt, Bordetella pertussis
gacgccgacgaugccggucucc

SEQ ID NO: 2367150 - RNA, 17 nt, Bordetella pertussis
gacgccgccacgcuggc

SEQ ID NO: 2367151 - RNA, 19 nt, Bordetella pertussis
gacgccgccacgcuggccg

SEQ ID NO: 2367152 - RNA, 19 nt, Bordetella pertussis
gacgccgccgaacggggcc

SEQ ID NO: 2367153 - RNA, 18 nt, Bordetella pertussis
gacgccgccgauggcgcc

SEQ ID NO: 2367154 - RNA, 14 nt, Bordetella pertussis
gacgccgccggccc

SEQ ID NO: 2367155 - RNA, 21 nt, Bordetella pertussis
gacgccgcgacacaaggcggc

SEQ ID NO: 2367156 - RNA, 22 nt, Bordetella pertussis
gacgccgcgccgcuacagcguc

SEQ ID NO: 2367157 - RNA, 16 nt, Bordetella pertussis
gacgccgcgcgcgacg

SEQ ID NO: 2367158 - RNA, 15 nt, Bordetella pertussis
gacgccgcggugcug

SEQ ID NO: 2367159 - RNA, 21 nt, Bordetella pertussis
gacgccggcgaaugccggccg

SEQ ID NO: 2367160 - RNA, 13 nt, Bordetella pertussis
gacgccggcgccg

SEQ ID NO: 2367161 - RNA, 16 nt, Bordetella pertussis
gacgccggcgccggcg

SEQ ID NO: 2367162 - RNA, 22 nt, Bordetella pertussis
gacgccggcgccggcgacgccg

SEQ ID NO: 2367163 - RNA, 14 nt, Bordetella pertussis
gacgccggcgggca

SEQ ID NO: 2367164 - RNA, 18 nt, Bordetella pertussis
gacgccggcgggcaggcg

SEQ ID NO: 2367165 - RNA, 16 nt, Bordetella pertussis
gacgccggcucaggcc

SEQ ID NO: 2367166 - RNA, 20 nt, Bordetella pertussis
gacgccggcucaggccagcg

SEQ ID NO: 2367167 - RNA, 12 nt, Bordetella pertussis
gacgccgggacg

SEQ ID NO: 2367168 - RNA, 20 nt, Bordetella pertussis
gacgccgggcgcggcccggc

SEQ ID NO: 2367169 - RNA, 13 nt, Bordetella pertussis
gacgccgucgacc

SEQ ID NO: 2367170 - RNA, 16 nt, Bordetella pertussis
gacgccgugcugaucg

SEQ ID NO: 2367171 - RNA, 23 nt, Bordetella pertussis
gacgccgugguggucacguucga

SEQ ID NO: 2367172 - RNA, 14 nt, Bordetella pertussis
gacgccuggcgcgg

SEQ ID NO: 2367173 - RNA, 15 nt, Bordetella pertussis
gacgccuggcgcggc

SEQ ID NO: 2367174 - RNA, 16 nt, Bordetella pertussis
gacgcgaagaucccgc

SEQ ID NO: 2367175 - RNA, 17 nt, Bordetella pertussis
gacgcgaagaucccgcc

SEQ ID NO: 2367176 - RNA, 23 nt, Bordetella pertussis
gacgcgagaccaugacgucgacg

SEQ ID NO: 2367177 - RNA, 20 nt, Bordetella pertussis
gacgcgaugcccgcgcacca

SEQ ID NO: 2367178 - RNA, 19 nt, Bordetella pertussis
gacgcgauguccagcucca

SEQ ID NO: 2367179 - RNA, 18 nt, Bordetella pertussis
gacgcgcaagcggcccca

SEQ ID NO: 2367180 - RNA, 13 nt, Bordetella pertussis
gacgcgcagcggc

SEQ ID NO: 2367181 - RNA, 16 nt, Bordetella pertussis
gacgcgcagcggcagg

SEQ ID NO: 2367182 - RNA, 17 nt, Bordetella pertussis
gacgcgcagcggcaggc

SEQ ID NO: 2367183 - RNA, 19 nt, Bordetella pertussis
gacgcgcagcggcaggccc

SEQ ID NO: 2367184 - RNA, 22 nt, Bordetella pertussis
gacgcgcagcggcaggcccugc

SEQ ID NO: 2367185 - RNA, 20 nt, Bordetella pertussis
gacgcgcaggccauugcugg

SEQ ID NO: 2367186 - RNA, 20 nt, Bordetella pertussis
gacgcgcauuucgaccugcg

SEQ ID NO: 2367187 - RNA, 22 nt, Bordetella pertussis
gacgcgcauuucgaccugcgca

SEQ ID NO: 2367188 - RNA, 20 nt, Bordetella pertussis
gacgcgcccucaguccagcu

SEQ ID NO: 2367189 - RNA, 19 nt, Bordetella pertussis
gacgcgccgaacaccagcu

SEQ ID NO: 2367190 - RNA, 14 nt, Bordetella pertussis
gacgcgccgcgccu

SEQ ID NO: 2367191 - RNA, 15 nt, Bordetella pertussis
gacgcgccggaugcg

SEQ ID NO: 2367192 - RNA, 17 nt, Bordetella pertussis
gacgcgccggaugcgcg

SEQ ID NO: 2367193 - RNA, 15 nt, Bordetella pertussis
gacgcgccgggccac

SEQ ID NO: 2367194 - RNA, 18 nt, Bordetella pertussis
gacgcgccgggcgaaccg

SEQ ID NO: 2367195 - RNA, 23 nt, Bordetella pertussis
gacgcgccgggcgaaccgguggc

SEQ ID NO: 2367196 - RNA, 14 nt, Bordetella pertussis
gacgcgccugcgcg

SEQ ID NO: 2367197 - RNA, 15 nt, Bordetella pertussis
gacgcgccugcgcgc

SEQ ID NO: 2367198 - RNA, 16 nt, Bordetella pertussis
gacgcgccugcgcgcg

SEQ ID NO: 2367199 - RNA, 17 nt, Bordetella pertussis
gacgcgccugcgcgcgg

SEQ ID NO: 2367200 - RNA, 13 nt, Bordetella pertussis
gacgcgcgccgca

SEQ ID NO: 2367201 - RNA, 15 nt, Bordetella pertussis
gacgcgcgccggcgc

SEQ ID NO: 2367202 - RNA, 16 nt, Bordetella pertussis
gacgcgcgccggcgcu

SEQ ID NO: 2367203 - RNA, 20 nt, Bordetella pertussis
gacgcgcggguccaggcccg

SEQ ID NO: 2367204 - RNA, 15 nt, Bordetella pertussis
gacgcgcucaggcgg

SEQ ID NO: 2367205 - RNA, 18 nt, Bordetella pertussis
gacgcgcucaggcgguga

SEQ ID NO: 2367206 - RNA, 16 nt, Bordetella pertussis
gacgcgcucgccgucg

SEQ ID NO: 2367207 - RNA, 17 nt, Bordetella pertussis
gacgcgcucgccgucga

SEQ ID NO: 2367208 - RNA, 18 nt, Bordetella pertussis
gacgcgcucgcgcgcgug

SEQ ID NO: 2367209 - RNA, 19 nt, Bordetella pertussis
gacgcgcucgcgcgcgugc

SEQ ID NO: 2367210 - RNA, 19 nt, Bordetella pertussis
gacgcgcugaugcgcggcg

SEQ ID NO: 2367211 - RNA, 20 nt, Bordetella pertussis
gacgcgcugaugcgcggcgg

SEQ ID NO: 2367212 - RNA, 12 nt, Bordetella pertussis
gacgcgcuggcc

SEQ ID NO: 2367213 - RNA, 14 nt, Bordetella pertussis
gacgcgcuggccga

SEQ ID NO: 2367214 - RNA, 15 nt, Bordetella pertussis
gacgcgcuggccgac

SEQ ID NO: 2367215 - RNA, 20 nt, Bordetella pertussis
gacgcgcuggccgacaagga

SEQ ID NO: 2367216 - RNA, 14 nt, Bordetella pertussis
gacgcgcugguccg

SEQ ID NO: 2367217 - RNA, 18 nt, Bordetella pertussis
gacgcgcuguaggcgccg

SEQ ID NO: 2367218 - RNA, 14 nt, Bordetella pertussis
gacgcgcuuccagg

SEQ ID NO: 2367219 - RNA, 16 nt, Bordetella pertussis
gacgcggacuucgccc

SEQ ID NO: 2367220 - RNA, 13 nt, Bordetella pertussis
gacgcggccagcg

SEQ ID NO: 2367221 - RNA, 17 nt, Bordetella pertussis
gacgcggccagcggcgc

SEQ ID NO: 2367222 - RNA, 14 nt, Bordetella pertussis
gacgcggccgaccc

SEQ ID NO: 2367223 - RNA, 12 nt, Bordetella pertussis
gacgcggccggc

SEQ ID NO: 2367224 - RNA, 13 nt, Bordetella pertussis
gacgcggccggca

SEQ ID NO: 2367225 - RNA, 21 nt, Bordetella pertussis
gacgcggccguggaggcggcg

SEQ ID NO: 2367226 - RNA, 12 nt, Bordetella pertussis
gacgcggcggcc

SEQ ID NO: 2367227 - RNA, 13 nt, Bordetella pertussis
gacgcggcggccg

SEQ ID NO: 2367228 - RNA, 15 nt, Bordetella pertussis
gacgcggcggccggu

SEQ ID NO: 2367229 - RNA, 22 nt, Bordetella pertussis
gacgcggcguacuggcgcggcg

SEQ ID NO: 2367230 - RNA, 12 nt, Bordetella pertussis
gacgcgggccac

SEQ ID NO: 2367231 - RNA, 17 nt, Bordetella pertussis
gacgcgggccacgcgcc

SEQ ID NO: 2367232 - RNA, 12 nt, Bordetella pertussis
gacgcggggaca

SEQ ID NO: 2367233 - RNA, 17 nt, Bordetella pertussis
gacgcggggacaggcac

SEQ ID NO: 2367234 - RNA, 22 nt, Bordetella pertussis
gacgcggggauggcuuccugcg

SEQ ID NO: 2367235 - RNA, 23 nt, Bordetella pertussis
gacgcggggauggcuuccugcgg

SEQ ID NO: 2367236 - RNA, 16 nt, Bordetella pertussis
gacgcggucgcccaac

SEQ ID NO: 2367237 - RNA, 23 nt, Bordetella pertussis
gacgcggucgcccaacccggcga

SEQ ID NO: 2367238 - RNA, 14 nt, Bordetella pertussis
gacgcguagccgau

SEQ ID NO: 2367239 - RNA, 19 nt, Bordetella pertussis
gacgcguccucggccagcc

SEQ ID NO: 2367240 - RNA, 17 nt, Bordetella pertussis
gacgcguucucgcgcuu

SEQ ID NO: 2367241 - RNA, 20 nt, Bordetella pertussis
gacgcguuguucgggccggc

SEQ ID NO: 2367242 - RNA, 15 nt, Bordetella pertussis
gacgcuacagcguca

SEQ ID NO: 2367243 - RNA, 18 nt, Bordetella pertussis
gacgcucauccaggcgcg

SEQ ID NO: 2367244 - RNA, 20 nt, Bordetella pertussis
gacgcucgagguaggcggga

SEQ ID NO: 2367245 - RNA, 17 nt, Bordetella pertussis
gacgcugacccuggccg

SEQ ID NO: 2367246 - RNA, 17 nt, Bordetella pertussis
gacgcugacugcggugc

SEQ ID NO: 2367247 - RNA, 18 nt, Bordetella pertussis
gacgcugacugcggugcc

SEQ ID NO: 2367248 - RNA, 16 nt, Bordetella pertussis
gacgcugaucggccga

SEQ ID NO: 2367249 - RNA, 17 nt, Bordetella pertussis
gacgcugaucggccgac

SEQ ID NO: 2367250 - RNA, 15 nt, Bordetella pertussis
gacgcugaucucggc

SEQ ID NO: 2367251 - RNA, 22 nt, Bordetella pertussis
gacgcugaucucggccugcccg

SEQ ID NO: 2367252 - RNA, 21 nt, Bordetella pertussis
gacgcugaugcccagcccggc

SEQ ID NO: 2367253 - RNA, 15 nt, Bordetella pertussis
gacgcugauggccgc

SEQ ID NO: 2367254 - RNA, 16 nt, Bordetella pertussis
gacgcugauggccgcc

SEQ ID NO: 2367255 - RNA, 13 nt, Bordetella pertussis
gacgggcgcacag

SEQ ID NO: 2367256 - RNA, 12 nt, Bordetella pertussis
gacgggcgcccg

SEQ ID NO: 2367257 - RNA, 13 nt, Bordetella pertussis
gacgggcggcggc

SEQ ID NO: 2367258 - RNA, 14 nt, Bordetella pertussis
gacgggcggcggcg

SEQ ID NO: 2367259 - RNA, 15 nt, Bordetella pertussis
gacgggcggcggcgc

SEQ ID NO: 2367260 - RNA, 18 nt, Bordetella pertussis
gacgggcggcggcgcgcg

SEQ ID NO: 2367261 - RNA, 13 nt, Bordetella pertussis
gacgggcugggcc

SEQ ID NO: 2367262 - RNA, 15 nt, Bordetella pertussis
gacggggaacaggcg

SEQ ID NO: 2367263 - RNA, 20 nt, Bordetella pertussis
gacggggaacaggcgcgcca

SEQ ID NO: 2367264 - RNA, 13 nt, Bordetella pertussis
gacggggacaggc

SEQ ID NO: 2367265 - RNA, 15 nt, Bordetella pertussis
gacggggacgccggc

SEQ ID NO: 2367266 - RNA, 23 nt, Bordetella pertussis
gacggggacgccggcgggcaggc

SEQ ID NO: 2367267 - RNA, 14 nt, Bordetella pertussis
gacggggcggcgcc

SEQ ID NO: 2367268 - RNA, 14 nt, Bordetella pertussis
gacggggugccugu

SEQ ID NO: 2367269 - RNA, 19 nt, Bordetella pertussis
gacggggugccuguccccg

SEQ ID NO: 2367270 - RNA, 19 nt, Bordetella pertussis
gacggggugccugucccug

SEQ ID NO: 2367271 - RNA, 15 nt, Bordetella pertussis
gacgguaauccaguu

SEQ ID NO: 2367272 - RNA, 16 nt, Bordetella pertussis
gacgguacaccugacg

SEQ ID NO: 2367273 - RNA, 18 nt, Bordetella pertussis
gacgguacaccugacgcg

SEQ ID NO: 2367274 - RNA, 23 nt, Bordetella pertussis
gacgguagccgggucuggccggc

SEQ ID NO: 2367275 - RNA, 15 nt, Bordetella pertussis
gacgguagcgcacgc

SEQ ID NO: 2367276 - RNA, 22 nt, Bordetella pertussis
gacgguagcgcacgcaccgcgc

SEQ ID NO: 2367277 - RNA, 23 nt, Bordetella pertussis
gacgguagcgcacgcaccgcgcc

SEQ ID NO: 2367278 - RNA, 19 nt, Bordetella pertussis
gacgguaucucagcgcgcc

SEQ ID NO: 2367279 - RNA, 20 nt, Bordetella pertussis
gacgguaucucagcgcgccg

SEQ ID NO: 2367280 - RNA, 24 nt, Bordetella pertussis
gacgguaucucagcgcgccgcgcc

SEQ ID NO: 2367281 - RNA, 16 nt, Bordetella pertussis
gacgguaucugucccg

SEQ ID NO: 2367282 - RNA, 21 nt, Bordetella pertussis
gacgguaucugucccggcggg

SEQ ID NO: 2367283 - RNA, 16 nt, Bordetella pertussis
gacggucaccgcgccc

SEQ ID NO: 2367284 - RNA, 19 nt, Bordetella pertussis
gacggucaggggcaggcgc

SEQ ID NO: 2367285 - RNA, 17 nt, Bordetella pertussis
gacgguccugcgcgccg

SEQ ID NO: 2367286 - RNA, 16 nt, Bordetella pertussis
gacggugccgagcaga

SEQ ID NO: 2367287 - RNA, 16 nt, Bordetella pertussis
gacggugccggccagc

SEQ ID NO: 2367288 - RNA, 19 nt, Bordetella pertussis
gacggugccggccagccug

SEQ ID NO: 2367289 - RNA, 20 nt, Bordetella pertussis
gacggugccggccagccugc

SEQ ID NO: 2367290 - RNA, 23 nt, Bordetella pertussis
gacggugccggccagccugcccg

SEQ ID NO: 2367291 - RNA, 14 nt, Bordetella pertussis
gacgguggccgcgg

SEQ ID NO: 2367292 - RNA, 17 nt, Bordetella pertussis
gacgguggccgcggcgu

SEQ ID NO: 2367293 - RNA, 15 nt, Bordetella pertussis
gacgguggcuggggc

SEQ ID NO: 2367294 - RNA, 14 nt, Bordetella pertussis
gacgguggugucgg

SEQ ID NO: 2367295 - RNA, 18 nt, Bordetella pertussis
gacgguggugucggcggc

SEQ ID NO: 2367296 - RNA, 15 nt, Bordetella pertussis
gacguaagugcccag

SEQ ID NO: 2367297 - RNA, 17 nt, Bordetella pertussis
gacguaagugcccaggc

SEQ ID NO: 2367298 - RNA, 18 nt, Bordetella pertussis
gacguaagugcccaggcc

SEQ ID NO: 2367299 - RNA, 21 nt, Bordetella pertussis
gacguaagugcccaggcccgu

SEQ ID NO: 2367300 - RNA, 20 nt, Bordetella pertussis
gacguaaucgagcuggccca

SEQ ID NO: 2367301 - RNA, 21 nt, Bordetella pertussis
gacguagagaccaagcugcgc

SEQ ID NO: 2367302 - RNA, 18 nt, Bordetella pertussis
gacguagcggaucgcggc

SEQ ID NO: 2367303 - RNA, 23 nt, Bordetella pertussis
gacguagcggaucgcggcgcggc

SEQ ID NO: 2367304 - RNA, 17 nt, Bordetella pertussis
gacguagucgcgccagc

SEQ ID NO: 2367305 - RNA, 18 nt, Bordetella pertussis
gacguagucgcgccagcg

SEQ ID NO: 2367306 - RNA, 18 nt, Bordetella pertussis
gacguccagcccgugggc

SEQ ID NO: 2367307 - RNA, 19 nt, Bordetella pertussis
gacguccagcccgugggcg

SEQ ID NO: 2367308 - RNA, 11 nt, Bordetella pertussis
gacguccagcg

SEQ ID NO: 2367309 - RNA, 14 nt, Bordetella pertussis
gacguccagcgacu

SEQ ID NO: 2367310 - RNA, 13 nt, Bordetella pertussis
gacguccagcgcc

SEQ ID NO: 2367311 - RNA, 23 nt, Bordetella pertussis
gacguccagcgccaccagcagcg

SEQ ID NO: 2367312 - RNA, 22 nt, Bordetella pertussis
gacguccaugauuuccaucgac

SEQ ID NO: 2367313 - RNA, 15 nt, Bordetella pertussis
gacgucccaggccga

SEQ ID NO: 2367314 - RNA, 14 nt, Bordetella pertussis
gacguccggcgggc

SEQ ID NO: 2367315 - RNA, 17 nt, Bordetella pertussis
gacguccggcgggccgc

SEQ ID NO: 2367316 - RNA, 15 nt, Bordetella pertussis
gacgucgacguugcg

SEQ ID NO: 2367317 - RNA, 19 nt, Bordetella pertussis
gacgucgcccuggauggcg

SEQ ID NO: 2367318 - RNA, 22 nt, Bordetella pertussis
gacgucgcccuggauggcggcc

SEQ ID NO: 2367319 - RNA, 14 nt, Bordetella pertussis
gacgucggccucgc

SEQ ID NO: 2367320 - RNA, 21 nt, Bordetella pertussis
gacgucggccucgcgcagggc

SEQ ID NO: 2367321 - RNA, 15 nt, Bordetella pertussis
gacgucguaccccga

SEQ ID NO: 2367322 - RNA, 16 nt, Bordetella pertussis
gacgugcgcgaccgcg

SEQ ID NO: 2367323 - RNA, 22 nt, Bordetella pertussis
gacgugcgcgaccgcgcggcgc

SEQ ID NO: 2367324 - RNA, 23 nt, Bordetella pertussis
gacgugcgcgaccgcgcggcgcu

SEQ ID NO: 2367325 - RNA, 20 nt, Bordetella pertussis
gacgugcugaccgacgugcg

SEQ ID NO: 2367326 - RNA, 22 nt, Bordetella pertussis
gacguggauggcuuuggcgaau

SEQ ID NO: 2367327 - RNA, 20 nt, Bordetella pertussis
gacguggcgcuccaugcggc

SEQ ID NO: 2367328 - RNA, 22 nt, Bordetella pertussis
gacguggcgcuccaugcggcgg

SEQ ID NO: 2367329 - RNA, 23 nt, Bordetella pertussis
gacguggcgcuccaugcggcggc

SEQ ID NO: 2367330 - RNA, 12 nt, Bordetella pertussis
gacguggcuggu

SEQ ID NO: 2367331 - RNA, 23 nt, Bordetella pertussis
gacgugggcgccuacggcggcgg

SEQ ID NO: 2367332 - RNA, 21 nt, Bordetella pertussis
gacguucggggcgucgcugcu

SEQ ID NO: 2367333 - RNA, 18 nt, Bordetella pertussis
gacguucuccagcgccgu

SEQ ID NO: 2367334 - RNA, 18 nt, Bordetella pertussis
gacguugagcgccggggc

SEQ ID NO: 2367335 - RNA, 21 nt, Bordetella pertussis
gacguugcauaccucgauggc

SEQ ID NO: 2367336 - RNA, 12 nt, Bordetella pertussis
gacguugccgcg

SEQ ID NO: 2367337 - RNA, 22 nt, Bordetella pertussis
gacguuggucaccacgccuucg

SEQ ID NO: 2367338 - RNA, 23 nt, Bordetella pertussis
gacguuguccaggccgaucagcg

SEQ ID NO: 2367339 - RNA, 23 nt, Bordetella pertussis
gacuauggccuggaugugcaggc

SEQ ID NO: 2367340 - RNA, 22 nt, Bordetella pertussis
gacucauaggcaucgaccagcg

SEQ ID NO: 2367341 - RNA, 17 nt, Bordetella pertussis
gacuccaccggcgucac

SEQ ID NO: 2367342 - RNA, 14 nt, Bordetella pertussis
gacuccggccgggc

SEQ ID NO: 2367343 - RNA, 22 nt, Bordetella pertussis
gacucgaaacgggcggcgucgc

SEQ ID NO: 2367344 - RNA, 17 nt, Bordetella pertussis
gacucgacgaacacgcg

SEQ ID NO: 2367345 - RNA, 20 nt, Bordetella pertussis
gacucgacgaacacgcgcgc

SEQ ID NO: 2367346 - RNA, 22 nt, Bordetella pertussis
gacucgacgaacacgcgcgccg

SEQ ID NO: 2367347 - RNA, 13 nt, Bordetella pertussis
gacucgauggcgc

SEQ ID NO: 2367348 - RNA, 19 nt, Bordetella pertussis
gacucgauggcgcaggcgc

SEQ ID NO: 2367349 - RNA, 16 nt, Bordetella pertussis
gacucgccgugcuggg

SEQ ID NO: 2367350 - RNA, 18 nt, Bordetella pertussis
gacucgccgugcugggcg

SEQ ID NO: 2367351 - RNA, 14 nt, Bordetella pertussis
gacucgcggucugg

SEQ ID NO: 2367352 - RNA, 21 nt, Bordetella pertussis
gacucgcggucuggucuggca

SEQ ID NO: 2367353 - RNA, 20 nt, Bordetella pertussis
gacucggccgagaacgccgu

SEQ ID NO: 2367354 - RNA, 22 nt, Bordetella pertussis
gacucguccauggugggcaggu

SEQ ID NO: 2367355 - RNA, 21 nt, Bordetella pertussis
gacucgucgaccaccagcauc

SEQ ID NO: 2367356 - RNA, 18 nt, Bordetella pertussis
gacugaacgcguccaggc

SEQ ID NO: 2367357 - RNA, 18 nt, Bordetella pertussis
gacugcagcaggcugggc

SEQ ID NO: 2367358 - RNA, 20 nt, Bordetella pertussis
gacugcagcaggcugggcga

SEQ ID NO: 2367359 - RNA, 18 nt, Bordetella pertussis
gacugcaggaugaggcgc

SEQ ID NO: 2367360 - RNA, 11 nt, Bordetella pertussis
gacugccagau

SEQ ID NO: 2367361 - RNA, 15 nt, Bordetella pertussis
gacugccccagcggc

SEQ ID NO: 2367362 - RNA, 21 nt, Bordetella pertussis
gacugccccagcggcuggcgc

SEQ ID NO: 2367363 - RNA, 18 nt, Bordetella pertussis
gacugcggugccuguccc

SEQ ID NO: 2367364 - RNA, 20 nt, Bordetella pertussis
gacugcggugccugucccca

SEQ ID NO: 2367365 - RNA, 20 nt, Bordetella pertussis
gacugcugccggauuggcgc

SEQ ID NO: 2367366 - RNA, 22 nt, Bordetella pertussis
gacugcuguacgacagcaaggg

SEQ ID NO: 2367367 - RNA, 15 nt, Bordetella pertussis
gagcagcagcgggcu

SEQ ID NO: 2367368 - RNA, 16 nt, Bordetella pertussis
gagcagcagcgggcuu

SEQ ID NO: 2367369 - RNA, 21 nt, Bordetella pertussis
gagcagcaugugcucgggacg

SEQ ID NO: 2367370 - RNA, 14 nt, Bordetella pertussis
gagcagcgcaucga

SEQ ID NO: 2367371 - RNA, 21 nt, Bordetella pertussis
gagcagcucacuuguaaugag

SEQ ID NO: 2367372 - RNA, 22 nt, Bordetella pertussis
gagcagcucacuuguaaugaga

SEQ ID NO: 2367373 - RNA, 12 nt, Bordetella pertussis
gagcaggccgcc

SEQ ID NO: 2367374 - RNA, 16 nt, Bordetella pertussis
gagcaggccgcccagc

SEQ ID NO: 2367375 - RNA, 19 nt, Bordetella pertussis
gagcaggccgcccagcgca

SEQ ID NO: 2367376 - RNA, 13 nt, Bordetella pertussis
gagcaggccgccg

SEQ ID NO: 2367377 - RNA, 16 nt, Bordetella pertussis
gagcaggccgccgccg

SEQ ID NO: 2367378 - RNA, 11 nt, Bordetella pertussis
gagcaggcgca

SEQ ID NO: 2367379 - RNA, 17 nt, Bordetella pertussis
gagcaggcgcaggccgc

SEQ ID NO: 2367380 - RNA, 18 nt, Bordetella pertussis
gagcaggcgcaggccgcg

SEQ ID NO: 2367381 - RNA, 14 nt, Bordetella pertussis
gagcaggcgcgcgg

SEQ ID NO: 2367382 - RNA, 13 nt, Bordetella pertussis
gagcaggcgcugg

SEQ ID NO: 2367383 - RNA, 20 nt, Bordetella pertussis
gagcagggggucgaucaugg

SEQ ID NO: 2367384 - RNA, 16 nt, Bordetella pertussis
gagcaguacacgcgca

SEQ ID NO: 2367385 - RNA, 15 nt, Bordetella pertussis
gagcagucgaccacg

SEQ ID NO: 2367386 - RNA, 17 nt, Bordetella pertussis
gagcagucgcgcagcca

SEQ ID NO: 2367387 - RNA, 19 nt, Bordetella pertussis
gagcagucgcgcagccaca

SEQ ID NO: 2367388 - RNA, 14 nt, Bordetella pertussis
gagcagugugccug

SEQ ID NO: 2367389 - RNA, 14 nt, Bordetella pertussis
gagcaucugcggca

SEQ ID NO: 2367390 - RNA, 17 nt, Bordetella pertussis
gagcaucuggcgcaugg

SEQ ID NO: 2367391 - RNA, 12 nt, Bordetella pertussis
gagcaugcccuu

SEQ ID NO: 2367392 - RNA, 20 nt, Bordetella pertussis
gagcaugcccuuugcagcca

SEQ ID NO: 2367393 - RNA, 23 nt, Bordetella pertussis
gagcaugcgcagcgcgucggcgc

SEQ ID NO: 2367394 - RNA, 13 nt, Bordetella pertussis
gagcaugcggcgu

SEQ ID NO: 2367395 - RNA, 14 nt, Bordetella pertussis
gagcaugcgggcca

SEQ ID NO: 2367396 - RNA, 18 nt, Bordetella pertussis
gagcauggcaugagcgcc

SEQ ID NO: 2367397 - RNA, 15 nt, Bordetella pertussis
gagcauggcgguggc

SEQ ID NO: 2367398 - RNA, 13 nt, Bordetella pertussis
gagcauugccgcg

SEQ ID NO: 2367399 - RNA, 15 nt, Bordetella pertussis
gagcauugccgcggc

SEQ ID NO: 2367400 - RNA, 21 nt, Bordetella pertussis
gagcauugccgcggcaaaugg

SEQ ID NO: 2367401 - RNA, 15 nt, Bordetella pertussis
gagccaggcgcccgg

SEQ ID NO: 2367402 - RNA, 17 nt, Bordetella pertussis
gagccaggcggcguagu

SEQ ID NO: 2367403 - RNA, 21 nt, Bordetella pertussis
gagccagguggacagcgccag

SEQ ID NO: 2367404 - RNA, 12 nt, Bordetella pertussis
gagccagucccc

SEQ ID NO: 2367405 - RNA, 19 nt, Bordetella pertussis
gagccaguccccgcaggga

SEQ ID NO: 2367406 - RNA, 23 nt, Bordetella pertussis
gagccaguccccgcagggacagg

SEQ ID NO: 2367407 - RNA, 18 nt, Bordetella pertussis
gagccaugccgucuggcg

SEQ ID NO: 2367408 - RNA, 21 nt, Bordetella pertussis
gagccaugccgucuggcggca

SEQ ID NO: 2367409 - RNA, 23 nt, Bordetella pertussis
gagccaugccgucuggcggcagc

SEQ ID NO: 2367410 - RNA, 23 nt, Bordetella pertussis
gagcccaucaggugggccgagcc

SEQ ID NO: 2367411 - RNA, 16 nt, Bordetella pertussis
gagcccgacgcgaggc

SEQ ID NO: 2367412 - RNA, 21 nt, Bordetella pertussis
gagcccgcacauacaaggcgc

SEQ ID NO: 2367413 - RNA, 15 nt, Bordetella pertussis
gagcccgccaucgcc

SEQ ID NO: 2367414 - RNA, 21 nt, Bordetella pertussis
gagcccgcgucggcgcgguau

SEQ ID NO: 2367415 - RNA, 22 nt, Bordetella pertussis
gagcccgcugccgagacggccg

SEQ ID NO: 2367416 - RNA, 14 nt, Bordetella pertussis
gagcccgggcgugc

SEQ ID NO: 2367417 - RNA, 16 nt, Bordetella pertussis
gagcccgggcgugccu

SEQ ID NO: 2367418 - RNA, 19 nt, Bordetella pertussis
gagcccgggcgugccugcu

SEQ ID NO: 2367419 - RNA, 20 nt, Bordetella pertussis
gagcccuucgacgcggcggc

SEQ ID NO: 2367420 - RNA, 21 nt, Bordetella pertussis
gagccgaaguacacggccagc

SEQ ID NO: 2367421 - RNA, 22 nt, Bordetella pertussis
gagccgaaguacacggccagca

SEQ ID NO: 2367422 - RNA, 17 nt, Bordetella pertussis
gagccgauacaggcgcu

SEQ ID NO: 2367423 - RNA, 22 nt, Bordetella pertussis
gagccgauacaggcgcucgcgc

SEQ ID NO: 2367424 - RNA, 23 nt, Bordetella pertussis
gagccgauggcauggggcaggcg

SEQ ID NO: 2367425 - RNA, 13 nt, Bordetella pertussis
gagccgcagaaca

SEQ ID NO: 2367426 - RNA, 15 nt, Bordetella pertussis
gagccgcagaacagc

SEQ ID NO: 2367427 - RNA, 17 nt, Bordetella pertussis
gagccgcagaacagcag

SEQ ID NO: 2367428 - RNA, 18 nt, Bordetella pertussis
gagccgcagaacagcagc

SEQ ID NO: 2367429 - RNA, 16 nt, Bordetella pertussis
gagccgcagguccagg

SEQ ID NO: 2367430 - RNA, 21 nt, Bordetella pertussis
gagccgcagguccaggccugg

SEQ ID NO: 2367431 - RNA, 22 nt, Bordetella pertussis
gagccgcagguccaggccuggg

SEQ ID NO: 2367432 - RNA, 19 nt, Bordetella pertussis
gagccgccccggcgcggcg

SEQ ID NO: 2367433 - RNA, 12 nt, Bordetella pertussis
gagccgcgcaca

SEQ ID NO: 2367434 - RNA, 22 nt, Bordetella pertussis
gagccgcgcacacauggcgcau

SEQ ID NO: 2367435 - RNA, 20 nt, Bordetella pertussis
gagccgcgcgcaugcgccuu

SEQ ID NO: 2367436 - RNA, 15 nt, Bordetella pertussis
gagccggacgugggc

SEQ ID NO: 2367437 - RNA, 18 nt, Bordetella pertussis
gagccggacgugggcgcc

SEQ ID NO: 2367438 - RNA, 21 nt, Bordetella pertussis
gagccggacgugggcgccuac

SEQ ID NO: 2367439 - RNA, 17 nt, Bordetella pertussis
gagccggcaagccaggg

SEQ ID NO: 2367440 - RNA, 12 nt, Bordetella pertussis
gagccggccacg

SEQ ID NO: 2367441 - RNA, 22 nt, Bordetella pertussis
gagccggccacgcgcugcagca

SEQ ID NO: 2367442 - RNA, 16 nt, Bordetella pertussis
gagccggccagcgcca

SEQ ID NO: 2367443 - RNA, 22 nt, Bordetella pertussis
gagccggccagcgccugggcgc

SEQ ID NO: 2367444 - RNA, 15 nt, Bordetella pertussis
gagccggccgcgccc

SEQ ID NO: 2367445 - RNA, 17 nt, Bordetella pertussis
gagccggccgcgcccga

SEQ ID NO: 2367446 - RNA, 13 nt, Bordetella pertussis
gagccggcuccag

SEQ ID NO: 2367447 - RNA, 15 nt, Bordetella pertussis
gagccgggcaccgag

SEQ ID NO: 2367448 - RNA, 17 nt, Bordetella pertussis
gagccgggccacgcgca

SEQ ID NO: 2367449 - RNA, 15 nt, Bordetella pertussis
gagccgggccaugcg

SEQ ID NO: 2367450 - RNA, 13 nt, Bordetella pertussis
gagccgggcgccg

SEQ ID NO: 2367451 - RNA, 14 nt, Bordetella pertussis
gagccgggcgccga

SEQ ID NO: 2367452 - RNA, 22 nt, Bordetella pertussis
gagccgguacagccaggccagc

SEQ ID NO: 2367453 - RNA, 23 nt, Bordetella pertussis
gagccgguccgccucgcacaguu

SEQ ID NO: 2367454 - RNA, 19 nt, Bordetella pertussis
gagccguacucgaucgcca

SEQ ID NO: 2367455 - RNA, 20 nt, Bordetella pertussis
gagccguacucgaucgccau

SEQ ID NO: 2367456 - RNA, 22 nt, Bordetella pertussis
gagccguaguaggucaugcaga

SEQ ID NO: 2367457 - RNA, 23 nt, Bordetella pertussis
gagccguucuggcagugcgccug

SEQ ID NO: 2367458 - RNA, 14 nt, Bordetella pertussis
gagccucuggaaga

SEQ ID NO: 2367459 - RNA, 16 nt, Bordetella pertussis
gagccuguccccgccg

SEQ ID NO: 2367460 - RNA, 16 nt, Bordetella pertussis
gagccuguccccgcgg

SEQ ID NO: 2367461 - RNA, 15 nt, Bordetella pertussis
gagccuguccccguc

SEQ ID NO: 2367462 - RNA, 20 nt, Bordetella pertussis
gagccugucccgacggggac

SEQ ID NO: 2367463 - RNA, 16 nt, Bordetella pertussis
gagccugucccugcgg

SEQ ID NO: 2367464 - RNA, 19 nt, Bordetella pertussis
gagccugucccugcgggga

SEQ ID NO: 2367465 - RNA, 15 nt, Bordetella pertussis
gagccuucggccggc

SEQ ID NO: 2367466 - RNA, 16 nt, Bordetella pertussis
gagccuucggccggcu

SEQ ID NO: 2367467 - RNA, 22 nt, Bordetella pertussis
gagcgaauccaucaucagcaug

SEQ ID NO: 2367468 - RNA, 22 nt, Bordetella pertussis
gagcgaaugcgcguaguccgag

SEQ ID NO: 2367469 - RNA, 16 nt, Bordetella pertussis
gagcgacccguggccc

SEQ ID NO: 2367470 - RNA, 20 nt, Bordetella pertussis
gagcgcaagcaccgccugcu

SEQ ID NO: 2367471 - RNA, 17 nt, Bordetella pertussis
gagcgcacaggcggcgc

SEQ ID NO: 2367472 - RNA, 14 nt, Bordetella pertussis
gagcgcaccauggc

SEQ ID NO: 2367473 - RNA, 16 nt, Bordetella pertussis
gagcgcaccauggcgc

SEQ ID NO: 2367474 - RNA, 19 nt, Bordetella pertussis
gagcgcaccccggccgacg

SEQ ID NO: 2367475 - RNA, 21 nt, Bordetella pertussis
gagcgcacugauagaccgauu

SEQ ID NO: 2367476 - RNA, 18 nt, Bordetella pertussis
gagcgcagcaagcugcug

SEQ ID NO: 2367477 - RNA, 21 nt, Bordetella pertussis
gagcgcagcaagcugcugcug

SEQ ID NO: 2367478 - RNA, 22 nt, Bordetella pertussis
gagcgcagccgcuccagccacc

SEQ ID NO: 2367479 - RNA, 14 nt, Bordetella pertussis
gagcgccacgccag

SEQ ID NO: 2367480 - RNA, 22 nt, Bordetella pertussis
gaggcagaaguggucgcgcagg

SEQ ID NO: 2367481 - RNA, 21 nt, Bordetella pertussis
gaggcaucgaaggcgaccggc

SEQ ID NO: 2367482 - RNA, 14 nt, Bordetella pertussis
gaggcauuggcggc

SEQ ID NO: 2367483 - RNA, 16 nt, Bordetella pertussis
gaggcauuggcggcgg

SEQ ID NO: 2367484 - RNA, 17 nt, Bordetella pertussis
gaggcauuggcggcggc

SEQ ID NO: 2367485 - RNA, 22 nt, Bordetella pertussis
gaggccacccgaagguggcccg

SEQ ID NO: 2367486 - RNA, 12 nt, Bordetella pertussis
gaggccagcacg

SEQ ID NO: 2367487 - RNA, 13 nt, Bordetella pertussis
gaggccagcacgc

SEQ ID NO: 2367488 - RNA, 14 nt, Bordetella pertussis
gaggccagcacgcc

SEQ ID NO: 2367489 - RNA, 16 nt, Bordetella pertussis
gaggccagcacgccgg

SEQ ID NO: 2367490 - RNA, 17 nt, Bordetella pertussis
gaggccagcacgccggc

SEQ ID NO: 2367491 - RNA, 12 nt, Bordetella pertussis
gaggccaggccc

SEQ ID NO: 2367492 - RNA, 13 nt, Bordetella pertussis
gaggccaggcccu

SEQ ID NO: 2367493 - RNA, 23 nt, Bordetella pertussis
gaggccaggcccucgcggccguc

SEQ ID NO: 2367494 - RNA, 12 nt, Bordetella pertussis
gaggccaggccg

SEQ ID NO: 2367495 - RNA, 19 nt, Bordetella pertussis
gaggccaggcugaccagcg

SEQ ID NO: 2367496 - RNA, 16 nt, Bordetella pertussis
gaggcccagccgcucg

SEQ ID NO: 2367497 - RNA, 21 nt, Bordetella pertussis
gaggcccgauggcggggaugg

SEQ ID NO: 2367498 - RNA, 16 nt, Bordetella pertussis
gaggcccguuuuguuu

SEQ ID NO: 2367499 - RNA, 18 nt, Bordetella pertussis
gaggccgaguagcggcgc

SEQ ID NO: 2367500 - RNA, 19 nt, Bordetella pertussis
gaggccgaguggccgcugu

SEQ ID NO: 2367501 - RNA, 14 nt, Bordetella pertussis
gaggccggcgugcu

SEQ ID NO: 2367502 - RNA, 15 nt, Bordetella pertussis
gaggccggcgugcug

SEQ ID NO: 2367503 - RNA, 17 nt, Bordetella pertussis
gaggccucgugcugcug

SEQ ID NO: 2367504 - RNA, 15 nt, Bordetella pertussis
gaggcgaacaggcac

SEQ ID NO: 2367505 - RNA, 22 nt, Bordetella pertussis
gaggcgaacauggccgagaugc

SEQ ID NO: 2367506 - RNA, 18 nt, Bordetella pertussis
gaggcgacgguggcuggg

SEQ ID NO: 2367507 - RNA, 14 nt, Bordetella pertussis
gaggcgaugccccg

SEQ ID NO: 2367508 - RNA, 19 nt, Bordetella pertussis
gaggcgaugcugaccaccg

SEQ ID NO: 2367509 - RNA, 19 nt, Bordetella pertussis
gaggcgauggucggccgga

SEQ ID NO: 2367510 - RNA, 16 nt, Bordetella pertussis
gaggcgcagcgcagcu

SEQ ID NO: 2367511 - RNA, 16 nt, Bordetella pertussis
gaggcgcagcgcggca

SEQ ID NO: 2367512 - RNA, 19 nt, Bordetella pertussis
gaggcgcagcgcggcacgc

SEQ ID NO: 2367513 - RNA, 14 nt, Bordetella pertussis
gaggcgcaggccga

SEQ ID NO: 2367514 - RNA, 16 nt, Bordetella pertussis
gaggcgcaggccgacg

SEQ ID NO: 2367515 - RNA, 22 nt, Bordetella pertussis
gaggcgcaggccgacgcgcugu

SEQ ID NO: 2367516 - RNA, 16 nt, Bordetella pertussis
gaggcgcaguccagcg

SEQ ID NO: 2367517 - RNA, 19 nt, Bordetella pertussis
gaggcgccccagagcaccg

SEQ ID NO: 2367518 - RNA, 12 nt, Bordetella pertussis
gaggcgccgcgg

SEQ ID NO: 2367519 - RNA, 18 nt, Bordetella pertussis
gaggcgccgcggaggcga

SEQ ID NO: 2367520 - RNA, 17 nt, Bordetella pertussis
gaggcgcgcagcacgcc

SEQ ID NO: 2367521 - RNA, 18 nt, Bordetella pertussis
gaggcgcggcucgccggc

SEQ ID NO: 2367522 - RNA, 18 nt, Bordetella pertussis
gaggcgcgggcagcaccg

SEQ ID NO: 2367523 - RNA, 13 nt, Bordetella pertussis
gaggcgcgggcga

SEQ ID NO: 2367524 - RNA, 19 nt, Bordetella pertussis
gaggcgcgggcgauguagg

SEQ ID NO: 2367525 - RNA, 22 nt, Bordetella pertussis
gaggcgcucggccuugccguug

SEQ ID NO: 2367526 - RNA, 18 nt, Bordetella pertussis
gaggcgcugaugccguac

SEQ ID NO: 2367527 - RNA, 14 nt, Bordetella pertussis
gaggcgcuggccgg

SEQ ID NO: 2367528 - RNA, 15 nt, Bordetella pertussis
gaggcgcuggccggc

SEQ ID NO: 2367529 - RNA, 14 nt, Bordetella pertussis
gaggcgcuggcguc

SEQ ID NO: 2367530 - RNA, 13 nt, Bordetella pertussis
gaggcggccgcgg

SEQ ID NO: 2367531 - RNA, 19 nt, Bordetella pertussis
gaggcggccgcgggcggcg

SEQ ID NO: 2367532 - RNA, 22 nt, Bordetella pertussis
gaggcggccgcgggcggcgcgc

SEQ ID NO: 2367533 - RNA, 12 nt, Bordetella pertussis
gaggcggccggg

SEQ ID NO: 2367534 - RNA, 13 nt, Bordetella pertussis
gaggcggccgggc

SEQ ID NO: 2367535 - RNA, 14 nt, Bordetella pertussis
gaggcggccgggcg

SEQ ID NO: 2367536 - RNA, 16 nt, Bordetella pertussis
gaggcggccuugaugg

SEQ ID NO: 2367537 - RNA, 13 nt, Bordetella pertussis
gaggcggcgcagg

SEQ ID NO: 2367538 - RNA, 13 nt, Bordetella pertussis
gaggcgggcagca

SEQ ID NO: 2367539 - RNA, 22 nt, Bordetella pertussis
gaggcgggcagcauggcgccau

SEQ ID NO: 2367540 - RNA, 15 nt, Bordetella pertussis
gaggcggggcuggcg

SEQ ID NO: 2367541 - RNA, 23 nt, Bordetella pertussis
gaggcggggcuggcgcggcuggc

SEQ ID NO: 2367542 - RNA, 17 nt, Bordetella pertussis
gaggcggucgaugaagc

SEQ ID NO: 2367543 - RNA, 16 nt, Bordetella pertussis
gaggcggugggcaggg

SEQ ID NO: 2367544 - RNA, 17 nt, Bordetella pertussis
gaggcggugggcagggc

SEQ ID NO: 2367545 - RNA, 18 nt, Bordetella pertussis
gaggcggugggcagggcg

SEQ ID NO: 2367546 - RNA, 17 nt, Bordetella pertussis
gaggcgugcugcaccug

SEQ ID NO: 2367547 - RNA, 18 nt, Bordetella pertussis
gaggcgugcugcaccugc

SEQ ID NO: 2367548 - RNA, 18 nt, Bordetella pertussis
gaggcugcgcgcgccagc

SEQ ID NO: 2367549 - RNA, 15 nt, Bordetella pertussis
gaggcuggcgcccac

SEQ ID NO: 2367550 - RNA, 22 nt, Bordetella pertussis
gaggcuuugucguugauggggc

SEQ ID NO: 2367551 - RNA, 20 nt, Bordetella pertussis
gaggcuuuuuuucgccgggc

SEQ ID NO: 2367552 - RNA, 21 nt, Bordetella pertussis
gaggcuuuuuuucgccgggcg

SEQ ID NO: 2367553 - RNA, 23 nt, Bordetella pertussis
gaggcuuuuuuucgccgggcggc

SEQ ID NO: 2367554 - RNA, 15 nt, Bordetella pertussis
gagggaaaacagcgc

SEQ ID NO: 2367555 - RNA, 22 nt, Bordetella pertussis
gagggaaaacagcgcgggcgca

SEQ ID NO: 2367556 - RNA, 13 nt, Bordetella pertussis
gagggacaccgca

SEQ ID NO: 2367557 - RNA, 19 nt, Bordetella pertussis
gagggacaccgcaggugcc

SEQ ID NO: 2367558 - RNA, 23 nt, Bordetella pertussis
gagggccacgcgcuugcgcgcca

SEQ ID NO: 2367559 - RNA, 13 nt, Bordetella pertussis
gagggccgcggcg

SEQ ID NO: 2367560 - RNA, 15 nt, Bordetella pertussis
gagggccggacuggc

SEQ ID NO: 2367561 - RNA, 20 nt, Bordetella pertussis
gagggccggacuggcgcgca

SEQ ID NO: 2367562 - RNA, 21 nt, Bordetella pertussis
gagggccuggucagcgccgac

SEQ ID NO: 2367563 - RNA, 13 nt, Bordetella pertussis
gagggcgacggcg

SEQ ID NO: 2367564 - RNA, 16 nt, Bordetella pertussis
gagggcgacggcggcg

SEQ ID NO: 2367565 - RNA, 17 nt, Bordetella pertussis
gagggcgacggcggcgu

SEQ ID NO: 2367566 - RNA, 14 nt, Bordetella pertussis
gagggcgaucaugc

SEQ ID NO: 2367567 - RNA, 12 nt, Bordetella pertussis
gagggcgcggcg

SEQ ID NO: 2367568 - RNA, 14 nt, Bordetella pertussis
gagggcgcggcgcc

SEQ ID NO: 2367569 - RNA, 14 nt, Bordetella pertussis
gagggcgcgggcca

SEQ ID NO: 2367570 - RNA, 16 nt, Bordetella pertussis
gagggcgcgggccagc

SEQ ID NO: 2367571 - RNA, 23 nt, Bordetella pertussis
gagggcggggcgugagcaggcgc

SEQ ID NO: 2367572 - RNA, 19 nt, Bordetella pertussis
gagggcgucaucggcgcgc

SEQ ID NO: 2367573 - RNA, 18 nt, Bordetella pertussis
gagggcuccaggcugagc

SEQ ID NO: 2367574 - RNA, 20 nt, Bordetella pertussis
gagggcuccaggcugagcgu

SEQ ID NO: 2367575 - RNA, 12 nt, Bordetella pertussis
gaggggccagcc

SEQ ID NO: 2367576 - RNA, 13 nt, Bordetella pertussis
gaggggccagccu

SEQ ID NO: 2367577 - RNA, 15 nt, Bordetella pertussis
gaggggccagccugg

SEQ ID NO: 2367578 - RNA, 14 nt, Bordetella pertussis
gaggggggcguggg

SEQ ID NO: 2367579 - RNA, 14 nt, Bordetella pertussis
gagggucuggccgg

SEQ ID NO: 2367580 - RNA, 17 nt, Bordetella pertussis
gagggucuggcggccgg

SEQ ID NO: 2367581 - RNA, 22 nt, Bordetella pertussis
gagggugaccaugucgccguug

SEQ ID NO: 2367582 - RNA, 19 nt, Bordetella pertussis
gagguacucgggggcgggc

SEQ ID NO: 2367583 - RNA, 13 nt, Bordetella pertussis
gagguagggcgcg

SEQ ID NO: 2367584 - RNA, 20 nt, Bordetella pertussis
gaggucagcccggcggccau

SEQ ID NO: 2367585 - RNA, 13 nt, Bordetella pertussis
gaggucagcggcu

SEQ ID NO: 2367586 - RNA, 23 nt, Bordetella pertussis
gaggucggcgguccacagcccgg

SEQ ID NO: 2367587 - RNA, 13 nt, Bordetella pertussis
gaggucggggugg

SEQ ID NO: 2367588 - RNA, 17 nt, Bordetella pertussis
gaggucggggugguugu

SEQ ID NO: 2367589 - RNA, 15 nt, Bordetella pertussis
gaggugcacgugggc

SEQ ID NO: 2367590 - RNA, 19 nt, Bordetella pertussis
gaggugcacgugggcacgc

SEQ ID NO: 2367591 - RNA, 16 nt, Bordetella pertussis
gaggugccggcgguga

SEQ ID NO: 2367592 - RNA, 22 nt, Bordetella pertussis
gaggugccggcggugaugacgu

SEQ ID NO: 2367593 - RNA, 22 nt, Bordetella pertussis
gaggugccguccggcaccucga

SEQ ID NO: 2367594 - RNA, 20 nt, Bordetella pertussis
gaucacgaacagcgccaggc

SEQ ID NO: 2367595 - RNA, 12 nt, Bordetella pertussis
gaucacggcgcg

SEQ ID NO: 2367596 - RNA, 16 nt, Bordetella pertussis
gaucacggcgcgcgcc

SEQ ID NO: 2367597 - RNA, 17 nt, Bordetella pertussis
gaucacgugccagccga

SEQ ID NO: 2367598 - RNA, 17 nt, Bordetella pertussis
gaucagaaaggcagcgg

SEQ ID NO: 2367599 - RNA, 22 nt, Bordetella pertussis
gaucagcaagggccccagcauc

SEQ ID NO: 2367600 - RNA, 20 nt, Bordetella pertussis
gaucagcaccacggcggcca

SEQ ID NO: 2367601 - RNA, 20 nt, Bordetella pertussis
gaucagcaccgcgaccaugc

SEQ ID NO: 2367602 - RNA, 14 nt, Bordetella pertussis
gaucagcaccgcgg

SEQ ID NO: 2367603 - RNA, 13 nt, Bordetella pertussis
gaucagcaggccc

SEQ ID NO: 2367604 - RNA, 18 nt, Bordetella pertussis
gaucagcaggcccaccag

SEQ ID NO: 2367605 - RNA, 21 nt, Bordetella pertussis
gaucagcaggucggcgcggcc

SEQ ID NO: 2367606 - RNA, 20 nt, Bordetella pertussis
gaucagcauaucgucgcugc

SEQ ID NO: 2367607 - RNA, 12 nt, Bordetella pertussis
gaucagccaccg

SEQ ID NO: 2367608 - RNA, 21 nt, Bordetella pertussis
gaucagccacgugaagcgccg

SEQ ID NO: 2367609 - RNA, 14 nt, Bordetella pertussis
gaucagccagccgg

SEQ ID NO: 2367610 - RNA, 15 nt, Bordetella pertussis
gaucagccagccggc

SEQ ID NO: 2367611 - RNA, 23 nt, Bordetella pertussis
gaucagccagccggcggccagcu

SEQ ID NO: 2367612 - RNA, 15 nt, Bordetella pertussis
gaucagccccugcca

SEQ ID NO: 2367613 - RNA, 17 nt, Bordetella pertussis
gaucagccccugccaug

SEQ ID NO: 2367614 - RNA, 14 nt, Bordetella pertussis
gaucagccgcugca

SEQ ID NO: 2367615 - RNA, 17 nt, Bordetella pertussis
gaucagccgcugcagca

SEQ ID NO: 2367616 - RNA, 19 nt, Bordetella pertussis
gaucagccgcuuggccugc

SEQ ID NO: 2367617 - RNA, 22 nt, Bordetella pertussis
gaucagccgcuuggccugcgcc

SEQ ID NO: 2367618 - RNA, 17 nt, Bordetella pertussis
gaucagccggccauggc

SEQ ID NO: 2367619 - RNA, 19 nt, Bordetella pertussis
gaucagcgaaugcgacagc

SEQ ID NO: 2367620 - RNA, 12 nt, Bordetella pertussis
gaucagcgccca

SEQ ID NO: 2367621 - RNA, 15 nt, Bordetella pertussis
gaucagcgcccaggu

SEQ ID NO: 2367622 - RNA, 13 nt, Bordetella pertussis
gaucagcgccuca

SEQ ID NO: 2367623 - RNA, 13 nt, Bordetella pertussis
gaucagcgcggcc

SEQ ID NO: 2367624 - RNA, 19 nt, Bordetella pertussis
gaucagcgcgggccacugc

SEQ ID NO: 2367625 - RNA, 13 nt, Bordetella pertussis
gaucagcgcgucg

SEQ ID NO: 2367626 - RNA, 19 nt, Bordetella pertussis
gaucagcgcgucggcgccg

SEQ ID NO: 2367627 - RNA, 13 nt, Bordetella pertussis
gaucagcggcggc

SEQ ID NO: 2367628 - RNA, 14 nt, Bordetella pertussis
gaucagcggcggca

SEQ ID NO: 2367629 - RNA, 17 nt, Bordetella pertussis
gaucagcgggcuggcca

SEQ ID NO: 2367630 - RNA, 18 nt, Bordetella pertussis
gaucagcgggcuggccag

SEQ ID NO: 2367631 - RNA, 19 nt, Bordetella pertussis
gaucagcuugaugccggcg

SEQ ID NO: 2367632 - RNA, 21 nt, Bordetella pertussis
gaucaggaagacuuccgugcc

SEQ ID NO: 2367633 - RNA, 17 nt, Bordetella pertussis
gaucaggaugggcgcgg

SEQ ID NO: 2367634 - RNA, 13 nt, Bordetella pertussis
gaucaggcccagc

SEQ ID NO: 2367635 - RNA, 16 nt, Bordetella pertussis
gaucaggcccuggggc

SEQ ID NO: 2367636 - RNA, 18 nt, Bordetella pertussis
gaucaggcccuggggccg

SEQ ID NO: 2367637 - RNA, 21 nt, Bordetella pertussis
gaucaggcccuggggccgcgg

SEQ ID NO: 2367638 - RNA, 22 nt, Bordetella pertussis
gaucaggcccuggggccgcggc

SEQ ID NO: 2367639 - RNA, 13 nt, Bordetella pertussis
gaucaggccggcg

SEQ ID NO: 2367640 - RNA, 20 nt, Bordetella pertussis
gaucaggcgcuccauggcgc

SEQ ID NO: 2367641 - RNA, 23 nt, Bordetella pertussis
gaucaggcgcuccauggcgccgg

SEQ ID NO: 2367642 - RNA, 13 nt, Bordetella pertussis
gaucaggcggcug

SEQ ID NO: 2367643 - RNA, 14 nt, Bordetella pertussis
gaucaggcugucgc

SEQ ID NO: 2367644 - RNA, 18 nt, Bordetella pertussis
gaucaggcugucgcgcgg

SEQ ID NO: 2367645 - RNA, 20 nt, Bordetella pertussis
gaucaggcugucgcgcgggu

SEQ ID NO: 2367646 - RNA, 16 nt, Bordetella pertussis
gaucagggccgccagg

SEQ ID NO: 2367647 - RNA, 17 nt, Bordetella pertussis
gaucagggccgccaggg

SEQ ID NO: 2367648 - RNA, 24 nt, Bordetella pertussis
gaucagggccgccagggcggcugc

SEQ ID NO: 2367649 - RNA, 13 nt, Bordetella pertussis
gaucagggcgcgg

SEQ ID NO: 2367650 - RNA, 19 nt, Bordetella pertussis
gaucaguaucucggcgccc

SEQ ID NO: 2367651 - RNA, 17 nt, Bordetella pertussis
gaucaguccgacgacaa

SEQ ID NO: 2367652 - RNA, 15 nt, Bordetella pertussis
gaucaguucggcaug

SEQ ID NO: 2367653 - RNA, 17 nt, Bordetella pertussis
gaucauccagguggcgg

SEQ ID NO: 2367654 - RNA, 17 nt, Bordetella pertussis
gaucauccgggcccggu

SEQ ID NO: 2367655 - RNA, 23 nt, Bordetella pertussis
gaucaucgaggcaaucagcccca

SEQ ID NO: 2367656 - RNA, 15 nt, Bordetella pertussis
gaucaucggcgccau

SEQ ID NO: 2367657 - RNA, 13 nt, Bordetella pertussis
gaucaucgugccg

SEQ ID NO: 2367658 - RNA, 16 nt, Bordetella pertussis
gaucaucuucgugcug

SEQ ID NO: 2367659 - RNA, 14 nt, Bordetella pertussis
gaucaugaugcgcu

SEQ ID NO: 2367660 - RNA, 20 nt, Bordetella pertussis
gaucaugccgcugaccagca

SEQ ID NO: 2367661 - RNA, 14 nt, Bordetella pertussis
gaucaugccgcugc

SEQ ID NO: 2367662 - RNA, 16 nt, Bordetella pertussis
gaucaugccgcugccc

SEQ ID NO: 2367663 - RNA, 23 nt, Bordetella pertussis
gaucauggcgccgauggcgccgc

SEQ ID NO: 2367664 - RNA, 18 nt, Bordetella pertussis
gaucauugggucugcgcg

SEQ ID NO: 2367665 - RNA, 20 nt, Bordetella pertussis
gauccacagucggucgccgc

SEQ ID NO: 2367666 - RNA, 19 nt, Bordetella pertussis
gauccacgcccgcgccgaa

SEQ ID NO: 2367667 - RNA, 14 nt, Bordetella pertussis
gauccacgccgccg

SEQ ID NO: 2367668 - RNA, 16 nt, Bordetella pertussis
gauccacgccgccggc

SEQ ID NO: 2367669 - RNA, 15 nt, Bordetella pertussis
gauccacggccggcg

SEQ ID NO: 2367670 - RNA, 19 nt, Bordetella pertussis
gauccacggccggcgcacg

SEQ ID NO: 2367671 - RNA, 16 nt, Bordetella pertussis
gauccacucggccagc

SEQ ID NO: 2367672 - RNA, 18 nt, Bordetella pertussis
gauccacucggccagcgc

SEQ ID NO: 2367673 - RNA, 21 nt, Bordetella pertussis
gauccacucggccagcgcgcg

SEQ ID NO: 2367674 - RNA, 18 nt, Bordetella pertussis
gauccagaagauauuggg

SEQ ID NO: 2367675 - RNA, 12 nt, Bordetella pertussis
gauccagcagcg

SEQ ID NO: 2367676 - RNA, 14 nt, Bordetella pertussis
gauccagcagcgug

SEQ ID NO: 2367677 - RNA, 22 nt, Bordetella pertussis
gauccagccauggaagcggcag

SEQ ID NO: 2367678 - RNA, 12 nt, Bordetella pertussis
gauccagccgcu

SEQ ID NO: 2367679 - RNA, 17 nt, Bordetella pertussis
gauccagccguuggcgc

SEQ ID NO: 2367680 - RNA, 20 nt, Bordetella pertussis
gauccagccguuggcgccca

SEQ ID NO: 2367681 - RNA, 22 nt, Bordetella pertussis
gauccagccguuggcgcccagc

SEQ ID NO: 2367682 - RNA, 17 nt, Bordetella pertussis
gauccagcgccuggggu

SEQ ID NO: 2367683 - RNA, 16 nt, Bordetella pertussis
gauccagcgcggccac

SEQ ID NO: 2367684 - RNA, 17 nt, Bordetella pertussis
gauccagcgcggccacg

SEQ ID NO: 2367685 - RNA, 14 nt, Bordetella pertussis
gauccagcgcucgg

SEQ ID NO: 2367686 - RNA, 17 nt, Bordetella pertussis
gauccagcuugcguccc

SEQ ID NO: 2367687 - RNA, 23 nt, Bordetella pertussis
gauccagcuugcgucccaccugc

SEQ ID NO: 2367688 - RNA, 22 nt, Bordetella pertussis
gauccaggcggccaccaccagg

SEQ ID NO: 2367689 - RNA, 17 nt, Bordetella pertussis
gauccagggccgcagca

SEQ ID NO: 2367690 - RNA, 17 nt, Bordetella pertussis
gauccagggccgccagc

SEQ ID NO: 2367691 - RNA, 17 nt, Bordetella pertussis
gauccagggcgaucagc

SEQ ID NO: 2367692 - RNA, 22 nt, Bordetella pertussis
gauccagucgaugauccacagu

SEQ ID NO: 2367693 - RNA, 13 nt, Bordetella pertussis
gaucccaggccgg

SEQ ID NO: 2367694 - RNA, 14 nt, Bordetella pertussis
gaucccaggccggc

SEQ ID NO: 2367695 - RNA, 14 nt, Bordetella pertussis
gaucccaggcgcuc

SEQ ID NO: 2367696 - RNA, 23 nt, Bordetella pertussis
gaucccgagcgggcaugggcccc

SEQ ID NO: 2367697 - RNA, 22 nt, Bordetella pertussis
gaucccggccacgggaccgcuc

SEQ ID NO: 2367698 - RNA, 19 nt, Bordetella pertussis
gaucccggcgaucaugccg

SEQ ID NO: 2367699 - RNA, 14 nt, Bordetella pertussis
gaucccggcgccag

SEQ ID NO: 2367700 - RNA, 15 nt, Bordetella pertussis
gaucccggcgccagc

SEQ ID NO: 2367701 - RNA, 17 nt, Bordetella pertussis
gaucccggcgccagcca

SEQ ID NO: 2367702 - RNA, 18 nt, Bordetella pertussis
gaucccggcgccagccag

SEQ ID NO: 2367703 - RNA, 14 nt, Bordetella pertussis
gaucccggcgcugg

SEQ ID NO: 2367704 - RNA, 16 nt, Bordetella pertussis
gaucccggcgcuggcc

SEQ ID NO: 2367705 - RNA, 17 nt, Bordetella pertussis
gaucccggcgcuggccg

SEQ ID NO: 2367706 - RNA, 17 nt, Bordetella pertussis
gaucccuugugcgcgcc

SEQ ID NO: 2367707 - RNA, 14 nt, Bordetella pertussis
gaucggcgcuggcc

SEQ ID NO: 2367708 - RNA, 20 nt, Bordetella pertussis
gaucggcgcuggccuggccg

SEQ ID NO: 2367709 - RNA, 21 nt, Bordetella pertussis
gaucggcgcuggccuggccgc

SEQ ID NO: 2367710 - RNA, 15 nt, Bordetella pertussis
gaucggcggccuggg

SEQ ID NO: 2367711 - RNA, 18 nt, Bordetella pertussis
gaucggcggccugggcca

SEQ ID NO: 2367712 - RNA, 17 nt, Bordetella pertussis
gaucggcuugccgcgcg

SEQ ID NO: 2367713 - RNA, 20 nt, Bordetella pertussis
gaucggcuugccgcgcggcg

SEQ ID NO: 2367714 - RNA, 19 nt, Bordetella pertussis
gaucgggagccucuggaag

SEQ ID NO: 2367715 - RNA, 16 nt, Bordetella pertussis
gaucgggcagcuuggc

SEQ ID NO: 2367716 - RNA, 18 nt, Bordetella pertussis
gaucgggcagcuuggcgc

SEQ ID NO: 2367717 - RNA, 21 nt, Bordetella pertussis
gaucgggcagcuuggcgcgcc

SEQ ID NO: 2367718 - RNA, 22 nt, Bordetella pertussis
gaucgggcagcuuggcgcgccg

SEQ ID NO: 2367719 - RNA, 18 nt, Bordetella pertussis
gaucgucaccaucgccgc

SEQ ID NO: 2367720 - RNA, 13 nt, Bordetella pertussis
gaucgucagcagc

SEQ ID NO: 2367721 - RNA, 15 nt, Bordetella pertussis
gaucgucagcagcac

SEQ ID NO: 2367722 - RNA, 19 nt, Bordetella pertussis
gaucgucgacguccuggug

SEQ ID NO: 2367723 - RNA, 16 nt, Bordetella pertussis
gaucgucgcugcgcgg

SEQ ID NO: 2367724 - RNA, 19 nt, Bordetella pertussis
gaucgucuugaccagcagg

SEQ ID NO: 2367725 - RNA, 21 nt, Bordetella pertussis
gaucgugcacgcccgcggcgc

SEQ ID NO: 2367726 - RNA, 14 nt, Bordetella pertussis
gaucgugcgccacu

SEQ ID NO: 2367727 - RNA, 14 nt, Bordetella pertussis
gaucuacgcgcgcg

SEQ ID NO: 2367728 - RNA, 22 nt, Bordetella pertussis
gaucuaggccguuuccucugga

SEQ ID NO: 2367729 - RNA, 17 nt, Bordetella pertussis
gaucuccacccccgggc

SEQ ID NO: 2367730 - RNA, 17 nt, Bordetella pertussis
gaucuccacgaaggcga

SEQ ID NO: 2367731 - RNA, 19 nt, Bordetella pertussis
gaucuccggauccagccgc

SEQ ID NO: 2367732 - RNA, 20 nt, Bordetella pertussis
gaucuccggauccagccgcu

SEQ ID NO: 2367733 - RNA, 17 nt, Bordetella pertussis
gaucuccggcgccuggc

SEQ ID NO: 2367734 - RNA, 18 nt, Bordetella pertussis
gaucuccggcgccuggcc

SEQ ID NO: 2367735 - RNA, 22 nt, Bordetella pertussis
gaucuccgggagccuguccccg

SEQ ID NO: 2367736 - RNA, 14 nt, Bordetella pertussis
gaucucgcccagca

SEQ ID NO: 2367737 - RNA, 16 nt, Bordetella pertussis
gaucucgcccagcagg

SEQ ID NO: 2367738 - RNA, 17 nt, Bordetella pertussis
gaucucgcccugcucgc

SEQ ID NO: 2367739 - RNA, 21 nt, Bordetella pertussis
gaucucgcccugcucgcgcag

SEQ ID NO: 2367740 - RNA, 13 nt, Bordetella pertussis
gaucucgcgcacc

SEQ ID NO: 2367741 - RNA, 14 nt, Bordetella pertussis
gaucucgcgcaccg

SEQ ID NO: 2367742 - RNA, 17 nt, Bordetella pertussis
gaucucgcgcaccgaca

SEQ ID NO: 2367743 - RNA, 19 nt, Bordetella pertussis
gaucucgcgcgcgcggucc

SEQ ID NO: 2367744 - RNA, 18 nt, Bordetella pertussis
gaucucgcggcugguggu

SEQ ID NO: 2367745 - RNA, 16 nt, Bordetella pertussis
gaucucggccagcagc

SEQ ID NO: 2367746 - RNA, 17 nt, Bordetella pertussis
gaucucggccagcagcg

SEQ ID NO: 2367747 - RNA, 13 nt, Bordetella pertussis
gaucucggccugc

SEQ ID NO: 2367748 - RNA, 20 nt, Bordetella pertussis
gaucucgggcaggucggcca

SEQ ID NO: 2367749 - RNA, 14 nt, Bordetella pertussis
gaucucgucgaccg

SEQ ID NO: 2367750 - RNA, 17 nt, Bordetella pertussis
gaucucgucgaccgccu

SEQ ID NO: 2367751 - RNA, 19 nt, Bordetella pertussis
gaucucuccgaacgcgaca

SEQ ID NO: 2367752 - RNA, 21 nt, Bordetella pertussis
gaucugcgagccuucggccgg

SEQ ID NO: 2367753 - RNA, 23 nt, Bordetella pertussis
gaucugcgagccuucggccggcu

SEQ ID NO: 2367754 - RNA, 14 nt, Bordetella pertussis
gaucugcggcgugg

SEQ ID NO: 2367755 - RNA, 13 nt, Bordetella pertussis
gaucugcugggcc

SEQ ID NO: 2367756 - RNA, 14 nt, Bordetella pertussis
gaucugcuuccagu

SEQ ID NO: 2367757 - RNA, 15 nt, Bordetella pertussis
gaucugcuuccagua

SEQ ID NO: 2367758 - RNA, 23 nt, Bordetella pertussis
gaucugcuugaggccgcgcgccu

SEQ ID NO: 2367759 - RNA, 23 nt, Bordetella pertussis
gaucuggcaaucgggguggcgcc

SEQ ID NO: 2367760 - RNA, 17 nt, Bordetella pertussis
gaucuggccgaccagcg

SEQ ID NO: 2367761 - RNA, 17 nt, Bordetella pertussis
gaucuggccggcgcugg

SEQ ID NO: 2367762 - RNA, 14 nt, Bordetella pertussis
gaucuggccgucga

SEQ ID NO: 2367763 - RNA, 21 nt, Bordetella pertussis
gaucuggcgcgucaggccggg

SEQ ID NO: 2367764 - RNA, 13 nt, Bordetella pertussis
gaucugggccucg

SEQ ID NO: 2367765 - RNA, 16 nt, Bordetella pertussis
gaucugguccacggcg

SEQ ID NO: 2367766 - RNA, 19 nt, Bordetella pertussis
gaucugguccacggcggcg

SEQ ID NO: 2367767 - RNA, 20 nt, Bordetella pertussis
gaucugguccacggcggcgg

SEQ ID NO: 2367768 - RNA, 18 nt, Bordetella pertussis
gaucuggugaaacagcau

SEQ ID NO: 2367769 - RNA, 19 nt, Bordetella pertussis
gaucuguaccgccgggucg

SEQ ID NO: 2367770 - RNA, 15 nt, Bordetella pertussis
gaucuucccgccaug

SEQ ID NO: 2367771 - RNA, 18 nt, Bordetella pertussis
gaucuuccuugaagccgu

SEQ ID NO: 2367772 - RNA, 18 nt, Bordetella pertussis
gaucuucucgacggcgcg

SEQ ID NO: 2367773 - RNA, 17 nt, Bordetella pertussis
gaucuucucgccgcgcg

SEQ ID NO: 2367774 - RNA, 22 nt, Bordetella pertussis
gaucuucuggacuugcggcacg

SEQ ID NO: 2367775 - RNA, 17 nt, Bordetella pertussis
gaucuugauccaggaau

SEQ ID NO: 2367776 - RNA, 23 nt, Bordetella pertussis
gaucuugaugcggccguugcucc

SEQ ID NO: 2367777 - RNA, 20 nt, Bordetella pertussis
gaucuugccgaugcggcgca

SEQ ID NO: 2367778 - RNA, 17 nt, Bordetella pertussis
gaugaaauauugggcug

SEQ ID NO: 2367779 - RNA, 21 nt, Bordetella pertussis
gaugaacaagguacccgcgcc

SEQ ID NO: 2367780 - RNA, 14 nt, Bordetella pertussis
gaugaacagcgaga

SEQ ID NO: 2367781 - RNA, 24 nt, Bordetella pertussis
gaugaacagcggcacgccggcggc

SEQ ID NO: 2367782 - RNA, 14 nt, Bordetella pertussis
gaugaacgaccagc

SEQ ID NO: 2367783 - RNA, 16 nt, Bordetella pertussis
gaugaacgaccagcac

SEQ ID NO: 2367784 - RNA, 20 nt, Bordetella pertussis
gaugaacgcgcgcaacaggu

SEQ ID NO: 2367785 - RNA, 17 nt, Bordetella pertussis
gaugaagaugccgaacc

SEQ ID NO: 2367786 - RNA, 19 nt, Bordetella pertussis
gaugaagcccgagcggcgc

SEQ ID NO: 2367787 - RNA, 18 nt, Bordetella pertussis
gaugaagcguucggccuu

SEQ ID NO: 2367788 - RNA, 17 nt, Bordetella pertussis
gaugaauuccagccagg

SEQ ID NO: 2367789 - RNA, 15 nt, Bordetella pertussis
gaugaccagcagcgc

SEQ ID NO: 2367790 - RNA, 16 nt, Bordetella pertussis
gaugaccagcagcgcc

SEQ ID NO: 2367791 - RNA, 12 nt, Bordetella pertussis
gaugaccagcca

SEQ ID NO: 2367792 - RNA, 13 nt, Bordetella pertussis
gaugaccagcgcc

SEQ ID NO: 2367793 - RNA, 21 nt, Bordetella pertussis
gaugaccagcgccggcgcaug

SEQ ID NO: 2367794 - RNA, 16 nt, Bordetella pertussis
gaugaccagggcgccg

SEQ ID NO: 2367795 - RNA, 18 nt, Bordetella pertussis
gaugaccagggcgccgac

SEQ ID NO: 2367796 - RNA, 18 nt, Bordetella pertussis
gaugaccggccaggcgcg

SEQ ID NO: 2367797 - RNA, 15 nt, Bordetella pertussis
gaugaccucgcgcug

SEQ ID NO: 2367798 - RNA, 16 nt, Bordetella pertussis
gaugaccucgcgcugc

SEQ ID NO: 2367799 - RNA, 17 nt, Bordetella pertussis
gaugaccucgcgcugca

SEQ ID NO: 2367800 - RNA, 20 nt, Bordetella pertussis
gaugaccucggcgagcgccu

SEQ ID NO: 2367801 - RNA, 14 nt, Bordetella pertussis
gaugaccugggccu

SEQ ID NO: 2367802 - RNA, 22 nt, Bordetella pertussis
gaugaccuggugcaccacgcgc

SEQ ID NO: 2367803 - RNA, 20 nt, Bordetella pertussis
gaugaccuugagaugccagc

SEQ ID NO: 2367804 - RNA, 23 nt, Bordetella pertussis
gaugaccuugagaugccagcggc

SEQ ID NO: 2367805 - RNA, 18 nt, Bordetella pertussis
gaugacgcgccgcgccuu

SEQ ID NO: 2367806 - RNA, 17 nt, Bordetella pertussis
gaugacggggcggcgcc

SEQ ID NO: 2367807 - RNA, 18 nt, Bordetella pertussis
gaugacggggcggcgccu

SEQ ID NO: 2367808 - RNA, 15 nt, Bordetella pertussis
gaugacucgggcaug

SEQ ID NO: 2367809 - RNA, 17 nt, Bordetella pertussis
gaugagaucgcccgcgu

SEQ ID NO: 2367810 - RNA, 23 nt, Bordetella pertussis
gaugagcaauuuucgguauggcg

SEQ ID NO: 2367811 - RNA, 14 nt, Bordetella pertussis
gaugagcaggccgg

SEQ ID NO: 2367812 - RNA, 16 nt, Bordetella pertussis
gaugagcaggccgggu

SEQ ID NO: 2367813 - RNA, 12 nt, Bordetella pertussis
gaugagcgcgcc

SEQ ID NO: 2367814 - RNA, 16 nt, Bordetella pertussis
gaugagcuacccccug

SEQ ID NO: 2367815 - RNA, 20 nt, Bordetella pertussis
gaugagcuacccccugaccg

SEQ ID NO: 2367816 - RNA, 14 nt, Bordetella pertussis
gaugaggccaggga

SEQ ID NO: 2367817 - RNA, 22 nt, Bordetella pertussis
gaugagguaggugaacgacagc

SEQ ID NO: 2367818 - RNA, 14 nt, Bordetella pertussis
gaugaucaugauga

SEQ ID NO: 2367819 - RNA, 13 nt, Bordetella pertussis
gaugauccugcug

SEQ ID NO: 2367820 - RNA, 19 nt, Bordetella pertussis
gaugcgacuggcggcugcg

SEQ ID NO: 2367821 - RNA, 20 nt, Bordetella pertussis
gaugcgacuggcggcugcgg

SEQ ID NO: 2367822 - RNA, 14 nt, Bordetella pertussis
gaugcgaucgucgc

SEQ ID NO: 2367823 - RNA, 17 nt, Bordetella pertussis
gaugcgaucgucgcugc

SEQ ID NO: 2367824 - RNA, 14 nt, Bordetella pertussis
gaugcgcaccggcc

SEQ ID NO: 2367825 - RNA, 17 nt, Bordetella pertussis
gaugcgcaccggccagg

SEQ ID NO: 2367826 - RNA, 14 nt, Bordetella pertussis
gaugcgcacgccca

SEQ ID NO: 2367827 - RNA, 22 nt, Bordetella pertussis
gaugcgcacgggcgagggcugc

SEQ ID NO: 2367828 - RNA, 11 nt, Bordetella pertussis
gaugcgcagca

SEQ ID NO: 2367829 - RNA, 14 nt, Bordetella pertussis
gaugcgcagcagca

SEQ ID NO: 2367830 - RNA, 22 nt, Bordetella pertussis
gaugcgcagcagcagcgcaucg

SEQ ID NO: 2367831 - RNA, 13 nt, Bordetella pertussis
gaugcgcagcagg

SEQ ID NO: 2367832 - RNA, 16 nt, Bordetella pertussis
gaugcgcagcaggcgc

SEQ ID NO: 2367833 - RNA, 17 nt, Bordetella pertussis
gaugcgcagcaggcgcg

SEQ ID NO: 2367834 - RNA, 20 nt, Bordetella pertussis
gaugcgcagcaggcgcgugc

SEQ ID NO: 2367835 - RNA, 16 nt, Bordetella pertussis
gaugcgcaggacggcg

SEQ ID NO: 2367836 - RNA, 18 nt, Bordetella pertussis
gaugcgccacaaagggcg

SEQ ID NO: 2367837 - RNA, 19 nt, Bordetella pertussis
gaugcgccaguccagcgcg

SEQ ID NO: 2367838 - RNA, 21 nt, Bordetella pertussis
gaugcgccaguccagcgcgcc

SEQ ID NO: 2367839 - RNA, 22 nt, Bordetella pertussis
gaugcgccaguccagcgcgccg

SEQ ID NO: 2367840 - RNA, 14 nt, Bordetella pertussis
gaugcgccgcacca

SEQ ID NO: 2367841 - RNA, 14 nt, Bordetella pertussis
gaugcgccggccug

SEQ ID NO: 2367842 - RNA, 17 nt, Bordetella pertussis
gaugcgccggccuggcg

SEQ ID NO: 2367843 - RNA, 19 nt, Bordetella pertussis
gaugcgccggccuggcgcg

SEQ ID NO: 2367844 - RNA, 20 nt, Bordetella pertussis
gaugcgccggccuggcgcga

SEQ ID NO: 2367845 - RNA, 21 nt, Bordetella pertussis
gaugcgccucggcggaugcga

SEQ ID NO: 2367846 - RNA, 21 nt, Bordetella pertussis
gaugcgcgaacgggcagccga

SEQ ID NO: 2367847 - RNA, 16 nt, Bordetella pertussis
gaugcgcgagcgcgug

SEQ ID NO: 2367848 - RNA, 14 nt, Bordetella pertussis
gaugcgcgccaggc

SEQ ID NO: 2367849 - RNA, 17 nt, Bordetella pertussis
gaugcgcgccaggcgcg

SEQ ID NO: 2367850 - RNA, 20 nt, Bordetella pertussis
gaugcgcgccccgucggccg

SEQ ID NO: 2367851 - RNA, 11 nt, Bordetella pertussis
gaugcgcgccg

SEQ ID NO: 2367852 - RNA, 12 nt, Bordetella pertussis
gaugcgcgccgu

SEQ ID NO: 2367853 - RNA, 12 nt, Bordetella pertussis
gaugcgcgccuu

SEQ ID NO: 2367854 - RNA, 14 nt, Bordetella pertussis
gaugcgcgcgaccu

SEQ ID NO: 2367855 - RNA, 21 nt, Bordetella pertussis
gaugcgcgcgcgggccagcag

SEQ ID NO: 2367856 - RNA, 13 nt, Bordetella pertussis
gaugcgcgcggcc

SEQ ID NO: 2367857 - RNA, 17 nt, Bordetella pertussis
gaugcgcgcggccagcg

SEQ ID NO: 2367858 - RNA, 19 nt, Bordetella pertussis
gaugcgcgcggccagcgcg

SEQ ID NO: 2367859 - RNA, 16 nt, Bordetella pertussis
gaugcgcgcggccaug

SEQ ID NO: 2367860 - RNA, 13 nt, Bordetella pertussis
gaugcgcggcacg

SEQ ID NO: 2367861 - RNA, 13 nt, Bordetella pertussis
gaugcgcggcggg

SEQ ID NO: 2367862 - RNA, 17 nt, Bordetella pertussis
gaugcgcucgaucaagg

SEQ ID NO: 2367863 - RNA, 17 nt, Bordetella pertussis
gaugcgcuggccggccg

SEQ ID NO: 2367864 - RNA, 12 nt, Bordetella pertussis
gaugcgcugggc

SEQ ID NO: 2367865 - RNA, 17 nt, Bordetella pertussis
gaugcgcugggccaggc

SEQ ID NO: 2367866 - RNA, 18 nt, Bordetella pertussis
gaugcgcugggccaggcc

SEQ ID NO: 2367867 - RNA, 22 nt, Bordetella pertussis
gaugcgcugggccaggccggcc

SEQ ID NO: 2367868 - RNA, 16 nt, Bordetella pertussis
gaugcgcuugccgccc

SEQ ID NO: 2367869 - RNA, 18 nt, Bordetella pertussis
gaugcggccuucgccggu

SEQ ID NO: 2367870 - RNA, 13 nt, Bordetella pertussis
gaugcggcgccac

SEQ ID NO: 2367871 - RNA, 12 nt, Bordetella pertussis
gaugcggcgcgc

SEQ ID NO: 2367872 - RNA, 22 nt, Bordetella pertussis
gaugcggcgcgccgcgucggug

SEQ ID NO: 2367873 - RNA, 13 nt, Bordetella pertussis
gaugcggcggccg

SEQ ID NO: 2367874 - RNA, 15 nt, Bordetella pertussis
gaugcgggccacgcc

SEQ ID NO: 2367875 - RNA, 20 nt, Bordetella pertussis
gaugcgggccacgccggccg

SEQ ID NO: 2367876 - RNA, 22 nt, Bordetella pertussis
gaugcgggccacgccggccggg

SEQ ID NO: 2367877 - RNA, 13 nt, Bordetella pertussis
gaugcgggcggcg

SEQ ID NO: 2367878 - RNA, 14 nt, Bordetella pertussis
gaugcgggcggcgg

SEQ ID NO: 2367879 - RNA, 20 nt, Bordetella pertussis
gaugcggguacuggccgacg

SEQ ID NO: 2367880 - RNA, 20 nt, Bordetella pertussis
gaugcgggucaaggcggggc

SEQ ID NO: 2367881 - RNA, 18 nt, Bordetella pertussis
gaugcgguacugcggcgc

SEQ ID NO: 2367882 - RNA, 14 nt, Bordetella pertussis
gaugcggucggcca

SEQ ID NO: 2367883 - RNA, 14 nt, Bordetella pertussis
gaugcggucggccg

SEQ ID NO: 2367884 - RNA, 22 nt, Bordetella pertussis
gaugcgguugaucagggccgcc

SEQ ID NO: 2367885 - RNA, 22 nt, Bordetella pertussis
gaugcgguuguugccgcgucga

SEQ ID NO: 2367886 - RNA, 21 nt, Bordetella pertussis
gaugcgucaggggcaugccgg

SEQ ID NO: 2367887 - RNA, 23 nt, Bordetella pertussis
gaugcguccgucggguugccgcu

SEQ ID NO: 2367888 - RNA, 23 nt, Bordetella pertussis
gaugcguucgacuucguccggcg

SEQ ID NO: 2367889 - RNA, 21 nt, Bordetella pertussis
gaugcguucgcccgugccgca

SEQ ID NO: 2367890 - RNA, 23 nt, Bordetella pertussis
gaugcucgauaugcagcaccgga

SEQ ID NO: 2367891 - RNA, 18 nt, Bordetella pertussis
gaugcucgccggcgccgc

SEQ ID NO: 2367892 - RNA, 15 nt, Bordetella pertussis
gaugcugaccaccgg

SEQ ID NO: 2367893 - RNA, 16 nt, Bordetella pertussis
gaugcugcagggccug

SEQ ID NO: 2367894 - RNA, 18 nt, Bordetella pertussis
gaugcugcagggccugga

SEQ ID NO: 2367895 - RNA, 18 nt, Bordetella pertussis
gaugcuggcgcggaccug

SEQ ID NO: 2367896 - RNA, 22 nt, Bordetella pertussis
gaugcuggcgcggaccugcucg

SEQ ID NO: 2367897 - RNA, 13 nt, Bordetella pertussis
gaugcuggcggca

SEQ ID NO: 2367898 - RNA, 17 nt, Bordetella pertussis
gaugcuggucagccugg

SEQ ID NO: 2367899 - RNA, 18 nt, Bordetella pertussis
gaugcuggucagccuggg

SEQ ID NO: 2367900 - RNA, 19 nt, Bordetella pertussis
gaugcuggucagccugggc

SEQ ID NO: 2367901 - RNA, 20 nt, Bordetella pertussis
gauggaaucauuggccagcg

SEQ ID NO: 2367902 - RNA, 14 nt, Bordetella pertussis
gauggacuggccgc

SEQ ID NO: 2367903 - RNA, 17 nt, Bordetella pertussis
gauggagagggccuggu

SEQ ID NO: 2367904 - RNA, 21 nt, Bordetella pertussis
gauggaucccuggucgaccca

SEQ ID NO: 2367905 - RNA, 18 nt, Bordetella pertussis
gauggaugccgucggccu

SEQ ID NO: 2367906 - RNA, 19 nt, Bordetella pertussis
gauggauuucgaccgcaug

SEQ ID NO: 2367907 - RNA, 23 nt, Bordetella pertussis
gauggauuucgaccgcaugcggc

SEQ ID NO: 2367908 - RNA, 21 nt, Bordetella pertussis
gauggcacggcacgccucgcc

SEQ ID NO: 2367909 - RNA, 18 nt, Bordetella pertussis
gauggcauggggcaggcg

SEQ ID NO: 2367910 - RNA, 18 nt, Bordetella pertussis
gauggccacgaccaccag

SEQ ID NO: 2367911 - RNA, 19 nt, Bordetella pertussis
gauggccacgaccaccagc

SEQ ID NO: 2367912 - RNA, 14 nt, Bordetella pertussis
gauggccagcagcg

SEQ ID NO: 2367913 - RNA, 22 nt, Bordetella pertussis
gauggccagcagcgccgccagc

SEQ ID NO: 2367914 - RNA, 13 nt, Bordetella pertussis
gauggccagcgcg

SEQ ID NO: 2367915 - RNA, 14 nt, Bordetella pertussis
gauggccagcgcgc

SEQ ID NO: 2367916 - RNA, 15 nt, Bordetella pertussis
gauggccagcgcgcg

SEQ ID NO: 2367917 - RNA, 20 nt, Bordetella pertussis
gauggccagguggcggcggc

SEQ ID NO: 2367918 - RNA, 13 nt, Bordetella pertussis
gauggccaucgac

SEQ ID NO: 2367919 - RNA, 12 nt, Bordetella pertussis
gauggcccaggg

SEQ ID NO: 2367920 - RNA, 16 nt, Bordetella pertussis
gauggcccagggcagc

SEQ ID NO: 2367921 - RNA, 20 nt, Bordetella pertussis
gauggcccgguaggccacgc

SEQ ID NO: 2367922 - RNA, 22 nt, Bordetella pertussis
gauggcccgguaggccacgcgc

SEQ ID NO: 2367923 - RNA, 17 nt, Bordetella pertussis
gauggcccgguuggggu

SEQ ID NO: 2367924 - RNA, 18 nt, Bordetella pertussis
gauggcccuugcccagcg

SEQ ID NO: 2367925 - RNA, 15 nt, Bordetella pertussis
gauggccgacauguc

SEQ ID NO: 2367926 - RNA, 16 nt, Bordetella pertussis
gauggccgacaugucg

SEQ ID NO: 2367927 - RNA, 14 nt, Bordetella pertussis
gauggccgccagcg

SEQ ID NO: 2367928 - RNA, 16 nt, Bordetella pertussis
gauggccgccagcggc

SEQ ID NO: 2367929 - RNA, 14 nt, Bordetella pertussis
gauggccgcgcgca

SEQ ID NO: 2367930 - RNA, 15 nt, Bordetella pertussis
gauggccgcgcgcag

SEQ ID NO: 2367931 - RNA, 20 nt, Bordetella pertussis
gauggccgcgcgcagcgagg

SEQ ID NO: 2367932 - RNA, 23 nt, Bordetella pertussis
gauggccggaucguagugcgugg

SEQ ID NO: 2367933 - RNA, 15 nt, Bordetella pertussis
gaugugcaggccgag

SEQ ID NO: 2367934 - RNA, 16 nt, Bordetella pertussis
gaugugcaugccgucg

SEQ ID NO: 2367935 - RNA, 18 nt, Bordetella pertussis
gaugugcaugccgucgcg

SEQ ID NO: 2367936 - RNA, 20 nt, Bordetella pertussis
gaugugcgcgggcgcgggcu

SEQ ID NO: 2367937 - RNA, 17 nt, Bordetella pertussis
gaugugcggcguggcgg

SEQ ID NO: 2367938 - RNA, 19 nt, Bordetella pertussis
gaugugcggcguggcgggg

SEQ ID NO: 2367939 - RNA, 20 nt, Bordetella pertussis
gaugugcggcguggcggggc

SEQ ID NO: 2367940 - RNA, 14 nt, Bordetella pertussis
gauguggcgcuggc

SEQ ID NO: 2367941 - RNA, 16 nt, Bordetella pertussis
gauguggcgcuggcgg

SEQ ID NO: 2367942 - RNA, 16 nt, Bordetella pertussis
gauguucaugaccgcc

SEQ ID NO: 2367943 - RNA, 18 nt, Bordetella pertussis
gauguucaugaccgccgc

SEQ ID NO: 2367944 - RNA, 15 nt, Bordetella pertussis
gauguugaacagcug

SEQ ID NO: 2367945 - RNA, 17 nt, Bordetella pertussis
gauguugaacagcugga

SEQ ID NO: 2367946 - RNA, 17 nt, Bordetella pertussis
gauguugccgccggcca

SEQ ID NO: 2367947 - RNA, 15 nt, Bordetella pertussis
gauucaugggcggcg

SEQ ID NO: 2367948 - RNA, 17 nt, Bordetella pertussis
gauuccaccuugccgcu

SEQ ID NO: 2367949 - RNA, 15 nt, Bordetella pertussis
gauuccagcgccgcc

SEQ ID NO: 2367950 - RNA, 13 nt, Bordetella pertussis
gauucccagcucc

SEQ ID NO: 2367951 - RNA, 20 nt, Bordetella pertussis
gauucccaggcccggccgca

SEQ ID NO: 2367952 - RNA, 24 nt, Bordetella pertussis
gauucccaggcccggccgcagggc

SEQ ID NO: 2367953 - RNA, 22 nt, Bordetella pertussis
gauucccuggcgcgccagcucg

SEQ ID NO: 2367954 - RNA, 19 nt, Bordetella pertussis
gauuccugucgcgcugcuu

SEQ ID NO: 2367955 - RNA, 17 nt, Bordetella pertussis
gauucgccggucggccg

SEQ ID NO: 2367956 - RNA, 15 nt, Bordetella pertussis
gauucgcgcaccgag

SEQ ID NO: 2367957 - RNA, 13 nt, Bordetella pertussis
gauucgcgccggc

SEQ ID NO: 2367958 - RNA, 19 nt, Bordetella pertussis
gauucgcgccggccgacgg

SEQ ID NO: 2367959 - RNA, 16 nt, Bordetella pertussis
gauucggacgccucgc

SEQ ID NO: 2367960 - RNA, 23 nt, Bordetella pertussis
gauucuugaaaaagcugccggca

SEQ ID NO: 2367961 - RNA, 17 nt, Bordetella pertussis
gauugaugcccaugcgc

SEQ ID NO: 2367962 - RNA, 22 nt, Bordetella pertussis
gauugaugucgcgcaccgccug

SEQ ID NO: 2367963 - RNA, 17 nt, Bordetella pertussis
gauugcaucuccaggau

SEQ ID NO: 2367964 - RNA, 21 nt, Bordetella pertussis
gauugccgccgcgcagccgac

SEQ ID NO: 2367965 - RNA, 15 nt, Bordetella pertussis
gauugccguccuggc

SEQ ID NO: 2367966 - RNA, 20 nt, Bordetella pertussis
gauugccguccuggcgaccg

SEQ ID NO: 2367967 - RNA, 15 nt, Bordetella pertussis
gauugcgccagcgcu

SEQ ID NO: 2367968 - RNA, 13 nt, Bordetella pertussis
gauuggacagcag

SEQ ID NO: 2367969 - RNA, 17 nt, Bordetella pertussis
gauuggacagcaguucg

SEQ ID NO: 2367970 - RNA, 14 nt, Bordetella pertussis
gauuggccaccagg

SEQ ID NO: 2367971 - RNA, 17 nt, Bordetella pertussis
gauuggccgagcgcgga

SEQ ID NO: 2367972 - RNA, 21 nt, Bordetella pertussis
gauuggccgagcgcggaucga

SEQ ID NO: 2367973 - RNA, 18 nt, Bordetella pertussis
gauuggcgaaaggcaccg

SEQ ID NO: 2367974 - RNA, 22 nt, Bordetella pertussis
gauuggcgaaaggcaccgagca

SEQ ID NO: 2367975 - RNA, 12 nt, Bordetella pertussis
gauuggcgcugc

SEQ ID NO: 2367976 - RNA, 19 nt, Bordetella pertussis
gauuguccagcggcagcgg

SEQ ID NO: 2367977 - RNA, 18 nt, Bordetella pertussis
gauuguccugcacgaagc

SEQ ID NO: 2367978 - RNA, 20 nt, Bordetella pertussis
gauugugcaugacggccagg

SEQ ID NO: 2367979 - RNA, 21 nt, Bordetella pertussis
gauugugcaugacggccagga

SEQ ID NO: 2367980 - RNA, 17 nt, Bordetella pertussis
gauuucauggcgucugc

SEQ ID NO: 2367981 - RNA, 20 nt, Bordetella pertussis
gauuucgcgcgccagcgcgg

SEQ ID NO: 2367982 - RNA, 16 nt, Bordetella pertussis
gauuucgcuggccauc

SEQ ID NO: 2367983 - RNA, 19 nt, Bordetella pertussis
gauuucggcggccaggccc

SEQ ID NO: 2367984 - RNA, 22 nt, Bordetella pertussis
gauuucgggugaggggccagcc

SEQ ID NO: 2367985 - RNA, 23 nt, Bordetella pertussis
gauuucgggugaggggccagccu

SEQ ID NO: 2367986 - RNA, 14 nt, Bordetella pertussis
gauuuucaccaucc

SEQ ID NO: 2367987 - RNA, 14 nt, Bordetella pertussis
gcaaaaaaagaggc

SEQ ID NO: 2367988 - RNA, 22 nt, Bordetella pertussis
gcaaaacggugccuugcggcgc

SEQ ID NO: 2367989 - RNA, 18 nt, Bordetella pertussis
gcaaaagcguuccagcag

SEQ ID NO: 2367990 - RNA, 19 nt, Bordetella pertussis
gcaaaagcguuccagcaga

SEQ ID NO: 2367991 - RNA, 13 nt, Bordetella pertussis
gcaaaccacgucg

SEQ ID NO: 2367992 - RNA, 19 nt, Bordetella pertussis
gcaaacccggcgaagccgg

SEQ ID NO: 2367993 - RNA, 12 nt, Bordetella pertussis
gcaaaccugccg

SEQ ID NO: 2367994 - RNA, 17 nt, Bordetella pertussis
gcaaacggcggcaggcc

SEQ ID NO: 2367995 - RNA, 19 nt, Bordetella pertussis
gcaaacggcggcaggccgc

SEQ ID NO: 2367996 - RNA, 18 nt, Bordetella pertussis
gcaaacgggggcaggccg

SEQ ID NO: 2367997 - RNA, 19 nt, Bordetella pertussis
gcaaacuuccccgcgugcc

SEQ ID NO: 2367998 - RNA, 20 nt, Bordetella pertussis
gcaaacuuccccgcgugccu

SEQ ID NO: 2367999 - RNA, 22 nt, Bordetella pertussis
gcaaacuuccccgcgugccugu

SEQ ID NO: 2368000 - RNA, 12 nt, Bordetella pertussis
gcaaagaucacc

SEQ ID NO: 2368001 - RNA, 13 nt, Bordetella pertussis
gcaaagccgcugc

SEQ ID NO: 2368002 - RNA, 15 nt, Bordetella pertussis
gcaaagccugacggc

SEQ ID NO: 2368003 - RNA, 17 nt, Bordetella pertussis
gcaaagccugacggcua

SEQ ID NO: 2368004 - RNA, 15 nt, Bordetella pertussis
gcaaagcgcgcgucc

SEQ ID NO: 2368005 - RNA, 18 nt, Bordetella pertussis
gcaaagcgcgcguccugc

SEQ ID NO: 2368006 - RNA, 17 nt, Bordetella pertussis
gcaaagcgguccccaga

SEQ ID NO: 2368007 - RNA, 14 nt, Bordetella pertussis
gcaaaggcccaggc

SEQ ID NO: 2368008 - RNA, 15 nt, Bordetella pertussis
gcaaaggcccaggca

SEQ ID NO: 2368009 - RNA, 15 nt, Bordetella pertussis
gcaaaucaaugaaaa

SEQ ID NO: 2368010 - RNA, 14 nt, Bordetella pertussis
gcaaauggggcggc

SEQ ID NO: 2368011 - RNA, 14 nt, Bordetella pertussis
gcaacaaccgcgcc

SEQ ID NO: 2368012 - RNA, 13 nt, Bordetella pertussis
gcaacacgaccag

SEQ ID NO: 2368013 - RNA, 14 nt, Bordetella pertussis
gcaacacgaccagc

SEQ ID NO: 2368014 - RNA, 16 nt, Bordetella pertussis
gcaacacgaccagcag

SEQ ID NO: 2368015 - RNA, 19 nt, Bordetella pertussis
gcaacacgcgcgacgccgu

SEQ ID NO: 2368016 - RNA, 15 nt, Bordetella pertussis
gcaacagacccgggc

SEQ ID NO: 2368017 - RNA, 16 nt, Bordetella pertussis
gcaacagacccgggcc

SEQ ID NO: 2368018 - RNA, 21 nt, Bordetella pertussis
gcaacaggcagcugcgcgucg

SEQ ID NO: 2368019 - RNA, 21 nt, Bordetella pertussis
gcaaccagcucagcuuggcgu

SEQ ID NO: 2368020 - RNA, 21 nt, Bordetella pertussis
gcaaccagggagccguucugg

SEQ ID NO: 2368021 - RNA, 15 nt, Bordetella pertussis
gcaaccaggggcggc

SEQ ID NO: 2368022 - RNA, 16 nt, Bordetella pertussis
gcaaccaggggcggcg

SEQ ID NO: 2368023 - RNA, 21 nt, Bordetella pertussis
gcaaccaggggcggcgcggcg

SEQ ID NO: 2368024 - RNA, 19 nt, Bordetella pertussis
gcaacccacccccagcagc

SEQ ID NO: 2368025 - RNA, 22 nt, Bordetella pertussis
gcaaccccaccggcaagccuug

SEQ ID NO: 2368026 - RNA, 16 nt, Bordetella pertussis
gcaaccccagcagcgc

SEQ ID NO: 2368027 - RNA, 23 nt, Bordetella pertussis
gcaacccgcccacgcggcgcugc

SEQ ID NO: 2368028 - RNA, 13 nt, Bordetella pertussis
gcaacccgcccgg

SEQ ID NO: 2368029 - RNA, 18 nt, Bordetella pertussis
gcaacccggccucgcugc

SEQ ID NO: 2368030 - RNA, 23 nt, Bordetella pertussis
gcaaccgccacgugcugcuggag

SEQ ID NO: 2368031 - RNA, 19 nt, Bordetella pertussis
gcaaccggaacaccagcaa

SEQ ID NO: 2368032 - RNA, 18 nt, Bordetella pertussis
gcaaccggucggccggca

SEQ ID NO: 2368033 - RNA, 19 nt, Bordetella pertussis
gcaaccggucggccggcag

SEQ ID NO: 2368034 - RNA, 22 nt, Bordetella pertussis
gcaaccggucggccggcagcgg

SEQ ID NO: 2368035 - RNA, 23 nt, Bordetella pertussis
gcaaccggucggccggcagcggc

SEQ ID NO: 2368036 - RNA, 17 nt, Bordetella pertussis
gcaaccgucgaccggcc

SEQ ID NO: 2368037 - RNA, 16 nt, Bordetella pertussis
gcaaccgucgccagcg

SEQ ID NO: 2368038 - RNA, 13 nt, Bordetella pertussis
gcaaccucgccgc

SEQ ID NO: 2368039 - RNA, 18 nt, Bordetella pertussis
gcaaccuggucaagggcg

SEQ ID NO: 2368040 - RNA, 21 nt, Bordetella pertussis
gcaaccuggucaagggcggcc

SEQ ID NO: 2368041 - RNA, 19 nt, Bordetella pertussis
gcaacgacgcaggcgccgc

SEQ ID NO: 2368042 - RNA, 21 nt, Bordetella pertussis
gcaacgacgcaggcgccgcac

SEQ ID NO: 2368043 - RNA, 19 nt, Bordetella pertussis
gcaacgcaggcgccgcccc

SEQ ID NO: 2368044 - RNA, 22 nt, Bordetella pertussis
gcaacgcaggcgccgccccguc

SEQ ID NO: 2368045 - RNA, 14 nt, Bordetella pertussis
gcaacgcaugcgcg

SEQ ID NO: 2368046 - RNA, 15 nt, Bordetella pertussis
gcaauaccuucagcc

SEQ ID NO: 2368047 - RNA, 18 nt, Bordetella pertussis
gcaauaccuucagcccgg

SEQ ID NO: 2368048 - RNA, 20 nt, Bordetella pertussis
gcaauaccuucagcccggcg

SEQ ID NO: 2368049 - RNA, 17 nt, Bordetella pertussis
gcaauacgccgccggcg

SEQ ID NO: 2368050 - RNA, 18 nt, Bordetella pertussis
gcaauacgucgcgaccgc

SEQ ID NO: 2368051 - RNA, 21 nt, Bordetella pertussis
gcaauacgucgcgaccgccgc

SEQ ID NO: 2368052 - RNA, 14 nt, Bordetella pertussis
gcaauacgugcgcg

SEQ ID NO: 2368053 - RNA, 16 nt, Bordetella pertussis
gcaauagaucauccag

SEQ ID NO: 2368054 - RNA, 16 nt, Bordetella pertussis
gcaauaggccgcgaug

SEQ ID NO: 2368055 - RNA, 15 nt, Bordetella pertussis
gcaaucaagggccuu

SEQ ID NO: 2368056 - RNA, 19 nt, Bordetella pertussis
gcaaucagccccaggcgcg

SEQ ID NO: 2368057 - RNA, 20 nt, Bordetella pertussis
gcaaucagccccaggcgcgu

SEQ ID NO: 2368058 - RNA, 15 nt, Bordetella pertussis
gcaauccgucaggca

SEQ ID NO: 2368059 - RNA, 22 nt, Bordetella pertussis
gcaaucgaaaagcccgccgagu

SEQ ID NO: 2368060 - RNA, 20 nt, Bordetella pertussis
gcaaucgacgaacaaggccg

SEQ ID NO: 2368061 - RNA, 24 nt, Bordetella pertussis
gcaaucgaugaagaucaggcggcu

SEQ ID NO: 2368062 - RNA, 20 nt, Bordetella pertussis
gcaaucggagguaugcacga

SEQ ID NO: 2368063 - RNA, 21 nt, Bordetella pertussis
gcaaucggagguaugcacgac

SEQ ID NO: 2368064 - RNA, 22 nt, Bordetella pertussis
gcaaucggagguaugcacgacc

SEQ ID NO: 2368065 - RNA, 14 nt, Bordetella pertussis
gcaaucggcgugca

SEQ ID NO: 2368066 - RNA, 17 nt, Bordetella pertussis
gcaaucgggguggcgcc

SEQ ID NO: 2368067 - RNA, 18 nt, Bordetella pertussis
gcaaucgggguggcgccg

SEQ ID NO: 2368068 - RNA, 19 nt, Bordetella pertussis
gcaaucgggguggcgccgu

SEQ ID NO: 2368069 - RNA, 16 nt, Bordetella pertussis
gcaaucuugccgccgg

SEQ ID NO: 2368070 - RNA, 19 nt, Bordetella pertussis
gcaaucuugccgccgggca

SEQ ID NO: 2368071 - RNA, 17 nt, Bordetella pertussis
gcaaugacgacgccggc

SEQ ID NO: 2368072 - RNA, 16 nt, Bordetella pertussis
gcaaugcgcaggcccg

SEQ ID NO: 2368073 - RNA, 16 nt, Bordetella pertussis
gcaaugcgcggcgcuc

SEQ ID NO: 2368074 - RNA, 14 nt, Bordetella pertussis
gcaaugcggccagg

SEQ ID NO: 2368075 - RNA, 17 nt, Bordetella pertussis
gcaaugcguggccggcg

SEQ ID NO: 2368076 - RNA, 15 nt, Bordetella pertussis
gcaaugguccagcag

SEQ ID NO: 2368077 - RNA, 16 nt, Bordetella pertussis
gcaaugguccagcagg

SEQ ID NO: 2368078 - RNA, 17 nt, Bordetella pertussis
gcaaugguccagcaggg

SEQ ID NO: 2368079 - RNA, 14 nt, Bordetella pertussis
gcaaugucgcaggc

SEQ ID NO: 2368080 - RNA, 21 nt, Bordetella pertussis
gcaauucgaccggcagggugc

SEQ ID NO: 2368081 - RNA, 14 nt, Bordetella pertussis
gcaauugccccagc

SEQ ID NO: 2368082 - RNA, 13 nt, Bordetella pertussis
gcacaaccuggcg

SEQ ID NO: 2368083 - RNA, 23 nt, Bordetella pertussis
gcacaagcgcguggccggcgacg

SEQ ID NO: 2368084 - RNA, 22 nt, Bordetella pertussis
gcacaagggccccucgcggggc

SEQ ID NO: 2368085 - RNA, 15 nt, Bordetella pertussis
gcacaaucugcgucg

SEQ ID NO: 2368086 - RNA, 15 nt, Bordetella pertussis
gcacaccagcgccag

SEQ ID NO: 2368087 - RNA, 14 nt, Bordetella pertussis
gcacaccaucagcu

SEQ ID NO: 2368088 - RNA, 16 nt, Bordetella pertussis
gcacaccaucagcugg

SEQ ID NO: 2368089 - RNA, 17 nt, Bordetella pertussis
gcacaccaucagcugga

SEQ ID NO: 2368090 - RNA, 19 nt, Bordetella pertussis
gcacaccccgggcgggcac

SEQ ID NO: 2368091 - RNA, 21 nt, Bordetella pertussis
gcacacccuccuacgccauga

SEQ ID NO: 2368092 - RNA, 23 nt, Bordetella pertussis
gcacacccuccuacgccaugaca

SEQ ID NO: 2368093 - RNA, 23 nt, Bordetella pertussis
gcacaccgcccgaaagguccugg

SEQ ID NO: 2368094 - RNA, 13 nt, Bordetella pertussis
gcacaccggucua

SEQ ID NO: 2368095 - RNA, 16 nt, Bordetella pertussis
gcacaccgugccgcag

SEQ ID NO: 2368096 - RNA, 13 nt, Bordetella pertussis
gcacacgaccggc

SEQ ID NO: 2368097 - RNA, 18 nt, Bordetella pertussis
gcacacgccuucggcgac

SEQ ID NO: 2368098 - RNA, 20 nt, Bordetella pertussis
gcacacgccuucggcgacuu

SEQ ID NO: 2368099 - RNA, 14 nt, Bordetella pertussis
gcacacgcgcuggg

SEQ ID NO: 2368100 - RNA, 14 nt, Bordetella pertussis
gcacacucugucgc

SEQ ID NO: 2368101 - RNA, 17 nt, Bordetella pertussis
gcacacucugucgcgga

SEQ ID NO: 2368102 - RNA, 14 nt, Bordetella pertussis
gcacacuggccagc

SEQ ID NO: 2368103 - RNA, 15 nt, Bordetella pertussis
gcacacuggccagca

SEQ ID NO: 2368104 - RNA, 16 nt, Bordetella pertussis
gcacacuggccagcaa

SEQ ID NO: 2368105 - RNA, 17 nt, Bordetella pertussis
gcacacuggccagcaag

SEQ ID NO: 2368106 - RNA, 23 nt, Bordetella pertussis
gcacagcaacucuuccccgucgg

SEQ ID NO: 2368107 - RNA, 22 nt, Bordetella pertussis
gcacagcaccugguggcgcugg

SEQ ID NO: 2368108 - RNA, 19 nt, Bordetella pertussis
gcacagcaugcgcuggucg

SEQ ID NO: 2368109 - RNA, 22 nt, Bordetella pertussis
gcacagcaugcgcuggucgcgc

SEQ ID NO: 2368110 - RNA, 23 nt, Bordetella pertussis
gcacagcaugcgcuggucgcgca

SEQ ID NO: 2368111 - RNA, 19 nt, Bordetella pertussis
gcacagcccgaucgacggc

SEQ ID NO: 2368112 - RNA, 20 nt, Bordetella pertussis
gcacagcccgaucgacggcc

SEQ ID NO: 2368113 - RNA, 13 nt, Bordetella pertussis
gcacagccgcagc

SEQ ID NO: 2368114 - RNA, 22 nt, Bordetella pertussis
gcacagccggggcgagcgcagc

SEQ ID NO: 2368115 - RNA, 19 nt, Bordetella pertussis
gcacagcgcgcaacuccag

SEQ ID NO: 2368116 - RNA, 20 nt, Bordetella pertussis
gcacagcgcgcaacuccagc

SEQ ID NO: 2368117 - RNA, 18 nt, Bordetella pertussis
gcacagcgcggcgaaggc

SEQ ID NO: 2368118 - RNA, 23 nt, Bordetella pertussis
gcacagcgcggcgaaggcgcggc

SEQ ID NO: 2368119 - RNA, 17 nt, Bordetella pertussis
gcacagcgcggcgaugc

SEQ ID NO: 2368120 - RNA, 15 nt, Bordetella pertussis
gcacagcgucccagc

SEQ ID NO: 2368121 - RNA, 13 nt, Bordetella pertussis
gcacagcguggcg

SEQ ID NO: 2368122 - RNA, 17 nt, Bordetella pertussis
gcacagcguggcgaagu

SEQ ID NO: 2368123 - RNA, 17 nt, Bordetella pertussis
gcacaggccaucggcgc

SEQ ID NO: 2368124 - RNA, 18 nt, Bordetella pertussis
gcacaggccaucggcgcc

SEQ ID NO: 2368125 - RNA, 23 nt, Bordetella pertussis
gcacaggccaucggcgccaagcg

SEQ ID NO: 2368126 - RNA, 14 nt, Bordetella pertussis
gcacaggcgcucgc

SEQ ID NO: 2368127 - RNA, 14 nt, Bordetella pertussis
gcacaggcggcgcc

SEQ ID NO: 2368128 - RNA, 19 nt, Bordetella pertussis
gcacaggcggcgccggcac

SEQ ID NO: 2368129 - RNA, 19 nt, Bordetella pertussis
gcacagggcgucgcgaugc

SEQ ID NO: 2368130 - RNA, 22 nt, Bordetella pertussis
gcacagguagaucagccgcugc

SEQ ID NO: 2368131 - RNA, 18 nt, Bordetella pertussis
gcacaguacuuguugcgu

SEQ ID NO: 2368132 - RNA, 21 nt, Bordetella pertussis
gcacaguucgugcaccagccc

SEQ ID NO: 2368133 - RNA, 15 nt, Bordetella pertussis
gcacauacgccgccg

SEQ ID NO: 2368134 - RNA, 19 nt, Bordetella pertussis
gcacauagcgcaagcccgu

SEQ ID NO: 2368135 - RNA, 18 nt, Bordetella pertussis
gcacaucagcgugccgcc

SEQ ID NO: 2368136 - RNA, 20 nt, Bordetella pertussis
gcacaucagcgugccgccgg

SEQ ID NO: 2368137 - RNA, 22 nt, Bordetella pertussis
gcacaucagcgugccgccggcg

SEQ ID NO: 2368138 - RNA, 19 nt, Bordetella pertussis
gcacaucaggucgaccugc

SEQ ID NO: 2368139 - RNA, 21 nt, Bordetella pertussis
gcacaucaggucgaccugcuu

SEQ ID NO: 2368140 - RNA, 16 nt, Bordetella pertussis
gcacauccagcgccag

SEQ ID NO: 2368141 - RNA, 19 nt, Bordetella pertussis
gcacauccagcgccagcac

SEQ ID NO: 2368142 - RNA, 24 nt, Bordetella pertussis
gcacauccagcgccagcaccggca

SEQ ID NO: 2368143 - RNA, 16 nt, Bordetella pertussis
gcacaucgacgucggc

SEQ ID NO: 2368144 - RNA, 14 nt, Bordetella pertussis
gcacaucgcccggc

SEQ ID NO: 2368145 - RNA, 15 nt, Bordetella pertussis
gcacaucgcccggca

SEQ ID NO: 2368146 - RNA, 13 nt, Bordetella pertussis
gcacaucgcccgu

SEQ ID NO: 2368147 - RNA, 19 nt, Bordetella pertussis
gcacaucggaauuggcggc

SEQ ID NO: 2368148 - RNA, 13 nt, Bordetella pertussis
gcacaucggccac

SEQ ID NO: 2368149 - RNA, 16 nt, Bordetella pertussis
gcacaugaugcccagc

SEQ ID NO: 2368150 - RNA, 17 nt, Bordetella pertussis
gcacaugaugcccagcg

SEQ ID NO: 2368151 - RNA, 21 nt, Bordetella pertussis
gcacaugaugcccagcgccag

SEQ ID NO: 2368152 - RNA, 14 nt, Bordetella pertussis
gcacaugcccggcc

SEQ ID NO: 2368153 - RNA, 17 nt, Bordetella pertussis
gcacaugcccggccacc

SEQ ID NO: 2368154 - RNA, 15 nt, Bordetella pertussis
gcacauggcgcgccg

SEQ ID NO: 2368155 - RNA, 16 nt, Bordetella pertussis
gcacauggcgcgccgg

SEQ ID NO: 2368156 - RNA, 17 nt, Bordetella pertussis
gcacauggcgcgccggc

SEQ ID NO: 2368157 - RNA, 20 nt, Bordetella pertussis
gcacauggcgcgccggccgg

SEQ ID NO: 2368158 - RNA, 13 nt, Bordetella pertussis
gcacccgaugacg

SEQ ID NO: 2368159 - RNA, 20 nt, Bordetella pertussis
gcacccgaugacggggcggc

SEQ ID NO: 2368160 - RNA, 23 nt, Bordetella pertussis
gcacccgcaagauuucauggcgu

SEQ ID NO: 2368161 - RNA, 13 nt, Bordetella pertussis
gcacccgcacggg

SEQ ID NO: 2368162 - RNA, 14 nt, Bordetella pertussis
gcacccgcacgggc

SEQ ID NO: 2368163 - RNA, 13 nt, Bordetella pertussis
gcacccgcaggcc

SEQ ID NO: 2368164 - RNA, 22 nt, Bordetella pertussis
gcacccgcaggccguuggccgc

SEQ ID NO: 2368165 - RNA, 15 nt, Bordetella pertussis
gcacccgcaggcggc

SEQ ID NO: 2368166 - RNA, 15 nt, Bordetella pertussis
gcacccgcauggugg

SEQ ID NO: 2368167 - RNA, 16 nt, Bordetella pertussis
gcacccgcaugguggc

SEQ ID NO: 2368168 - RNA, 18 nt, Bordetella pertussis
gcacccgcaugguggcgc

SEQ ID NO: 2368169 - RNA, 20 nt, Bordetella pertussis
gcacccgcaugguggcgcag

SEQ ID NO: 2368170 - RNA, 21 nt, Bordetella pertussis
gcacccgcaugguggcgcagg

SEQ ID NO: 2368171 - RNA, 18 nt, Bordetella pertussis
gcacccgcgcgcagcguu

SEQ ID NO: 2368172 - RNA, 11 nt, Bordetella pertussis
gcacccgcggc

SEQ ID NO: 2368173 - RNA, 21 nt, Bordetella pertussis
gcacccgcggcgcaugcagcc

SEQ ID NO: 2368174 - RNA, 20 nt, Bordetella pertussis
gcacccgguauccgcgcaug

SEQ ID NO: 2368175 - RNA, 19 nt, Bordetella pertussis
gcacccgucccugguccag

SEQ ID NO: 2368176 - RNA, 23 nt, Bordetella pertussis
gcacccgucccugguccagcagc

SEQ ID NO: 2368177 - RNA, 16 nt, Bordetella pertussis
gcacccugcaggccgg

SEQ ID NO: 2368178 - RNA, 17 nt, Bordetella pertussis
gcacccugcaggccggg

SEQ ID NO: 2368179 - RNA, 18 nt, Bordetella pertussis
gcacccugcaggccgggc

SEQ ID NO: 2368180 - RNA, 11 nt, Bordetella pertussis
gcacccugccc

SEQ ID NO: 2368181 - RNA, 21 nt, Bordetella pertussis
gcacccugucauacgccauga

SEQ ID NO: 2368182 - RNA, 14 nt, Bordetella pertussis
gcacccuugccgca

SEQ ID NO: 2368183 - RNA, 16 nt, Bordetella pertussis
gcacccuugccgcagc

SEQ ID NO: 2368184 - RNA, 17 nt, Bordetella pertussis
gcacccuugccgcagga

SEQ ID NO: 2368185 - RNA, 14 nt, Bordetella pertussis
gcacccuugccgcg

SEQ ID NO: 2368186 - RNA, 15 nt, Bordetella pertussis
gcaccgaacccugcc

SEQ ID NO: 2368187 - RNA, 23 nt, Bordetella pertussis
gcaccgaacccugccucagacca

SEQ ID NO: 2368188 - RNA, 23 nt, Bordetella pertussis
gcaccgaacgggcguggcgcagg

SEQ ID NO: 2368189 - RNA, 16 nt, Bordetella pertussis
gcaccgaagcauccca

SEQ ID NO: 2368190 - RNA, 22 nt, Bordetella pertussis
gcaccgaauacgucagagcccu

SEQ ID NO: 2368191 - RNA, 13 nt, Bordetella pertussis
gcaccgacacgcu

SEQ ID NO: 2368192 - RNA, 17 nt, Bordetella pertussis
gcaccgacacgcuggcg

SEQ ID NO: 2368193 - RNA, 13 nt, Bordetella pertussis
gcaccgacaggcc

SEQ ID NO: 2368194 - RNA, 14 nt, Bordetella pertussis
gcaccgaccagcgc

SEQ ID NO: 2368195 - RNA, 21 nt, Bordetella pertussis
gcaccgaccagcgcgcgccgg

SEQ ID NO: 2368196 - RNA, 22 nt, Bordetella pertussis
gcaccgaccagcgcgcgccggc

SEQ ID NO: 2368197 - RNA, 16 nt, Bordetella pertussis
gcaccgacggcagccc

SEQ ID NO: 2368198 - RNA, 14 nt, Bordetella pertussis
gcaccgacugcgca

SEQ ID NO: 2368199 - RNA, 17 nt, Bordetella pertussis
gcaccgagcacagcaac

SEQ ID NO: 2368200 - RNA, 18 nt, Bordetella pertussis
gcaccgagcugccgccuu

SEQ ID NO: 2368201 - RNA, 13 nt, Bordetella pertussis
gcaccgaggccga

SEQ ID NO: 2368202 - RNA, 21 nt, Bordetella pertussis
gcaccgaggccgaguggccgc

SEQ ID NO: 2368203 - RNA, 17 nt, Bordetella pertussis
gcaccgaggugccggcg

SEQ ID NO: 2368204 - RNA, 17 nt, Bordetella pertussis
gcaccgaugcgccggcc

SEQ ID NO: 2368205 - RNA, 21 nt, Bordetella pertussis
gcaccgaugcgccggccuggc

SEQ ID NO: 2368206 - RNA, 22 nt, Bordetella pertussis
gcaccgaugcgccggccuggcg

SEQ ID NO: 2368207 - RNA, 21 nt, Bordetella pertussis
gcaccgcaugggccaggcgcu

SEQ ID NO: 2368208 - RNA, 16 nt, Bordetella pertussis
gcaccgccaccguggc

SEQ ID NO: 2368209 - RNA, 20 nt, Bordetella pertussis
gcaccgccaccguggcgucc

SEQ ID NO: 2368210 - RNA, 15 nt, Bordetella pertussis
gcaccgccagcgcgu

SEQ ID NO: 2368211 - RNA, 16 nt, Bordetella pertussis
gcaccgccagcgcguc

SEQ ID NO: 2368212 - RNA, 13 nt, Bordetella pertussis
gcaccgccaggca

SEQ ID NO: 2368213 - RNA, 23 nt, Bordetella pertussis
gcaccgccaugugcgccgcgccg

SEQ ID NO: 2368214 - RNA, 11 nt, Bordetella pertussis
gcaccgcccgc

SEQ ID NO: 2368215 - RNA, 15 nt, Bordetella pertussis
gcaccgccgcacagc

SEQ ID NO: 2368216 - RNA, 15 nt, Bordetella pertussis
gcaccgccgccggcc

SEQ ID NO: 2368217 - RNA, 14 nt, Bordetella pertussis
gcaccgccgcgcgg

SEQ ID NO: 2368218 - RNA, 15 nt, Bordetella pertussis
gcaccgccgcgcggu

SEQ ID NO: 2368219 - RNA, 13 nt, Bordetella pertussis
gcaccgccgcguc

SEQ ID NO: 2368220 - RNA, 14 nt, Bordetella pertussis
gcaccgccgcgucc

SEQ ID NO: 2368221 - RNA, 15 nt, Bordetella pertussis
gcaccgccgcguccu

SEQ ID NO: 2368222 - RNA, 24 nt, Bordetella pertussis
gcaccgccgcguccucggccuggc

SEQ ID NO: 2368223 - RNA, 14 nt, Bordetella pertussis
gcaccgccgcguug

SEQ ID NO: 2368224 - RNA, 21 nt, Bordetella pertussis
gcaccgccgcguugcgcgacu

SEQ ID NO: 2368225 - RNA, 14 nt, Bordetella pertussis
gcaccgccugcugc

SEQ ID NO: 2368226 - RNA, 15 nt, Bordetella pertussis
gcaccgcgcagcccg

SEQ ID NO: 2368227 - RNA, 17 nt, Bordetella pertussis
gcaccgcgcagcccggc

SEQ ID NO: 2368228 - RNA, 14 nt, Bordetella pertussis
gcaccgcgccagcg

SEQ ID NO: 2368229 - RNA, 16 nt, Bordetella pertussis
gcaccgcgccagcgcc

SEQ ID NO: 2368230 - RNA, 18 nt, Bordetella pertussis
gcaccgcgccagcgccgg

SEQ ID NO: 2368231 - RNA, 19 nt, Bordetella pertussis
gcaccgcgccagcgccggc

SEQ ID NO: 2368232 - RNA, 12 nt, Bordetella pertussis
gcaccgcgcgca

SEQ ID NO: 2368233 - RNA, 16 nt, Bordetella pertussis
gcaccgcgcgcacgac

SEQ ID NO: 2368234 - RNA, 13 nt, Bordetella pertussis
gcaccgcggcggg

SEQ ID NO: 2368235 - RNA, 11 nt, Bordetella pertussis
gcaccgcgucg

SEQ ID NO: 2368236 - RNA, 20 nt, Bordetella pertussis
gcaccgcgucggccugccag

SEQ ID NO: 2368237 - RNA, 22 nt, Bordetella pertussis
gcaccgcgucggccugccagcc

SEQ ID NO: 2368238 - RNA, 17 nt, Bordetella pertussis
gcaccgcguggcgcugc

SEQ ID NO: 2368239 - RNA, 19 nt, Bordetella pertussis
gcaccgcugcuaugccgug

SEQ ID NO: 2368240 - RNA, 16 nt, Bordetella pertussis
gcaccggaggcgccgc

SEQ ID NO: 2368241 - RNA, 17 nt, Bordetella pertussis
gcaccggcacgacggcc

SEQ ID NO: 2368242 - RNA, 20 nt, Bordetella pertussis
gcaccggcacgacggccucc

SEQ ID NO: 2368243 - RNA, 22 nt, Bordetella pertussis
gcaccggcacgacggccuccgc

SEQ ID NO: 2368244 - RNA, 14 nt, Bordetella pertussis
gcaccggcacgcgc

SEQ ID NO: 2368245 - RNA, 19 nt, Bordetella pertussis
gcaccggcacgcgccagcu

SEQ ID NO: 2368246 - RNA, 20 nt, Bordetella pertussis
gcaccggcacgcgccaggcg

SEQ ID NO: 2368247 - RNA, 17 nt, Bordetella pertussis
gcaccggcagauggugc

SEQ ID NO: 2368248 - RNA, 19 nt, Bordetella pertussis
gcaccggcagauggugcuc

SEQ ID NO: 2368249 - RNA, 20 nt, Bordetella pertussis
gcaccggcagauggugcucc

SEQ ID NO: 2368250 - RNA, 15 nt, Bordetella pertussis
gcaccggcagccauc

SEQ ID NO: 2368251 - RNA, 18 nt, Bordetella pertussis
gcaccggcagccauccca

SEQ ID NO: 2368252 - RNA, 14 nt, Bordetella pertussis
gcaccggcagcgua

SEQ ID NO: 2368253 - RNA, 21 nt, Bordetella pertussis
gcaccggcagcguaucgcccg

SEQ ID NO: 2368254 - RNA, 21 nt, Bordetella pertussis
gcaccggccaagcuccaggaa

SEQ ID NO: 2368255 - RNA, 21 nt, Bordetella pertussis
gcaccggccaggggcgcuggu

SEQ ID NO: 2368256 - RNA, 15 nt, Bordetella pertussis
gcaccggcccgaaga

SEQ ID NO: 2368257 - RNA, 19 nt, Bordetella pertussis
gcaccggccgacccgcggc

SEQ ID NO: 2368258 - RNA, 14 nt, Bordetella pertussis
gcaccggccggccg

SEQ ID NO: 2368259 - RNA, 15 nt, Bordetella pertussis
gcaccggccggccgg

SEQ ID NO: 2368260 - RNA, 12 nt, Bordetella pertussis
gcaccggcgcca

SEQ ID NO: 2368261 - RNA, 18 nt, Bordetella pertussis
gcaccggcgugcgcuggc

SEQ ID NO: 2368262 - RNA, 18 nt, Bordetella pertussis
gcaccggcugccagggcc

SEQ ID NO: 2368263 - RNA, 19 nt, Bordetella pertussis
gcaccggcugccagggccg

SEQ ID NO: 2368264 - RNA, 21 nt, Bordetella pertussis
gcaccggcuuggggcgcgccg

SEQ ID NO: 2368265 - RNA, 22 nt, Bordetella pertussis
gcaccggcuuggggcgcgccgc

SEQ ID NO: 2368266 - RNA, 20 nt, Bordetella pertussis
gcaccggcuugucgaccagu

SEQ ID NO: 2368267 - RNA, 16 nt, Bordetella pertussis
gcaccgggcggcccgg

SEQ ID NO: 2368268 - RNA, 18 nt, Bordetella pertussis
gcaccgggcggcccggcg

SEQ ID NO: 2368269 - RNA, 19 nt, Bordetella pertussis
gcaccgggcggcccggcgg

SEQ ID NO: 2368270 - RNA, 15 nt, Bordetella pertussis
gcaccggggcagggc

SEQ ID NO: 2368271 - RNA, 23 nt, Bordetella pertussis
gcacgaucuggcgcgcgaccagg

SEQ ID NO: 2368272 - RNA, 24 nt, Bordetella pertussis
gcacgaucuggcgcgcgaccaggc

SEQ ID NO: 2368273 - RNA, 15 nt, Bordetella pertussis
gcacgaugaggccga

SEQ ID NO: 2368274 - RNA, 17 nt, Bordetella pertussis
gcacgaugcccagggcc

SEQ ID NO: 2368275 - RNA, 18 nt, Bordetella pertussis
gcacgaugcccagggccg

SEQ ID NO: 2368276 - RNA, 21 nt, Bordetella pertussis
gcacgaugcccagggccgcgc

SEQ ID NO: 2368277 - RNA, 11 nt, Bordetella pertussis
gcacgaugccg

SEQ ID NO: 2368278 - RNA, 15 nt, Bordetella pertussis
gcacgaugccgucgc

SEQ ID NO: 2368279 - RNA, 18 nt, Bordetella pertussis
gcacgaugccgucgccgc

SEQ ID NO: 2368280 - RNA, 19 nt, Bordetella pertussis
gcacgaugccgucgccgcc

SEQ ID NO: 2368281 - RNA, 23 nt, Bordetella pertussis
gcacgauggaaucgucgaccagc

SEQ ID NO: 2368282 - RNA, 17 nt, Bordetella pertussis
gcacgauggccgcgccc

SEQ ID NO: 2368283 - RNA, 16 nt, Bordetella pertussis
gcacgauggcgcccac

SEQ ID NO: 2368284 - RNA, 14 nt, Bordetella pertussis
gcacgauggcgccg

SEQ ID NO: 2368285 - RNA, 17 nt, Bordetella pertussis
gcacgauggcgccggcu

SEQ ID NO: 2368286 - RNA, 18 nt, Bordetella pertussis
gcacgauggcgccggcuu

SEQ ID NO: 2368287 - RNA, 14 nt, Bordetella pertussis
gcacgauggcgcgc

SEQ ID NO: 2368288 - RNA, 12 nt, Bordetella pertussis
gcacgauggggc

SEQ ID NO: 2368289 - RNA, 17 nt, Bordetella pertussis
gcacgauggggcagcca

SEQ ID NO: 2368290 - RNA, 13 nt, Bordetella pertussis
gcacgauggggcc

SEQ ID NO: 2368291 - RNA, 14 nt, Bordetella pertussis
gcacgauggggccg

SEQ ID NO: 2368292 - RNA, 18 nt, Bordetella pertussis
gcacgauggggccgucgc

SEQ ID NO: 2368293 - RNA, 15 nt, Bordetella pertussis
gcacgaugguaucgg

SEQ ID NO: 2368294 - RNA, 19 nt, Bordetella pertussis
gcacgaugguaucggccgg

SEQ ID NO: 2368295 - RNA, 17 nt, Bordetella pertussis
gcacgauggucagcggc

SEQ ID NO: 2368296 - RNA, 19 nt, Bordetella pertussis
gcacgauggucagcggcau

SEQ ID NO: 2368297 - RNA, 16 nt, Bordetella pertussis
gcacgauguugccgcc

SEQ ID NO: 2368298 - RNA, 18 nt, Bordetella pertussis
gcacgauguugccgccgg

SEQ ID NO: 2368299 - RNA, 19 nt, Bordetella pertussis
gcacgauguugccgccggc

SEQ ID NO: 2368300 - RNA, 20 nt, Bordetella pertussis
gcacgauguugccgccggcc

SEQ ID NO: 2368301 - RNA, 23 nt, Bordetella pertussis
gcacgauguugccgccggccagg

SEQ ID NO: 2368302 - RNA, 23 nt, Bordetella pertussis
gcacgauuccgccuacuggcgcg

SEQ ID NO: 2368303 - RNA, 17 nt, Bordetella pertussis
gcacgauuucacccagg

SEQ ID NO: 2368304 - RNA, 22 nt, Bordetella pertussis
gcacgauuuccgcuaccaggcg

SEQ ID NO: 2368305 - RNA, 21 nt, Bordetella pertussis
gcacgauuucgccgauccggu

SEQ ID NO: 2368306 - RNA, 14 nt, Bordetella pertussis
gcacgauuuuucgc

SEQ ID NO: 2368307 - RNA, 16 nt, Bordetella pertussis
gcacgcaccaggcgca

SEQ ID NO: 2368308 - RNA, 17 nt, Bordetella pertussis
gcacgcaccgcgccagc

SEQ ID NO: 2368309 - RNA, 12 nt, Bordetella pertussis
gcacgcagcccu

SEQ ID NO: 2368310 - RNA, 19 nt, Bordetella pertussis
gcacgcaggauaccggagc

SEQ ID NO: 2368311 - RNA, 23 nt, Bordetella pertussis
gcacgccauagcguucgguggcg

SEQ ID NO: 2368312 - RNA, 22 nt, Bordetella pertussis
gcacgccauggucucguccacc

SEQ ID NO: 2368313 - RNA, 18 nt, Bordetella pertussis
gcacgccauucauccagc

SEQ ID NO: 2368314 - RNA, 21 nt, Bordetella pertussis
gcacgccauucauccagcgcg

SEQ ID NO: 2368315 - RNA, 16 nt, Bordetella pertussis
gcacgcccagacuggc

SEQ ID NO: 2368316 - RNA, 11 nt, Bordetella pertussis
gcacgcccagc

SEQ ID NO: 2368317 - RNA, 12 nt, Bordetella pertussis
gcacgcccagcc

SEQ ID NO: 2368318 - RNA, 14 nt, Bordetella pertussis
gcacgcccagccgc

SEQ ID NO: 2368319 - RNA, 15 nt, Bordetella pertussis
gcacgcccagccgca

SEQ ID NO: 2368320 - RNA, 21 nt, Bordetella pertussis
gcacgcccagccgcagcaggc

SEQ ID NO: 2368321 - RNA, 17 nt, Bordetella pertussis
gcacgcccgacgguauc

SEQ ID NO: 2368322 - RNA, 17 nt, Bordetella pertussis
gcacgcccgccagcagc

SEQ ID NO: 2368323 - RNA, 20 nt, Bordetella pertussis
gcacgcccgccugcagcagc

SEQ ID NO: 2368324 - RNA, 21 nt, Bordetella pertussis
gcacgcccgccugcagcagcg

SEQ ID NO: 2368325 - RNA, 22 nt, Bordetella pertussis
gcacgcccgcgacgcuggcgau

SEQ ID NO: 2368326 - RNA, 16 nt, Bordetella pertussis
gcacgcccgcgcgcga

SEQ ID NO: 2368327 - RNA, 14 nt, Bordetella pertussis
gcacgcccgcggcg

SEQ ID NO: 2368328 - RNA, 17 nt, Bordetella pertussis
gcacgcccuggcugagc

SEQ ID NO: 2368329 - RNA, 17 nt, Bordetella pertussis
gcacgccgaccuggcgc

SEQ ID NO: 2368330 - RNA, 17 nt, Bordetella pertussis
gcacgccgaucgcgcac

SEQ ID NO: 2368331 - RNA, 18 nt, Bordetella pertussis
gcacgccgaucgcgcaca

SEQ ID NO: 2368332 - RNA, 22 nt, Bordetella pertussis
gcacgccgaucgcgcacagcau

SEQ ID NO: 2368333 - RNA, 14 nt, Bordetella pertussis
gcacgccgcgccag

SEQ ID NO: 2368334 - RNA, 15 nt, Bordetella pertussis
gcacgccgcgccagg

SEQ ID NO: 2368335 - RNA, 16 nt, Bordetella pertussis
gcacgccgcgccaggc

SEQ ID NO: 2368336 - RNA, 17 nt, Bordetella pertussis
gcacgccgcgccaggca

SEQ ID NO: 2368337 - RNA, 18 nt, Bordetella pertussis
gcacgccgcgccaggcau

SEQ ID NO: 2368338 - RNA, 15 nt, Bordetella pertussis
gcacgccgcgccggc

SEQ ID NO: 2368339 - RNA, 16 nt, Bordetella pertussis
gcacgccgcgccggcg

SEQ ID NO: 2368340 - RNA, 21 nt, Bordetella pertussis
gcacgccgcgccggcgcgcga

SEQ ID NO: 2368341 - RNA, 15 nt, Bordetella pertussis
gcacgccgcgcucgu

SEQ ID NO: 2368342 - RNA, 14 nt, Bordetella pertussis
gcacgccggccacg

SEQ ID NO: 2368343 - RNA, 15 nt, Bordetella pertussis
gcacgccggccacga

SEQ ID NO: 2368344 - RNA, 17 nt, Bordetella pertussis
gcacgccggccaggucg

SEQ ID NO: 2368345 - RNA, 20 nt, Bordetella pertussis
gcacgccggccugcgccagc

SEQ ID NO: 2368346 - RNA, 15 nt, Bordetella pertussis
gcacgccggccuugc

SEQ ID NO: 2368347 - RNA, 17 nt, Bordetella pertussis
gcacgccggccuugcug

SEQ ID NO: 2368348 - RNA, 18 nt, Bordetella pertussis
gcacgccggcggcgcugg

SEQ ID NO: 2368349 - RNA, 19 nt, Bordetella pertussis
gcacgccggcggcgcuggc

SEQ ID NO: 2368350 - RNA, 15 nt, Bordetella pertussis
gcacgccggcgggca

SEQ ID NO: 2368351 - RNA, 12 nt, Bordetella pertussis
gcacgccgggcg

SEQ ID NO: 2368352 - RNA, 14 nt, Bordetella pertussis
gcacgccgggcgcg

SEQ ID NO: 2368353 - RNA, 16 nt, Bordetella pertussis
gcacgccgggcgcgcu

SEQ ID NO: 2368354 - RNA, 17 nt, Bordetella pertussis
gcacgccgggcgcgcug

SEQ ID NO: 2368355 - RNA, 20 nt, Bordetella pertussis
gcacgccgggcgcgcugccc

SEQ ID NO: 2368356 - RNA, 17 nt, Bordetella pertussis
gcacgccgggcgcggcc

SEQ ID NO: 2368357 - RNA, 18 nt, Bordetella pertussis
gcacgccgggcgcggccg

SEQ ID NO: 2368358 - RNA, 19 nt, Bordetella pertussis
gcacgccgggcgcggccgc

SEQ ID NO: 2368359 - RNA, 17 nt, Bordetella pertussis
gcacgccggucgccagc

SEQ ID NO: 2368360 - RNA, 19 nt, Bordetella pertussis
gcacgccggucgccagcga

SEQ ID NO: 2368361 - RNA, 17 nt, Bordetella pertussis
gcacgccucgccggccc

SEQ ID NO: 2368362 - RNA, 20 nt, Bordetella pertussis
gcacgccugccgcgcccggc

SEQ ID NO: 2368363 - RNA, 17 nt, Bordetella pertussis
gcacgccuucgagcugc

SEQ ID NO: 2368364 - RNA, 17 nt, Bordetella pertussis
gcacgcgcaccaggccu

SEQ ID NO: 2368365 - RNA, 18 nt, Bordetella pertussis
gcacgcgcaccaggccug

SEQ ID NO: 2368366 - RNA, 20 nt, Bordetella pertussis
gcacgcgcaccaggccugcc

SEQ ID NO: 2368367 - RNA, 13 nt, Bordetella pertussis
gcacgcgcagcac

SEQ ID NO: 2368368 - RNA, 20 nt, Bordetella pertussis
gcacgcgcagcacgcugcgc

SEQ ID NO: 2368369 - RNA, 16 nt, Bordetella pertussis
gcacgcgccaggcguu

SEQ ID NO: 2368370 - RNA, 15 nt, Bordetella pertussis
gcacgcgcgccagcu

SEQ ID NO: 2368371 - RNA, 17 nt, Bordetella pertussis
gcacgcgcgccagcugg

SEQ ID NO: 2368372 - RNA, 18 nt, Bordetella pertussis
gcacgcgcgccagcuggg

SEQ ID NO: 2368373 - RNA, 15 nt, Bordetella pertussis
gcacgcgcgccggca

SEQ ID NO: 2368374 - RNA, 13 nt, Bordetella pertussis
gcacgcgcgcggc

SEQ ID NO: 2368375 - RNA, 17 nt, Bordetella pertussis
gcacgcgcgcgggcgcg

SEQ ID NO: 2368376 - RNA, 19 nt, Bordetella pertussis
gcacgcgcgcgggcgcgcc

SEQ ID NO: 2368377 - RNA, 19 nt, Bordetella pertussis
gcacgcgcggcagcgccgg

SEQ ID NO: 2368378 - RNA, 21 nt, Bordetella pertussis
gcacgcgcggcagcgccgggu

SEQ ID NO: 2368379 - RNA, 21 nt, Bordetella pertussis
gcacgcgcgguucgccgugca

SEQ ID NO: 2368380 - RNA, 12 nt, Bordetella pertussis
gcacgcgcguga

SEQ ID NO: 2368381 - RNA, 19 nt, Bordetella pertussis
gcacgcgcucgggcagcuc

SEQ ID NO: 2368382 - RNA, 12 nt, Bordetella pertussis
gcacgcggccgc

SEQ ID NO: 2368383 - RNA, 16 nt, Bordetella pertussis
gcacgcggccgcgggc

SEQ ID NO: 2368384 - RNA, 20 nt, Bordetella pertussis
gcacgucauugcaucgcagc

SEQ ID NO: 2368385 - RNA, 22 nt, Bordetella pertussis
gcacguccagagucugccuggc

SEQ ID NO: 2368386 - RNA, 15 nt, Bordetella pertussis
gcacguccagcggcg

SEQ ID NO: 2368387 - RNA, 18 nt, Bordetella pertussis
gcacguccagcggcgcga

SEQ ID NO: 2368388 - RNA, 23 nt, Bordetella pertussis
gcacguccagcggcgcgacgcgc

SEQ ID NO: 2368389 - RNA, 20 nt, Bordetella pertussis
gcacgucccagucgccgcgc

SEQ ID NO: 2368390 - RNA, 22 nt, Bordetella pertussis
gcacguccgagaggaucaccgc

SEQ ID NO: 2368391 - RNA, 12 nt, Bordetella pertussis
gcacgucggcgu

SEQ ID NO: 2368392 - RNA, 20 nt, Bordetella pertussis
gcacgucggcgucgggcuug

SEQ ID NO: 2368393 - RNA, 18 nt, Bordetella pertussis
gcacgucgggcaggaugg

SEQ ID NO: 2368394 - RNA, 16 nt, Bordetella pertussis
gcacgucggucgagua

SEQ ID NO: 2368395 - RNA, 21 nt, Bordetella pertussis
gcacgucggucgaguagaagu

SEQ ID NO: 2368396 - RNA, 16 nt, Bordetella pertussis
gcacgucguagcgcug

SEQ ID NO: 2368397 - RNA, 15 nt, Bordetella pertussis
gcacgugacgccggc

SEQ ID NO: 2368398 - RNA, 16 nt, Bordetella pertussis
gcacgugacgccggcg

SEQ ID NO: 2368399 - RNA, 17 nt, Bordetella pertussis
gcacgugaugcaggcgg

SEQ ID NO: 2368400 - RNA, 22 nt, Bordetella pertussis
gcacgugccggccgccuccagg

SEQ ID NO: 2368401 - RNA, 18 nt, Bordetella pertussis
gcacgugcgacgugaccc

SEQ ID NO: 2368402 - RNA, 17 nt, Bordetella pertussis
gcacgugggcacgccgg

SEQ ID NO: 2368403 - RNA, 18 nt, Bordetella pertussis
gcacgugggcacgccggc

SEQ ID NO: 2368404 - RNA, 20 nt, Bordetella pertussis
gcacgugggcacgccggccu

SEQ ID NO: 2368405 - RNA, 17 nt, Bordetella pertussis
gcacguggucgugcagg

SEQ ID NO: 2368406 - RNA, 21 nt, Bordetella pertussis
gcacguggucgugcaggaccu

SEQ ID NO: 2368407 - RNA, 19 nt, Bordetella pertussis
gcacguugucgagcaggcc

SEQ ID NO: 2368408 - RNA, 20 nt, Bordetella pertussis
gcacguugucgagcaggccg

SEQ ID NO: 2368409 - RNA, 19 nt, Bordetella pertussis
gcacuccggauaccgccgc

SEQ ID NO: 2368410 - RNA, 14 nt, Bordetella pertussis
gcacucgaccgccg

SEQ ID NO: 2368411 - RNA, 16 nt, Bordetella pertussis
gcacucgaccgccggg

SEQ ID NO: 2368412 - RNA, 17 nt, Bordetella pertussis
gcacucgaccgccggga

SEQ ID NO: 2368413 - RNA, 19 nt, Bordetella pertussis
gcacucgaccgccgggaca

SEQ ID NO: 2368414 - RNA, 17 nt, Bordetella pertussis
gcacucggccauggugc

SEQ ID NO: 2368415 - RNA, 20 nt, Bordetella pertussis
gcacucgguaucgucggaca

SEQ ID NO: 2368416 - RNA, 21 nt, Bordetella pertussis
gcacugagaaaggccgccacg

SEQ ID NO: 2368417 - RNA, 22 nt, Bordetella pertussis
gcacugagaaaggccgccacga

SEQ ID NO: 2368418 - RNA, 13 nt, Bordetella pertussis
gcacugaucgccg

SEQ ID NO: 2368419 - RNA, 23 nt, Bordetella pertussis
gcacugaucuuucagcgcgacga

SEQ ID NO: 2368420 - RNA, 14 nt, Bordetella pertussis
gcacugcaggccau

SEQ ID NO: 2368421 - RNA, 15 nt, Bordetella pertussis
gcacugcaggccauc

SEQ ID NO: 2368422 - RNA, 12 nt, Bordetella pertussis
gcacuggcgcgg

SEQ ID NO: 2368423 - RNA, 15 nt, Bordetella pertussis
gcacuggcgcggcgc

SEQ ID NO: 2368424 - RNA, 16 nt, Bordetella pertussis
gcacuggcgcggcgcu

SEQ ID NO: 2368425 - RNA, 20 nt, Bordetella pertussis
gcacugggugacgcuggagc

SEQ ID NO: 2368426 - RNA, 15 nt, Bordetella pertussis
gcacuggguggccag

SEQ ID NO: 2368427 - RNA, 21 nt, Bordetella pertussis
gcacuggguggccagcgccgc

SEQ ID NO: 2368428 - RNA, 23 nt, Bordetella pertussis
gcacuggguggccagcgccgcca

SEQ ID NO: 2368429 - RNA, 22 nt, Bordetella pertussis
gcacugucggcguuccuggcgc

SEQ ID NO: 2368430 - RNA, 16 nt, Bordetella pertussis
gcacuucgggccaccc

SEQ ID NO: 2368431 - RNA, 15 nt, Bordetella pertussis
gcacuugcgaacggc

SEQ ID NO: 2368432 - RNA, 17 nt, Bordetella pertussis
gcacuuucgacacgggg

SEQ ID NO: 2368433 - RNA, 13 nt, Bordetella pertussis
gcagaaaccccag

SEQ ID NO: 2368434 - RNA, 17 nt, Bordetella pertussis
gcagaaaccgccacagc

SEQ ID NO: 2368435 - RNA, 19 nt, Bordetella pertussis
gcagaaaggaugcccgcgg

SEQ ID NO: 2368436 - RNA, 20 nt, Bordetella pertussis
gcagaaaggaugcccgcggg

SEQ ID NO: 2368437 - RNA, 18 nt, Bordetella pertussis
gcagaaauggaugcgcgc

SEQ ID NO: 2368438 - RNA, 13 nt, Bordetella pertussis
gcagaacagcagc

SEQ ID NO: 2368439 - RNA, 14 nt, Bordetella pertussis
gcagaacagcagcg

SEQ ID NO: 2368440 - RNA, 15 nt, Bordetella pertussis
gcagaacagcagcgu

SEQ ID NO: 2368441 - RNA, 16 nt, Bordetella pertussis
gcagaacagcagcgug

SEQ ID NO: 2368442 - RNA, 18 nt, Bordetella pertussis
gcagaacagcggaucgcc

SEQ ID NO: 2368443 - RNA, 15 nt, Bordetella pertussis
gcagaacagggugcc

SEQ ID NO: 2368444 - RNA, 20 nt, Bordetella pertussis
gcagaacagggugccgcccu

SEQ ID NO: 2368445 - RNA, 19 nt, Bordetella pertussis
gcagaacggaaacgcccag

SEQ ID NO: 2368446 - RNA, 18 nt, Bordetella pertussis
gcagaagaacaccgugug

SEQ ID NO: 2368447 - RNA, 22 nt, Bordetella pertussis
gcagaagcagccgcgcggccgg

SEQ ID NO: 2368448 - RNA, 15 nt, Bordetella pertussis
gcagaaggucugggc

SEQ ID NO: 2368449 - RNA, 13 nt, Bordetella pertussis
gcagaccacgccg

SEQ ID NO: 2368450 - RNA, 24 nt, Bordetella pertussis
gcagaccacgccggcggucacgcc

SEQ ID NO: 2368451 - RNA, 19 nt, Bordetella pertussis
gcagaccagcaccggcacg

SEQ ID NO: 2368452 - RNA, 16 nt, Bordetella pertussis
gcagacccgcgcccag

SEQ ID NO: 2368453 - RNA, 17 nt, Bordetella pertussis
gcagacccgcgcccagc

SEQ ID NO: 2368454 - RNA, 14 nt, Bordetella pertussis
gcagacccuggcgc

SEQ ID NO: 2368455 - RNA, 15 nt, Bordetella pertussis
gcagacccuggcgcg

SEQ ID NO: 2368456 - RNA, 13 nt, Bordetella pertussis
gcagaccgagcgc

SEQ ID NO: 2368457 - RNA, 15 nt, Bordetella pertussis
gcagaccgagcgcgc

SEQ ID NO: 2368458 - RNA, 19 nt, Bordetella pertussis
gcagacgaucauccaggcc

SEQ ID NO: 2368459 - RNA, 21 nt, Bordetella pertussis
gcagacgaucauccaggccgu

SEQ ID NO: 2368460 - RNA, 19 nt, Bordetella pertussis
gcagacgccaucuugcagg

SEQ ID NO: 2368461 - RNA, 20 nt, Bordetella pertussis
gcagacgccaucuugcaggc

SEQ ID NO: 2368462 - RNA, 21 nt, Bordetella pertussis
gcagacgccaucuugcaggcg

SEQ ID NO: 2368463 - RNA, 22 nt, Bordetella pertussis
gcagacgccaucuugcaggcgc

SEQ ID NO: 2368464 - RNA, 17 nt, Bordetella pertussis
gcagacgcgcucaggcg

SEQ ID NO: 2368465 - RNA, 17 nt, Bordetella pertussis
gcagacgcuucaggccg

SEQ ID NO: 2368466 - RNA, 13 nt, Bordetella pertussis
gcagacggcggcu

SEQ ID NO: 2368467 - RNA, 17 nt, Bordetella pertussis
gcagacggucgacaccg

SEQ ID NO: 2368468 - RNA, 15 nt, Bordetella pertussis
gcagacuccaggagc

SEQ ID NO: 2368469 - RNA, 16 nt, Bordetella pertussis
gcagagcaccacggcg

SEQ ID NO: 2368470 - RNA, 22 nt, Bordetella pertussis
gcagagggagcgacacccgcgg

SEQ ID NO: 2368471 - RNA, 20 nt, Bordetella pertussis
gcagaucaucgagcaccgcc

SEQ ID NO: 2368472 - RNA, 15 nt, Bordetella pertussis
gcagaucccaggcgc

SEQ ID NO: 2368473 - RNA, 21 nt, Bordetella pertussis
gcagaucgccaacgucggcag

SEQ ID NO: 2368474 - RNA, 13 nt, Bordetella pertussis
gcagaucgcggcg

SEQ ID NO: 2368475 - RNA, 14 nt, Bordetella pertussis
gcagaucgcggcgg

SEQ ID NO: 2368476 - RNA, 14 nt, Bordetella pertussis
gcagaucggcgcug

SEQ ID NO: 2368477 - RNA, 21 nt, Bordetella pertussis
gcagaucggcgcuggccuggc

SEQ ID NO: 2368478 - RNA, 15 nt, Bordetella pertussis
gcagaucggcggccu

SEQ ID NO: 2368479 - RNA, 17 nt, Bordetella pertussis
gcagaucggcggccugg

SEQ ID NO: 2368480 - RNA, 19 nt, Bordetella pertussis
gcagaucggcggccugggc

SEQ ID NO: 2368481 - RNA, 16 nt, Bordetella pertussis
gcagaugcaccggcca

SEQ ID NO: 2368482 - RNA, 14 nt, Bordetella pertussis
gcagaugcgacugg

SEQ ID NO: 2368483 - RNA, 17 nt, Bordetella pertussis
gcagaugcgcgccaggc

SEQ ID NO: 2368484 - RNA, 18 nt, Bordetella pertussis
gcagaugcgcgccaggcg

SEQ ID NO: 2368485 - RNA, 14 nt, Bordetella pertussis
gcagauggccagca

SEQ ID NO: 2368486 - RNA, 15 nt, Bordetella pertussis
gcagauggccagcag

SEQ ID NO: 2368487 - RNA, 17 nt, Bordetella pertussis
gcagauggccagcagcg

SEQ ID NO: 2368488 - RNA, 16 nt, Bordetella pertussis
gcagauggccaucgac

SEQ ID NO: 2368489 - RNA, 19 nt, Bordetella pertussis
gcagauggccaucgacgcc

SEQ ID NO: 2368490 - RNA, 19 nt, Bordetella pertussis
gcagauggcggcgaugccg

SEQ ID NO: 2368491 - RNA, 21 nt, Bordetella pertussis
gcagauggcguaggcggccuu

SEQ ID NO: 2368492 - RNA, 21 nt, Bordetella pertussis
gcagauggcuuucuaucauca

SEQ ID NO: 2368493 - RNA, 12 nt, Bordetella pertussis
gcagauugccgc

SEQ ID NO: 2368494 - RNA, 17 nt, Bordetella pertussis
gcagauugccgcgcggc

SEQ ID NO: 2368495 - RNA, 16 nt, Bordetella pertussis
gcagauuuccagcgcg

SEQ ID NO: 2368496 - RNA, 14 nt, Bordetella pertussis
gcagcaacccgccc

SEQ ID NO: 2368497 - RNA, 17 nt, Bordetella pertussis
gcagcagggccaggccg

SEQ ID NO: 2368498 - RNA, 19 nt, Bordetella pertussis
gcagcaggguggccacgcc

SEQ ID NO: 2368499 - RNA, 17 nt, Bordetella pertussis
gcagcaguucggcgucg

SEQ ID NO: 2368500 - RNA, 23 nt, Bordetella pertussis
gcagcaguucggucagcgcggcg

SEQ ID NO: 2368501 - RNA, 18 nt, Bordetella pertussis
gcagcaguugcagcauga

SEQ ID NO: 2368502 - RNA, 16 nt, Bordetella pertussis
gcagcauauccgcgug

SEQ ID NO: 2368503 - RNA, 19 nt, Bordetella pertussis
gcagcaucuugcgccgcug

SEQ ID NO: 2368504 - RNA, 22 nt, Bordetella pertussis
gcagcaugaccgacaggcggcu

SEQ ID NO: 2368505 - RNA, 16 nt, Bordetella pertussis
gcagcaugagcugaug

SEQ ID NO: 2368506 - RNA, 14 nt, Bordetella pertussis
gcagcaugccgcgg

SEQ ID NO: 2368507 - RNA, 18 nt, Bordetella pertussis
gcagcaugccgcgguggc

SEQ ID NO: 2368508 - RNA, 19 nt, Bordetella pertussis
gcagcaugccgcgguggcg

SEQ ID NO: 2368509 - RNA, 23 nt, Bordetella pertussis
gcagcaugccgcgguggcgggcg

SEQ ID NO: 2368510 - RNA, 15 nt, Bordetella pertussis
gcagcaugcggcccg

SEQ ID NO: 2368511 - RNA, 16 nt, Bordetella pertussis
gcagcaugcggcccgc

SEQ ID NO: 2368512 - RNA, 18 nt, Bordetella pertussis
gcagcaugcggcccgcgc

SEQ ID NO: 2368513 - RNA, 13 nt, Bordetella pertussis
gcagcauggcgcc

SEQ ID NO: 2368514 - RNA, 14 nt, Bordetella pertussis
gcagcauggcgcca

SEQ ID NO: 2368515 - RNA, 24 nt, Bordetella pertussis
gcagcauggcgccaugcgacagcc

SEQ ID NO: 2368516 - RNA, 16 nt, Bordetella pertussis
gcagcauggcgggcga

SEQ ID NO: 2368517 - RNA, 12 nt, Bordetella pertussis
gcagcaugugcu

SEQ ID NO: 2368518 - RNA, 22 nt, Bordetella pertussis
gcagcauucuggugcagcggcu

SEQ ID NO: 2368519 - RNA, 19 nt, Bordetella pertussis
gcagcauuucgaugcgcac

SEQ ID NO: 2368520 - RNA, 21 nt, Bordetella pertussis
gcagcauuucggcgccgccgg

SEQ ID NO: 2368521 - RNA, 15 nt, Bordetella pertussis
gcagcauuucuucca

SEQ ID NO: 2368522 - RNA, 15 nt, Bordetella pertussis
gcagccacagcgcgu

SEQ ID NO: 2368523 - RNA, 17 nt, Bordetella pertussis
gcagccacagcgcgugg

SEQ ID NO: 2368524 - RNA, 22 nt, Bordetella pertussis
gcagccacaggcccaugccgcg

SEQ ID NO: 2368525 - RNA, 15 nt, Bordetella pertussis
gcagccacgccuggc

SEQ ID NO: 2368526 - RNA, 20 nt, Bordetella pertussis
gcagccacgccuggccgcgc

SEQ ID NO: 2368527 - RNA, 13 nt, Bordetella pertussis
gcagccacgggau

SEQ ID NO: 2368528 - RNA, 16 nt, Bordetella pertussis
gcagccacgggauguc

SEQ ID NO: 2368529 - RNA, 23 nt, Bordetella pertussis
gcagccagaacaugagccaugcc

SEQ ID NO: 2368530 - RNA, 19 nt, Bordetella pertussis
gcagccagguaagcuggcg

SEQ ID NO: 2368531 - RNA, 23 nt, Bordetella pertussis
gcagccagguggcgaugccgggc

SEQ ID NO: 2368532 - RNA, 24 nt, Bordetella pertussis
gcagccagguggcgaugccgggca

SEQ ID NO: 2368533 - RNA, 20 nt, Bordetella pertussis
gcagccauccucgcccagcg

SEQ ID NO: 2368534 - RNA, 16 nt, Bordetella pertussis
gcagccauucggccac

SEQ ID NO: 2368535 - RNA, 17 nt, Bordetella pertussis
gcagccauucggccacu

SEQ ID NO: 2368536 - RNA, 14 nt, Bordetella pertussis
gcagcccacucagg

SEQ ID NO: 2368537 - RNA, 20 nt, Bordetella pertussis
gcagcccacucagggcgggg

SEQ ID NO: 2368538 - RNA, 17 nt, Bordetella pertussis
gcagcccagcaccacgg

SEQ ID NO: 2368539 - RNA, 14 nt, Bordetella pertussis
gcagcccagcacga

SEQ ID NO: 2368540 - RNA, 13 nt, Bordetella pertussis
gcagcccagcgcg

SEQ ID NO: 2368541 - RNA, 14 nt, Bordetella pertussis
gcagcccagcgcga

SEQ ID NO: 2368542 - RNA, 15 nt, Bordetella pertussis
gcagcccagcgcgau

SEQ ID NO: 2368543 - RNA, 14 nt, Bordetella pertussis
gcagccccagcgcc

SEQ ID NO: 2368544 - RNA, 20 nt, Bordetella pertussis
gcagccccagcgcccaggcg

SEQ ID NO: 2368545 - RNA, 18 nt, Bordetella pertussis
gcagccccagcguccagg

SEQ ID NO: 2368546 - RNA, 20 nt, Bordetella pertussis
gcagccccagcguccaggcg

SEQ ID NO: 2368547 - RNA, 13 nt, Bordetella pertussis
gcagcccgcuggc

SEQ ID NO: 2368548 - RNA, 14 nt, Bordetella pertussis
gcagcccgcuggcc

SEQ ID NO: 2368549 - RNA, 15 nt, Bordetella pertussis
gcagcccgcuggccg

SEQ ID NO: 2368550 - RNA, 14 nt, Bordetella pertussis
gcagcccggccaga

SEQ ID NO: 2368551 - RNA, 19 nt, Bordetella pertussis
gcagcccggccagagccug

SEQ ID NO: 2368552 - RNA, 19 nt, Bordetella pertussis
gcagcccuucggagccagu

SEQ ID NO: 2368553 - RNA, 19 nt, Bordetella pertussis
gcagccgacaggcgcgcag

SEQ ID NO: 2368554 - RNA, 22 nt, Bordetella pertussis
gcagccgaugauggugaacgcc

SEQ ID NO: 2368555 - RNA, 20 nt, Bordetella pertussis
gcagccgcaauaccuucagc

SEQ ID NO: 2368556 - RNA, 13 nt, Bordetella pertussis
gcagccgcaccag

SEQ ID NO: 2368557 - RNA, 14 nt, Bordetella pertussis
gcagccgcaccagc

SEQ ID NO: 2368558 - RNA, 17 nt, Bordetella pertussis
gcagccgcaccagcgca

SEQ ID NO: 2368559 - RNA, 15 nt, Bordetella pertussis
gcagccgccagcgcc

SEQ ID NO: 2368560 - RNA, 17 nt, Bordetella pertussis
gcagccgccagcgccug

SEQ ID NO: 2368561 - RNA, 12 nt, Bordetella pertussis
gcagccgccaua

SEQ ID NO: 2368562 - RNA, 15 nt, Bordetella pertussis
gcagccgcccggcag

SEQ ID NO: 2368563 - RNA, 22 nt, Bordetella pertussis
gcagccgcgccaagggcgugcg

SEQ ID NO: 2368564 - RNA, 15 nt, Bordetella pertussis
gcagccgcgcgccuu

SEQ ID NO: 2368565 - RNA, 13 nt, Bordetella pertussis
gcagccgcgcggc

SEQ ID NO: 2368566 - RNA, 16 nt, Bordetella pertussis
gcagccgcgcggccgg

SEQ ID NO: 2368567 - RNA, 16 nt, Bordetella pertussis
gcagccgcuccagcca

SEQ ID NO: 2368568 - RNA, 15 nt, Bordetella pertussis
gcagccgcuucacgc

SEQ ID NO: 2368569 - RNA, 22 nt, Bordetella pertussis
gcagccgcuucacgcuguucuu

SEQ ID NO: 2368570 - RNA, 15 nt, Bordetella pertussis
gcagccggccaaggc

SEQ ID NO: 2368571 - RNA, 13 nt, Bordetella pertussis
gcagccggccaug

SEQ ID NO: 2368572 - RNA, 23 nt, Bordetella pertussis
gcagccggccauggccgccacac

SEQ ID NO: 2368573 - RNA, 13 nt, Bordetella pertussis
gcagccggccccg

SEQ ID NO: 2368574 - RNA, 14 nt, Bordetella pertussis
gcagccggccccgc

SEQ ID NO: 2368575 - RNA, 15 nt, Bordetella pertussis
gcagccgggcugccg

SEQ ID NO: 2368576 - RNA, 18 nt, Bordetella pertussis
gcagccgggcugccggca

SEQ ID NO: 2368577 - RNA, 19 nt, Bordetella pertussis
gcagccgggcugccggcag

SEQ ID NO: 2368578 - RNA, 23 nt, Bordetella pertussis
gcagccgggcugccggcagcagg

SEQ ID NO: 2368579 - RNA, 23 nt, Bordetella pertussis
gcagccgguuggcgccuuccggc

SEQ ID NO: 2368580 - RNA, 16 nt, Bordetella pertussis
gcagccgucgcgcugc

SEQ ID NO: 2368581 - RNA, 16 nt, Bordetella pertussis
gcagccguugaucugg

SEQ ID NO: 2368582 - RNA, 15 nt, Bordetella pertussis
gcagccuugaaagag

SEQ ID NO: 2368583 - RNA, 11 nt, Bordetella pertussis
gcagccuuggu

SEQ ID NO: 2368584 - RNA, 18 nt, Bordetella pertussis
gcagcgaacggcccacgc

SEQ ID NO: 2368585 - RNA, 23 nt, Bordetella pertussis
gcagcgaacggcccacgcugucg

SEQ ID NO: 2368586 - RNA, 15 nt, Bordetella pertussis
gcagcgaaucgcccu

SEQ ID NO: 2368587 - RNA, 15 nt, Bordetella pertussis
gcagcgacaggacgu

SEQ ID NO: 2368588 - RNA, 16 nt, Bordetella pertussis
gcagcgaccgcggcgg

SEQ ID NO: 2368589 - RNA, 20 nt, Bordetella pertussis
gcagcgacggccccagcgcc

SEQ ID NO: 2368590 - RNA, 17 nt, Bordetella pertussis
gcagcgacucgaacacc

SEQ ID NO: 2368591 - RNA, 18 nt, Bordetella pertussis
gcagcgacucgaacaccg

SEQ ID NO: 2368592 - RNA, 23 nt, Bordetella pertussis
gcagcgacucgccgugcugggcg

SEQ ID NO: 2368593 - RNA, 15 nt, Bordetella pertussis
gcagcgacuucuacc

SEQ ID NO: 2368594 - RNA, 21 nt, Bordetella pertussis
gcagcgacuugucgcgcccga

SEQ ID NO: 2368595 - RNA, 22 nt, Bordetella pertussis
gcagcgacuugucgcgcccgaa

SEQ ID NO: 2368596 - RNA, 19 nt, Bordetella pertussis
gcagcgagaacagccacac

SEQ ID NO: 2368597 - RNA, 16 nt, Bordetella pertussis
gcagcgagagcgccac

SEQ ID NO: 2368598 - RNA, 20 nt, Bordetella pertussis
gcagcgagagcgccacgcca

SEQ ID NO: 2368599 - RNA, 17 nt, Bordetella pertussis
gcagcgaggacacgcag

SEQ ID NO: 2368600 - RNA, 20 nt, Bordetella pertussis
gcagcgaggccucgugcugc

SEQ ID NO: 2368601 - RNA, 17 nt, Bordetella pertussis
gcagcgaggcgcgggcg

SEQ ID NO: 2368602 - RNA, 21 nt, Bordetella pertussis
gcagcgaguagacgcagccgc

SEQ ID NO: 2368603 - RNA, 22 nt, Bordetella pertussis
gcagcgaguagacgcagccgca

SEQ ID NO: 2368604 - RNA, 14 nt, Bordetella pertussis
gcagcgcaccacca

SEQ ID NO: 2368605 - RNA, 22 nt, Bordetella pertussis
gcagcgcaccgucgccagggcg

SEQ ID NO: 2368606 - RNA, 13 nt, Bordetella pertussis
gcagcgcagcgcc

SEQ ID NO: 2368607 - RNA, 17 nt, Bordetella pertussis
gcagcgcagcgccacgc

SEQ ID NO: 2368608 - RNA, 21 nt, Bordetella pertussis
gcagcgcaggaugggcagcuc

SEQ ID NO: 2368609 - RNA, 14 nt, Bordetella pertussis
gcagcgcaucgagc

SEQ ID NO: 2368610 - RNA, 22 nt, Bordetella pertussis
gcagcgucugcugguacagccc

SEQ ID NO: 2368611 - RNA, 20 nt, Bordetella pertussis
gcagcgucuggcacgcuugc

SEQ ID NO: 2368612 - RNA, 19 nt, Bordetella pertussis
gcagcgugaccgacaggcc

SEQ ID NO: 2368613 - RNA, 15 nt, Bordetella pertussis
gcagcgugaccggac

SEQ ID NO: 2368614 - RNA, 21 nt, Bordetella pertussis
gcagcgugaugccgucgagcg

SEQ ID NO: 2368615 - RNA, 23 nt, Bordetella pertussis
gcagcgugaugcggucggccaca

SEQ ID NO: 2368616 - RNA, 15 nt, Bordetella pertussis
gcagcgugauggggc

SEQ ID NO: 2368617 - RNA, 16 nt, Bordetella pertussis
gcagcgugauggggcc

SEQ ID NO: 2368618 - RNA, 19 nt, Bordetella pertussis
gcagcgugauggggccggg

SEQ ID NO: 2368619 - RNA, 20 nt, Bordetella pertussis
gcagcgugauggggccgggc

SEQ ID NO: 2368620 - RNA, 21 nt, Bordetella pertussis
gcagcgugauggggccgggcg

SEQ ID NO: 2368621 - RNA, 17 nt, Bordetella pertussis
gcagcgugcggaccagc

SEQ ID NO: 2368622 - RNA, 14 nt, Bordetella pertussis
gcagcgugcugcgu

SEQ ID NO: 2368623 - RNA, 15 nt, Bordetella pertussis
gcagcguggccacca

SEQ ID NO: 2368624 - RNA, 21 nt, Bordetella pertussis
gcagcguggccaccaggcgcg

SEQ ID NO: 2368625 - RNA, 22 nt, Bordetella pertussis
gcagcguggccaccaggcgcgc

SEQ ID NO: 2368626 - RNA, 17 nt, Bordetella pertussis
gcagcguggccgccacc

SEQ ID NO: 2368627 - RNA, 21 nt, Bordetella pertussis
gcagcguggccgccaccagcg

SEQ ID NO: 2368628 - RNA, 22 nt, Bordetella pertussis
gcagcguggcgcggguggccgg

SEQ ID NO: 2368629 - RNA, 19 nt, Bordetella pertussis
gcagcgugggcucgaugcg

SEQ ID NO: 2368630 - RNA, 16 nt, Bordetella pertussis
gcagcguuacgcgacc

SEQ ID NO: 2368631 - RNA, 19 nt, Bordetella pertussis
gcagcguuacgcgaccagc

SEQ ID NO: 2368632 - RNA, 15 nt, Bordetella pertussis
gcagcguugcggcgu

SEQ ID NO: 2368633 - RNA, 17 nt, Bordetella pertussis
gcagcguugcggcgucg

SEQ ID NO: 2368634 - RNA, 22 nt, Bordetella pertussis
gcagcguugcggcgucgacgua

SEQ ID NO: 2368635 - RNA, 13 nt, Bordetella pertussis
gcagcguuucacc

SEQ ID NO: 2368636 - RNA, 18 nt, Bordetella pertussis
gcagcguuucaccgcugg

SEQ ID NO: 2368637 - RNA, 19 nt, Bordetella pertussis
gcagcguuucaccgcugga

SEQ ID NO: 2368638 - RNA, 21 nt, Bordetella pertussis
gcagcguuucaccgcuggacg

SEQ ID NO: 2368639 - RNA, 17 nt, Bordetella pertussis
gcagcucccccacgccg

SEQ ID NO: 2368640 - RNA, 21 nt, Bordetella pertussis
gcagcuccgggucgagcgccg

SEQ ID NO: 2368641 - RNA, 18 nt, Bordetella pertussis
gcagcuccguauccuggu

SEQ ID NO: 2368642 - RNA, 13 nt, Bordetella pertussis
gcagcucgcgcgc

SEQ ID NO: 2368643 - RNA, 15 nt, Bordetella pertussis
gcagcucggccaccg

SEQ ID NO: 2368644 - RNA, 14 nt, Bordetella pertussis
gcagcucggcgaag

SEQ ID NO: 2368645 - RNA, 20 nt, Bordetella pertussis
gcagcucggcgaagccgcag

SEQ ID NO: 2368646 - RNA, 15 nt, Bordetella pertussis
gcagcucggcgacca

SEQ ID NO: 2368647 - RNA, 23 nt, Bordetella pertussis
gcagcucggcgaucugcgcggcg

SEQ ID NO: 2368648 - RNA, 18 nt, Bordetella pertussis
gcagcucggugcagccca

SEQ ID NO: 2368649 - RNA, 19 nt, Bordetella pertussis
gcagcucggugcagcccag

SEQ ID NO: 2368650 - RNA, 18 nt, Bordetella pertussis
gcagcucguggcgcgccu

SEQ ID NO: 2368651 - RNA, 14 nt, Bordetella pertussis
gcagcugccugagc

SEQ ID NO: 2368652 - RNA, 14 nt, Bordetella pertussis
gcagcugcgccagc

SEQ ID NO: 2368653 - RNA, 15 nt, Bordetella pertussis
gcagcugcgccagcc

SEQ ID NO: 2368654 - RNA, 20 nt, Bordetella pertussis
gcagcugcuugcccaggccg

SEQ ID NO: 2368655 - RNA, 21 nt, Bordetella pertussis
gcagcugcuugcccaggccgg

SEQ ID NO: 2368656 - RNA, 22 nt, Bordetella pertussis
gcagcugcuugcccaggccggc

SEQ ID NO: 2368657 - RNA, 12 nt, Bordetella pertussis
gcagcuggcgca

SEQ ID NO: 2368658 - RNA, 15 nt, Bordetella pertussis
gcagcuggcgcagca

SEQ ID NO: 2368659 - RNA, 16 nt, Bordetella pertussis
gcagcuggcgcgggcg

SEQ ID NO: 2368660 - RNA, 19 nt, Bordetella pertussis
gcagcuggcgcgggcggcc

SEQ ID NO: 2368661 - RNA, 20 nt, Bordetella pertussis
gcagcuggcgcgggcggccu

SEQ ID NO: 2368662 - RNA, 21 nt, Bordetella pertussis
gcagcuggcgcgggcggccua

SEQ ID NO: 2368663 - RNA, 23 nt, Bordetella pertussis
gcagcuguagcccuggcgcugca

SEQ ID NO: 2368664 - RNA, 22 nt, Bordetella pertussis
gcagcuucuugaacucggccag

SEQ ID NO: 2368665 - RNA, 20 nt, Bordetella pertussis
gcagcuugaccgccuccagg

SEQ ID NO: 2368666 - RNA, 21 nt, Bordetella pertussis
gcagcuugaccgccuccagga

SEQ ID NO: 2368667 - RNA, 22 nt, Bordetella pertussis
gcagcuugaccgccuccaggau

SEQ ID NO: 2368668 - RNA, 15 nt, Bordetella pertussis
gcagcuugcccgcgc

SEQ ID NO: 2368669 - RNA, 17 nt, Bordetella pertussis
gcagcuugcccgcgcgc

SEQ ID NO: 2368670 - RNA, 21 nt, Bordetella pertussis
gcagcuugcccgcgcgcacgu

SEQ ID NO: 2368671 - RNA, 20 nt, Bordetella pertussis
gcagcuugccgaccgcuucc

SEQ ID NO: 2368672 - RNA, 17 nt, Bordetella pertussis
gcagcuugcgcgccagu

SEQ ID NO: 2368673 - RNA, 23 nt, Bordetella pertussis
gcagcuugcgcgcccccacgccg

SEQ ID NO: 2368674 - RNA, 14 nt, Bordetella pertussis
gcagcuuggcgcgc

SEQ ID NO: 2368675 - RNA, 17 nt, Bordetella pertussis
gcagcuugucgaucgcc

SEQ ID NO: 2368676 - RNA, 20 nt, Bordetella pertussis
gcaggaaaaagccucgcccu

SEQ ID NO: 2368677 - RNA, 18 nt, Bordetella pertussis
gcaggaacaggcugcgca

SEQ ID NO: 2368678 - RNA, 22 nt, Bordetella pertussis
gcaggaacaggcugcgcaggcg

SEQ ID NO: 2368679 - RNA, 16 nt, Bordetella pertussis
gcaggaacucagcgca

SEQ ID NO: 2368680 - RNA, 22 nt, Bordetella pertussis
gcaggaagccugcgcgcgagca

SEQ ID NO: 2368681 - RNA, 17 nt, Bordetella pertussis
gcaggaaguucagggcg

SEQ ID NO: 2368682 - RNA, 17 nt, Bordetella pertussis
gcaggaauccuggugcc

SEQ ID NO: 2368683 - RNA, 13 nt, Bordetella pertussis
gcaggacaaggcg

SEQ ID NO: 2368684 - RNA, 18 nt, Bordetella pertussis
gcaggacaaggcgcgcgc

SEQ ID NO: 2368685 - RNA, 21 nt, Bordetella pertussis
gcaggacgaacaggccgccgu

SEQ ID NO: 2368686 - RNA, 14 nt, Bordetella pertussis
gcaggacgccggcg

SEQ ID NO: 2368687 - RNA, 18 nt, Bordetella pertussis
gcaggacgccggcgccgg

SEQ ID NO: 2368688 - RNA, 24 nt, Bordetella pertussis
gcaggacggggaacaggcgcgcca

SEQ ID NO: 2368689 - RNA, 13 nt, Bordetella pertussis
gcaggagcccgcu

SEQ ID NO: 2368690 - RNA, 17 nt, Bordetella pertussis
gcaggagcccgcugccg

SEQ ID NO: 2368691 - RNA, 15 nt, Bordetella pertussis
gcaggaggcgcgggc

SEQ ID NO: 2368692 - RNA, 14 nt, Bordetella pertussis
gcaggagucgcucc

SEQ ID NO: 2368693 - RNA, 20 nt, Bordetella pertussis
gcaggauaccggagcggcuc

SEQ ID NO: 2368694 - RNA, 12 nt, Bordetella pertussis
gcaggaucagcu

SEQ ID NO: 2368695 - RNA, 14 nt, Bordetella pertussis
gcaggaucgcggcc

SEQ ID NO: 2368696 - RNA, 15 nt, Bordetella pertussis
gcaggaucgcggcca

SEQ ID NO: 2368697 - RNA, 18 nt, Bordetella pertussis
gcaggaucgcggccagcg

SEQ ID NO: 2368698 - RNA, 20 nt, Bordetella pertussis
gcaggaucgcggccagcggc

SEQ ID NO: 2368699 - RNA, 17 nt, Bordetella pertussis
gcaggaugacguggcag

SEQ ID NO: 2368700 - RNA, 20 nt, Bordetella pertussis
gcaggaugaggcgccgggug

SEQ ID NO: 2368701 - RNA, 15 nt, Bordetella pertussis
gcaggaugcgcggca

SEQ ID NO: 2368702 - RNA, 16 nt, Bordetella pertussis
gcaggaugcgcggcac

SEQ ID NO: 2368703 - RNA, 18 nt, Bordetella pertussis
gcaggauggaucccuggu

SEQ ID NO: 2368704 - RNA, 14 nt, Bordetella pertussis
gcaggauggccaug

SEQ ID NO: 2368705 - RNA, 16 nt, Bordetella pertussis
gcaggauggccaugcg

SEQ ID NO: 2368706 - RNA, 15 nt, Bordetella pertussis
gcaggauggcgaaca

SEQ ID NO: 2368707 - RNA, 16 nt, Bordetella pertussis
gcaggcaaagccugac

SEQ ID NO: 2368708 - RNA, 19 nt, Bordetella pertussis
gcaggcaagcugcuggcgc

SEQ ID NO: 2368709 - RNA, 17 nt, Bordetella pertussis
gcaggcacacgaccggc

SEQ ID NO: 2368710 - RNA, 19 nt, Bordetella pertussis
gcaggcacacgaccggcuu

SEQ ID NO: 2368711 - RNA, 18 nt, Bordetella pertussis
gcaggcacuggcgcggcg

SEQ ID NO: 2368712 - RNA, 19 nt, Bordetella pertussis
gcaggcacuggcgcggcgc

SEQ ID NO: 2368713 - RNA, 19 nt, Bordetella pertussis
gcaggcaguuggcggcgca

SEQ ID NO: 2368714 - RNA, 22 nt, Bordetella pertussis
gcaggcaguuggcggcgcagcc

SEQ ID NO: 2368715 - RNA, 23 nt, Bordetella pertussis
gcaggcaguuggcggcgcagccg

SEQ ID NO: 2368716 - RNA, 22 nt, Bordetella pertussis
gcaggccaccgacggcgcggcg

SEQ ID NO: 2368717 - RNA, 14 nt, Bordetella pertussis
gcaggccagcaugg

SEQ ID NO: 2368718 - RNA, 20 nt, Bordetella pertussis
gcaggccagcauggccgugg

SEQ ID NO: 2368719 - RNA, 13 nt, Bordetella pertussis
gcaggccagcgcc

SEQ ID NO: 2368720 - RNA, 14 nt, Bordetella pertussis
gcaggccagcgcca

SEQ ID NO: 2368721 - RNA, 16 nt, Bordetella pertussis
gcaggccagcgccgcg

SEQ ID NO: 2368722 - RNA, 16 nt, Bordetella pertussis
gcaggcgcguggccac

SEQ ID NO: 2368723 - RNA, 17 nt, Bordetella pertussis
gcaggcgcguggccacg

SEQ ID NO: 2368724 - RNA, 20 nt, Bordetella pertussis
gcaggcgcguggccacggcg

SEQ ID NO: 2368725 - RNA, 17 nt, Bordetella pertussis
gcaggcgcucgaggcgc

SEQ ID NO: 2368726 - RNA, 18 nt, Bordetella pertussis
gcaggcgcucgaggcgcu

SEQ ID NO: 2368727 - RNA, 20 nt, Bordetella pertussis
gcaggcgcucgaggcgcugg

SEQ ID NO: 2368728 - RNA, 21 nt, Bordetella pertussis
gcaggcgcucgaggcgcuggc

SEQ ID NO: 2368729 - RNA, 12 nt, Bordetella pertussis
gcaggcgcucgg

SEQ ID NO: 2368730 - RNA, 13 nt, Bordetella pertussis
gcaggcgcucggc

SEQ ID NO: 2368731 - RNA, 17 nt, Bordetella pertussis
gcaggcgcucggccagc

SEQ ID NO: 2368732 - RNA, 18 nt, Bordetella pertussis
gcaggcgcucggccagcg

SEQ ID NO: 2368733 - RNA, 16 nt, Bordetella pertussis
gcaggcgcugcagcaa

SEQ ID NO: 2368734 - RNA, 12 nt, Bordetella pertussis
gcaggcgcugcg

SEQ ID NO: 2368735 - RNA, 13 nt, Bordetella pertussis
gcaggcgcugcgc

SEQ ID NO: 2368736 - RNA, 11 nt, Bordetella pertussis
gcaggcgcugg

SEQ ID NO: 2368737 - RNA, 16 nt, Bordetella pertussis
gcaggcggcagaaggc

SEQ ID NO: 2368738 - RNA, 15 nt, Bordetella pertussis
gcaggcggccgacca

SEQ ID NO: 2368739 - RNA, 18 nt, Bordetella pertussis
gcaggcggccgaccagca

SEQ ID NO: 2368740 - RNA, 23 nt, Bordetella pertussis
gcaggcggcgcaucagcgcgccc

SEQ ID NO: 2368741 - RNA, 12 nt, Bordetella pertussis
gcaggcggcggc

SEQ ID NO: 2368742 - RNA, 22 nt, Bordetella pertussis
gcaggcggcggccuccagcagg

SEQ ID NO: 2368743 - RNA, 20 nt, Bordetella pertussis
gcaggcggcuuucaugggcc

SEQ ID NO: 2368744 - RNA, 22 nt, Bordetella pertussis
gcaggcggcuuucaugggccug

SEQ ID NO: 2368745 - RNA, 23 nt, Bordetella pertussis
gcaggcggcuuucaugggccugg

SEQ ID NO: 2368746 - RNA, 13 nt, Bordetella pertussis
gcaggcgggccag

SEQ ID NO: 2368747 - RNA, 14 nt, Bordetella pertussis
gcaggcgggcgccg

SEQ ID NO: 2368748 - RNA, 16 nt, Bordetella pertussis
gcaggcgggcgccgcg

SEQ ID NO: 2368749 - RNA, 16 nt, Bordetella pertussis
gcaggcggugcggagg

SEQ ID NO: 2368750 - RNA, 17 nt, Bordetella pertussis
gcaggcggugcggaggc

SEQ ID NO: 2368751 - RNA, 16 nt, Bordetella pertussis
gcaggcgucggccagc

SEQ ID NO: 2368752 - RNA, 19 nt, Bordetella pertussis
gcaggcgucggccagcgcg

SEQ ID NO: 2368753 - RNA, 14 nt, Bordetella pertussis
gcaggcguuucgcc

SEQ ID NO: 2368754 - RNA, 17 nt, Bordetella pertussis
gcaggcucagcccggcg

SEQ ID NO: 2368755 - RNA, 18 nt, Bordetella pertussis
gcaggcucagcgggcugc

SEQ ID NO: 2368756 - RNA, 16 nt, Bordetella pertussis
gcaggcuccacagcca

SEQ ID NO: 2368757 - RNA, 20 nt, Bordetella pertussis
gcaggcuccacagccacugc

SEQ ID NO: 2368758 - RNA, 18 nt, Bordetella pertussis
gcaggcuccucgccacac

SEQ ID NO: 2368759 - RNA, 16 nt, Bordetella pertussis
gcaggcucuggcugac

SEQ ID NO: 2368760 - RNA, 16 nt, Bordetella pertussis
gcaggcugauccaggu

SEQ ID NO: 2368761 - RNA, 16 nt, Bordetella pertussis
gcaggcugccgccggc

SEQ ID NO: 2368762 - RNA, 17 nt, Bordetella pertussis
gcaggcugccgccggcg

SEQ ID NO: 2368763 - RNA, 13 nt, Bordetella pertussis
gcaggcuggaagu

SEQ ID NO: 2368764 - RNA, 15 nt, Bordetella pertussis
gcaggcuggccaccg

SEQ ID NO: 2368765 - RNA, 14 nt, Bordetella pertussis
gcaggcuggccggc

SEQ ID NO: 2368766 - RNA, 16 nt, Bordetella pertussis
gcaggcuuucgcacag

SEQ ID NO: 2368767 - RNA, 18 nt, Bordetella pertussis
gcaggcuuucgcacagcc

SEQ ID NO: 2368768 - RNA, 20 nt, Bordetella pertussis
gcaggcuuugcuggccauag

SEQ ID NO: 2368769 - RNA, 13 nt, Bordetella pertussis
gcagggacaggca

SEQ ID NO: 2368770 - RNA, 14 nt, Bordetella pertussis
gcagggacaggcac

SEQ ID NO: 2368771 - RNA, 15 nt, Bordetella pertussis
gcagggacuugggca

SEQ ID NO: 2368772 - RNA, 20 nt, Bordetella pertussis
gcagggacuugggcaggccu

SEQ ID NO: 2368773 - RNA, 22 nt, Bordetella pertussis
gcagggcaucguuggaccccag

SEQ ID NO: 2368774 - RNA, 16 nt, Bordetella pertussis
gcagggcaugggcccg

SEQ ID NO: 2368775 - RNA, 20 nt, Bordetella pertussis
gcagggcaugggcccgggcg

SEQ ID NO: 2368776 - RNA, 14 nt, Bordetella pertussis
gcagggccagcgcc

SEQ ID NO: 2368777 - RNA, 19 nt, Bordetella pertussis
gcagggccagcgccagcac

SEQ ID NO: 2368778 - RNA, 13 nt, Bordetella pertussis
gcagggccaggcc

SEQ ID NO: 2368779 - RNA, 19 nt, Bordetella pertussis
gcagggccaggcccacggc

SEQ ID NO: 2368780 - RNA, 14 nt, Bordetella pertussis
gcagggccaggccg

SEQ ID NO: 2368781 - RNA, 15 nt, Bordetella pertussis
gcagggccaggccga

SEQ ID NO: 2368782 - RNA, 22 nt, Bordetella pertussis
gcagggccggccgggcgcggcg

SEQ ID NO: 2368783 - RNA, 16 nt, Bordetella pertussis
gcagggccuccugcag

SEQ ID NO: 2368784 - RNA, 14 nt, Bordetella pertussis
gcagggccuggcag

SEQ ID NO: 2368785 - RNA, 21 nt, Bordetella pertussis
gcagggcgacgucccaggccg

SEQ ID NO: 2368786 - RNA, 18 nt, Bordetella pertussis
gcagggcgcaacgccggc

SEQ ID NO: 2368787 - RNA, 19 nt, Bordetella pertussis
gcagggcgcaacgccggcc

SEQ ID NO: 2368788 - RNA, 14 nt, Bordetella pertussis
gcagggcgccgcgc

SEQ ID NO: 2368789 - RNA, 15 nt, Bordetella pertussis
gcagggcgccgcgcg

SEQ ID NO: 2368790 - RNA, 12 nt, Bordetella pertussis
gcagggcggcca

SEQ ID NO: 2368791 - RNA, 16 nt, Bordetella pertussis
gcagggcggccaggcc

SEQ ID NO: 2368792 - RNA, 18 nt, Bordetella pertussis
gcagggcggccaggccgg

SEQ ID NO: 2368793 - RNA, 18 nt, Bordetella pertussis
gcagggcggccucgacgg

SEQ ID NO: 2368794 - RNA, 22 nt, Bordetella pertussis
gcagggcggccucgacggccgc

SEQ ID NO: 2368795 - RNA, 12 nt, Bordetella pertussis
gcagggcggcgg

SEQ ID NO: 2368796 - RNA, 21 nt, Bordetella pertussis
gcagggcgggggacgcccgcc

SEQ ID NO: 2368797 - RNA, 14 nt, Bordetella pertussis
gcagggcgucggcc

SEQ ID NO: 2368798 - RNA, 20 nt, Bordetella pertussis
gcagggcgugcgggacggcc

SEQ ID NO: 2368799 - RNA, 21 nt, Bordetella pertussis
gcaggggccgcacgcgcggca

SEQ ID NO: 2368800 - RNA, 17 nt, Bordetella pertussis
gcagggucagcccgcca

SEQ ID NO: 2368801 - RNA, 19 nt, Bordetella pertussis
gcagggucagcccgccauc

SEQ ID NO: 2368802 - RNA, 14 nt, Bordetella pertussis
gcagggucagcggc

SEQ ID NO: 2368803 - RNA, 15 nt, Bordetella pertussis
gcagggucagcggcc

SEQ ID NO: 2368804 - RNA, 19 nt, Bordetella pertussis
gcagggucagcggccggcc

SEQ ID NO: 2368805 - RNA, 20 nt, Bordetella pertussis
gcaggguccgucggauugcg

SEQ ID NO: 2368806 - RNA, 23 nt, Bordetella pertussis
gcagggugacgggcugggccgag

SEQ ID NO: 2368807 - RNA, 14 nt, Bordetella pertussis
gcagggugcccagu

SEQ ID NO: 2368808 - RNA, 22 nt, Bordetella pertussis
gcagggugcccaguucgcggcc

SEQ ID NO: 2368809 - RNA, 22 nt, Bordetella pertussis
gcagggugccugucccggcugg

SEQ ID NO: 2368810 - RNA, 13 nt, Bordetella pertussis
gcaggguggccac

SEQ ID NO: 2368811 - RNA, 18 nt, Bordetella pertussis
gcagggugucggccaggg

SEQ ID NO: 2368812 - RNA, 21 nt, Bordetella pertussis
gcaggguucggugccuguccc

SEQ ID NO: 2368813 - RNA, 15 nt, Bordetella pertussis
gcaggguuggcgcgc

SEQ ID NO: 2368814 - RNA, 19 nt, Bordetella pertussis
gcagguacugggccaccuu

SEQ ID NO: 2368815 - RNA, 14 nt, Bordetella pertussis
gcagguaggacggc

SEQ ID NO: 2368816 - RNA, 24 nt, Bordetella pertussis
gcagguagucgaugaaggcgccga

SEQ ID NO: 2368817 - RNA, 13 nt, Bordetella pertussis
gcagguauuccgc

SEQ ID NO: 2368818 - RNA, 17 nt, Bordetella pertussis
gcaggucaucgcgcugg

SEQ ID NO: 2368819 - RNA, 19 nt, Bordetella pertussis
gcaggucaucgcgcuggcg

SEQ ID NO: 2368820 - RNA, 14 nt, Bordetella pertussis
gcagguccaggccu

SEQ ID NO: 2368821 - RNA, 17 nt, Bordetella pertussis
gcagguccaggccuggg

SEQ ID NO: 2368822 - RNA, 16 nt, Bordetella pertussis
gcagguccggucgcgc

SEQ ID NO: 2368823 - RNA, 21 nt, Bordetella pertussis
gcagguccugcacgcgggcca

SEQ ID NO: 2368824 - RNA, 22 nt, Bordetella pertussis
gcagguccugguaucccucgcc

SEQ ID NO: 2368825 - RNA, 14 nt, Bordetella pertussis
gcaggucgccagca

SEQ ID NO: 2368826 - RNA, 20 nt, Bordetella pertussis
gcaggucgccagcaggcccu

SEQ ID NO: 2368827 - RNA, 13 nt, Bordetella pertussis
gcaggucgcgcac

SEQ ID NO: 2368828 - RNA, 12 nt, Bordetella pertussis
gcaggucgcgcg

SEQ ID NO: 2368829 - RNA, 15 nt, Bordetella pertussis
gcaggucggccagcg

SEQ ID NO: 2368830 - RNA, 14 nt, Bordetella pertussis
gcaggucggccagg

SEQ ID NO: 2368831 - RNA, 15 nt, Bordetella pertussis
gcaggucggccagga

SEQ ID NO: 2368832 - RNA, 17 nt, Bordetella pertussis
gcaggucggccaggacg

SEQ ID NO: 2368833 - RNA, 17 nt, Bordetella pertussis
gcaggucggcgaugcgc

SEQ ID NO: 2368834 - RNA, 12 nt, Bordetella pertussis
gcaggucggcgc

SEQ ID NO: 2368835 - RNA, 13 nt, Bordetella pertussis
gcaggucggcgcg

SEQ ID NO: 2368836 - RNA, 19 nt, Bordetella pertussis
gcaucaucugggcgucgaa

SEQ ID NO: 2368837 - RNA, 13 nt, Bordetella pertussis
gcaucauggcgcg

SEQ ID NO: 2368838 - RNA, 23 nt, Bordetella pertussis
gcaucauggcgcgcgccgcgcug

SEQ ID NO: 2368839 - RNA, 20 nt, Bordetella pertussis
gcaucauguaaggcgcaugc

SEQ ID NO: 2368840 - RNA, 20 nt, Bordetella pertussis
gcauccagccgaucagccgg

SEQ ID NO: 2368841 - RNA, 21 nt, Bordetella pertussis
gcauccagccgaucagccggc

SEQ ID NO: 2368842 - RNA, 13 nt, Bordetella pertussis
gcauccagcggca

SEQ ID NO: 2368843 - RNA, 20 nt, Bordetella pertussis
gcauccaggucuacccgcgc

SEQ ID NO: 2368844 - RNA, 21 nt, Bordetella pertussis
gcauccaggucuacccgcgcg

SEQ ID NO: 2368845 - RNA, 17 nt, Bordetella pertussis
gcauccaggugccgcgu

SEQ ID NO: 2368846 - RNA, 20 nt, Bordetella pertussis
gcaucccaauuggccgcccu

SEQ ID NO: 2368847 - RNA, 21 nt, Bordetella pertussis
gcaucccaauuggccgcccug

SEQ ID NO: 2368848 - RNA, 23 nt, Bordetella pertussis
gcaucccaauuggccgcccuggc

SEQ ID NO: 2368849 - RNA, 19 nt, Bordetella pertussis
gcaucccgacaugccgccc

SEQ ID NO: 2368850 - RNA, 15 nt, Bordetella pertussis
gcaucccggcgcuca

SEQ ID NO: 2368851 - RNA, 15 nt, Bordetella pertussis
gcaucccugcuugcg

SEQ ID NO: 2368852 - RNA, 22 nt, Bordetella pertussis
gcaucccugcuugcgcggaccu

SEQ ID NO: 2368853 - RNA, 13 nt, Bordetella pertussis
gcauccgcgccag

SEQ ID NO: 2368854 - RNA, 19 nt, Bordetella pertussis
gcauccgcgccaggauggc

SEQ ID NO: 2368855 - RNA, 18 nt, Bordetella pertussis
gcauccggcccagcgcca

SEQ ID NO: 2368856 - RNA, 19 nt, Bordetella pertussis
gcauccggcccagcgccau

SEQ ID NO: 2368857 - RNA, 19 nt, Bordetella pertussis
gcauccggcccggugcagc

SEQ ID NO: 2368858 - RNA, 24 nt, Bordetella pertussis
gcauccuuuuuguuuuggcgcacg

SEQ ID NO: 2368859 - RNA, 17 nt, Bordetella pertussis
gcaucgacagcgcgccc

SEQ ID NO: 2368860 - RNA, 17 nt, Bordetella pertussis
gcaucgacaugcccgcc

SEQ ID NO: 2368861 - RNA, 21 nt, Bordetella pertussis
gcaucgacaugcccgccggca

SEQ ID NO: 2368862 - RNA, 20 nt, Bordetella pertussis
gcaucgaccacgcgcgcgcc

SEQ ID NO: 2368863 - RNA, 21 nt, Bordetella pertussis
gcaucgaccacgcgcgcgccg

SEQ ID NO: 2368864 - RNA, 22 nt, Bordetella pertussis
gcaucgagaaaccagccgccgc

SEQ ID NO: 2368865 - RNA, 18 nt, Bordetella pertussis
gcaucgagcuccugcagg

SEQ ID NO: 2368866 - RNA, 16 nt, Bordetella pertussis
gcaucgaucagcgcgc

SEQ ID NO: 2368867 - RNA, 16 nt, Bordetella pertussis
gcaucgaucaggcugu

SEQ ID NO: 2368868 - RNA, 19 nt, Bordetella pertussis
gcaucgaucaggcugucgc

SEQ ID NO: 2368869 - RNA, 15 nt, Bordetella pertussis
gcaucgaucucggcc

SEQ ID NO: 2368870 - RNA, 16 nt, Bordetella pertussis
gcaucgaucucggccu

SEQ ID NO: 2368871 - RNA, 16 nt, Bordetella pertussis
gcaucgaugcggccuu

SEQ ID NO: 2368872 - RNA, 15 nt, Bordetella pertussis
gcaucgauuucucgc

SEQ ID NO: 2368873 - RNA, 18 nt, Bordetella pertussis
gcaucgauuucucgcugc

SEQ ID NO: 2368874 - RNA, 22 nt, Bordetella pertussis
gcaucgauuucucgcugcugac

SEQ ID NO: 2368875 - RNA, 18 nt, Bordetella pertussis
gcaucgccaugccggccc

SEQ ID NO: 2368876 - RNA, 19 nt, Bordetella pertussis
gcaucgccaugccggcccc

SEQ ID NO: 2368877 - RNA, 15 nt, Bordetella pertussis
gcaucgcccaccaug

SEQ ID NO: 2368878 - RNA, 22 nt, Bordetella pertussis
gcaucgcccaccaugagcacgc

SEQ ID NO: 2368879 - RNA, 22 nt, Bordetella pertussis
gcaucgcccugcucgaucuggu

SEQ ID NO: 2368880 - RNA, 12 nt, Bordetella pertussis
gcaucgccgaac

SEQ ID NO: 2368881 - RNA, 16 nt, Bordetella pertussis
gcaucgccgcaggcgu

SEQ ID NO: 2368882 - RNA, 14 nt, Bordetella pertussis
gcaucgccgcgggc

SEQ ID NO: 2368883 - RNA, 18 nt, Bordetella pertussis
gcaucgcgaugcgcagca

SEQ ID NO: 2368884 - RNA, 21 nt, Bordetella pertussis
gcaucgcgcacccguuccagc

SEQ ID NO: 2368885 - RNA, 13 nt, Bordetella pertussis
gcaucgcgcagcg

SEQ ID NO: 2368886 - RNA, 19 nt, Bordetella pertussis
gcaucgcgccuucggcgcg

SEQ ID NO: 2368887 - RNA, 13 nt, Bordetella pertussis
gcaucgcgcgccg

SEQ ID NO: 2368888 - RNA, 15 nt, Bordetella pertussis
gcaucgcgcgccgcc

SEQ ID NO: 2368889 - RNA, 16 nt, Bordetella pertussis
gcaucgcgcgccgccg

SEQ ID NO: 2368890 - RNA, 20 nt, Bordetella pertussis
gcaucgcgcgccgccgcccg

SEQ ID NO: 2368891 - RNA, 15 nt, Bordetella pertussis
gcaucgcgcgcgccg

SEQ ID NO: 2368892 - RNA, 14 nt, Bordetella pertussis
gcaucgcgcggcau

SEQ ID NO: 2368893 - RNA, 16 nt, Bordetella pertussis
gcaucgcgcggcaugg

SEQ ID NO: 2368894 - RNA, 12 nt, Bordetella pertussis
gcaucgcgcuga

SEQ ID NO: 2368895 - RNA, 15 nt, Bordetella pertussis
gcaucgcggcagccc

SEQ ID NO: 2368896 - RNA, 19 nt, Bordetella pertussis
gcaucgcggcagcccggca

SEQ ID NO: 2368897 - RNA, 16 nt, Bordetella pertussis
gcaucggcacccagcc

SEQ ID NO: 2368898 - RNA, 18 nt, Bordetella pertussis
gcaucggcacccagccgg

SEQ ID NO: 2368899 - RNA, 18 nt, Bordetella pertussis
gcaucggcacgggucagg

SEQ ID NO: 2368900 - RNA, 21 nt, Bordetella pertussis
gcaucggccacgcugcccugc

SEQ ID NO: 2368901 - RNA, 14 nt, Bordetella pertussis
gcaucggccagcau

SEQ ID NO: 2368902 - RNA, 21 nt, Bordetella pertussis
gcaucggccaggcgccugagc

SEQ ID NO: 2368903 - RNA, 18 nt, Bordetella pertussis
gcaucggccggauccagc

SEQ ID NO: 2368904 - RNA, 18 nt, Bordetella pertussis
gcaucggccggcggucgc

SEQ ID NO: 2368905 - RNA, 23 nt, Bordetella pertussis
gcaucggccggcggucgcgcugg

SEQ ID NO: 2368906 - RNA, 24 nt, Bordetella pertussis
gcaucggccggcggucgcgcuggc

SEQ ID NO: 2368907 - RNA, 13 nt, Bordetella pertussis
gcaucggcgccgc

SEQ ID NO: 2368908 - RNA, 17 nt, Bordetella pertussis
gcaucggcgccgcgcgc

SEQ ID NO: 2368909 - RNA, 14 nt, Bordetella pertussis
gcaucggcgccggc

SEQ ID NO: 2368910 - RNA, 15 nt, Bordetella pertussis
gcaucggcgccggcg

SEQ ID NO: 2368911 - RNA, 18 nt, Bordetella pertussis
gcaucggcgccggcgucc

SEQ ID NO: 2368912 - RNA, 22 nt, Bordetella pertussis
gcaucggcggcaggucggugca

SEQ ID NO: 2368913 - RNA, 16 nt, Bordetella pertussis
gcaucggcuggcgcaa

SEQ ID NO: 2368914 - RNA, 20 nt, Bordetella pertussis
gcaucgggauccgugcggcg

SEQ ID NO: 2368915 - RNA, 15 nt, Bordetella pertussis
gcaucgggcagggcu

SEQ ID NO: 2368916 - RNA, 18 nt, Bordetella pertussis
gcaucggucaacgccugc

SEQ ID NO: 2368917 - RNA, 21 nt, Bordetella pertussis
gcaucguaguugggcgccuug

SEQ ID NO: 2368918 - RNA, 22 nt, Bordetella pertussis
gcaucguaguugggcgccuugc

SEQ ID NO: 2368919 - RNA, 22 nt, Bordetella pertussis
gcaucguauggcggggugccug

SEQ ID NO: 2368920 - RNA, 15 nt, Bordetella pertussis
gcaucgucaggcagg

SEQ ID NO: 2368921 - RNA, 20 nt, Bordetella pertussis
gcaucgucaggcaggcgcgc

SEQ ID NO: 2368922 - RNA, 21 nt, Bordetella pertussis
gcaucgucaggcaggcgcgcc

SEQ ID NO: 2368923 - RNA, 16 nt, Bordetella pertussis
gcaucgucgcgcugcg

SEQ ID NO: 2368924 - RNA, 19 nt, Bordetella pertussis
gcaucguuacacuggcccu

SEQ ID NO: 2368925 - RNA, 17 nt, Bordetella pertussis
gcaucguucaggcgcau

SEQ ID NO: 2368926 - RNA, 16 nt, Bordetella pertussis
gcaucguucagucgag

SEQ ID NO: 2368927 - RNA, 22 nt, Bordetella pertussis
gcaucuccaggaugcgcgacac

SEQ ID NO: 2368928 - RNA, 14 nt, Bordetella pertussis
gcaucucgaagcgc

SEQ ID NO: 2368929 - RNA, 14 nt, Bordetella pertussis
gcaucugccccagc

SEQ ID NO: 2368930 - RNA, 23 nt, Bordetella pertussis
gcaucugccccagcuugucggcc

SEQ ID NO: 2368931 - RNA, 16 nt, Bordetella pertussis
gcaucuguccgcgccg

SEQ ID NO: 2368932 - RNA, 15 nt, Bordetella pertussis
gcaucuugcgccgcu

SEQ ID NO: 2368933 - RNA, 18 nt, Bordetella pertussis
gcaucuugcgccgcugcg

SEQ ID NO: 2368934 - RNA, 15 nt, Bordetella pertussis
gcaucuuggccgcca

SEQ ID NO: 2368935 - RNA, 23 nt, Bordetella pertussis
gcaugaaaaaagccccauugccu

SEQ ID NO: 2368936 - RNA, 16 nt, Bordetella pertussis
gcaugaaaaagggcgc

SEQ ID NO: 2368937 - RNA, 20 nt, Bordetella pertussis
gcaugaaaaagggcgcacca

SEQ ID NO: 2368938 - RNA, 22 nt, Bordetella pertussis
gcaugaaaaagggcgcaccaug

SEQ ID NO: 2368939 - RNA, 18 nt, Bordetella pertussis
gcaugaacggcagcgcgc

SEQ ID NO: 2368940 - RNA, 15 nt, Bordetella pertussis
gcaugaagcgcagca

SEQ ID NO: 2368941 - RNA, 15 nt, Bordetella pertussis
gcaugaagcugccca

SEQ ID NO: 2368942 - RNA, 18 nt, Bordetella pertussis
gcaugaagcugcccagca

SEQ ID NO: 2368943 - RNA, 17 nt, Bordetella pertussis
gcaugaccgacaggcgg

SEQ ID NO: 2368944 - RNA, 17 nt, Bordetella pertussis
gcaugaccgccgccagc

SEQ ID NO: 2368945 - RNA, 21 nt, Bordetella pertussis
gcaugaccgccgccagcagcg

SEQ ID NO: 2368946 - RNA, 22 nt, Bordetella pertussis
gcaugaccgccgccagcagcgc

SEQ ID NO: 2368947 - RNA, 14 nt, Bordetella pertussis
gcaugaccgccggc

SEQ ID NO: 2368948 - RNA, 14 nt, Bordetella pertussis
gcauggcgaucgaa

SEQ ID NO: 2368949 - RNA, 19 nt, Bordetella pertussis
gcauggcgaucgaacgcgg

SEQ ID NO: 2368950 - RNA, 18 nt, Bordetella pertussis
gcauggcgccagcuggac

SEQ ID NO: 2368951 - RNA, 21 nt, Bordetella pertussis
gcauggcgccaugcgacagcc

SEQ ID NO: 2368952 - RNA, 11 nt, Bordetella pertussis
gcauggcgccg

SEQ ID NO: 2368953 - RNA, 17 nt, Bordetella pertussis
gcauggcgccgcgccgc

SEQ ID NO: 2368954 - RNA, 18 nt, Bordetella pertussis
gcauggcgccgcgccgcc

SEQ ID NO: 2368955 - RNA, 17 nt, Bordetella pertussis
gcauggcgccgcgcgcc

SEQ ID NO: 2368956 - RNA, 13 nt, Bordetella pertussis
gcauggcgcgcgg

SEQ ID NO: 2368957 - RNA, 20 nt, Bordetella pertussis
gcauggcgcgcgggcccugg

SEQ ID NO: 2368958 - RNA, 21 nt, Bordetella pertussis
gcauggcgcgugcgcgcgcca

SEQ ID NO: 2368959 - RNA, 12 nt, Bordetella pertussis
gcauggcggcca

SEQ ID NO: 2368960 - RNA, 14 nt, Bordetella pertussis
gcauggcggccagc

SEQ ID NO: 2368961 - RNA, 20 nt, Bordetella pertussis
gcauggcggccaggcgcgcc

SEQ ID NO: 2368962 - RNA, 21 nt, Bordetella pertussis
gcauggcggccaggcgcgccg

SEQ ID NO: 2368963 - RNA, 23 nt, Bordetella pertussis
gcauggcggccaggcgcgccgcg

SEQ ID NO: 2368964 - RNA, 14 nt, Bordetella pertussis
gcauggcggcgccc

SEQ ID NO: 2368965 - RNA, 16 nt, Bordetella pertussis
gcauggcggcgcccgc

SEQ ID NO: 2368966 - RNA, 19 nt, Bordetella pertussis
gcauggcggcgcccgcugc

SEQ ID NO: 2368967 - RNA, 20 nt, Bordetella pertussis
gcauggcggcgcccgcugcg

SEQ ID NO: 2368968 - RNA, 14 nt, Bordetella pertussis
gcauggcgggcgag

SEQ ID NO: 2368969 - RNA, 17 nt, Bordetella pertussis
gcauggcgguggccagc

SEQ ID NO: 2368970 - RNA, 24 nt, Bordetella pertussis
gcauggcgucgaaacgcugcgcga

SEQ ID NO: 2368971 - RNA, 17 nt, Bordetella pertussis
gcaugggcacauacagc

SEQ ID NO: 2368972 - RNA, 21 nt, Bordetella pertussis
gcaugggcacauacagcggag

SEQ ID NO: 2368973 - RNA, 13 nt, Bordetella pertussis
gcaugggccaggc

SEQ ID NO: 2368974 - RNA, 14 nt, Bordetella pertussis
gcaugggccaggcg

SEQ ID NO: 2368975 - RNA, 17 nt, Bordetella pertussis
gcaugggccaggcgcuc

SEQ ID NO: 2368976 - RNA, 19 nt, Bordetella pertussis
gcaugggccaggcgcucca

SEQ ID NO: 2368977 - RNA, 19 nt, Bordetella pertussis
gcaugggcccgggcgcgcu

SEQ ID NO: 2368978 - RNA, 21 nt, Bordetella pertussis
gcaugggcccgggcgcgcugu

SEQ ID NO: 2368979 - RNA, 14 nt, Bordetella pertussis
gcaugggcgcaggc

SEQ ID NO: 2368980 - RNA, 15 nt, Bordetella pertussis
gcaugggcgcaggcc

SEQ ID NO: 2368981 - RNA, 17 nt, Bordetella pertussis
gcaugggcgcaggccgc

SEQ ID NO: 2368982 - RNA, 20 nt, Bordetella pertussis
gcaugggcgcaggccgccac

SEQ ID NO: 2368983 - RNA, 13 nt, Bordetella pertussis
gcaugggcgccga

SEQ ID NO: 2368984 - RNA, 14 nt, Bordetella pertussis
gcaugggcgcgccc

SEQ ID NO: 2368985 - RNA, 19 nt, Bordetella pertussis
gcaugggcgcgcccggcga

SEQ ID NO: 2368986 - RNA, 12 nt, Bordetella pertussis
gcaugggcggcc

SEQ ID NO: 2368987 - RNA, 16 nt, Bordetella pertussis
gcaugggcggcccggc

SEQ ID NO: 2368988 - RNA, 17 nt, Bordetella pertussis
gcaugggcggcccggcc

SEQ ID NO: 2368989 - RNA, 14 nt, Bordetella pertussis
gcauggggacuggc

SEQ ID NO: 2368990 - RNA, 17 nt, Bordetella pertussis
gcauggggacuggcgcc

SEQ ID NO: 2368991 - RNA, 22 nt, Bordetella pertussis
gcauggggacuggcgccugcaa

SEQ ID NO: 2368992 - RNA, 14 nt, Bordetella pertussis
gcauggggcaggcg

SEQ ID NO: 2368993 - RNA, 18 nt, Bordetella pertussis
gcauggggcaggcgcagc

SEQ ID NO: 2368994 - RNA, 16 nt, Bordetella pertussis
gcaugggggcuggcgc

SEQ ID NO: 2368995 - RNA, 17 nt, Bordetella pertussis
gcaugggggcuggcgcu

SEQ ID NO: 2368996 - RNA, 19 nt, Bordetella pertussis
gcauggguaaagcgccggc

SEQ ID NO: 2368997 - RNA, 20 nt, Bordetella pertussis
gcauggguaaagcgccggcc

SEQ ID NO: 2368998 - RNA, 18 nt, Bordetella pertussis
gcaugguagcgguccagc

SEQ ID NO: 2368999 - RNA, 15 nt, Bordetella pertussis
gcauggucgcgaugc

SEQ ID NO: 2369000 - RNA, 19 nt, Bordetella pertussis
gcauggucggcauggccag

SEQ ID NO: 2369001 - RNA, 16 nt, Bordetella pertussis
gcauggugagggccac

SEQ ID NO: 2369002 - RNA, 17 nt, Bordetella pertussis
gcaugguggcgcaggca

SEQ ID NO: 2369003 - RNA, 18 nt, Bordetella pertussis
gcaugguggcgcaggcaa

SEQ ID NO: 2369004 - RNA, 22 nt, Bordetella pertussis
gcaugguggcgcaggcaaagcc

SEQ ID NO: 2369005 - RNA, 17 nt, Bordetella pertussis
gcauguacucggccagg

SEQ ID NO: 2369006 - RNA, 21 nt, Bordetella pertussis
gcauguacucggccaggccau

SEQ ID NO: 2369007 - RNA, 19 nt, Bordetella pertussis
gcauguaggccucgggcca

SEQ ID NO: 2369008 - RNA, 20 nt, Bordetella pertussis
gcauguaggccucgggccau

SEQ ID NO: 2369009 - RNA, 23 nt, Bordetella pertussis
gcauguauucaucacgggcgcca

SEQ ID NO: 2369010 - RNA, 14 nt, Bordetella pertussis
gcauguccagcggc

SEQ ID NO: 2369011 - RNA, 16 nt, Bordetella pertussis
gcauguccagcggcgu

SEQ ID NO: 2369012 - RNA, 20 nt, Bordetella pertussis
gcaugucccgaggcgcccca

SEQ ID NO: 2369013 - RNA, 13 nt, Bordetella pertussis
gcauguccgccac

SEQ ID NO: 2369014 - RNA, 21 nt, Bordetella pertussis
gcauguccgccacgccggcca

SEQ ID NO: 2369015 - RNA, 13 nt, Bordetella pertussis
gcauguccgccau

SEQ ID NO: 2369016 - RNA, 14 nt, Bordetella pertussis
gcauguccgccaug

SEQ ID NO: 2369017 - RNA, 20 nt, Bordetella pertussis
gcauguccguaucgcggccg

SEQ ID NO: 2369018 - RNA, 23 nt, Bordetella pertussis
gcauguccguaucgcggccgagc

SEQ ID NO: 2369019 - RNA, 18 nt, Bordetella pertussis
gcaugucgaagcaggcgg

SEQ ID NO: 2369020 - RNA, 19 nt, Bordetella pertussis
gcaugucgaagcaggcggu

SEQ ID NO: 2369021 - RNA, 23 nt, Bordetella pertussis
gcaugucgaagcaggcgguacag

SEQ ID NO: 2369022 - RNA, 14 nt, Bordetella pertussis
gcaugucgcggccc

SEQ ID NO: 2369023 - RNA, 21 nt, Bordetella pertussis
gcaugucgcggcccacggcca

SEQ ID NO: 2369024 - RNA, 20 nt, Bordetella pertussis
gcaugucguggcgauagcgc

SEQ ID NO: 2369025 - RNA, 15 nt, Bordetella pertussis
gcaugugccaccgcc

SEQ ID NO: 2369026 - RNA, 19 nt, Bordetella pertussis
gcaugugccaccgcccagg

SEQ ID NO: 2369027 - RNA, 23 nt, Bordetella pertussis
gcaugugccaccgcccaggcgca

SEQ ID NO: 2369028 - RNA, 21 nt, Bordetella pertussis
gcaugugcucgggacgcaggc

SEQ ID NO: 2369029 - RNA, 16 nt, Bordetella pertussis
gcauucccgcccagcg

SEQ ID NO: 2369030 - RNA, 21 nt, Bordetella pertussis
gcauucccgcccagcgacgag

SEQ ID NO: 2369031 - RNA, 20 nt, Bordetella pertussis
gcauucccggaccgcgcugc

SEQ ID NO: 2369032 - RNA, 21 nt, Bordetella pertussis
gcauucccggaccgcgcugcg

SEQ ID NO: 2369033 - RNA, 18 nt, Bordetella pertussis
gcauucgcgccugagcug

SEQ ID NO: 2369034 - RNA, 19 nt, Bordetella pertussis
gcauucgcgccugagcugc

SEQ ID NO: 2369035 - RNA, 17 nt, Bordetella pertussis
gcauucggcggccggcu

SEQ ID NO: 2369036 - RNA, 22 nt, Bordetella pertussis
gcauucgucgcugccgcgcgau

SEQ ID NO: 2369037 - RNA, 15 nt, Bordetella pertussis
gcauucgugaugccc

SEQ ID NO: 2369038 - RNA, 14 nt, Bordetella pertussis
gcauucucggacag

SEQ ID NO: 2369039 - RNA, 15 nt, Bordetella pertussis
gcauugaagcuggcg

SEQ ID NO: 2369040 - RNA, 22 nt, Bordetella pertussis
gcauugaucgaucagccagccg

SEQ ID NO: 2369041 - RNA, 16 nt, Bordetella pertussis
gcauugcacaacgggc

SEQ ID NO: 2369042 - RNA, 19 nt, Bordetella pertussis
gcauugccgccgcccugcc

SEQ ID NO: 2369043 - RNA, 14 nt, Bordetella pertussis
gcauugccgcggca

SEQ ID NO: 2369044 - RNA, 20 nt, Bordetella pertussis
gcauugccggagcagcagcg

SEQ ID NO: 2369045 - RNA, 15 nt, Bordetella pertussis
gcauugcgccagccg

SEQ ID NO: 2369046 - RNA, 18 nt, Bordetella pertussis
gcauugcgcguauccagc

SEQ ID NO: 2369047 - RNA, 11 nt, Bordetella pertussis
gcauugcggcu

SEQ ID NO: 2369048 - RNA, 18 nt, Bordetella pertussis
gcauuggcccugcugggg

SEQ ID NO: 2369049 - RNA, 16 nt, Bordetella pertussis
gcauuggccgccgcca

SEQ ID NO: 2369050 - RNA, 17 nt, Bordetella pertussis
gcauuggcgccgcgcuc

SEQ ID NO: 2369051 - RNA, 19 nt, Bordetella pertussis
gcauuggcgccgcgcucgc

SEQ ID NO: 2369052 - RNA, 12 nt, Bordetella pertussis
gcauuggcggcg

SEQ ID NO: 2369053 - RNA, 13 nt, Bordetella pertussis
gcauuggcggcgg

SEQ ID NO: 2369054 - RNA, 14 nt, Bordetella pertussis
gcauugggcagcgg

SEQ ID NO: 2369055 - RNA, 12 nt, Bordetella pertussis
gcauuggugagc

SEQ ID NO: 2369056 - RNA, 14 nt, Bordetella pertussis
gcauuucccagccg

SEQ ID NO: 2369057 - RNA, 14 nt, Bordetella pertussis
gcauuucgcgugcg

SEQ ID NO: 2369058 - RNA, 16 nt, Bordetella pertussis
gcauuucggcgccgcc

SEQ ID NO: 2369059 - RNA, 14 nt, Bordetella pertussis
gcauuucucgggcg

SEQ ID NO: 2369060 - RNA, 14 nt, Bordetella pertussis
gcauuugccgcggc

SEQ ID NO: 2369061 - RNA, 14 nt, Bordetella pertussis
gccaccacgauggc

SEQ ID NO: 2369062 - RNA, 16 nt, Bordetella pertussis
gccaccacgauggcgc

SEQ ID NO: 2369063 - RNA, 15 nt, Bordetella pertussis
gccaccacgcgcacc

SEQ ID NO: 2369064 - RNA, 18 nt, Bordetella pertussis
gccaccacgcgcaccagc

SEQ ID NO: 2369065 - RNA, 19 nt, Bordetella pertussis
gccaccacgcgcaccagcu

SEQ ID NO: 2369066 - RNA, 17 nt, Bordetella pertussis
gccaccacggcgcggau

SEQ ID NO: 2369067 - RNA, 12 nt, Bordetella pertussis
gccaccacugca

SEQ ID NO: 2369068 - RNA, 19 nt, Bordetella pertussis
gccaccacugcaaggcccg

SEQ ID NO: 2369069 - RNA, 20 nt, Bordetella pertussis
gccaccacugcaaggcccgc

SEQ ID NO: 2369070 - RNA, 22 nt, Bordetella pertussis
gccaccacugcaaggcccgccc

SEQ ID NO: 2369071 - RNA, 17 nt, Bordetella pertussis
gccaccagcagcgccag

SEQ ID NO: 2369072 - RNA, 14 nt, Bordetella pertussis
gccaccagcgcgcc

SEQ ID NO: 2369073 - RNA, 16 nt, Bordetella pertussis
gccaccagcgcgccag

SEQ ID NO: 2369074 - RNA, 17 nt, Bordetella pertussis
gccaccagcgcgccagc

SEQ ID NO: 2369075 - RNA, 18 nt, Bordetella pertussis
gccaccagcgcgccagca

SEQ ID NO: 2369076 - RNA, 14 nt, Bordetella pertussis
gccaccagcggcgu

SEQ ID NO: 2369077 - RNA, 20 nt, Bordetella pertussis
gccaccagcggcguggcggc

SEQ ID NO: 2369078 - RNA, 22 nt, Bordetella pertussis
gccaccagcguguagagcaggc

SEQ ID NO: 2369079 - RNA, 20 nt, Bordetella pertussis
gccaccagcuugcgcgccgc

SEQ ID NO: 2369080 - RNA, 23 nt, Bordetella pertussis
gccaccaggaacgccagcagcac

SEQ ID NO: 2369081 - RNA, 16 nt, Bordetella pertussis
gccaccaggccgaugg

SEQ ID NO: 2369082 - RNA, 21 nt, Bordetella pertussis
gccaccaggccgauggcgucc

SEQ ID NO: 2369083 - RNA, 14 nt, Bordetella pertussis
gccaccaggccguc

SEQ ID NO: 2369084 - RNA, 19 nt, Bordetella pertussis
gccaccaggccgucggcca

SEQ ID NO: 2369085 - RNA, 20 nt, Bordetella pertussis
gccaccaggccgucggccag

SEQ ID NO: 2369086 - RNA, 22 nt, Bordetella pertussis
gccaccaggccgucggccaggg

SEQ ID NO: 2369087 - RNA, 19 nt, Bordetella pertussis
gccaccaggcgcgcgccau

SEQ ID NO: 2369088 - RNA, 20 nt, Bordetella pertussis
gccaccaggcgcgcgccauc

SEQ ID NO: 2369089 - RNA, 14 nt, Bordetella pertussis
gccaccaggcugau

SEQ ID NO: 2369090 - RNA, 14 nt, Bordetella pertussis
gccaccagggcccg

SEQ ID NO: 2369091 - RNA, 17 nt, Bordetella pertussis
gccaccagggcgcccgc

SEQ ID NO: 2369092 - RNA, 18 nt, Bordetella pertussis
gccaccagguagggcagc

SEQ ID NO: 2369093 - RNA, 19 nt, Bordetella pertussis
gccaccagguagggcagca

SEQ ID NO: 2369094 - RNA, 17 nt, Bordetella pertussis
gccaccagugcgccggc

SEQ ID NO: 2369095 - RNA, 18 nt, Bordetella pertussis
gccaccagugcgccggcg

SEQ ID NO: 2369096 - RNA, 18 nt, Bordetella pertussis
gccaccaugucccuggcc

SEQ ID NO: 2369097 - RNA, 12 nt, Bordetella pertussis
gccacccagcuc

SEQ ID NO: 2369098 - RNA, 15 nt, Bordetella pertussis
gccacccagcucagc

SEQ ID NO: 2369099 - RNA, 13 nt, Bordetella pertussis
gccacccaggcgg

SEQ ID NO: 2369100 - RNA, 14 nt, Bordetella pertussis
gccacccaggcggc

SEQ ID NO: 2369101 - RNA, 20 nt, Bordetella pertussis
gccacccaggcggcaggcgc

SEQ ID NO: 2369102 - RNA, 13 nt, Bordetella pertussis
gccacccagggcu

SEQ ID NO: 2369103 - RNA, 21 nt, Bordetella pertussis
gccacccagggcuugacgcgc

SEQ ID NO: 2369104 - RNA, 22 nt, Bordetella pertussis
gccacccagggcuugacgcgcg

SEQ ID NO: 2369105 - RNA, 16 nt, Bordetella pertussis
gccaccccguagcgca

SEQ ID NO: 2369106 - RNA, 20 nt, Bordetella pertussis
gccaccccguagcgcaucgc

SEQ ID NO: 2369107 - RNA, 14 nt, Bordetella pertussis
gccaccccgucauc

SEQ ID NO: 2369108 - RNA, 14 nt, Bordetella pertussis
gccacccgccgccg

SEQ ID NO: 2369109 - RNA, 18 nt, Bordetella pertussis
gccacccgccgccggcga

SEQ ID NO: 2369110 - RNA, 15 nt, Bordetella pertussis
gccacccgccguacc

SEQ ID NO: 2369111 - RNA, 18 nt, Bordetella pertussis
gccacccuggcacgcugg

SEQ ID NO: 2369112 - RNA, 16 nt, Bordetella pertussis
gccaccgacaagccgg

SEQ ID NO: 2369113 - RNA, 19 nt, Bordetella pertussis
gccaccgacaagccggucg

SEQ ID NO: 2369114 - RNA, 16 nt, Bordetella pertussis
gccaccgacggcgcgg

SEQ ID NO: 2369115 - RNA, 17 nt, Bordetella pertussis
gccaccgacggcgcggc

SEQ ID NO: 2369116 - RNA, 18 nt, Bordetella pertussis
gccaccgacggcgcggcg

SEQ ID NO: 2369117 - RNA, 23 nt, Bordetella pertussis
gccaccgagauguuccugcgcga

SEQ ID NO: 2369118 - RNA, 13 nt, Bordetella pertussis
gccaccgcauggg

SEQ ID NO: 2369119 - RNA, 13 nt, Bordetella pertussis
gccaccgcccagg

SEQ ID NO: 2369120 - RNA, 14 nt, Bordetella pertussis
gccaccgcccaggc

SEQ ID NO: 2369121 - RNA, 18 nt, Bordetella pertussis
gccaccgcccaggcgcag

SEQ ID NO: 2369122 - RNA, 19 nt, Bordetella pertussis
gccaccgcccaggcgcagc

SEQ ID NO: 2369123 - RNA, 15 nt, Bordetella pertussis
gccaccgcccccgcc

SEQ ID NO: 2369124 - RNA, 17 nt, Bordetella pertussis
gccaccgcccccgccgc

SEQ ID NO: 2369125 - RNA, 19 nt, Bordetella pertussis
gccaccgcccccgccgcca

SEQ ID NO: 2369126 - RNA, 21 nt, Bordetella pertussis
gccaccgcccccgccgccaug

SEQ ID NO: 2369127 - RNA, 22 nt, Bordetella pertussis
gccaccgcccccgccgccaugc

SEQ ID NO: 2369128 - RNA, 21 nt, Bordetella pertussis
gccaccgccugugccagcugg

SEQ ID NO: 2369129 - RNA, 16 nt, Bordetella pertussis
gccaccgcgccgccca

SEQ ID NO: 2369130 - RNA, 19 nt, Bordetella pertussis
gccaccgcggugccgcgcg

SEQ ID NO: 2369131 - RNA, 20 nt, Bordetella pertussis
gccaccgcggugccgcgcgc

SEQ ID NO: 2369132 - RNA, 23 nt, Bordetella pertussis
gccaccgcggugccgcgcgcggc

SEQ ID NO: 2369133 - RNA, 21 nt, Bordetella pertussis
gccaccgcguugagcgccgac

SEQ ID NO: 2369134 - RNA, 17 nt, Bordetella pertussis
gccaccgguugcagcgc

SEQ ID NO: 2369135 - RNA, 19 nt, Bordetella pertussis
gccaccgguugcagcgcgc

SEQ ID NO: 2369136 - RNA, 21 nt, Bordetella pertussis
gccaccgguugcagcgcgcca

SEQ ID NO: 2369137 - RNA, 13 nt, Bordetella pertussis
gccaccgucgcca

SEQ ID NO: 2369138 - RNA, 16 nt, Bordetella pertussis
gccaccgucgccaccu

SEQ ID NO: 2369139 - RNA, 16 nt, Bordetella pertussis
gccaccgugauggcgc

SEQ ID NO: 2369140 - RNA, 15 nt, Bordetella pertussis
gccaccguggccacg

SEQ ID NO: 2369141 - RNA, 18 nt, Bordetella pertussis
gccaccguggccacggcc

SEQ ID NO: 2369142 - RNA, 12 nt, Bordetella pertussis
gccaccguggcg

SEQ ID NO: 2369143 - RNA, 21 nt, Bordetella pertussis
gccaccucgaucaccaccggc

SEQ ID NO: 2369144 - RNA, 18 nt, Bordetella pertussis
gccaccucuucagcccgg

SEQ ID NO: 2369145 - RNA, 14 nt, Bordetella pertussis
gccaccuggcagcc

SEQ ID NO: 2369146 - RNA, 15 nt, Bordetella pertussis
gccaccuggcagccg

SEQ ID NO: 2369147 - RNA, 14 nt, Bordetella pertussis
gccaccuggcgcaa

SEQ ID NO: 2369148 - RNA, 21 nt, Bordetella pertussis
gccaccuggcgcaaggcgucg

SEQ ID NO: 2369149 - RNA, 16 nt, Bordetella pertussis
gccaccuggcgcccgg

SEQ ID NO: 2369150 - RNA, 17 nt, Bordetella pertussis
gccaccuggcgcccggc

SEQ ID NO: 2369151 - RNA, 20 nt, Bordetella pertussis
gccaccuggcgcccggcggc

SEQ ID NO: 2369152 - RNA, 16 nt, Bordetella pertussis
gccaccugggccgccu

SEQ ID NO: 2369153 - RNA, 17 nt, Bordetella pertussis
gccaccugggccgccug

SEQ ID NO: 2369154 - RNA, 15 nt, Bordetella pertussis
gccaccuggucgucg

SEQ ID NO: 2369155 - RNA, 23 nt, Bordetella pertussis
gccaccuggucgucggccacgcc

SEQ ID NO: 2369156 - RNA, 15 nt, Bordetella pertussis
gccaccuucgccgcg

SEQ ID NO: 2369157 - RNA, 17 nt, Bordetella pertussis
gccaccuucgccgcgca

SEQ ID NO: 2369158 - RNA, 22 nt, Bordetella pertussis
gccaccuucgccgcgcacagcc

SEQ ID NO: 2369159 - RNA, 21 nt, Bordetella pertussis
gccaccuuggccaauggccgc

SEQ ID NO: 2369160 - RNA, 21 nt, Bordetella pertussis
gccacgaaacccacggcgaug

SEQ ID NO: 2369161 - RNA, 16 nt, Bordetella pertussis
gccacgaaacccagga

SEQ ID NO: 2369162 - RNA, 20 nt, Bordetella pertussis
gccacgaaacccaggaagcg

SEQ ID NO: 2369163 - RNA, 23 nt, Bordetella pertussis
gccacgaacggcgcgaaggugcg

SEQ ID NO: 2369164 - RNA, 21 nt, Bordetella pertussis
gccacgaagacgaagucccag

SEQ ID NO: 2369165 - RNA, 22 nt, Bordetella pertussis
gccacgaagcgcagcaccgcgc

SEQ ID NO: 2369166 - RNA, 23 nt, Bordetella pertussis
gccacgaagcgcagcaccgcgcg

SEQ ID NO: 2369167 - RNA, 19 nt, Bordetella pertussis
gccacgaauuccucgccgc

SEQ ID NO: 2369168 - RNA, 24 nt, Bordetella pertussis
gccacgaauuccucgccgcccagc

SEQ ID NO: 2369169 - RNA, 12 nt, Bordetella pertussis
gccacgaccacc

SEQ ID NO: 2369170 - RNA, 17 nt, Bordetella pertussis
gccacgaccaccagcgu

SEQ ID NO: 2369171 - RNA, 13 nt, Bordetella pertussis
gccacgaccggcu

SEQ ID NO: 2369172 - RNA, 14 nt, Bordetella pertussis
gccacgaccggcuc

SEQ ID NO: 2369173 - RNA, 16 nt, Bordetella pertussis
gccacgaccggcucga

SEQ ID NO: 2369174 - RNA, 19 nt, Bordetella pertussis
gccacgucgaccucgagca

SEQ ID NO: 2369175 - RNA, 21 nt, Bordetella pertussis
gccacgucgaccucgagcacc

SEQ ID NO: 2369176 - RNA, 13 nt, Bordetella pertussis
gccacgucgccca

SEQ ID NO: 2369177 - RNA, 13 nt, Bordetella pertussis
gccacgucgccgg

SEQ ID NO: 2369178 - RNA, 15 nt, Bordetella pertussis
gccacgucgccggcg

SEQ ID NO: 2369179 - RNA, 16 nt, Bordetella pertussis
gccacgucgccggcgu

SEQ ID NO: 2369180 - RNA, 16 nt, Bordetella pertussis
gccacgucgcucggcc

SEQ ID NO: 2369181 - RNA, 16 nt, Bordetella pertussis
gccacgucggcggccg

SEQ ID NO: 2369182 - RNA, 17 nt, Bordetella pertussis
gccacgucggcggccgc

SEQ ID NO: 2369183 - RNA, 19 nt, Bordetella pertussis
gccacgucggcggccgccu

SEQ ID NO: 2369184 - RNA, 18 nt, Bordetella pertussis
gccacgucggucgcuucc

SEQ ID NO: 2369185 - RNA, 22 nt, Bordetella pertussis
gccacgucggucgcuuccagcg

SEQ ID NO: 2369186 - RNA, 17 nt, Bordetella pertussis
gccacgugaagcgccgc

SEQ ID NO: 2369187 - RNA, 18 nt, Bordetella pertussis
gccacgugaagcgccgcg

SEQ ID NO: 2369188 - RNA, 21 nt, Bordetella pertussis
gccacgugaagcgccgcgccu

SEQ ID NO: 2369189 - RNA, 14 nt, Bordetella pertussis
gccacgugcugcug

SEQ ID NO: 2369190 - RNA, 15 nt, Bordetella pertussis
gccacgugcugcugg

SEQ ID NO: 2369191 - RNA, 21 nt, Bordetella pertussis
gccacgugcugcuggagaucg

SEQ ID NO: 2369192 - RNA, 17 nt, Bordetella pertussis
gccacguguggcaggcc

SEQ ID NO: 2369193 - RNA, 18 nt, Bordetella pertussis
gccacguguggcaggcca

SEQ ID NO: 2369194 - RNA, 19 nt, Bordetella pertussis
gccacguguggcaggccag

SEQ ID NO: 2369195 - RNA, 20 nt, Bordetella pertussis
gccacguguggcaggccagc

SEQ ID NO: 2369196 - RNA, 21 nt, Bordetella pertussis
gccacguguggcaggccagcg

SEQ ID NO: 2369197 - RNA, 18 nt, Bordetella pertussis
gccacguugaagcgcagc

SEQ ID NO: 2369198 - RNA, 19 nt, Bordetella pertussis
gccacguugaagcgcagcc

SEQ ID NO: 2369199 - RNA, 23 nt, Bordetella pertussis
gccacguugaagcgcagccacgg

SEQ ID NO: 2369200 - RNA, 15 nt, Bordetella pertussis
gccacguugauccag

SEQ ID NO: 2369201 - RNA, 21 nt, Bordetella pertussis
gccacguugauccagcgcucg

SEQ ID NO: 2369202 - RNA, 22 nt, Bordetella pertussis
gccacguugauccagcgcucgg

SEQ ID NO: 2369203 - RNA, 15 nt, Bordetella pertussis
gccacguugucgcgc

SEQ ID NO: 2369204 - RNA, 16 nt, Bordetella pertussis
gccacuauuuucagaa

SEQ ID NO: 2369205 - RNA, 14 nt, Bordetella pertussis
gccacucgaugggc

SEQ ID NO: 2369206 - RNA, 17 nt, Bordetella pertussis
gccacucgaugggcgcg

SEQ ID NO: 2369207 - RNA, 18 nt, Bordetella pertussis
gccacucgaugggcgcgc

SEQ ID NO: 2369208 - RNA, 21 nt, Bordetella pertussis
gccacucgaugggcgcgcgca

SEQ ID NO: 2369209 - RNA, 22 nt, Bordetella pertussis
gccacucgaugggcgcgcgcau

SEQ ID NO: 2369210 - RNA, 21 nt, Bordetella pertussis
gccacugcaucgugcgcgagg

SEQ ID NO: 2369211 - RNA, 17 nt, Bordetella pertussis
gccacugccaggcgccc

SEQ ID NO: 2369212 - RNA, 14 nt, Bordetella pertussis
gccacugcgccugg

SEQ ID NO: 2369213 - RNA, 16 nt, Bordetella pertussis
gccacugcguccuuga

SEQ ID NO: 2369214 - RNA, 16 nt, Bordetella pertussis
gccacuggccgcgcuc

SEQ ID NO: 2369215 - RNA, 18 nt, Bordetella pertussis
gccacuuccagcgccugc

SEQ ID NO: 2369216 - RNA, 13 nt, Bordetella pertussis
gccacuuccuugc

SEQ ID NO: 2369217 - RNA, 14 nt, Bordetella pertussis
gccacuucgccggu

SEQ ID NO: 2369218 - RNA, 14 nt, Bordetella pertussis
gccacuugcaggcc

SEQ ID NO: 2369219 - RNA, 15 nt, Bordetella pertussis
gccacuugcaggccg

SEQ ID NO: 2369220 - RNA, 16 nt, Bordetella pertussis
gccacuugcaggccgc

SEQ ID NO: 2369221 - RNA, 19 nt, Bordetella pertussis
gccacuuucgcgcgcgccu

SEQ ID NO: 2369222 - RNA, 20 nt, Bordetella pertussis
gccacuuucgcgcgcgccug

SEQ ID NO: 2369223 - RNA, 23 nt, Bordetella pertussis
gccagaaaaaauacccguccuug

SEQ ID NO: 2369224 - RNA, 18 nt, Bordetella pertussis
gccagaaagcgcggccgg

SEQ ID NO: 2369225 - RNA, 20 nt, Bordetella pertussis
gccagaacgacagcgacaac

SEQ ID NO: 2369226 - RNA, 18 nt, Bordetella pertussis
gccagaacgcugaugcgc

SEQ ID NO: 2369227 - RNA, 22 nt, Bordetella pertussis
gccagaacgcugaugcgcguca

SEQ ID NO: 2369228 - RNA, 23 nt, Bordetella pertussis
gccagacauugucaagcagcgcc

SEQ ID NO: 2369229 - RNA, 15 nt, Bordetella pertussis
gccagaccgcgcgca

SEQ ID NO: 2369230 - RNA, 16 nt, Bordetella pertussis
gccagaccgcgcgcac

SEQ ID NO: 2369231 - RNA, 18 nt, Bordetella pertussis
gccagaccgcgcgcacca

SEQ ID NO: 2369232 - RNA, 14 nt, Bordetella pertussis
gccagaccugguga

SEQ ID NO: 2369233 - RNA, 20 nt, Bordetella pertussis
gccagaccuggugaucgcgc

SEQ ID NO: 2369234 - RNA, 14 nt, Bordetella pertussis
gccagacggccagc

SEQ ID NO: 2369235 - RNA, 15 nt, Bordetella pertussis
gccagacggccagcg

SEQ ID NO: 2369236 - RNA, 18 nt, Bordetella pertussis
gccagacggccagcgcgc

SEQ ID NO: 2369237 - RNA, 16 nt, Bordetella pertussis
gccagauagcccaggc

SEQ ID NO: 2369238 - RNA, 17 nt, Bordetella pertussis
gccagauagcccaggcg

SEQ ID NO: 2369239 - RNA, 14 nt, Bordetella pertussis
gccagauagucgcg

SEQ ID NO: 2369240 - RNA, 15 nt, Bordetella pertussis
gccagauagucgcgg

SEQ ID NO: 2369241 - RNA, 18 nt, Bordetella pertussis
gccagaucgaacacgagc

SEQ ID NO: 2369242 - RNA, 18 nt, Bordetella pertussis
gccagaucggacgggccg

SEQ ID NO: 2369243 - RNA, 20 nt, Bordetella pertussis
gccagaucguugaucucgcc

SEQ ID NO: 2369244 - RNA, 17 nt, Bordetella pertussis
gccagaucucgcguccg

SEQ ID NO: 2369245 - RNA, 14 nt, Bordetella pertussis
gccagaugcgccgc

SEQ ID NO: 2369246 - RNA, 15 nt, Bordetella pertussis
gccagaugcgccgca

SEQ ID NO: 2369247 - RNA, 15 nt, Bordetella pertussis
gccagcaagcgcgcc

SEQ ID NO: 2369248 - RNA, 16 nt, Bordetella pertussis
gccagcaagcgcgcca

SEQ ID NO: 2369249 - RNA, 17 nt, Bordetella pertussis
gccagcaagcgcucggc

SEQ ID NO: 2369250 - RNA, 19 nt, Bordetella pertussis
gccagcaagcgcucggcca

SEQ ID NO: 2369251 - RNA, 21 nt, Bordetella pertussis
gccagcaagcgcucggccacg

SEQ ID NO: 2369252 - RNA, 22 nt, Bordetella pertussis
gccagcaagcgcucggccacgc

SEQ ID NO: 2369253 - RNA, 15 nt, Bordetella pertussis
gccagcaaggcggca

SEQ ID NO: 2369254 - RNA, 18 nt, Bordetella pertussis
gccagcaaggcgucggcc

SEQ ID NO: 2369255 - RNA, 19 nt, Bordetella pertussis
gccagcaaggcgucggcca

SEQ ID NO: 2369256 - RNA, 21 nt, Bordetella pertussis
gccagcaaggcgucggccagg

SEQ ID NO: 2369257 - RNA, 23 nt, Bordetella pertussis
gccagcaagggguccguggcggc

SEQ ID NO: 2369258 - RNA, 24 nt, Bordetella pertussis
gccagcacagugucuaucauggcc

SEQ ID NO: 2369259 - RNA, 19 nt, Bordetella pertussis
gccagcacauacgccgccg

SEQ ID NO: 2369260 - RNA, 20 nt, Bordetella pertussis
gccagcacauacgccgccga

SEQ ID NO: 2369261 - RNA, 24 nt, Bordetella pertussis
gccagcacauacgccgccgaggcg

SEQ ID NO: 2369262 - RNA, 20 nt, Bordetella pertussis
gccagcaccggcacgcgcca

SEQ ID NO: 2369263 - RNA, 15 nt, Bordetella pertussis
gccagcaccggcccg

SEQ ID NO: 2369264 - RNA, 19 nt, Bordetella pertussis
gccagcaccggcccgaaga

SEQ ID NO: 2369265 - RNA, 16 nt, Bordetella pertussis
gccagcaccggccgcc

SEQ ID NO: 2369266 - RNA, 17 nt, Bordetella pertussis
gccagcaccggccgccg

SEQ ID NO: 2369267 - RNA, 21 nt, Bordetella pertussis
gccagcaccggccgccgcaug

SEQ ID NO: 2369268 - RNA, 13 nt, Bordetella pertussis
gccagcaccugcu

SEQ ID NO: 2369269 - RNA, 20 nt, Bordetella pertussis
gccagcaccugcuugacgua

SEQ ID NO: 2369270 - RNA, 17 nt, Bordetella pertussis
gccagcacgaaccacag

SEQ ID NO: 2369271 - RNA, 22 nt, Bordetella pertussis
gccagcacgaucacgaacagcg

SEQ ID NO: 2369272 - RNA, 13 nt, Bordetella pertussis
gccagcacgccau

SEQ ID NO: 2369273 - RNA, 22 nt, Bordetella pertussis
gccagcacgccauucauccagc

SEQ ID NO: 2369274 - RNA, 14 nt, Bordetella pertussis
gccagcacgccggc

SEQ ID NO: 2369275 - RNA, 15 nt, Bordetella pertussis
gccagcacgccggcc

SEQ ID NO: 2369276 - RNA, 16 nt, Bordetella pertussis
gccagcacgccggcca

SEQ ID NO: 2369277 - RNA, 18 nt, Bordetella pertussis
gccagcacgccggccagg

SEQ ID NO: 2369278 - RNA, 21 nt, Bordetella pertussis
gccagcacgcgcagcuugccc

SEQ ID NO: 2369279 - RNA, 14 nt, Bordetella pertussis
gccagcacggcaug

SEQ ID NO: 2369280 - RNA, 23 nt, Bordetella pertussis
gccagcacggcaugucccgaggc

SEQ ID NO: 2369281 - RNA, 19 nt, Bordetella pertussis
gccagcacggcgcacacca

SEQ ID NO: 2369282 - RNA, 22 nt, Bordetella pertussis
gccagcacggcgcacaccauca

SEQ ID NO: 2369283 - RNA, 22 nt, Bordetella pertussis
gccagcacgguggcgcccggcg

SEQ ID NO: 2369284 - RNA, 23 nt, Bordetella pertussis
gccagcacgguggcgcccggcgg

SEQ ID NO: 2369285 - RNA, 14 nt, Bordetella pertussis
gccagcagaaugcc

SEQ ID NO: 2369286 - RNA, 16 nt, Bordetella pertussis
gccagccgcuggcgcg

SEQ ID NO: 2369287 - RNA, 17 nt, Bordetella pertussis
gccagccgcuggcgcgc

SEQ ID NO: 2369288 - RNA, 20 nt, Bordetella pertussis
gccagccgcuggcgcgccgc

SEQ ID NO: 2369289 - RNA, 18 nt, Bordetella pertussis
gccagccgcuugcggcca

SEQ ID NO: 2369290 - RNA, 16 nt, Bordetella pertussis
gccagccggcccagca

SEQ ID NO: 2369291 - RNA, 20 nt, Bordetella pertussis
gccagccggcccagcacgcc

SEQ ID NO: 2369292 - RNA, 20 nt, Bordetella pertussis
gccagccggcccagcaugcc

SEQ ID NO: 2369293 - RNA, 13 nt, Bordetella pertussis
gccagccggcccg

SEQ ID NO: 2369294 - RNA, 18 nt, Bordetella pertussis
gccagccggcccgacacc

SEQ ID NO: 2369295 - RNA, 22 nt, Bordetella pertussis
gccagccggcccgacaccugga

SEQ ID NO: 2369296 - RNA, 14 nt, Bordetella pertussis
gccagccggcgcgc

SEQ ID NO: 2369297 - RNA, 15 nt, Bordetella pertussis
gccagccggcgcgcc

SEQ ID NO: 2369298 - RNA, 16 nt, Bordetella pertussis
gccagccggcgcgcca

SEQ ID NO: 2369299 - RNA, 17 nt, Bordetella pertussis
gccagccggcgcgccau

SEQ ID NO: 2369300 - RNA, 15 nt, Bordetella pertussis
gccagccggcggcca

SEQ ID NO: 2369301 - RNA, 18 nt, Bordetella pertussis
gccagccggcggccagcu

SEQ ID NO: 2369302 - RNA, 19 nt, Bordetella pertussis
gccagccgggcgaucgcgu

SEQ ID NO: 2369303 - RNA, 21 nt, Bordetella pertussis
gccagccguugcgccagcggc

SEQ ID NO: 2369304 - RNA, 12 nt, Bordetella pertussis
gccagccugcca

SEQ ID NO: 2369305 - RNA, 14 nt, Bordetella pertussis
gccagccugccaca

SEQ ID NO: 2369306 - RNA, 12 nt, Bordetella pertussis
gccagccugccc

SEQ ID NO: 2369307 - RNA, 13 nt, Bordetella pertussis
gccagccugcccg

SEQ ID NO: 2369308 - RNA, 14 nt, Bordetella pertussis
gccagccugcccgu

SEQ ID NO: 2369309 - RNA, 18 nt, Bordetella pertussis
gccagccugccgcggccg

SEQ ID NO: 2369310 - RNA, 16 nt, Bordetella pertussis
gccagccugugcgcca

SEQ ID NO: 2369311 - RNA, 17 nt, Bordetella pertussis
gccagccugugcgccau

SEQ ID NO: 2369312 - RNA, 23 nt, Bordetella pertussis
gccagcgcaaggguuguggccgu

SEQ ID NO: 2369313 - RNA, 15 nt, Bordetella pertussis
gccagcgccacgccc

SEQ ID NO: 2369314 - RNA, 19 nt, Bordetella pertussis
gccagcgccacgcccuggc

SEQ ID NO: 2369315 - RNA, 18 nt, Bordetella pertussis
gccagcgccagaaagcgc

SEQ ID NO: 2369316 - RNA, 12 nt, Bordetella pertussis
gccagcgccagc

SEQ ID NO: 2369317 - RNA, 16 nt, Bordetella pertussis
gccagcgccagcacga

SEQ ID NO: 2369318 - RNA, 16 nt, Bordetella pertussis
gccagcgccagccgcu

SEQ ID NO: 2369319 - RNA, 18 nt, Bordetella pertussis
gccagcgccagcgucagg

SEQ ID NO: 2369320 - RNA, 12 nt, Bordetella pertussis
gccagcgccaug

SEQ ID NO: 2369321 - RNA, 13 nt, Bordetella pertussis
gccagcgccauga

SEQ ID NO: 2369322 - RNA, 22 nt, Bordetella pertussis
gccagcgccaugaugucgcgcg

SEQ ID NO: 2369323 - RNA, 13 nt, Bordetella pertussis
gccagcgccgaaa

SEQ ID NO: 2369324 - RNA, 12 nt, Bordetella pertussis
gccagcgccgca

SEQ ID NO: 2369325 - RNA, 14 nt, Bordetella pertussis
gccagcgccgcagc

SEQ ID NO: 2369326 - RNA, 15 nt, Bordetella pertussis
gccagcgccgcagcg

SEQ ID NO: 2369327 - RNA, 12 nt, Bordetella pertussis
gccagcgccgcc

SEQ ID NO: 2369328 - RNA, 13 nt, Bordetella pertussis
gccagcgccgcca

SEQ ID NO: 2369329 - RNA, 16 nt, Bordetella pertussis
gccagcgccgccagcc

SEQ ID NO: 2369330 - RNA, 18 nt, Bordetella pertussis
gccagcgccgccagccgc

SEQ ID NO: 2369331 - RNA, 14 nt, Bordetella pertussis
gccagcgccgccau

SEQ ID NO: 2369332 - RNA, 16 nt, Bordetella pertussis
gccagcgccgcgcgcg

SEQ ID NO: 2369333 - RNA, 19 nt, Bordetella pertussis
gccagcgccgcggccggcg

SEQ ID NO: 2369334 - RNA, 23 nt, Bordetella pertussis
gccagcgccgcggccggcggcgc

SEQ ID NO: 2369335 - RNA, 16 nt, Bordetella pertussis
gccagcgccgcgguga

SEQ ID NO: 2369336 - RNA, 17 nt, Bordetella pertussis
gccagcgccgcggugau

SEQ ID NO: 2369337 - RNA, 14 nt, Bordetella pertussis
gccagcgccggcgc

SEQ ID NO: 2369338 - RNA, 22 nt, Bordetella pertussis
gccagcgccggcgcgcgcugau

SEQ ID NO: 2369339 - RNA, 16 nt, Bordetella pertussis
gccagcgccggcgcgu

SEQ ID NO: 2369340 - RNA, 18 nt, Bordetella pertussis
gccagcgccggcgcgucc

SEQ ID NO: 2369341 - RNA, 19 nt, Bordetella pertussis
gccagcgccggcgcgucca

SEQ ID NO: 2369342 - RNA, 13 nt, Bordetella pertussis
gccagcgccgggg

SEQ ID NO: 2369343 - RNA, 21 nt, Bordetella pertussis
gccagcgccuccaucagcagc

SEQ ID NO: 2369344 - RNA, 22 nt, Bordetella pertussis
gccagcgccuccaucagcagca

SEQ ID NO: 2369345 - RNA, 23 nt, Bordetella pertussis
gccagcgccuccaucagcagcac

SEQ ID NO: 2369346 - RNA, 21 nt, Bordetella pertussis
gccagcgccucgcgcucgagc

SEQ ID NO: 2369347 - RNA, 14 nt, Bordetella pertussis
gccagcgccugcgc

SEQ ID NO: 2369348 - RNA, 15 nt, Bordetella pertussis
gccagcgccugcgcg

SEQ ID NO: 2369349 - RNA, 19 nt, Bordetella pertussis
gccagcgccugcgcggccu

SEQ ID NO: 2369350 - RNA, 21 nt, Bordetella pertussis
gccagcgccugcgcggccucg

SEQ ID NO: 2369351 - RNA, 13 nt, Bordetella pertussis
gccagcgccugga

SEQ ID NO: 2369352 - RNA, 23 nt, Bordetella pertussis
gccagcgccuggaccuggacgag

SEQ ID NO: 2369353 - RNA, 14 nt, Bordetella pertussis
gccagcgccugggc

SEQ ID NO: 2369354 - RNA, 20 nt, Bordetella pertussis
gccagcgccugggcgcggau

SEQ ID NO: 2369355 - RNA, 22 nt, Bordetella pertussis
gccagcgccugggucaggucgg

SEQ ID NO: 2369356 - RNA, 22 nt, Bordetella pertussis
gccagcgcgaaaacccgcggca

SEQ ID NO: 2369357 - RNA, 13 nt, Bordetella pertussis
gccagcgcgacgg

SEQ ID NO: 2369358 - RNA, 18 nt, Bordetella pertussis
gccagcgcgacggccucg

SEQ ID NO: 2369359 - RNA, 18 nt, Bordetella pertussis
gccagcgcgacgggcacc

SEQ ID NO: 2369360 - RNA, 19 nt, Bordetella pertussis
gccagcgcgacgggcaccg

SEQ ID NO: 2369361 - RNA, 20 nt, Bordetella pertussis
gccagcgcgaucucgcgcag

SEQ ID NO: 2369362 - RNA, 23 nt, Bordetella pertussis
gccagcgcgcaggugugccagcc

SEQ ID NO: 2369363 - RNA, 14 nt, Bordetella pertussis
gccagcgcgccgcc

SEQ ID NO: 2369364 - RNA, 15 nt, Bordetella pertussis
gccagcgcgccgcca

SEQ ID NO: 2369365 - RNA, 16 nt, Bordetella pertussis
gccagcgcgccgccag

SEQ ID NO: 2369366 - RNA, 17 nt, Bordetella pertussis
gccagcgcgccgccagc

SEQ ID NO: 2369367 - RNA, 20 nt, Bordetella pertussis
gccagcgcgccgcccaccac

SEQ ID NO: 2369368 - RNA, 23 nt, Bordetella pertussis
gccagcgcgccgcccaccaccag

SEQ ID NO: 2369369 - RNA, 14 nt, Bordetella pertussis
gccagcgcgccggc

SEQ ID NO: 2369370 - RNA, 17 nt, Bordetella pertussis
gccagcgcgccggccag

SEQ ID NO: 2369371 - RNA, 12 nt, Bordetella pertussis
gccagcgcgccu

SEQ ID NO: 2369372 - RNA, 15 nt, Bordetella pertussis
gccagcgcgccuucg

SEQ ID NO: 2369373 - RNA, 13 nt, Bordetella pertussis
gccagcgcgcgau

SEQ ID NO: 2369374 - RNA, 12 nt, Bordetella pertussis
gccagcgcgcgc

SEQ ID NO: 2369375 - RNA, 15 nt, Bordetella pertussis
gccagcgcgcgccag

SEQ ID NO: 2369376 - RNA, 14 nt, Bordetella pertussis
gccagcgcgcgcga

SEQ ID NO: 2369377 - RNA, 13 nt, Bordetella pertussis
gccagcgcgcggc

SEQ ID NO: 2369378 - RNA, 14 nt, Bordetella pertussis
gccagcgcgcggcc

SEQ ID NO: 2369379 - RNA, 15 nt, Bordetella pertussis
gccagcgcgcggccg

SEQ ID NO: 2369380 - RNA, 16 nt, Bordetella pertussis
gccagcgcgcggccgg

SEQ ID NO: 2369381 - RNA, 15 nt, Bordetella pertussis
gccagcgcgcggcgc

SEQ ID NO: 2369382 - RNA, 17 nt, Bordetella pertussis
gccagcgcgcggcgcag

SEQ ID NO: 2369383 - RNA, 20 nt, Bordetella pertussis
gccagcgcgcggcgcagcgc

SEQ ID NO: 2369384 - RNA, 15 nt, Bordetella pertussis
gccagcgcgcgggcg

SEQ ID NO: 2369385 - RNA, 20 nt, Bordetella pertussis
gccagcgcgcggggcaggcc

SEQ ID NO: 2369386 - RNA, 22 nt, Bordetella pertussis
gccagcgcgcggggcaggccga

SEQ ID NO: 2369387 - RNA, 12 nt, Bordetella pertussis
gccagcgcggca

SEQ ID NO: 2369388 - RNA, 16 nt, Bordetella pertussis
gccagcgcggcaucgg

SEQ ID NO: 2369389 - RNA, 13 nt, Bordetella pertussis
gccagcgcggcca

SEQ ID NO: 2369390 - RNA, 15 nt, Bordetella pertussis
gccagcgcggccagc

SEQ ID NO: 2369391 - RNA, 18 nt, Bordetella pertussis
gccagcgcggccagcgcg

SEQ ID NO: 2369392 - RNA, 19 nt, Bordetella pertussis
gccagcgcggccagcgcgu

SEQ ID NO: 2369393 - RNA, 21 nt, Bordetella pertussis
gccagcgcggccagcgcgucg

SEQ ID NO: 2369394 - RNA, 19 nt, Bordetella pertussis
gccagcgcggccaggucgg

SEQ ID NO: 2369395 - RNA, 12 nt, Bordetella pertussis
gccagcgcggcg

SEQ ID NO: 2369396 - RNA, 14 nt, Bordetella pertussis
gccagcgcggcggc

SEQ ID NO: 2369397 - RNA, 19 nt, Bordetella pertussis
gccagcgcggcggcagcgc

SEQ ID NO: 2369398 - RNA, 18 nt, Bordetella pertussis
gccagcgcggcgggccgg

SEQ ID NO: 2369399 - RNA, 15 nt, Bordetella pertussis
gccagcgcggcuugg

SEQ ID NO: 2369400 - RNA, 23 nt, Bordetella pertussis
gccaggacuucgucgaucauggc

SEQ ID NO: 2369401 - RNA, 13 nt, Bordetella pertussis
gccaggaucgcgg

SEQ ID NO: 2369402 - RNA, 19 nt, Bordetella pertussis
gccaggaucgcggccagcc

SEQ ID NO: 2369403 - RNA, 20 nt, Bordetella pertussis
gccaggaucgcggccagccg

SEQ ID NO: 2369404 - RNA, 21 nt, Bordetella pertussis
gccaggaucgcggccagccgg

SEQ ID NO: 2369405 - RNA, 15 nt, Bordetella pertussis
gccaggaugaugagg

SEQ ID NO: 2369406 - RNA, 12 nt, Bordetella pertussis
gccaggauggcc

SEQ ID NO: 2369407 - RNA, 18 nt, Bordetella pertussis
gccaggauggccacgacc

SEQ ID NO: 2369408 - RNA, 19 nt, Bordetella pertussis
gccaggauggccacgacca

SEQ ID NO: 2369409 - RNA, 13 nt, Bordetella pertussis
gccaggauggcgu

SEQ ID NO: 2369410 - RNA, 21 nt, Bordetella pertussis
gccaggauuucauggcaucgg

SEQ ID NO: 2369411 - RNA, 19 nt, Bordetella pertussis
gccaggcaaaggcccaggc

SEQ ID NO: 2369412 - RNA, 22 nt, Bordetella pertussis
gccaggcaaucgaugaucacgc

SEQ ID NO: 2369413 - RNA, 15 nt, Bordetella pertussis
gccaggcagauccgc

SEQ ID NO: 2369414 - RNA, 21 nt, Bordetella pertussis
gccaggcauugaagcuggcgc

SEQ ID NO: 2369415 - RNA, 22 nt, Bordetella pertussis
gccaggcauugaagcuggcgcc

SEQ ID NO: 2369416 - RNA, 12 nt, Bordetella pertussis
gccaggccagca

SEQ ID NO: 2369417 - RNA, 13 nt, Bordetella pertussis
gccaggccagcag

SEQ ID NO: 2369418 - RNA, 15 nt, Bordetella pertussis
gccaggccagcgcca

SEQ ID NO: 2369419 - RNA, 15 nt, Bordetella pertussis
gccaggccauggcgc

SEQ ID NO: 2369420 - RNA, 18 nt, Bordetella pertussis
gccaggccauggcgcgau

SEQ ID NO: 2369421 - RNA, 18 nt, Bordetella pertussis
gccaggcccacggcgcca

SEQ ID NO: 2369422 - RNA, 14 nt, Bordetella pertussis
gccaggcccagggc

SEQ ID NO: 2369423 - RNA, 15 nt, Bordetella pertussis
gccaggcccagggcc

SEQ ID NO: 2369424 - RNA, 13 nt, Bordetella pertussis
gccaggcccaugc

SEQ ID NO: 2369425 - RNA, 19 nt, Bordetella pertussis
gccaggcccaugccgcccg

SEQ ID NO: 2369426 - RNA, 20 nt, Bordetella pertussis
gccaggcccaugccgcccgc

SEQ ID NO: 2369427 - RNA, 15 nt, Bordetella pertussis
gccaggccccgccgg

SEQ ID NO: 2369428 - RNA, 18 nt, Bordetella pertussis
gccaggccccgccgggcc

SEQ ID NO: 2369429 - RNA, 17 nt, Bordetella pertussis
gccaggcccggcgcgca

SEQ ID NO: 2369430 - RNA, 18 nt, Bordetella pertussis
gccaggcccggcgcgcau

SEQ ID NO: 2369431 - RNA, 17 nt, Bordetella pertussis
gccaggcccucgcggcc

SEQ ID NO: 2369432 - RNA, 18 nt, Bordetella pertussis
gccaggcccucgcggccg

SEQ ID NO: 2369433 - RNA, 22 nt, Bordetella pertussis
gccaggcccucgcggccgucgg

SEQ ID NO: 2369434 - RNA, 16 nt, Bordetella pertussis
gccaggcccugcgcgu

SEQ ID NO: 2369435 - RNA, 14 nt, Bordetella pertussis
gccaggcccuugau

SEQ ID NO: 2369436 - RNA, 20 nt, Bordetella pertussis
gccaggcccuugauggccgg

SEQ ID NO: 2369437 - RNA, 13 nt, Bordetella pertussis
gccaggccgaacg

SEQ ID NO: 2369438 - RNA, 17 nt, Bordetella pertussis
gccaggccgaacgcggu

SEQ ID NO: 2369439 - RNA, 20 nt, Bordetella pertussis
gccaggccgaacgcggucgc

SEQ ID NO: 2369440 - RNA, 18 nt, Bordetella pertussis
gccaggccgaucagcacc

SEQ ID NO: 2369441 - RNA, 15 nt, Bordetella pertussis
gccaggccgaugccg

SEQ ID NO: 2369442 - RNA, 16 nt, Bordetella pertussis
gccaggccgaugccga

SEQ ID NO: 2369443 - RNA, 23 nt, Bordetella pertussis
gccaggccgauuucggccgccgg

SEQ ID NO: 2369444 - RNA, 12 nt, Bordetella pertussis
gccaggccgcau

SEQ ID NO: 2369445 - RNA, 24 nt, Bordetella pertussis
gccaggccgcauacgacacgucau

SEQ ID NO: 2369446 - RNA, 14 nt, Bordetella pertussis
gccaggccgccgcc

SEQ ID NO: 2369447 - RNA, 15 nt, Bordetella pertussis
gccaggccgccgccg

SEQ ID NO: 2369448 - RNA, 15 nt, Bordetella pertussis
gccaggccgcgcagg

SEQ ID NO: 2369449 - RNA, 19 nt, Bordetella pertussis
gccaggccgcgcagggcau

SEQ ID NO: 2369450 - RNA, 12 nt, Bordetella pertussis
gccaggccggcc

SEQ ID NO: 2369451 - RNA, 13 nt, Bordetella pertussis
gccaggccggccc

SEQ ID NO: 2369452 - RNA, 15 nt, Bordetella pertussis
gccaggccggcccag

SEQ ID NO: 2369453 - RNA, 13 nt, Bordetella pertussis
gccaggccggccu

SEQ ID NO: 2369454 - RNA, 19 nt, Bordetella pertussis
gccaggccggccugcaggc

SEQ ID NO: 2369455 - RNA, 22 nt, Bordetella pertussis
gccaggccggccugcaggcucu

SEQ ID NO: 2369456 - RNA, 16 nt, Bordetella pertussis
gccaggccggccuugg

SEQ ID NO: 2369457 - RNA, 15 nt, Bordetella pertussis
gccaggccggcgcgc

SEQ ID NO: 2369458 - RNA, 16 nt, Bordetella pertussis
gccaggccggcgcgcc

SEQ ID NO: 2369459 - RNA, 17 nt, Bordetella pertussis
gccaggccggcgcgccg

SEQ ID NO: 2369460 - RNA, 16 nt, Bordetella pertussis
gccaggccggcggcga

SEQ ID NO: 2369461 - RNA, 15 nt, Bordetella pertussis
gccaggccggggccg

SEQ ID NO: 2369462 - RNA, 13 nt, Bordetella pertussis
gccaggccgucga

SEQ ID NO: 2369463 - RNA, 12 nt, Bordetella pertussis
gccaggccucgg

SEQ ID NO: 2369464 - RNA, 18 nt, Bordetella pertussis
gccaggccuucgacgucc

SEQ ID NO: 2369465 - RNA, 21 nt, Bordetella pertussis
gccaggccuucgacguccagc

SEQ ID NO: 2369466 - RNA, 16 nt, Bordetella pertussis
gccaggcgaaccuggc

SEQ ID NO: 2369467 - RNA, 20 nt, Bordetella pertussis
gccaggcgaaccuggcgggg

SEQ ID NO: 2369468 - RNA, 22 nt, Bordetella pertussis
gccaggcgagcgccgcgcucca

SEQ ID NO: 2369469 - RNA, 13 nt, Bordetella pertussis
gccaggcgcagua

SEQ ID NO: 2369470 - RNA, 16 nt, Bordetella pertussis
gccaggcgcaguaucu

SEQ ID NO: 2369471 - RNA, 21 nt, Bordetella pertussis
gccaggcgcauguccgccacg

SEQ ID NO: 2369472 - RNA, 18 nt, Bordetella pertussis
gccaggcgccagaugcgc

SEQ ID NO: 2369473 - RNA, 19 nt, Bordetella pertussis
gccaggcgccagaugcgcc

SEQ ID NO: 2369474 - RNA, 14 nt, Bordetella pertussis
gccaggcgccagcg

SEQ ID NO: 2369475 - RNA, 15 nt, Bordetella pertussis
gccaggcgccagcgg

SEQ ID NO: 2369476 - RNA, 13 nt, Bordetella pertussis
gccaggcgcccca

SEQ ID NO: 2369477 - RNA, 14 nt, Bordetella pertussis
gccaggcgcccggc

SEQ ID NO: 2369478 - RNA, 13 nt, Bordetella pertussis
gccaggcgccgcg

SEQ ID NO: 2369479 - RNA, 14 nt, Bordetella pertussis
gccaggcgccgcgu

SEQ ID NO: 2369480 - RNA, 17 nt, Bordetella pertussis
gccaggcgccgcguccg

SEQ ID NO: 2369481 - RNA, 23 nt, Bordetella pertussis
gccaggcgccgcguccggcgccc

SEQ ID NO: 2369482 - RNA, 14 nt, Bordetella pertussis
gccaggcgccgcuc

SEQ ID NO: 2369483 - RNA, 17 nt, Bordetella pertussis
gccaggcgccgcucagc

SEQ ID NO: 2369484 - RNA, 18 nt, Bordetella pertussis
gccaggcgccgcucagcg

SEQ ID NO: 2369485 - RNA, 13 nt, Bordetella pertussis
gccaggcgccggc

SEQ ID NO: 2369486 - RNA, 15 nt, Bordetella pertussis
gccaggcgccgggcc

SEQ ID NO: 2369487 - RNA, 16 nt, Bordetella pertussis
gccaggcgcgaucgaa

SEQ ID NO: 2369488 - RNA, 18 nt, Bordetella pertussis
gccaggcgcgaucgaacg

SEQ ID NO: 2369489 - RNA, 15 nt, Bordetella pertussis
gccaggcgcgcaucg

SEQ ID NO: 2369490 - RNA, 13 nt, Bordetella pertussis
gccaggcgcgccg

SEQ ID NO: 2369491 - RNA, 15 nt, Bordetella pertussis
gccaggcgcgccgcg

SEQ ID NO: 2369492 - RNA, 16 nt, Bordetella pertussis
gccaggcgcgccgcga

SEQ ID NO: 2369493 - RNA, 18 nt, Bordetella pertussis
gccaggcgcuccagcacc

SEQ ID NO: 2369494 - RNA, 21 nt, Bordetella pertussis
gccaggcgcuccagcaccugc

SEQ ID NO: 2369495 - RNA, 13 nt, Bordetella pertussis
gccaggcgcucgg

SEQ ID NO: 2369496 - RNA, 15 nt, Bordetella pertussis
gccaggcgcucggcg

SEQ ID NO: 2369497 - RNA, 21 nt, Bordetella pertussis
gccaggcggcggcgcggcgcc

SEQ ID NO: 2369498 - RNA, 22 nt, Bordetella pertussis
gccaggcggcggcgcggcgcca

SEQ ID NO: 2369499 - RNA, 23 nt, Bordetella pertussis
gccaggcggcggcgcggcgccau

SEQ ID NO: 2369500 - RNA, 20 nt, Bordetella pertussis
gccaggcgggguggcacagc

SEQ ID NO: 2369501 - RNA, 23 nt, Bordetella pertussis
gccaggcgguacaggccggcggc

SEQ ID NO: 2369502 - RNA, 23 nt, Bordetella pertussis
gccaggcgguggccucguccacg

SEQ ID NO: 2369503 - RNA, 19 nt, Bordetella pertussis
gccaggcguagaccaccug

SEQ ID NO: 2369504 - RNA, 20 nt, Bordetella pertussis
gccaggcguagaccaccugc

SEQ ID NO: 2369505 - RNA, 17 nt, Bordetella pertussis
gccaggcguugaccugg

SEQ ID NO: 2369506 - RNA, 22 nt, Bordetella pertussis
gccaggcuaucguggcuggcga

SEQ ID NO: 2369507 - RNA, 15 nt, Bordetella pertussis
gccaggcucagcagg

SEQ ID NO: 2369508 - RNA, 22 nt, Bordetella pertussis
gccaggcugaaugccgccguga

SEQ ID NO: 2369509 - RNA, 22 nt, Bordetella pertussis
gccaggcugaccagcgcgucgc

SEQ ID NO: 2369510 - RNA, 22 nt, Bordetella pertussis
gccaggcugucccagauggcgc

SEQ ID NO: 2369511 - RNA, 17 nt, Bordetella pertussis
gccagggaggaacuggg

SEQ ID NO: 2369512 - RNA, 18 nt, Bordetella pertussis
gccagggagugcgaggac

SEQ ID NO: 2369513 - RNA, 21 nt, Bordetella pertussis
gccagugguccaucagguucu

SEQ ID NO: 2369514 - RNA, 15 nt, Bordetella pertussis
gccaguuccgugcgc

SEQ ID NO: 2369515 - RNA, 15 nt, Bordetella pertussis
gccaguucgacgccc

SEQ ID NO: 2369516 - RNA, 16 nt, Bordetella pertussis
gccaguucgacgccca

SEQ ID NO: 2369517 - RNA, 17 nt, Bordetella pertussis
gccaguucgacgcccau

SEQ ID NO: 2369518 - RNA, 19 nt, Bordetella pertussis
gccaguucgacgcccaugc

SEQ ID NO: 2369519 - RNA, 21 nt, Bordetella pertussis
gccaguucgaugcgcuugccg

SEQ ID NO: 2369520 - RNA, 19 nt, Bordetella pertussis
gccaguucgcggcgcagcg

SEQ ID NO: 2369521 - RNA, 20 nt, Bordetella pertussis
gccaguucgcggcgcagcgc

SEQ ID NO: 2369522 - RNA, 16 nt, Bordetella pertussis
gccaguucguccgcuu

SEQ ID NO: 2369523 - RNA, 16 nt, Bordetella pertussis
gccaguucuuccaucc

SEQ ID NO: 2369524 - RNA, 13 nt, Bordetella pertussis
gccaguugccgcc

SEQ ID NO: 2369525 - RNA, 17 nt, Bordetella pertussis
gccaguugccgccgccg

SEQ ID NO: 2369526 - RNA, 14 nt, Bordetella pertussis
gccaguugcgcacc

SEQ ID NO: 2369527 - RNA, 13 nt, Bordetella pertussis
gccaguugcgggg

SEQ ID NO: 2369528 - RNA, 22 nt, Bordetella pertussis
gccaguugcggggcgcccagcg

SEQ ID NO: 2369529 - RNA, 13 nt, Bordetella pertussis
gccaguugggcca

SEQ ID NO: 2369530 - RNA, 19 nt, Bordetella pertussis
gccaguugggccagggccu

SEQ ID NO: 2369531 - RNA, 16 nt, Bordetella pertussis
gccaguuguagcgguc

SEQ ID NO: 2369532 - RNA, 18 nt, Bordetella pertussis
gccauacagcaaggacaa

SEQ ID NO: 2369533 - RNA, 14 nt, Bordetella pertussis
gccauacguccuuu

SEQ ID NO: 2369534 - RNA, 17 nt, Bordetella pertussis
gccauaggccagcgccu

SEQ ID NO: 2369535 - RNA, 17 nt, Bordetella pertussis
gccauaggcgcgcacca

SEQ ID NO: 2369536 - RNA, 19 nt, Bordetella pertussis
gccauaggcgcgcaccagc

SEQ ID NO: 2369537 - RNA, 22 nt, Bordetella pertussis
gccauagggcgacugcagcagg

SEQ ID NO: 2369538 - RNA, 15 nt, Bordetella pertussis
gccaucaacguggcg

SEQ ID NO: 2369539 - RNA, 20 nt, Bordetella pertussis
gccaucacaucgcuaugcag

SEQ ID NO: 2369540 - RNA, 15 nt, Bordetella pertussis
gccaucaccgccucc

SEQ ID NO: 2369541 - RNA, 21 nt, Bordetella pertussis
gccaucacggugucgaugggc

SEQ ID NO: 2369542 - RNA, 17 nt, Bordetella pertussis
gccaucaggugcagggu

SEQ ID NO: 2369543 - RNA, 19 nt, Bordetella pertussis
gccaucagguuguccagcg

SEQ ID NO: 2369544 - RNA, 22 nt, Bordetella pertussis
gccaucaucaucgucggcgcca

SEQ ID NO: 2369545 - RNA, 20 nt, Bordetella pertussis
gccaucauccuggucgacgc

SEQ ID NO: 2369546 - RNA, 21 nt, Bordetella pertussis
gccaucauccuggucgacgcg

SEQ ID NO: 2369547 - RNA, 23 nt, Bordetella pertussis
gccaucauccuggucgacgcgac

SEQ ID NO: 2369548 - RNA, 21 nt, Bordetella pertussis
gccaucauggcgucggccacg

SEQ ID NO: 2369549 - RNA, 15 nt, Bordetella pertussis
gccauccagccaggc

SEQ ID NO: 2369550 - RNA, 16 nt, Bordetella pertussis
gccauccagccaggcc

SEQ ID NO: 2369551 - RNA, 11 nt, Bordetella pertussis
gccauccaggu

SEQ ID NO: 2369552 - RNA, 13 nt, Bordetella pertussis
gccauccggccgc

SEQ ID NO: 2369553 - RNA, 17 nt, Bordetella pertussis
gccauccggccgcacgc

SEQ ID NO: 2369554 - RNA, 20 nt, Bordetella pertussis
gccauccggccgcacgcggc

SEQ ID NO: 2369555 - RNA, 22 nt, Bordetella pertussis
gccauccggccgcacgcggccg

SEQ ID NO: 2369556 - RNA, 14 nt, Bordetella pertussis
gccauccggcgcau

SEQ ID NO: 2369557 - RNA, 21 nt, Bordetella pertussis
gccauccggcgcaugauggcc

SEQ ID NO: 2369558 - RNA, 14 nt, Bordetella pertussis
gccauccguccgcc

SEQ ID NO: 2369559 - RNA, 18 nt, Bordetella pertussis
gccauccguccgccagga

SEQ ID NO: 2369560 - RNA, 13 nt, Bordetella pertussis
gccauccucgccc

SEQ ID NO: 2369561 - RNA, 17 nt, Bordetella pertussis
gccauccucgcccagcg

SEQ ID NO: 2369562 - RNA, 19 nt, Bordetella pertussis
gccauccucgcccagcggc

SEQ ID NO: 2369563 - RNA, 21 nt, Bordetella pertussis
gccauccucgcccagcggcgc

SEQ ID NO: 2369564 - RNA, 23 nt, Bordetella pertussis
gccauccucgucgcggaagcuga

SEQ ID NO: 2369565 - RNA, 15 nt, Bordetella pertussis
gccauccugaacgcc

SEQ ID NO: 2369566 - RNA, 18 nt, Bordetella pertussis
gccauccugaacgccgcg

SEQ ID NO: 2369567 - RNA, 19 nt, Bordetella pertussis
gccauccugaacgccgcgc

SEQ ID NO: 2369568 - RNA, 15 nt, Bordetella pertussis
gccauccuggccgcc

SEQ ID NO: 2369569 - RNA, 16 nt, Bordetella pertussis
gccaucgacaagcgcu

SEQ ID NO: 2369570 - RNA, 15 nt, Bordetella pertussis
gccaucgacgcuugc

SEQ ID NO: 2369571 - RNA, 21 nt, Bordetella pertussis
gccaucgacgcuugccggcga

SEQ ID NO: 2369572 - RNA, 17 nt, Bordetella pertussis
gccaucgacgggcggcu

SEQ ID NO: 2369573 - RNA, 19 nt, Bordetella pertussis
gccaucgauaugggcggcc

SEQ ID NO: 2369574 - RNA, 16 nt, Bordetella pertussis
gccaucgccauggcca

SEQ ID NO: 2369575 - RNA, 17 nt, Bordetella pertussis
gccaucgccauggccac

SEQ ID NO: 2369576 - RNA, 12 nt, Bordetella pertussis
gccaucgccgcc

SEQ ID NO: 2369577 - RNA, 14 nt, Bordetella pertussis
gccaucgccgccgc

SEQ ID NO: 2369578 - RNA, 17 nt, Bordetella pertussis
gccaucgccgccgccgg

SEQ ID NO: 2369579 - RNA, 19 nt, Bordetella pertussis
gccaucgccgccgccgggc

SEQ ID NO: 2369580 - RNA, 21 nt, Bordetella pertussis
gccaucgcgguccugaccggc

SEQ ID NO: 2369581 - RNA, 22 nt, Bordetella pertussis
gccaucgcgguccugaccggcg

SEQ ID NO: 2369582 - RNA, 15 nt, Bordetella pertussis
gccaucgcgucgacg

SEQ ID NO: 2369583 - RNA, 16 nt, Bordetella pertussis
gccaucgcgucgacgg

SEQ ID NO: 2369584 - RNA, 23 nt, Bordetella pertussis
gccaucgcugguaugcacgaugc

SEQ ID NO: 2369585 - RNA, 18 nt, Bordetella pertussis
gccaucggcgccaagcgg

SEQ ID NO: 2369586 - RNA, 21 nt, Bordetella pertussis
gccaucggcgccaagcggcag

SEQ ID NO: 2369587 - RNA, 22 nt, Bordetella pertussis
gccaucggcgccaagcggcagg

SEQ ID NO: 2369588 - RNA, 20 nt, Bordetella pertussis
gccaucgggauaccgcuggc

SEQ ID NO: 2369589 - RNA, 22 nt, Bordetella pertussis
gccaucgucguagcgccagcgu

SEQ ID NO: 2369590 - RNA, 17 nt, Bordetella pertussis
gccaucuaugucggcua

SEQ ID NO: 2369591 - RNA, 15 nt, Bordetella pertussis
gccaucucgcgcgcu

SEQ ID NO: 2369592 - RNA, 16 nt, Bordetella pertussis
gccaucucgucgguca

SEQ ID NO: 2369593 - RNA, 21 nt, Bordetella pertussis
gccaucugcugcgagacgcgc

SEQ ID NO: 2369594 - RNA, 18 nt, Bordetella pertussis
gccaucuugcaggcgcca

SEQ ID NO: 2369595 - RNA, 18 nt, Bordetella pertussis
gccaucuuggugcgcgcc

SEQ ID NO: 2369596 - RNA, 19 nt, Bordetella pertussis
gccaucuuggugcgcgcca

SEQ ID NO: 2369597 - RNA, 23 nt, Bordetella pertussis
gccaugaaagcgaacagggcgcg

SEQ ID NO: 2369598 - RNA, 19 nt, Bordetella pertussis
gccaugaacgcuugacggc

SEQ ID NO: 2369599 - RNA, 23 nt, Bordetella pertussis
gccaugaacgcuugacggccagg

SEQ ID NO: 2369600 - RNA, 14 nt, Bordetella pertussis
gccaugaacucgcg

SEQ ID NO: 2369601 - RNA, 21 nt, Bordetella pertussis
gccaugacaugcgggccucga

SEQ ID NO: 2369602 - RNA, 20 nt, Bordetella pertussis
gccaugaccacgucgaccag

SEQ ID NO: 2369603 - RNA, 18 nt, Bordetella pertussis
gccaugagccacaaucca

SEQ ID NO: 2369604 - RNA, 20 nt, Bordetella pertussis
gccaugagcgcuugacggcc

SEQ ID NO: 2369605 - RNA, 23 nt, Bordetella pertussis
gccaugagcgcuugacggccaag

SEQ ID NO: 2369606 - RNA, 21 nt, Bordetella pertussis
gccaugauacccauggccgug

SEQ ID NO: 2369607 - RNA, 22 nt, Bordetella pertussis
gccaugaucaggccgaacuggg

SEQ ID NO: 2369608 - RNA, 14 nt, Bordetella pertussis
gccaugaucgccgg

SEQ ID NO: 2369609 - RNA, 16 nt, Bordetella pertussis
gccaugaucgccggca

SEQ ID NO: 2369610 - RNA, 17 nt, Bordetella pertussis
gccaugaugucgcgcgc

SEQ ID NO: 2369611 - RNA, 19 nt, Bordetella pertussis
gccaugaugucgcgcgccu

SEQ ID NO: 2369612 - RNA, 13 nt, Bordetella pertussis
gccaugcaacacg

SEQ ID NO: 2369613 - RNA, 17 nt, Bordetella pertussis
gccaugcaacacgacca

SEQ ID NO: 2369614 - RNA, 21 nt, Bordetella pertussis
gccaugcaacacgaccagcag

SEQ ID NO: 2369615 - RNA, 14 nt, Bordetella pertussis
gccaugcccaggcc

SEQ ID NO: 2369616 - RNA, 15 nt, Bordetella pertussis
gccaugcccaggccc

SEQ ID NO: 2369617 - RNA, 23 nt, Bordetella pertussis
gccaugcccaggcccaguucggc

SEQ ID NO: 2369618 - RNA, 23 nt, Bordetella pertussis
gccaugccccauccagcggacgg

SEQ ID NO: 2369619 - RNA, 11 nt, Bordetella pertussis
gccaugccgcg

SEQ ID NO: 2369620 - RNA, 17 nt, Bordetella pertussis
gccaugccgcgcccgcc

SEQ ID NO: 2369621 - RNA, 18 nt, Bordetella pertussis
gccaugccgcgcccgccu

SEQ ID NO: 2369622 - RNA, 23 nt, Bordetella pertussis
gccaugccgcgcccgccuucagc

SEQ ID NO: 2369623 - RNA, 14 nt, Bordetella pertussis
gccaugccgcgcgc

SEQ ID NO: 2369624 - RNA, 15 nt, Bordetella pertussis
gccaugccgcgcgcc

SEQ ID NO: 2369625 - RNA, 16 nt, Bordetella pertussis
gccauguucgaccagg

SEQ ID NO: 2369626 - RNA, 17 nt, Bordetella pertussis
gccauguucgaccagga

SEQ ID NO: 2369627 - RNA, 20 nt, Bordetella pertussis
gccauguucuucaggcucca

SEQ ID NO: 2369628 - RNA, 21 nt, Bordetella pertussis
gccauguucuucaggcuccag

SEQ ID NO: 2369629 - RNA, 22 nt, Bordetella pertussis
gccauguucuucaggcuccagu

SEQ ID NO: 2369630 - RNA, 18 nt, Bordetella pertussis
gccauuccggcuggucgg

SEQ ID NO: 2369631 - RNA, 23 nt, Bordetella pertussis
gccauuccggcuggucggggugg

SEQ ID NO: 2369632 - RNA, 22 nt, Bordetella pertussis
gccauuccuuccgggcccgcgc

SEQ ID NO: 2369633 - RNA, 17 nt, Bordetella pertussis
gccauucgauggcggcg

SEQ ID NO: 2369634 - RNA, 18 nt, Bordetella pertussis
gccauucgauggcggcgc

SEQ ID NO: 2369635 - RNA, 22 nt, Bordetella pertussis
gccauucgauggcggcgcuggc

SEQ ID NO: 2369636 - RNA, 15 nt, Bordetella pertussis
gccauugaaagcgcg

SEQ ID NO: 2369637 - RNA, 16 nt, Bordetella pertussis
gccauugccgcacgau

SEQ ID NO: 2369638 - RNA, 14 nt, Bordetella pertussis
gccauugcgcggcc

SEQ ID NO: 2369639 - RNA, 23 nt, Bordetella pertussis
gccauugcgcggccugcuccggc

SEQ ID NO: 2369640 - RNA, 23 nt, Bordetella pertussis
gccauuggugcgcacaucgcccg

SEQ ID NO: 2369641 - RNA, 15 nt, Bordetella pertussis
gcccaacccggcgag

SEQ ID NO: 2369642 - RNA, 13 nt, Bordetella pertussis
gcccaacgaggac

SEQ ID NO: 2369643 - RNA, 12 nt, Bordetella pertussis
gcccaacgcggc

SEQ ID NO: 2369644 - RNA, 13 nt, Bordetella pertussis
gcccaacgcggcg

SEQ ID NO: 2369645 - RNA, 15 nt, Bordetella pertussis
gcccaacgcggcguc

SEQ ID NO: 2369646 - RNA, 11 nt, Bordetella pertussis
gcccaagcccg

SEQ ID NO: 2369647 - RNA, 16 nt, Bordetella pertussis
gcccaagcccguggcg

SEQ ID NO: 2369648 - RNA, 22 nt, Bordetella pertussis
gcccaagucgaguucggcgcgc

SEQ ID NO: 2369649 - RNA, 18 nt, Bordetella pertussis
gcccaauccgaucagcac

SEQ ID NO: 2369650 - RNA, 17 nt, Bordetella pertussis
gcccaaugucaccgacg

SEQ ID NO: 2369651 - RNA, 24 nt, Bordetella pertussis
gcccaaugucaccgacgccagcga

SEQ ID NO: 2369652 - RNA, 19 nt, Bordetella pertussis
gcccacaaugccccacggg

SEQ ID NO: 2369653 - RNA, 15 nt, Bordetella pertussis
gcccacagcgccccc

SEQ ID NO: 2369654 - RNA, 21 nt, Bordetella pertussis
gcccacaggaacaggccggcc

SEQ ID NO: 2369655 - RNA, 16 nt, Bordetella pertussis
gcccacaucgucgcgc

SEQ ID NO: 2369656 - RNA, 17 nt, Bordetella pertussis
gcccacaucgucgcgcu

SEQ ID NO: 2369657 - RNA, 19 nt, Bordetella pertussis
gcccacaucgucgcgcugg

SEQ ID NO: 2369658 - RNA, 14 nt, Bordetella pertussis
gcccacauggcggc

SEQ ID NO: 2369659 - RNA, 13 nt, Bordetella pertussis
gcccaccaccagc

SEQ ID NO: 2369660 - RNA, 14 nt, Bordetella pertussis
gcccaccaccagcg

SEQ ID NO: 2369661 - RNA, 17 nt, Bordetella pertussis
gcccaccaccagcgcgg

SEQ ID NO: 2369662 - RNA, 20 nt, Bordetella pertussis
gcccaccaccagcgcggcca

SEQ ID NO: 2369663 - RNA, 23 nt, Bordetella pertussis
gcccaccaccagcgcggccagca

SEQ ID NO: 2369664 - RNA, 16 nt, Bordetella pertussis
gcccaccacgccgccc

SEQ ID NO: 2369665 - RNA, 22 nt, Bordetella pertussis
gcccaccacggcgggaucgggc

SEQ ID NO: 2369666 - RNA, 18 nt, Bordetella pertussis
gcccaccagccgcccggc

SEQ ID NO: 2369667 - RNA, 16 nt, Bordetella pertussis
gcccaccagccgggcg

SEQ ID NO: 2369668 - RNA, 18 nt, Bordetella pertussis
gcccaccagccgggcggc

SEQ ID NO: 2369669 - RNA, 20 nt, Bordetella pertussis
gcccaccagccgggcggcca

SEQ ID NO: 2369670 - RNA, 22 nt, Bordetella pertussis
gcccaccagccgggcggccacg

SEQ ID NO: 2369671 - RNA, 13 nt, Bordetella pertussis
gcccaccagcgcc

SEQ ID NO: 2369672 - RNA, 14 nt, Bordetella pertussis
gcccaccagcgcca

SEQ ID NO: 2369673 - RNA, 15 nt, Bordetella pertussis
gcccaccagcgccac

SEQ ID NO: 2369674 - RNA, 17 nt, Bordetella pertussis
gcccaccagcgccacgc

SEQ ID NO: 2369675 - RNA, 14 nt, Bordetella pertussis
gcccaccagggacc

SEQ ID NO: 2369676 - RNA, 18 nt, Bordetella pertussis
gcccaccagggccagcuu

SEQ ID NO: 2369677 - RNA, 12 nt, Bordetella pertussis
gcccaccagggu

SEQ ID NO: 2369678 - RNA, 16 nt, Bordetella pertussis
gcccaccagggugccg

SEQ ID NO: 2369679 - RNA, 23 nt, Bordetella pertussis
gcccaccaugagcacgccccaau

SEQ ID NO: 2369680 - RNA, 19 nt, Bordetella pertussis
gcccacccggcacgcgccg

SEQ ID NO: 2369681 - RNA, 17 nt, Bordetella pertussis
gcccaccgagacgcugu

SEQ ID NO: 2369682 - RNA, 19 nt, Bordetella pertussis
gcccaccgagacgcugucg

SEQ ID NO: 2369683 - RNA, 23 nt, Bordetella pertussis
gcccaccgagacgcugucgcgcc

SEQ ID NO: 2369684 - RNA, 13 nt, Bordetella pertussis
gcccaccgcaucg

SEQ ID NO: 2369685 - RNA, 15 nt, Bordetella pertussis
gcccaccgcaucgcg

SEQ ID NO: 2369686 - RNA, 17 nt, Bordetella pertussis
gcccaccgcaucgcgca

SEQ ID NO: 2369687 - RNA, 18 nt, Bordetella pertussis
gcccaccgcaucgcgcag

SEQ ID NO: 2369688 - RNA, 13 nt, Bordetella pertussis
gcccaccgccagg

SEQ ID NO: 2369689 - RNA, 14 nt, Bordetella pertussis
gcccaccgccagga

SEQ ID NO: 2369690 - RNA, 16 nt, Bordetella pertussis
gcccaccgccgcccgc

SEQ ID NO: 2369691 - RNA, 19 nt, Bordetella pertussis
gcccaccgccguggccggc

SEQ ID NO: 2369692 - RNA, 17 nt, Bordetella pertussis
gcccaccggcaugccgu

SEQ ID NO: 2369693 - RNA, 24 nt, Bordetella pertussis
gcccaccggcaugccguccacgcc

SEQ ID NO: 2369694 - RNA, 13 nt, Bordetella pertussis
gcccaccgggccg

SEQ ID NO: 2369695 - RNA, 15 nt, Bordetella pertussis
gcccaccgggccggc

SEQ ID NO: 2369696 - RNA, 17 nt, Bordetella pertussis
gcccaccgggccggccu

SEQ ID NO: 2369697 - RNA, 18 nt, Bordetella pertussis
gcccaccgggccggccug

SEQ ID NO: 2369698 - RNA, 19 nt, Bordetella pertussis
gcccaccgggccggccugc

SEQ ID NO: 2369699 - RNA, 17 nt, Bordetella pertussis
gcccaccgugaccagcg

SEQ ID NO: 2369700 - RNA, 20 nt, Bordetella pertussis
gcccaccgugaccagcgagu

SEQ ID NO: 2369701 - RNA, 22 nt, Bordetella pertussis
gcccaccuuccugcuggaccug

SEQ ID NO: 2369702 - RNA, 12 nt, Bordetella pertussis
gcccaccuugcg

SEQ ID NO: 2369703 - RNA, 21 nt, Bordetella pertussis
gcccaccuugcgcgcgaacuc

SEQ ID NO: 2369704 - RNA, 18 nt, Bordetella pertussis
gcccacgaucaccacgcc

SEQ ID NO: 2369705 - RNA, 16 nt, Bordetella pertussis
gcccacgaugcgggca

SEQ ID NO: 2369706 - RNA, 19 nt, Bordetella pertussis
gcccacgaugcgggcaucg

SEQ ID NO: 2369707 - RNA, 22 nt, Bordetella pertussis
gcccacgcacaugaugcccagc

SEQ ID NO: 2369708 - RNA, 23 nt, Bordetella pertussis
gcccacgcacaugaugcccagcg

SEQ ID NO: 2369709 - RNA, 13 nt, Bordetella pertussis
gcccacgccaugg

SEQ ID NO: 2369710 - RNA, 14 nt, Bordetella pertussis
gcccacgccgccga

SEQ ID NO: 2369711 - RNA, 13 nt, Bordetella pertussis
gcccacgccgccu

SEQ ID NO: 2369712 - RNA, 14 nt, Bordetella pertussis
gcccacgccgccug

SEQ ID NO: 2369713 - RNA, 17 nt, Bordetella pertussis
gcccacgccgccuggcc

SEQ ID NO: 2369714 - RNA, 18 nt, Bordetella pertussis
gcccacgccgccuggccc

SEQ ID NO: 2369715 - RNA, 17 nt, Bordetella pertussis
gcccacgccgcugucga

SEQ ID NO: 2369716 - RNA, 19 nt, Bordetella pertussis
gcccacgccuuccggcccc

SEQ ID NO: 2369717 - RNA, 22 nt, Bordetella pertussis
gcccacgcgcacgacgucgcgc

SEQ ID NO: 2369718 - RNA, 13 nt, Bordetella pertussis
gcccacgcgccgc

SEQ ID NO: 2369719 - RNA, 21 nt, Bordetella pertussis
gcccacgcgccgccaggcgcg

SEQ ID NO: 2369720 - RNA, 12 nt, Bordetella pertussis
gcccacgcgcuc

SEQ ID NO: 2369721 - RNA, 14 nt, Bordetella pertussis
gcccacgcggcgcu

SEQ ID NO: 2369722 - RNA, 15 nt, Bordetella pertussis
gcccacgcggcgcug

SEQ ID NO: 2369723 - RNA, 16 nt, Bordetella pertussis
gcccacgcggcgcugc

SEQ ID NO: 2369724 - RNA, 20 nt, Bordetella pertussis
gcccacgcggcgcugcuggc

SEQ ID NO: 2369725 - RNA, 14 nt, Bordetella pertussis
gcccacgcugucgg

SEQ ID NO: 2369726 - RNA, 19 nt, Bordetella pertussis
gcccacgcugucggggugc

SEQ ID NO: 2369727 - RNA, 16 nt, Bordetella pertussis
gcccacggcaaaagcc

SEQ ID NO: 2369728 - RNA, 18 nt, Bordetella pertussis
gcccacggcaucgccgcg

SEQ ID NO: 2369729 - RNA, 19 nt, Bordetella pertussis
gcccacggcaucgccgcgg

SEQ ID NO: 2369730 - RNA, 22 nt, Bordetella pertussis
gcccacggcaucgccgcgggcg

SEQ ID NO: 2369731 - RNA, 12 nt, Bordetella pertussis
gcccacggccag

SEQ ID NO: 2369732 - RNA, 13 nt, Bordetella pertussis
gcccacggccagc

SEQ ID NO: 2369733 - RNA, 14 nt, Bordetella pertussis
gcccacggccagca

SEQ ID NO: 2369734 - RNA, 15 nt, Bordetella pertussis
gcccacggccagcac

SEQ ID NO: 2369735 - RNA, 16 nt, Bordetella pertussis
gcccacggccgcaugc

SEQ ID NO: 2369736 - RNA, 22 nt, Bordetella pertussis
gcccacggcgacuuccagcaga

SEQ ID NO: 2369737 - RNA, 20 nt, Bordetella pertussis
gcccacguaggcaaagcgcg

SEQ ID NO: 2369738 - RNA, 15 nt, Bordetella pertussis
gcccagcgccagcag

SEQ ID NO: 2369739 - RNA, 20 nt, Bordetella pertussis
gcccagcgccagcagcaggc

SEQ ID NO: 2369740 - RNA, 14 nt, Bordetella pertussis
gcccagcgccaggg

SEQ ID NO: 2369741 - RNA, 15 nt, Bordetella pertussis
gcccagcgccagggc

SEQ ID NO: 2369742 - RNA, 13 nt, Bordetella pertussis
gcccagcgccgcc

SEQ ID NO: 2369743 - RNA, 15 nt, Bordetella pertussis
gcccagcgccgccga

SEQ ID NO: 2369744 - RNA, 24 nt, Bordetella pertussis
gcccagcgccgccgacggcauggc

SEQ ID NO: 2369745 - RNA, 13 nt, Bordetella pertussis
gcccagcgccggc

SEQ ID NO: 2369746 - RNA, 14 nt, Bordetella pertussis
gcccagcgccggca

SEQ ID NO: 2369747 - RNA, 16 nt, Bordetella pertussis
gcccagcgccggcacg

SEQ ID NO: 2369748 - RNA, 23 nt, Bordetella pertussis
gcccagcgccggcacgcugaucg

SEQ ID NO: 2369749 - RNA, 22 nt, Bordetella pertussis
gcccagcgccugcaaguccagc

SEQ ID NO: 2369750 - RNA, 17 nt, Bordetella pertussis
gcccagcgcgaugucgc

SEQ ID NO: 2369751 - RNA, 23 nt, Bordetella pertussis
gcccagcgcgaugucgcccaugc

SEQ ID NO: 2369752 - RNA, 13 nt, Bordetella pertussis
gcccagcgcgcca

SEQ ID NO: 2369753 - RNA, 15 nt, Bordetella pertussis
gcccagcgcggcggc

SEQ ID NO: 2369754 - RNA, 19 nt, Bordetella pertussis
gcccagcgcggcggccaug

SEQ ID NO: 2369755 - RNA, 22 nt, Bordetella pertussis
gcccagcgcggcggccaugccc

SEQ ID NO: 2369756 - RNA, 18 nt, Bordetella pertussis
gcccagcgcgucggccag

SEQ ID NO: 2369757 - RNA, 23 nt, Bordetella pertussis
gcccagcgcgucggccagcgccg

SEQ ID NO: 2369758 - RNA, 19 nt, Bordetella pertussis
gcccagcgcgugggccagc

SEQ ID NO: 2369759 - RNA, 19 nt, Bordetella pertussis
gcccagcgcuugcacgcca

SEQ ID NO: 2369760 - RNA, 15 nt, Bordetella pertussis
gcccagcggcaggcu

SEQ ID NO: 2369761 - RNA, 17 nt, Bordetella pertussis
gcccagcggcaggcugg

SEQ ID NO: 2369762 - RNA, 20 nt, Bordetella pertussis
gcccagcggcaggcuggccg

SEQ ID NO: 2369763 - RNA, 23 nt, Bordetella pertussis
gcccagcggcaggcuggccggcg

SEQ ID NO: 2369764 - RNA, 13 nt, Bordetella pertussis
gcccagcggcgcc

SEQ ID NO: 2369765 - RNA, 18 nt, Bordetella pertussis
gcccagcgucagcugggc

SEQ ID NO: 2369766 - RNA, 20 nt, Bordetella pertussis
gcccagcgucagcugggcau

SEQ ID NO: 2369767 - RNA, 16 nt, Bordetella pertussis
gcccagcguggcggug

SEQ ID NO: 2369768 - RNA, 18 nt, Bordetella pertussis
gcccagcguguaggcggc

SEQ ID NO: 2369769 - RNA, 19 nt, Bordetella pertussis
gcccagcguguaggcggcc

SEQ ID NO: 2369770 - RNA, 13 nt, Bordetella pertussis
gcccagcucaugg

SEQ ID NO: 2369771 - RNA, 15 nt, Bordetella pertussis
gcccagcucauggca

SEQ ID NO: 2369772 - RNA, 22 nt, Bordetella pertussis
gcccagcucauggcacagcgcg

SEQ ID NO: 2369773 - RNA, 24 nt, Bordetella pertussis
gcccagcucauggcacagcgcggc

SEQ ID NO: 2369774 - RNA, 17 nt, Bordetella pertussis
gcccagcuccaccccgg

SEQ ID NO: 2369775 - RNA, 13 nt, Bordetella pertussis
gcccagcuccagc

SEQ ID NO: 2369776 - RNA, 17 nt, Bordetella pertussis
gcccagcuccagcuggc

SEQ ID NO: 2369777 - RNA, 19 nt, Bordetella pertussis
gcccagcuccagcuggcgc

SEQ ID NO: 2369778 - RNA, 23 nt, Bordetella pertussis
gcccagcuccagcuggcgcacca

SEQ ID NO: 2369779 - RNA, 12 nt, Bordetella pertussis
gcccagcucugg

SEQ ID NO: 2369780 - RNA, 19 nt, Bordetella pertussis
gcccagcucugguccaggc

SEQ ID NO: 2369781 - RNA, 20 nt, Bordetella pertussis
gcccagcugcuucaugcgcu

SEQ ID NO: 2369782 - RNA, 21 nt, Bordetella pertussis
gcccagcuggcaccgcgacga

SEQ ID NO: 2369783 - RNA, 15 nt, Bordetella pertussis
gcccagcuggcgccc

SEQ ID NO: 2369784 - RNA, 18 nt, Bordetella pertussis
gcccagcugggccacagg

SEQ ID NO: 2369785 - RNA, 19 nt, Bordetella pertussis
gcccagcugggccacaggg

SEQ ID NO: 2369786 - RNA, 18 nt, Bordetella pertussis
gcccagcugggcggcgug

SEQ ID NO: 2369787 - RNA, 20 nt, Bordetella pertussis
gcccagcuguccaagcgcgu

SEQ ID NO: 2369788 - RNA, 19 nt, Bordetella pertussis
gcccagcuugaacaggcag

SEQ ID NO: 2369789 - RNA, 17 nt, Bordetella pertussis
gcccagcuugaugccgc

SEQ ID NO: 2369790 - RNA, 19 nt, Bordetella pertussis
gcccagcuugaugccgccg

SEQ ID NO: 2369791 - RNA, 20 nt, Bordetella pertussis
gcccagcuugaugccgccga

SEQ ID NO: 2369792 - RNA, 15 nt, Bordetella pertussis
gcccaggaaaccggc

SEQ ID NO: 2369793 - RNA, 15 nt, Bordetella pertussis
gcccaggagcaacug

SEQ ID NO: 2369794 - RNA, 16 nt, Bordetella pertussis
gcccaggaugcccuug

SEQ ID NO: 2369795 - RNA, 22 nt, Bordetella pertussis
gcccaggauggagagggccugg

SEQ ID NO: 2369796 - RNA, 14 nt, Bordetella pertussis
gcccaggauggcgc

SEQ ID NO: 2369797 - RNA, 19 nt, Bordetella pertussis
gcccaggauggcgccagcc

SEQ ID NO: 2369798 - RNA, 13 nt, Bordetella pertussis
gcccaggccagcg

SEQ ID NO: 2369799 - RNA, 15 nt, Bordetella pertussis
gcccaggccagcgcc

SEQ ID NO: 2369800 - RNA, 19 nt, Bordetella pertussis
gcccaggccagcgccgcgg

SEQ ID NO: 2369801 - RNA, 17 nt, Bordetella pertussis
gcccaggcccaccgcau

SEQ ID NO: 2369802 - RNA, 18 nt, Bordetella pertussis
gcccaggcccacgccgcg

SEQ ID NO: 2369803 - RNA, 22 nt, Bordetella pertussis
gcccaggcccacgccgcguucg

SEQ ID NO: 2369804 - RNA, 17 nt, Bordetella pertussis
gcccaggcccagcauca

SEQ ID NO: 2369805 - RNA, 17 nt, Bordetella pertussis
gcccaggcccagcgcgc

SEQ ID NO: 2369806 - RNA, 18 nt, Bordetella pertussis
gcccaggcccagcgcgcc

SEQ ID NO: 2369807 - RNA, 21 nt, Bordetella pertussis
gcccaggcccaguucggcgcg

SEQ ID NO: 2369808 - RNA, 22 nt, Bordetella pertussis
gcccaggcccaguucggcgcgc

SEQ ID NO: 2369809 - RNA, 15 nt, Bordetella pertussis
gcccaggcccgccag

SEQ ID NO: 2369810 - RNA, 12 nt, Bordetella pertussis
gcccaggcccgu

SEQ ID NO: 2369811 - RNA, 16 nt, Bordetella pertussis
gcccaggcccuggcug

SEQ ID NO: 2369812 - RNA, 18 nt, Bordetella pertussis
gcccaggcccuggcuggc

SEQ ID NO: 2369813 - RNA, 22 nt, Bordetella pertussis
gcccaggcccuggcuggccagc

SEQ ID NO: 2369814 - RNA, 23 nt, Bordetella pertussis
gcccaggcccuggcuggccagcc

SEQ ID NO: 2369815 - RNA, 14 nt, Bordetella pertussis
gcccaggccgaacc

SEQ ID NO: 2369816 - RNA, 18 nt, Bordetella pertussis
gcccaggccgaucagcgg

SEQ ID NO: 2369817 - RNA, 13 nt, Bordetella pertussis
gcccaggccgccg

SEQ ID NO: 2369818 - RNA, 15 nt, Bordetella pertussis
gcccaggccgccggc

SEQ ID NO: 2369819 - RNA, 16 nt, Bordetella pertussis
gcccaggccgccggcg

SEQ ID NO: 2369820 - RNA, 18 nt, Bordetella pertussis
gcccaggccgccggcggc

SEQ ID NO: 2369821 - RNA, 20 nt, Bordetella pertussis
gcccaggccgccggcggcgu

SEQ ID NO: 2369822 - RNA, 21 nt, Bordetella pertussis
gcccaggccgccggcggcguc

SEQ ID NO: 2369823 - RNA, 22 nt, Bordetella pertussis
gcccaggccgccggcggcgucg

SEQ ID NO: 2369824 - RNA, 14 nt, Bordetella pertussis
gcccaggccggcgc

SEQ ID NO: 2369825 - RNA, 15 nt, Bordetella pertussis
gcccaggccggcgcg

SEQ ID NO: 2369826 - RNA, 18 nt, Bordetella pertussis
gcccaggccggcgcgcuc

SEQ ID NO: 2369827 - RNA, 16 nt, Bordetella pertussis
gcccaggccgggcgag

SEQ ID NO: 2369828 - RNA, 17 nt, Bordetella pertussis
gcccaggccgggcgagc

SEQ ID NO: 2369829 - RNA, 15 nt, Bordetella pertussis
gcccaggccgggcgu

SEQ ID NO: 2369830 - RNA, 18 nt, Bordetella pertussis
gcccaggccguggcgcac

SEQ ID NO: 2369831 - RNA, 20 nt, Bordetella pertussis
gcccaggcgaauccgcaacc

SEQ ID NO: 2369832 - RNA, 17 nt, Bordetella pertussis
gcccaggcgacccagca

SEQ ID NO: 2369833 - RNA, 24 nt, Bordetella pertussis
gcccaggcgacccagcaccgagcu

SEQ ID NO: 2369834 - RNA, 18 nt, Bordetella pertussis
gcccaggcgaugcccagc

SEQ ID NO: 2369835 - RNA, 22 nt, Bordetella pertussis
gcccaggcgaugcccagcgccg

SEQ ID NO: 2369836 - RNA, 12 nt, Bordetella pertussis
gcccaggcgcag

SEQ ID NO: 2369837 - RNA, 14 nt, Bordetella pertussis
gcccaggcgcagcc

SEQ ID NO: 2369838 - RNA, 15 nt, Bordetella pertussis
gcccaggcgcagccg

SEQ ID NO: 2369839 - RNA, 18 nt, Bordetella pertussis
gcccaggcgcagccgcgc

SEQ ID NO: 2369840 - RNA, 14 nt, Bordetella pertussis
gcccaggcgcgcug

SEQ ID NO: 2369841 - RNA, 16 nt, Bordetella pertussis
gcccaggcgcgcuggc

SEQ ID NO: 2369842 - RNA, 17 nt, Bordetella pertussis
gcccaggcgcgcuggcg

SEQ ID NO: 2369843 - RNA, 18 nt, Bordetella pertussis
gcccaggcgcgcuggcgc

SEQ ID NO: 2369844 - RNA, 14 nt, Bordetella pertussis
gcccaggcgcuggu

SEQ ID NO: 2369845 - RNA, 22 nt, Bordetella pertussis
gcccaggcgcugguaguaggcc

SEQ ID NO: 2369846 - RNA, 16 nt, Bordetella pertussis
gcccaggcggcccagc

SEQ ID NO: 2369847 - RNA, 19 nt, Bordetella pertussis
gcccaggcggcccagcgug

SEQ ID NO: 2369848 - RNA, 14 nt, Bordetella pertussis
gcccaggcgggcgu

SEQ ID NO: 2369849 - RNA, 16 nt, Bordetella pertussis
gcccaggcguccaggc

SEQ ID NO: 2369850 - RNA, 19 nt, Bordetella pertussis
gcccaggcguccaggcugc

SEQ ID NO: 2369851 - RNA, 17 nt, Bordetella pertussis
gcccauucgcgcaccga

SEQ ID NO: 2369852 - RNA, 17 nt, Bordetella pertussis
gcccauugcggcaccug

SEQ ID NO: 2369853 - RNA, 14 nt, Bordetella pertussis
gcccauuuccgcuu

SEQ ID NO: 2369854 - RNA, 16 nt, Bordetella pertussis
gcccauuuccgcuucg

SEQ ID NO: 2369855 - RNA, 22 nt, Bordetella pertussis
gcccauuuccgcuucggacagc

SEQ ID NO: 2369856 - RNA, 16 nt, Bordetella pertussis
gcccauuucgauggcc

SEQ ID NO: 2369857 - RNA, 23 nt, Bordetella pertussis
gcccauuucgauggccagggcga

SEQ ID NO: 2369858 - RNA, 19 nt, Bordetella pertussis
gcccauuuucugccacagc

SEQ ID NO: 2369859 - RNA, 13 nt, Bordetella pertussis
gccccaacgcggc

SEQ ID NO: 2369860 - RNA, 17 nt, Bordetella pertussis
gccccaacgcggccagc

SEQ ID NO: 2369861 - RNA, 14 nt, Bordetella pertussis
gccccaaugugcug

SEQ ID NO: 2369862 - RNA, 14 nt, Bordetella pertussis
gccccacacgcgcg

SEQ ID NO: 2369863 - RNA, 17 nt, Bordetella pertussis
gccccacacgcgcgcaa

SEQ ID NO: 2369864 - RNA, 17 nt, Bordetella pertussis
gccccaccuggcggugc

SEQ ID NO: 2369865 - RNA, 22 nt, Bordetella pertussis
gccccaccuggcggugcgccgc

SEQ ID NO: 2369866 - RNA, 23 nt, Bordetella pertussis
gccccaccuggcggugcgccgca

SEQ ID NO: 2369867 - RNA, 21 nt, Bordetella pertussis
gccccaccuugcccagcagcu

SEQ ID NO: 2369868 - RNA, 14 nt, Bordetella pertussis
gccccacgccgacc

SEQ ID NO: 2369869 - RNA, 20 nt, Bordetella pertussis
gccccacgccgaugccgcgc

SEQ ID NO: 2369870 - RNA, 18 nt, Bordetella pertussis
gccccacggguaccaggc

SEQ ID NO: 2369871 - RNA, 20 nt, Bordetella pertussis
gccccacggguaccaggcuc

SEQ ID NO: 2369872 - RNA, 19 nt, Bordetella pertussis
gccccacuuggcgaucucg

SEQ ID NO: 2369873 - RNA, 14 nt, Bordetella pertussis
gccccagaugccgg

SEQ ID NO: 2369874 - RNA, 23 nt, Bordetella pertussis
gccccagcacgaagggcagcagc

SEQ ID NO: 2369875 - RNA, 12 nt, Bordetella pertussis
gccccagcagca

SEQ ID NO: 2369876 - RNA, 20 nt, Bordetella pertussis
gccccagcagcacgcccagu

SEQ ID NO: 2369877 - RNA, 12 nt, Bordetella pertussis
gccccagcaucu

SEQ ID NO: 2369878 - RNA, 20 nt, Bordetella pertussis
gccccagcaucugccccagc

SEQ ID NO: 2369879 - RNA, 14 nt, Bordetella pertussis
gccccagcgccagc

SEQ ID NO: 2369880 - RNA, 15 nt, Bordetella pertussis
gccccagcgccagcg

SEQ ID NO: 2369881 - RNA, 14 nt, Bordetella pertussis
gccccagcgcccag

SEQ ID NO: 2369882 - RNA, 18 nt, Bordetella pertussis
gccccagcgcccaggcga

SEQ ID NO: 2369883 - RNA, 13 nt, Bordetella pertussis
gccccagcgccgc

SEQ ID NO: 2369884 - RNA, 14 nt, Bordetella pertussis
gccccagcgccgcg

SEQ ID NO: 2369885 - RNA, 12 nt, Bordetella pertussis
gccccagcggcu

SEQ ID NO: 2369886 - RNA, 15 nt, Bordetella pertussis
gccccagcggcuggc

SEQ ID NO: 2369887 - RNA, 17 nt, Bordetella pertussis
gccccagcggcuggcgc

SEQ ID NO: 2369888 - RNA, 19 nt, Bordetella pertussis
gccccagcggcuggcgcac

SEQ ID NO: 2369889 - RNA, 16 nt, Bordetella pertussis
gccccagcguccaggc

SEQ ID NO: 2369890 - RNA, 18 nt, Bordetella pertussis
gccccagcguccaggcgg

SEQ ID NO: 2369891 - RNA, 22 nt, Bordetella pertussis
gccccagcguccaggcggccau

SEQ ID NO: 2369892 - RNA, 17 nt, Bordetella pertussis
gccccagcuugucggcc

SEQ ID NO: 2369893 - RNA, 21 nt, Bordetella pertussis
gccccagcuugucggccgcgc

SEQ ID NO: 2369894 - RNA, 20 nt, Bordetella pertussis
gccccaggaaaccgaccuga

SEQ ID NO: 2369895 - RNA, 23 nt, Bordetella pertussis
gccccaggaacuugaacggcgcg

SEQ ID NO: 2369896 - RNA, 18 nt, Bordetella pertussis
gccccaggaugcgcaccg

SEQ ID NO: 2369897 - RNA, 22 nt, Bordetella pertussis
gccccaggaugcgcaccggcca

SEQ ID NO: 2369898 - RNA, 21 nt, Bordetella pertussis
gccccaggcaggcgggcccgc

SEQ ID NO: 2369899 - RNA, 17 nt, Bordetella pertussis
gccccaggcguacgagg

SEQ ID NO: 2369900 - RNA, 19 nt, Bordetella pertussis
gccccaggcguacgaggac

SEQ ID NO: 2369901 - RNA, 20 nt, Bordetella pertussis
gccccaggcguacgaggacc

SEQ ID NO: 2369902 - RNA, 21 nt, Bordetella pertussis
gccccaggcgucggcggccca

SEQ ID NO: 2369903 - RNA, 16 nt, Bordetella pertussis
gccccaggcgugaacg

SEQ ID NO: 2369904 - RNA, 19 nt, Bordetella pertussis
gccccaggcgugaacgccc

SEQ ID NO: 2369905 - RNA, 21 nt, Bordetella pertussis
gccccaggcgugaacgccccg

SEQ ID NO: 2369906 - RNA, 16 nt, Bordetella pertussis
gccccagguccgccgg

SEQ ID NO: 2369907 - RNA, 18 nt, Bordetella pertussis
gccccagguccgccggca

SEQ ID NO: 2369908 - RNA, 14 nt, Bordetella pertussis
gccccaguccaggc

SEQ ID NO: 2369909 - RNA, 19 nt, Bordetella pertussis
gccccaguccaggccggcc

SEQ ID NO: 2369910 - RNA, 20 nt, Bordetella pertussis
gccccaguccaggccggccu

SEQ ID NO: 2369911 - RNA, 21 nt, Bordetella pertussis
gccccaguccaggccggccug

SEQ ID NO: 2369912 - RNA, 17 nt, Bordetella pertussis
gccccagucgcugcucg

SEQ ID NO: 2369913 - RNA, 18 nt, Bordetella pertussis
gccccauccacggcgcca

SEQ ID NO: 2369914 - RNA, 24 nt, Bordetella pertussis
gccccauccacggcgccaugccgg

SEQ ID NO: 2369915 - RNA, 14 nt, Bordetella pertussis
gccccauccagcgg

SEQ ID NO: 2369916 - RNA, 18 nt, Bordetella pertussis
gccccaucccauccgcgc

SEQ ID NO: 2369917 - RNA, 19 nt, Bordetella pertussis
gccccaucccauccgcgcc

SEQ ID NO: 2369918 - RNA, 21 nt, Bordetella pertussis
gccccaucccauccgcgccac

SEQ ID NO: 2369919 - RNA, 17 nt, Bordetella pertussis
gccccauccucaucgug

SEQ ID NO: 2369920 - RNA, 14 nt, Bordetella pertussis
gccccauggcaugc

SEQ ID NO: 2369921 - RNA, 18 nt, Bordetella pertussis
gccccauggcaugcaccg

SEQ ID NO: 2369922 - RNA, 17 nt, Bordetella pertussis
gccccauugccucgcgg

SEQ ID NO: 2369923 - RNA, 20 nt, Bordetella pertussis
gccccauugccucgcggcag

SEQ ID NO: 2369924 - RNA, 16 nt, Bordetella pertussis
gccccauugcgggugg

SEQ ID NO: 2369925 - RNA, 23 nt, Bordetella pertussis
gccccauugcgggugggcaucca

SEQ ID NO: 2369926 - RNA, 22 nt, Bordetella pertussis
gccccauugggacgccagcccg

SEQ ID NO: 2369927 - RNA, 20 nt, Bordetella pertussis
gccccauuuuuuugccugcu

SEQ ID NO: 2369928 - RNA, 18 nt, Bordetella pertussis
gcccccacgccgcugaug

SEQ ID NO: 2369929 - RNA, 17 nt, Bordetella pertussis
gcccccagcgccgucag

SEQ ID NO: 2369930 - RNA, 20 nt, Bordetella pertussis
gcccccagcgccgucagcag

SEQ ID NO: 2369931 - RNA, 21 nt, Bordetella pertussis
gcccccagcgccgucagcagc

SEQ ID NO: 2369932 - RNA, 16 nt, Bordetella pertussis
gcccccagcgcgccug

SEQ ID NO: 2369933 - RNA, 23 nt, Bordetella pertussis
gcccccagcgcgccugcccaggc

SEQ ID NO: 2369934 - RNA, 14 nt, Bordetella pertussis
gccccccaugccgg

SEQ ID NO: 2369935 - RNA, 15 nt, Bordetella pertussis
gccccccaugccgga

SEQ ID NO: 2369936 - RNA, 15 nt, Bordetella pertussis
gccccccggcgcggc

SEQ ID NO: 2369937 - RNA, 16 nt, Bordetella pertussis
gccccccggcgcggcc

SEQ ID NO: 2369938 - RNA, 17 nt, Bordetella pertussis
gccccccggcgcggccg

SEQ ID NO: 2369939 - RNA, 17 nt, Bordetella pertussis
gcccccgaaggccgcgc

SEQ ID NO: 2369940 - RNA, 20 nt, Bordetella pertussis
gcccccgaaggccgcgccua

SEQ ID NO: 2369941 - RNA, 18 nt, Bordetella pertussis
gcccccgauccccugccc

SEQ ID NO: 2369942 - RNA, 13 nt, Bordetella pertussis
gcccccgccgcca

SEQ ID NO: 2369943 - RNA, 14 nt, Bordetella pertussis
gcccccgcgccgcg

SEQ ID NO: 2369944 - RNA, 15 nt, Bordetella pertussis
gcccccgcgccgcgc

SEQ ID NO: 2369945 - RNA, 14 nt, Bordetella pertussis
gcccccgcgcugcg

SEQ ID NO: 2369946 - RNA, 21 nt, Bordetella pertussis
gcccccgcgcugcgcccgcua

SEQ ID NO: 2369947 - RNA, 22 nt, Bordetella pertussis
gcccccgcgcugcgcccgcuac

SEQ ID NO: 2369948 - RNA, 12 nt, Bordetella pertussis
gcccccgcggcg

SEQ ID NO: 2369949 - RNA, 17 nt, Bordetella pertussis
gcccccgcggcgccccg

SEQ ID NO: 2369950 - RNA, 23 nt, Bordetella pertussis
gcccccgcggcgccccgugccau

SEQ ID NO: 2369951 - RNA, 14 nt, Bordetella pertussis
gccccgacgcgcuu

SEQ ID NO: 2369952 - RNA, 19 nt, Bordetella pertussis
gccccgacgcggucgccca

SEQ ID NO: 2369953 - RNA, 21 nt, Bordetella pertussis
gccccgacgcggucgcccaac

SEQ ID NO: 2369954 - RNA, 23 nt, Bordetella pertussis
gccccgacgcggucgcccaaccc

SEQ ID NO: 2369955 - RNA, 16 nt, Bordetella pertussis
gccccgaucagcaagg

SEQ ID NO: 2369956 - RNA, 17 nt, Bordetella pertussis
gccccgauccgcgggcg

SEQ ID NO: 2369957 - RNA, 20 nt, Bordetella pertussis
gccccgauccgcgggcgggc

SEQ ID NO: 2369958 - RNA, 17 nt, Bordetella pertussis
gccccgaucggcgccgc

SEQ ID NO: 2369959 - RNA, 18 nt, Bordetella pertussis
gccccgaucggcgccgcg

SEQ ID NO: 2369960 - RNA, 22 nt, Bordetella pertussis
gccccgaugauggauucgcgcc

SEQ ID NO: 2369961 - RNA, 15 nt, Bordetella pertussis
gccccgcaaggggcc

SEQ ID NO: 2369962 - RNA, 18 nt, Bordetella pertussis
gccccgcaaggggccggc

SEQ ID NO: 2369963 - RNA, 22 nt, Bordetella pertussis
gcccgacgguaucucagcgcgc

SEQ ID NO: 2369964 - RNA, 16 nt, Bordetella pertussis
gcccgacuuggugggc

SEQ ID NO: 2369965 - RNA, 21 nt, Bordetella pertussis
gcccgacuuggugggcaccuc

SEQ ID NO: 2369966 - RNA, 14 nt, Bordetella pertussis
gcccgagaagggcu

SEQ ID NO: 2369967 - RNA, 23 nt, Bordetella pertussis
gcccgagaagggcuugaccaggg

SEQ ID NO: 2369968 - RNA, 15 nt, Bordetella pertussis
gcccgagaccgcccg

SEQ ID NO: 2369969 - RNA, 22 nt, Bordetella pertussis
gcccgagagcugcgucuugagc

SEQ ID NO: 2369970 - RNA, 23 nt, Bordetella pertussis
gcccgagagcugcgucuugagca

SEQ ID NO: 2369971 - RNA, 13 nt, Bordetella pertussis
gcccgagaugccc

SEQ ID NO: 2369972 - RNA, 16 nt, Bordetella pertussis
gcccgagaugcccgac

SEQ ID NO: 2369973 - RNA, 17 nt, Bordetella pertussis
gcccgagaugcccgacg

SEQ ID NO: 2369974 - RNA, 15 nt, Bordetella pertussis
gcccgagauggcgca

SEQ ID NO: 2369975 - RNA, 16 nt, Bordetella pertussis
gcccgagauggcgcag

SEQ ID NO: 2369976 - RNA, 17 nt, Bordetella pertussis
gcccgagauggcgcagg

SEQ ID NO: 2369977 - RNA, 18 nt, Bordetella pertussis
gcccgagauggcgcaggc

SEQ ID NO: 2369978 - RNA, 16 nt, Bordetella pertussis
gcccgagcgcgacagc

SEQ ID NO: 2369979 - RNA, 13 nt, Bordetella pertussis
gcccgagcuggcc

SEQ ID NO: 2369980 - RNA, 18 nt, Bordetella pertussis
gcccgagcuggccggcga

SEQ ID NO: 2369981 - RNA, 17 nt, Bordetella pertussis
gcccgaggcacaaggcc

SEQ ID NO: 2369982 - RNA, 13 nt, Bordetella pertussis
gcccgaggcgcgc

SEQ ID NO: 2369983 - RNA, 16 nt, Bordetella pertussis
gcccgaggcgcgcagc

SEQ ID NO: 2369984 - RNA, 17 nt, Bordetella pertussis
gcccgaggcgcgcagca

SEQ ID NO: 2369985 - RNA, 14 nt, Bordetella pertussis
gcccgaggcggcgc

SEQ ID NO: 2369986 - RNA, 16 nt, Bordetella pertussis
gcccgaggcggcgcgg

SEQ ID NO: 2369987 - RNA, 13 nt, Bordetella pertussis
gcccgagggcgcg

SEQ ID NO: 2369988 - RNA, 15 nt, Bordetella pertussis
gcccgagggcgcguc

SEQ ID NO: 2369989 - RNA, 16 nt, Bordetella pertussis
gcccgagggcgcgucg

SEQ ID NO: 2369990 - RNA, 21 nt, Bordetella pertussis
gcccgauaugcagccgcacca

SEQ ID NO: 2369991 - RNA, 23 nt, Bordetella pertussis
gcccgauaugcagccgcaccagc

SEQ ID NO: 2369992 - RNA, 14 nt, Bordetella pertussis
gcccgaucgacggc

SEQ ID NO: 2369993 - RNA, 19 nt, Bordetella pertussis
gcccgaucgacggccgcaa

SEQ ID NO: 2369994 - RNA, 23 nt, Bordetella pertussis
gcccgaucgacggccgcaagcug

SEQ ID NO: 2369995 - RNA, 14 nt, Bordetella pertussis
gcccgaucggccgg

SEQ ID NO: 2369996 - RNA, 18 nt, Bordetella pertussis
gcccgaucggccggccgg

SEQ ID NO: 2369997 - RNA, 20 nt, Bordetella pertussis
gcccgaucggccggccgggc

SEQ ID NO: 2369998 - RNA, 23 nt, Bordetella pertussis
gcccgaugccgauacgucgcagc

SEQ ID NO: 2369999 - RNA, 13 nt, Bordetella pertussis
gcccgaugccgcc

SEQ ID NO: 2370000 - RNA, 15 nt, Bordetella pertussis
gcccgaugccgccau

SEQ ID NO: 2370001 - RNA, 16 nt, Bordetella pertussis
gcccgaugccgccaug

SEQ ID NO: 2370002 - RNA, 17 nt, Bordetella pertussis
gcccgaugccgccaugc

SEQ ID NO: 2370003 - RNA, 18 nt, Bordetella pertussis
gcccgaugccgccaugcg

SEQ ID NO: 2370004 - RNA, 16 nt, Bordetella pertussis
gcccgaugccuuggug

SEQ ID NO: 2370005 - RNA, 15 nt, Bordetella pertussis
gcccgaugcgccagg

SEQ ID NO: 2370006 - RNA, 16 nt, Bordetella pertussis
gcccgaugcgccaggc

SEQ ID NO: 2370007 - RNA, 18 nt, Bordetella pertussis
gcccgaugcgccaggccu

SEQ ID NO: 2370008 - RNA, 15 nt, Bordetella pertussis
gcccgaugcucgccg

SEQ ID NO: 2370009 - RNA, 17 nt, Bordetella pertussis
gcccgaugcucgccggc

SEQ ID NO: 2370010 - RNA, 18 nt, Bordetella pertussis
gcccgaugcucgccggcg

SEQ ID NO: 2370011 - RNA, 13 nt, Bordetella pertussis
gcccgauggcggg

SEQ ID NO: 2370012 - RNA, 16 nt, Bordetella pertussis
gcccgauggcggggau

SEQ ID NO: 2370013 - RNA, 19 nt, Bordetella pertussis
gcccgauggcggggaugga

SEQ ID NO: 2370014 - RNA, 12 nt, Bordetella pertussis
gcccgauggugc

SEQ ID NO: 2370015 - RNA, 23 nt, Bordetella pertussis
gcccgauggugcauucguccagg

SEQ ID NO: 2370016 - RNA, 15 nt, Bordetella pertussis
gcccgcaacgccgcc

SEQ ID NO: 2370017 - RNA, 16 nt, Bordetella pertussis
gcccgcaacgccgccc

SEQ ID NO: 2370018 - RNA, 15 nt, Bordetella pertussis
gcccgcaacgggccg

SEQ ID NO: 2370019 - RNA, 23 nt, Bordetella pertussis
gcccgcaacgggccggccgccgg

SEQ ID NO: 2370020 - RNA, 22 nt, Bordetella pertussis
gcccgcaagcauuugcgcgacg

SEQ ID NO: 2370021 - RNA, 24 nt, Bordetella pertussis
gcccgcaagcauuugcgcgacggc

SEQ ID NO: 2370022 - RNA, 15 nt, Bordetella pertussis
gcccgcaccgcccgc

SEQ ID NO: 2370023 - RNA, 12 nt, Bordetella pertussis
gcccgcaccggg

SEQ ID NO: 2370024 - RNA, 15 nt, Bordetella pertussis
gcccgcaccgggcgg

SEQ ID NO: 2370025 - RNA, 17 nt, Bordetella pertussis
gcccgcaccgggcggcc

SEQ ID NO: 2370026 - RNA, 19 nt, Bordetella pertussis
gcccgcaccgggcggcccg

SEQ ID NO: 2370027 - RNA, 20 nt, Bordetella pertussis
gcccgcaccgggcggcccgg

SEQ ID NO: 2370028 - RNA, 21 nt, Bordetella pertussis
gcccgcaccugaacaccggcg

SEQ ID NO: 2370029 - RNA, 16 nt, Bordetella pertussis
gcccgcacgaagcggc

SEQ ID NO: 2370030 - RNA, 15 nt, Bordetella pertussis
gcccgcacgggccga

SEQ ID NO: 2370031 - RNA, 21 nt, Bordetella pertussis
gcccgcacgggccgacggccu

SEQ ID NO: 2370032 - RNA, 16 nt, Bordetella pertussis
gcccgcagagggagcg

SEQ ID NO: 2370033 - RNA, 21 nt, Bordetella pertussis
gcccgcaggcauugcgccagc

SEQ ID NO: 2370034 - RNA, 13 nt, Bordetella pertussis
gcccgcaggcggc

SEQ ID NO: 2370035 - RNA, 18 nt, Bordetella pertussis
gcccgcaggcggcggccu

SEQ ID NO: 2370036 - RNA, 20 nt, Bordetella pertussis
gcccgcaggcggcggccucc

SEQ ID NO: 2370037 - RNA, 21 nt, Bordetella pertussis
gcccgcaggcggcggccucca

SEQ ID NO: 2370038 - RNA, 16 nt, Bordetella pertussis
gcccgcauccuucacg

SEQ ID NO: 2370039 - RNA, 14 nt, Bordetella pertussis
gcccgcaucgcgcg

SEQ ID NO: 2370040 - RNA, 18 nt, Bordetella pertussis
gcccgcaucggcuggcgc

SEQ ID NO: 2370041 - RNA, 16 nt, Bordetella pertussis
gcccgcaugcaggucc

SEQ ID NO: 2370042 - RNA, 17 nt, Bordetella pertussis
gcccgcaugcagguccu

SEQ ID NO: 2370043 - RNA, 23 nt, Bordetella pertussis
gcccgcauggaccgccgccgucg

SEQ ID NO: 2370044 - RNA, 18 nt, Bordetella pertussis
gcccgcaugucccagcgc

SEQ ID NO: 2370045 - RNA, 20 nt, Bordetella pertussis
gcccgcaugucccagcgcuc

SEQ ID NO: 2370046 - RNA, 22 nt, Bordetella pertussis
gcccgcaugucccagcgcucgu

SEQ ID NO: 2370047 - RNA, 17 nt, Bordetella pertussis
gcccgccaccacgcgca

SEQ ID NO: 2370048 - RNA, 20 nt, Bordetella pertussis
gcccgccaccacgcgcacca

SEQ ID NO: 2370049 - RNA, 22 nt, Bordetella pertussis
gcccgccaccacgcgcaccagc

SEQ ID NO: 2370050 - RNA, 19 nt, Bordetella pertussis
gcccgccaccacggcgcgg

SEQ ID NO: 2370051 - RNA, 19 nt, Bordetella pertussis
gcccgccaccaggaacgcc

SEQ ID NO: 2370052 - RNA, 22 nt, Bordetella pertussis
gcccgccaccaggaacgccagc

SEQ ID NO: 2370053 - RNA, 23 nt, Bordetella pertussis
gcccgccaccaggaacgccagca

SEQ ID NO: 2370054 - RNA, 15 nt, Bordetella pertussis
gcccgccacgcgggc

SEQ ID NO: 2370055 - RNA, 19 nt, Bordetella pertussis
gcccgccacgcgggccggc

SEQ ID NO: 2370056 - RNA, 15 nt, Bordetella pertussis
gcccgccacggcgcc

SEQ ID NO: 2370057 - RNA, 19 nt, Bordetella pertussis
gcccgccagcaaggcggca

SEQ ID NO: 2370058 - RNA, 15 nt, Bordetella pertussis
gcccgccagcagcuc

SEQ ID NO: 2370059 - RNA, 14 nt, Bordetella pertussis
gcccgccagcgcgg

SEQ ID NO: 2370060 - RNA, 15 nt, Bordetella pertussis
gcccgccagcgcggc

SEQ ID NO: 2370061 - RNA, 16 nt, Bordetella pertussis
gcccgccagcgcggcu

SEQ ID NO: 2370062 - RNA, 15 nt, Bordetella pertussis
gcccgccaggaagcg

SEQ ID NO: 2370063 - RNA, 20 nt, Bordetella pertussis
gcccgccaggaagcgggccu

SEQ ID NO: 2370064 - RNA, 14 nt, Bordetella pertussis
gcccgccaggccag

SEQ ID NO: 2370065 - RNA, 16 nt, Bordetella pertussis
gcccgccaggccaggu

SEQ ID NO: 2370066 - RNA, 15 nt, Bordetella pertussis
gcccgccagggccau

SEQ ID NO: 2370067 - RNA, 23 nt, Bordetella pertussis
gcccgccagggccauguggcgca

SEQ ID NO: 2370068 - RNA, 15 nt, Bordetella pertussis
gcccgccaucgccag

SEQ ID NO: 2370069 - RNA, 16 nt, Bordetella pertussis
gcccgccaucgccagg

SEQ ID NO: 2370070 - RNA, 22 nt, Bordetella pertussis
gcccgccaucgccaggaccagg

SEQ ID NO: 2370071 - RNA, 14 nt, Bordetella pertussis
gcccgccaucgcgc

SEQ ID NO: 2370072 - RNA, 19 nt, Bordetella pertussis
gcccgccauugcacgcgca

SEQ ID NO: 2370073 - RNA, 22 nt, Bordetella pertussis
gcccgccauugcacgcgcagga

SEQ ID NO: 2370074 - RNA, 17 nt, Bordetella pertussis
gcccgcccacauggcgg

SEQ ID NO: 2370075 - RNA, 23 nt, Bordetella pertussis
gcccgccccacggcgagucugaa

SEQ ID NO: 2370076 - RNA, 15 nt, Bordetella pertussis
gcccgcggccugcgc

SEQ ID NO: 2370077 - RNA, 17 nt, Bordetella pertussis
gcccgcggccugcgcgu

SEQ ID NO: 2370078 - RNA, 23 nt, Bordetella pertussis
gcccgcggccuuggucgcgaccu

SEQ ID NO: 2370079 - RNA, 15 nt, Bordetella pertussis
gcccgcggcgccagc

SEQ ID NO: 2370080 - RNA, 16 nt, Bordetella pertussis
gcccgcggcgccagcg

SEQ ID NO: 2370081 - RNA, 13 nt, Bordetella pertussis
gcccgcggcgccc

SEQ ID NO: 2370082 - RNA, 14 nt, Bordetella pertussis
gcccgcggcgccca

SEQ ID NO: 2370083 - RNA, 16 nt, Bordetella pertussis
gcccgcggcgcccagc

SEQ ID NO: 2370084 - RNA, 19 nt, Bordetella pertussis
gcccgcggcgcccagcugg

SEQ ID NO: 2370085 - RNA, 22 nt, Bordetella pertussis
gcccgcggcgcccagcuggcgc

SEQ ID NO: 2370086 - RNA, 23 nt, Bordetella pertussis
gcccgcggcgcccagcuggcgcc

SEQ ID NO: 2370087 - RNA, 15 nt, Bordetella pertussis
gcccgcggcggcccg

SEQ ID NO: 2370088 - RNA, 18 nt, Bordetella pertussis
gcccgcgggcgcccggcc

SEQ ID NO: 2370089 - RNA, 16 nt, Bordetella pertussis
gcccgcgguccagcac

SEQ ID NO: 2370090 - RNA, 21 nt, Bordetella pertussis
gcccgcgguccagcacggcga

SEQ ID NO: 2370091 - RNA, 21 nt, Bordetella pertussis
gcccgcggucgagacgauggc

SEQ ID NO: 2370092 - RNA, 17 nt, Bordetella pertussis
gcccgcguacagcccga

SEQ ID NO: 2370093 - RNA, 19 nt, Bordetella pertussis
gcccgcgucagacgcgcuu

SEQ ID NO: 2370094 - RNA, 13 nt, Bordetella pertussis
gcccgcguccacc

SEQ ID NO: 2370095 - RNA, 16 nt, Bordetella pertussis
gcccgcguccaccaag

SEQ ID NO: 2370096 - RNA, 14 nt, Bordetella pertussis
gcccgcgucgcugu

SEQ ID NO: 2370097 - RNA, 17 nt, Bordetella pertussis
gcccgcgucgcugucgg

SEQ ID NO: 2370098 - RNA, 20 nt, Bordetella pertussis
gcccgcgucgcugucggcga

SEQ ID NO: 2370099 - RNA, 20 nt, Bordetella pertussis
gcccgcgugcgugccgacga

SEQ ID NO: 2370100 - RNA, 22 nt, Bordetella pertussis
gcccgcguggaagguccacggc

SEQ ID NO: 2370101 - RNA, 18 nt, Bordetella pertussis
gcccgcguucaggcgcgg

SEQ ID NO: 2370102 - RNA, 20 nt, Bordetella pertussis
gcccgcguucaggcgcggcu

SEQ ID NO: 2370103 - RNA, 16 nt, Bordetella pertussis
gcccgcuacgcgggcu

SEQ ID NO: 2370104 - RNA, 23 nt, Bordetella pertussis
gcccgcuacgcgggcuugcugcc

SEQ ID NO: 2370105 - RNA, 16 nt, Bordetella pertussis
gcccgcuaugcgggcu

SEQ ID NO: 2370106 - RNA, 18 nt, Bordetella pertussis
gcccgcuccaccagcacc

SEQ ID NO: 2370107 - RNA, 22 nt, Bordetella pertussis
gcccgcuccaccagcaccggca

SEQ ID NO: 2370108 - RNA, 16 nt, Bordetella pertussis
gcccgcuccaggcggc

SEQ ID NO: 2370109 - RNA, 20 nt, Bordetella pertussis
gcccgcuccaggcggccagu

SEQ ID NO: 2370110 - RNA, 13 nt, Bordetella pertussis
gcccgcucggcca

SEQ ID NO: 2370111 - RNA, 14 nt, Bordetella pertussis
gcccgcucggccag

SEQ ID NO: 2370112 - RNA, 16 nt, Bordetella pertussis
gcccgcucggccagca

SEQ ID NO: 2370113 - RNA, 18 nt, Bordetella pertussis
gcccgcucggccagcagu

SEQ ID NO: 2370114 - RNA, 15 nt, Bordetella pertussis
gcccgcugaccggcc

SEQ ID NO: 2370115 - RNA, 18 nt, Bordetella pertussis
gcccgcugaccggccugg

SEQ ID NO: 2370116 - RNA, 22 nt, Bordetella pertussis
gcccgcugaccggccuggucau

SEQ ID NO: 2370117 - RNA, 23 nt, Bordetella pertussis
gcccgcugaccggccuggucaug

SEQ ID NO: 2370118 - RNA, 20 nt, Bordetella pertussis
gcccgcugcguccaccacca

SEQ ID NO: 2370119 - RNA, 14 nt, Bordetella pertussis
gcccgcuggccaug

SEQ ID NO: 2370120 - RNA, 21 nt, Bordetella pertussis
gcccgcuggccgaucugcugg

SEQ ID NO: 2370121 - RNA, 14 nt, Bordetella pertussis
gcccgcuuccuugg

SEQ ID NO: 2370122 - RNA, 22 nt, Bordetella pertussis
gcccgcuucucacugcccgcgc

SEQ ID NO: 2370123 - RNA, 24 nt, Bordetella pertussis
gcccgcuucucacugcccgcgccg

SEQ ID NO: 2370124 - RNA, 18 nt, Bordetella pertussis
gcccgcuucuuccuugcg

SEQ ID NO: 2370125 - RNA, 16 nt, Bordetella pertussis
gcccgcuugcggccgg

SEQ ID NO: 2370126 - RNA, 17 nt, Bordetella pertussis
gcccgcuugcggccggc

SEQ ID NO: 2370127 - RNA, 19 nt, Bordetella pertussis
gcccgcuugggccgcgccu

SEQ ID NO: 2370128 - RNA, 21 nt, Bordetella pertussis
gcccgcuugggccgcgccugc

SEQ ID NO: 2370129 - RNA, 19 nt, Bordetella pertussis
gcccggaauaccgccagcu

SEQ ID NO: 2370130 - RNA, 16 nt, Bordetella pertussis
gcccggacgcggccgg

SEQ ID NO: 2370131 - RNA, 19 nt, Bordetella pertussis
gcccggauauggccggcgc

SEQ ID NO: 2370132 - RNA, 20 nt, Bordetella pertussis
gcccggauauggccggcgcg

SEQ ID NO: 2370133 - RNA, 22 nt, Bordetella pertussis
gcccggauauggccggcgcgcu

SEQ ID NO: 2370134 - RNA, 19 nt, Bordetella pertussis
gcccggaucaguccgggcg

SEQ ID NO: 2370135 - RNA, 20 nt, Bordetella pertussis
gcccggaucaguccgggcgc

SEQ ID NO: 2370136 - RNA, 23 nt, Bordetella pertussis
gcccggaucauccgggcccgguu

SEQ ID NO: 2370137 - RNA, 19 nt, Bordetella pertussis
gcccggcaacaucuccacc

SEQ ID NO: 2370138 - RNA, 22 nt, Bordetella pertussis
gcccggcaacaucuccaccagc

SEQ ID NO: 2370139 - RNA, 23 nt, Bordetella pertussis
gcccggcaacaucuccaccagcg

SEQ ID NO: 2370140 - RNA, 13 nt, Bordetella pertussis
gcccggcaacccg

SEQ ID NO: 2370141 - RNA, 14 nt, Bordetella pertussis
gcccggcaacccgc

SEQ ID NO: 2370142 - RNA, 19 nt, Bordetella pertussis
gcccggcaacccgcccacg

SEQ ID NO: 2370143 - RNA, 17 nt, Bordetella pertussis
gcccggcaccaugcgca

SEQ ID NO: 2370144 - RNA, 19 nt, Bordetella pertussis
gcccggcaccaugcgcacc

SEQ ID NO: 2370145 - RNA, 20 nt, Bordetella pertussis
gcccggcaccaugcgcacca

SEQ ID NO: 2370146 - RNA, 22 nt, Bordetella pertussis
gcccggcaccaugcgcaccagg

SEQ ID NO: 2370147 - RNA, 15 nt, Bordetella pertussis
gcccggcacgucggu

SEQ ID NO: 2370148 - RNA, 16 nt, Bordetella pertussis
gcccggcagaacagcg

SEQ ID NO: 2370149 - RNA, 19 nt, Bordetella pertussis
gcccggcagaacagcggau

SEQ ID NO: 2370150 - RNA, 22 nt, Bordetella pertussis
gcccggcagaacagcggaucgc

SEQ ID NO: 2370151 - RNA, 14 nt, Bordetella pertussis
gcccggcaggcaca

SEQ ID NO: 2370152 - RNA, 22 nt, Bordetella pertussis
gcccggcagggucucggccacg

SEQ ID NO: 2370153 - RNA, 21 nt, Bordetella pertussis
gcccggcagggugacgggcug

SEQ ID NO: 2370154 - RNA, 21 nt, Bordetella pertussis
gcccggcaggucgaugcccuc

SEQ ID NO: 2370155 - RNA, 22 nt, Bordetella pertussis
gcccggcaugggcgugccgcgc

SEQ ID NO: 2370156 - RNA, 23 nt, Bordetella pertussis
gcccggccaagcuggagaagcgc

SEQ ID NO: 2370157 - RNA, 14 nt, Bordetella pertussis
gcccggccaccagc

SEQ ID NO: 2370158 - RNA, 16 nt, Bordetella pertussis
gcccggccacggccgg

SEQ ID NO: 2370159 - RNA, 14 nt, Bordetella pertussis
gcccggcccaggcc

SEQ ID NO: 2370160 - RNA, 13 nt, Bordetella pertussis
gcccggccccagg

SEQ ID NO: 2370161 - RNA, 16 nt, Bordetella pertussis
gcccggccccaggccg

SEQ ID NO: 2370162 - RNA, 17 nt, Bordetella pertussis
gcccggccccaggccgg

SEQ ID NO: 2370163 - RNA, 14 nt, Bordetella pertussis
gcccggcccccagc

SEQ ID NO: 2370164 - RNA, 16 nt, Bordetella pertussis
gcccggcccccagccc

SEQ ID NO: 2370165 - RNA, 15 nt, Bordetella pertussis
gcccggccgcagggc

SEQ ID NO: 2370166 - RNA, 14 nt, Bordetella pertussis
gcccggccgccagc

SEQ ID NO: 2370167 - RNA, 15 nt, Bordetella pertussis
gcccggccgccagca

SEQ ID NO: 2370168 - RNA, 18 nt, Bordetella pertussis
gcccggccgccgccggca

SEQ ID NO: 2370169 - RNA, 19 nt, Bordetella pertussis
gcccggccgccgccggcaa

SEQ ID NO: 2370170 - RNA, 12 nt, Bordetella pertussis
gcccggccgccu

SEQ ID NO: 2370171 - RNA, 13 nt, Bordetella pertussis
gcccggccgccuc

SEQ ID NO: 2370172 - RNA, 20 nt, Bordetella pertussis
gcccggccgccucaccgcgc

SEQ ID NO: 2370173 - RNA, 22 nt, Bordetella pertussis
gcccggccggcaaggggccagc

SEQ ID NO: 2370174 - RNA, 14 nt, Bordetella pertussis
gcccggccggcacg

SEQ ID NO: 2370175 - RNA, 16 nt, Bordetella pertussis
gcccggccggcacggc

SEQ ID NO: 2370176 - RNA, 17 nt, Bordetella pertussis
gcccggccggcacggcc

SEQ ID NO: 2370177 - RNA, 18 nt, Bordetella pertussis
gcccggccggcacggccg

SEQ ID NO: 2370178 - RNA, 19 nt, Bordetella pertussis
gcccggccggcacggccgg

SEQ ID NO: 2370179 - RNA, 22 nt, Bordetella pertussis
gcccggccggcacggccggcca

SEQ ID NO: 2370180 - RNA, 15 nt, Bordetella pertussis
gcccggccggcccgc

SEQ ID NO: 2370181 - RNA, 17 nt, Bordetella pertussis
gcccggccggcccgcgc

SEQ ID NO: 2370182 - RNA, 14 nt, Bordetella pertussis
gcccggccggcccu

SEQ ID NO: 2370183 - RNA, 20 nt, Bordetella pertussis
gcccggccugcgggcgccgc

SEQ ID NO: 2370184 - RNA, 21 nt, Bordetella pertussis
gcccggccugcgggcgccgcg

SEQ ID NO: 2370185 - RNA, 23 nt, Bordetella pertussis
gcccggcgaaagcgucggcuucc

SEQ ID NO: 2370186 - RNA, 20 nt, Bordetella pertussis
gcccggcgagaacgcggccg

SEQ ID NO: 2370187 - RNA, 22 nt, Bordetella pertussis
gcccggcgagaacgcggccgcg

SEQ ID NO: 2370188 - RNA, 16 nt, Bordetella pertussis
gcccguccuggugcac

SEQ ID NO: 2370189 - RNA, 14 nt, Bordetella pertussis
gcccgucgcgccag

SEQ ID NO: 2370190 - RNA, 16 nt, Bordetella pertussis
gcccgucgcgccaggc

SEQ ID NO: 2370191 - RNA, 17 nt, Bordetella pertussis
gcccgucgcgccaggcc

SEQ ID NO: 2370192 - RNA, 20 nt, Bordetella pertussis
gcccgucgcgccaggccggc

SEQ ID NO: 2370193 - RNA, 22 nt, Bordetella pertussis
gcccgucgcgccaggccggcgg

SEQ ID NO: 2370194 - RNA, 13 nt, Bordetella pertussis
gcccgucgcuggc

SEQ ID NO: 2370195 - RNA, 14 nt, Bordetella pertussis
gcccgucgcuggcg

SEQ ID NO: 2370196 - RNA, 15 nt, Bordetella pertussis
gcccgucgcuggcgc

SEQ ID NO: 2370197 - RNA, 16 nt, Bordetella pertussis
gcccgucgcuggcgcg

SEQ ID NO: 2370198 - RNA, 22 nt, Bordetella pertussis
gcccgucgcuggcgcguugcgc

SEQ ID NO: 2370199 - RNA, 22 nt, Bordetella pertussis
gcccgucgggcaggucggcgcg

SEQ ID NO: 2370200 - RNA, 19 nt, Bordetella pertussis
gcccgucucgcgcgccagg

SEQ ID NO: 2370201 - RNA, 21 nt, Bordetella pertussis
gcccgucucgcgcgccaggug

SEQ ID NO: 2370202 - RNA, 17 nt, Bordetella pertussis
gcccgucuuggcguggu

SEQ ID NO: 2370203 - RNA, 14 nt, Bordetella pertussis
gcccgugccacggc

SEQ ID NO: 2370204 - RNA, 22 nt, Bordetella pertussis
gcccgugccgcagaagaacacc

SEQ ID NO: 2370205 - RNA, 15 nt, Bordetella pertussis
gcccgugccuugccg

SEQ ID NO: 2370206 - RNA, 14 nt, Bordetella pertussis
gcccgugcgcaacg

SEQ ID NO: 2370207 - RNA, 17 nt, Bordetella pertussis
gcccgugcgcaacgcgc

SEQ ID NO: 2370208 - RNA, 18 nt, Bordetella pertussis
gcccgugcgcaacgcgcg

SEQ ID NO: 2370209 - RNA, 21 nt, Bordetella pertussis
gcccgugcgcaacgcgcgcgc

SEQ ID NO: 2370210 - RNA, 22 nt, Bordetella pertussis
gcccgugcgcggcgagccgcgc

SEQ ID NO: 2370211 - RNA, 14 nt, Bordetella pertussis
gcccgugcgggccu

SEQ ID NO: 2370212 - RNA, 15 nt, Bordetella pertussis
gcccgugcgggccug

SEQ ID NO: 2370213 - RNA, 18 nt, Bordetella pertussis
gcccgugcgggccugcag

SEQ ID NO: 2370214 - RNA, 20 nt, Bordetella pertussis
gcccgugcgggugccugucc

SEQ ID NO: 2370215 - RNA, 17 nt, Bordetella pertussis
gcccgugcgugcgccug

SEQ ID NO: 2370216 - RNA, 17 nt, Bordetella pertussis
gcccgugcgugugccug

SEQ ID NO: 2370217 - RNA, 20 nt, Bordetella pertussis
gcccgugcgugugccugucc

SEQ ID NO: 2370218 - RNA, 21 nt, Bordetella pertussis
gcccgugcgugugccuguccc

SEQ ID NO: 2370219 - RNA, 18 nt, Bordetella pertussis
gcccgugggcggcguaga

SEQ ID NO: 2370220 - RNA, 16 nt, Bordetella pertussis
gcccguguagacggca

SEQ ID NO: 2370221 - RNA, 16 nt, Bordetella pertussis
gcccgugucgccgucg

SEQ ID NO: 2370222 - RNA, 13 nt, Bordetella pertussis
gcccguucacgcg

SEQ ID NO: 2370223 - RNA, 15 nt, Bordetella pertussis
gcccguucacgcgca

SEQ ID NO: 2370224 - RNA, 16 nt, Bordetella pertussis
gcccguucacgcgcag

SEQ ID NO: 2370225 - RNA, 17 nt, Bordetella pertussis
gcccguucacgcgcagc

SEQ ID NO: 2370226 - RNA, 15 nt, Bordetella pertussis
gcccguugccgcgcg

SEQ ID NO: 2370227 - RNA, 14 nt, Bordetella pertussis
gcccguugcggcgc

SEQ ID NO: 2370228 - RNA, 18 nt, Bordetella pertussis
gcccguugcggcgccucg

SEQ ID NO: 2370229 - RNA, 17 nt, Bordetella pertussis
gcccguuggcaggccag

SEQ ID NO: 2370230 - RNA, 16 nt, Bordetella pertussis
gcccguuggcgucgag

SEQ ID NO: 2370231 - RNA, 20 nt, Bordetella pertussis
gcccuacccugaucaaucug

SEQ ID NO: 2370232 - RNA, 18 nt, Bordetella pertussis
gcccuacgacacgcucaa

SEQ ID NO: 2370233 - RNA, 16 nt, Bordetella pertussis
gcccuccggcgccagc

SEQ ID NO: 2370234 - RNA, 17 nt, Bordetella pertussis
gcccucgauaugggcgc

SEQ ID NO: 2370235 - RNA, 14 nt, Bordetella pertussis
gcccucgcccagga

SEQ ID NO: 2370236 - RNA, 13 nt, Bordetella pertussis
gcccucgcgcacg

SEQ ID NO: 2370237 - RNA, 14 nt, Bordetella pertussis
gcccucgcgcacgg

SEQ ID NO: 2370238 - RNA, 15 nt, Bordetella pertussis
gcccucgcgcacggu

SEQ ID NO: 2370239 - RNA, 15 nt, Bordetella pertussis
gcccucgcgccacca

SEQ ID NO: 2370240 - RNA, 22 nt, Bordetella pertussis
gcccucgcgccaccaugccuug

SEQ ID NO: 2370241 - RNA, 14 nt, Bordetella pertussis
gcccucgcugcgcg

SEQ ID NO: 2370242 - RNA, 18 nt, Bordetella pertussis
gcccucgcugcgcgucaa

SEQ ID NO: 2370243 - RNA, 19 nt, Bordetella pertussis
gcccucgggaaacaggccc

SEQ ID NO: 2370244 - RNA, 20 nt, Bordetella pertussis
gcccucgggcgacaggcgcg

SEQ ID NO: 2370245 - RNA, 21 nt, Bordetella pertussis
gcccucgggcgacaggcgcgc

SEQ ID NO: 2370246 - RNA, 19 nt, Bordetella pertussis
gcccucggucagcgccagg

SEQ ID NO: 2370247 - RNA, 19 nt, Bordetella pertussis
gcccucggucgucagcacg

SEQ ID NO: 2370248 - RNA, 15 nt, Bordetella pertussis
gcccucgucgcggcc

SEQ ID NO: 2370249 - RNA, 17 nt, Bordetella pertussis
gcccucgucgcggccgu

SEQ ID NO: 2370250 - RNA, 17 nt, Bordetella pertussis
gcccucuuccguuggcc

SEQ ID NO: 2370251 - RNA, 20 nt, Bordetella pertussis
gcccucuucggcggccagcc

SEQ ID NO: 2370252 - RNA, 22 nt, Bordetella pertussis
gcccucuucggcggccagccgg

SEQ ID NO: 2370253 - RNA, 24 nt, Bordetella pertussis
gcccucuucggcguaaggcugcag

SEQ ID NO: 2370254 - RNA, 17 nt, Bordetella pertussis
gcccucuuucgccgcgc

SEQ ID NO: 2370255 - RNA, 22 nt, Bordetella pertussis
gcccugaacuauggcgcgcgca

SEQ ID NO: 2370256 - RNA, 17 nt, Bordetella pertussis
gcccugacccgcuggcu

SEQ ID NO: 2370257 - RNA, 19 nt, Bordetella pertussis
gcccugacccgcuggcugg

SEQ ID NO: 2370258 - RNA, 18 nt, Bordetella pertussis
gcccugacgaccaaccug

SEQ ID NO: 2370259 - RNA, 23 nt, Bordetella pertussis
gcccugacgaccaaccugaccgc

SEQ ID NO: 2370260 - RNA, 21 nt, Bordetella pertussis
gcccugacgccugcgccgggu

SEQ ID NO: 2370261 - RNA, 21 nt, Bordetella pertussis
gcccugcaccgucacgcgcug

SEQ ID NO: 2370262 - RNA, 22 nt, Bordetella pertussis
gcccugcaccgucacgcgcugg

SEQ ID NO: 2370263 - RNA, 14 nt, Bordetella pertussis
gcccugcacgcgcg

SEQ ID NO: 2370264 - RNA, 16 nt, Bordetella pertussis
gcccugcacgcgcgcg

SEQ ID NO: 2370265 - RNA, 15 nt, Bordetella pertussis
gcccugcagcggcca

SEQ ID NO: 2370266 - RNA, 13 nt, Bordetella pertussis
gcccugcagggca

SEQ ID NO: 2370267 - RNA, 13 nt, Bordetella pertussis
gcccugcaugacc

SEQ ID NO: 2370268 - RNA, 15 nt, Bordetella pertussis
gcccugcaugaccgc

SEQ ID NO: 2370269 - RNA, 20 nt, Bordetella pertussis
gcccugcaugaccgccgcca

SEQ ID NO: 2370270 - RNA, 21 nt, Bordetella pertussis
gcccugcaugaccgccgccag

SEQ ID NO: 2370271 - RNA, 22 nt, Bordetella pertussis
gcccugcaugaccgccgccagc

SEQ ID NO: 2370272 - RNA, 23 nt, Bordetella pertussis
gcccugcaugaccgccgccagca

SEQ ID NO: 2370273 - RNA, 19 nt, Bordetella pertussis
gcccugccauucggacacg

SEQ ID NO: 2370274 - RNA, 15 nt, Bordetella pertussis
gcccugcccgcacca

SEQ ID NO: 2370275 - RNA, 13 nt, Bordetella pertussis
gcccugcccggcg

SEQ ID NO: 2370276 - RNA, 14 nt, Bordetella pertussis
gcccugcccggcga

SEQ ID NO: 2370277 - RNA, 15 nt, Bordetella pertussis
gcccugcccggcgag

SEQ ID NO: 2370278 - RNA, 16 nt, Bordetella pertussis
gcccugcccggcgagc

SEQ ID NO: 2370279 - RNA, 23 nt, Bordetella pertussis
gcccugcccggcgagcauggcgg

SEQ ID NO: 2370280 - RNA, 20 nt, Bordetella pertussis
gcccugccgccaagggcgcg

SEQ ID NO: 2370281 - RNA, 16 nt, Bordetella pertussis
gcccugccgcccuggc

SEQ ID NO: 2370282 - RNA, 19 nt, Bordetella pertussis
gcccugccgcccuggcgca

SEQ ID NO: 2370283 - RNA, 21 nt, Bordetella pertussis
gcccugccgcccuggcgcagg

SEQ ID NO: 2370284 - RNA, 15 nt, Bordetella pertussis
gcccugcgaacccgc

SEQ ID NO: 2370285 - RNA, 19 nt, Bordetella pertussis
gcccugcgaacccgccgcg

SEQ ID NO: 2370286 - RNA, 14 nt, Bordetella pertussis
gcccugcgcaucga

SEQ ID NO: 2370287 - RNA, 23 nt, Bordetella pertussis
gcccugcgcaucgaucagcgcgc

SEQ ID NO: 2370288 - RNA, 14 nt, Bordetella pertussis
gcccugcgccagcg

SEQ ID NO: 2370289 - RNA, 16 nt, Bordetella pertussis
gcccugcgccagcgcc

SEQ ID NO: 2370290 - RNA, 18 nt, Bordetella pertussis
gcccugcgcguacguggc

SEQ ID NO: 2370291 - RNA, 23 nt, Bordetella pertussis
gcccugcgcguacguggcgcggc

SEQ ID NO: 2370292 - RNA, 19 nt, Bordetella pertussis
gcccugcgcguugagcagc

SEQ ID NO: 2370293 - RNA, 24 nt, Bordetella pertussis
gcccugcgcguugagcagcaugug

SEQ ID NO: 2370294 - RNA, 16 nt, Bordetella pertussis
gcccugcggacccagu

SEQ ID NO: 2370295 - RNA, 13 nt, Bordetella pertussis
gcccugcggcgcg

SEQ ID NO: 2370296 - RNA, 15 nt, Bordetella pertussis
gcccugcggcgcggc

SEQ ID NO: 2370297 - RNA, 21 nt, Bordetella pertussis
gcccugcggcgcggccagcac

SEQ ID NO: 2370298 - RNA, 22 nt, Bordetella pertussis
gcccugcggcgcggccagcacg

SEQ ID NO: 2370299 - RNA, 21 nt, Bordetella pertussis
gcccugcggcuugggcccggc

SEQ ID NO: 2370300 - RNA, 19 nt, Bordetella pertussis
gcccuuugcauugcggcug

SEQ ID NO: 2370301 - RNA, 14 nt, Bordetella pertussis
gccgaaacgcuggc

SEQ ID NO: 2370302 - RNA, 16 nt, Bordetella pertussis
gccgaaacgcuggcgu

SEQ ID NO: 2370303 - RNA, 15 nt, Bordetella pertussis
gccgaaauggcggcg

SEQ ID NO: 2370304 - RNA, 16 nt, Bordetella pertussis
gccgaaauggcggcgg

SEQ ID NO: 2370305 - RNA, 17 nt, Bordetella pertussis
gccgaacaagguccagg

SEQ ID NO: 2370306 - RNA, 18 nt, Bordetella pertussis
gccgaacaagguccaggc

SEQ ID NO: 2370307 - RNA, 22 nt, Bordetella pertussis
gccgaacaagguccaggcccgg

SEQ ID NO: 2370308 - RNA, 23 nt, Bordetella pertussis
gccgaacaagguccaggcccggc

SEQ ID NO: 2370309 - RNA, 14 nt, Bordetella pertussis
gccgaacacaucga

SEQ ID NO: 2370310 - RNA, 12 nt, Bordetella pertussis
gccgaacaccag

SEQ ID NO: 2370311 - RNA, 22 nt, Bordetella pertussis
gccgaacaccagcucggcggcg

SEQ ID NO: 2370312 - RNA, 23 nt, Bordetella pertussis
gccgaacaccagcucggcggcga

SEQ ID NO: 2370313 - RNA, 19 nt, Bordetella pertussis
gccgaacagcauggcggcg

SEQ ID NO: 2370314 - RNA, 11 nt, Bordetella pertussis
gccgaacagcc

SEQ ID NO: 2370315 - RNA, 14 nt, Bordetella pertussis
gccgaacagccagg

SEQ ID NO: 2370316 - RNA, 15 nt, Bordetella pertussis
gccgaacagccaggg

SEQ ID NO: 2370317 - RNA, 23 nt, Bordetella pertussis
gccgaacagccagggcagggcgc

SEQ ID NO: 2370318 - RNA, 23 nt, Bordetella pertussis
gccgaacaugacguucuccagcg

SEQ ID NO: 2370319 - RNA, 12 nt, Bordetella pertussis
gccgaaccacag

SEQ ID NO: 2370320 - RNA, 15 nt, Bordetella pertussis
gccgaaccacagcau

SEQ ID NO: 2370321 - RNA, 16 nt, Bordetella pertussis
gccgaaccagaucagg

SEQ ID NO: 2370322 - RNA, 18 nt, Bordetella pertussis
gccgaaccagaucagguc

SEQ ID NO: 2370323 - RNA, 15 nt, Bordetella pertussis
gccgaaccagcgcac

SEQ ID NO: 2370324 - RNA, 23 nt, Bordetella pertussis
gccgaaccagcgcaccaccagca

SEQ ID NO: 2370325 - RNA, 23 nt, Bordetella pertussis
gccgaaccauugcagggugucgg

SEQ ID NO: 2370326 - RNA, 18 nt, Bordetella pertussis
gccgaaccgcgcagccgc

SEQ ID NO: 2370327 - RNA, 14 nt, Bordetella pertussis
gccgaacgccgccg

SEQ ID NO: 2370328 - RNA, 15 nt, Bordetella pertussis
gccgaacgcgcagcg

SEQ ID NO: 2370329 - RNA, 14 nt, Bordetella pertussis
gccgaacggcagca

SEQ ID NO: 2370330 - RNA, 16 nt, Bordetella pertussis
gccgaacggcagcagc

SEQ ID NO: 2370331 - RNA, 20 nt, Bordetella pertussis
gccgaacggggccgccucgg

SEQ ID NO: 2370332 - RNA, 12 nt, Bordetella pertussis
gccgaacucgcg

SEQ ID NO: 2370333 - RNA, 17 nt, Bordetella pertussis
gccgaacucgcgcucgg

SEQ ID NO: 2370334 - RNA, 19 nt, Bordetella pertussis
gccgaacucgcgcucggcc

SEQ ID NO: 2370335 - RNA, 23 nt, Bordetella pertussis
gccgaacucgcgcucggccagcg

SEQ ID NO: 2370336 - RNA, 13 nt, Bordetella pertussis
gccgaacugccgg

SEQ ID NO: 2370337 - RNA, 21 nt, Bordetella pertussis
gccgaacugccggcgcgggcg

SEQ ID NO: 2370338 - RNA, 21 nt, Bordetella pertussis
gccgaacugggacaggcccag

SEQ ID NO: 2370339 - RNA, 22 nt, Bordetella pertussis
gccgaacugggacaggcccagc

SEQ ID NO: 2370340 - RNA, 23 nt, Bordetella pertussis
gccgaacugggacaggcccagcc

SEQ ID NO: 2370341 - RNA, 21 nt, Bordetella pertussis
gccgaacugggucugcaccgg

SEQ ID NO: 2370342 - RNA, 14 nt, Bordetella pertussis
gccgaacugucgcg

SEQ ID NO: 2370343 - RNA, 19 nt, Bordetella pertussis
gccgaacugucgcgccacg

SEQ ID NO: 2370344 - RNA, 21 nt, Bordetella pertussis
gccgaagaucuccucgcgcgc

SEQ ID NO: 2370345 - RNA, 22 nt, Bordetella pertussis
gccgaagaucuccucgcgcgcg

SEQ ID NO: 2370346 - RNA, 14 nt, Bordetella pertussis
gccgaagauggggg

SEQ ID NO: 2370347 - RNA, 20 nt, Bordetella pertussis
gccgaagauucccgcgcacg

SEQ ID NO: 2370348 - RNA, 21 nt, Bordetella pertussis
gccgaagauucccgcgcacgc

SEQ ID NO: 2370349 - RNA, 14 nt, Bordetella pertussis
gccgaagcgcaggc

SEQ ID NO: 2370350 - RNA, 16 nt, Bordetella pertussis
gccgaagcgcaggccu

SEQ ID NO: 2370351 - RNA, 23 nt, Bordetella pertussis
gccgaagcgcgcgugcagguagg

SEQ ID NO: 2370352 - RNA, 23 nt, Bordetella pertussis
gccgaagggcaccgugaugucgc

SEQ ID NO: 2370353 - RNA, 22 nt, Bordetella pertussis
gccgaaggguugcaguucgccg

SEQ ID NO: 2370354 - RNA, 19 nt, Bordetella pertussis
gccgaaguacacggccagc

SEQ ID NO: 2370355 - RNA, 21 nt, Bordetella pertussis
gccgaaguaguuggucgagcg

SEQ ID NO: 2370356 - RNA, 20 nt, Bordetella pertussis
gccgaaguugcggccgugcg

SEQ ID NO: 2370357 - RNA, 14 nt, Bordetella pertussis
gccgaauccggcca

SEQ ID NO: 2370358 - RNA, 15 nt, Bordetella pertussis
gccgaauccggccag

SEQ ID NO: 2370359 - RNA, 20 nt, Bordetella pertussis
gccgaauccggccagcacgc

SEQ ID NO: 2370360 - RNA, 23 nt, Bordetella pertussis
gccgaauccggccagcacgccgg

SEQ ID NO: 2370361 - RNA, 17 nt, Bordetella pertussis
gccgaaucggccccugc

SEQ ID NO: 2370362 - RNA, 18 nt, Bordetella pertussis
gccgaaucguucacgccc

SEQ ID NO: 2370363 - RNA, 17 nt, Bordetella pertussis
gccgaaugcccgcccuu

SEQ ID NO: 2370364 - RNA, 14 nt, Bordetella pertussis
gccgaauugccgcc

SEQ ID NO: 2370365 - RNA, 21 nt, Bordetella pertussis
gccgaauugccgccgcugccg

SEQ ID NO: 2370366 - RNA, 19 nt, Bordetella pertussis
gccgaauugcuggagcgcc

SEQ ID NO: 2370367 - RNA, 21 nt, Bordetella pertussis
gccgacaacggcgugcugcgg

SEQ ID NO: 2370368 - RNA, 18 nt, Bordetella pertussis
gccgacaggaaggcgagc

SEQ ID NO: 2370369 - RNA, 23 nt, Bordetella pertussis
gccgacaggaaggcgagcgcggc

SEQ ID NO: 2370370 - RNA, 18 nt, Bordetella pertussis
gccgacaggaugaagacc

SEQ ID NO: 2370371 - RNA, 16 nt, Bordetella pertussis
gccgacaggcgcgcag

SEQ ID NO: 2370372 - RNA, 22 nt, Bordetella pertussis
gccgacaggcgcgcaggcgggc

SEQ ID NO: 2370373 - RNA, 13 nt, Bordetella pertussis
gccgacaugccgu

SEQ ID NO: 2370374 - RNA, 22 nt, Bordetella pertussis
gccgacaugucgugcuggcuga

SEQ ID NO: 2370375 - RNA, 14 nt, Bordetella pertussis
gccgaccaccagca

SEQ ID NO: 2370376 - RNA, 23 nt, Bordetella pertussis
gccgaccaccagcaccgaugcgc

SEQ ID NO: 2370377 - RNA, 15 nt, Bordetella pertussis
gccgaccacccgcgc

SEQ ID NO: 2370378 - RNA, 18 nt, Bordetella pertussis
gccgaccacccgcgccag

SEQ ID NO: 2370379 - RNA, 20 nt, Bordetella pertussis
gccgaccacccgcgccagga

SEQ ID NO: 2370380 - RNA, 15 nt, Bordetella pertussis
gccgaccaccugcac

SEQ ID NO: 2370381 - RNA, 23 nt, Bordetella pertussis
gccgaccaccugcaccgccgcgu

SEQ ID NO: 2370382 - RNA, 15 nt, Bordetella pertussis
gccgaccacgcuggg

SEQ ID NO: 2370383 - RNA, 22 nt, Bordetella pertussis
gccgaccacgcugggccagacc

SEQ ID NO: 2370384 - RNA, 13 nt, Bordetella pertussis
gccgaccacggcu

SEQ ID NO: 2370385 - RNA, 18 nt, Bordetella pertussis
gccgaccagcacgaucca

SEQ ID NO: 2370386 - RNA, 20 nt, Bordetella pertussis
gccgaccagcacgauccagc

SEQ ID NO: 2370387 - RNA, 13 nt, Bordetella pertussis
gccgaccagcgag

SEQ ID NO: 2370388 - RNA, 19 nt, Bordetella pertussis
gccgaccagcucgacgcca

SEQ ID NO: 2370389 - RNA, 14 nt, Bordetella pertussis
gccgaccaggcccg

SEQ ID NO: 2370390 - RNA, 15 nt, Bordetella pertussis
gccgaccaggcccgc

SEQ ID NO: 2370391 - RNA, 20 nt, Bordetella pertussis
gccgaccaggccggcggcgg

SEQ ID NO: 2370392 - RNA, 15 nt, Bordetella pertussis
gccgaccaggcugcg

SEQ ID NO: 2370393 - RNA, 18 nt, Bordetella pertussis
gccgaccaggcugcgcgc

SEQ ID NO: 2370394 - RNA, 20 nt, Bordetella pertussis
gccgaccaggcugcgcgccg

SEQ ID NO: 2370395 - RNA, 23 nt, Bordetella pertussis
gccgaccaggcugcgcgccggcg

SEQ ID NO: 2370396 - RNA, 14 nt, Bordetella pertussis
gccgaccagguauc

SEQ ID NO: 2370397 - RNA, 21 nt, Bordetella pertussis
gccgaccauguggcagauggc

SEQ ID NO: 2370398 - RNA, 23 nt, Bordetella pertussis
gccgaccauguggcagauggcgg

SEQ ID NO: 2370399 - RNA, 12 nt, Bordetella pertussis
gccgacccgggc

SEQ ID NO: 2370400 - RNA, 16 nt, Bordetella pertussis
gccgacccgggcgggc

SEQ ID NO: 2370401 - RNA, 20 nt, Bordetella pertussis
gccgacccgggcgggcgucu

SEQ ID NO: 2370402 - RNA, 18 nt, Bordetella pertussis
gccgacccugcccggcag

SEQ ID NO: 2370403 - RNA, 19 nt, Bordetella pertussis
gccgacccugcccggcagg

SEQ ID NO: 2370404 - RNA, 18 nt, Bordetella pertussis
gccgaccgcacgauggcg

SEQ ID NO: 2370405 - RNA, 22 nt, Bordetella pertussis
gccgaccgcacgauggcgcgcg

SEQ ID NO: 2370406 - RNA, 12 nt, Bordetella pertussis
gccgaccgcgcg

SEQ ID NO: 2370407 - RNA, 22 nt, Bordetella pertussis
gccgaccgcuuccgccaccgcg

SEQ ID NO: 2370408 - RNA, 23 nt, Bordetella pertussis
gccgaccgcuuccgccaccgcgc

SEQ ID NO: 2370409 - RNA, 18 nt, Bordetella pertussis
gccgaccggccccaccug

SEQ ID NO: 2370410 - RNA, 21 nt, Bordetella pertussis
gccgaccggccccaccuggcg

SEQ ID NO: 2370411 - RNA, 14 nt, Bordetella pertussis
gccgaccggcgcgc

SEQ ID NO: 2370412 - RNA, 14 nt, Bordetella pertussis
gccgagggccgcgc

SEQ ID NO: 2370413 - RNA, 14 nt, Bordetella pertussis
gccgaggucggcgg

SEQ ID NO: 2370414 - RNA, 22 nt, Bordetella pertussis
gccgaggucggcgguccacagc

SEQ ID NO: 2370415 - RNA, 23 nt, Bordetella pertussis
gccgaggucggcgguccacagcc

SEQ ID NO: 2370416 - RNA, 23 nt, Bordetella pertussis
gccgaggugaucugguccacggc

SEQ ID NO: 2370417 - RNA, 20 nt, Bordetella pertussis
gccgagguggaugcguucgc

SEQ ID NO: 2370418 - RNA, 17 nt, Bordetella pertussis
gccgaguagcggcgcaa

SEQ ID NO: 2370419 - RNA, 13 nt, Bordetella pertussis
gccgaguccuggu

SEQ ID NO: 2370420 - RNA, 13 nt, Bordetella pertussis
gccgagucggcga

SEQ ID NO: 2370421 - RNA, 23 nt, Bordetella pertussis
gccgagucggcgauggcgcgcgc

SEQ ID NO: 2370422 - RNA, 16 nt, Bordetella pertussis
gccgaguggaugcgcu

SEQ ID NO: 2370423 - RNA, 19 nt, Bordetella pertussis
gccgaguggaugcgcuugc

SEQ ID NO: 2370424 - RNA, 16 nt, Bordetella pertussis
gccgaguggcgggcca

SEQ ID NO: 2370425 - RNA, 16 nt, Bordetella pertussis
gccgaguuuccgcacc

SEQ ID NO: 2370426 - RNA, 15 nt, Bordetella pertussis
gccgauacaggcgcu

SEQ ID NO: 2370427 - RNA, 19 nt, Bordetella pertussis
gccgauacaggcgcucgcg

SEQ ID NO: 2370428 - RNA, 16 nt, Bordetella pertussis
gccgauaccacgcgcg

SEQ ID NO: 2370429 - RNA, 18 nt, Bordetella pertussis
gccgauaccacgcgcggc

SEQ ID NO: 2370430 - RNA, 19 nt, Bordetella pertussis
gccgauaccacgcgcggcg

SEQ ID NO: 2370431 - RNA, 21 nt, Bordetella pertussis
gccgauaccacgcgcggcggc

SEQ ID NO: 2370432 - RNA, 22 nt, Bordetella pertussis
gccgauaccacgcgcggcggcg

SEQ ID NO: 2370433 - RNA, 23 nt, Bordetella pertussis
gccgauaccacgcgcggcggcgg

SEQ ID NO: 2370434 - RNA, 15 nt, Bordetella pertussis
gccgauacgcgugcg

SEQ ID NO: 2370435 - RNA, 20 nt, Bordetella pertussis
gccgauacgcgugcgcggcc

SEQ ID NO: 2370436 - RNA, 17 nt, Bordetella pertussis
gccgauacgggcgcggc

SEQ ID NO: 2370437 - RNA, 18 nt, Bordetella pertussis
gccgauacgggcgcggcg

SEQ ID NO: 2370438 - RNA, 14 nt, Bordetella pertussis
gccgauacgucgca

SEQ ID NO: 2370439 - RNA, 15 nt, Bordetella pertussis
gccgauacgucgcag

SEQ ID NO: 2370440 - RNA, 17 nt, Bordetella pertussis
gccgauacgucgcagca

SEQ ID NO: 2370441 - RNA, 16 nt, Bordetella pertussis
gccgauagccgcggcg

SEQ ID NO: 2370442 - RNA, 23 nt, Bordetella pertussis
gccgauauugcgguacaggucgu

SEQ ID NO: 2370443 - RNA, 16 nt, Bordetella pertussis
gccgaucaccacgggc

SEQ ID NO: 2370444 - RNA, 19 nt, Bordetella pertussis
gccgaucaccacgggcacg

SEQ ID NO: 2370445 - RNA, 21 nt, Bordetella pertussis
gccgaucaccacgggcacgau

SEQ ID NO: 2370446 - RNA, 16 nt, Bordetella pertussis
gccgaucaccugcagg

SEQ ID NO: 2370447 - RNA, 23 nt, Bordetella pertussis
gccgaucaccugcaggcccaccg

SEQ ID NO: 2370448 - RNA, 14 nt, Bordetella pertussis
gccgaucagcacca

SEQ ID NO: 2370449 - RNA, 17 nt, Bordetella pertussis
gccgaucagcaccacgg

SEQ ID NO: 2370450 - RNA, 17 nt, Bordetella pertussis
gccgaucagcaggucgg

SEQ ID NO: 2370451 - RNA, 14 nt, Bordetella pertussis
gccgaucagccggc

SEQ ID NO: 2370452 - RNA, 15 nt, Bordetella pertussis
gccgaucagccggcc

SEQ ID NO: 2370453 - RNA, 16 nt, Bordetella pertussis
gccgaucagccggcca

SEQ ID NO: 2370454 - RNA, 17 nt, Bordetella pertussis
gccgaucagccggccau

SEQ ID NO: 2370455 - RNA, 18 nt, Bordetella pertussis
gccgaucagccggccaug

SEQ ID NO: 2370456 - RNA, 14 nt, Bordetella pertussis
gccgaucagcgaca

SEQ ID NO: 2370457 - RNA, 18 nt, Bordetella pertussis
gccgaucagcgacagcag

SEQ ID NO: 2370458 - RNA, 22 nt, Bordetella pertussis
gccgaucagcggauugaccagc

SEQ ID NO: 2370459 - RNA, 23 nt, Bordetella pertussis
gccgaucagcggauugaccagcg

SEQ ID NO: 2370460 - RNA, 17 nt, Bordetella pertussis
gccgaucagcgggcugg

SEQ ID NO: 2370461 - RNA, 18 nt, Bordetella pertussis
gccgauccacucggccag

SEQ ID NO: 2370462 - RNA, 19 nt, Bordetella pertussis
gccgauccagcccaccgcg

SEQ ID NO: 2370463 - RNA, 23 nt, Bordetella pertussis
gccgauccagcccaccgcgaacc

SEQ ID NO: 2370464 - RNA, 16 nt, Bordetella pertussis
gccgauccagcgccug

SEQ ID NO: 2370465 - RNA, 17 nt, Bordetella pertussis
gccgauccagggccgca

SEQ ID NO: 2370466 - RNA, 19 nt, Bordetella pertussis
gccgauccagggccgcagc

SEQ ID NO: 2370467 - RNA, 21 nt, Bordetella pertussis
gccgauccagggccgcagcaa

SEQ ID NO: 2370468 - RNA, 23 nt, Bordetella pertussis
gccgauccagggccgcagcaauu

SEQ ID NO: 2370469 - RNA, 13 nt, Bordetella pertussis
gccgauccgcgac

SEQ ID NO: 2370470 - RNA, 14 nt, Bordetella pertussis
gccgauccgcgacg

SEQ ID NO: 2370471 - RNA, 15 nt, Bordetella pertussis
gccgauccggcgcag

SEQ ID NO: 2370472 - RNA, 16 nt, Bordetella pertussis
gccgauccgguugacg

SEQ ID NO: 2370473 - RNA, 23 nt, Bordetella pertussis
gccgauccgguugacgaucucgc

SEQ ID NO: 2370474 - RNA, 17 nt, Bordetella pertussis
gccgaucgagcaggccg

SEQ ID NO: 2370475 - RNA, 21 nt, Bordetella pertussis
gccgaucgagcaggccgccgg

SEQ ID NO: 2370476 - RNA, 13 nt, Bordetella pertussis
gccgaucgccgac

SEQ ID NO: 2370477 - RNA, 14 nt, Bordetella pertussis
gccgaucgccgaca

SEQ ID NO: 2370478 - RNA, 18 nt, Bordetella pertussis
gccgaucgcgcacagcau

SEQ ID NO: 2370479 - RNA, 19 nt, Bordetella pertussis
gccgaucgcgcacagcaug

SEQ ID NO: 2370480 - RNA, 23 nt, Bordetella pertussis
gccgaucgcgcacagcauggcca

SEQ ID NO: 2370481 - RNA, 21 nt, Bordetella pertussis
gccgaucgcgccguccgagcc

SEQ ID NO: 2370482 - RNA, 19 nt, Bordetella pertussis
gccgaucgcggcuccagcu

SEQ ID NO: 2370483 - RNA, 18 nt, Bordetella pertussis
gccgaucggcuugccgcg

SEQ ID NO: 2370484 - RNA, 19 nt, Bordetella pertussis
gccgaucggcuugccgcgc

SEQ ID NO: 2370485 - RNA, 16 nt, Bordetella pertussis
gccgaucgugcacgcc

SEQ ID NO: 2370486 - RNA, 17 nt, Bordetella pertussis
gccgaucgugcacgccc

SEQ ID NO: 2370487 - RNA, 23 nt, Bordetella pertussis
gccgaucgugcacgcccgcggcg

SEQ ID NO: 2370488 - RNA, 14 nt, Bordetella pertussis
gccgaucugcuggg

SEQ ID NO: 2370489 - RNA, 17 nt, Bordetella pertussis
gccgaucugcugggccg

SEQ ID NO: 2370490 - RNA, 21 nt, Bordetella pertussis
gccgaucugcugggccgggug

SEQ ID NO: 2370491 - RNA, 15 nt, Bordetella pertussis
gccgaucugcuucca

SEQ ID NO: 2370492 - RNA, 21 nt, Bordetella pertussis
gccgaucuucuggacgcugac

SEQ ID NO: 2370493 - RNA, 23 nt, Bordetella pertussis
gccgaucuucuggacgcugaccg

SEQ ID NO: 2370494 - RNA, 17 nt, Bordetella pertussis
gccgaugaagacgccgu

SEQ ID NO: 2370495 - RNA, 17 nt, Bordetella pertussis
gccgaugaauugcgcca

SEQ ID NO: 2370496 - RNA, 20 nt, Bordetella pertussis
gccgaugaauugcgccacgc

SEQ ID NO: 2370497 - RNA, 21 nt, Bordetella pertussis
gccgaugaauugcgccacgcc

SEQ ID NO: 2370498 - RNA, 22 nt, Bordetella pertussis
gccgaugaauugcgccacgccc

SEQ ID NO: 2370499 - RNA, 23 nt, Bordetella pertussis
gccgaugaauugcgccacgccca

SEQ ID NO: 2370500 - RNA, 18 nt, Bordetella pertussis
gccgaugacaucgccgcu

SEQ ID NO: 2370501 - RNA, 19 nt, Bordetella pertussis
gccgaugacaucgccgcug

SEQ ID NO: 2370502 - RNA, 22 nt, Bordetella pertussis
gccgaugacaucgccgcugcgc

SEQ ID NO: 2370503 - RNA, 21 nt, Bordetella pertussis
gccgaugaccagcagcgccgg

SEQ ID NO: 2370504 - RNA, 17 nt, Bordetella pertussis
gccgaugaccagggcgc

SEQ ID NO: 2370505 - RNA, 18 nt, Bordetella pertussis
gccgaugaccagggcgcc

SEQ ID NO: 2370506 - RNA, 20 nt, Bordetella pertussis
gccgaugaccagggcgccga

SEQ ID NO: 2370507 - RNA, 21 nt, Bordetella pertussis
gccgaugaccagggcgccgac

SEQ ID NO: 2370508 - RNA, 16 nt, Bordetella pertussis
gccgaugaccggccag

SEQ ID NO: 2370509 - RNA, 23 nt, Bordetella pertussis
gccgaugaccggccaggcgcgga

SEQ ID NO: 2370510 - RNA, 23 nt, Bordetella pertussis
gccgaugauggccauggccagcu

SEQ ID NO: 2370511 - RNA, 22 nt, Bordetella pertussis
gccgaugauggugaacgccacc

SEQ ID NO: 2370512 - RNA, 16 nt, Bordetella pertussis
gccgaugccgccauca

SEQ ID NO: 2370513 - RNA, 13 nt, Bordetella pertussis
gccgaugccgcgc

SEQ ID NO: 2370514 - RNA, 22 nt, Bordetella pertussis
gccgaugccgcgcaccugggcg

SEQ ID NO: 2370515 - RNA, 15 nt, Bordetella pertussis
gccgaugcgccaggc

SEQ ID NO: 2370516 - RNA, 15 nt, Bordetella pertussis
gccgaugcgccgcgc

SEQ ID NO: 2370517 - RNA, 17 nt, Bordetella pertussis
gccgaugcgccgcgcuu

SEQ ID NO: 2370518 - RNA, 14 nt, Bordetella pertussis
gccgaugcgcucgg

SEQ ID NO: 2370519 - RNA, 21 nt, Bordetella pertussis
gccgaugcgcucgguccagac

SEQ ID NO: 2370520 - RNA, 13 nt, Bordetella pertussis
gccgaugcggcgc

SEQ ID NO: 2370521 - RNA, 22 nt, Bordetella pertussis
gccgaugcggcgcaugcugcgc

SEQ ID NO: 2370522 - RNA, 19 nt, Bordetella pertussis
gccgaugcggguacuggcc

SEQ ID NO: 2370523 - RNA, 22 nt, Bordetella pertussis
gccgaugcggguacuggccgac

SEQ ID NO: 2370524 - RNA, 12 nt, Bordetella pertussis
gccgcagcacca

SEQ ID NO: 2370525 - RNA, 20 nt, Bordetella pertussis
gccgcagcaccacaucgccg

SEQ ID NO: 2370526 - RNA, 21 nt, Bordetella pertussis
gccgcagcaccacaucgccgg

SEQ ID NO: 2370527 - RNA, 17 nt, Bordetella pertussis
gccgcagcaccucggcg

SEQ ID NO: 2370528 - RNA, 13 nt, Bordetella pertussis
gccgcagcaccuu

SEQ ID NO: 2370529 - RNA, 16 nt, Bordetella pertussis
gccgcagcaggcgcuc

SEQ ID NO: 2370530 - RNA, 18 nt, Bordetella pertussis
gccgcagcaggcgcucgg

SEQ ID NO: 2370531 - RNA, 19 nt, Bordetella pertussis
gccgcagcaggcgcucggc

SEQ ID NO: 2370532 - RNA, 22 nt, Bordetella pertussis
gccgcagcaggcgcucggccag

SEQ ID NO: 2370533 - RNA, 17 nt, Bordetella pertussis
gccgcagcauggcgcca

SEQ ID NO: 2370534 - RNA, 13 nt, Bordetella pertussis
gccgcagcccgcg

SEQ ID NO: 2370535 - RNA, 17 nt, Bordetella pertussis
gccgcagcccgcgcgcc

SEQ ID NO: 2370536 - RNA, 20 nt, Bordetella pertussis
gccgcagcccgcgcgccugc

SEQ ID NO: 2370537 - RNA, 13 nt, Bordetella pertussis
gccgcagccgcca

SEQ ID NO: 2370538 - RNA, 15 nt, Bordetella pertussis
gccgcagccgccagc

SEQ ID NO: 2370539 - RNA, 22 nt, Bordetella pertussis
gccgcagccgccagcgccugga

SEQ ID NO: 2370540 - RNA, 12 nt, Bordetella pertussis
gccgcagccggc

SEQ ID NO: 2370541 - RNA, 13 nt, Bordetella pertussis
gccgcagccggcu

SEQ ID NO: 2370542 - RNA, 14 nt, Bordetella pertussis
gccgcagccggcug

SEQ ID NO: 2370543 - RNA, 21 nt, Bordetella pertussis
gccgcagcgaacggauggucg

SEQ ID NO: 2370544 - RNA, 18 nt, Bordetella pertussis
gccgcagcgaggugguga

SEQ ID NO: 2370545 - RNA, 18 nt, Bordetella pertussis
gccgcagcggacguuggc

SEQ ID NO: 2370546 - RNA, 12 nt, Bordetella pertussis
gccgcagcggca

SEQ ID NO: 2370547 - RNA, 13 nt, Bordetella pertussis
gccgcagcggcag

SEQ ID NO: 2370548 - RNA, 12 nt, Bordetella pertussis
gccgcagcggcc

SEQ ID NO: 2370549 - RNA, 13 nt, Bordetella pertussis
gccgcagcggcca

SEQ ID NO: 2370550 - RNA, 14 nt, Bordetella pertussis
gccgcagcggccau

SEQ ID NO: 2370551 - RNA, 20 nt, Bordetella pertussis
gccgcagcgggcccgucgcg

SEQ ID NO: 2370552 - RNA, 22 nt, Bordetella pertussis
gccgcagcgggcccgucgcgcc

SEQ ID NO: 2370553 - RNA, 14 nt, Bordetella pertussis
gccgcagcggggac

SEQ ID NO: 2370554 - RNA, 13 nt, Bordetella pertussis
gccgcagcgucgc

SEQ ID NO: 2370555 - RNA, 15 nt, Bordetella pertussis
gccgcagcguggcgu

SEQ ID NO: 2370556 - RNA, 12 nt, Bordetella pertussis
gccgcagcugga

SEQ ID NO: 2370557 - RNA, 19 nt, Bordetella pertussis
gccgcagcuggacuauggc

SEQ ID NO: 2370558 - RNA, 14 nt, Bordetella pertussis
gccgcaggagucgc

SEQ ID NO: 2370559 - RNA, 19 nt, Bordetella pertussis
gccgcaggccagcccgcgc

SEQ ID NO: 2370560 - RNA, 13 nt, Bordetella pertussis
gccgcaggcuaug

SEQ ID NO: 2370561 - RNA, 18 nt, Bordetella pertussis
gccgcaggcuaugcaggc

SEQ ID NO: 2370562 - RNA, 15 nt, Bordetella pertussis
gccgcaggcuuucgc

SEQ ID NO: 2370563 - RNA, 15 nt, Bordetella pertussis
gccgcagguccaggc

SEQ ID NO: 2370564 - RNA, 16 nt, Bordetella pertussis
gccgcagguccaggcc

SEQ ID NO: 2370565 - RNA, 21 nt, Bordetella pertussis
gccgcagguccaggccuggga

SEQ ID NO: 2370566 - RNA, 23 nt, Bordetella pertussis
gccgcaguauuccugcugguaga

SEQ ID NO: 2370567 - RNA, 13 nt, Bordetella pertussis
gccgcagugcgcg

SEQ ID NO: 2370568 - RNA, 16 nt, Bordetella pertussis
gccgcagugcgcgcgc

SEQ ID NO: 2370569 - RNA, 16 nt, Bordetella pertussis
gccgcaguuccaggca

SEQ ID NO: 2370570 - RNA, 19 nt, Bordetella pertussis
gccgcauaccuuggcgccc

SEQ ID NO: 2370571 - RNA, 20 nt, Bordetella pertussis
gccgcauaccuuggcgccca

SEQ ID NO: 2370572 - RNA, 22 nt, Bordetella pertussis
gccgcauaccuuggcgcccagc

SEQ ID NO: 2370573 - RNA, 23 nt, Bordetella pertussis
gccgcauaccuuggcgcccagcu

SEQ ID NO: 2370574 - RNA, 21 nt, Bordetella pertussis
gccgcaucccgcccccgccgc

SEQ ID NO: 2370575 - RNA, 22 nt, Bordetella pertussis
gccgcaucccgcccccgccgca

SEQ ID NO: 2370576 - RNA, 19 nt, Bordetella pertussis
gccgcaugaaaaaagcccc

SEQ ID NO: 2370577 - RNA, 20 nt, Bordetella pertussis
gccgcaugaaaaaagcccca

SEQ ID NO: 2370578 - RNA, 15 nt, Bordetella pertussis
gccgcaugccggcga

SEQ ID NO: 2370579 - RNA, 17 nt, Bordetella pertussis
gccgcaugccggcgaug

SEQ ID NO: 2370580 - RNA, 15 nt, Bordetella pertussis
gccgcaugccgggcu

SEQ ID NO: 2370581 - RNA, 16 nt, Bordetella pertussis
gccgcaugcggcggcu

SEQ ID NO: 2370582 - RNA, 17 nt, Bordetella pertussis
gccgcauggcggcccug

SEQ ID NO: 2370583 - RNA, 14 nt, Bordetella pertussis
gccgcaugggcgcg

SEQ ID NO: 2370584 - RNA, 15 nt, Bordetella pertussis
gccgcaugggcgcgc

SEQ ID NO: 2370585 - RNA, 16 nt, Bordetella pertussis
gccgcaugggcgcgcc

SEQ ID NO: 2370586 - RNA, 20 nt, Bordetella pertussis
gccgcaugggcgcgcccggc

SEQ ID NO: 2370587 - RNA, 19 nt, Bordetella pertussis
gccgcauugggacgcggcc

SEQ ID NO: 2370588 - RNA, 20 nt, Bordetella pertussis
gccgcauuuccucgaccagc

SEQ ID NO: 2370589 - RNA, 21 nt, Bordetella pertussis
gccgcauuuccucgaccagcg

SEQ ID NO: 2370590 - RNA, 22 nt, Bordetella pertussis
gccgcauuuccucgaccagcgc

SEQ ID NO: 2370591 - RNA, 23 nt, Bordetella pertussis
gccgcauuuccucgaccagcgcg

SEQ ID NO: 2370592 - RNA, 23 nt, Bordetella pertussis
gccgcauuucguaaagccgcacg

SEQ ID NO: 2370593 - RNA, 16 nt, Bordetella pertussis
gccgccaacgccaagc

SEQ ID NO: 2370594 - RNA, 21 nt, Bordetella pertussis
gccgccaacgccaagcugcug

SEQ ID NO: 2370595 - RNA, 22 nt, Bordetella pertussis
gccgccaacgccaagcugcugg

SEQ ID NO: 2370596 - RNA, 15 nt, Bordetella pertussis
gccgccaacgcggcg

SEQ ID NO: 2370597 - RNA, 23 nt, Bordetella pertussis
gccgccaacgcggcgcgugcaga

SEQ ID NO: 2370598 - RNA, 14 nt, Bordetella pertussis
gccgccaagggcgc

SEQ ID NO: 2370599 - RNA, 17 nt, Bordetella pertussis
gccgccaagggcgcgcc

SEQ ID NO: 2370600 - RNA, 18 nt, Bordetella pertussis
gccgccaagggcgcgcca

SEQ ID NO: 2370601 - RNA, 20 nt, Bordetella pertussis
gccgccaagggcgcgccagc

SEQ ID NO: 2370602 - RNA, 21 nt, Bordetella pertussis
gccgccaagggcgcgccagca

SEQ ID NO: 2370603 - RNA, 23 nt, Bordetella pertussis
gccgccaagggcgcgccagcacg

SEQ ID NO: 2370604 - RNA, 13 nt, Bordetella pertussis
gccgccacaggcu

SEQ ID NO: 2370605 - RNA, 21 nt, Bordetella pertussis
gccgccacaggcugacgcccg

SEQ ID NO: 2370606 - RNA, 23 nt, Bordetella pertussis
gccgccacaggcugacgcccggc

SEQ ID NO: 2370607 - RNA, 17 nt, Bordetella pertussis
gccgccaccaccucggc

SEQ ID NO: 2370608 - RNA, 13 nt, Bordetella pertussis
gccgccaccagcg

SEQ ID NO: 2370609 - RNA, 18 nt, Bordetella pertussis
gccgccaccagcgcgucg

SEQ ID NO: 2370610 - RNA, 14 nt, Bordetella pertussis
gccgccaccagcgg

SEQ ID NO: 2370611 - RNA, 15 nt, Bordetella pertussis
gccgccaccagcggc

SEQ ID NO: 2370612 - RNA, 20 nt, Bordetella pertussis
gccgccaccagcggcguggc

SEQ ID NO: 2370613 - RNA, 18 nt, Bordetella pertussis
gccgccaccagggcgccc

SEQ ID NO: 2370614 - RNA, 19 nt, Bordetella pertussis
gccgccaccagggcgcccg

SEQ ID NO: 2370615 - RNA, 22 nt, Bordetella pertussis
gccgccaccagggcgcccgccg

SEQ ID NO: 2370616 - RNA, 15 nt, Bordetella pertussis
gccgccacccaggcg

SEQ ID NO: 2370617 - RNA, 18 nt, Bordetella pertussis
gccgccacccaggcggca

SEQ ID NO: 2370618 - RNA, 21 nt, Bordetella pertussis
gccgccacccaggcggcaggc

SEQ ID NO: 2370619 - RNA, 23 nt, Bordetella pertussis
gccgccacccaggcggcaggcgc

SEQ ID NO: 2370620 - RNA, 12 nt, Bordetella pertussis
gccgccaccucg

SEQ ID NO: 2370621 - RNA, 16 nt, Bordetella pertussis
gccgccaccugggccg

SEQ ID NO: 2370622 - RNA, 17 nt, Bordetella pertussis
gccgccaccugggccgc

SEQ ID NO: 2370623 - RNA, 19 nt, Bordetella pertussis
gccgccaccugggccgccu

SEQ ID NO: 2370624 - RNA, 21 nt, Bordetella pertussis
gccgccaccugggccgccugc

SEQ ID NO: 2370625 - RNA, 22 nt, Bordetella pertussis
gccgccaccugggccgccugcu

SEQ ID NO: 2370626 - RNA, 14 nt, Bordetella pertussis
gccgccacgaaacc

SEQ ID NO: 2370627 - RNA, 22 nt, Bordetella pertussis
gccgccacgaaacccacggcga

SEQ ID NO: 2370628 - RNA, 16 nt, Bordetella pertussis
gccgccacgcccuggc

SEQ ID NO: 2370629 - RNA, 23 nt, Bordetella pertussis
gccgccacgcccuggcagcuggc

SEQ ID NO: 2370630 - RNA, 15 nt, Bordetella pertussis
gccgccacgcgcacg

SEQ ID NO: 2370631 - RNA, 16 nt, Bordetella pertussis
gccgccacgcgcacgg

SEQ ID NO: 2370632 - RNA, 18 nt, Bordetella pertussis
gccgccacgcgcacggcc

SEQ ID NO: 2370633 - RNA, 22 nt, Bordetella pertussis
gccgccacgcgcacggccagca

SEQ ID NO: 2370634 - RNA, 16 nt, Bordetella pertussis
gccgccacgcuggccg

SEQ ID NO: 2370635 - RNA, 15 nt, Bordetella pertussis
gccgccacgggcccg

SEQ ID NO: 2370636 - RNA, 22 nt, Bordetella pertussis
gccgccagcaaggcgucggcca

SEQ ID NO: 2370637 - RNA, 16 nt, Bordetella pertussis
gccgcccgcccgccgc

SEQ ID NO: 2370638 - RNA, 15 nt, Bordetella pertussis
gccgcccgccgggcc

SEQ ID NO: 2370639 - RNA, 16 nt, Bordetella pertussis
gccgcccgccugccgg

SEQ ID NO: 2370640 - RNA, 18 nt, Bordetella pertussis
gccgcccgccugccggcc

SEQ ID NO: 2370641 - RNA, 12 nt, Bordetella pertussis
gccgcccgcggc

SEQ ID NO: 2370642 - RNA, 13 nt, Bordetella pertussis
gccgcccgcggcc

SEQ ID NO: 2370643 - RNA, 14 nt, Bordetella pertussis
gccgcccgcggcca

SEQ ID NO: 2370644 - RNA, 15 nt, Bordetella pertussis
gccgcccgcggccag

SEQ ID NO: 2370645 - RNA, 16 nt, Bordetella pertussis
gccgcccgcggcggcc

SEQ ID NO: 2370646 - RNA, 11 nt, Bordetella pertussis
gccgcccggau

SEQ ID NO: 2370647 - RNA, 19 nt, Bordetella pertussis
gccgcccggaugggcggcc

SEQ ID NO: 2370648 - RNA, 11 nt, Bordetella pertussis
gccgcccggca

SEQ ID NO: 2370649 - RNA, 13 nt, Bordetella pertussis
gccgcccggccgg

SEQ ID NO: 2370650 - RNA, 14 nt, Bordetella pertussis
gccgcccggccggc

SEQ ID NO: 2370651 - RNA, 16 nt, Bordetella pertussis
gccgcccggccggcac

SEQ ID NO: 2370652 - RNA, 17 nt, Bordetella pertussis
gccgcccggccggcccg

SEQ ID NO: 2370653 - RNA, 22 nt, Bordetella pertussis
gccgcccggccggcccgcgcgc

SEQ ID NO: 2370654 - RNA, 15 nt, Bordetella pertussis
gccgcccguccgggc

SEQ ID NO: 2370655 - RNA, 19 nt, Bordetella pertussis
gccgcccguccgggcggcg

SEQ ID NO: 2370656 - RNA, 14 nt, Bordetella pertussis
gccgcccgugcaga

SEQ ID NO: 2370657 - RNA, 15 nt, Bordetella pertussis
gccgcccgugccagu

SEQ ID NO: 2370658 - RNA, 21 nt, Bordetella pertussis
gccgcccucgcccccgaaggc

SEQ ID NO: 2370659 - RNA, 20 nt, Bordetella pertussis
gccgcccugccgccaagggc

SEQ ID NO: 2370660 - RNA, 13 nt, Bordetella pertussis
gccgcccugcugc

SEQ ID NO: 2370661 - RNA, 20 nt, Bordetella pertussis
gccgcccugcugcccgccgc

SEQ ID NO: 2370662 - RNA, 13 nt, Bordetella pertussis
gccgcccuggccg

SEQ ID NO: 2370663 - RNA, 18 nt, Bordetella pertussis
gccgcccuggccgcgccg

SEQ ID NO: 2370664 - RNA, 18 nt, Bordetella pertussis
gccgcccuggcgcagggc

SEQ ID NO: 2370665 - RNA, 20 nt, Bordetella pertussis
gccgcccuggcgcagggcau

SEQ ID NO: 2370666 - RNA, 14 nt, Bordetella pertussis
gccgcccuggcgcg

SEQ ID NO: 2370667 - RNA, 18 nt, Bordetella pertussis
gccgcccuggcgcgaggc

SEQ ID NO: 2370668 - RNA, 22 nt, Bordetella pertussis
gccgcccuggucaucgccaugc

SEQ ID NO: 2370669 - RNA, 13 nt, Bordetella pertussis
gccgccgaaccag

SEQ ID NO: 2370670 - RNA, 17 nt, Bordetella pertussis
gccgccgaacgaggcgc

SEQ ID NO: 2370671 - RNA, 18 nt, Bordetella pertussis
gccgccgaacgaggcgcg

SEQ ID NO: 2370672 - RNA, 12 nt, Bordetella pertussis
gccgccgaacgg

SEQ ID NO: 2370673 - RNA, 16 nt, Bordetella pertussis
gccgccgaacggcacg

SEQ ID NO: 2370674 - RNA, 17 nt, Bordetella pertussis
gccgccgaacggcagca

SEQ ID NO: 2370675 - RNA, 19 nt, Bordetella pertussis
gccgccgaacggcagcagc

SEQ ID NO: 2370676 - RNA, 20 nt, Bordetella pertussis
gccgccgaacggcagcagcg

SEQ ID NO: 2370677 - RNA, 15 nt, Bordetella pertussis
gccgccgaacggggc

SEQ ID NO: 2370678 - RNA, 17 nt, Bordetella pertussis
gccgccgaacggggccg

SEQ ID NO: 2370679 - RNA, 14 nt, Bordetella pertussis
gccgccgaagccgc

SEQ ID NO: 2370680 - RNA, 16 nt, Bordetella pertussis
gccgccgaagccgccg

SEQ ID NO: 2370681 - RNA, 19 nt, Bordetella pertussis
gccgccgaagccgccgccg

SEQ ID NO: 2370682 - RNA, 17 nt, Bordetella pertussis
gccgccgaagggcaccg

SEQ ID NO: 2370683 - RNA, 14 nt, Bordetella pertussis
gccgccgaccucgu

SEQ ID NO: 2370684 - RNA, 19 nt, Bordetella pertussis
gccgccgaccucgucgggc

SEQ ID NO: 2370685 - RNA, 16 nt, Bordetella pertussis
gccgccgacgaugacc

SEQ ID NO: 2370686 - RNA, 18 nt, Bordetella pertussis
gccgccgacgccgccacg

SEQ ID NO: 2370687 - RNA, 17 nt, Bordetella pertussis
gccgccgacggcauggc

SEQ ID NO: 2370688 - RNA, 23 nt, Bordetella pertussis
gccgccgacggcauggcggccag

SEQ ID NO: 2370689 - RNA, 14 nt, Bordetella pertussis
gccgccgagcaggg

SEQ ID NO: 2370690 - RNA, 15 nt, Bordetella pertussis
gccgccgaggcggug

SEQ ID NO: 2370691 - RNA, 14 nt, Bordetella pertussis
gccgccgauggcgc

SEQ ID NO: 2370692 - RNA, 16 nt, Bordetella pertussis
gccgccgauggcgcca

SEQ ID NO: 2370693 - RNA, 20 nt, Bordetella pertussis
gccgccgauggcgccaccuu

SEQ ID NO: 2370694 - RNA, 15 nt, Bordetella pertussis
gccgccgauggcgcg

SEQ ID NO: 2370695 - RNA, 17 nt, Bordetella pertussis
gccgccgauggcgcgcg

SEQ ID NO: 2370696 - RNA, 18 nt, Bordetella pertussis
gccgccgauggcgcgcgg

SEQ ID NO: 2370697 - RNA, 20 nt, Bordetella pertussis
gccgccgauggcgcgcggcu

SEQ ID NO: 2370698 - RNA, 22 nt, Bordetella pertussis
gccgccgauguugaacagcugg

SEQ ID NO: 2370699 - RNA, 14 nt, Bordetella pertussis
gccgccgcacagcg

SEQ ID NO: 2370700 - RNA, 19 nt, Bordetella pertussis
gccgccgcagccgccagcg

SEQ ID NO: 2370701 - RNA, 14 nt, Bordetella pertussis
gccgccgcaggcua

SEQ ID NO: 2370702 - RNA, 15 nt, Bordetella pertussis
gccgccgcaugccgg

SEQ ID NO: 2370703 - RNA, 22 nt, Bordetella pertussis
gccgccgccaccaccucggccu

SEQ ID NO: 2370704 - RNA, 16 nt, Bordetella pertussis
gccgccgccaccagcg

SEQ ID NO: 2370705 - RNA, 12 nt, Bordetella pertussis
gccgccgccagc

SEQ ID NO: 2370706 - RNA, 14 nt, Bordetella pertussis
gccgccgccagccu

SEQ ID NO: 2370707 - RNA, 19 nt, Bordetella pertussis
gccgccgccagcgcgccgc

SEQ ID NO: 2370708 - RNA, 14 nt, Bordetella pertussis
gccgccgccauggu

SEQ ID NO: 2370709 - RNA, 19 nt, Bordetella pertussis
gccgccgcccacgccgccu

SEQ ID NO: 2370710 - RNA, 13 nt, Bordetella pertussis
gccgccgcccgca

SEQ ID NO: 2370711 - RNA, 15 nt, Bordetella pertussis
gccgccgcccgcacg

SEQ ID NO: 2370712 - RNA, 14 nt, Bordetella pertussis
gccgccgcccgccc

SEQ ID NO: 2370713 - RNA, 16 nt, Bordetella pertussis
gccgccgcccgcccgc

SEQ ID NO: 2370714 - RNA, 17 nt, Bordetella pertussis
gccgccgcccgcccgcc

SEQ ID NO: 2370715 - RNA, 22 nt, Bordetella pertussis
gccgccgcccgcccgccgccug

SEQ ID NO: 2370716 - RNA, 14 nt, Bordetella pertussis
gccgccgcccggca

SEQ ID NO: 2370717 - RNA, 13 nt, Bordetella pertussis
gccgccgcccugg

SEQ ID NO: 2370718 - RNA, 12 nt, Bordetella pertussis
gccgccgccgcg

SEQ ID NO: 2370719 - RNA, 13 nt, Bordetella pertussis
gccgccgccgcgc

SEQ ID NO: 2370720 - RNA, 16 nt, Bordetella pertussis
gccgccgccgcgcgcg

SEQ ID NO: 2370721 - RNA, 14 nt, Bordetella pertussis
gccgccgccgcggc

SEQ ID NO: 2370722 - RNA, 15 nt, Bordetella pertussis
gccgccgccgcggcc

SEQ ID NO: 2370723 - RNA, 12 nt, Bordetella pertussis
gccgccgccggc

SEQ ID NO: 2370724 - RNA, 13 nt, Bordetella pertussis
gccgccgccggca

SEQ ID NO: 2370725 - RNA, 13 nt, Bordetella pertussis
gccgccgccggcg

SEQ ID NO: 2370726 - RNA, 15 nt, Bordetella pertussis
gccgccgccggcgcg

SEQ ID NO: 2370727 - RNA, 21 nt, Bordetella pertussis
gccgccgcgauugcagguggc

SEQ ID NO: 2370728 - RNA, 13 nt, Bordetella pertussis
gccgccgcgcacc

SEQ ID NO: 2370729 - RNA, 18 nt, Bordetella pertussis
gccgccgcgcaccaccga

SEQ ID NO: 2370730 - RNA, 14 nt, Bordetella pertussis
gccgccgcgcagcc

SEQ ID NO: 2370731 - RNA, 20 nt, Bordetella pertussis
gccgccgcgcagccgacagg

SEQ ID NO: 2370732 - RNA, 13 nt, Bordetella pertussis
gccgccgcgcagg

SEQ ID NO: 2370733 - RNA, 18 nt, Bordetella pertussis
gccgccgcgcccagcagc

SEQ ID NO: 2370734 - RNA, 17 nt, Bordetella pertussis
gccgccgcgcccagccg

SEQ ID NO: 2370735 - RNA, 19 nt, Bordetella pertussis
gccgccgcgcccagccgcg

SEQ ID NO: 2370736 - RNA, 19 nt, Bordetella pertussis
gccgccgcgcccuggcgcg

SEQ ID NO: 2370737 - RNA, 12 nt, Bordetella pertussis
gccgccgcgccg

SEQ ID NO: 2370738 - RNA, 17 nt, Bordetella pertussis
gccgccgcgccgaacgc

SEQ ID NO: 2370739 - RNA, 13 nt, Bordetella pertussis
gccgccgcgcgcc

SEQ ID NO: 2370740 - RNA, 15 nt, Bordetella pertussis
gccgccgcgcgccgc

SEQ ID NO: 2370741 - RNA, 16 nt, Bordetella pertussis
gccgccgcgcgccgcg

SEQ ID NO: 2370742 - RNA, 14 nt, Bordetella pertussis
gccgccgcgcgcgg

SEQ ID NO: 2370743 - RNA, 16 nt, Bordetella pertussis
gccgccgcgcgcggca

SEQ ID NO: 2370744 - RNA, 17 nt, Bordetella pertussis
gccgccgcgcgcggcaa

SEQ ID NO: 2370745 - RNA, 16 nt, Bordetella pertussis
gccgccgcgcgcuggc

SEQ ID NO: 2370746 - RNA, 20 nt, Bordetella pertussis
gccgccgcgcgcuggcugug

SEQ ID NO: 2370747 - RNA, 21 nt, Bordetella pertussis
gccgccgcgcgcuggcugugc

SEQ ID NO: 2370748 - RNA, 14 nt, Bordetella pertussis
gccgccgcgcggcg

SEQ ID NO: 2370749 - RNA, 22 nt, Bordetella pertussis
gccgccgcgcucaccgagggcc

SEQ ID NO: 2370750 - RNA, 23 nt, Bordetella pertussis
gccgccgcgcucggcgcugccgg

SEQ ID NO: 2370751 - RNA, 12 nt, Bordetella pertussis
gccgccgcggcc

SEQ ID NO: 2370752 - RNA, 13 nt, Bordetella pertussis
gccgccugcgccg

SEQ ID NO: 2370753 - RNA, 14 nt, Bordetella pertussis
gccgccugcgcgaa

SEQ ID NO: 2370754 - RNA, 15 nt, Bordetella pertussis
gccgccugcggcgcg

SEQ ID NO: 2370755 - RNA, 18 nt, Bordetella pertussis
gccgccugcggcgcggcc

SEQ ID NO: 2370756 - RNA, 14 nt, Bordetella pertussis
gccgccugcugcgc

SEQ ID NO: 2370757 - RNA, 22 nt, Bordetella pertussis
gccgccuggaccugacccccga

SEQ ID NO: 2370758 - RNA, 15 nt, Bordetella pertussis
gccgccuggccagau

SEQ ID NO: 2370759 - RNA, 13 nt, Bordetella pertussis
gccgccuggccca

SEQ ID NO: 2370760 - RNA, 14 nt, Bordetella pertussis
gccgccuggcccac

SEQ ID NO: 2370761 - RNA, 21 nt, Bordetella pertussis
gccgccuggcccaugaacagg

SEQ ID NO: 2370762 - RNA, 20 nt, Bordetella pertussis
gccgccuggcuuucgccgcg

SEQ ID NO: 2370763 - RNA, 22 nt, Bordetella pertussis
gccgccugguaguaaucgcgcg

SEQ ID NO: 2370764 - RNA, 15 nt, Bordetella pertussis
gccgccuucaccggc

SEQ ID NO: 2370765 - RNA, 15 nt, Bordetella pertussis
gccgccuucccaggc

SEQ ID NO: 2370766 - RNA, 16 nt, Bordetella pertussis
gccgccuucccaggcg

SEQ ID NO: 2370767 - RNA, 18 nt, Bordetella pertussis
gccgccuucccaggcgag

SEQ ID NO: 2370768 - RNA, 17 nt, Bordetella pertussis
gccgccuucgggcgguu

SEQ ID NO: 2370769 - RNA, 20 nt, Bordetella pertussis
gccgccuucgucgcgcaccc

SEQ ID NO: 2370770 - RNA, 19 nt, Bordetella pertussis
gccgccuuggacgcgcugu

SEQ ID NO: 2370771 - RNA, 17 nt, Bordetella pertussis
gccgccuuuucgcagcg

SEQ ID NO: 2370772 - RNA, 20 nt, Bordetella pertussis
gccgccuuuucgcagcggau

SEQ ID NO: 2370773 - RNA, 15 nt, Bordetella pertussis
gccgcgaacgcgccg

SEQ ID NO: 2370774 - RNA, 20 nt, Bordetella pertussis
gccgcgaacgcgccggccca

SEQ ID NO: 2370775 - RNA, 21 nt, Bordetella pertussis
gccgcgaacgcgccggcccag

SEQ ID NO: 2370776 - RNA, 23 nt, Bordetella pertussis
gccgcgacacaaggcggccgcgc

SEQ ID NO: 2370777 - RNA, 16 nt, Bordetella pertussis
gccgcgaccaccagca

SEQ ID NO: 2370778 - RNA, 20 nt, Bordetella pertussis
gccgcgaccaccagcaccau

SEQ ID NO: 2370779 - RNA, 24 nt, Bordetella pertussis
gccgcgaccacggucuggcgcgac

SEQ ID NO: 2370780 - RNA, 15 nt, Bordetella pertussis
gccgcgaccgggccg

SEQ ID NO: 2370781 - RNA, 13 nt, Bordetella pertussis
gccgcgagcaugc

SEQ ID NO: 2370782 - RNA, 17 nt, Bordetella pertussis
gccgcgagcaugcgcag

SEQ ID NO: 2370783 - RNA, 13 nt, Bordetella pertussis
gccgcgaggcgca

SEQ ID NO: 2370784 - RNA, 14 nt, Bordetella pertussis
gccgcgaggcgcag

SEQ ID NO: 2370785 - RNA, 15 nt, Bordetella pertussis
gccgcgaggcgcagg

SEQ ID NO: 2370786 - RNA, 16 nt, Bordetella pertussis
gccgcgaggcgcaggc

SEQ ID NO: 2370787 - RNA, 22 nt, Bordetella pertussis
gccgcgaggcgcaggccgacgc

SEQ ID NO: 2370788 - RNA, 18 nt, Bordetella pertussis
gccgcgauauccuugcgc

SEQ ID NO: 2370789 - RNA, 22 nt, Bordetella pertussis
gccgcgauauccuugcgcucgc

SEQ ID NO: 2370790 - RNA, 20 nt, Bordetella pertussis
gccgcgauauugaaggccga

SEQ ID NO: 2370791 - RNA, 21 nt, Bordetella pertussis
gccgcgauauugaaggccgag

SEQ ID NO: 2370792 - RNA, 23 nt, Bordetella pertussis
gccgcgauauugaaggccgaggc

SEQ ID NO: 2370793 - RNA, 16 nt, Bordetella pertussis
gccgcgaucagcgcgg

SEQ ID NO: 2370794 - RNA, 18 nt, Bordetella pertussis
gccgcgaucagcgcggcc

SEQ ID NO: 2370795 - RNA, 19 nt, Bordetella pertussis
gccgcgaucagcgcggccg

SEQ ID NO: 2370796 - RNA, 12 nt, Bordetella pertussis
gccgcgaucgag

SEQ ID NO: 2370797 - RNA, 18 nt, Bordetella pertussis
gccgcgaugcaugaaccg

SEQ ID NO: 2370798 - RNA, 21 nt, Bordetella pertussis
gccgcgaugcaugaaccgcag

SEQ ID NO: 2370799 - RNA, 16 nt, Bordetella pertussis
gccgcgauggcgccgg

SEQ ID NO: 2370800 - RNA, 18 nt, Bordetella pertussis
gccgcgauggcgccggcc

SEQ ID NO: 2370801 - RNA, 19 nt, Bordetella pertussis
gccgcgauggcgccggcca

SEQ ID NO: 2370802 - RNA, 23 nt, Bordetella pertussis
gccgcgauggcgccggccagcgc

SEQ ID NO: 2370803 - RNA, 15 nt, Bordetella pertussis
gccgcgaugucgcgc

SEQ ID NO: 2370804 - RNA, 16 nt, Bordetella pertussis
gccgcgaugucgcgcg

SEQ ID NO: 2370805 - RNA, 19 nt, Bordetella pertussis
gccgcgaugucgcgcgcgc

SEQ ID NO: 2370806 - RNA, 18 nt, Bordetella pertussis
gccgcgauugcagguggc

SEQ ID NO: 2370807 - RNA, 23 nt, Bordetella pertussis
gccgcgauugcagguggccagcc

SEQ ID NO: 2370808 - RNA, 19 nt, Bordetella pertussis
gccgcgauuucguccgggg

SEQ ID NO: 2370809 - RNA, 14 nt, Bordetella pertussis
gccgcgcaaggccu

SEQ ID NO: 2370810 - RNA, 19 nt, Bordetella pertussis
gccgcgcaaggccugcucg

SEQ ID NO: 2370811 - RNA, 13 nt, Bordetella pertussis
gccgcgcaaggcg

SEQ ID NO: 2370812 - RNA, 15 nt, Bordetella pertussis
gccgcgcaaggcggc

SEQ ID NO: 2370813 - RNA, 16 nt, Bordetella pertussis
gccgcgcaaggcggcc

SEQ ID NO: 2370814 - RNA, 17 nt, Bordetella pertussis
gccgcgcaaggcggccc

SEQ ID NO: 2370815 - RNA, 19 nt, Bordetella pertussis
gccgcgcacacauggcgca

SEQ ID NO: 2370816 - RNA, 17 nt, Bordetella pertussis
gccgcgcacagcccgau

SEQ ID NO: 2370817 - RNA, 19 nt, Bordetella pertussis
gccgcgcacccaggcccau

SEQ ID NO: 2370818 - RNA, 21 nt, Bordetella pertussis
gccgcgcaccugcugcggcac

SEQ ID NO: 2370819 - RNA, 22 nt, Bordetella pertussis
gccgcgcaccugcugcggcacg

SEQ ID NO: 2370820 - RNA, 15 nt, Bordetella pertussis
gccgcgcaccugggc

SEQ ID NO: 2370821 - RNA, 17 nt, Bordetella pertussis
gccgcgcaccugggcgu

SEQ ID NO: 2370822 - RNA, 20 nt, Bordetella pertussis
gccgcgcacgauggggcagc

SEQ ID NO: 2370823 - RNA, 15 nt, Bordetella pertussis
gccgcgcacgggcgc

SEQ ID NO: 2370824 - RNA, 17 nt, Bordetella pertussis
gccgcgcacgggcgccu

SEQ ID NO: 2370825 - RNA, 18 nt, Bordetella pertussis
gccgcgcacgggcgccug

SEQ ID NO: 2370826 - RNA, 14 nt, Bordetella pertussis
gccgcgcagcacgc

SEQ ID NO: 2370827 - RNA, 13 nt, Bordetella pertussis
gccgcgcagcagc

SEQ ID NO: 2370828 - RNA, 15 nt, Bordetella pertussis
gccgcgcagcagcaa

SEQ ID NO: 2370829 - RNA, 11 nt, Bordetella pertussis
gccgcgcagcg

SEQ ID NO: 2370830 - RNA, 19 nt, Bordetella pertussis
gccgcgcagcgucugcgca

SEQ ID NO: 2370831 - RNA, 20 nt, Bordetella pertussis
gccgcgcagcgucugcgcau

SEQ ID NO: 2370832 - RNA, 20 nt, Bordetella pertussis
gccgcgcaggaugacguggc

SEQ ID NO: 2370833 - RNA, 22 nt, Bordetella pertussis
gccgcgcaggauuucaucgccc

SEQ ID NO: 2370834 - RNA, 13 nt, Bordetella pertussis
gccgcgcaggccc

SEQ ID NO: 2370835 - RNA, 14 nt, Bordetella pertussis
gccgcgcagggcau

SEQ ID NO: 2370836 - RNA, 17 nt, Bordetella pertussis
gccgcgcaggucggcga

SEQ ID NO: 2370837 - RNA, 19 nt, Bordetella pertussis
gccgcgcaggucggcgaug

SEQ ID NO: 2370838 - RNA, 22 nt, Bordetella pertussis
gccgcgcaggucggcgaugcgc

SEQ ID NO: 2370839 - RNA, 19 nt, Bordetella pertussis
gccgcgcaucgaucaggcu

SEQ ID NO: 2370840 - RNA, 15 nt, Bordetella pertussis
gccgcgcaugccagc

SEQ ID NO: 2370841 - RNA, 19 nt, Bordetella pertussis
gccgcgcauuugccgcggc

SEQ ID NO: 2370842 - RNA, 23 nt, Bordetella pertussis
gccgcgcauuugccgcggcgaag

SEQ ID NO: 2370843 - RNA, 13 nt, Bordetella pertussis
gccgcgccacagg

SEQ ID NO: 2370844 - RNA, 14 nt, Bordetella pertussis
gccgcgccacaggc

SEQ ID NO: 2370845 - RNA, 13 nt, Bordetella pertussis
gccgcgccagcgc

SEQ ID NO: 2370846 - RNA, 15 nt, Bordetella pertussis
gccgcgccagcgccu

SEQ ID NO: 2370847 - RNA, 16 nt, Bordetella pertussis
gccgcgccagcugcgc

SEQ ID NO: 2370848 - RNA, 18 nt, Bordetella pertussis
gccgcgccagcugcgcag

SEQ ID NO: 2370849 - RNA, 23 nt, Bordetella pertussis
gccgcgccagcugcgcagcgacu

SEQ ID NO: 2370850 - RNA, 13 nt, Bordetella pertussis
gccgcgccaggca

SEQ ID NO: 2370851 - RNA, 14 nt, Bordetella pertussis
gccgcgccagggcg

SEQ ID NO: 2370852 - RNA, 16 nt, Bordetella pertussis
gccgcgccagggcgcg

SEQ ID NO: 2370853 - RNA, 22 nt, Bordetella pertussis
gccgcgccagguaggccggcgc

SEQ ID NO: 2370854 - RNA, 17 nt, Bordetella pertussis
gccgcgccaugcucgcg

SEQ ID NO: 2370855 - RNA, 21 nt, Bordetella pertussis
gccgcgccaugcucgcgcaca

SEQ ID NO: 2370856 - RNA, 16 nt, Bordetella pertussis
gccgcgcccagcagcg

SEQ ID NO: 2370857 - RNA, 22 nt, Bordetella pertussis
gccgcgcccagcagcgccaccg

SEQ ID NO: 2370858 - RNA, 15 nt, Bordetella pertussis
gccgcgcccagcaug

SEQ ID NO: 2370859 - RNA, 21 nt, Bordetella pertussis
gccgcgcccagcauggucggc

SEQ ID NO: 2370860 - RNA, 13 nt, Bordetella pertussis
gccgcgcccagcc

SEQ ID NO: 2370861 - RNA, 15 nt, Bordetella pertussis
gccgcgcccagccgc

SEQ ID NO: 2370862 - RNA, 16 nt, Bordetella pertussis
gccgcgcccagccgcg

SEQ ID NO: 2370863 - RNA, 21 nt, Bordetella pertussis
gccgcgcccagccgcgccauc

SEQ ID NO: 2370864 - RNA, 18 nt, Bordetella pertussis
gccgcgcccagcgcggcc

SEQ ID NO: 2370865 - RNA, 23 nt, Bordetella pertussis
gccgcgcgcguauggcggcgccg

SEQ ID NO: 2370866 - RNA, 16 nt, Bordetella pertussis
gccgcgcgcgucgccg

SEQ ID NO: 2370867 - RNA, 20 nt, Bordetella pertussis
gccgcgcgcgucgccgcugg

SEQ ID NO: 2370868 - RNA, 23 nt, Bordetella pertussis
gccgcgcgcgugccgcaggccag

SEQ ID NO: 2370869 - RNA, 14 nt, Bordetella pertussis
gccgcgcgcuggcu

SEQ ID NO: 2370870 - RNA, 14 nt, Bordetella pertussis
gccgcgcgcugguc

SEQ ID NO: 2370871 - RNA, 19 nt, Bordetella pertussis
gccgcgcgcuggucgggau

SEQ ID NO: 2370872 - RNA, 13 nt, Bordetella pertussis
gccgcgcggccgg

SEQ ID NO: 2370873 - RNA, 20 nt, Bordetella pertussis
gccgcgcggccggcuugcgc

SEQ ID NO: 2370874 - RNA, 14 nt, Bordetella pertussis
gccgcgcggccggg

SEQ ID NO: 2370875 - RNA, 15 nt, Bordetella pertussis
gccgcgcggccguca

SEQ ID NO: 2370876 - RNA, 18 nt, Bordetella pertussis
gccgcgcggccgucaggc

SEQ ID NO: 2370877 - RNA, 13 nt, Bordetella pertussis
gccgcgcggcgag

SEQ ID NO: 2370878 - RNA, 16 nt, Bordetella pertussis
gccgcgcggcgccugc

SEQ ID NO: 2370879 - RNA, 18 nt, Bordetella pertussis
gccgcgcggcgccugccu

SEQ ID NO: 2370880 - RNA, 13 nt, Bordetella pertussis
gccgcgcggcgga

SEQ ID NO: 2370881 - RNA, 15 nt, Bordetella pertussis
gccgcgcgggcggcc

SEQ ID NO: 2370882 - RNA, 19 nt, Bordetella pertussis
gccgcgcgggcggcccgca

SEQ ID NO: 2370883 - RNA, 22 nt, Bordetella pertussis
gccgcgcgguacgcaccgccgc

SEQ ID NO: 2370884 - RNA, 13 nt, Bordetella pertussis
gccgcgcguacgc

SEQ ID NO: 2370885 - RNA, 16 nt, Bordetella pertussis
gccgcgcguacgcggc

SEQ ID NO: 2370886 - RNA, 17 nt, Bordetella pertussis
gccgcgcguacgcggcg

SEQ ID NO: 2370887 - RNA, 19 nt, Bordetella pertussis
gccgcgcguacgcggcgcg

SEQ ID NO: 2370888 - RNA, 17 nt, Bordetella pertussis
gccgcgcguaugcaccg

SEQ ID NO: 2370889 - RNA, 20 nt, Bordetella pertussis
gccgcgcgugcggggcggca

SEQ ID NO: 2370890 - RNA, 16 nt, Bordetella pertussis
gccgcgcucaccgagg

SEQ ID NO: 2370891 - RNA, 18 nt, Bordetella pertussis
gccgcgcucaccgagggc

SEQ ID NO: 2370892 - RNA, 13 nt, Bordetella pertussis
gccgcgcucagca

SEQ ID NO: 2370893 - RNA, 16 nt, Bordetella pertussis
gccgcgcucagcacca

SEQ ID NO: 2370894 - RNA, 19 nt, Bordetella pertussis
gccgcgcucagcaccaggc

SEQ ID NO: 2370895 - RNA, 20 nt, Bordetella pertussis
gccgcgcucagcaccaggcc

SEQ ID NO: 2370896 - RNA, 13 nt, Bordetella pertussis
gccgcgcucagcc

SEQ ID NO: 2370897 - RNA, 16 nt, Bordetella pertussis
gccgcgcucaggccgc

SEQ ID NO: 2370898 - RNA, 20 nt, Bordetella pertussis
gccgcgcucaggccgcuggg

SEQ ID NO: 2370899 - RNA, 21 nt, Bordetella pertussis
gccgcgcucaggccgcugggc

SEQ ID NO: 2370900 - RNA, 23 nt, Bordetella pertussis
gccgcgcucaggccgcugggcac

SEQ ID NO: 2370901 - RNA, 13 nt, Bordetella pertussis
gccgcgcuccagg

SEQ ID NO: 2370902 - RNA, 18 nt, Bordetella pertussis
gccgcgcuccagggcguc

SEQ ID NO: 2370903 - RNA, 13 nt, Bordetella pertussis
gccgcgcucgcgc

SEQ ID NO: 2370904 - RNA, 16 nt, Bordetella pertussis
gccgcgcucgcgccag

SEQ ID NO: 2370905 - RNA, 17 nt, Bordetella pertussis
gccgcgcucgcgccagg

SEQ ID NO: 2370906 - RNA, 16 nt, Bordetella pertussis
gccgcgcucggcgcug

SEQ ID NO: 2370907 - RNA, 19 nt, Bordetella pertussis
gccgcgcucggcgcugccg

SEQ ID NO: 2370908 - RNA, 18 nt, Bordetella pertussis
gccgcgcugauccuggcu

SEQ ID NO: 2370909 - RNA, 20 nt, Bordetella pertussis
gccgcgcugauccuggcucu

SEQ ID NO: 2370910 - RNA, 11 nt, Bordetella pertussis
gccgcgcugcc

SEQ ID NO: 2370911 - RNA, 15 nt, Bordetella pertussis
gccgcgcugccagcc

SEQ ID NO: 2370912 - RNA, 16 nt, Bordetella pertussis
gccgcgcugccagcca

SEQ ID NO: 2370913 - RNA, 21 nt, Bordetella pertussis
gccgcgcugcccgagaagggc

SEQ ID NO: 2370914 - RNA, 12 nt, Bordetella pertussis
gccgcgcugccu

SEQ ID NO: 2370915 - RNA, 22 nt, Bordetella pertussis
gccgcgcugcugcaggccggcg

SEQ ID NO: 2370916 - RNA, 20 nt, Bordetella pertussis
gccgcgcuggaagacguggc

SEQ ID NO: 2370917 - RNA, 12 nt, Bordetella pertussis
gccgcgcuggcg

SEQ ID NO: 2370918 - RNA, 13 nt, Bordetella pertussis
gccgcgcuggcgc

SEQ ID NO: 2370919 - RNA, 14 nt, Bordetella pertussis
gccgcgcuggcgcu

SEQ ID NO: 2370920 - RNA, 15 nt, Bordetella pertussis
gccgcgcuggcggcg

SEQ ID NO: 2370921 - RNA, 22 nt, Bordetella pertussis
gccgcgcuggcggcgcaggccg

SEQ ID NO: 2370922 - RNA, 12 nt, Bordetella pertussis
gccgcgcugggc

SEQ ID NO: 2370923 - RNA, 17 nt, Bordetella pertussis
gccgcgcugggcgcugc

SEQ ID NO: 2370924 - RNA, 23 nt, Bordetella pertussis
gccgcgcugggcgcugcugcugu

SEQ ID NO: 2370925 - RNA, 13 nt, Bordetella pertussis
gccgcgcuggugc

SEQ ID NO: 2370926 - RNA, 19 nt, Bordetella pertussis
gccgcgcuggugcuggccg

SEQ ID NO: 2370927 - RNA, 17 nt, Bordetella pertussis
gccgcgcugugcgacga

SEQ ID NO: 2370928 - RNA, 17 nt, Bordetella pertussis
gccgcgcuucgucggcg

SEQ ID NO: 2370929 - RNA, 18 nt, Bordetella pertussis
gccgcgcuucgucggcgu

SEQ ID NO: 2370930 - RNA, 20 nt, Bordetella pertussis
gccgcgcuucgucggcgucg

SEQ ID NO: 2370931 - RNA, 19 nt, Bordetella pertussis
gccgcggaagucgggcacc

SEQ ID NO: 2370932 - RNA, 23 nt, Bordetella pertussis
gccgcggaagucgggcaccagca

SEQ ID NO: 2370933 - RNA, 17 nt, Bordetella pertussis
gccgcggacccaggccu

SEQ ID NO: 2370934 - RNA, 14 nt, Bordetella pertussis
gccgcggacgaagc

SEQ ID NO: 2370935 - RNA, 20 nt, Bordetella pertussis
gccgcggauugccguccugg

SEQ ID NO: 2370936 - RNA, 21 nt, Bordetella pertussis
gccgcggauugccguccuggc

SEQ ID NO: 2370937 - RNA, 22 nt, Bordetella pertussis
gccgcggauugccguccuggcg

SEQ ID NO: 2370938 - RNA, 18 nt, Bordetella pertussis
gccgcggcaagccgcggc

SEQ ID NO: 2370939 - RNA, 19 nt, Bordetella pertussis
gccgcggcaggccccggcc

SEQ ID NO: 2370940 - RNA, 13 nt, Bordetella pertussis
gccgcggccagcg

SEQ ID NO: 2370941 - RNA, 14 nt, Bordetella pertussis
gccgcggccaggcc

SEQ ID NO: 2370942 - RNA, 13 nt, Bordetella pertussis
gccgcggcccagc

SEQ ID NO: 2370943 - RNA, 14 nt, Bordetella pertussis
gccgcggcccagcg

SEQ ID NO: 2370944 - RNA, 13 nt, Bordetella pertussis
gccgcggccgccc

SEQ ID NO: 2370945 - RNA, 14 nt, Bordetella pertussis
gccgcggccgcccc

SEQ ID NO: 2370946 - RNA, 14 nt, Bordetella pertussis
gccgcggccgccgu

SEQ ID NO: 2370947 - RNA, 15 nt, Bordetella pertussis
gccgcggccggcacg

SEQ ID NO: 2370948 - RNA, 16 nt, Bordetella pertussis
gccgcggccggcacgc

SEQ ID NO: 2370949 - RNA, 19 nt, Bordetella pertussis
gccgcggccggcacgccca

SEQ ID NO: 2370950 - RNA, 14 nt, Bordetella pertussis
gccgcggccggcgc

SEQ ID NO: 2370951 - RNA, 15 nt, Bordetella pertussis
gccgcggccggcgca

SEQ ID NO: 2370952 - RNA, 16 nt, Bordetella pertussis
gccgcggccggcgcag

SEQ ID NO: 2370953 - RNA, 16 nt, Bordetella pertussis
gccgcggccggcggcg

SEQ ID NO: 2370954 - RNA, 13 nt, Bordetella pertussis
gccgcggccgggu

SEQ ID NO: 2370955 - RNA, 13 nt, Bordetella pertussis
gccgcggccucgg

SEQ ID NO: 2370956 - RNA, 18 nt, Bordetella pertussis
gccgcggccuggccgggg

SEQ ID NO: 2370957 - RNA, 17 nt, Bordetella pertussis
gccgcggcgagcucggc

SEQ ID NO: 2370958 - RNA, 19 nt, Bordetella pertussis
gccgcggcgagcucggcau

SEQ ID NO: 2370959 - RNA, 18 nt, Bordetella pertussis
gccgcggcgaugccggcc

SEQ ID NO: 2370960 - RNA, 19 nt, Bordetella pertussis
gccgcggcgaugccggcca

SEQ ID NO: 2370961 - RNA, 20 nt, Bordetella pertussis
gccgcggcgaugccggccag

SEQ ID NO: 2370962 - RNA, 22 nt, Bordetella pertussis
gccgcggcgaugccggccagca

SEQ ID NO: 2370963 - RNA, 14 nt, Bordetella pertussis
gccgcggcgcccgg

SEQ ID NO: 2370964 - RNA, 13 nt, Bordetella pertussis
gccgcggcgccgc

SEQ ID NO: 2370965 - RNA, 13 nt, Bordetella pertussis
gccgcggcgcgcg

SEQ ID NO: 2370966 - RNA, 14 nt, Bordetella pertussis
gccgcggcgcgcgc

SEQ ID NO: 2370967 - RNA, 15 nt, Bordetella pertussis
gccgcggcgcgcgcg

SEQ ID NO: 2370968 - RNA, 12 nt, Bordetella pertussis
gccgcggcgcgg

SEQ ID NO: 2370969 - RNA, 14 nt, Bordetella pertussis
gccgcggcgcggcc

SEQ ID NO: 2370970 - RNA, 16 nt, Bordetella pertussis
gccgcggcgcggcccg

SEQ ID NO: 2370971 - RNA, 17 nt, Bordetella pertussis
gccgcggcgcggcccgc

SEQ ID NO: 2370972 - RNA, 20 nt, Bordetella pertussis
gccgcggcgcggcccgccac

SEQ ID NO: 2370973 - RNA, 22 nt, Bordetella pertussis
gccgcggcgcggcccgccacgc

SEQ ID NO: 2370974 - RNA, 16 nt, Bordetella pertussis
gccgcggcgcggccuu

SEQ ID NO: 2370975 - RNA, 11 nt, Bordetella pertussis
gccgcggcggc

SEQ ID NO: 2370976 - RNA, 14 nt, Bordetella pertussis
gccgcggcggcgag

SEQ ID NO: 2370977 - RNA, 13 nt, Bordetella pertussis
gccgcggcgggcu

SEQ ID NO: 2370978 - RNA, 18 nt, Bordetella pertussis
gccgcggcgguuucggcc

SEQ ID NO: 2370979 - RNA, 23 nt, Bordetella pertussis
gccgcucguaguguuccugguag

SEQ ID NO: 2370980 - RNA, 15 nt, Bordetella pertussis
gccgcucuuggcgug

SEQ ID NO: 2370981 - RNA, 15 nt, Bordetella pertussis
gccgcugaccagcac

SEQ ID NO: 2370982 - RNA, 16 nt, Bordetella pertussis
gccgcugaccagcacg

SEQ ID NO: 2370983 - RNA, 17 nt, Bordetella pertussis
gccgcugaccagcacga

SEQ ID NO: 2370984 - RNA, 16 nt, Bordetella pertussis
gccgcugaccggcggc

SEQ ID NO: 2370985 - RNA, 17 nt, Bordetella pertussis
gccgcugaccggcggca

SEQ ID NO: 2370986 - RNA, 19 nt, Bordetella pertussis
gccgcugaccggcggcacg

SEQ ID NO: 2370987 - RNA, 20 nt, Bordetella pertussis
gccgcugaccggcggcacgg

SEQ ID NO: 2370988 - RNA, 22 nt, Bordetella pertussis
gccgcugaccggcggcacggcc

SEQ ID NO: 2370989 - RNA, 19 nt, Bordetella pertussis
gccgcugaucuuccugggc

SEQ ID NO: 2370990 - RNA, 16 nt, Bordetella pertussis
gccgcugaugcuggca

SEQ ID NO: 2370991 - RNA, 17 nt, Bordetella pertussis
gccgcugauggcgguca

SEQ ID NO: 2370992 - RNA, 23 nt, Bordetella pertussis
gccgcugauggcggucaccaacg

SEQ ID NO: 2370993 - RNA, 21 nt, Bordetella pertussis
gccgcugcagaucaucggcgc

SEQ ID NO: 2370994 - RNA, 23 nt, Bordetella pertussis
gccgcugcagaucaucggcgcca

SEQ ID NO: 2370995 - RNA, 22 nt, Bordetella pertussis
gccgcugcagcacgcaccaggc

SEQ ID NO: 2370996 - RNA, 15 nt, Bordetella pertussis
gccgcugcagcgacu

SEQ ID NO: 2370997 - RNA, 19 nt, Bordetella pertussis
gccgcugcagcgcugguuc

SEQ ID NO: 2370998 - RNA, 15 nt, Bordetella pertussis
gccgcugcaggcccu

SEQ ID NO: 2370999 - RNA, 18 nt, Bordetella pertussis
gccgcugcaugggcggcc

SEQ ID NO: 2371000 - RNA, 20 nt, Bordetella pertussis
gccgcugcaugggcggcccg

SEQ ID NO: 2371001 - RNA, 21 nt, Bordetella pertussis
gccgcugcaugggcggcccgc

SEQ ID NO: 2371002 - RNA, 13 nt, Bordetella pertussis
gccgcugcccacc

SEQ ID NO: 2371003 - RNA, 16 nt, Bordetella pertussis
gccgcugcccaccuuc

SEQ ID NO: 2371004 - RNA, 20 nt, Bordetella pertussis
gccgcugcccaccuuccugc

SEQ ID NO: 2371005 - RNA, 14 nt, Bordetella pertussis
gccgcugcccagcg

SEQ ID NO: 2371006 - RNA, 13 nt, Bordetella pertussis
gccgcugccgcgc

SEQ ID NO: 2371007 - RNA, 16 nt, Bordetella pertussis
gccgcugccgcgcgcc

SEQ ID NO: 2371008 - RNA, 13 nt, Bordetella pertussis
gccgcugccggcc

SEQ ID NO: 2371009 - RNA, 23 nt, Bordetella pertussis
gccgcugccgggcucggccacca

SEQ ID NO: 2371010 - RNA, 14 nt, Bordetella pertussis
gccgcugcgcagca

SEQ ID NO: 2371011 - RNA, 16 nt, Bordetella pertussis
gccgcugcgcgcggcc

SEQ ID NO: 2371012 - RNA, 14 nt, Bordetella pertussis
gccgcugcgcuggc

SEQ ID NO: 2371013 - RNA, 15 nt, Bordetella pertussis
gccgcugcgcuggcc

SEQ ID NO: 2371014 - RNA, 16 nt, Bordetella pertussis
gccgcuggacgcgccg

SEQ ID NO: 2371015 - RNA, 21 nt, Bordetella pertussis
gccgcuggauuucgccgcguu

SEQ ID NO: 2371016 - RNA, 12 nt, Bordetella pertussis
gccgcuggccag

SEQ ID NO: 2371017 - RNA, 14 nt, Bordetella pertussis
gccgcuggccagcc

SEQ ID NO: 2371018 - RNA, 13 nt, Bordetella pertussis
gccgcuggcccgg

SEQ ID NO: 2371019 - RNA, 14 nt, Bordetella pertussis
gccgcuggcccggg

SEQ ID NO: 2371020 - RNA, 16 nt, Bordetella pertussis
gccgcuggcgaucagg

SEQ ID NO: 2371021 - RNA, 22 nt, Bordetella pertussis
gccgcuggcgaucaggccgccc

SEQ ID NO: 2371022 - RNA, 16 nt, Bordetella pertussis
gccgcuggcgauggcc

SEQ ID NO: 2371023 - RNA, 18 nt, Bordetella pertussis
gccgcuggcgauggccug

SEQ ID NO: 2371024 - RNA, 12 nt, Bordetella pertussis
gccgcuggcgcg

SEQ ID NO: 2371025 - RNA, 18 nt, Bordetella pertussis
gccgcuggcgcgccgccu

SEQ ID NO: 2371026 - RNA, 12 nt, Bordetella pertussis
gccgcuggcggc

SEQ ID NO: 2371027 - RNA, 13 nt, Bordetella pertussis
gccgcuggcggcc

SEQ ID NO: 2371028 - RNA, 14 nt, Bordetella pertussis
gccgcuggcggccc

SEQ ID NO: 2371029 - RNA, 17 nt, Bordetella pertussis
gccgcuggcggcccugc

SEQ ID NO: 2371030 - RNA, 18 nt, Bordetella pertussis
gccgcuggcggcccugcc

SEQ ID NO: 2371031 - RNA, 15 nt, Bordetella pertussis
gccgcuggcggccgc

SEQ ID NO: 2371032 - RNA, 17 nt, Bordetella pertussis
gccgcuggcggccgcgg

SEQ ID NO: 2371033 - RNA, 19 nt, Bordetella pertussis
gccgcuggcggccgcgggc

SEQ ID NO: 2371034 - RNA, 14 nt, Bordetella pertussis
gccgcuggcgucca

SEQ ID NO: 2371035 - RNA, 17 nt, Bordetella pertussis
gccgcuggcguccaggu

SEQ ID NO: 2371036 - RNA, 13 nt, Bordetella pertussis
gccgcuggcgucg

SEQ ID NO: 2371037 - RNA, 16 nt, Bordetella pertussis
gccgcuggcgucgcgc

SEQ ID NO: 2371038 - RNA, 20 nt, Bordetella pertussis
gccgcuggcgucgcgcuucu

SEQ ID NO: 2371039 - RNA, 16 nt, Bordetella pertussis
gccgcugggcacaucc

SEQ ID NO: 2371040 - RNA, 23 nt, Bordetella pertussis
gccgcugggcacauccagcgcca

SEQ ID NO: 2371041 - RNA, 21 nt, Bordetella pertussis
gccgcuggucguaucgccgcu

SEQ ID NO: 2371042 - RNA, 18 nt, Bordetella pertussis
gccgcuggugaucugcug

SEQ ID NO: 2371043 - RNA, 19 nt, Bordetella pertussis
gccgcuggugaucugcugc

SEQ ID NO: 2371044 - RNA, 21 nt, Bordetella pertussis
gccgcuggugaucugcugcgu

SEQ ID NO: 2371045 - RNA, 15 nt, Bordetella pertussis
gccgcugucgcaggc

SEQ ID NO: 2371046 - RNA, 20 nt, Bordetella pertussis
gccgcugucgcaggcgcugc

SEQ ID NO: 2371047 - RNA, 15 nt, Bordetella pertussis
gccgcugucgcagua

SEQ ID NO: 2371048 - RNA, 16 nt, Bordetella pertussis
gccgcugucgcugauc

SEQ ID NO: 2371049 - RNA, 19 nt, Bordetella pertussis
gccgcugucgcugaucugc

SEQ ID NO: 2371050 - RNA, 21 nt, Bordetella pertussis
gccgcugucgcugaucugcuu

SEQ ID NO: 2371051 - RNA, 14 nt, Bordetella pertussis
gccgcuguggacgc

SEQ ID NO: 2371052 - RNA, 17 nt, Bordetella pertussis
gccgcuguggacgccgc

SEQ ID NO: 2371053 - RNA, 20 nt, Bordetella pertussis
gccgcuguggacgccgccgg

SEQ ID NO: 2371054 - RNA, 13 nt, Bordetella pertussis
gccgcuguggcgc

SEQ ID NO: 2371055 - RNA, 16 nt, Bordetella pertussis
gccgcuguggcgcgcc

SEQ ID NO: 2371056 - RNA, 16 nt, Bordetella pertussis
gccgcuguucggcgag

SEQ ID NO: 2371057 - RNA, 17 nt, Bordetella pertussis
gccgcuguucggcgagc

SEQ ID NO: 2371058 - RNA, 17 nt, Bordetella pertussis
gccgcuguugcccacca

SEQ ID NO: 2371059 - RNA, 18 nt, Bordetella pertussis
gccgcuguugcccaccag

SEQ ID NO: 2371060 - RNA, 19 nt, Bordetella pertussis
gccgcuguugcccaccagc

SEQ ID NO: 2371061 - RNA, 20 nt, Bordetella pertussis
gccgcuguugcccaccagcc

SEQ ID NO: 2371062 - RNA, 21 nt, Bordetella pertussis
gccgcuguugcccaccagccg

SEQ ID NO: 2371063 - RNA, 21 nt, Bordetella pertussis
gccgcuucaggaacaugucca

SEQ ID NO: 2371064 - RNA, 15 nt, Bordetella pertussis
gccgcuuccggcaug

SEQ ID NO: 2371065 - RNA, 16 nt, Bordetella pertussis
gccgcuuccggcauga

SEQ ID NO: 2371066 - RNA, 22 nt, Bordetella pertussis
gccgcuuccggcaugaccgcgg

SEQ ID NO: 2371067 - RNA, 16 nt, Bordetella pertussis
gccgcuuccggccgga

SEQ ID NO: 2371068 - RNA, 18 nt, Bordetella pertussis
gccgcuucgaugcuggcg

SEQ ID NO: 2371069 - RNA, 21 nt, Bordetella pertussis
gccgcuucgaugcuggcggca

SEQ ID NO: 2371070 - RNA, 20 nt, Bordetella pertussis
gccgcuucggccugcgccac

SEQ ID NO: 2371071 - RNA, 15 nt, Bordetella pertussis
gccgcuucggcggcc

SEQ ID NO: 2371072 - RNA, 16 nt, Bordetella pertussis
gccgcuucggcggccg

SEQ ID NO: 2371073 - RNA, 21 nt, Bordetella pertussis
gccgcuucgugcggccgcagc

SEQ ID NO: 2371074 - RNA, 20 nt, Bordetella pertussis
gccgcuugaaguaaucgccc

SEQ ID NO: 2371075 - RNA, 23 nt, Bordetella pertussis
gccgcuugcccgucaugcgccgc

SEQ ID NO: 2371076 - RNA, 16 nt, Bordetella pertussis
gccgcuugcggccagg

SEQ ID NO: 2371077 - RNA, 17 nt, Bordetella pertussis
gccgcuugcggccaggc

SEQ ID NO: 2371078 - RNA, 18 nt, Bordetella pertussis
gccgcuugcggccaggcg

SEQ ID NO: 2371079 - RNA, 13 nt, Bordetella pertussis
gccgcuuggccug

SEQ ID NO: 2371080 - RNA, 16 nt, Bordetella pertussis
gccgcuuggccugcgc

SEQ ID NO: 2371081 - RNA, 21 nt, Bordetella pertussis
gccgcuuggccugcgccaccg

SEQ ID NO: 2371082 - RNA, 23 nt, Bordetella pertussis
gccgcuuggccugcgccaccgca

SEQ ID NO: 2371083 - RNA, 18 nt, Bordetella pertussis
gccgcuugucgaugacgc

SEQ ID NO: 2371084 - RNA, 19 nt, Bordetella pertussis
gccgcuugucgaugacgcg

SEQ ID NO: 2371085 - RNA, 20 nt, Bordetella pertussis
gccgcuugucgaugacgcgc

SEQ ID NO: 2371086 - RNA, 21 nt, Bordetella pertussis
gccgcuugucgaugacgcgcc

SEQ ID NO: 2371087 - RNA, 17 nt, Bordetella pertussis
gccgcuuucgaccagcg

SEQ ID NO: 2371088 - RNA, 18 nt, Bordetella pertussis
gccgcuuucgaccagcga

SEQ ID NO: 2371089 - RNA, 23 nt, Bordetella pertussis
gccgcuuucgaccuugcugacgc

SEQ ID NO: 2371090 - RNA, 22 nt, Bordetella pertussis
gccggaaacgcggucaccgagc

SEQ ID NO: 2371091 - RNA, 23 nt, Bordetella pertussis
gccggaaacgcggucaccgagcu

SEQ ID NO: 2371092 - RNA, 16 nt, Bordetella pertussis
gccggcagggcggcca

SEQ ID NO: 2371093 - RNA, 17 nt, Bordetella pertussis
gccggcagggcggccag

SEQ ID NO: 2371094 - RNA, 18 nt, Bordetella pertussis
gccggcagggcggccagg

SEQ ID NO: 2371095 - RNA, 19 nt, Bordetella pertussis
gccggcagggcggccaggc

SEQ ID NO: 2371096 - RNA, 20 nt, Bordetella pertussis
gccggcagggcggccaggcc

SEQ ID NO: 2371097 - RNA, 21 nt, Bordetella pertussis
gccggcagggcggccaggccg

SEQ ID NO: 2371098 - RNA, 22 nt, Bordetella pertussis
gccggcagggugcuguucaggc

SEQ ID NO: 2371099 - RNA, 23 nt, Bordetella pertussis
gccggcagugccugcgaacgccc

SEQ ID NO: 2371100 - RNA, 17 nt, Bordetella pertussis
gccggcauaggcggcgc

SEQ ID NO: 2371101 - RNA, 21 nt, Bordetella pertussis
gccggcauaggcggcgcaggc

SEQ ID NO: 2371102 - RNA, 22 nt, Bordetella pertussis
gccggcauaggcggcgcaggcc

SEQ ID NO: 2371103 - RNA, 15 nt, Bordetella pertussis
gccggcaucgcgcug

SEQ ID NO: 2371104 - RNA, 15 nt, Bordetella pertussis
gccggcaucggcggc

SEQ ID NO: 2371105 - RNA, 16 nt, Bordetella pertussis
gccggcaucggcggcu

SEQ ID NO: 2371106 - RNA, 17 nt, Bordetella pertussis
gccggcaugaagcgcag

SEQ ID NO: 2371107 - RNA, 21 nt, Bordetella pertussis
gccggcaugcgccggcccggc

SEQ ID NO: 2371108 - RNA, 21 nt, Bordetella pertussis
gccggcauguugccgcuggug

SEQ ID NO: 2371109 - RNA, 17 nt, Bordetella pertussis
gccggcauugcccacca

SEQ ID NO: 2371110 - RNA, 17 nt, Bordetella pertussis
gccggcauuucgcuggg

SEQ ID NO: 2371111 - RNA, 18 nt, Bordetella pertussis
gccggcauuucgcugggc

SEQ ID NO: 2371112 - RNA, 22 nt, Bordetella pertussis
gccggcauuucgcugggcgcgc

SEQ ID NO: 2371113 - RNA, 17 nt, Bordetella pertussis
gccggccaacagcucgc

SEQ ID NO: 2371114 - RNA, 18 nt, Bordetella pertussis
gccggccaacagcucgcg

SEQ ID NO: 2371115 - RNA, 20 nt, Bordetella pertussis
gccggccaacagcucgcgcc

SEQ ID NO: 2371116 - RNA, 21 nt, Bordetella pertussis
gccggccaacagcucgcgcca

SEQ ID NO: 2371117 - RNA, 22 nt, Bordetella pertussis
gccggccaacagcucgcgccag

SEQ ID NO: 2371118 - RNA, 16 nt, Bordetella pertussis
gccggccaaggcaagc

SEQ ID NO: 2371119 - RNA, 13 nt, Bordetella pertussis
gccggccaccagc

SEQ ID NO: 2371120 - RNA, 17 nt, Bordetella pertussis
gccggccaccagcggcg

SEQ ID NO: 2371121 - RNA, 19 nt, Bordetella pertussis
gccggccaccagcggcgcc

SEQ ID NO: 2371122 - RNA, 20 nt, Bordetella pertussis
gccggccaccagcggcgccg

SEQ ID NO: 2371123 - RNA, 22 nt, Bordetella pertussis
gccggccaccgagauguuccug

SEQ ID NO: 2371124 - RNA, 19 nt, Bordetella pertussis
gccggccacgaacggcgcg

SEQ ID NO: 2371125 - RNA, 16 nt, Bordetella pertussis
gccggccacgcgcugc

SEQ ID NO: 2371126 - RNA, 11 nt, Bordetella pertussis
gccggccagca

SEQ ID NO: 2371127 - RNA, 13 nt, Bordetella pertussis
gccggccagcacg

SEQ ID NO: 2371128 - RNA, 13 nt, Bordetella pertussis
gccggccagcagc

SEQ ID NO: 2371129 - RNA, 11 nt, Bordetella pertussis
gccggccagcc

SEQ ID NO: 2371130 - RNA, 13 nt, Bordetella pertussis
gccggccagccau

SEQ ID NO: 2371131 - RNA, 21 nt, Bordetella pertussis
gccggccagccauugccgcac

SEQ ID NO: 2371132 - RNA, 22 nt, Bordetella pertussis
gccggccagccauugccgcacg

SEQ ID NO: 2371133 - RNA, 12 nt, Bordetella pertussis
gccggccagcgc

SEQ ID NO: 2371134 - RNA, 15 nt, Bordetella pertussis
gccggccagcgccac

SEQ ID NO: 2371135 - RNA, 14 nt, Bordetella pertussis
gccggccagcgccu

SEQ ID NO: 2371136 - RNA, 18 nt, Bordetella pertussis
gccggccagcgccugggc

SEQ ID NO: 2371137 - RNA, 19 nt, Bordetella pertussis
gccggccagcgccugggcg

SEQ ID NO: 2371138 - RNA, 21 nt, Bordetella pertussis
gccggccagcgccugggcgcg

SEQ ID NO: 2371139 - RNA, 13 nt, Bordetella pertussis
gccggccagcgcg

SEQ ID NO: 2371140 - RNA, 14 nt, Bordetella pertussis
gccggccagcgcgc

SEQ ID NO: 2371141 - RNA, 16 nt, Bordetella pertussis
gccggccagcgcgccg

SEQ ID NO: 2371142 - RNA, 16 nt, Bordetella pertussis
gccggccagcgcggca

SEQ ID NO: 2371143 - RNA, 22 nt, Bordetella pertussis
gccggccagcgcggcaucggcc

SEQ ID NO: 2371144 - RNA, 14 nt, Bordetella pertussis
gccggccagcggca

SEQ ID NO: 2371145 - RNA, 15 nt, Bordetella pertussis
gccggccagcggcag

SEQ ID NO: 2371146 - RNA, 13 nt, Bordetella pertussis
gccggccagcugc

SEQ ID NO: 2371147 - RNA, 16 nt, Bordetella pertussis
gccggccagcugcaug

SEQ ID NO: 2371148 - RNA, 20 nt, Bordetella pertussis
gccggccagcugcaugcgca

SEQ ID NO: 2371149 - RNA, 22 nt, Bordetella pertussis
gccggccagcugcaugcgcacg

SEQ ID NO: 2371150 - RNA, 13 nt, Bordetella pertussis
gccggccagcuug

SEQ ID NO: 2371151 - RNA, 22 nt, Bordetella pertussis
gccggccagcuugagcaggcgc

SEQ ID NO: 2371152 - RNA, 22 nt, Bordetella pertussis
gccggccaggacgaucccggcc

SEQ ID NO: 2371153 - RNA, 14 nt, Bordetella pertussis
gccggccaggcgcc

SEQ ID NO: 2371154 - RNA, 15 nt, Bordetella pertussis
gccggccagggccac

SEQ ID NO: 2371155 - RNA, 17 nt, Bordetella pertussis
gccggccagggccacca

SEQ ID NO: 2371156 - RNA, 21 nt, Bordetella pertussis
gccggccagggccacgccggc

SEQ ID NO: 2371157 - RNA, 15 nt, Bordetella pertussis
gccggccaggucggc

SEQ ID NO: 2371158 - RNA, 18 nt, Bordetella pertussis
gccggccaggucggcggc

SEQ ID NO: 2371159 - RNA, 23 nt, Bordetella pertussis
gccggccaggucggcggccagcg

SEQ ID NO: 2371160 - RNA, 16 nt, Bordetella pertussis
gccggccaguggcgcg

SEQ ID NO: 2371161 - RNA, 18 nt, Bordetella pertussis
gccggccaguggcgcggc

SEQ ID NO: 2371162 - RNA, 19 nt, Bordetella pertussis
gccggccaguggcgcggcg

SEQ ID NO: 2371163 - RNA, 18 nt, Bordetella pertussis
gccggccaucaggugcag

SEQ ID NO: 2371164 - RNA, 17 nt, Bordetella pertussis
gccggccaugcucagca

SEQ ID NO: 2371165 - RNA, 15 nt, Bordetella pertussis
gccggccauggcggc

SEQ ID NO: 2371166 - RNA, 16 nt, Bordetella pertussis
gccggccauggcggcc

SEQ ID NO: 2371167 - RNA, 17 nt, Bordetella pertussis
gccggccauggcggccg

SEQ ID NO: 2371168 - RNA, 19 nt, Bordetella pertussis
gccggccauggcggccggc

SEQ ID NO: 2371169 - RNA, 22 nt, Bordetella pertussis
gccggccauggcggccggcguu

SEQ ID NO: 2371170 - RNA, 14 nt, Bordetella pertussis
gccggcccaaggcc

SEQ ID NO: 2371171 - RNA, 21 nt, Bordetella pertussis
gccggcccaaggccccgcgac

SEQ ID NO: 2371172 - RNA, 13 nt, Bordetella pertussis
gccggcccagcac

SEQ ID NO: 2371173 - RNA, 18 nt, Bordetella pertussis
gccggcccaggauggcgc

SEQ ID NO: 2371174 - RNA, 21 nt, Bordetella pertussis
gccggcccaggauggcgccag

SEQ ID NO: 2371175 - RNA, 23 nt, Bordetella pertussis
gccggcccaggauggcgccagcc

SEQ ID NO: 2371176 - RNA, 14 nt, Bordetella pertussis
gccggcccaggcgc

SEQ ID NO: 2371177 - RNA, 19 nt, Bordetella pertussis
gccggcccaggcgcgcugg

SEQ ID NO: 2371178 - RNA, 18 nt, Bordetella pertussis
gccggcccaucuguacgg

SEQ ID NO: 2371179 - RNA, 22 nt, Bordetella pertussis
gccggcccaucuguacggccgg

SEQ ID NO: 2371180 - RNA, 15 nt, Bordetella pertussis
gccggccccauccuc

SEQ ID NO: 2371181 - RNA, 12 nt, Bordetella pertussis
gccggcccccuc

SEQ ID NO: 2371182 - RNA, 13 nt, Bordetella pertussis
gccggccccgcaa

SEQ ID NO: 2371183 - RNA, 13 nt, Bordetella pertussis
gccggcccgccac

SEQ ID NO: 2371184 - RNA, 14 nt, Bordetella pertussis
gccggcccgccacg

SEQ ID NO: 2371185 - RNA, 19 nt, Bordetella pertussis
gccggcccgccacgcgggc

SEQ ID NO: 2371186 - RNA, 20 nt, Bordetella pertussis
gccggcccgccacgcgggcc

SEQ ID NO: 2371187 - RNA, 16 nt, Bordetella pertussis
gccggcccgccccacg

SEQ ID NO: 2371188 - RNA, 15 nt, Bordetella pertussis
gccggcccgcgcgcc

SEQ ID NO: 2371189 - RNA, 23 nt, Bordetella pertussis
gccggcccggaauaccgccagcu

SEQ ID NO: 2371190 - RNA, 22 nt, Bordetella pertussis
gccggcccguuggcaggccagc

SEQ ID NO: 2371191 - RNA, 15 nt, Bordetella pertussis
gccggcccugccgcc

SEQ ID NO: 2371192 - RNA, 16 nt, Bordetella pertussis
gccggcccugccgccc

SEQ ID NO: 2371193 - RNA, 16 nt, Bordetella pertussis
gccggccgaccggcgc

SEQ ID NO: 2371194 - RNA, 18 nt, Bordetella pertussis
gccggccgaccggcgcgc

SEQ ID NO: 2371195 - RNA, 14 nt, Bordetella pertussis
gccggccgacggcg

SEQ ID NO: 2371196 - RNA, 15 nt, Bordetella pertussis
gccggccgacggcgc

SEQ ID NO: 2371197 - RNA, 17 nt, Bordetella pertussis
gccggccgacggcgcug

SEQ ID NO: 2371198 - RNA, 16 nt, Bordetella pertussis
gccggccgauagccgc

SEQ ID NO: 2371199 - RNA, 20 nt, Bordetella pertussis
gccggccgaugacaucgccg

SEQ ID NO: 2371200 - RNA, 14 nt, Bordetella pertussis
gccggccgccagca

SEQ ID NO: 2371201 - RNA, 13 nt, Bordetella pertussis
gccggccgccaug

SEQ ID NO: 2371202 - RNA, 22 nt, Bordetella pertussis
gccggccgccauggccggcguu

SEQ ID NO: 2371203 - RNA, 12 nt, Bordetella pertussis
gccggccgccca

SEQ ID NO: 2371204 - RNA, 14 nt, Bordetella pertussis
gccggccgcccagg

SEQ ID NO: 2371205 - RNA, 19 nt, Bordetella pertussis
gccggcgccggcgacgccg

SEQ ID NO: 2371206 - RNA, 18 nt, Bordetella pertussis
gccggcgccggcgcgccg

SEQ ID NO: 2371207 - RNA, 11 nt, Bordetella pertussis
gccggcgccgu

SEQ ID NO: 2371208 - RNA, 13 nt, Bordetella pertussis
gccggcgccguuc

SEQ ID NO: 2371209 - RNA, 16 nt, Bordetella pertussis
gccggcgccuggggcg

SEQ ID NO: 2371210 - RNA, 20 nt, Bordetella pertussis
gccggcgccuuggccugggc

SEQ ID NO: 2371211 - RNA, 13 nt, Bordetella pertussis
gccggcgcgcauc

SEQ ID NO: 2371212 - RNA, 12 nt, Bordetella pertussis
gccggcgcgccc

SEQ ID NO: 2371213 - RNA, 14 nt, Bordetella pertussis
gccggcgcgcccag

SEQ ID NO: 2371214 - RNA, 22 nt, Bordetella pertussis
gccggcgcgcccaggggccggc

SEQ ID NO: 2371215 - RNA, 13 nt, Bordetella pertussis
gccggcgcgcccu

SEQ ID NO: 2371216 - RNA, 14 nt, Bordetella pertussis
gccggcgcgccgcg

SEQ ID NO: 2371217 - RNA, 20 nt, Bordetella pertussis
gccggcgcgccgcgccgccc

SEQ ID NO: 2371218 - RNA, 14 nt, Bordetella pertussis
gccggcgcgccggc

SEQ ID NO: 2371219 - RNA, 15 nt, Bordetella pertussis
gccggcgcgccggcc

SEQ ID NO: 2371220 - RNA, 20 nt, Bordetella pertussis
gccggcgcgccggcccaagg

SEQ ID NO: 2371221 - RNA, 17 nt, Bordetella pertussis
gccggcgcgccggccgc

SEQ ID NO: 2371222 - RNA, 18 nt, Bordetella pertussis
gccggcgcgccgggccag

SEQ ID NO: 2371223 - RNA, 12 nt, Bordetella pertussis
gccggcgcgccu

SEQ ID NO: 2371224 - RNA, 23 nt, Bordetella pertussis
gccggcgcgcgaucucgggcagg

SEQ ID NO: 2371225 - RNA, 16 nt, Bordetella pertussis
gccggcgcgcgcaggc

SEQ ID NO: 2371226 - RNA, 13 nt, Bordetella pertussis
gccggcgcgcgcg

SEQ ID NO: 2371227 - RNA, 16 nt, Bordetella pertussis
gccggcgcgcgcgacc

SEQ ID NO: 2371228 - RNA, 14 nt, Bordetella pertussis
gccggcgcgcgcgc

SEQ ID NO: 2371229 - RNA, 15 nt, Bordetella pertussis
gccggcgcgcgcgcg

SEQ ID NO: 2371230 - RNA, 18 nt, Bordetella pertussis
gccggcgcgcgcgcgccg

SEQ ID NO: 2371231 - RNA, 22 nt, Bordetella pertussis
gccggcgcgcgcgcgccgcacg

SEQ ID NO: 2371232 - RNA, 17 nt, Bordetella pertussis
gccggcgcgcgcguaca

SEQ ID NO: 2371233 - RNA, 15 nt, Bordetella pertussis
gccggcgcgcgcuga

SEQ ID NO: 2371234 - RNA, 22 nt, Bordetella pertussis
gccggcgcgcggaugaucgcgc

SEQ ID NO: 2371235 - RNA, 14 nt, Bordetella pertussis
gccggcgcgcggcc

SEQ ID NO: 2371236 - RNA, 15 nt, Bordetella pertussis
gccggcgcgcggccg

SEQ ID NO: 2371237 - RNA, 16 nt, Bordetella pertussis
gccggcgcgcggccgu

SEQ ID NO: 2371238 - RNA, 19 nt, Bordetella pertussis
gccggcgcgcucgcugccg

SEQ ID NO: 2371239 - RNA, 12 nt, Bordetella pertussis
gccggcgcggca

SEQ ID NO: 2371240 - RNA, 13 nt, Bordetella pertussis
gccggcgcggcag

SEQ ID NO: 2371241 - RNA, 12 nt, Bordetella pertussis
gccggcgcggcg

SEQ ID NO: 2371242 - RNA, 14 nt, Bordetella pertussis
gccggcgcggcggu

SEQ ID NO: 2371243 - RNA, 18 nt, Bordetella pertussis
gccggcgcggcugcuggg

SEQ ID NO: 2371244 - RNA, 21 nt, Bordetella pertussis
gccggcgcggcugcugggcau

SEQ ID NO: 2371245 - RNA, 15 nt, Bordetella pertussis
gccggcgcgggcgca

SEQ ID NO: 2371246 - RNA, 17 nt, Bordetella pertussis
gccggcgcgggcgcagg

SEQ ID NO: 2371247 - RNA, 14 nt, Bordetella pertussis
gccggcgcgguggc

SEQ ID NO: 2371248 - RNA, 23 nt, Bordetella pertussis
gccggcgcgguggccaugcuggg

SEQ ID NO: 2371249 - RNA, 13 nt, Bordetella pertussis
gccggcgcgucca

SEQ ID NO: 2371250 - RNA, 21 nt, Bordetella pertussis
gccggcgcguccacgccgugg

SEQ ID NO: 2371251 - RNA, 14 nt, Bordetella pertussis
gccggcgcgucgcc

SEQ ID NO: 2371252 - RNA, 17 nt, Bordetella pertussis
gccggcgcgucgccggc

SEQ ID NO: 2371253 - RNA, 19 nt, Bordetella pertussis
gccggcgcgucgccggcga

SEQ ID NO: 2371254 - RNA, 14 nt, Bordetella pertussis
gccggcgcgucgcg

SEQ ID NO: 2371255 - RNA, 15 nt, Bordetella pertussis
gccggcgcgucgcgc

SEQ ID NO: 2371256 - RNA, 16 nt, Bordetella pertussis
gccggcgcgucgcgcg

SEQ ID NO: 2371257 - RNA, 23 nt, Bordetella pertussis
gccggcgcgucgcgcggcggcac

SEQ ID NO: 2371258 - RNA, 19 nt, Bordetella pertussis
gccggcgcgugcuggcgca

SEQ ID NO: 2371259 - RNA, 20 nt, Bordetella pertussis
gccggcgcgugcuggcgcag

SEQ ID NO: 2371260 - RNA, 23 nt, Bordetella pertussis
gccggcgcuacagggugccgcgc

SEQ ID NO: 2371261 - RNA, 14 nt, Bordetella pertussis
gccggcgcucagcg

SEQ ID NO: 2371262 - RNA, 20 nt, Bordetella pertussis
gccggcgcucagcgacgcgc

SEQ ID NO: 2371263 - RNA, 23 nt, Bordetella pertussis
gccggcgcucagcgacgcgcgcc

SEQ ID NO: 2371264 - RNA, 14 nt, Bordetella pertussis
gccggcgcucgcgc

SEQ ID NO: 2371265 - RNA, 18 nt, Bordetella pertussis
gccggcgcucgcgcaccg

SEQ ID NO: 2371266 - RNA, 15 nt, Bordetella pertussis
gccggcgcugcgcag

SEQ ID NO: 2371267 - RNA, 16 nt, Bordetella pertussis
gccggcgcugcgcagc

SEQ ID NO: 2371268 - RNA, 23 nt, Bordetella pertussis
gccggcgcugcgcagcagggcgg

SEQ ID NO: 2371269 - RNA, 17 nt, Bordetella pertussis
gccggcgcugcggucgc

SEQ ID NO: 2371270 - RNA, 12 nt, Bordetella pertussis
gccggcgcugcu

SEQ ID NO: 2371271 - RNA, 17 nt, Bordetella pertussis
gccggcgcugcugucgc

SEQ ID NO: 2371272 - RNA, 17 nt, Bordetella pertussis
gccggcgcugggcaggc

SEQ ID NO: 2371273 - RNA, 21 nt, Bordetella pertussis
gccggcgcugggcaggcuggc

SEQ ID NO: 2371274 - RNA, 21 nt, Bordetella pertussis
gccggcggcaauaucggcacc

SEQ ID NO: 2371275 - RNA, 12 nt, Bordetella pertussis
gccggcggcacc

SEQ ID NO: 2371276 - RNA, 15 nt, Bordetella pertussis
gccggcggcaccgcg

SEQ ID NO: 2371277 - RNA, 18 nt, Bordetella pertussis
gccggcggcaccgcgcag

SEQ ID NO: 2371278 - RNA, 21 nt, Bordetella pertussis
gccggcggcacgcugcgcagg

SEQ ID NO: 2371279 - RNA, 13 nt, Bordetella pertussis
gccggcggcagcc

SEQ ID NO: 2371280 - RNA, 14 nt, Bordetella pertussis
gccggcggcagccg

SEQ ID NO: 2371281 - RNA, 18 nt, Bordetella pertussis
gccggcggcagccggcca

SEQ ID NO: 2371282 - RNA, 23 nt, Bordetella pertussis
gccggcggcaugcgccagccagc

SEQ ID NO: 2371283 - RNA, 16 nt, Bordetella pertussis
gccggcggcauucagc

SEQ ID NO: 2371284 - RNA, 19 nt, Bordetella pertussis
gccggcggcauucagcgcu

SEQ ID NO: 2371285 - RNA, 14 nt, Bordetella pertussis
gccggcggccagcg

SEQ ID NO: 2371286 - RNA, 15 nt, Bordetella pertussis
gccggcggccagcgc

SEQ ID NO: 2371287 - RNA, 21 nt, Bordetella pertussis
gccggcggcccauucgcgcac

SEQ ID NO: 2371288 - RNA, 13 nt, Bordetella pertussis
gccggcggccggu

SEQ ID NO: 2371289 - RNA, 15 nt, Bordetella pertussis
gccggcggccgguca

SEQ ID NO: 2371290 - RNA, 20 nt, Bordetella pertussis
gccggcggccuaugugcagg

SEQ ID NO: 2371291 - RNA, 23 nt, Bordetella pertussis
gccggcggccuaugugcaggcca

SEQ ID NO: 2371292 - RNA, 15 nt, Bordetella pertussis
gccggcggccuccgc

SEQ ID NO: 2371293 - RNA, 17 nt, Bordetella pertussis
gccggcggccuccgcgc

SEQ ID NO: 2371294 - RNA, 23 nt, Bordetella pertussis
gccggcggccuccgcgcacagcg

SEQ ID NO: 2371295 - RNA, 17 nt, Bordetella pertussis
gccggcggccugcaggc

SEQ ID NO: 2371296 - RNA, 19 nt, Bordetella pertussis
gccggcggccugcaggccg

SEQ ID NO: 2371297 - RNA, 13 nt, Bordetella pertussis
gccggcggccugg

SEQ ID NO: 2371298 - RNA, 14 nt, Bordetella pertussis
gccggcggcgagcg

SEQ ID NO: 2371299 - RNA, 15 nt, Bordetella pertussis
gccggcggcgaugcg

SEQ ID NO: 2371300 - RNA, 11 nt, Bordetella pertussis
gccggcggcgc

SEQ ID NO: 2371301 - RNA, 13 nt, Bordetella pertussis
gccggcggcgcac

SEQ ID NO: 2371302 - RNA, 15 nt, Bordetella pertussis
gccggcggcgcacca

SEQ ID NO: 2371303 - RNA, 14 nt, Bordetella pertussis
gccggcggcgccgg

SEQ ID NO: 2371304 - RNA, 15 nt, Bordetella pertussis
gccggcggcgccggc

SEQ ID NO: 2371305 - RNA, 12 nt, Bordetella pertussis
gccggcggcgcu

SEQ ID NO: 2371306 - RNA, 13 nt, Bordetella pertussis
gccggcggcgcug

SEQ ID NO: 2371307 - RNA, 15 nt, Bordetella pertussis
gccggcggcgcuggc

SEQ ID NO: 2371308 - RNA, 16 nt, Bordetella pertussis
gccggcggcgcuggcg

SEQ ID NO: 2371309 - RNA, 17 nt, Bordetella pertussis
gccggcggcgcuggcga

SEQ ID NO: 2371310 - RNA, 14 nt, Bordetella pertussis
gccggcggcgguca

SEQ ID NO: 2371311 - RNA, 14 nt, Bordetella pertussis
gccggcggcgucgg

SEQ ID NO: 2371312 - RNA, 17 nt, Bordetella pertussis
gccggcggcgucggcgc

SEQ ID NO: 2371313 - RNA, 21 nt, Bordetella pertussis
gccggcggcgucggcgcccgg

SEQ ID NO: 2371314 - RNA, 18 nt, Bordetella pertussis
gccggcggcgugcccugc

SEQ ID NO: 2371315 - RNA, 22 nt, Bordetella pertussis
gccggcggcgugcgccugcugg

SEQ ID NO: 2371316 - RNA, 14 nt, Bordetella pertussis
gccggcggcguggc

SEQ ID NO: 2371317 - RNA, 16 nt, Bordetella pertussis
gccggcggcguggccg

SEQ ID NO: 2371318 - RNA, 22 nt, Bordetella pertussis
gccggcgggcaugacgaccgcg

SEQ ID NO: 2371319 - RNA, 16 nt, Bordetella pertussis
gccgggcagcaucacg

SEQ ID NO: 2371320 - RNA, 21 nt, Bordetella pertussis
gccgggcagcaucacggugcc

SEQ ID NO: 2371321 - RNA, 14 nt, Bordetella pertussis
gccgggcagcccgc

SEQ ID NO: 2371322 - RNA, 18 nt, Bordetella pertussis
gccgggcagcccgcgcac

SEQ ID NO: 2371323 - RNA, 20 nt, Bordetella pertussis
gccgggcagcgggccgcagc

SEQ ID NO: 2371324 - RNA, 15 nt, Bordetella pertussis
gccgggcaggccgcg

SEQ ID NO: 2371325 - RNA, 16 nt, Bordetella pertussis
gccgggcaggccgcgc

SEQ ID NO: 2371326 - RNA, 16 nt, Bordetella pertussis
gccgggcaguccuggc

SEQ ID NO: 2371327 - RNA, 18 nt, Bordetella pertussis
gccgggcaguccuggcug

SEQ ID NO: 2371328 - RNA, 19 nt, Bordetella pertussis
gccgggcaguucgggcacg

SEQ ID NO: 2371329 - RNA, 20 nt, Bordetella pertussis
gccgggcaguucgggcacgc

SEQ ID NO: 2371330 - RNA, 17 nt, Bordetella pertussis
gccgggcaugcaccagg

SEQ ID NO: 2371331 - RNA, 17 nt, Bordetella pertussis
gccgggcauugccggag

SEQ ID NO: 2371332 - RNA, 14 nt, Bordetella pertussis
gccgggccaaggug

SEQ ID NO: 2371333 - RNA, 18 nt, Bordetella pertussis
gccgggccaaggugccug

SEQ ID NO: 2371334 - RNA, 14 nt, Bordetella pertussis
gccgggccacgcgc

SEQ ID NO: 2371335 - RNA, 15 nt, Bordetella pertussis
gccgggccacgcgca

SEQ ID NO: 2371336 - RNA, 18 nt, Bordetella pertussis
gccgggccagaccuggug

SEQ ID NO: 2371337 - RNA, 12 nt, Bordetella pertussis
gccgggccagcg

SEQ ID NO: 2371338 - RNA, 17 nt, Bordetella pertussis
gccgggcccggccacgg

SEQ ID NO: 2371339 - RNA, 14 nt, Bordetella pertussis
gccgggcccggcgc

SEQ ID NO: 2371340 - RNA, 17 nt, Bordetella pertussis
gccgggcccggcgcgcc

SEQ ID NO: 2371341 - RNA, 18 nt, Bordetella pertussis
gccgggcccggcgcgccu

SEQ ID NO: 2371342 - RNA, 17 nt, Bordetella pertussis
gccgggccgcgaccacg

SEQ ID NO: 2371343 - RNA, 12 nt, Bordetella pertussis
gccgggccgcgc

SEQ ID NO: 2371344 - RNA, 15 nt, Bordetella pertussis
gccgggccgcgccca

SEQ ID NO: 2371345 - RNA, 16 nt, Bordetella pertussis
gccgggccgcgcccac

SEQ ID NO: 2371346 - RNA, 16 nt, Bordetella pertussis
gccgggccgcgccgcc

SEQ ID NO: 2371347 - RNA, 16 nt, Bordetella pertussis
gccgggccgggcacga

SEQ ID NO: 2371348 - RNA, 16 nt, Bordetella pertussis
gccgggccgugcgccg

SEQ ID NO: 2371349 - RNA, 19 nt, Bordetella pertussis
gccgggccgugcgccgggc

SEQ ID NO: 2371350 - RNA, 20 nt, Bordetella pertussis
gccgggccgugcgccgggcg

SEQ ID NO: 2371351 - RNA, 12 nt, Bordetella pertussis
gccgggccgugg

SEQ ID NO: 2371352 - RNA, 23 nt, Bordetella pertussis
gccgggccucaaucgaugaugug

SEQ ID NO: 2371353 - RNA, 12 nt, Bordetella pertussis
gccgggccugcc

SEQ ID NO: 2371354 - RNA, 14 nt, Bordetella pertussis
gccgggccugcccg

SEQ ID NO: 2371355 - RNA, 16 nt, Bordetella pertussis
gccgggccugcccgca

SEQ ID NO: 2371356 - RNA, 14 nt, Bordetella pertussis
gccgggccuggugc

SEQ ID NO: 2371357 - RNA, 15 nt, Bordetella pertussis
gccgggccuggugcc

SEQ ID NO: 2371358 - RNA, 18 nt, Bordetella pertussis
gccgggccuggugcccga

SEQ ID NO: 2371359 - RNA, 16 nt, Bordetella pertussis
gccgggcgaucgcguc

SEQ ID NO: 2371360 - RNA, 14 nt, Bordetella pertussis
gccgggcgccaggc

SEQ ID NO: 2371361 - RNA, 15 nt, Bordetella pertussis
gccgggcgccaggcu

SEQ ID NO: 2371362 - RNA, 14 nt, Bordetella pertussis
gccgggcgcccagc

SEQ ID NO: 2371363 - RNA, 13 nt, Bordetella pertussis
gccgggcgccgcg

SEQ ID NO: 2371364 - RNA, 16 nt, Bordetella pertussis
gccgggcgccgcgccc

SEQ ID NO: 2371365 - RNA, 13 nt, Bordetella pertussis
gccgggcgccggc

SEQ ID NO: 2371366 - RNA, 15 nt, Bordetella pertussis
gccgggcgcgccggc

SEQ ID NO: 2371367 - RNA, 19 nt, Bordetella pertussis
gccgggcgcgccggcgggc

SEQ ID NO: 2371368 - RNA, 20 nt, Bordetella pertussis
gccgggcgcgcgccggcggc

SEQ ID NO: 2371369 - RNA, 22 nt, Bordetella pertussis
gccgggcgcgcgccggcggccu

SEQ ID NO: 2371370 - RNA, 16 nt, Bordetella pertussis
gccgggcgcgcugccc

SEQ ID NO: 2371371 - RNA, 20 nt, Bordetella pertussis
gccgggcgcgcugcccagcc

SEQ ID NO: 2371372 - RNA, 14 nt, Bordetella pertussis
gccgggcgcggcca

SEQ ID NO: 2371373 - RNA, 21 nt, Bordetella pertussis
gccgggcgcggccaggcgcuc

SEQ ID NO: 2371374 - RNA, 16 nt, Bordetella pertussis
gccgggcgcggcccgg

SEQ ID NO: 2371375 - RNA, 17 nt, Bordetella pertussis
gccgggcgcggcccggc

SEQ ID NO: 2371376 - RNA, 20 nt, Bordetella pertussis
gccgggcgcggcccggcguc

SEQ ID NO: 2371377 - RNA, 14 nt, Bordetella pertussis
gccgggcgcggccg

SEQ ID NO: 2371378 - RNA, 14 nt, Bordetella pertussis
gccgggcgcggcgc

SEQ ID NO: 2371379 - RNA, 17 nt, Bordetella pertussis
gccgggcgcggcgcccg

SEQ ID NO: 2371380 - RNA, 19 nt, Bordetella pertussis
gccgggcgcggcgcccgcc

SEQ ID NO: 2371381 - RNA, 20 nt, Bordetella pertussis
gccgggcgcguggcccgcgc

SEQ ID NO: 2371382 - RNA, 22 nt, Bordetella pertussis
gccgggcggcgagaugccgucg

SEQ ID NO: 2371383 - RNA, 12 nt, Bordetella pertussis
gccgggcggcgc

SEQ ID NO: 2371384 - RNA, 15 nt, Bordetella pertussis
gccgggcggcgccgu

SEQ ID NO: 2371385 - RNA, 13 nt, Bordetella pertussis
gccgggcggcgcg

SEQ ID NO: 2371386 - RNA, 14 nt, Bordetella pertussis
gccgggcggcgcgg

SEQ ID NO: 2371387 - RNA, 24 nt, Bordetella pertussis
gccgggcgggucggcgaacagcgc

SEQ ID NO: 2371388 - RNA, 18 nt, Bordetella pertussis
gccgggcucaggcugcgc

SEQ ID NO: 2371389 - RNA, 15 nt, Bordetella pertussis
gccgggcuccucgcc

SEQ ID NO: 2371390 - RNA, 19 nt, Bordetella pertussis
gccgggcucgaaguacagc

SEQ ID NO: 2371391 - RNA, 15 nt, Bordetella pertussis
gccgggcucgaugac

SEQ ID NO: 2371392 - RNA, 19 nt, Bordetella pertussis
gccgggcucgaugaccagc

SEQ ID NO: 2371393 - RNA, 20 nt, Bordetella pertussis
gccgggcucgaugaccagca

SEQ ID NO: 2371394 - RNA, 17 nt, Bordetella pertussis
gccgggcucggccacca

SEQ ID NO: 2371395 - RNA, 19 nt, Bordetella pertussis
gccgggcucggccaccaug

SEQ ID NO: 2371396 - RNA, 16 nt, Bordetella pertussis
gccgggcugccggcag

SEQ ID NO: 2371397 - RNA, 21 nt, Bordetella pertussis
gccgggcugccggcagcaggg

SEQ ID NO: 2371398 - RNA, 15 nt, Bordetella pertussis
gccgggcuggauccg

SEQ ID NO: 2371399 - RNA, 15 nt, Bordetella pertussis
gccgggcuugcgcac

SEQ ID NO: 2371400 - RNA, 19 nt, Bordetella pertussis
gccggggaaacggccaagc

SEQ ID NO: 2371401 - RNA, 20 nt, Bordetella pertussis
gccggggaaacggccaagca

SEQ ID NO: 2371402 - RNA, 17 nt, Bordetella pertussis
gccggggaagccgccgg

SEQ ID NO: 2371403 - RNA, 18 nt, Bordetella pertussis
gccggggaagccgccggc

SEQ ID NO: 2371404 - RNA, 16 nt, Bordetella pertussis
gccggggaggccucga

SEQ ID NO: 2371405 - RNA, 22 nt, Bordetella pertussis
gccggggcccgcgggcgcccgg

SEQ ID NO: 2371406 - RNA, 16 nt, Bordetella pertussis
gccggggccgcccagc

SEQ ID NO: 2371407 - RNA, 19 nt, Bordetella pertussis
gccggggccgcccagcacc

SEQ ID NO: 2371408 - RNA, 14 nt, Bordetella pertussis
gccggggccgcccu

SEQ ID NO: 2371409 - RNA, 16 nt, Bordetella pertussis
gccggggccgcccugc

SEQ ID NO: 2371410 - RNA, 12 nt, Bordetella pertussis
gccggggcgagc

SEQ ID NO: 2371411 - RNA, 12 nt, Bordetella pertussis
gccggggcgcac

SEQ ID NO: 2371412 - RNA, 14 nt, Bordetella pertussis
gccggggcgcaccg

SEQ ID NO: 2371413 - RNA, 17 nt, Bordetella pertussis
gccggggcgcaccggca

SEQ ID NO: 2371414 - RNA, 18 nt, Bordetella pertussis
gccggggcgcaccggcac

SEQ ID NO: 2371415 - RNA, 13 nt, Bordetella pertussis
gccggggcgccgg

SEQ ID NO: 2371416 - RNA, 14 nt, Bordetella pertussis
gccggggcggcgca

SEQ ID NO: 2371417 - RNA, 15 nt, Bordetella pertussis
gccggggcggcgcag

SEQ ID NO: 2371418 - RNA, 19 nt, Bordetella pertussis
gccggggcggcucggcccu

SEQ ID NO: 2371419 - RNA, 19 nt, Bordetella pertussis
gccggggcguggccgcagu

SEQ ID NO: 2371420 - RNA, 13 nt, Bordetella pertussis
gccggggggcgca

SEQ ID NO: 2371421 - RNA, 14 nt, Bordetella pertussis
gccggggggcgcac

SEQ ID NO: 2371422 - RNA, 15 nt, Bordetella pertussis
gccggggggcgcacg

SEQ ID NO: 2371423 - RNA, 21 nt, Bordetella pertussis
gccggggggcgcacgccgcgc

SEQ ID NO: 2371424 - RNA, 16 nt, Bordetella pertussis
gccggggguuccugcc

SEQ ID NO: 2371425 - RNA, 22 nt, Bordetella pertussis
gccgggguccugaggccaggcc

SEQ ID NO: 2371426 - RNA, 18 nt, Bordetella pertussis
gccggggucuugccgcgc

SEQ ID NO: 2371427 - RNA, 22 nt, Bordetella pertussis
gccggggucuugccgcgcagcg

SEQ ID NO: 2371428 - RNA, 23 nt, Bordetella pertussis
gccgggguuggaguuugcgggug

SEQ ID NO: 2371429 - RNA, 14 nt, Bordetella pertussis
gccgggucaucgag

SEQ ID NO: 2371430 - RNA, 20 nt, Bordetella pertussis
gccgggucaucgagguggcg

SEQ ID NO: 2371431 - RNA, 16 nt, Bordetella pertussis
gccgggucccuggccc

SEQ ID NO: 2371432 - RNA, 17 nt, Bordetella pertussis
gccgggucccuggcccu

SEQ ID NO: 2371433 - RNA, 18 nt, Bordetella pertussis
gccgucgaccgcgaagcg

SEQ ID NO: 2371434 - RNA, 19 nt, Bordetella pertussis
gccgucgaccgcgaagcgc

SEQ ID NO: 2371435 - RNA, 23 nt, Bordetella pertussis
gccgucgaccgcgaagcgcgcca

SEQ ID NO: 2371436 - RNA, 19 nt, Bordetella pertussis
gccgucgacgucggugacg

SEQ ID NO: 2371437 - RNA, 20 nt, Bordetella pertussis
gccgucgagcaucccggcgc

SEQ ID NO: 2371438 - RNA, 15 nt, Bordetella pertussis
gccgucgagccgggc

SEQ ID NO: 2371439 - RNA, 18 nt, Bordetella pertussis
gccgucgagccgggcgcc

SEQ ID NO: 2371440 - RNA, 22 nt, Bordetella pertussis
gccgucgagccgggcgccgauc

SEQ ID NO: 2371441 - RNA, 15 nt, Bordetella pertussis
gccgucgagcgcggc

SEQ ID NO: 2371442 - RNA, 16 nt, Bordetella pertussis
gccgucgagcgcggcc

SEQ ID NO: 2371443 - RNA, 17 nt, Bordetella pertussis
gccgucgagcgcggcca

SEQ ID NO: 2371444 - RNA, 19 nt, Bordetella pertussis
gccgucgagcgcggccagg

SEQ ID NO: 2371445 - RNA, 22 nt, Bordetella pertussis
gccgucgagcgcggccaggcgc

SEQ ID NO: 2371446 - RNA, 20 nt, Bordetella pertussis
gccgucgagcugcucgagca

SEQ ID NO: 2371447 - RNA, 22 nt, Bordetella pertussis
gccgucgagcugcucgagcaug

SEQ ID NO: 2371448 - RNA, 19 nt, Bordetella pertussis
gccgucgaucccaucgcgc

SEQ ID NO: 2371449 - RNA, 17 nt, Bordetella pertussis
gccgucgccagcgacga

SEQ ID NO: 2371450 - RNA, 17 nt, Bordetella pertussis
gccgucgcccuggcggc

SEQ ID NO: 2371451 - RNA, 18 nt, Bordetella pertussis
gccgucgcccuggcggcg

SEQ ID NO: 2371452 - RNA, 21 nt, Bordetella pertussis
gccgucgcccuggcggcgguc

SEQ ID NO: 2371453 - RNA, 22 nt, Bordetella pertussis
gccgucgcccuggcggcgguca

SEQ ID NO: 2371454 - RNA, 13 nt, Bordetella pertussis
gccgucgccgauc

SEQ ID NO: 2371455 - RNA, 12 nt, Bordetella pertussis
gccgucgccgcc

SEQ ID NO: 2371456 - RNA, 13 nt, Bordetella pertussis
gccgucgccgccc

SEQ ID NO: 2371457 - RNA, 15 nt, Bordetella pertussis
gccgucgccgcccau

SEQ ID NO: 2371458 - RNA, 17 nt, Bordetella pertussis
gccgucgccgcccaugc

SEQ ID NO: 2371459 - RNA, 19 nt, Bordetella pertussis
gccgucgccgcccaugcgc

SEQ ID NO: 2371460 - RNA, 20 nt, Bordetella pertussis
gccgucgccgcccaugcgca

SEQ ID NO: 2371461 - RNA, 17 nt, Bordetella pertussis
gccgucgccgcccugcu

SEQ ID NO: 2371462 - RNA, 17 nt, Bordetella pertussis
gccgucgccgcgcggcg

SEQ ID NO: 2371463 - RNA, 20 nt, Bordetella pertussis
gccgucgccuucggcggcga

SEQ ID NO: 2371464 - RNA, 22 nt, Bordetella pertussis
gccgucgccuucggcggcgaug

SEQ ID NO: 2371465 - RNA, 20 nt, Bordetella pertussis
gccgucgcgauuuccaugac

SEQ ID NO: 2371466 - RNA, 14 nt, Bordetella pertussis
gccgucgcgcacca

SEQ ID NO: 2371467 - RNA, 12 nt, Bordetella pertussis
gccgucgcgcuc

SEQ ID NO: 2371468 - RNA, 14 nt, Bordetella pertussis
gccgucgcgcucgg

SEQ ID NO: 2371469 - RNA, 17 nt, Bordetella pertussis
gccgucgcgcucggacg

SEQ ID NO: 2371470 - RNA, 23 nt, Bordetella pertussis
gccgucgcgcucggacgccgcgc

SEQ ID NO: 2371471 - RNA, 19 nt, Bordetella pertussis
gccgucgcgcugcaggcgu

SEQ ID NO: 2371472 - RNA, 20 nt, Bordetella pertussis
gccgucgcgcuguuccagcc

SEQ ID NO: 2371473 - RNA, 19 nt, Bordetella pertussis
gccgucgcggaccuccugg

SEQ ID NO: 2371474 - RNA, 15 nt, Bordetella pertussis
gccgucgcuggggcg

SEQ ID NO: 2371475 - RNA, 14 nt, Bordetella pertussis
gccgucggcauggg

SEQ ID NO: 2371476 - RNA, 16 nt, Bordetella pertussis
gccgucggccacgucc

SEQ ID NO: 2371477 - RNA, 12 nt, Bordetella pertussis
gccgucggccag

SEQ ID NO: 2371478 - RNA, 14 nt, Bordetella pertussis
gccgucggccgcgc

SEQ ID NO: 2371479 - RNA, 14 nt, Bordetella pertussis
gccgucggccugga

SEQ ID NO: 2371480 - RNA, 15 nt, Bordetella pertussis
gccgucggccuggaa

SEQ ID NO: 2371481 - RNA, 14 nt, Bordetella pertussis
gccgucggcgcugg

SEQ ID NO: 2371482 - RNA, 15 nt, Bordetella pertussis
gccgucggcgcuggc

SEQ ID NO: 2371483 - RNA, 16 nt, Bordetella pertussis
gccgucggcgcuggcg

SEQ ID NO: 2371484 - RNA, 18 nt, Bordetella pertussis
gccgucggcgcuggcgcg

SEQ ID NO: 2371485 - RNA, 19 nt, Bordetella pertussis
gccgucggcgcuggcgcgc

SEQ ID NO: 2371486 - RNA, 22 nt, Bordetella pertussis
gccgucggcguugugccggcgc

SEQ ID NO: 2371487 - RNA, 14 nt, Bordetella pertussis
gccgucgggcgccg

SEQ ID NO: 2371488 - RNA, 14 nt, Bordetella pertussis
gccgucgggggccg

SEQ ID NO: 2371489 - RNA, 18 nt, Bordetella pertussis
gccgucgggggccggcuc

SEQ ID NO: 2371490 - RNA, 20 nt, Bordetella pertussis
gccgucgggggccggcucgc

SEQ ID NO: 2371491 - RNA, 16 nt, Bordetella pertussis
gccgucgguaucgggc

SEQ ID NO: 2371492 - RNA, 14 nt, Bordetella pertussis
gccgucgguggugg

SEQ ID NO: 2371493 - RNA, 19 nt, Bordetella pertussis
gccgucggugguggugacg

SEQ ID NO: 2371494 - RNA, 17 nt, Bordetella pertussis
gccgucgucaucgccau

SEQ ID NO: 2371495 - RNA, 19 nt, Bordetella pertussis
gccgucgucaucgccaucg

SEQ ID NO: 2371496 - RNA, 17 nt, Bordetella pertussis
gccgucgucguccaggc

SEQ ID NO: 2371497 - RNA, 20 nt, Bordetella pertussis
gccgucgucguccaggcgca

SEQ ID NO: 2371498 - RNA, 21 nt, Bordetella pertussis
gccgucgucguccaggcgcac

SEQ ID NO: 2371499 - RNA, 13 nt, Bordetella pertussis
gccgucgugcgcc

SEQ ID NO: 2371500 - RNA, 17 nt, Bordetella pertussis
gccgucgugcgccuggc

SEQ ID NO: 2371501 - RNA, 14 nt, Bordetella pertussis
gccgucuacaggcc

SEQ ID NO: 2371502 - RNA, 19 nt, Bordetella pertussis
gccgucuacaggcccagcg

SEQ ID NO: 2371503 - RNA, 18 nt, Bordetella pertussis
gccgucucgugccccgca

SEQ ID NO: 2371504 - RNA, 18 nt, Bordetella pertussis
gccgucugcgccgccgcg

SEQ ID NO: 2371505 - RNA, 19 nt, Bordetella pertussis
gccgucugcgccgccgcgu

SEQ ID NO: 2371506 - RNA, 21 nt, Bordetella pertussis
gccgucugcgccgccgcgugg

SEQ ID NO: 2371507 - RNA, 17 nt, Bordetella pertussis
gccgucuggcggcagcu

SEQ ID NO: 2371508 - RNA, 22 nt, Bordetella pertussis
gccgucuggcggcagcucgcgc

SEQ ID NO: 2371509 - RNA, 15 nt, Bordetella pertussis
gccgucugugcgccc

SEQ ID NO: 2371510 - RNA, 21 nt, Bordetella pertussis
gccgucugugcgccccgcugg

SEQ ID NO: 2371511 - RNA, 23 nt, Bordetella pertussis
gccgucugugcgccccgcuggcc

SEQ ID NO: 2371512 - RNA, 23 nt, Bordetella pertussis
gccgucuugaggauaucggccag

SEQ ID NO: 2371513 - RNA, 16 nt, Bordetella pertussis
gccgucuuggcgggcu

SEQ ID NO: 2371514 - RNA, 16 nt, Bordetella pertussis
gccgugaaugcgccug

SEQ ID NO: 2371515 - RNA, 17 nt, Bordetella pertussis
gccgugaaugcgccugg

SEQ ID NO: 2371516 - RNA, 18 nt, Bordetella pertussis
gccgugaaugcgccuggc

SEQ ID NO: 2371517 - RNA, 19 nt, Bordetella pertussis
gccgugaaugcgccuggcg

SEQ ID NO: 2371518 - RNA, 15 nt, Bordetella pertussis
gccgugaccugcucg

SEQ ID NO: 2371519 - RNA, 19 nt, Bordetella pertussis
gccgugaccugcucgucgc

SEQ ID NO: 2371520 - RNA, 22 nt, Bordetella pertussis
gccgugacgcugauggccgcca

SEQ ID NO: 2371521 - RNA, 22 nt, Bordetella pertussis
gccgugacguugagcgccgggg

SEQ ID NO: 2371522 - RNA, 20 nt, Bordetella pertussis
gccgugagcgccgccgccau

SEQ ID NO: 2371523 - RNA, 22 nt, Bordetella pertussis
gccgugagcgccgccgccaugg

SEQ ID NO: 2371524 - RNA, 18 nt, Bordetella pertussis
gccgugaucuugaugccg

SEQ ID NO: 2371525 - RNA, 19 nt, Bordetella pertussis
gccgugaucuugaugccgc

SEQ ID NO: 2371526 - RNA, 20 nt, Bordetella pertussis
gccgugaucuugaugccgcc

SEQ ID NO: 2371527 - RNA, 20 nt, Bordetella pertussis
gccgugaugccgcccgcaug

SEQ ID NO: 2371528 - RNA, 18 nt, Bordetella pertussis
gccgugcagacggcggcu

SEQ ID NO: 2371529 - RNA, 13 nt, Bordetella pertussis
gccgugcagaugg

SEQ ID NO: 2371530 - RNA, 14 nt, Bordetella pertussis
gccgugcaggcccg

SEQ ID NO: 2371531 - RNA, 15 nt, Bordetella pertussis
gccgugcaggcccgg

SEQ ID NO: 2371532 - RNA, 16 nt, Bordetella pertussis
gccgugcaggcccggg

SEQ ID NO: 2371533 - RNA, 17 nt, Bordetella pertussis
gccgugcaggcccgggc

SEQ ID NO: 2371534 - RNA, 20 nt, Bordetella pertussis
gccgugcaggcccgggcgcc

SEQ ID NO: 2371535 - RNA, 14 nt, Bordetella pertussis
gccgugcagggcca

SEQ ID NO: 2371536 - RNA, 13 nt, Bordetella pertussis
gccgugcccggcg

SEQ ID NO: 2371537 - RNA, 13 nt, Bordetella pertussis
gccgugccgcccg

SEQ ID NO: 2371538 - RNA, 18 nt, Bordetella pertussis
gccgugccgcgcgcaccg

SEQ ID NO: 2371539 - RNA, 20 nt, Bordetella pertussis
gccgugccgcgcgcaccggc

SEQ ID NO: 2371540 - RNA, 13 nt, Bordetella pertussis
gccgugccgggcc

SEQ ID NO: 2371541 - RNA, 16 nt, Bordetella pertussis
gccgugccgggccugg

SEQ ID NO: 2371542 - RNA, 22 nt, Bordetella pertussis
gccgugccgggccuggugcccg

SEQ ID NO: 2371543 - RNA, 20 nt, Bordetella pertussis
gccgugccucaacuggccgg

SEQ ID NO: 2371544 - RNA, 23 nt, Bordetella pertussis
gccgugcgaggcgaacaggcaca

SEQ ID NO: 2371545 - RNA, 15 nt, Bordetella pertussis
gccgugcgccagcgc

SEQ ID NO: 2371546 - RNA, 13 nt, Bordetella pertussis
gccgugcgcgggc

SEQ ID NO: 2371547 - RNA, 18 nt, Bordetella pertussis
gccgugcgguucgucagg

SEQ ID NO: 2371548 - RNA, 18 nt, Bordetella pertussis
gccgugcugaucgacaug

SEQ ID NO: 2371549 - RNA, 23 nt, Bordetella pertussis
gccgugcugaucgacaugcuggc

SEQ ID NO: 2371550 - RNA, 16 nt, Bordetella pertussis
gccgugcugggcggcc

SEQ ID NO: 2371551 - RNA, 17 nt, Bordetella pertussis
gccgugcugggcggcca

SEQ ID NO: 2371552 - RNA, 18 nt, Bordetella pertussis
gccgugcuguaccucagc

SEQ ID NO: 2371553 - RNA, 19 nt, Bordetella pertussis
gccgugcuguaccucagcc

SEQ ID NO: 2371554 - RNA, 14 nt, Bordetella pertussis
gccguggacgugcg

SEQ ID NO: 2371555 - RNA, 21 nt, Bordetella pertussis
gccguggacgugcgcgaccgc

SEQ ID NO: 2371556 - RNA, 23 nt, Bordetella pertussis
gccguggacgugcgcgaccgcgc

SEQ ID NO: 2371557 - RNA, 16 nt, Bordetella pertussis
gccguggaggcggcgg

SEQ ID NO: 2371558 - RNA, 18 nt, Bordetella pertussis
gccguggaggcggcggcc

SEQ ID NO: 2371559 - RNA, 22 nt, Bordetella pertussis
gccguggcccagccgcaugccg

SEQ ID NO: 2371560 - RNA, 21 nt, Bordetella pertussis
gccguggccggcaucgcgcug

SEQ ID NO: 2371561 - RNA, 17 nt, Bordetella pertussis
gccguggccgggcccgg

SEQ ID NO: 2371562 - RNA, 17 nt, Bordetella pertussis
gccguggcgauccaggg

SEQ ID NO: 2371563 - RNA, 16 nt, Bordetella pertussis
gccguggcgcaccagg

SEQ ID NO: 2371564 - RNA, 17 nt, Bordetella pertussis
gccguggcgcaccaggu

SEQ ID NO: 2371565 - RNA, 22 nt, Bordetella pertussis
gccguggcgcaccagguuggcg

SEQ ID NO: 2371566 - RNA, 13 nt, Bordetella pertussis
gccguggcggcca

SEQ ID NO: 2371567 - RNA, 19 nt, Bordetella pertussis
gccguggcggccugcgccg

SEQ ID NO: 2371568 - RNA, 20 nt, Bordetella pertussis
gccguggcggccugcgccgg

SEQ ID NO: 2371569 - RNA, 21 nt, Bordetella pertussis
gccguggcggccugcgccggc

SEQ ID NO: 2371570 - RNA, 22 nt, Bordetella pertussis
gccguggcggccugcgccggca

SEQ ID NO: 2371571 - RNA, 14 nt, Bordetella pertussis
gccguggcgggucc

SEQ ID NO: 2371572 - RNA, 21 nt, Bordetella pertussis
gccguggcggguccacguggc

SEQ ID NO: 2371573 - RNA, 21 nt, Bordetella pertussis
gccguggcgugcaggccggcg

SEQ ID NO: 2371574 - RNA, 13 nt, Bordetella pertussis
gccguggcguuga

SEQ ID NO: 2371575 - RNA, 18 nt, Bordetella pertussis
gccguggcguugacggcc

SEQ ID NO: 2371576 - RNA, 22 nt, Bordetella pertussis
gccguggcguugacggcccagc

SEQ ID NO: 2371577 - RNA, 23 nt, Bordetella pertussis
gccguggcguugacggcccagcu

SEQ ID NO: 2371578 - RNA, 20 nt, Bordetella pertussis
gccguggcuggucacgucca

SEQ ID NO: 2371579 - RNA, 16 nt, Bordetella pertussis
gccgugggacaggcac

SEQ ID NO: 2371580 - RNA, 18 nt, Bordetella pertussis
gccgugggacaggcacuc

SEQ ID NO: 2371581 - RNA, 20 nt, Bordetella pertussis
gccgugggacaggcacucuu

SEQ ID NO: 2371582 - RNA, 17 nt, Bordetella pertussis
gccgugggcgaacuggu

SEQ ID NO: 2371583 - RNA, 22 nt, Bordetella pertussis
gccgugucgcccuucaggccag

SEQ ID NO: 2371584 - RNA, 19 nt, Bordetella pertussis
gccguguucgagcaggcgc

SEQ ID NO: 2371585 - RNA, 15 nt, Bordetella pertussis
gccguguuguccugg

SEQ ID NO: 2371586 - RNA, 19 nt, Bordetella pertussis
gccguguuguccuggacag

SEQ ID NO: 2371587 - RNA, 23 nt, Bordetella pertussis
gccguuaugguucggccucgccc

SEQ ID NO: 2371588 - RNA, 12 nt, Bordetella pertussis
gccguucaggga

SEQ ID NO: 2371589 - RNA, 23 nt, Bordetella pertussis
gccguucagggacgggccagccc

SEQ ID NO: 2371590 - RNA, 23 nt, Bordetella pertussis
gccguucagguucaucagccgga

SEQ ID NO: 2371591 - RNA, 21 nt, Bordetella pertussis
gccguucaucagcgcgcgcag

SEQ ID NO: 2371592 - RNA, 14 nt, Bordetella pertussis
gccguucaugccga

SEQ ID NO: 2371593 - RNA, 15 nt, Bordetella pertussis
gccguuccagcugcu

SEQ ID NO: 2371594 - RNA, 16 nt, Bordetella pertussis
gccguuccaguccagc

SEQ ID NO: 2371595 - RNA, 16 nt, Bordetella pertussis
gccguucccgccgggc

SEQ ID NO: 2371596 - RNA, 17 nt, Bordetella pertussis
gccguucccgccgggcu

SEQ ID NO: 2371597 - RNA, 13 nt, Bordetella pertussis
gccguucgcgcug

SEQ ID NO: 2371598 - RNA, 23 nt, Bordetella pertussis
gccguucggaguaguugucgucg

SEQ ID NO: 2371599 - RNA, 17 nt, Bordetella pertussis
gccguucggccagcgcg

SEQ ID NO: 2371600 - RNA, 22 nt, Bordetella pertussis
gccguucggccagcgcgcggcg

SEQ ID NO: 2371601 - RNA, 16 nt, Bordetella pertussis
gccguucggugcgcag

SEQ ID NO: 2371602 - RNA, 13 nt, Bordetella pertussis
gccguucgucgcg

SEQ ID NO: 2371603 - RNA, 15 nt, Bordetella pertussis
gccguucgucgcgca

SEQ ID NO: 2371604 - RNA, 18 nt, Bordetella pertussis
gccguucgucgcgcagca

SEQ ID NO: 2371605 - RNA, 16 nt, Bordetella pertussis
gccguucucaggccga

SEQ ID NO: 2371606 - RNA, 23 nt, Bordetella pertussis
gccguucucaggccgaggcugcg

SEQ ID NO: 2371607 - RNA, 22 nt, Bordetella pertussis
gccguucuggcagugcgccugg

SEQ ID NO: 2371608 - RNA, 14 nt, Bordetella pertussis
gccguucuggcugc

SEQ ID NO: 2371609 - RNA, 17 nt, Bordetella pertussis
gccguucuucgaucgcc

SEQ ID NO: 2371610 - RNA, 22 nt, Bordetella pertussis
gccguucuucgaucgccugggg

SEQ ID NO: 2371611 - RNA, 14 nt, Bordetella pertussis
gccguugaucuggu

SEQ ID NO: 2371612 - RNA, 18 nt, Bordetella pertussis
gccguugaucugguucau

SEQ ID NO: 2371613 - RNA, 23 nt, Bordetella pertussis
gccguugccgcuguggcgcgcca

SEQ ID NO: 2371614 - RNA, 18 nt, Bordetella pertussis
gccguugcgccagcggcg

SEQ ID NO: 2371615 - RNA, 20 nt, Bordetella pertussis
gccguugcgccagcggcgac

SEQ ID NO: 2371616 - RNA, 15 nt, Bordetella pertussis
gccguugcgccugcc

SEQ ID NO: 2371617 - RNA, 13 nt, Bordetella pertussis
gccguugcuccag

SEQ ID NO: 2371618 - RNA, 14 nt, Bordetella pertussis
gccguugcuccagc

SEQ ID NO: 2371619 - RNA, 16 nt, Bordetella pertussis
gccguugcuccagcca

SEQ ID NO: 2371620 - RNA, 19 nt, Bordetella pertussis
gccguugcuccagccaggc

SEQ ID NO: 2371621 - RNA, 22 nt, Bordetella pertussis
gccguugcuccagccaggcgcg

SEQ ID NO: 2371622 - RNA, 16 nt, Bordetella pertussis
gccguugcucgcgcgc

SEQ ID NO: 2371623 - RNA, 18 nt, Bordetella pertussis
gccguugcucgcgcgcag

SEQ ID NO: 2371624 - RNA, 18 nt, Bordetella pertussis
gccguuggagccggagca

SEQ ID NO: 2371625 - RNA, 19 nt, Bordetella pertussis
gccguuggagccggagcag

SEQ ID NO: 2371626 - RNA, 14 nt, Bordetella pertussis
gccguuggccagcg

SEQ ID NO: 2371627 - RNA, 16 nt, Bordetella pertussis
gccguuggccagcgcc

SEQ ID NO: 2371628 - RNA, 17 nt, Bordetella pertussis
gccguuggccagcgccg

SEQ ID NO: 2371629 - RNA, 19 nt, Bordetella pertussis
gccguuggccagcgccgcc

SEQ ID NO: 2371630 - RNA, 13 nt, Bordetella pertussis
gccguuggccgcg

SEQ ID NO: 2371631 - RNA, 14 nt, Bordetella pertussis
gccguuggccgcgc

SEQ ID NO: 2371632 - RNA, 17 nt, Bordetella pertussis
gccguuggcgauggcgc

SEQ ID NO: 2371633 - RNA, 21 nt, Bordetella pertussis
gccguuggcgauggcgcggcc

SEQ ID NO: 2371634 - RNA, 14 nt, Bordetella pertussis
gccguuggcgccca

SEQ ID NO: 2371635 - RNA, 16 nt, Bordetella pertussis
gccguuggcgcccagc

SEQ ID NO: 2371636 - RNA, 17 nt, Bordetella pertussis
gccguuggcgcccagcg

SEQ ID NO: 2371637 - RNA, 18 nt, Bordetella pertussis
gccguuggcgugcagcca

SEQ ID NO: 2371638 - RNA, 21 nt, Bordetella pertussis
gccguuguccuggcgcgccag

SEQ ID NO: 2371639 - RNA, 19 nt, Bordetella pertussis
gccguuucaggccugcggc

SEQ ID NO: 2371640 - RNA, 19 nt, Bordetella pertussis
gccguuuccucuggagacg

SEQ ID NO: 2371641 - RNA, 18 nt, Bordetella pertussis
gccguuucucaacccgcc

SEQ ID NO: 2371642 - RNA, 20 nt, Bordetella pertussis
gccguuucucaacccgccgg

SEQ ID NO: 2371643 - RNA, 22 nt, Bordetella pertussis
gccguuucucaacccgccggcc

SEQ ID NO: 2371644 - RNA, 19 nt, Bordetella pertussis
gccguuuucagcgcaggcu

SEQ ID NO: 2371645 - RNA, 15 nt, Bordetella pertussis
gccuacacgguggcg

SEQ ID NO: 2371646 - RNA, 22 nt, Bordetella pertussis
gccuacacgguggcggugcucg

SEQ ID NO: 2371647 - RNA, 23 nt, Bordetella pertussis
gccuacacgguggcggugcucga

SEQ ID NO: 2371648 - RNA, 13 nt, Bordetella pertussis
gccuacggcggcg

SEQ ID NO: 2371649 - RNA, 20 nt, Bordetella pertussis
gccuacggcggcggccaucg

SEQ ID NO: 2371650 - RNA, 15 nt, Bordetella pertussis
gccuacuggcgcgcg

SEQ ID NO: 2371651 - RNA, 18 nt, Bordetella pertussis
gccuacuucggcagcuug

SEQ ID NO: 2371652 - RNA, 15 nt, Bordetella pertussis
gccuacuugccggcg

SEQ ID NO: 2371653 - RNA, 15 nt, Bordetella pertussis
gccuaggcugcagcc

SEQ ID NO: 2371654 - RNA, 16 nt, Bordetella pertussis
gccuaggcugcagcca

SEQ ID NO: 2371655 - RNA, 17 nt, Bordetella pertussis
gccuaugaagacgcgcu

SEQ ID NO: 2371656 - RNA, 20 nt, Bordetella pertussis
gccuaugaagacgcgcucgc

SEQ ID NO: 2371657 - RNA, 16 nt, Bordetella pertussis
gccugcagcagcgccu

SEQ ID NO: 2371658 - RNA, 15 nt, Bordetella pertussis
gccugcagcagcgug

SEQ ID NO: 2371659 - RNA, 21 nt, Bordetella pertussis
gccugcagcagcguggccgcc

SEQ ID NO: 2371660 - RNA, 13 nt, Bordetella pertussis
gccugcagcgccg

SEQ ID NO: 2371661 - RNA, 16 nt, Bordetella pertussis
gccugcagcgccgccu

SEQ ID NO: 2371662 - RNA, 13 nt, Bordetella pertussis
gccugcagcgcgc

SEQ ID NO: 2371663 - RNA, 14 nt, Bordetella pertussis
gccugcagcgcgcg

SEQ ID NO: 2371664 - RNA, 15 nt, Bordetella pertussis
gccugcagcgcgcgc

SEQ ID NO: 2371665 - RNA, 19 nt, Bordetella pertussis
gccugcaggaagccugcgc

SEQ ID NO: 2371666 - RNA, 21 nt, Bordetella pertussis
gccugcaggaagccugcgcgc

SEQ ID NO: 2371667 - RNA, 15 nt, Bordetella pertussis
gccugcaggaugggc

SEQ ID NO: 2371668 - RNA, 15 nt, Bordetella pertussis
gccugcaggcccagc

SEQ ID NO: 2371669 - RNA, 16 nt, Bordetella pertussis
gccugcaggcccagca

SEQ ID NO: 2371670 - RNA, 12 nt, Bordetella pertussis
gccugcaggccg

SEQ ID NO: 2371671 - RNA, 24 nt, Bordetella pertussis
gccugcaggccguuccaguccagc

SEQ ID NO: 2371672 - RNA, 18 nt, Bordetella pertussis
gccugcaggucuucgggc

SEQ ID NO: 2371673 - RNA, 15 nt, Bordetella pertussis
gccugcaggugccgc

SEQ ID NO: 2371674 - RNA, 16 nt, Bordetella pertussis
gccugcaggugccgcc

SEQ ID NO: 2371675 - RNA, 17 nt, Bordetella pertussis
gccugcaggugccgccg

SEQ ID NO: 2371676 - RNA, 19 nt, Bordetella pertussis
gccugcaggugccgccggc

SEQ ID NO: 2371677 - RNA, 21 nt, Bordetella pertussis
gccugcaggugccgccggcgc

SEQ ID NO: 2371678 - RNA, 14 nt, Bordetella pertussis
gccugcaguucggc

SEQ ID NO: 2371679 - RNA, 18 nt, Bordetella pertussis
gccugcaguucggccgcc

SEQ ID NO: 2371680 - RNA, 21 nt, Bordetella pertussis
gccugcaguucggccgccagg

SEQ ID NO: 2371681 - RNA, 18 nt, Bordetella pertussis
gccugcaucacgguaggc

SEQ ID NO: 2371682 - RNA, 21 nt, Bordetella pertussis
gccugcaucacgguaggcgcg

SEQ ID NO: 2371683 - RNA, 13 nt, Bordetella pertussis
gccugcauccggc

SEQ ID NO: 2371684 - RNA, 15 nt, Bordetella pertussis
gccugcauccggccc

SEQ ID NO: 2371685 - RNA, 22 nt, Bordetella pertussis
gccugcauccggcccagcgcca

SEQ ID NO: 2371686 - RNA, 20 nt, Bordetella pertussis
gccugcaugccauagucgcg

SEQ ID NO: 2371687 - RNA, 17 nt, Bordetella pertussis
gccugcauguccagcgg

SEQ ID NO: 2371688 - RNA, 18 nt, Bordetella pertussis
gccugcauguccagcggc

SEQ ID NO: 2371689 - RNA, 19 nt, Bordetella pertussis
gccugcauguccagcggcg

SEQ ID NO: 2371690 - RNA, 20 nt, Bordetella pertussis
gccugcaugucguacaggcc

SEQ ID NO: 2371691 - RNA, 22 nt, Bordetella pertussis
gccugcaugucguacaggccgu

SEQ ID NO: 2371692 - RNA, 16 nt, Bordetella pertussis
gccugccaagcgccgc

SEQ ID NO: 2371693 - RNA, 20 nt, Bordetella pertussis
gccugccaagcgccgcggcc

SEQ ID NO: 2371694 - RNA, 13 nt, Bordetella pertussis
gccugccaccagc

SEQ ID NO: 2371695 - RNA, 14 nt, Bordetella pertussis
gccugccaccagcg

SEQ ID NO: 2371696 - RNA, 16 nt, Bordetella pertussis
gccugccaccagcgcg

SEQ ID NO: 2371697 - RNA, 17 nt, Bordetella pertussis
gccugccaccagcgcgc

SEQ ID NO: 2371698 - RNA, 18 nt, Bordetella pertussis
gccugccaccagcgcgcc

SEQ ID NO: 2371699 - RNA, 19 nt, Bordetella pertussis
gccugccaccagcgcgcca

SEQ ID NO: 2371700 - RNA, 22 nt, Bordetella pertussis
gccugccaccagcgcgccagca

SEQ ID NO: 2371701 - RNA, 24 nt, Bordetella pertussis
gccugccaccagcgcgccagcaga

SEQ ID NO: 2371702 - RNA, 18 nt, Bordetella pertussis
gccugccagaacagccgc

SEQ ID NO: 2371703 - RNA, 22 nt, Bordetella pertussis
gccugccagaacagccgcgagg

SEQ ID NO: 2371704 - RNA, 13 nt, Bordetella pertussis
gccugccagccca

SEQ ID NO: 2371705 - RNA, 16 nt, Bordetella pertussis
gccugccagcccacca

SEQ ID NO: 2371706 - RNA, 18 nt, Bordetella pertussis
gccugccagcccaccagc

SEQ ID NO: 2371707 - RNA, 21 nt, Bordetella pertussis
gccugccagcccaccagcgcc

SEQ ID NO: 2371708 - RNA, 14 nt, Bordetella pertussis
gccugccagccugc

SEQ ID NO: 2371709 - RNA, 13 nt, Bordetella pertussis
gccugccaguucg

SEQ ID NO: 2371710 - RNA, 14 nt, Bordetella pertussis
gccugccauccggc

SEQ ID NO: 2371711 - RNA, 16 nt, Bordetella pertussis
gccugccauccggccg

SEQ ID NO: 2371712 - RNA, 18 nt, Bordetella pertussis
gccugccauccggccgca

SEQ ID NO: 2371713 - RNA, 23 nt, Bordetella pertussis
gccugccauccggccgcacgcgg

SEQ ID NO: 2371714 - RNA, 16 nt, Bordetella pertussis
gccugcccaggccagc

SEQ ID NO: 2371715 - RNA, 17 nt, Bordetella pertussis
gccugcccaggccagcg

SEQ ID NO: 2371716 - RNA, 19 nt, Bordetella pertussis
gccugcccaggccagcgcc

SEQ ID NO: 2371717 - RNA, 22 nt, Bordetella pertussis
gccugcccaggccagcgccgcg

SEQ ID NO: 2371718 - RNA, 18 nt, Bordetella pertussis
gccugcccauggccugca

SEQ ID NO: 2371719 - RNA, 20 nt, Bordetella pertussis
gccugccccgauacaaggug

SEQ ID NO: 2371720 - RNA, 14 nt, Bordetella pertussis
gccugccccgccgg

SEQ ID NO: 2371721 - RNA, 16 nt, Bordetella pertussis
gccugccccgccugcg

SEQ ID NO: 2371722 - RNA, 17 nt, Bordetella pertussis
gccugccccggcagaga

SEQ ID NO: 2371723 - RNA, 17 nt, Bordetella pertussis
gccugccccugcgggga

SEQ ID NO: 2371724 - RNA, 14 nt, Bordetella pertussis
gccugcccgcaacg

SEQ ID NO: 2371725 - RNA, 20 nt, Bordetella pertussis
gccugcccgcacgggccgac

SEQ ID NO: 2371726 - RNA, 22 nt, Bordetella pertussis
gccugcccgcacgggccgacgg

SEQ ID NO: 2371727 - RNA, 18 nt, Bordetella pertussis
gccugcccgggcaccagg

SEQ ID NO: 2371728 - RNA, 14 nt, Bordetella pertussis
gccugcccgggcag

SEQ ID NO: 2371729 - RNA, 18 nt, Bordetella pertussis
gccugcccgggcagcacc

SEQ ID NO: 2371730 - RNA, 13 nt, Bordetella pertussis
gccugcccgucgg

SEQ ID NO: 2371731 - RNA, 16 nt, Bordetella pertussis
gccugcccgucgggca

SEQ ID NO: 2371732 - RNA, 19 nt, Bordetella pertussis
gccugcccguucacgcgca

SEQ ID NO: 2371733 - RNA, 20 nt, Bordetella pertussis
gccugcccguucacgcgcag

SEQ ID NO: 2371734 - RNA, 22 nt, Bordetella pertussis
gccugcccguucacgcgcagcg

SEQ ID NO: 2371735 - RNA, 12 nt, Bordetella pertussis
gccugcccuggu

SEQ ID NO: 2371736 - RNA, 17 nt, Bordetella pertussis
gccugccgagcgcugcg

SEQ ID NO: 2371737 - RNA, 15 nt, Bordetella pertussis
gccugccgaucgugc

SEQ ID NO: 2371738 - RNA, 21 nt, Bordetella pertussis
gccugccgaucgugcacgccc

SEQ ID NO: 2371739 - RNA, 16 nt, Bordetella pertussis
gccugccgcaucccgc

SEQ ID NO: 2371740 - RNA, 13 nt, Bordetella pertussis
gccugccgccugc

SEQ ID NO: 2371741 - RNA, 16 nt, Bordetella pertussis
gccugccgcgcccggc

SEQ ID NO: 2371742 - RNA, 18 nt, Bordetella pertussis
gccugccgcgcccggcgg

SEQ ID NO: 2371743 - RNA, 20 nt, Bordetella pertussis
gccugccgcgcccggcggcc

SEQ ID NO: 2371744 - RNA, 21 nt, Bordetella pertussis
gccugccgcgccgaccggccc

SEQ ID NO: 2371745 - RNA, 13 nt, Bordetella pertussis
gccugccgcgcgu

SEQ ID NO: 2371746 - RNA, 22 nt, Bordetella pertussis
gccugccgcggccgcccccagc

SEQ ID NO: 2371747 - RNA, 14 nt, Bordetella pertussis
gccugccgcgugcc

SEQ ID NO: 2371748 - RNA, 13 nt, Bordetella pertussis
gccugccggccgg

SEQ ID NO: 2371749 - RNA, 19 nt, Bordetella pertussis
gccugccggccggccagua

SEQ ID NO: 2371750 - RNA, 19 nt, Bordetella pertussis
gccugccggccuggcucag

SEQ ID NO: 2371751 - RNA, 14 nt, Bordetella pertussis
gccugccggcgcac

SEQ ID NO: 2371752 - RNA, 22 nt, Bordetella pertussis
gccugccggcgcacaaucugcg

SEQ ID NO: 2371753 - RNA, 16 nt, Bordetella pertussis
gccugccggcgcgccu

SEQ ID NO: 2371754 - RNA, 15 nt, Bordetella pertussis
gccugccggcggccu

SEQ ID NO: 2371755 - RNA, 20 nt, Bordetella pertussis
gccugccggcggccuaugug

SEQ ID NO: 2371756 - RNA, 15 nt, Bordetella pertussis
gccugcgaacgcccg

SEQ ID NO: 2371757 - RNA, 17 nt, Bordetella pertussis
gccugcgaacgcccggc

SEQ ID NO: 2371758 - RNA, 18 nt, Bordetella pertussis
gccugcgaacgcccggcc

SEQ ID NO: 2371759 - RNA, 22 nt, Bordetella pertussis
gccugcgagagauagcccagca

SEQ ID NO: 2371760 - RNA, 13 nt, Bordetella pertussis
gccugcgccacca

SEQ ID NO: 2371761 - RNA, 21 nt, Bordetella pertussis
gccugcgccaccagcuugcgc

SEQ ID NO: 2371762 - RNA, 23 nt, Bordetella pertussis
gccugcgccaccagcuugcgcgc

SEQ ID NO: 2371763 - RNA, 15 nt, Bordetella pertussis
gccugcgccaccugg

SEQ ID NO: 2371764 - RNA, 17 nt, Bordetella pertussis
gccugcgccaccuggcg

SEQ ID NO: 2371765 - RNA, 18 nt, Bordetella pertussis
gccugcgccaccuggcgc

SEQ ID NO: 2371766 - RNA, 19 nt, Bordetella pertussis
gccugcgccaccuggcgcc

SEQ ID NO: 2371767 - RNA, 22 nt, Bordetella pertussis
gccugcgccaccuggcgcccgg

SEQ ID NO: 2371768 - RNA, 16 nt, Bordetella pertussis
gccugcgccacgucca

SEQ ID NO: 2371769 - RNA, 21 nt, Bordetella pertussis
gccugcgccacguccagcacg

SEQ ID NO: 2371770 - RNA, 22 nt, Bordetella pertussis
gccuggccagauagcccaggcg

SEQ ID NO: 2371771 - RNA, 18 nt, Bordetella pertussis
gccuggcccacaucgucg

SEQ ID NO: 2371772 - RNA, 20 nt, Bordetella pertussis
gccuggcccacaucgucgcg

SEQ ID NO: 2371773 - RNA, 14 nt, Bordetella pertussis
gccuggcccagcuc

SEQ ID NO: 2371774 - RNA, 15 nt, Bordetella pertussis
gccuggcccagcucc

SEQ ID NO: 2371775 - RNA, 17 nt, Bordetella pertussis
gccuggcccagcuccag

SEQ ID NO: 2371776 - RNA, 18 nt, Bordetella pertussis
gccuggcccagcuccagc

SEQ ID NO: 2371777 - RNA, 19 nt, Bordetella pertussis
gccuggcccagcuccagcu

SEQ ID NO: 2371778 - RNA, 18 nt, Bordetella pertussis
gccuggccccaggcgccc

SEQ ID NO: 2371779 - RNA, 20 nt, Bordetella pertussis
gccuggccccaggcgcccga

SEQ ID NO: 2371780 - RNA, 15 nt, Bordetella pertussis
gccuggcccgaacgg

SEQ ID NO: 2371781 - RNA, 22 nt, Bordetella pertussis
gccuggcccgaacggcccaucc

SEQ ID NO: 2371782 - RNA, 16 nt, Bordetella pertussis
gccuggccgagcgcgg

SEQ ID NO: 2371783 - RNA, 22 nt, Bordetella pertussis
gccuggccgagcgcggcaugcg

SEQ ID NO: 2371784 - RNA, 19 nt, Bordetella pertussis
gccuggccgcccagcgccu

SEQ ID NO: 2371785 - RNA, 21 nt, Bordetella pertussis
gccuggccgcccagcgccugc

SEQ ID NO: 2371786 - RNA, 22 nt, Bordetella pertussis
gccuggccgcccagcgccugca

SEQ ID NO: 2371787 - RNA, 13 nt, Bordetella pertussis
gccuggccgccgg

SEQ ID NO: 2371788 - RNA, 15 nt, Bordetella pertussis
gccuggccgccggcg

SEQ ID NO: 2371789 - RNA, 17 nt, Bordetella pertussis
gccuggccgccggcggc

SEQ ID NO: 2371790 - RNA, 18 nt, Bordetella pertussis
gccuggccgccggcggcg

SEQ ID NO: 2371791 - RNA, 19 nt, Bordetella pertussis
gccuggccgccggcggcgc

SEQ ID NO: 2371792 - RNA, 23 nt, Bordetella pertussis
gccuggccgccggcggcgcacca

SEQ ID NO: 2371793 - RNA, 14 nt, Bordetella pertussis
gccuggccgcgcgc

SEQ ID NO: 2371794 - RNA, 16 nt, Bordetella pertussis
gccuggccgcgcgccu

SEQ ID NO: 2371795 - RNA, 19 nt, Bordetella pertussis
gccuggccgcgcgccugcu

SEQ ID NO: 2371796 - RNA, 14 nt, Bordetella pertussis
gccuggccgcgcug

SEQ ID NO: 2371797 - RNA, 16 nt, Bordetella pertussis
gccuggccgcgcugau

SEQ ID NO: 2371798 - RNA, 22 nt, Bordetella pertussis
gccuggccggggaagccgccgg

SEQ ID NO: 2371799 - RNA, 15 nt, Bordetella pertussis
gccuggccugcgccg

SEQ ID NO: 2371800 - RNA, 16 nt, Bordetella pertussis
gccuggccugcgccgc

SEQ ID NO: 2371801 - RNA, 20 nt, Bordetella pertussis
gccuggcgaacaguugcacc

SEQ ID NO: 2371802 - RNA, 21 nt, Bordetella pertussis
gccuggcgccaacccgccauc

SEQ ID NO: 2371803 - RNA, 14 nt, Bordetella pertussis
gccuggcgccgcgc

SEQ ID NO: 2371804 - RNA, 18 nt, Bordetella pertussis
gccuggcgcgacgccugc

SEQ ID NO: 2371805 - RNA, 14 nt, Bordetella pertussis
gccuggcgcgccca

SEQ ID NO: 2371806 - RNA, 17 nt, Bordetella pertussis
gccuggcgcgcggccug

SEQ ID NO: 2371807 - RNA, 13 nt, Bordetella pertussis
gccuggcgcggcc

SEQ ID NO: 2371808 - RNA, 21 nt, Bordetella pertussis
gccuggcgcggccccaugcgc

SEQ ID NO: 2371809 - RNA, 14 nt, Bordetella pertussis
gccuggcgcggcgc

SEQ ID NO: 2371810 - RNA, 18 nt, Bordetella pertussis
gccuggcgcggcgccugc

SEQ ID NO: 2371811 - RNA, 23 nt, Bordetella pertussis
gccuggcgcggcgccugcgcgcg

SEQ ID NO: 2371812 - RNA, 12 nt, Bordetella pertussis
gccuggcgcucc

SEQ ID NO: 2371813 - RNA, 20 nt, Bordetella pertussis
gccuggcgcuccucgcgcgc

SEQ ID NO: 2371814 - RNA, 21 nt, Bordetella pertussis
gccuggcgcuccucgcgcgcg

SEQ ID NO: 2371815 - RNA, 20 nt, Bordetella pertussis
gccuggcggacgauggccug

SEQ ID NO: 2371816 - RNA, 18 nt, Bordetella pertussis
gccuggcggaucucggcc

SEQ ID NO: 2371817 - RNA, 19 nt, Bordetella pertussis
gccuggcggaucucggcca

SEQ ID NO: 2371818 - RNA, 20 nt, Bordetella pertussis
gccuggcggaucucggccag

SEQ ID NO: 2371819 - RNA, 21 nt, Bordetella pertussis
gccuggcggaucucggccagc

SEQ ID NO: 2371820 - RNA, 13 nt, Bordetella pertussis
gccuggcggcugg

SEQ ID NO: 2371821 - RNA, 17 nt, Bordetella pertussis
gccuggcggcuggucaa

SEQ ID NO: 2371822 - RNA, 13 nt, Bordetella pertussis
gccuggcgggccg

SEQ ID NO: 2371823 - RNA, 22 nt, Bordetella pertussis
gccuggcgguaugcggcgccca

SEQ ID NO: 2371824 - RNA, 21 nt, Bordetella pertussis
gccuggcguucaaucgcgcuu

SEQ ID NO: 2371825 - RNA, 12 nt, Bordetella pertussis
gccuggcguucg

SEQ ID NO: 2371826 - RNA, 15 nt, Bordetella pertussis
gccuggcucaggccu

SEQ ID NO: 2371827 - RNA, 21 nt, Bordetella pertussis
gccuggcucaggccugcacgu

SEQ ID NO: 2371828 - RNA, 23 nt, Bordetella pertussis
gccuggcucagucggccuggcgc

SEQ ID NO: 2371829 - RNA, 19 nt, Bordetella pertussis
gccuggcuccccgggcacc

SEQ ID NO: 2371830 - RNA, 16 nt, Bordetella pertussis
gccuggcuuacaggcc

SEQ ID NO: 2371831 - RNA, 20 nt, Bordetella pertussis
gccuggcuuacaggcccagu

SEQ ID NO: 2371832 - RNA, 21 nt, Bordetella pertussis
gccuggcuuacaggcccagua

SEQ ID NO: 2371833 - RNA, 21 nt, Bordetella pertussis
gccuggcuucccgguccaggc

SEQ ID NO: 2371834 - RNA, 23 nt, Bordetella pertussis
gccuggcuucccgguccaggccg

SEQ ID NO: 2371835 - RNA, 20 nt, Bordetella pertussis
gccuggcuugcgccacgccc

SEQ ID NO: 2371836 - RNA, 16 nt, Bordetella pertussis
gccuggcuuggcggcc

SEQ ID NO: 2371837 - RNA, 17 nt, Bordetella pertussis
gccuggcuuggcggcca

SEQ ID NO: 2371838 - RNA, 21 nt, Bordetella pertussis
gccuggcuuucgccgcgggcc

SEQ ID NO: 2371839 - RNA, 16 nt, Bordetella pertussis
gccugggaggcgcuga

SEQ ID NO: 2371840 - RNA, 17 nt, Bordetella pertussis
gccugggaggcgcugau

SEQ ID NO: 2371841 - RNA, 15 nt, Bordetella pertussis
gccugggccauggcc

SEQ ID NO: 2371842 - RNA, 16 nt, Bordetella pertussis
gccugggccauggccu

SEQ ID NO: 2371843 - RNA, 18 nt, Bordetella pertussis
gccugggccgacaugccg

SEQ ID NO: 2371844 - RNA, 22 nt, Bordetella pertussis
gccugggccuucuugucgcugg

SEQ ID NO: 2371845 - RNA, 13 nt, Bordetella pertussis
gccugggcgccug

SEQ ID NO: 2371846 - RNA, 15 nt, Bordetella pertussis
gccugggcgccuggc

SEQ ID NO: 2371847 - RNA, 18 nt, Bordetella pertussis
gccugggcgccuggcugc

SEQ ID NO: 2371848 - RNA, 15 nt, Bordetella pertussis
gccugggcgcgcgcc

SEQ ID NO: 2371849 - RNA, 16 nt, Bordetella pertussis
gccugggcgcgcgccc

SEQ ID NO: 2371850 - RNA, 21 nt, Bordetella pertussis
gccugggcgcgguccagcaag

SEQ ID NO: 2371851 - RNA, 15 nt, Bordetella pertussis
gccugggcggccacg

SEQ ID NO: 2371852 - RNA, 14 nt, Bordetella pertussis
gccugggcggcgcg

SEQ ID NO: 2371853 - RNA, 15 nt, Bordetella pertussis
gccugggcggcgcgc

SEQ ID NO: 2371854 - RNA, 16 nt, Bordetella pertussis
gccugggcggcgcgcu

SEQ ID NO: 2371855 - RNA, 13 nt, Bordetella pertussis
gccugggcggcgg

SEQ ID NO: 2371856 - RNA, 14 nt, Bordetella pertussis
gccugggcgggccg

SEQ ID NO: 2371857 - RNA, 17 nt, Bordetella pertussis
gccugggcgggccguug

SEQ ID NO: 2371858 - RNA, 18 nt, Bordetella pertussis
gccugggcgggccguugc

SEQ ID NO: 2371859 - RNA, 16 nt, Bordetella pertussis
gccugggcgucgagcg

SEQ ID NO: 2371860 - RNA, 19 nt, Bordetella pertussis
gccugggcgucgagcggcg

SEQ ID NO: 2371861 - RNA, 21 nt, Bordetella pertussis
gccugggcgucgagcggcgug

SEQ ID NO: 2371862 - RNA, 17 nt, Bordetella pertussis
gccuggggacgggcgca

SEQ ID NO: 2371863 - RNA, 15 nt, Bordetella pertussis
gccuggggcaggcgg

SEQ ID NO: 2371864 - RNA, 22 nt, Bordetella pertussis
gccuggggcaguuuccagggcu

SEQ ID NO: 2371865 - RNA, 15 nt, Bordetella pertussis
gccuggggcgggcgc

SEQ ID NO: 2371866 - RNA, 18 nt, Bordetella pertussis
gccuggggcgggcgcugc

SEQ ID NO: 2371867 - RNA, 19 nt, Bordetella pertussis
gccuggggcgggcgcugcg

SEQ ID NO: 2371868 - RNA, 17 nt, Bordetella pertussis
gccugggggcuggaggc

SEQ ID NO: 2371869 - RNA, 18 nt, Bordetella pertussis
gccugggggcuggaggcg

SEQ ID NO: 2371870 - RNA, 20 nt, Bordetella pertussis
gccuggggggucaaccaggu

SEQ ID NO: 2371871 - RNA, 16 nt, Bordetella pertussis
gccugggguaggcgcg

SEQ ID NO: 2371872 - RNA, 17 nt, Bordetella pertussis
gccugggucaggucggc

SEQ ID NO: 2371873 - RNA, 21 nt, Bordetella pertussis
gccugggugcgguaggcgccc

SEQ ID NO: 2371874 - RNA, 14 nt, Bordetella pertussis
gccugggugcuggu

SEQ ID NO: 2371875 - RNA, 15 nt, Bordetella pertussis
gccugguacgacagc

SEQ ID NO: 2371876 - RNA, 20 nt, Bordetella pertussis
gccugguacgacagcucggg

SEQ ID NO: 2371877 - RNA, 22 nt, Bordetella pertussis
gccugguaguaaucgcgcgcca

SEQ ID NO: 2371878 - RNA, 21 nt, Bordetella pertussis
gccuggucagguugcgccggc

SEQ ID NO: 2371879 - RNA, 22 nt, Bordetella pertussis
gccuggucaugacgggcggcgg

SEQ ID NO: 2371880 - RNA, 16 nt, Bordetella pertussis
gccugguccgccgcga

SEQ ID NO: 2371881 - RNA, 13 nt, Bordetella pertussis
gccuggucgaagu

SEQ ID NO: 2371882 - RNA, 16 nt, Bordetella pertussis
gccuucgucgagguca

SEQ ID NO: 2371883 - RNA, 22 nt, Bordetella pertussis
gccuucgucgaggucagcggcu

SEQ ID NO: 2371884 - RNA, 14 nt, Bordetella pertussis
gccuucuacccgcu

SEQ ID NO: 2371885 - RNA, 16 nt, Bordetella pertussis
gccuucugcgccagcg

SEQ ID NO: 2371886 - RNA, 23 nt, Bordetella pertussis
gccuucuucacguagccggccag

SEQ ID NO: 2371887 - RNA, 11 nt, Bordetella pertussis
gccuucuugaa

SEQ ID NO: 2371888 - RNA, 20 nt, Bordetella pertussis
gccuucuugaacagcucggc

SEQ ID NO: 2371889 - RNA, 20 nt, Bordetella pertussis
gccuucuuucgcgagucgca

SEQ ID NO: 2371890 - RNA, 23 nt, Bordetella pertussis
gccuugaaagaggcauuggcggc

SEQ ID NO: 2371891 - RNA, 20 nt, Bordetella pertussis
gccuugacgaucucggcguu

SEQ ID NO: 2371892 - RNA, 17 nt, Bordetella pertussis
gccuugacgcugcucuu

SEQ ID NO: 2371893 - RNA, 15 nt, Bordetella pertussis
gccuugcccaggcug

SEQ ID NO: 2371894 - RNA, 13 nt, Bordetella pertussis
gccuugcccgggc

SEQ ID NO: 2371895 - RNA, 19 nt, Bordetella pertussis
gccuugcccuuggcggccu

SEQ ID NO: 2371896 - RNA, 17 nt, Bordetella pertussis
gccuugccgccgccgcg

SEQ ID NO: 2371897 - RNA, 15 nt, Bordetella pertussis
gccuugccgccgcgc

SEQ ID NO: 2371898 - RNA, 14 nt, Bordetella pertussis
gccuugccgccgug

SEQ ID NO: 2371899 - RNA, 20 nt, Bordetella pertussis
gccuugccgguggacggcca

SEQ ID NO: 2371900 - RNA, 22 nt, Bordetella pertussis
gccuugccgguggacggccagc

SEQ ID NO: 2371901 - RNA, 18 nt, Bordetella pertussis
gccuugccguaggguucg

SEQ ID NO: 2371902 - RNA, 18 nt, Bordetella pertussis
gccuugccuugcgcggcc

SEQ ID NO: 2371903 - RNA, 17 nt, Bordetella pertussis
gccuugcgcggccagca

SEQ ID NO: 2371904 - RNA, 19 nt, Bordetella pertussis
gccuugcgcggccagcacc

SEQ ID NO: 2371905 - RNA, 17 nt, Bordetella pertussis
gccuugcgcggcgagcg

SEQ ID NO: 2371906 - RNA, 22 nt, Bordetella pertussis
gccuugcgcuuuuuucuccagc

SEQ ID NO: 2371907 - RNA, 23 nt, Bordetella pertussis
gccuugcgcuuuuuucuccagcg

SEQ ID NO: 2371908 - RNA, 17 nt, Bordetella pertussis
gccuugcgggccggcug

SEQ ID NO: 2371909 - RNA, 18 nt, Bordetella pertussis
gccuugcgggccggcugg

SEQ ID NO: 2371910 - RNA, 23 nt, Bordetella pertussis
gccuugcgggccggcugggcggc

SEQ ID NO: 2371911 - RNA, 16 nt, Bordetella pertussis
gccuugcuccggcgug

SEQ ID NO: 2371912 - RNA, 17 nt, Bordetella pertussis
gccuugcucgaccaggu

SEQ ID NO: 2371913 - RNA, 23 nt, Bordetella pertussis
gccuugcucgcccauggcaucga

SEQ ID NO: 2371914 - RNA, 17 nt, Bordetella pertussis
gccuugcugaaccugcu

SEQ ID NO: 2371915 - RNA, 17 nt, Bordetella pertussis
gccuugcugcccgacgg

SEQ ID NO: 2371916 - RNA, 16 nt, Bordetella pertussis
gccuuggaguagccgc

SEQ ID NO: 2371917 - RNA, 19 nt, Bordetella pertussis
gccuuggcaucgaccacgc

SEQ ID NO: 2371918 - RNA, 14 nt, Bordetella pertussis
gccuuggccagcag

SEQ ID NO: 2371919 - RNA, 15 nt, Bordetella pertussis
gccuuggccagcagc

SEQ ID NO: 2371920 - RNA, 21 nt, Bordetella pertussis
gccuuggccagcagcgcaucg

SEQ ID NO: 2371921 - RNA, 15 nt, Bordetella pertussis
gccuuggccgcagcc

SEQ ID NO: 2371922 - RNA, 16 nt, Bordetella pertussis
gccuuggccgcagccg

SEQ ID NO: 2371923 - RNA, 17 nt, Bordetella pertussis
gccuuggccgcagccgg

SEQ ID NO: 2371924 - RNA, 18 nt, Bordetella pertussis
gccuuggccgcagccggc

SEQ ID NO: 2371925 - RNA, 12 nt, Bordetella pertussis
gccuuggccugg

SEQ ID NO: 2371926 - RNA, 15 nt, Bordetella pertussis
gccuuggccugggcg

SEQ ID NO: 2371927 - RNA, 17 nt, Bordetella pertussis
gccuuggcgcgcagacg

SEQ ID NO: 2371928 - RNA, 12 nt, Bordetella pertussis
gccuuggcggcc

SEQ ID NO: 2371929 - RNA, 17 nt, Bordetella pertussis
gccuugggcgcggcggc

SEQ ID NO: 2371930 - RNA, 21 nt, Bordetella pertussis
gccuugggcgcggcggccugg

SEQ ID NO: 2371931 - RNA, 18 nt, Bordetella pertussis
gccuuggggcggcccagc

SEQ ID NO: 2371932 - RNA, 19 nt, Bordetella pertussis
gccuuggggcggcccagcg

SEQ ID NO: 2371933 - RNA, 15 nt, Bordetella pertussis
gccuugucgcgggca

SEQ ID NO: 2371934 - RNA, 16 nt, Bordetella pertussis
gccuuguucgcgcgcg

SEQ ID NO: 2371935 - RNA, 17 nt, Bordetella pertussis
gccuuguucgcgcgcgg

SEQ ID NO: 2371936 - RNA, 17 nt, Bordetella pertussis
gccuuuauugcuuuucc

SEQ ID NO: 2371937 - RNA, 16 nt, Bordetella pertussis
gcgaaaaagcccgcgc

SEQ ID NO: 2371938 - RNA, 15 nt, Bordetella pertussis
gcgaaaacccgcggc

SEQ ID NO: 2371939 - RNA, 13 nt, Bordetella pertussis
gcgaaacagcagc

SEQ ID NO: 2371940 - RNA, 21 nt, Bordetella pertussis
gcgaaacccgcugggccagca

SEQ ID NO: 2371941 - RNA, 13 nt, Bordetella pertussis
gcgaaacgccagc

SEQ ID NO: 2371942 - RNA, 18 nt, Bordetella pertussis
gcgaaacggcgggcgcgc

SEQ ID NO: 2371943 - RNA, 22 nt, Bordetella pertussis
gcgaaacggcgggcgcgcaggc

SEQ ID NO: 2371944 - RNA, 14 nt, Bordetella pertussis
gcgaaagccggccu

SEQ ID NO: 2371945 - RNA, 12 nt, Bordetella pertussis
gcgaaagcggcg

SEQ ID NO: 2371946 - RNA, 23 nt, Bordetella pertussis
gcgaaaucuucugcgccacggcg

SEQ ID NO: 2371947 - RNA, 15 nt, Bordetella pertussis
gcgaaaugcccagcg

SEQ ID NO: 2371948 - RNA, 18 nt, Bordetella pertussis
gcgaaaugcccagcgagc

SEQ ID NO: 2371949 - RNA, 14 nt, Bordetella pertussis
gcgaaaugccgaag

SEQ ID NO: 2371950 - RNA, 13 nt, Bordetella pertussis
gcgaaauggcggc

SEQ ID NO: 2371951 - RNA, 17 nt, Bordetella pertussis
gcgaaauggcggccucg

SEQ ID NO: 2371952 - RNA, 21 nt, Bordetella pertussis
gcgaaauggugcggccaugau

SEQ ID NO: 2371953 - RNA, 18 nt, Bordetella pertussis
gcgaacaacgggaucggc

SEQ ID NO: 2371954 - RNA, 16 nt, Bordetella pertussis
gcgaacaccagggugg

SEQ ID NO: 2371955 - RNA, 21 nt, Bordetella pertussis
gcgaacaccggcaggccgcgc

SEQ ID NO: 2371956 - RNA, 18 nt, Bordetella pertussis
gcgaacacgucgcgggcg

SEQ ID NO: 2371957 - RNA, 22 nt, Bordetella pertussis
gcgaacagauccacgcccgcgc

SEQ ID NO: 2371958 - RNA, 13 nt, Bordetella pertussis
gcgaacagcgcgu

SEQ ID NO: 2371959 - RNA, 15 nt, Bordetella pertussis
gcgaacagggcgcga

SEQ ID NO: 2371960 - RNA, 14 nt, Bordetella pertussis
gcgaaccaggccug

SEQ ID NO: 2371961 - RNA, 16 nt, Bordetella pertussis
gcgaacccgaucgcga

SEQ ID NO: 2371962 - RNA, 21 nt, Bordetella pertussis
gcgaaccgaaaugccgcagca

SEQ ID NO: 2371963 - RNA, 17 nt, Bordetella pertussis
gcgaaccgcggcgcagg

SEQ ID NO: 2371964 - RNA, 15 nt, Bordetella pertussis
gcgaaccggugcugg

SEQ ID NO: 2371965 - RNA, 18 nt, Bordetella pertussis
gcgaaccggugcuggugc

SEQ ID NO: 2371966 - RNA, 15 nt, Bordetella pertussis
gcgaaccgguggcca

SEQ ID NO: 2371967 - RNA, 12 nt, Bordetella pertussis
gcgaacgcccgg

SEQ ID NO: 2371968 - RNA, 13 nt, Bordetella pertussis
gcgaacgcccggc

SEQ ID NO: 2371969 - RNA, 14 nt, Bordetella pertussis
gcgaacgcccggcc

SEQ ID NO: 2371970 - RNA, 18 nt, Bordetella pertussis
gcgaacgcccggcccagg

SEQ ID NO: 2371971 - RNA, 15 nt, Bordetella pertussis
gcgaacgcgccggcc

SEQ ID NO: 2371972 - RNA, 16 nt, Bordetella pertussis
gcgaacgcgccggccc

SEQ ID NO: 2371973 - RNA, 17 nt, Bordetella pertussis
gcgaacgcgccggccca

SEQ ID NO: 2371974 - RNA, 19 nt, Bordetella pertussis
gcgaacgcgccggcccagg

SEQ ID NO: 2371975 - RNA, 18 nt, Bordetella pertussis
gcgaacgcgcgccggcca

SEQ ID NO: 2371976 - RNA, 23 nt, Bordetella pertussis
gcgaacgcgcgccggccagcggc

SEQ ID NO: 2371977 - RNA, 16 nt, Bordetella pertussis
gcgaacggauggucgu

SEQ ID NO: 2371978 - RNA, 22 nt, Bordetella pertussis
gcgaacggauggucgugcggca

SEQ ID NO: 2371979 - RNA, 17 nt, Bordetella pertussis
gcgaacggcacgucgcg

SEQ ID NO: 2371980 - RNA, 14 nt, Bordetella pertussis
gcgaacggccgccc

SEQ ID NO: 2371981 - RNA, 15 nt, Bordetella pertussis
gcgaacggccgcccg

SEQ ID NO: 2371982 - RNA, 13 nt, Bordetella pertussis
gcgaacggcgggc

SEQ ID NO: 2371983 - RNA, 14 nt, Bordetella pertussis
gcgaacgggcagcc

SEQ ID NO: 2371984 - RNA, 16 nt, Bordetella pertussis
gcgaacgggcagccga

SEQ ID NO: 2371985 - RNA, 16 nt, Bordetella pertussis
gcgaacgugcgcgcca

SEQ ID NO: 2371986 - RNA, 17 nt, Bordetella pertussis
gcgaacgugcgcgccag

SEQ ID NO: 2371987 - RNA, 19 nt, Bordetella pertussis
gcgaagaccgugaucggcg

SEQ ID NO: 2371988 - RNA, 20 nt, Bordetella pertussis
gcgaagaccgugaucggcgc

SEQ ID NO: 2371989 - RNA, 21 nt, Bordetella pertussis
gcgaagaccgugaucggcgca

SEQ ID NO: 2371990 - RNA, 23 nt, Bordetella pertussis
gcgaagaccgugaucggcgcaac

SEQ ID NO: 2371991 - RNA, 14 nt, Bordetella pertussis
gcgaagaucccgcc

SEQ ID NO: 2371992 - RNA, 16 nt, Bordetella pertussis
gcgaagaucccgccgg

SEQ ID NO: 2371993 - RNA, 13 nt, Bordetella pertussis
gcgaagcagccgg

SEQ ID NO: 2371994 - RNA, 21 nt, Bordetella pertussis
gcgaagcagccggccaaggca

SEQ ID NO: 2371995 - RNA, 17 nt, Bordetella pertussis
gcgaccgcgcggcgcug

SEQ ID NO: 2371996 - RNA, 18 nt, Bordetella pertussis
gcgaccgcgcggcgcugc

SEQ ID NO: 2371997 - RNA, 21 nt, Bordetella pertussis
gcgaccgcggcgguccugcug

SEQ ID NO: 2371998 - RNA, 13 nt, Bordetella pertussis
gcgaccggcaccu

SEQ ID NO: 2371999 - RNA, 17 nt, Bordetella pertussis
gcgaccggcaccugggc

SEQ ID NO: 2372000 - RNA, 14 nt, Bordetella pertussis
gcgaccggcgccgg

SEQ ID NO: 2372001 - RNA, 16 nt, Bordetella pertussis
gcgaccggcgccggcu

SEQ ID NO: 2372002 - RNA, 16 nt, Bordetella pertussis
gcgaccucggcggcgu

SEQ ID NO: 2372003 - RNA, 18 nt, Bordetella pertussis
gcgaccucggcggcgucg

SEQ ID NO: 2372004 - RNA, 21 nt, Bordetella pertussis
gcgaccucgggacggcccugc

SEQ ID NO: 2372005 - RNA, 15 nt, Bordetella pertussis
gcgaccugcgcgacc

SEQ ID NO: 2372006 - RNA, 14 nt, Bordetella pertussis
gcgaccugcgggcg

SEQ ID NO: 2372007 - RNA, 15 nt, Bordetella pertussis
gcgacgaacccgggc

SEQ ID NO: 2372008 - RNA, 16 nt, Bordetella pertussis
gcgacgaacccgggcg

SEQ ID NO: 2372009 - RNA, 23 nt, Bordetella pertussis
gcgacgaacugaucggcaaggcg

SEQ ID NO: 2372010 - RNA, 22 nt, Bordetella pertussis
gcgacgacagcggcgagcgcgg

SEQ ID NO: 2372011 - RNA, 15 nt, Bordetella pertussis
gcgacgaccccgccg

SEQ ID NO: 2372012 - RNA, 18 nt, Bordetella pertussis
gcgacgaccccgccgugc

SEQ ID NO: 2372013 - RNA, 20 nt, Bordetella pertussis
gcgacgaccccgccgugccg

SEQ ID NO: 2372014 - RNA, 22 nt, Bordetella pertussis
gcgacgacuacgcgcuggcgca

SEQ ID NO: 2372015 - RNA, 16 nt, Bordetella pertussis
gcgacgauccggcgac

SEQ ID NO: 2372016 - RNA, 22 nt, Bordetella pertussis
gcgacgauccggcgaccgacgg

SEQ ID NO: 2372017 - RNA, 23 nt, Bordetella pertussis
gcgacgauccggcgaccgacggc

SEQ ID NO: 2372018 - RNA, 16 nt, Bordetella pertussis
gcgacgaucuccaccc

SEQ ID NO: 2372019 - RNA, 20 nt, Bordetella pertussis
gcgacgaucuccacccccgg

SEQ ID NO: 2372020 - RNA, 22 nt, Bordetella pertussis
gcgacgaucuccacccccgggc

SEQ ID NO: 2372021 - RNA, 23 nt, Bordetella pertussis
gcgacgaucuccacccccgggcg

SEQ ID NO: 2372022 - RNA, 12 nt, Bordetella pertussis
gcgacgaugccg

SEQ ID NO: 2372023 - RNA, 21 nt, Bordetella pertussis
gcgacgcaacagacccgggcc

SEQ ID NO: 2372024 - RNA, 15 nt, Bordetella pertussis
gcgacgcagcacggc

SEQ ID NO: 2372025 - RNA, 21 nt, Bordetella pertussis
gcgacgcagcacggcuugcgc

SEQ ID NO: 2372026 - RNA, 18 nt, Bordetella pertussis
gcgacgcauauccaggcg

SEQ ID NO: 2372027 - RNA, 22 nt, Bordetella pertussis
gcgacgcauauccaggcggcgc

SEQ ID NO: 2372028 - RNA, 15 nt, Bordetella pertussis
gcgacgcaugucagc

SEQ ID NO: 2372029 - RNA, 21 nt, Bordetella pertussis
gcgacgcccagccugccggcg

SEQ ID NO: 2372030 - RNA, 14 nt, Bordetella pertussis
gcgacgcccuggcc

SEQ ID NO: 2372031 - RNA, 13 nt, Bordetella pertussis
gcgacgccgccga

SEQ ID NO: 2372032 - RNA, 20 nt, Bordetella pertussis
gcgacgccgcggugcugggc

SEQ ID NO: 2372033 - RNA, 15 nt, Bordetella pertussis
gcgacgccugcgcca

SEQ ID NO: 2372034 - RNA, 16 nt, Bordetella pertussis
gcgacgccugcgccau

SEQ ID NO: 2372035 - RNA, 19 nt, Bordetella pertussis
gcgacgccugcgccauggc

SEQ ID NO: 2372036 - RNA, 13 nt, Bordetella pertussis
gcgacgcgacacg

SEQ ID NO: 2372037 - RNA, 13 nt, Bordetella pertussis
gcgacgcgacgcg

SEQ ID NO: 2372038 - RNA, 17 nt, Bordetella pertussis
gcgacgcgacgcgggcg

SEQ ID NO: 2372039 - RNA, 18 nt, Bordetella pertussis
gcgacgcgacgcgggcgg

SEQ ID NO: 2372040 - RNA, 17 nt, Bordetella pertussis
gcgacgcgcccucaguc

SEQ ID NO: 2372041 - RNA, 21 nt, Bordetella pertussis
gcgacgcgcccucaguccagc

SEQ ID NO: 2372042 - RNA, 13 nt, Bordetella pertussis
gcgacgcgccugc

SEQ ID NO: 2372043 - RNA, 14 nt, Bordetella pertussis
gcgacgcgcgccgg

SEQ ID NO: 2372044 - RNA, 12 nt, Bordetella pertussis
gcgacgcggcgu

SEQ ID NO: 2372045 - RNA, 15 nt, Bordetella pertussis
gcgacgcgggcggcc

SEQ ID NO: 2372046 - RNA, 18 nt, Bordetella pertussis
gcgacgcgggcggccgac

SEQ ID NO: 2372047 - RNA, 20 nt, Bordetella pertussis
gcgacgcgggcggccgacgg

SEQ ID NO: 2372048 - RNA, 13 nt, Bordetella pertussis
gcgacgcuguugg

SEQ ID NO: 2372049 - RNA, 18 nt, Bordetella pertussis
gcgacgcuguuggucagg

SEQ ID NO: 2372050 - RNA, 17 nt, Bordetella pertussis
gcgacggccccagcgcc

SEQ ID NO: 2372051 - RNA, 17 nt, Bordetella pertussis
gcgacggccucccgccg

SEQ ID NO: 2372052 - RNA, 20 nt, Bordetella pertussis
gcgacggccucccgccgccc

SEQ ID NO: 2372053 - RNA, 22 nt, Bordetella pertussis
gcgacggccucccgccgcccgg

SEQ ID NO: 2372054 - RNA, 15 nt, Bordetella pertussis
gcgacggcgccggcc

SEQ ID NO: 2372055 - RNA, 16 nt, Bordetella pertussis
gcgacggcgccuggcg

SEQ ID NO: 2372056 - RNA, 17 nt, Bordetella pertussis
gcgacggcgccuggcgc

SEQ ID NO: 2372057 - RNA, 19 nt, Bordetella pertussis
gcgacggcggccuuugcgc

SEQ ID NO: 2372058 - RNA, 13 nt, Bordetella pertussis
gcgacggcggcgu

SEQ ID NO: 2372059 - RNA, 16 nt, Bordetella pertussis
gcgacggcgucggccu

SEQ ID NO: 2372060 - RNA, 18 nt, Bordetella pertussis
gcgacggcgucggccugg

SEQ ID NO: 2372061 - RNA, 13 nt, Bordetella pertussis
gcgacggcgugcu

SEQ ID NO: 2372062 - RNA, 15 nt, Bordetella pertussis
gcgacggcgugcugc

SEQ ID NO: 2372063 - RNA, 15 nt, Bordetella pertussis
gcgacgggcaccgac

SEQ ID NO: 2372064 - RNA, 16 nt, Bordetella pertussis
gcgacggucaggggca

SEQ ID NO: 2372065 - RNA, 15 nt, Bordetella pertussis
gcgacgguccugcgc

SEQ ID NO: 2372066 - RNA, 17 nt, Bordetella pertussis
gcgacgguccugcgcgc

SEQ ID NO: 2372067 - RNA, 19 nt, Bordetella pertussis
gcgacgguccugcgcgccg

SEQ ID NO: 2372068 - RNA, 16 nt, Bordetella pertussis
gcgacgucccaggccg

SEQ ID NO: 2372069 - RNA, 17 nt, Bordetella pertussis
gcgacgucccaggccga

SEQ ID NO: 2372070 - RNA, 18 nt, Bordetella pertussis
gcgacgucgggcagggcg

SEQ ID NO: 2372071 - RNA, 15 nt, Bordetella pertussis
gcgacgugucggcca

SEQ ID NO: 2372072 - RNA, 16 nt, Bordetella pertussis
gcgacgugucggccac

SEQ ID NO: 2372073 - RNA, 15 nt, Bordetella pertussis
gcgacuccagcccga

SEQ ID NO: 2372074 - RNA, 13 nt, Bordetella pertussis
gcgacuccggccg

SEQ ID NO: 2372075 - RNA, 14 nt, Bordetella pertussis
gcgacuccggccgg

SEQ ID NO: 2372076 - RNA, 17 nt, Bordetella pertussis
gcgacuccggccgggcc

SEQ ID NO: 2372077 - RNA, 21 nt, Bordetella pertussis
gcgacuccggccgggccagcg

SEQ ID NO: 2372078 - RNA, 22 nt, Bordetella pertussis
gcgacucgacgaacacgcgcgc

SEQ ID NO: 2372079 - RNA, 14 nt, Bordetella pertussis
gcgacugcagcagg

SEQ ID NO: 2372080 - RNA, 12 nt, Bordetella pertussis
gcgacugcagga

SEQ ID NO: 2372081 - RNA, 21 nt, Bordetella pertussis
gcgacuguguaccccgaucgg

SEQ ID NO: 2372082 - RNA, 20 nt, Bordetella pertussis
gcgacuuccucgacccgcgc

SEQ ID NO: 2372083 - RNA, 19 nt, Bordetella pertussis
gcgacuucgccgaucgagc

SEQ ID NO: 2372084 - RNA, 14 nt, Bordetella pertussis
gcgacuucggcggc

SEQ ID NO: 2372085 - RNA, 15 nt, Bordetella pertussis
gcgacuucggcggcc

SEQ ID NO: 2372086 - RNA, 18 nt, Bordetella pertussis
gcgacuucggcggccaug

SEQ ID NO: 2372087 - RNA, 16 nt, Bordetella pertussis
gcgacuucggcggccu

SEQ ID NO: 2372088 - RNA, 18 nt, Bordetella pertussis
gcgacuucggcggccugc

SEQ ID NO: 2372089 - RNA, 16 nt, Bordetella pertussis
gcgacuugucgcgccc

SEQ ID NO: 2372090 - RNA, 19 nt, Bordetella pertussis
gcgagaaaaucggcgaucg

SEQ ID NO: 2372091 - RNA, 21 nt, Bordetella pertussis
gcgagaaaaucggcgaucgcc

SEQ ID NO: 2372092 - RNA, 16 nt, Bordetella pertussis
gcgagaaccaggccac

SEQ ID NO: 2372093 - RNA, 17 nt, Bordetella pertussis
gcgagaacgcggccgcg

SEQ ID NO: 2372094 - RNA, 19 nt, Bordetella pertussis
gcgagaccagcggaucgcc

SEQ ID NO: 2372095 - RNA, 23 nt, Bordetella pertussis
gcgagaccagcggaucgccgggc

SEQ ID NO: 2372096 - RNA, 22 nt, Bordetella pertussis
gcgagaccguggaaaccgcguc

SEQ ID NO: 2372097 - RNA, 19 nt, Bordetella pertussis
gcgagacgaaggcgccggc

SEQ ID NO: 2372098 - RNA, 20 nt, Bordetella pertussis
gcgagacgaaggcgccggcc

SEQ ID NO: 2372099 - RNA, 23 nt, Bordetella pertussis
gcgagacgaaggcgccggccagg

SEQ ID NO: 2372100 - RNA, 24 nt, Bordetella pertussis
gcgagacgcgcucgcgcgcgugcu

SEQ ID NO: 2372101 - RNA, 16 nt, Bordetella pertussis
gcgagagauagcccag

SEQ ID NO: 2372102 - RNA, 17 nt, Bordetella pertussis
gcgagagauagcccagc

SEQ ID NO: 2372103 - RNA, 19 nt, Bordetella pertussis
gcgagagauagcccagcac

SEQ ID NO: 2372104 - RNA, 13 nt, Bordetella pertussis
gcgagagcgccac

SEQ ID NO: 2372105 - RNA, 19 nt, Bordetella pertussis
gcgagagcgccacgccagc

SEQ ID NO: 2372106 - RNA, 20 nt, Bordetella pertussis
gcgagagcgccacgccagcg

SEQ ID NO: 2372107 - RNA, 21 nt, Bordetella pertussis
gcgagagcuccagccgggucg

SEQ ID NO: 2372108 - RNA, 18 nt, Bordetella pertussis
gcgauaggugcgcagccg

SEQ ID NO: 2372109 - RNA, 19 nt, Bordetella pertussis
gcgauaggugcgcagccgg

SEQ ID NO: 2372110 - RNA, 21 nt, Bordetella pertussis
gcgauauccagguaggcggcg

SEQ ID NO: 2372111 - RNA, 22 nt, Bordetella pertussis
gcgauauccagguaggcggcgc

SEQ ID NO: 2372112 - RNA, 16 nt, Bordetella pertussis
gcgauauccaucggcg

SEQ ID NO: 2372113 - RNA, 23 nt, Bordetella pertussis
gcgauauccaucggcgcgcgcug

SEQ ID NO: 2372114 - RNA, 22 nt, Bordetella pertussis
gcgauauccuugcgcucgccca

SEQ ID NO: 2372115 - RNA, 21 nt, Bordetella pertussis
gcgaucaacgugcgccaggca

SEQ ID NO: 2372116 - RNA, 15 nt, Bordetella pertussis
gcgaucaccgacagc

SEQ ID NO: 2372117 - RNA, 20 nt, Bordetella pertussis
gcgaucaccgagugggcggc

SEQ ID NO: 2372118 - RNA, 18 nt, Bordetella pertussis
gcgaucaccugcguggcc

SEQ ID NO: 2372119 - RNA, 19 nt, Bordetella pertussis
gcgaucacgccgaaggcgu

SEQ ID NO: 2372120 - RNA, 13 nt, Bordetella pertussis
gcgaucacgccgu

SEQ ID NO: 2372121 - RNA, 14 nt, Bordetella pertussis
gcgaucagcaccgc

SEQ ID NO: 2372122 - RNA, 17 nt, Bordetella pertussis
gcgaucagcaccgcggc

SEQ ID NO: 2372123 - RNA, 13 nt, Bordetella pertussis
gcgaucagcgcgg

SEQ ID NO: 2372124 - RNA, 15 nt, Bordetella pertussis
gcgaucagcgcggcc

SEQ ID NO: 2372125 - RNA, 13 nt, Bordetella pertussis
gcgaucaggccgc

SEQ ID NO: 2372126 - RNA, 21 nt, Bordetella pertussis
gcgaucaggccgccccaacgg

SEQ ID NO: 2372127 - RNA, 19 nt, Bordetella pertussis
gcgaucaugcaguacaggc

SEQ ID NO: 2372128 - RNA, 13 nt, Bordetella pertussis
gcgauccagcagc

SEQ ID NO: 2372129 - RNA, 14 nt, Bordetella pertussis
gcgauccagcagcg

SEQ ID NO: 2372130 - RNA, 15 nt, Bordetella pertussis
gcgauccagcagcgu

SEQ ID NO: 2372131 - RNA, 17 nt, Bordetella pertussis
gcgauccagcagcgugg

SEQ ID NO: 2372132 - RNA, 19 nt, Bordetella pertussis
gcgauccagcagcguggcc

SEQ ID NO: 2372133 - RNA, 14 nt, Bordetella pertussis
gcgauccaggccac

SEQ ID NO: 2372134 - RNA, 20 nt, Bordetella pertussis
gcgauccagggccgccagca

SEQ ID NO: 2372135 - RNA, 22 nt, Bordetella pertussis
gcgauccagggccgccagcacc

SEQ ID NO: 2372136 - RNA, 18 nt, Bordetella pertussis
gcgauccauguggccagc

SEQ ID NO: 2372137 - RNA, 15 nt, Bordetella pertussis
gcgauccgccgcggc

SEQ ID NO: 2372138 - RNA, 16 nt, Bordetella pertussis
gcgauccgccgcggcc

SEQ ID NO: 2372139 - RNA, 17 nt, Bordetella pertussis
gcgauccgccgcggcca

SEQ ID NO: 2372140 - RNA, 18 nt, Bordetella pertussis
gcgauccgcgccaggcgg

SEQ ID NO: 2372141 - RNA, 22 nt, Bordetella pertussis
gcgauccggcgugguaucgcgc

SEQ ID NO: 2372142 - RNA, 15 nt, Bordetella pertussis
gcgauccugcccacc

SEQ ID NO: 2372143 - RNA, 15 nt, Bordetella pertussis
gcgauccuggggcag

SEQ ID NO: 2372144 - RNA, 17 nt, Bordetella pertussis
gcgauccuucgcggccg

SEQ ID NO: 2372145 - RNA, 18 nt, Bordetella pertussis
gcgauccuucgcggccgu

SEQ ID NO: 2372146 - RNA, 23 nt, Bordetella pertussis
gcgaucgaacgacucgucgacca

SEQ ID NO: 2372147 - RNA, 15 nt, Bordetella pertussis
gcgaucgaacgcggc

SEQ ID NO: 2372148 - RNA, 17 nt, Bordetella pertussis
gcgaucgaacgcggcca

SEQ ID NO: 2372149 - RNA, 22 nt, Bordetella pertussis
gcgaucgaauggucggccucgg

SEQ ID NO: 2372150 - RNA, 23 nt, Bordetella pertussis
gcgaucgaauggucggccucggc

SEQ ID NO: 2372151 - RNA, 13 nt, Bordetella pertussis
gcgaucgacagcc

SEQ ID NO: 2372152 - RNA, 20 nt, Bordetella pertussis
gcgaucgaguggugcgcggu

SEQ ID NO: 2372153 - RNA, 13 nt, Bordetella pertussis
gcgaucgccagca

SEQ ID NO: 2372154 - RNA, 22 nt, Bordetella pertussis
gcgaucgccagcaggcgcuggu

SEQ ID NO: 2372155 - RNA, 23 nt, Bordetella pertussis
gcgaucgccagcaggcgcugguc

SEQ ID NO: 2372156 - RNA, 20 nt, Bordetella pertussis
gcgaucgccgcaugggcgcg

SEQ ID NO: 2372157 - RNA, 21 nt, Bordetella pertussis
gcgaucgccgcaugggcgcgc

SEQ ID NO: 2372158 - RNA, 21 nt, Bordetella pertussis
gcgaucgccuguaucugcgcc

SEQ ID NO: 2372159 - RNA, 14 nt, Bordetella pertussis
gcgaucggccucgg

SEQ ID NO: 2372160 - RNA, 21 nt, Bordetella pertussis
gcgaucgucgaccgcgaagcc

SEQ ID NO: 2372161 - RNA, 23 nt, Bordetella pertussis
gcgaucgucgaccgcgaagccgc

SEQ ID NO: 2372162 - RNA, 17 nt, Bordetella pertussis
gcgaucgucgcugcgcg

SEQ ID NO: 2372163 - RNA, 21 nt, Bordetella pertussis
gcgaucucagccaucaucauc

SEQ ID NO: 2372164 - RNA, 14 nt, Bordetella pertussis
gcgaucucgcgcgc

SEQ ID NO: 2372165 - RNA, 19 nt, Bordetella pertussis
gcgaucucgggcaggucgg

SEQ ID NO: 2372166 - RNA, 16 nt, Bordetella pertussis
gcgaucucgucgaccg

SEQ ID NO: 2372167 - RNA, 19 nt, Bordetella pertussis
gcgaucugcgcggcggugc

SEQ ID NO: 2372168 - RNA, 17 nt, Bordetella pertussis
gcgaucugcggcguggc

SEQ ID NO: 2372169 - RNA, 18 nt, Bordetella pertussis
gcgaucugggccucggcc

SEQ ID NO: 2372170 - RNA, 15 nt, Bordetella pertussis
gcgaucuugccggcc

SEQ ID NO: 2372171 - RNA, 23 nt, Bordetella pertussis
gcgaucuugccggccuggcgggc

SEQ ID NO: 2372172 - RNA, 15 nt, Bordetella pertussis
gcgaugaacagcggc

SEQ ID NO: 2372173 - RNA, 20 nt, Bordetella pertussis
gcgaugaacagcggcacgcc

SEQ ID NO: 2372174 - RNA, 20 nt, Bordetella pertussis
gcgaugaagucgcggcccgc

SEQ ID NO: 2372175 - RNA, 23 nt, Bordetella pertussis
gcgaugaagucgcggcccgccag

SEQ ID NO: 2372176 - RNA, 14 nt, Bordetella pertussis
gcgaugaccggcaa

SEQ ID NO: 2372177 - RNA, 20 nt, Bordetella pertussis
gcgaugaccucggcgagcgc

SEQ ID NO: 2372178 - RNA, 21 nt, Bordetella pertussis
gcgaugaccucggcgagcgcc

SEQ ID NO: 2372179 - RNA, 13 nt, Bordetella pertussis
gcgaugauggggu

SEQ ID NO: 2372180 - RNA, 21 nt, Bordetella pertussis
gcgaugauggggucgccgggc

SEQ ID NO: 2372181 - RNA, 22 nt, Bordetella pertussis
gcgaugauggggucgccgggca

SEQ ID NO: 2372182 - RNA, 17 nt, Bordetella pertussis
gcgaugcacccaggcgc

SEQ ID NO: 2372183 - RNA, 19 nt, Bordetella pertussis
gcgaugcacccaggcgccg

SEQ ID NO: 2372184 - RNA, 20 nt, Bordetella pertussis
gcgaugcacccaggcgccga

SEQ ID NO: 2372185 - RNA, 16 nt, Bordetella pertussis
gcgaugcccaccagcc

SEQ ID NO: 2372186 - RNA, 19 nt, Bordetella pertussis
gcgaugcccaccagccgcc

SEQ ID NO: 2372187 - RNA, 21 nt, Bordetella pertussis
gcgaugcccaccagccgcccg

SEQ ID NO: 2372188 - RNA, 13 nt, Bordetella pertussis
gcgaugcccagcg

SEQ ID NO: 2372189 - RNA, 15 nt, Bordetella pertussis
gcgaugcccagcgcc

SEQ ID NO: 2372190 - RNA, 21 nt, Bordetella pertussis
gcgaugccccaguccaggccg

SEQ ID NO: 2372191 - RNA, 16 nt, Bordetella pertussis
gcgaugcccgcgcacc

SEQ ID NO: 2372192 - RNA, 17 nt, Bordetella pertussis
gcgaugcccgcgcacca

SEQ ID NO: 2372193 - RNA, 17 nt, Bordetella pertussis
gcgaugcccuggauggc

SEQ ID NO: 2372194 - RNA, 22 nt, Bordetella pertussis
gcgaugcccuggauggccuggg

SEQ ID NO: 2372195 - RNA, 12 nt, Bordetella pertussis
gcgaugccgauc

SEQ ID NO: 2372196 - RNA, 15 nt, Bordetella pertussis
gcgaugccgcuggcg

SEQ ID NO: 2372197 - RNA, 15 nt, Bordetella pertussis
gcgaugccggccagc

SEQ ID NO: 2372198 - RNA, 18 nt, Bordetella pertussis
gcgaugccggccagcagc

SEQ ID NO: 2372199 - RNA, 12 nt, Bordetella pertussis
gcgaugccggcg

SEQ ID NO: 2372200 - RNA, 19 nt, Bordetella pertussis
gcgaugccggcguggcgcg

SEQ ID NO: 2372201 - RNA, 20 nt, Bordetella pertussis
gcgaugccggcguggcgcgc

SEQ ID NO: 2372202 - RNA, 21 nt, Bordetella pertussis
gcgaugccggcguggcgcgca

SEQ ID NO: 2372203 - RNA, 13 nt, Bordetella pertussis
gcgaugccgggca

SEQ ID NO: 2372204 - RNA, 13 nt, Bordetella pertussis
gcgaugcgcagca

SEQ ID NO: 2372205 - RNA, 14 nt, Bordetella pertussis
gcgaugcgcagcag

SEQ ID NO: 2372206 - RNA, 16 nt, Bordetella pertussis
gcgaugcgcagcagca

SEQ ID NO: 2372207 - RNA, 14 nt, Bordetella pertussis
gcgaugcgccaggc

SEQ ID NO: 2372208 - RNA, 15 nt, Bordetella pertussis
gcgaugcgccaggcg

SEQ ID NO: 2372209 - RNA, 16 nt, Bordetella pertussis
gcgaugcgccaggcgc

SEQ ID NO: 2372210 - RNA, 19 nt, Bordetella pertussis
gcgaugcgccaggcgcucg

SEQ ID NO: 2372211 - RNA, 20 nt, Bordetella pertussis
gcgaugcgcgagcgcgugga

SEQ ID NO: 2372212 - RNA, 19 nt, Bordetella pertussis
gcgaugcgcgcgcgggcca

SEQ ID NO: 2372213 - RNA, 18 nt, Bordetella pertussis
gcgaugcgcgcgugcagc

SEQ ID NO: 2372214 - RNA, 14 nt, Bordetella pertussis
gcgaugcgcggccc

SEQ ID NO: 2372215 - RNA, 15 nt, Bordetella pertussis
gcgaugcgcggcccg

SEQ ID NO: 2372216 - RNA, 18 nt, Bordetella pertussis
gcgaugcgcggcccggcc

SEQ ID NO: 2372217 - RNA, 20 nt, Bordetella pertussis
gcgaugcgcggcccggccgc

SEQ ID NO: 2372218 - RNA, 19 nt, Bordetella pertussis
gcgaugcgggccacgccgg

SEQ ID NO: 2372219 - RNA, 21 nt, Bordetella pertussis
gcgaugcgggccacgccggcc

SEQ ID NO: 2372220 - RNA, 13 nt, Bordetella pertussis
gcgcacacauggc

SEQ ID NO: 2372221 - RNA, 15 nt, Bordetella pertussis
gcgcacacauggcgc

SEQ ID NO: 2372222 - RNA, 13 nt, Bordetella pertussis
gcgcacaccauca

SEQ ID NO: 2372223 - RNA, 17 nt, Bordetella pertussis
gcgcacacuggccagca

SEQ ID NO: 2372224 - RNA, 14 nt, Bordetella pertussis
gcgcacagcccgau

SEQ ID NO: 2372225 - RNA, 13 nt, Bordetella pertussis
gcgcacagcgcgc

SEQ ID NO: 2372226 - RNA, 18 nt, Bordetella pertussis
gcgcacagcgcggcgaug

SEQ ID NO: 2372227 - RNA, 22 nt, Bordetella pertussis
gcgcacaggcgcucgcccucgc

SEQ ID NO: 2372228 - RNA, 13 nt, Bordetella pertussis
gcgcacaggcggc

SEQ ID NO: 2372229 - RNA, 16 nt, Bordetella pertussis
gcgcacaggcggcgcc

SEQ ID NO: 2372230 - RNA, 17 nt, Bordetella pertussis
gcgcacaggcggcgccg

SEQ ID NO: 2372231 - RNA, 14 nt, Bordetella pertussis
gcgcacagggcguc

SEQ ID NO: 2372232 - RNA, 14 nt, Bordetella pertussis
gcgcacaggucgcc

SEQ ID NO: 2372233 - RNA, 15 nt, Bordetella pertussis
gcgcacaggucgccg

SEQ ID NO: 2372234 - RNA, 18 nt, Bordetella pertussis
gcgcacaguugcaggcca

SEQ ID NO: 2372235 - RNA, 20 nt, Bordetella pertussis
gcgcacaguugcaggccaug

SEQ ID NO: 2372236 - RNA, 23 nt, Bordetella pertussis
gcgcacaguugcaggccaugcuc

SEQ ID NO: 2372237 - RNA, 22 nt, Bordetella pertussis
gcgcaccaaucuugccaggccc

SEQ ID NO: 2372238 - RNA, 21 nt, Bordetella pertussis
gcgcaccaccaccaugugcuu

SEQ ID NO: 2372239 - RNA, 14 nt, Bordetella pertussis
gcgcaccaccagca

SEQ ID NO: 2372240 - RNA, 19 nt, Bordetella pertussis
gcgcaccaccagcaccgcc

SEQ ID NO: 2372241 - RNA, 23 nt, Bordetella pertussis
gcgcaccaccagcaccgccacgc

SEQ ID NO: 2372242 - RNA, 20 nt, Bordetella pertussis
gcgcaccaccgagaaaccga

SEQ ID NO: 2372243 - RNA, 17 nt, Bordetella pertussis
gcgcaccaccuggcuga

SEQ ID NO: 2372244 - RNA, 12 nt, Bordetella pertussis
gcgcaccagccc

SEQ ID NO: 2372245 - RNA, 17 nt, Bordetella pertussis
gcgcaccagcccgcccg

SEQ ID NO: 2372246 - RNA, 13 nt, Bordetella pertussis
gcgcaccagcgag

SEQ ID NO: 2372247 - RNA, 18 nt, Bordetella pertussis
gcgcaccagcgaggcggc

SEQ ID NO: 2372248 - RNA, 23 nt, Bordetella pertussis
gcgcaccagcgaguuguccuggc

SEQ ID NO: 2372249 - RNA, 12 nt, Bordetella pertussis
gcgcaccagcgg

SEQ ID NO: 2372250 - RNA, 19 nt, Bordetella pertussis
gcgcaccagcuuggccugc

SEQ ID NO: 2372251 - RNA, 15 nt, Bordetella pertussis
gcgcaccaggccugc

SEQ ID NO: 2372252 - RNA, 16 nt, Bordetella pertussis
gcgcaccaggcgcggc

SEQ ID NO: 2372253 - RNA, 19 nt, Bordetella pertussis
gcgcaccaggcuggggccg

SEQ ID NO: 2372254 - RNA, 12 nt, Bordetella pertussis
gcgcaccagguu

SEQ ID NO: 2372255 - RNA, 19 nt, Bordetella pertussis
gcgcaccagguuggcgaug

SEQ ID NO: 2372256 - RNA, 20 nt, Bordetella pertussis
gcgcaccaguuucucggcca

SEQ ID NO: 2372257 - RNA, 16 nt, Bordetella pertussis
gcgcaccaugcgcagc

SEQ ID NO: 2372258 - RNA, 17 nt, Bordetella pertussis
gcgcaccaugcgcagca

SEQ ID NO: 2372259 - RNA, 20 nt, Bordetella pertussis
gcgcaccaugcggugcgccc

SEQ ID NO: 2372260 - RNA, 13 nt, Bordetella pertussis
gcgcaccauggcg

SEQ ID NO: 2372261 - RNA, 14 nt, Bordetella pertussis
gcgcaccauggcgc

SEQ ID NO: 2372262 - RNA, 19 nt, Bordetella pertussis
gcgcaccauggcgcccacg

SEQ ID NO: 2372263 - RNA, 17 nt, Bordetella pertussis
gcgcaccaugggcgucg

SEQ ID NO: 2372264 - RNA, 14 nt, Bordetella pertussis
gcgcaccccggccg

SEQ ID NO: 2372265 - RNA, 19 nt, Bordetella pertussis
gcgcaccccggugucgccg

SEQ ID NO: 2372266 - RNA, 14 nt, Bordetella pertussis
gcgcacccgcaggc

SEQ ID NO: 2372267 - RNA, 15 nt, Bordetella pertussis
gcgcacccgcaggcc

SEQ ID NO: 2372268 - RNA, 12 nt, Bordetella pertussis
gcgcacccgccu

SEQ ID NO: 2372269 - RNA, 13 nt, Bordetella pertussis
gcgcacccgccug

SEQ ID NO: 2372270 - RNA, 21 nt, Bordetella pertussis
gcgcacccgccuggacggcga

SEQ ID NO: 2372271 - RNA, 23 nt, Bordetella pertussis
gcgcacccgccuggacggcgagg

SEQ ID NO: 2372272 - RNA, 19 nt, Bordetella pertussis
gcgcacccguuccagcaug

SEQ ID NO: 2372273 - RNA, 23 nt, Bordetella pertussis
gcgcacccugcaggccgggcagu

SEQ ID NO: 2372274 - RNA, 19 nt, Bordetella pertussis
gcgcaccgacggcagcccc

SEQ ID NO: 2372275 - RNA, 20 nt, Bordetella pertussis
gcgcaccgcaugggccaggc

SEQ ID NO: 2372276 - RNA, 13 nt, Bordetella pertussis
gcgcaccgccugc

SEQ ID NO: 2372277 - RNA, 14 nt, Bordetella pertussis
gcgcaccgccugcu

SEQ ID NO: 2372278 - RNA, 14 nt, Bordetella pertussis
gcgcaccgcgcugg

SEQ ID NO: 2372279 - RNA, 16 nt, Bordetella pertussis
gcgcaccgcgcuggga

SEQ ID NO: 2372280 - RNA, 13 nt, Bordetella pertussis
gcgcaccggccag

SEQ ID NO: 2372281 - RNA, 14 nt, Bordetella pertussis
gcgcaccggccagg

SEQ ID NO: 2372282 - RNA, 14 nt, Bordetella pertussis
gcgcaccggccggc

SEQ ID NO: 2372283 - RNA, 16 nt, Bordetella pertussis
gcgcaccggccggccg

SEQ ID NO: 2372284 - RNA, 18 nt, Bordetella pertussis
gcgcaccggccggccggg

SEQ ID NO: 2372285 - RNA, 14 nt, Bordetella pertussis
gcgcaccggcuugg

SEQ ID NO: 2372286 - RNA, 21 nt, Bordetella pertussis
gcgcaccggcuuggggcgcgc

SEQ ID NO: 2372287 - RNA, 14 nt, Bordetella pertussis
gcgcaccgucgcca

SEQ ID NO: 2372288 - RNA, 16 nt, Bordetella pertussis
gcgcaccgucgccagg

SEQ ID NO: 2372289 - RNA, 15 nt, Bordetella pertussis
gcgcaccugcugcgg

SEQ ID NO: 2372290 - RNA, 16 nt, Bordetella pertussis
gcgcaccugcugcggc

SEQ ID NO: 2372291 - RNA, 21 nt, Bordetella pertussis
gcgcaccugggaggggccggc

SEQ ID NO: 2372292 - RNA, 19 nt, Bordetella pertussis
gcgcaccugguccauggcg

SEQ ID NO: 2372293 - RNA, 22 nt, Bordetella pertussis
gcgcaccugguccauggcgggg

SEQ ID NO: 2372294 - RNA, 21 nt, Bordetella pertussis
gcgcaccuguucggcggcgcc

SEQ ID NO: 2372295 - RNA, 22 nt, Bordetella pertussis
gcgcaccuguucggcggcgccc

SEQ ID NO: 2372296 - RNA, 23 nt, Bordetella pertussis
gcgcaccuguucggcggcgccca

SEQ ID NO: 2372297 - RNA, 13 nt, Bordetella pertussis
gcgcaccuugccc

SEQ ID NO: 2372298 - RNA, 17 nt, Bordetella pertussis
gcgcaccuugcccacgc

SEQ ID NO: 2372299 - RNA, 17 nt, Bordetella pertussis
gcgcaccuugucgcgca

SEQ ID NO: 2372300 - RNA, 20 nt, Bordetella pertussis
gcgcaccuugucgcgcagcg

SEQ ID NO: 2372301 - RNA, 14 nt, Bordetella pertussis
gcgcacgaagccga

SEQ ID NO: 2372302 - RNA, 23 nt, Bordetella pertussis
gcgcacgaaguacucgccggcgc

SEQ ID NO: 2372303 - RNA, 18 nt, Bordetella pertussis
gcgcacgaccaccagcgc

SEQ ID NO: 2372304 - RNA, 17 nt, Bordetella pertussis
gcgcacgaugaggccga

SEQ ID NO: 2372305 - RNA, 14 nt, Bordetella pertussis
gcgcacgauggggc

SEQ ID NO: 2372306 - RNA, 22 nt, Bordetella pertussis
gcgcacgauugucgucgcgcga

SEQ ID NO: 2372307 - RNA, 13 nt, Bordetella pertussis
gcgcacgcaccgc

SEQ ID NO: 2372308 - RNA, 17 nt, Bordetella pertussis
gcgcacgcaccgcgcca

SEQ ID NO: 2372309 - RNA, 20 nt, Bordetella pertussis
gcgcacgcaccgcgccagcg

SEQ ID NO: 2372310 - RNA, 13 nt, Bordetella pertussis
gcgcacgcagcgc

SEQ ID NO: 2372311 - RNA, 15 nt, Bordetella pertussis
gcgcacgcccagacu

SEQ ID NO: 2372312 - RNA, 14 nt, Bordetella pertussis
gcgcacgccgcgcc

SEQ ID NO: 2372313 - RNA, 16 nt, Bordetella pertussis
gcgcacgccgcgccgg

SEQ ID NO: 2372314 - RNA, 17 nt, Bordetella pertussis
gcgcacgccgcgccggc

SEQ ID NO: 2372315 - RNA, 21 nt, Bordetella pertussis
gcgcacgccgcgccggcgcgc

SEQ ID NO: 2372316 - RNA, 14 nt, Bordetella pertussis
gcgcacgccgggcg

SEQ ID NO: 2372317 - RNA, 16 nt, Bordetella pertussis
gcgcacgccgggcgcg

SEQ ID NO: 2372318 - RNA, 18 nt, Bordetella pertussis
gcgcacgccgggcgcggc

SEQ ID NO: 2372319 - RNA, 19 nt, Bordetella pertussis
gcgcacgccgggcgcggcc

SEQ ID NO: 2372320 - RNA, 12 nt, Bordetella pertussis
gcgcacgcgcag

SEQ ID NO: 2372321 - RNA, 14 nt, Bordetella pertussis
gcgcacgcgcagca

SEQ ID NO: 2372322 - RNA, 17 nt, Bordetella pertussis
gcgcacgcgcagcacgc

SEQ ID NO: 2372323 - RNA, 19 nt, Bordetella pertussis
gcgcacgcgcagcacgcug

SEQ ID NO: 2372324 - RNA, 14 nt, Bordetella pertussis
gcgcacgcgcucgg

SEQ ID NO: 2372325 - RNA, 20 nt, Bordetella pertussis
gcgcacgcguucgggcggca

SEQ ID NO: 2372326 - RNA, 22 nt, Bordetella pertussis
gcgcacgcguucgggcggcagg

SEQ ID NO: 2372327 - RNA, 13 nt, Bordetella pertussis
gcgcacgcuggca

SEQ ID NO: 2372328 - RNA, 19 nt, Bordetella pertussis
gcgcacgcuggcaucgucg

SEQ ID NO: 2372329 - RNA, 13 nt, Bordetella pertussis
gcgcacgcuggcg

SEQ ID NO: 2372330 - RNA, 14 nt, Bordetella pertussis
gcgcacgcuggcgc

SEQ ID NO: 2372331 - RNA, 19 nt, Bordetella pertussis
gcgcacgcuggcgcccgcc

SEQ ID NO: 2372332 - RNA, 21 nt, Bordetella pertussis
gcgcacgcuggcgcccgccug

SEQ ID NO: 2372333 - RNA, 14 nt, Bordetella pertussis
gcgcacgcugggcg

SEQ ID NO: 2372334 - RNA, 12 nt, Bordetella pertussis
gcgcagcgacuc

SEQ ID NO: 2372335 - RNA, 13 nt, Bordetella pertussis
gcgcagcgccacg

SEQ ID NO: 2372336 - RNA, 18 nt, Bordetella pertussis
gcgcagcgccugcaggcg

SEQ ID NO: 2372337 - RNA, 15 nt, Bordetella pertussis
gcgcagcgccuggcc

SEQ ID NO: 2372338 - RNA, 16 nt, Bordetella pertussis
gcgcagcgccuggccg

SEQ ID NO: 2372339 - RNA, 18 nt, Bordetella pertussis
gcgcagcgccuggccgag

SEQ ID NO: 2372340 - RNA, 17 nt, Bordetella pertussis
gcgcagcgcgccggaca

SEQ ID NO: 2372341 - RNA, 13 nt, Bordetella pertussis
gcgcagcgcggca

SEQ ID NO: 2372342 - RNA, 21 nt, Bordetella pertussis
gcgcagcgcggcacgcugcug

SEQ ID NO: 2372343 - RNA, 13 nt, Bordetella pertussis
gcgcagcgcgucc

SEQ ID NO: 2372344 - RNA, 16 nt, Bordetella pertussis
gcgcagcgcgucggcg

SEQ ID NO: 2372345 - RNA, 14 nt, Bordetella pertussis
gcgcagcggcaggc

SEQ ID NO: 2372346 - RNA, 15 nt, Bordetella pertussis
gcgcagcggcaggcc

SEQ ID NO: 2372347 - RNA, 12 nt, Bordetella pertussis
gcgcagcggcgc

SEQ ID NO: 2372348 - RNA, 13 nt, Bordetella pertussis
gcgcagcggcgcg

SEQ ID NO: 2372349 - RNA, 14 nt, Bordetella pertussis
gcgcagcggcgcgc

SEQ ID NO: 2372350 - RNA, 13 nt, Bordetella pertussis
gcgcagcggcggc

SEQ ID NO: 2372351 - RNA, 15 nt, Bordetella pertussis
gcgcagcggcggcgc

SEQ ID NO: 2372352 - RNA, 19 nt, Bordetella pertussis
gcgcagcgugaccggacug

SEQ ID NO: 2372353 - RNA, 23 nt, Bordetella pertussis
gcgcagcgugaccggacugucca

SEQ ID NO: 2372354 - RNA, 22 nt, Bordetella pertussis
gcgcagcgugcggaccagcggu

SEQ ID NO: 2372355 - RNA, 14 nt, Bordetella pertussis
gcgcagcuccccca

SEQ ID NO: 2372356 - RNA, 17 nt, Bordetella pertussis
gcgcagcucccccacgc

SEQ ID NO: 2372357 - RNA, 18 nt, Bordetella pertussis
gcgcagcucccccacgcc

SEQ ID NO: 2372358 - RNA, 22 nt, Bordetella pertussis
gcgcagcucccccacgccgccg

SEQ ID NO: 2372359 - RNA, 15 nt, Bordetella pertussis
gcgcagcuccggguc

SEQ ID NO: 2372360 - RNA, 16 nt, Bordetella pertussis
gcgcagcuccgggucg

SEQ ID NO: 2372361 - RNA, 20 nt, Bordetella pertussis
gcgcagcuccgggucgagcg

SEQ ID NO: 2372362 - RNA, 19 nt, Bordetella pertussis
gcgcagcucguggcgcgcc

SEQ ID NO: 2372363 - RNA, 17 nt, Bordetella pertussis
gcgcagcuugcccgcgc

SEQ ID NO: 2372364 - RNA, 20 nt, Bordetella pertussis
gcgcagcuugcccgcgcgca

SEQ ID NO: 2372365 - RNA, 21 nt, Bordetella pertussis
gcgcagcuugcccgcgcgcac

SEQ ID NO: 2372366 - RNA, 17 nt, Bordetella pertussis
gcgcaggaacucagcgc

SEQ ID NO: 2372367 - RNA, 21 nt, Bordetella pertussis
gcgcaggaauuccucgcggcu

SEQ ID NO: 2372368 - RNA, 22 nt, Bordetella pertussis
gcgcaggaauuccucgcggcug

SEQ ID NO: 2372369 - RNA, 17 nt, Bordetella pertussis
gcgcaggacaaggcgcg

SEQ ID NO: 2372370 - RNA, 20 nt, Bordetella pertussis
gcgcaggacaaggcgcgcgc

SEQ ID NO: 2372371 - RNA, 13 nt, Bordetella pertussis
gcgcaggaugacg

SEQ ID NO: 2372372 - RNA, 15 nt, Bordetella pertussis
gcgcaggaugacgug

SEQ ID NO: 2372373 - RNA, 17 nt, Bordetella pertussis
gcgcaggaugacguggc

SEQ ID NO: 2372374 - RNA, 18 nt, Bordetella pertussis
gcgcaggaugacguggca

SEQ ID NO: 2372375 - RNA, 16 nt, Bordetella pertussis
gcgcaggaugcgcugg

SEQ ID NO: 2372376 - RNA, 19 nt, Bordetella pertussis
gcgcaggaugcgcuggccg

SEQ ID NO: 2372377 - RNA, 21 nt, Bordetella pertussis
gcgcaggaugcgcuggccggc

SEQ ID NO: 2372378 - RNA, 15 nt, Bordetella pertussis
gcgcaggaugggcag

SEQ ID NO: 2372379 - RNA, 22 nt, Bordetella pertussis
gcgcaggaugggcagcucgccu

SEQ ID NO: 2372380 - RNA, 19 nt, Bordetella pertussis
gcgcaggauuucaucgccc

SEQ ID NO: 2372381 - RNA, 19 nt, Bordetella pertussis
gcgcaggcaaagccugacg

SEQ ID NO: 2372382 - RNA, 21 nt, Bordetella pertussis
gcgcaggcaaagccugacggc

SEQ ID NO: 2372383 - RNA, 21 nt, Bordetella pertussis
gcgcaggcaguuggcggcgca

SEQ ID NO: 2372384 - RNA, 12 nt, Bordetella pertussis
gcgcaggccagc

SEQ ID NO: 2372385 - RNA, 14 nt, Bordetella pertussis
gcgcaggccagcgc

SEQ ID NO: 2372386 - RNA, 20 nt, Bordetella pertussis
gcgcaggccauugcuggcgc

SEQ ID NO: 2372387 - RNA, 18 nt, Bordetella pertussis
gcgcaggcccgacaggau

SEQ ID NO: 2372388 - RNA, 19 nt, Bordetella pertussis
gcgcaggcccgacaggauc

SEQ ID NO: 2372389 - RNA, 16 nt, Bordetella pertussis
gcgcaggccgacgcgc

SEQ ID NO: 2372390 - RNA, 11 nt, Bordetella pertussis
gcgcaggccgc

SEQ ID NO: 2372391 - RNA, 13 nt, Bordetella pertussis
gcgcaggccgcca

SEQ ID NO: 2372392 - RNA, 15 nt, Bordetella pertussis
gcgcaggccgcgccg

SEQ ID NO: 2372393 - RNA, 22 nt, Bordetella pertussis
gcgcaggccgcgccggcucccg

SEQ ID NO: 2372394 - RNA, 13 nt, Bordetella pertussis
gcgcaggccggcg

SEQ ID NO: 2372395 - RNA, 15 nt, Bordetella pertussis
gcgcaggccggcggc

SEQ ID NO: 2372396 - RNA, 18 nt, Bordetella pertussis
gcgcaggccggcggccag

SEQ ID NO: 2372397 - RNA, 20 nt, Bordetella pertussis
gcgcaggccggcggccagcg

SEQ ID NO: 2372398 - RNA, 13 nt, Bordetella pertussis
gcgcaggcgccgc

SEQ ID NO: 2372399 - RNA, 12 nt, Bordetella pertussis
gcgcaggcgcgc

SEQ ID NO: 2372400 - RNA, 13 nt, Bordetella pertussis
gcgcaggcgcgcc

SEQ ID NO: 2372401 - RNA, 19 nt, Bordetella pertussis
gcgcaggcgcgcgccuucu

SEQ ID NO: 2372402 - RNA, 14 nt, Bordetella pertussis
gcgcaggcgcgcgg

SEQ ID NO: 2372403 - RNA, 17 nt, Bordetella pertussis
gcgcaggcgcgcggggg

SEQ ID NO: 2372404 - RNA, 19 nt, Bordetella pertussis
gcgcaggcgcguggccacg

SEQ ID NO: 2372405 - RNA, 20 nt, Bordetella pertussis
gcgcaggcgcguggccacgg

SEQ ID NO: 2372406 - RNA, 14 nt, Bordetella pertussis
gcgcaggcgggccu

SEQ ID NO: 2372407 - RNA, 15 nt, Bordetella pertussis
gcgcaggcgggccuc

SEQ ID NO: 2372408 - RNA, 17 nt, Bordetella pertussis
gcgcaggcgugcgcggg

SEQ ID NO: 2372409 - RNA, 22 nt, Bordetella pertussis
gcgcaggcgugcgcgggcgcca

SEQ ID NO: 2372410 - RNA, 14 nt, Bordetella pertussis
gcgcaggcugucga

SEQ ID NO: 2372411 - RNA, 12 nt, Bordetella pertussis
gcgcagggcggc

SEQ ID NO: 2372412 - RNA, 16 nt, Bordetella pertussis
gcgcagggcggccggc

SEQ ID NO: 2372413 - RNA, 17 nt, Bordetella pertussis
gcgcagggcggccggca

SEQ ID NO: 2372414 - RNA, 19 nt, Bordetella pertussis
gcgcagggcggccggcacg

SEQ ID NO: 2372415 - RNA, 21 nt, Bordetella pertussis
gcgcagggcggccggcacgcc

SEQ ID NO: 2372416 - RNA, 22 nt, Bordetella pertussis
gcgcagggcggccggcacgccg

SEQ ID NO: 2372417 - RNA, 14 nt, Bordetella pertussis
gcgcagggcggccu

SEQ ID NO: 2372418 - RNA, 15 nt, Bordetella pertussis
gcgcagggcggccuc

SEQ ID NO: 2372419 - RNA, 14 nt, Bordetella pertussis
gcgcagggcgggcg

SEQ ID NO: 2372420 - RNA, 16 nt, Bordetella pertussis
gcgcagggcgggcggu

SEQ ID NO: 2372421 - RNA, 22 nt, Bordetella pertussis
gcgcaggggcucuucgacagcg

SEQ ID NO: 2372422 - RNA, 16 nt, Bordetella pertussis
gcgcagguauuccgcc

SEQ ID NO: 2372423 - RNA, 20 nt, Bordetella pertussis
gcgcagguauuccgccguca

SEQ ID NO: 2372424 - RNA, 17 nt, Bordetella pertussis
gcgcagguccaccgcca

SEQ ID NO: 2372425 - RNA, 14 nt, Bordetella pertussis
gcgcaggucggcca

SEQ ID NO: 2372426 - RNA, 20 nt, Bordetella pertussis
gcgcaggucggccaggacgg

SEQ ID NO: 2372427 - RNA, 17 nt, Bordetella pertussis
gcgcaggugugccagcc

SEQ ID NO: 2372428 - RNA, 18 nt, Bordetella pertussis
gcgcaggugugccagccg

SEQ ID NO: 2372429 - RNA, 20 nt, Bordetella pertussis
gcgcaggugugccagccgcu

SEQ ID NO: 2372430 - RNA, 17 nt, Bordetella pertussis
gcgcaguaucccggcca

SEQ ID NO: 2372431 - RNA, 18 nt, Bordetella pertussis
gcgcaguaucccggccag

SEQ ID NO: 2372432 - RNA, 21 nt, Bordetella pertussis
gcgcaguaucccggccaggcg

SEQ ID NO: 2372433 - RNA, 22 nt, Bordetella pertussis
gcgcaguaucuggugcgcgucc

SEQ ID NO: 2372434 - RNA, 12 nt, Bordetella pertussis
gcgcaguccagc

SEQ ID NO: 2372435 - RNA, 14 nt, Bordetella pertussis
gcgcaguccgcaca

SEQ ID NO: 2372436 - RNA, 20 nt, Bordetella pertussis
gcgcagucgagcaccgcgcg

SEQ ID NO: 2372437 - RNA, 16 nt, Bordetella pertussis
gcgcagucgcgcacga

SEQ ID NO: 2372438 - RNA, 15 nt, Bordetella pertussis
gcgcagugggccagu

SEQ ID NO: 2372439 - RNA, 20 nt, Bordetella pertussis
gcgcaguugcgucuccagcg

SEQ ID NO: 2372440 - RNA, 20 nt, Bordetella pertussis
gcgcaguuguucgcgcaacu

SEQ ID NO: 2372441 - RNA, 13 nt, Bordetella pertussis
gcgcauacagggc

SEQ ID NO: 2372442 - RNA, 21 nt, Bordetella pertussis
gcgcauacgcggguucgacgc

SEQ ID NO: 2372443 - RNA, 23 nt, Bordetella pertussis
gcgcauagacccacagguuggcc

SEQ ID NO: 2372444 - RNA, 14 nt, Bordetella pertussis
gcgcauaggacgcc

SEQ ID NO: 2372445 - RNA, 18 nt, Bordetella pertussis
gcgcauauggagccaggc

SEQ ID NO: 2372446 - RNA, 22 nt, Bordetella pertussis
gcgcauauggagccaggcggcg

SEQ ID NO: 2372447 - RNA, 16 nt, Bordetella pertussis
gcgccacagcaugacc

SEQ ID NO: 2372448 - RNA, 17 nt, Bordetella pertussis
gcgccacagcaugaccu

SEQ ID NO: 2372449 - RNA, 24 nt, Bordetella pertussis
gcgccacagcaugaccucggccug

SEQ ID NO: 2372450 - RNA, 13 nt, Bordetella pertussis
gcgccacagcgcc

SEQ ID NO: 2372451 - RNA, 14 nt, Bordetella pertussis
gcgccacagcgcca

SEQ ID NO: 2372452 - RNA, 16 nt, Bordetella pertussis
gcgccacagcgccauc

SEQ ID NO: 2372453 - RNA, 17 nt, Bordetella pertussis
gcgccacagggccugac

SEQ ID NO: 2372454 - RNA, 17 nt, Bordetella pertussis
gcgccacaggugcgcgg

SEQ ID NO: 2372455 - RNA, 22 nt, Bordetella pertussis
gcgccacaggugcgcggcgcgc

SEQ ID NO: 2372456 - RNA, 19 nt, Bordetella pertussis
gcgccacauccugcacggc

SEQ ID NO: 2372457 - RNA, 12 nt, Bordetella pertussis
gcgccaccaccg

SEQ ID NO: 2372458 - RNA, 22 nt, Bordetella pertussis
gcgccaccaccggcacgccggc

SEQ ID NO: 2372459 - RNA, 13 nt, Bordetella pertussis
gcgccaccaccgu

SEQ ID NO: 2372460 - RNA, 18 nt, Bordetella pertussis
gcgccaccagcagcgcca

SEQ ID NO: 2372461 - RNA, 20 nt, Bordetella pertussis
gcgccaccagcagcgccagg

SEQ ID NO: 2372462 - RNA, 23 nt, Bordetella pertussis
gcgccaccagcagcgccaggaug

SEQ ID NO: 2372463 - RNA, 12 nt, Bordetella pertussis
gcgccaccagcu

SEQ ID NO: 2372464 - RNA, 21 nt, Bordetella pertussis
gcgccaccagcuugcgcgccg

SEQ ID NO: 2372465 - RNA, 14 nt, Bordetella pertussis
gcgccaccccgccg

SEQ ID NO: 2372466 - RNA, 15 nt, Bordetella pertussis
gcgccaccccgccgc

SEQ ID NO: 2372467 - RNA, 17 nt, Bordetella pertussis
gcgccaccccgccgcug

SEQ ID NO: 2372468 - RNA, 17 nt, Bordetella pertussis
gcgccaccgcauggggc

SEQ ID NO: 2372469 - RNA, 21 nt, Bordetella pertussis
gcgccaccgcauggggcgagg

SEQ ID NO: 2372470 - RNA, 13 nt, Bordetella pertussis
gcgccaccggcug

SEQ ID NO: 2372471 - RNA, 15 nt, Bordetella pertussis
gcgccaccggcugga

SEQ ID NO: 2372472 - RNA, 22 nt, Bordetella pertussis
gcgccaccggucgccguccagg

SEQ ID NO: 2372473 - RNA, 22 nt, Bordetella pertussis
gcgccaccgugauggcgcgggu

SEQ ID NO: 2372474 - RNA, 13 nt, Bordetella pertussis
gcgccaccuggcg

SEQ ID NO: 2372475 - RNA, 14 nt, Bordetella pertussis
gcgccaccuggcgc

SEQ ID NO: 2372476 - RNA, 15 nt, Bordetella pertussis
gcgccaccuggcgcc

SEQ ID NO: 2372477 - RNA, 18 nt, Bordetella pertussis
gcgccaccuggcgcccgg

SEQ ID NO: 2372478 - RNA, 20 nt, Bordetella pertussis
gcgccaccuggcgcccggcg

SEQ ID NO: 2372479 - RNA, 19 nt, Bordetella pertussis
gcgccacgacguagucggc

SEQ ID NO: 2372480 - RNA, 14 nt, Bordetella pertussis
gcgccacgccagcg

SEQ ID NO: 2372481 - RNA, 12 nt, Bordetella pertussis
gcgccacgccca

SEQ ID NO: 2372482 - RNA, 13 nt, Bordetella pertussis
gcgccacgcccac

SEQ ID NO: 2372483 - RNA, 17 nt, Bordetella pertussis
gcgccacgcccacuucc

SEQ ID NO: 2372484 - RNA, 24 nt, Bordetella pertussis
gcgccacgcccacuuccucggcgc

SEQ ID NO: 2372485 - RNA, 15 nt, Bordetella pertussis
gcgccacgcccaggc

SEQ ID NO: 2372486 - RNA, 16 nt, Bordetella pertussis
gcgccacgcccaggcc

SEQ ID NO: 2372487 - RNA, 17 nt, Bordetella pertussis
gcgccacgcccaggccg

SEQ ID NO: 2372488 - RNA, 18 nt, Bordetella pertussis
gcgccacgcccaggccgc

SEQ ID NO: 2372489 - RNA, 16 nt, Bordetella pertussis
gcgccacgcccuggcg

SEQ ID NO: 2372490 - RNA, 16 nt, Bordetella pertussis
gcgccacgccggccag

SEQ ID NO: 2372491 - RNA, 18 nt, Bordetella pertussis
gcgccacgccggccagcu

SEQ ID NO: 2372492 - RNA, 14 nt, Bordetella pertussis
gcgccacgccguca

SEQ ID NO: 2372493 - RNA, 21 nt, Bordetella pertussis
gcgccacggcgucgccggcca

SEQ ID NO: 2372494 - RNA, 23 nt, Bordetella pertussis
gcgccacggcgucgccggccagg

SEQ ID NO: 2372495 - RNA, 20 nt, Bordetella pertussis
gcgccacggcuucgcccagc

SEQ ID NO: 2372496 - RNA, 21 nt, Bordetella pertussis
gcgccacggcuucgcccagcg

SEQ ID NO: 2372497 - RNA, 22 nt, Bordetella pertussis
gcgccacggcuucgcccagcgc

SEQ ID NO: 2372498 - RNA, 23 nt, Bordetella pertussis
gcgccacggcuucgcccagcgcu

SEQ ID NO: 2372499 - RNA, 14 nt, Bordetella pertussis
gcgccacggcuugc

SEQ ID NO: 2372500 - RNA, 19 nt, Bordetella pertussis
gcgccacggcuugcgcgua

SEQ ID NO: 2372501 - RNA, 22 nt, Bordetella pertussis
gcgccacggucugcacgccggg

SEQ ID NO: 2372502 - RNA, 23 nt, Bordetella pertussis
gcgccacggucugcacgccgggc

SEQ ID NO: 2372503 - RNA, 16 nt, Bordetella pertussis
gcgccacguccagcac

SEQ ID NO: 2372504 - RNA, 21 nt, Bordetella pertussis
gcgccacguccagcacggccg

SEQ ID NO: 2372505 - RNA, 22 nt, Bordetella pertussis
gcgccacgucgaccucgagcac

SEQ ID NO: 2372506 - RNA, 16 nt, Bordetella pertussis
gcgccacugccaggcg

SEQ ID NO: 2372507 - RNA, 17 nt, Bordetella pertussis
gcgccacuucgccucgg

SEQ ID NO: 2372508 - RNA, 19 nt, Bordetella pertussis
gcgccagaaagcgcggccg

SEQ ID NO: 2372509 - RNA, 22 nt, Bordetella pertussis
gcgccagaaagcgcggccgggc

SEQ ID NO: 2372510 - RNA, 17 nt, Bordetella pertussis
gcgccagaacgacagcg

SEQ ID NO: 2372511 - RNA, 18 nt, Bordetella pertussis
gcgccagaugcgccgcac

SEQ ID NO: 2372512 - RNA, 21 nt, Bordetella pertussis
gcgccagaugcgccgcacguc

SEQ ID NO: 2372513 - RNA, 13 nt, Bordetella pertussis
gcgccagcaccgg

SEQ ID NO: 2372514 - RNA, 15 nt, Bordetella pertussis
gcgccagcaccggca

SEQ ID NO: 2372515 - RNA, 22 nt, Bordetella pertussis
gcgccagcaccggcacgcgcca

SEQ ID NO: 2372516 - RNA, 15 nt, Bordetella pertussis
gcgccagcacgauca

SEQ ID NO: 2372517 - RNA, 23 nt, Bordetella pertussis
gcgccagcacgaucacgaacagc

SEQ ID NO: 2372518 - RNA, 14 nt, Bordetella pertussis
gcgccagcacggca

SEQ ID NO: 2372519 - RNA, 19 nt, Bordetella pertussis
gcgccagcacgguggcgcc

SEQ ID NO: 2372520 - RNA, 23 nt, Bordetella pertussis
gcgccagcacgguggcgcccggc

SEQ ID NO: 2372521 - RNA, 11 nt, Bordetella pertussis
gcgccagcagc

SEQ ID NO: 2372522 - RNA, 16 nt, Bordetella pertussis
gcgccagcagcacguc

SEQ ID NO: 2372523 - RNA, 18 nt, Bordetella pertussis
gcgccagcagcaggccgu

SEQ ID NO: 2372524 - RNA, 14 nt, Bordetella pertussis
gcgccagcagcgcc

SEQ ID NO: 2372525 - RNA, 16 nt, Bordetella pertussis
gcgccagcagcgccgg

SEQ ID NO: 2372526 - RNA, 17 nt, Bordetella pertussis
gcgccagcagcgccggu

SEQ ID NO: 2372527 - RNA, 15 nt, Bordetella pertussis
gcgccagcagcgggc

SEQ ID NO: 2372528 - RNA, 16 nt, Bordetella pertussis
gcgccagcagcgggcu

SEQ ID NO: 2372529 - RNA, 12 nt, Bordetella pertussis
gcgccagcaggg

SEQ ID NO: 2372530 - RNA, 24 nt, Bordetella pertussis
gcgccagcagggucagcggccggc

SEQ ID NO: 2372531 - RNA, 14 nt, Bordetella pertussis
gcgccagcauccgg

SEQ ID NO: 2372532 - RNA, 20 nt, Bordetella pertussis
gcgccagcaugacggggucg

SEQ ID NO: 2372533 - RNA, 14 nt, Bordetella pertussis
gcgccagcaugcgc

SEQ ID NO: 2372534 - RNA, 16 nt, Bordetella pertussis
gcgccagcaugcgcgc

SEQ ID NO: 2372535 - RNA, 18 nt, Bordetella pertussis
gcgccagcaugcgcgcgg

SEQ ID NO: 2372536 - RNA, 12 nt, Bordetella pertussis
gcgccagccagc

SEQ ID NO: 2372537 - RNA, 19 nt, Bordetella pertussis
gcgccagccagcgcaugcc

SEQ ID NO: 2372538 - RNA, 14 nt, Bordetella pertussis
gcgccagcccgccc

SEQ ID NO: 2372539 - RNA, 15 nt, Bordetella pertussis
gcgccagcccgcccg

SEQ ID NO: 2372540 - RNA, 18 nt, Bordetella pertussis
gcgccagcccgcccgcga

SEQ ID NO: 2372541 - RNA, 23 nt, Bordetella pertussis
gcgccagcccgcccgcgagcggc

SEQ ID NO: 2372542 - RNA, 17 nt, Bordetella pertussis
gcgccagcccgccgcug

SEQ ID NO: 2372543 - RNA, 17 nt, Bordetella pertussis
gcgccagcccgcugccg

SEQ ID NO: 2372544 - RNA, 12 nt, Bordetella pertussis
gcgccagccgcg

SEQ ID NO: 2372545 - RNA, 16 nt, Bordetella pertussis
gcgccagccgcgccug

SEQ ID NO: 2372546 - RNA, 20 nt, Bordetella pertussis
gcgccagccgcgccugcagc

SEQ ID NO: 2372547 - RNA, 19 nt, Bordetella pertussis
gcgccagccgcgcgaccuu

SEQ ID NO: 2372548 - RNA, 21 nt, Bordetella pertussis
gcgccagccgcgcgaccuugu

SEQ ID NO: 2372549 - RNA, 12 nt, Bordetella pertussis
gcgccagccgcu

SEQ ID NO: 2372550 - RNA, 13 nt, Bordetella pertussis
gcgccagccgcuc

SEQ ID NO: 2372551 - RNA, 19 nt, Bordetella pertussis
gcgccagccgcuccaggaa

SEQ ID NO: 2372552 - RNA, 13 nt, Bordetella pertussis
gcgccagccgcuu

SEQ ID NO: 2372553 - RNA, 17 nt, Bordetella pertussis
gcgccagccgcuugccc

SEQ ID NO: 2372554 - RNA, 15 nt, Bordetella pertussis
gcgccagcgccacgc

SEQ ID NO: 2372555 - RNA, 16 nt, Bordetella pertussis
gcgccagcgccacgcg

SEQ ID NO: 2372556 - RNA, 13 nt, Bordetella pertussis
gcgccagcgccag

SEQ ID NO: 2372557 - RNA, 15 nt, Bordetella pertussis
gcgccagcgccagcg

SEQ ID NO: 2372558 - RNA, 16 nt, Bordetella pertussis
gcgccagcgccagcgu

SEQ ID NO: 2372559 - RNA, 20 nt, Bordetella pertussis
gcgccagcgccccggcguau

SEQ ID NO: 2372560 - RNA, 17 nt, Bordetella pertussis
gcgccaguugcggggcg

SEQ ID NO: 2372561 - RNA, 20 nt, Bordetella pertussis
gcgccaguugcggggcgccc

SEQ ID NO: 2372562 - RNA, 22 nt, Bordetella pertussis
gcgccaguugcggggcgcccag

SEQ ID NO: 2372563 - RNA, 18 nt, Bordetella pertussis
gcgccaucaagagcaccg

SEQ ID NO: 2372564 - RNA, 19 nt, Bordetella pertussis
gcgccaucaagagcaccgu

SEQ ID NO: 2372565 - RNA, 12 nt, Bordetella pertussis
gcgccaucaucg

SEQ ID NO: 2372566 - RNA, 20 nt, Bordetella pertussis
gcgccauccugaacgccgcg

SEQ ID NO: 2372567 - RNA, 22 nt, Bordetella pertussis
gcgccaucgacgggcggcugcc

SEQ ID NO: 2372568 - RNA, 11 nt, Bordetella pertussis
gcgccaucgcg

SEQ ID NO: 2372569 - RNA, 14 nt, Bordetella pertussis
gcgccaucgcggua

SEQ ID NO: 2372570 - RNA, 14 nt, Bordetella pertussis
gcgccaucgcgucg

SEQ ID NO: 2372571 - RNA, 15 nt, Bordetella pertussis
gcgccaucgcgucga

SEQ ID NO: 2372572 - RNA, 22 nt, Bordetella pertussis
gcgccaucuaccugucgggcgg

SEQ ID NO: 2372573 - RNA, 19 nt, Bordetella pertussis
gcgccaucucaaccacgaa

SEQ ID NO: 2372574 - RNA, 21 nt, Bordetella pertussis
gcgccaugaacucgcgcucgg

SEQ ID NO: 2372575 - RNA, 22 nt, Bordetella pertussis
gcgccaugaacucgcgcucggc

SEQ ID NO: 2372576 - RNA, 23 nt, Bordetella pertussis
gcgccaugaacucgcgcucggcg

SEQ ID NO: 2372577 - RNA, 19 nt, Bordetella pertussis
gcgccaugaucgccggcaa

SEQ ID NO: 2372578 - RNA, 16 nt, Bordetella pertussis
gcgccaugaugucgcg

SEQ ID NO: 2372579 - RNA, 17 nt, Bordetella pertussis
gcgccaugaugucgcgc

SEQ ID NO: 2372580 - RNA, 20 nt, Bordetella pertussis
gcgccaugaugucgcgcgcc

SEQ ID NO: 2372581 - RNA, 21 nt, Bordetella pertussis
gcgccaugaugucgcgcgccu

SEQ ID NO: 2372582 - RNA, 22 nt, Bordetella pertussis
gcgccaugaugucgcgcgccug

SEQ ID NO: 2372583 - RNA, 21 nt, Bordetella pertussis
gcgccaugcaacacgaccagc

SEQ ID NO: 2372584 - RNA, 23 nt, Bordetella pertussis
gcgccaugcaacacgaccagcag

SEQ ID NO: 2372585 - RNA, 14 nt, Bordetella pertussis
gcgccaugccgcgc

SEQ ID NO: 2372586 - RNA, 14 nt, Bordetella pertussis
gcgccaugccggga

SEQ ID NO: 2372587 - RNA, 15 nt, Bordetella pertussis
gcgccaugcgacagc

SEQ ID NO: 2372588 - RNA, 20 nt, Bordetella pertussis
gcgccaugcgacagcccggg

SEQ ID NO: 2372589 - RNA, 15 nt, Bordetella pertussis
gcgccaugcgcacca

SEQ ID NO: 2372590 - RNA, 18 nt, Bordetella pertussis
gcgccaugcgcaccaccg

SEQ ID NO: 2372591 - RNA, 20 nt, Bordetella pertussis
gcgccaugcgcaccaccgcc

SEQ ID NO: 2372592 - RNA, 21 nt, Bordetella pertussis
gcgccaugcgcaccaccgccg

SEQ ID NO: 2372593 - RNA, 22 nt, Bordetella pertussis
gcgccaugcgcaccaccgccga

SEQ ID NO: 2372594 - RNA, 14 nt, Bordetella pertussis
gcgccaugcgcccg

SEQ ID NO: 2372595 - RNA, 15 nt, Bordetella pertussis
gcgccaugcgcccgg

SEQ ID NO: 2372596 - RNA, 16 nt, Bordetella pertussis
gcgccaugcgcccggc

SEQ ID NO: 2372597 - RNA, 21 nt, Bordetella pertussis
gcgccaugcggaugaacgacc

SEQ ID NO: 2372598 - RNA, 19 nt, Bordetella pertussis
gcgccaugcucgcgcacag

SEQ ID NO: 2372599 - RNA, 23 nt, Bordetella pertussis
gcgccaugcuggccgccgcgcuc

SEQ ID NO: 2372600 - RNA, 14 nt, Bordetella pertussis
gcgccauggcgcgc

SEQ ID NO: 2372601 - RNA, 23 nt, Bordetella pertussis
gcgccauggucucccccucggcc

SEQ ID NO: 2372602 - RNA, 21 nt, Bordetella pertussis
gcgccauggugaacggccccg

SEQ ID NO: 2372603 - RNA, 15 nt, Bordetella pertussis
gcgccauguggcgac

SEQ ID NO: 2372604 - RNA, 19 nt, Bordetella pertussis
gcgccauguggcgacgccc

SEQ ID NO: 2372605 - RNA, 22 nt, Bordetella pertussis
gcgccauucuucgccgaugcgc

SEQ ID NO: 2372606 - RNA, 16 nt, Bordetella pertussis
gcgccauugccacggc

SEQ ID NO: 2372607 - RNA, 17 nt, Bordetella pertussis
gcgccauugccacggcg

SEQ ID NO: 2372608 - RNA, 15 nt, Bordetella pertussis
gcgcccaacccaggu

SEQ ID NO: 2372609 - RNA, 17 nt, Bordetella pertussis
gcgcccaauccgaucag

SEQ ID NO: 2372610 - RNA, 20 nt, Bordetella pertussis
gcgcccaauccgaucagcac

SEQ ID NO: 2372611 - RNA, 17 nt, Bordetella pertussis
gcgcccaaucgggcagc

SEQ ID NO: 2372612 - RNA, 21 nt, Bordetella pertussis
gcgcccaaucgggcagcacgc

SEQ ID NO: 2372613 - RNA, 13 nt, Bordetella pertussis
gcgcccacaggaa

SEQ ID NO: 2372614 - RNA, 17 nt, Bordetella pertussis
gcgcccaccagggugcc

SEQ ID NO: 2372615 - RNA, 23 nt, Bordetella pertussis
gcgcccacgcacaugaugcccag

SEQ ID NO: 2372616 - RNA, 15 nt, Bordetella pertussis
gcgcccacggccgca

SEQ ID NO: 2372617 - RNA, 14 nt, Bordetella pertussis
gcgcccacggccug

SEQ ID NO: 2372618 - RNA, 21 nt, Bordetella pertussis
gcgcccacggccuguccggca

SEQ ID NO: 2372619 - RNA, 21 nt, Bordetella pertussis
gcgcccagaucgauccagaag

SEQ ID NO: 2372620 - RNA, 13 nt, Bordetella pertussis
gcgcccagcagcg

SEQ ID NO: 2372621 - RNA, 15 nt, Bordetella pertussis
gcgcccagcagcgcc

SEQ ID NO: 2372622 - RNA, 23 nt, Bordetella pertussis
gcgcccagcauggucggcauggc

SEQ ID NO: 2372623 - RNA, 16 nt, Bordetella pertussis
gcgcccagccccgcgg

SEQ ID NO: 2372624 - RNA, 12 nt, Bordetella pertussis
gcgcccagccgc

SEQ ID NO: 2372625 - RNA, 16 nt, Bordetella pertussis
gcgcccagccgcgcca

SEQ ID NO: 2372626 - RNA, 21 nt, Bordetella pertussis
gcgcccagccgcgccaucacg

SEQ ID NO: 2372627 - RNA, 15 nt, Bordetella pertussis
gcgcccagcgagcug

SEQ ID NO: 2372628 - RNA, 16 nt, Bordetella pertussis
gcgcccagcgagcugc

SEQ ID NO: 2372629 - RNA, 13 nt, Bordetella pertussis
gcgcccagcgcca

SEQ ID NO: 2372630 - RNA, 15 nt, Bordetella pertussis
gcgcccagcgcgccg

SEQ ID NO: 2372631 - RNA, 19 nt, Bordetella pertussis
gcgcccagcgcgccggggg

SEQ ID NO: 2372632 - RNA, 14 nt, Bordetella pertussis
gcgcccagcgcggc

SEQ ID NO: 2372633 - RNA, 16 nt, Bordetella pertussis
gcgcccagcgcggccu

SEQ ID NO: 2372634 - RNA, 13 nt, Bordetella pertussis
gcgcccagcgcgu

SEQ ID NO: 2372635 - RNA, 17 nt, Bordetella pertussis
gcgcccagcgcgucggc

SEQ ID NO: 2372636 - RNA, 19 nt, Bordetella pertussis
gcgcccagcgcgucggcca

SEQ ID NO: 2372637 - RNA, 21 nt, Bordetella pertussis
gcgcccagcgcgucggccagc

SEQ ID NO: 2372638 - RNA, 22 nt, Bordetella pertussis
gcgcccagcggcaggcuggccg

SEQ ID NO: 2372639 - RNA, 13 nt, Bordetella pertussis
gcgcccagcugcu

SEQ ID NO: 2372640 - RNA, 16 nt, Bordetella pertussis
gcgcccagcuggcgcc

SEQ ID NO: 2372641 - RNA, 14 nt, Bordetella pertussis
gcgcccagcugucc

SEQ ID NO: 2372642 - RNA, 19 nt, Bordetella pertussis
gcgcccagcuguccaagcg

SEQ ID NO: 2372643 - RNA, 22 nt, Bordetella pertussis
gcgcccagcuguccaagcgcgu

SEQ ID NO: 2372644 - RNA, 21 nt, Bordetella pertussis
gcgcccagcuugaugccgccg

SEQ ID NO: 2372645 - RNA, 14 nt, Bordetella pertussis
gcgcccaggccagc

SEQ ID NO: 2372646 - RNA, 15 nt, Bordetella pertussis
gcgcccaggccagcc

SEQ ID NO: 2372647 - RNA, 16 nt, Bordetella pertussis
gcgcccaggccagcca

SEQ ID NO: 2372648 - RNA, 20 nt, Bordetella pertussis
gcgcccaggcccagcgcgcc

SEQ ID NO: 2372649 - RNA, 14 nt, Bordetella pertussis
gcgcccaggcgaug

SEQ ID NO: 2372650 - RNA, 19 nt, Bordetella pertussis
gcgcccaggcgaugcccag

SEQ ID NO: 2372651 - RNA, 23 nt, Bordetella pertussis
gcgcccaggcgaugcccagcgcc

SEQ ID NO: 2372652 - RNA, 16 nt, Bordetella pertussis
gcgcccaggggccggc

SEQ ID NO: 2372653 - RNA, 20 nt, Bordetella pertussis
gcgcccaggggccggcgcgc

SEQ ID NO: 2372654 - RNA, 17 nt, Bordetella pertussis
gcgcccagggugguggc

SEQ ID NO: 2372655 - RNA, 23 nt, Bordetella pertussis
gcgcccagguacaucauccccag

SEQ ID NO: 2372656 - RNA, 21 nt, Bordetella pertussis
gcgcccagguccugcgccagc

SEQ ID NO: 2372657 - RNA, 22 nt, Bordetella pertussis
gcgcccagguccugcgccagcu

SEQ ID NO: 2372658 - RNA, 13 nt, Bordetella pertussis
gcgcccagguuuc

SEQ ID NO: 2372659 - RNA, 20 nt, Bordetella pertussis
gcgcccaguuccacgcggcc

SEQ ID NO: 2372660 - RNA, 20 nt, Bordetella pertussis
gcgcccaucucggccgcggc

SEQ ID NO: 2372661 - RNA, 15 nt, Bordetella pertussis
gcgcccaugcgcugg

SEQ ID NO: 2372662 - RNA, 16 nt, Bordetella pertussis
gcgcccaugcgcuggc

SEQ ID NO: 2372663 - RNA, 19 nt, Bordetella pertussis
gcgcccaugcgcuggcgca

SEQ ID NO: 2372664 - RNA, 16 nt, Bordetella pertussis
gcgcccauggcgcgca

SEQ ID NO: 2372665 - RNA, 19 nt, Bordetella pertussis
gcgcccauuccgagcgggc

SEQ ID NO: 2372666 - RNA, 20 nt, Bordetella pertussis
gcgcccauuccgagcgggcc

SEQ ID NO: 2372667 - RNA, 22 nt, Bordetella pertussis
gcgcccauuccgagcgggcccg

SEQ ID NO: 2372668 - RNA, 22 nt, Bordetella pertussis
gcgcccauuucgauggccaggg

SEQ ID NO: 2372669 - RNA, 12 nt, Bordetella pertussis
gcgccccagagc

SEQ ID NO: 2372670 - RNA, 22 nt, Bordetella pertussis
gcgccccaggcgucggcggccc

SEQ ID NO: 2372671 - RNA, 19 nt, Bordetella pertussis
gcgccccaucaccauggcc

SEQ ID NO: 2372672 - RNA, 14 nt, Bordetella pertussis
gcgccgaagucggc

SEQ ID NO: 2372673 - RNA, 18 nt, Bordetella pertussis
gcgccgaaguugcggccg

SEQ ID NO: 2372674 - RNA, 22 nt, Bordetella pertussis
gcgccgaaguugcggccgugcg

SEQ ID NO: 2372675 - RNA, 14 nt, Bordetella pertussis
gcgccgacaacggc

SEQ ID NO: 2372676 - RNA, 19 nt, Bordetella pertussis
gcgccgacaacggcgugcu

SEQ ID NO: 2372677 - RNA, 21 nt, Bordetella pertussis
gcgccgacaggaaggcgagcg

SEQ ID NO: 2372678 - RNA, 18 nt, Bordetella pertussis
gcgccgacagguaggcgc

SEQ ID NO: 2372679 - RNA, 21 nt, Bordetella pertussis
gcgccgacagguaggcgccgg

SEQ ID NO: 2372680 - RNA, 22 nt, Bordetella pertussis
gcgccgacagguaggcgccggu

SEQ ID NO: 2372681 - RNA, 21 nt, Bordetella pertussis
gcgccgaccacgcugggccag

SEQ ID NO: 2372682 - RNA, 22 nt, Bordetella pertussis
gcgccgaccacgcugggccaga

SEQ ID NO: 2372683 - RNA, 12 nt, Bordetella pertussis
gcgccgaccagg

SEQ ID NO: 2372684 - RNA, 20 nt, Bordetella pertussis
gcgccgaccagguaucgacc

SEQ ID NO: 2372685 - RNA, 23 nt, Bordetella pertussis
gcgccgacccgagcccuggcuug

SEQ ID NO: 2372686 - RNA, 14 nt, Bordetella pertussis
gcgccgaccgcacg

SEQ ID NO: 2372687 - RNA, 13 nt, Bordetella pertussis
gcgccgaccggcc

SEQ ID NO: 2372688 - RNA, 16 nt, Bordetella pertussis
gcgccgaccgggccga

SEQ ID NO: 2372689 - RNA, 19 nt, Bordetella pertussis
gcgccgaccgggccgacca

SEQ ID NO: 2372690 - RNA, 23 nt, Bordetella pertussis
gcgccgaccgggccgaccaggcc

SEQ ID NO: 2372691 - RNA, 14 nt, Bordetella pertussis
gcgccgacgaccga

SEQ ID NO: 2372692 - RNA, 18 nt, Bordetella pertussis
gcgccgacgaccgaaccg

SEQ ID NO: 2372693 - RNA, 18 nt, Bordetella pertussis
gcgccgacgaugccgccc

SEQ ID NO: 2372694 - RNA, 22 nt, Bordetella pertussis
gcgccgacgaugccgcccacgc

SEQ ID NO: 2372695 - RNA, 23 nt, Bordetella pertussis
gcgccgacgaugccgcccacgcc

SEQ ID NO: 2372696 - RNA, 13 nt, Bordetella pertussis
gcgccgacgcgcu

SEQ ID NO: 2372697 - RNA, 16 nt, Bordetella pertussis
gcgccgacggcauggc

SEQ ID NO: 2372698 - RNA, 20 nt, Bordetella pertussis
gcgccgacggcauggccggc

SEQ ID NO: 2372699 - RNA, 17 nt, Bordetella pertussis
gcgccgacggcggcgcg

SEQ ID NO: 2372700 - RNA, 18 nt, Bordetella pertussis
gcgccgacggcggcgcgg

SEQ ID NO: 2372701 - RNA, 14 nt, Bordetella pertussis
gcgccgacgggccg

SEQ ID NO: 2372702 - RNA, 16 nt, Bordetella pertussis
gcgccgacgggccggu

SEQ ID NO: 2372703 - RNA, 18 nt, Bordetella pertussis
gcgccgacgggccgguca

SEQ ID NO: 2372704 - RNA, 17 nt, Bordetella pertussis
gcgccgacucgaagaag

SEQ ID NO: 2372705 - RNA, 17 nt, Bordetella pertussis
gcgccgagauggacgcg

SEQ ID NO: 2372706 - RNA, 19 nt, Bordetella pertussis
gcgccgagauggacgcguu

SEQ ID NO: 2372707 - RNA, 21 nt, Bordetella pertussis
gcgccgagcagaucgccaacg

SEQ ID NO: 2372708 - RNA, 14 nt, Bordetella pertussis
gcgccgagcgccag

SEQ ID NO: 2372709 - RNA, 21 nt, Bordetella pertussis
gcgccgaggaucuggccggcg

SEQ ID NO: 2372710 - RNA, 14 nt, Bordetella pertussis
gcgccgaggccugc

SEQ ID NO: 2372711 - RNA, 14 nt, Bordetella pertussis
gcgccgaggcgggc

SEQ ID NO: 2372712 - RNA, 16 nt, Bordetella pertussis
gcgccgaggcgggcag

SEQ ID NO: 2372713 - RNA, 17 nt, Bordetella pertussis
gcgccgaggcgggcagc

SEQ ID NO: 2372714 - RNA, 18 nt, Bordetella pertussis
gcgccgaggcgggcagca

SEQ ID NO: 2372715 - RNA, 15 nt, Bordetella pertussis
gcgccgaggcggucg

SEQ ID NO: 2372716 - RNA, 17 nt, Bordetella pertussis
gcgccgaggugaucugg

SEQ ID NO: 2372717 - RNA, 13 nt, Bordetella pertussis
gcgccgaucacca

SEQ ID NO: 2372718 - RNA, 22 nt, Bordetella pertussis
gcgccgaucaccacgggcacga

SEQ ID NO: 2372719 - RNA, 15 nt, Bordetella pertussis
gcgccgauccagccc

SEQ ID NO: 2372720 - RNA, 16 nt, Bordetella pertussis
gcgccgauccagccca

SEQ ID NO: 2372721 - RNA, 16 nt, Bordetella pertussis
gcgccgauccagggcc

SEQ ID NO: 2372722 - RNA, 19 nt, Bordetella pertussis
gcgccgauccagggccgca

SEQ ID NO: 2372723 - RNA, 15 nt, Bordetella pertussis
gcgccgauccggcgc

SEQ ID NO: 2372724 - RNA, 15 nt, Bordetella pertussis
gcgccgaucgcggcu

SEQ ID NO: 2372725 - RNA, 15 nt, Bordetella pertussis
gcgccgaugcgccag

SEQ ID NO: 2372726 - RNA, 12 nt, Bordetella pertussis
gcgccgauggcg

SEQ ID NO: 2372727 - RNA, 13 nt, Bordetella pertussis
gcgccgauggcgc

SEQ ID NO: 2372728 - RNA, 15 nt, Bordetella pertussis
gcgccgauggcgccg

SEQ ID NO: 2372729 - RNA, 16 nt, Bordetella pertussis
gcgccgauggcgccgc

SEQ ID NO: 2372730 - RNA, 17 nt, Bordetella pertussis
gcgccgauggcgccgcu

SEQ ID NO: 2372731 - RNA, 18 nt, Bordetella pertussis
gcgccgauggcgccgcug

SEQ ID NO: 2372732 - RNA, 21 nt, Bordetella pertussis
gcgccgauggcgccgcugucg

SEQ ID NO: 2372733 - RNA, 18 nt, Bordetella pertussis
gcgccgauggugcgggcg

SEQ ID NO: 2372734 - RNA, 19 nt, Bordetella pertussis
gcgccgauuucgccgccgc

SEQ ID NO: 2372735 - RNA, 23 nt, Bordetella pertussis
gcgccgcaacaggcagcugcgcg

SEQ ID NO: 2372736 - RNA, 16 nt, Bordetella pertussis
gcgccgcaacccgcuu

SEQ ID NO: 2372737 - RNA, 19 nt, Bordetella pertussis
gcgccgcaacgccgccggc

SEQ ID NO: 2372738 - RNA, 20 nt, Bordetella pertussis
gcgccgcaacgccgccggca

SEQ ID NO: 2372739 - RNA, 21 nt, Bordetella pertussis
gcgccgcaacgccgccggcag

SEQ ID NO: 2372740 - RNA, 16 nt, Bordetella pertussis
gcgccgcaacgccggg

SEQ ID NO: 2372741 - RNA, 16 nt, Bordetella pertussis
gcgccgcaauagauca

SEQ ID NO: 2372742 - RNA, 19 nt, Bordetella pertussis
gcgccgcaauagaucaucc

SEQ ID NO: 2372743 - RNA, 12 nt, Bordetella pertussis
gcgccgcaccag

SEQ ID NO: 2372744 - RNA, 13 nt, Bordetella pertussis
gcgccgcaccagc

SEQ ID NO: 2372745 - RNA, 15 nt, Bordetella pertussis
gcgccgcaccagcgc

SEQ ID NO: 2372746 - RNA, 16 nt, Bordetella pertussis
gcgccgcaccagcgcc

SEQ ID NO: 2372747 - RNA, 18 nt, Bordetella pertussis
gcgccgcaccagcgccga

SEQ ID NO: 2372748 - RNA, 23 nt, Bordetella pertussis
gcgccgcaccagcgccgacggca

SEQ ID NO: 2372749 - RNA, 15 nt, Bordetella pertussis
gcgccgcacgccggu

SEQ ID NO: 2372750 - RNA, 17 nt, Bordetella pertussis
gcgccgcacgucggucg

SEQ ID NO: 2372751 - RNA, 23 nt, Bordetella pertussis
gcgccgcagcaccucggcguggc

SEQ ID NO: 2372752 - RNA, 13 nt, Bordetella pertussis
gcgccgcagcguc

SEQ ID NO: 2372753 - RNA, 19 nt, Bordetella pertussis
gcgccgcagcgucgcggcg

SEQ ID NO: 2372754 - RNA, 17 nt, Bordetella pertussis
gcgccgcagcguggcgu

SEQ ID NO: 2372755 - RNA, 20 nt, Bordetella pertussis
gcgccgcagugcgcgcgccc

SEQ ID NO: 2372756 - RNA, 14 nt, Bordetella pertussis
gcgccgcaugcggc

SEQ ID NO: 2372757 - RNA, 15 nt, Bordetella pertussis
gcgccgcaugcggcg

SEQ ID NO: 2372758 - RNA, 23 nt, Bordetella pertussis
gcgccgcauuuccucgaccagcg

SEQ ID NO: 2372759 - RNA, 15 nt, Bordetella pertussis
gcgccgccacaggcu

SEQ ID NO: 2372760 - RNA, 17 nt, Bordetella pertussis
gcgccgccacaggcuga

SEQ ID NO: 2372761 - RNA, 18 nt, Bordetella pertussis
gcgccgccacaggcugac

SEQ ID NO: 2372762 - RNA, 13 nt, Bordetella pertussis
gcgccgccaccuc

SEQ ID NO: 2372763 - RNA, 23 nt, Bordetella pertussis
gcgccgccaccucggcgucgccc

SEQ ID NO: 2372764 - RNA, 23 nt, Bordetella pertussis
gcgccgccagcauggcggccagg

SEQ ID NO: 2372765 - RNA, 13 nt, Bordetella pertussis
gcgccgccagccg

SEQ ID NO: 2372766 - RNA, 15 nt, Bordetella pertussis
gcgccgccagccgcu

SEQ ID NO: 2372767 - RNA, 16 nt, Bordetella pertussis
gcgccgccagccgcug

SEQ ID NO: 2372768 - RNA, 17 nt, Bordetella pertussis
gcgccgccagccgcugg

SEQ ID NO: 2372769 - RNA, 21 nt, Bordetella pertussis
gcgccgccagccgcuggcgcg

SEQ ID NO: 2372770 - RNA, 22 nt, Bordetella pertussis
gcgccgccagccgcuggcgcgc

SEQ ID NO: 2372771 - RNA, 19 nt, Bordetella pertussis
gcgccgccagcgcgcgcga

SEQ ID NO: 2372772 - RNA, 13 nt, Bordetella pertussis
gcgccgccaggcc

SEQ ID NO: 2372773 - RNA, 14 nt, Bordetella pertussis
gcgccgccaggccg

SEQ ID NO: 2372774 - RNA, 14 nt, Bordetella pertussis
gcgccgccaggcgc

SEQ ID NO: 2372775 - RNA, 15 nt, Bordetella pertussis
gcgccgccaggcgcg

SEQ ID NO: 2372776 - RNA, 16 nt, Bordetella pertussis
gcgccgccaggcgcga

SEQ ID NO: 2372777 - RNA, 18 nt, Bordetella pertussis
gcgccgccaucauggcgu

SEQ ID NO: 2372778 - RNA, 20 nt, Bordetella pertussis
gcgccgccauggcggcgccc

SEQ ID NO: 2372779 - RNA, 19 nt, Bordetella pertussis
gcgccgcccaccaccagcg

SEQ ID NO: 2372780 - RNA, 13 nt, Bordetella pertussis
gcgccgcccacgc

SEQ ID NO: 2372781 - RNA, 17 nt, Bordetella pertussis
gcgccgcccacgccgcu

SEQ ID NO: 2372782 - RNA, 18 nt, Bordetella pertussis
gcgccgcccccgcccagc

SEQ ID NO: 2372783 - RNA, 15 nt, Bordetella pertussis
gcgccgccccgucau

SEQ ID NO: 2372784 - RNA, 16 nt, Bordetella pertussis
gcgccgcccgcggcca

SEQ ID NO: 2372785 - RNA, 14 nt, Bordetella pertussis
gcgccgcuggccac

SEQ ID NO: 2372786 - RNA, 12 nt, Bordetella pertussis
gcgccgcuggcg

SEQ ID NO: 2372787 - RNA, 16 nt, Bordetella pertussis
gcgccgcuggcggccg

SEQ ID NO: 2372788 - RNA, 22 nt, Bordetella pertussis
gcgccgcuggcggccgcgggcg

SEQ ID NO: 2372789 - RNA, 14 nt, Bordetella pertussis
gcgccgcuggcguc

SEQ ID NO: 2372790 - RNA, 15 nt, Bordetella pertussis
gcgccgcuggcgucc

SEQ ID NO: 2372791 - RNA, 17 nt, Bordetella pertussis
gcgccgcuggcguccag

SEQ ID NO: 2372792 - RNA, 12 nt, Bordetella pertussis
gcgccgcugugg

SEQ ID NO: 2372793 - RNA, 21 nt, Bordetella pertussis
gcgccgcuguugcccaccagc

SEQ ID NO: 2372794 - RNA, 18 nt, Bordetella pertussis
gcgccgcuuccaccgucu

SEQ ID NO: 2372795 - RNA, 15 nt, Bordetella pertussis
gcgccgcuuccggcc

SEQ ID NO: 2372796 - RNA, 23 nt, Bordetella pertussis
gcgccgcuuccggccggaacuga

SEQ ID NO: 2372797 - RNA, 23 nt, Bordetella pertussis
gcgccgcuugcguucaugccggu

SEQ ID NO: 2372798 - RNA, 20 nt, Bordetella pertussis
gcgccgcuuucucccgccgc

SEQ ID NO: 2372799 - RNA, 17 nt, Bordetella pertussis
gcgccggaacauggcgg

SEQ ID NO: 2372800 - RNA, 18 nt, Bordetella pertussis
gcgccggaacauggcggu

SEQ ID NO: 2372801 - RNA, 17 nt, Bordetella pertussis
gcgccggacaucagcca

SEQ ID NO: 2372802 - RNA, 17 nt, Bordetella pertussis
gcgccggacguagucgc

SEQ ID NO: 2372803 - RNA, 13 nt, Bordetella pertussis
gcgccggacuggg

SEQ ID NO: 2372804 - RNA, 13 nt, Bordetella pertussis
gcgccggaucgca

SEQ ID NO: 2372805 - RNA, 15 nt, Bordetella pertussis
gcgccggaucggccg

SEQ ID NO: 2372806 - RNA, 17 nt, Bordetella pertussis
gcgccggaucggccggc

SEQ ID NO: 2372807 - RNA, 14 nt, Bordetella pertussis
gcgccggaugcgcg

SEQ ID NO: 2372808 - RNA, 18 nt, Bordetella pertussis
gcgccggcacgcugaucg

SEQ ID NO: 2372809 - RNA, 13 nt, Bordetella pertussis
gcgccggcagccc

SEQ ID NO: 2372810 - RNA, 16 nt, Bordetella pertussis
gcgccggcagccccag

SEQ ID NO: 2372811 - RNA, 13 nt, Bordetella pertussis
gcgccggcagggc

SEQ ID NO: 2372812 - RNA, 14 nt, Bordetella pertussis
gcgccggcagggcg

SEQ ID NO: 2372813 - RNA, 22 nt, Bordetella pertussis
gcgccggcagggcggccaggcc

SEQ ID NO: 2372814 - RNA, 23 nt, Bordetella pertussis
gcgccggcagggcggccaggccg

SEQ ID NO: 2372815 - RNA, 13 nt, Bordetella pertussis
gcgccggcagggu

SEQ ID NO: 2372816 - RNA, 15 nt, Bordetella pertussis
gcgccggcagggugc

SEQ ID NO: 2372817 - RNA, 18 nt, Bordetella pertussis
gcgccggcagggugcugu

SEQ ID NO: 2372818 - RNA, 17 nt, Bordetella pertussis
gcgccggcaucggcggc

SEQ ID NO: 2372819 - RNA, 20 nt, Bordetella pertussis
gcgccggcaucggcggcuug

SEQ ID NO: 2372820 - RNA, 20 nt, Bordetella pertussis
gcgccggcaugaagcgcagc

SEQ ID NO: 2372821 - RNA, 13 nt, Bordetella pertussis
gcgccggcauggc

SEQ ID NO: 2372822 - RNA, 15 nt, Bordetella pertussis
gcgccggcauggcca

SEQ ID NO: 2372823 - RNA, 22 nt, Bordetella pertussis
gcgccggcauggccaaugccau

SEQ ID NO: 2372824 - RNA, 13 nt, Bordetella pertussis
gcgccggcauggu

SEQ ID NO: 2372825 - RNA, 21 nt, Bordetella pertussis
gcgccggcauuucgcugggcg

SEQ ID NO: 2372826 - RNA, 22 nt, Bordetella pertussis
gcgccggcauuucgcugggcgc

SEQ ID NO: 2372827 - RNA, 12 nt, Bordetella pertussis
gcgccggccacc

SEQ ID NO: 2372828 - RNA, 16 nt, Bordetella pertussis
gcgccggccaccgccu

SEQ ID NO: 2372829 - RNA, 17 nt, Bordetella pertussis
gcgccggccaccgccug

SEQ ID NO: 2372830 - RNA, 18 nt, Bordetella pertussis
gcgccggccaccgccugu

SEQ ID NO: 2372831 - RNA, 13 nt, Bordetella pertussis
gcgccggccagcg

SEQ ID NO: 2372832 - RNA, 16 nt, Bordetella pertussis
gcgccggccagcgcgc

SEQ ID NO: 2372833 - RNA, 19 nt, Bordetella pertussis
gcgccggccagcgcgccgg

SEQ ID NO: 2372834 - RNA, 20 nt, Bordetella pertussis
gcgccggccagcgcgccggc

SEQ ID NO: 2372835 - RNA, 16 nt, Bordetella pertussis
gcgccggccagcggca

SEQ ID NO: 2372836 - RNA, 22 nt, Bordetella pertussis
gcgccggccagcggcaggacgg

SEQ ID NO: 2372837 - RNA, 12 nt, Bordetella pertussis
gcgccggccagg

SEQ ID NO: 2372838 - RNA, 13 nt, Bordetella pertussis
gcgccggccaggc

SEQ ID NO: 2372839 - RNA, 14 nt, Bordetella pertussis
gcgccggccaggcc

SEQ ID NO: 2372840 - RNA, 19 nt, Bordetella pertussis
gcgccggccagggccacca

SEQ ID NO: 2372841 - RNA, 15 nt, Bordetella pertussis
gcgccggcccaaggc

SEQ ID NO: 2372842 - RNA, 17 nt, Bordetella pertussis
gcgccggcccaggcgcg

SEQ ID NO: 2372843 - RNA, 18 nt, Bordetella pertussis
gcgccggcccaggcgcgc

SEQ ID NO: 2372844 - RNA, 12 nt, Bordetella pertussis
gcgccggcccgc

SEQ ID NO: 2372845 - RNA, 13 nt, Bordetella pertussis
gcgccggcccgcc

SEQ ID NO: 2372846 - RNA, 14 nt, Bordetella pertussis
gcgccggcccgccu

SEQ ID NO: 2372847 - RNA, 13 nt, Bordetella pertussis
gcgccggcccggc

SEQ ID NO: 2372848 - RNA, 18 nt, Bordetella pertussis
gcgccggccgacaggugg

SEQ ID NO: 2372849 - RNA, 12 nt, Bordetella pertussis
gcgccggccgcc

SEQ ID NO: 2372850 - RNA, 13 nt, Bordetella pertussis
gcgccggccgcca

SEQ ID NO: 2372851 - RNA, 16 nt, Bordetella pertussis
gcgccggccgccagca

SEQ ID NO: 2372852 - RNA, 21 nt, Bordetella pertussis
gcgccggccgccagcaaggcg

SEQ ID NO: 2372853 - RNA, 13 nt, Bordetella pertussis
gcgccggccgccc

SEQ ID NO: 2372854 - RNA, 16 nt, Bordetella pertussis
gcgccggccgcccgcc

SEQ ID NO: 2372855 - RNA, 17 nt, Bordetella pertussis
gcgccggccgcccgccu

SEQ ID NO: 2372856 - RNA, 14 nt, Bordetella pertussis
gcgccggccgcgcg

SEQ ID NO: 2372857 - RNA, 15 nt, Bordetella pertussis
gcgccggccgcgcgc

SEQ ID NO: 2372858 - RNA, 19 nt, Bordetella pertussis
gcgccggccgcgcgcgcca

SEQ ID NO: 2372859 - RNA, 16 nt, Bordetella pertussis
gcgccggccgcggggc

SEQ ID NO: 2372860 - RNA, 20 nt, Bordetella pertussis
gcgccggccgcggggcuggc

SEQ ID NO: 2372861 - RNA, 18 nt, Bordetella pertussis
gcgccggccuccagcauc

SEQ ID NO: 2372862 - RNA, 22 nt, Bordetella pertussis
gcgccggccuccagcaucgccg

SEQ ID NO: 2372863 - RNA, 18 nt, Bordetella pertussis
gcgccggccugcgccggg

SEQ ID NO: 2372864 - RNA, 20 nt, Bordetella pertussis
gcgccggccugcgccgggcg

SEQ ID NO: 2372865 - RNA, 13 nt, Bordetella pertussis
gcgccggccuggc

SEQ ID NO: 2372866 - RNA, 18 nt, Bordetella pertussis
gcgccggccuggcgcgac

SEQ ID NO: 2372867 - RNA, 13 nt, Bordetella pertussis
gcgccggcgcccg

SEQ ID NO: 2372868 - RNA, 14 nt, Bordetella pertussis
gcgccggcgcccgg

SEQ ID NO: 2372869 - RNA, 14 nt, Bordetella pertussis
gcgccggcgccggc

SEQ ID NO: 2372870 - RNA, 15 nt, Bordetella pertussis
gcgccggcgccggcg

SEQ ID NO: 2372871 - RNA, 18 nt, Bordetella pertussis
gcgccggcgccggcgcgc

SEQ ID NO: 2372872 - RNA, 18 nt, Bordetella pertussis
gcgccggcgccgggcagc

SEQ ID NO: 2372873 - RNA, 15 nt, Bordetella pertussis
gcgccggcgcgccgc

SEQ ID NO: 2372874 - RNA, 18 nt, Bordetella pertussis
gcgccggcgcgccgcccg

SEQ ID NO: 2372875 - RNA, 21 nt, Bordetella pertussis
gcgccggcgcgccgcccgcuu

SEQ ID NO: 2372876 - RNA, 14 nt, Bordetella pertussis
gcgccggcgcgcga

SEQ ID NO: 2372877 - RNA, 20 nt, Bordetella pertussis
gcgccggcgcgcgcugauuc

SEQ ID NO: 2372878 - RNA, 13 nt, Bordetella pertussis
gcgccggcgcucg

SEQ ID NO: 2372879 - RNA, 13 nt, Bordetella pertussis
gcgccggcggcac

SEQ ID NO: 2372880 - RNA, 13 nt, Bordetella pertussis
gcgccggcggccu

SEQ ID NO: 2372881 - RNA, 14 nt, Bordetella pertussis
gcgccggcggccuc

SEQ ID NO: 2372882 - RNA, 15 nt, Bordetella pertussis
gcgccggcggccugc

SEQ ID NO: 2372883 - RNA, 18 nt, Bordetella pertussis
gcgccggcggccugcagg

SEQ ID NO: 2372884 - RNA, 21 nt, Bordetella pertussis
gcgccggcggccugcaggccg

SEQ ID NO: 2372885 - RNA, 12 nt, Bordetella pertussis
gcgccggcggcg

SEQ ID NO: 2372886 - RNA, 15 nt, Bordetella pertussis
gcgccggcggcgaug

SEQ ID NO: 2372887 - RNA, 16 nt, Bordetella pertussis
gcgccggcgggcgcug

SEQ ID NO: 2372888 - RNA, 20 nt, Bordetella pertussis
gcgccggcgucacgcggccg

SEQ ID NO: 2372889 - RNA, 14 nt, Bordetella pertussis
gcgccggcguccac

SEQ ID NO: 2372890 - RNA, 15 nt, Bordetella pertussis
gcgccggcguccacg

SEQ ID NO: 2372891 - RNA, 17 nt, Bordetella pertussis
gcgccggcguccacggc

SEQ ID NO: 2372892 - RNA, 20 nt, Bordetella pertussis
gcgccggcguccacggcauc

SEQ ID NO: 2372893 - RNA, 15 nt, Bordetella pertussis
gcgccggcucagccc

SEQ ID NO: 2372894 - RNA, 16 nt, Bordetella pertussis
gcgccggcucagcccc

SEQ ID NO: 2372895 - RNA, 18 nt, Bordetella pertussis
gcgccggcucccgcgcug

SEQ ID NO: 2372896 - RNA, 20 nt, Bordetella pertussis
gcgccggcucccgcgcugcc

SEQ ID NO: 2372897 - RNA, 20 nt, Bordetella pertussis
gcgccggcuccgauagcggc

SEQ ID NO: 2372898 - RNA, 19 nt, Bordetella pertussis
gcgccggcuggcaugcggc

SEQ ID NO: 2372899 - RNA, 17 nt, Bordetella pertussis
gcgccgugcagacggcg

SEQ ID NO: 2372900 - RNA, 19 nt, Bordetella pertussis
gcgccgugcagacggcggc

SEQ ID NO: 2372901 - RNA, 21 nt, Bordetella pertussis
gcgccgugcagacggcggcug

SEQ ID NO: 2372902 - RNA, 23 nt, Bordetella pertussis
gcgccgugcagacggcggcugga

SEQ ID NO: 2372903 - RNA, 14 nt, Bordetella pertussis
gcgccgugcccgac

SEQ ID NO: 2372904 - RNA, 16 nt, Bordetella pertussis
gcgccgugcccgacgg

SEQ ID NO: 2372905 - RNA, 22 nt, Bordetella pertussis
gcgccgugcccgacggacuggc

SEQ ID NO: 2372906 - RNA, 14 nt, Bordetella pertussis
gcgccgugcccggc

SEQ ID NO: 2372907 - RNA, 17 nt, Bordetella pertussis
gcgccgugcccggcggg

SEQ ID NO: 2372908 - RNA, 18 nt, Bordetella pertussis
gcgccgugcccggcgggc

SEQ ID NO: 2372909 - RNA, 14 nt, Bordetella pertussis
gcgccgugcuggag

SEQ ID NO: 2372910 - RNA, 17 nt, Bordetella pertussis
gcgccgugcuggaggug

SEQ ID NO: 2372911 - RNA, 19 nt, Bordetella pertussis
gcgccgugcuggaggugcc

SEQ ID NO: 2372912 - RNA, 17 nt, Bordetella pertussis
gcgccguucagggacgg

SEQ ID NO: 2372913 - RNA, 22 nt, Bordetella pertussis
gcgccguucaugcgucgaacgg

SEQ ID NO: 2372914 - RNA, 16 nt, Bordetella pertussis
gcgccguuccugcagc

SEQ ID NO: 2372915 - RNA, 19 nt, Bordetella pertussis
gcgccguuccugcagcgug

SEQ ID NO: 2372916 - RNA, 21 nt, Bordetella pertussis
gcgccguuccugcagcgugcu

SEQ ID NO: 2372917 - RNA, 19 nt, Bordetella pertussis
gcgccguucgucgcgcagc

SEQ ID NO: 2372918 - RNA, 20 nt, Bordetella pertussis
gcgccguucgucgcgcagca

SEQ ID NO: 2372919 - RNA, 16 nt, Bordetella pertussis
gcgccguucucaggcc

SEQ ID NO: 2372920 - RNA, 19 nt, Bordetella pertussis
gcgccguucucaggccgag

SEQ ID NO: 2372921 - RNA, 21 nt, Bordetella pertussis
gcgccguucucaggccgaggc

SEQ ID NO: 2372922 - RNA, 16 nt, Bordetella pertussis
gcgccguugcgggcug

SEQ ID NO: 2372923 - RNA, 19 nt, Bordetella pertussis
gcgccguuuucagcgcagg

SEQ ID NO: 2372924 - RNA, 20 nt, Bordetella pertussis
gcgccguuuucagcgcaggc

SEQ ID NO: 2372925 - RNA, 19 nt, Bordetella pertussis
gcgccuacacgguggcggu

SEQ ID NO: 2372926 - RNA, 20 nt, Bordetella pertussis
gcgccuacagcagcggcucg

SEQ ID NO: 2372927 - RNA, 13 nt, Bordetella pertussis
gcgccuaccggcg

SEQ ID NO: 2372928 - RNA, 14 nt, Bordetella pertussis
gcgccuaccggcgc

SEQ ID NO: 2372929 - RNA, 22 nt, Bordetella pertussis
gcgccuaccggcgccgacgcgc

SEQ ID NO: 2372930 - RNA, 14 nt, Bordetella pertussis
gcgccuacggcggc

SEQ ID NO: 2372931 - RNA, 17 nt, Bordetella pertussis
gcgccuacggcggcggc

SEQ ID NO: 2372932 - RNA, 19 nt, Bordetella pertussis
gcgccuacggcggcggcca

SEQ ID NO: 2372933 - RNA, 17 nt, Bordetella pertussis
gcgccuaucaggccucg

SEQ ID NO: 2372934 - RNA, 20 nt, Bordetella pertussis
gcgccuaucaggccucgaag

SEQ ID NO: 2372935 - RNA, 18 nt, Bordetella pertussis
gcgccuauugcgacgccg

SEQ ID NO: 2372936 - RNA, 22 nt, Bordetella pertussis
gcgccuauugcgacgccgccga

SEQ ID NO: 2372937 - RNA, 22 nt, Bordetella pertussis
gcgccucaucguucugcgucaa

SEQ ID NO: 2372938 - RNA, 12 nt, Bordetella pertussis
gcgccuccagcu

SEQ ID NO: 2372939 - RNA, 14 nt, Bordetella pertussis
gcgccuccagcucc

SEQ ID NO: 2372940 - RNA, 22 nt, Bordetella pertussis
gcgccuccagcuccagcgcgcc

SEQ ID NO: 2372941 - RNA, 18 nt, Bordetella pertussis
gcgccuccaucagcagca

SEQ ID NO: 2372942 - RNA, 18 nt, Bordetella pertussis
gcgccucgaacguccgcc

SEQ ID NO: 2372943 - RNA, 18 nt, Bordetella pertussis
gcgccucgaugauggcgu

SEQ ID NO: 2372944 - RNA, 17 nt, Bordetella pertussis
gcgccucgcaucggccu

SEQ ID NO: 2372945 - RNA, 18 nt, Bordetella pertussis
gcgccucgcaucggccug

SEQ ID NO: 2372946 - RNA, 19 nt, Bordetella pertussis
gcgccucgcaucggccugc

SEQ ID NO: 2372947 - RNA, 13 nt, Bordetella pertussis
gcgccucgcgacg

SEQ ID NO: 2372948 - RNA, 18 nt, Bordetella pertussis
gcgccucgcgacggccuc

SEQ ID NO: 2372949 - RNA, 22 nt, Bordetella pertussis
gcgccucgcgacggccucccgc

SEQ ID NO: 2372950 - RNA, 16 nt, Bordetella pertussis
gcgccucgcgcuccau

SEQ ID NO: 2372951 - RNA, 20 nt, Bordetella pertussis
gcgccucgcgcuccaugggc

SEQ ID NO: 2372952 - RNA, 19 nt, Bordetella pertussis
gcgccucgcgcucgagcgc

SEQ ID NO: 2372953 - RNA, 14 nt, Bordetella pertussis
gcgccucggacgcc

SEQ ID NO: 2372954 - RNA, 18 nt, Bordetella pertussis
gcgccucggacgccuggc

SEQ ID NO: 2372955 - RNA, 20 nt, Bordetella pertussis
gcgccucggacgccuggcgc

SEQ ID NO: 2372956 - RNA, 18 nt, Bordetella pertussis
gcgccucggcgcgcgcgg

SEQ ID NO: 2372957 - RNA, 21 nt, Bordetella pertussis
gcgccucguccugcaggcggc

SEQ ID NO: 2372958 - RNA, 22 nt, Bordetella pertussis
gcgccucguccugcaggcggcg

SEQ ID NO: 2372959 - RNA, 23 nt, Bordetella pertussis
gcgccucguccugcaggcggcgc

SEQ ID NO: 2372960 - RNA, 16 nt, Bordetella pertussis
gcgccucgucgcgcaa

SEQ ID NO: 2372961 - RNA, 18 nt, Bordetella pertussis
gcgccucgugcgaggcca

SEQ ID NO: 2372962 - RNA, 19 nt, Bordetella pertussis
gcgccugagcugccaggcu

SEQ ID NO: 2372963 - RNA, 18 nt, Bordetella pertussis
gcgccugcaagauggcgu

SEQ ID NO: 2372964 - RNA, 19 nt, Bordetella pertussis
gcgccugcaagauggcguc

SEQ ID NO: 2372965 - RNA, 22 nt, Bordetella pertussis
gcgccugcaaguccagcguggu

SEQ ID NO: 2372966 - RNA, 16 nt, Bordetella pertussis
gcgccugcagcacggc

SEQ ID NO: 2372967 - RNA, 21 nt, Bordetella pertussis
gcgccugcagcacggccacgg

SEQ ID NO: 2372968 - RNA, 15 nt, Bordetella pertussis
gcgccugcagcagcg

SEQ ID NO: 2372969 - RNA, 17 nt, Bordetella pertussis
gcgccugcagcagcggc

SEQ ID NO: 2372970 - RNA, 18 nt, Bordetella pertussis
gcgccugcagcagcggca

SEQ ID NO: 2372971 - RNA, 16 nt, Bordetella pertussis
gcgccugcagcagcgu

SEQ ID NO: 2372972 - RNA, 23 nt, Bordetella pertussis
gcgccugcagcagcguggccgcc

SEQ ID NO: 2372973 - RNA, 13 nt, Bordetella pertussis
gcgccugcagcgc

SEQ ID NO: 2372974 - RNA, 17 nt, Bordetella pertussis
gcgccugcagcgccgcc

SEQ ID NO: 2372975 - RNA, 17 nt, Bordetella pertussis
gcgccugcaggcggucg

SEQ ID NO: 2372976 - RNA, 18 nt, Bordetella pertussis
gcgccugcauccggccca

SEQ ID NO: 2372977 - RNA, 19 nt, Bordetella pertussis
gcgccugcauccggcccag

SEQ ID NO: 2372978 - RNA, 20 nt, Bordetella pertussis
gcgccugcauccggcccagc

SEQ ID NO: 2372979 - RNA, 21 nt, Bordetella pertussis
gcgccugcauccggcccagcg

SEQ ID NO: 2372980 - RNA, 22 nt, Bordetella pertussis
gcgccugcauccggcccagcgc

SEQ ID NO: 2372981 - RNA, 18 nt, Bordetella pertussis
gcgccugcauguccagcg

SEQ ID NO: 2372982 - RNA, 21 nt, Bordetella pertussis
gcgccugcauguccagcggcg

SEQ ID NO: 2372983 - RNA, 14 nt, Bordetella pertussis
gcgccugcccaggc

SEQ ID NO: 2372984 - RNA, 13 nt, Bordetella pertussis
gcgccugccccgc

SEQ ID NO: 2372985 - RNA, 16 nt, Bordetella pertussis
gcgccugccccgccgg

SEQ ID NO: 2372986 - RNA, 18 nt, Bordetella pertussis
gcgccugccccgccggga

SEQ ID NO: 2372987 - RNA, 20 nt, Bordetella pertussis
gcgccugccccgccgggaca

SEQ ID NO: 2372988 - RNA, 19 nt, Bordetella pertussis
gcgccugccccgccugcgc

SEQ ID NO: 2372989 - RNA, 17 nt, Bordetella pertussis
gcgccugccccggcaga

SEQ ID NO: 2372990 - RNA, 13 nt, Bordetella pertussis
gcgccugcccgca

SEQ ID NO: 2372991 - RNA, 22 nt, Bordetella pertussis
gcgccugcccgcaacgccgccc

SEQ ID NO: 2372992 - RNA, 23 nt, Bordetella pertussis
gcgccugcccgcaacgccgcccg

SEQ ID NO: 2372993 - RNA, 18 nt, Bordetella pertussis
gcgccugccgaucgugca

SEQ ID NO: 2372994 - RNA, 22 nt, Bordetella pertussis
gcgccugcgagagauagcccag

SEQ ID NO: 2372995 - RNA, 13 nt, Bordetella pertussis
gcgccugcgccac

SEQ ID NO: 2372996 - RNA, 14 nt, Bordetella pertussis
gcgccugcgccaug

SEQ ID NO: 2372997 - RNA, 17 nt, Bordetella pertussis
gcgccugcgcgccgccu

SEQ ID NO: 2372998 - RNA, 23 nt, Bordetella pertussis
gcgccugcgcgcgcuggggcagc

SEQ ID NO: 2372999 - RNA, 15 nt, Bordetella pertussis
gcgccugcgcgcggu

SEQ ID NO: 2373000 - RNA, 13 nt, Bordetella pertussis
gcgccugcgcggc

SEQ ID NO: 2373001 - RNA, 15 nt, Bordetella pertussis
gcgccugcgcggccu

SEQ ID NO: 2373002 - RNA, 17 nt, Bordetella pertussis
gcgccugcgcggccucg

SEQ ID NO: 2373003 - RNA, 14 nt, Bordetella pertussis
gcgccugcgcggcg

SEQ ID NO: 2373004 - RNA, 19 nt, Bordetella pertussis
gcgccugcggcaggccgca

SEQ ID NO: 2373005 - RNA, 21 nt, Bordetella pertussis
gcgccugcguugcgaucagcg

SEQ ID NO: 2373006 - RNA, 18 nt, Bordetella pertussis
gcgccugcucacgccccg

SEQ ID NO: 2373007 - RNA, 20 nt, Bordetella pertussis
gcgccugcucacgccccgcc

SEQ ID NO: 2373008 - RNA, 23 nt, Bordetella pertussis
gcgccugcucgaccugcucgggc

SEQ ID NO: 2373009 - RNA, 16 nt, Bordetella pertussis
gcgccugcuggucggc

SEQ ID NO: 2373010 - RNA, 17 nt, Bordetella pertussis
gcgccugcuggucggcc

SEQ ID NO: 2373011 - RNA, 20 nt, Bordetella pertussis
gcgccugcuggucggccucg

SEQ ID NO: 2373012 - RNA, 14 nt, Bordetella pertussis
gcgccuggccgccc

SEQ ID NO: 2373013 - RNA, 22 nt, Bordetella pertussis
gcgccuggccgcccagcgccug

SEQ ID NO: 2373014 - RNA, 12 nt, Bordetella pertussis
gcgccuggcgcg

SEQ ID NO: 2373015 - RNA, 13 nt, Bordetella pertussis
gcgccuggcgcgc

SEQ ID NO: 2373016 - RNA, 13 nt, Bordetella pertussis
gcgccuggcggac

SEQ ID NO: 2373017 - RNA, 14 nt, Bordetella pertussis
gcgccuggcggacg

SEQ ID NO: 2373018 - RNA, 21 nt, Bordetella pertussis
gcgccuggcggacgauggccu

SEQ ID NO: 2373019 - RNA, 16 nt, Bordetella pertussis
gcgccuggcggcuggu

SEQ ID NO: 2373020 - RNA, 15 nt, Bordetella pertussis
gcgccuggcggcugu

SEQ ID NO: 2373021 - RNA, 17 nt, Bordetella pertussis
gcgccuggcgggccugg

SEQ ID NO: 2373022 - RNA, 19 nt, Bordetella pertussis
gcgccuggcgggccugggc

SEQ ID NO: 2373023 - RNA, 23 nt, Bordetella pertussis
gcgccuggcgggccugggcgucg

SEQ ID NO: 2373024 - RNA, 21 nt, Bordetella pertussis
gcgccuggcuucccgguccag

SEQ ID NO: 2373025 - RNA, 14 nt, Bordetella pertussis
gcgccugggcggcc

SEQ ID NO: 2373026 - RNA, 15 nt, Bordetella pertussis
gcgccugggcggcca

SEQ ID NO: 2373027 - RNA, 18 nt, Bordetella pertussis
gcgccugggcggccacgu

SEQ ID NO: 2373028 - RNA, 18 nt, Bordetella pertussis
gcgccugggcggcgcagu

SEQ ID NO: 2373029 - RNA, 22 nt, Bordetella pertussis
gcgccuggggcgggcgggcgca

SEQ ID NO: 2373030 - RNA, 16 nt, Bordetella pertussis
gcgccugggggcugga

SEQ ID NO: 2373031 - RNA, 17 nt, Bordetella pertussis
gcgccugggggucgguc

SEQ ID NO: 2373032 - RNA, 19 nt, Bordetella pertussis
gcgccugggggucggucug

SEQ ID NO: 2373033 - RNA, 22 nt, Bordetella pertussis
gcgccugggguaggcgcggucc

SEQ ID NO: 2373034 - RNA, 16 nt, Bordetella pertussis
gcgccuggucgcgcgc

SEQ ID NO: 2373035 - RNA, 19 nt, Bordetella pertussis
gcgccugucccaggcgcuc

SEQ ID NO: 2373036 - RNA, 21 nt, Bordetella pertussis
gcgccugucccaggcgcucgc

SEQ ID NO: 2373037 - RNA, 17 nt, Bordetella pertussis
gcgccuguccccgcagg

SEQ ID NO: 2373038 - RNA, 18 nt, Bordetella pertussis
gcgccuguccccgcagga

SEQ ID NO: 2373039 - RNA, 22 nt, Bordetella pertussis
gcgccuguccccgcaugggggc

SEQ ID NO: 2373040 - RNA, 19 nt, Bordetella pertussis
gcgccuguccccgcugcgg

SEQ ID NO: 2373041 - RNA, 15 nt, Bordetella pertussis
gcgccuuccggcagc

SEQ ID NO: 2373042 - RNA, 18 nt, Bordetella pertussis
gcgccuuccggcagcggc

SEQ ID NO: 2373043 - RNA, 20 nt, Bordetella pertussis
gcgccuuccggcagcggcca

SEQ ID NO: 2373044 - RNA, 23 nt, Bordetella pertussis
gcgccuuccggcagcggccagcg

SEQ ID NO: 2373045 - RNA, 19 nt, Bordetella pertussis
gcgccuuccugggcgccgg

SEQ ID NO: 2373046 - RNA, 20 nt, Bordetella pertussis
gcgccuuccugggcgccggc

SEQ ID NO: 2373047 - RNA, 14 nt, Bordetella pertussis
gcgccuucggcgcg

SEQ ID NO: 2373048 - RNA, 19 nt, Bordetella pertussis
gcgccuucggcgcgcacgc

SEQ ID NO: 2373049 - RNA, 15 nt, Bordetella pertussis
gcgccuucggcgcgg

SEQ ID NO: 2373050 - RNA, 16 nt, Bordetella pertussis
gcgccuucggcgcggc

SEQ ID NO: 2373051 - RNA, 20 nt, Bordetella pertussis
gcgccuucggcgcggcgggc

SEQ ID NO: 2373052 - RNA, 16 nt, Bordetella pertussis
gcgccuucuacccgcu

SEQ ID NO: 2373053 - RNA, 18 nt, Bordetella pertussis
gcgccuugacgcugcucu

SEQ ID NO: 2373054 - RNA, 13 nt, Bordetella pertussis
gcgccuugccgcc

SEQ ID NO: 2373055 - RNA, 14 nt, Bordetella pertussis
gcgccuugccgccg

SEQ ID NO: 2373056 - RNA, 15 nt, Bordetella pertussis
gcgccuugccgccgc

SEQ ID NO: 2373057 - RNA, 17 nt, Bordetella pertussis
gcgccuugccgccgcgc

SEQ ID NO: 2373058 - RNA, 18 nt, Bordetella pertussis
gcgccuugccgccgcgca

SEQ ID NO: 2373059 - RNA, 15 nt, Bordetella pertussis
gcgccuugccgccgu

SEQ ID NO: 2373060 - RNA, 14 nt, Bordetella pertussis
gcgccuugcgcggc

SEQ ID NO: 2373061 - RNA, 20 nt, Bordetella pertussis
gcgccuugcgcggcgagcgc

SEQ ID NO: 2373062 - RNA, 23 nt, Bordetella pertussis
gcgccuugcggcgaugcacccag

SEQ ID NO: 2373063 - RNA, 14 nt, Bordetella pertussis
gcgccuugcggcgc

SEQ ID NO: 2373064 - RNA, 15 nt, Bordetella pertussis
gcgccuugcggcgcu

SEQ ID NO: 2373065 - RNA, 19 nt, Bordetella pertussis
gcgccuuggccugggcgcg

SEQ ID NO: 2373066 - RNA, 23 nt, Bordetella pertussis
gcgccuuggccugggcgcggucc

SEQ ID NO: 2373067 - RNA, 14 nt, Bordetella pertussis
gcgccuuggcgcgc

SEQ ID NO: 2373068 - RNA, 15 nt, Bordetella pertussis
gcgccuuggcgcgca

SEQ ID NO: 2373069 - RNA, 15 nt, Bordetella pertussis
gcgccuuucccgcgc

SEQ ID NO: 2373070 - RNA, 20 nt, Bordetella pertussis
gcgccuuucccgcgccgagc

SEQ ID NO: 2373071 - RNA, 21 nt, Bordetella pertussis
gcgccuuucccgcgccgagcg

SEQ ID NO: 2373072 - RNA, 17 nt, Bordetella pertussis
gcgcgaaaacccgcggc

SEQ ID NO: 2373073 - RNA, 15 nt, Bordetella pertussis
gcgcgaaacccccug

SEQ ID NO: 2373074 - RNA, 15 nt, Bordetella pertussis
gcgcgaaacggccgg

SEQ ID NO: 2373075 - RNA, 16 nt, Bordetella pertussis
gcgcgaaacggccggg

SEQ ID NO: 2373076 - RNA, 14 nt, Bordetella pertussis
gcgcgaaauccagc

SEQ ID NO: 2373077 - RNA, 15 nt, Bordetella pertussis
gcgcgaaauccagcg

SEQ ID NO: 2373078 - RNA, 16 nt, Bordetella pertussis
gcgcgaaauccagcgc

SEQ ID NO: 2373079 - RNA, 17 nt, Bordetella pertussis
gcgcgaaauccagcgcg

SEQ ID NO: 2373080 - RNA, 15 nt, Bordetella pertussis
gcgcgaaaugcccag

SEQ ID NO: 2373081 - RNA, 17 nt, Bordetella pertussis
gcgcgaaaugcccagcg

SEQ ID NO: 2373082 - RNA, 19 nt, Bordetella pertussis
gcgcgaaaugcccagcgag

SEQ ID NO: 2373083 - RNA, 20 nt, Bordetella pertussis
gcgcgaaaugcccagcgagc

SEQ ID NO: 2373084 - RNA, 14 nt, Bordetella pertussis
gcgcgaacaccggc

SEQ ID NO: 2373085 - RNA, 17 nt, Bordetella pertussis
gcgcgaacaccggcagg

SEQ ID NO: 2373086 - RNA, 18 nt, Bordetella pertussis
gcgcgaacaccggcaggc

SEQ ID NO: 2373087 - RNA, 20 nt, Bordetella pertussis
gcgcgaacaccggcaggccg

SEQ ID NO: 2373088 - RNA, 21 nt, Bordetella pertussis
gcgcgaacaccggcaggccgc

SEQ ID NO: 2373089 - RNA, 22 nt, Bordetella pertussis
gcgcgaacaccggcaggccgcg

SEQ ID NO: 2373090 - RNA, 16 nt, Bordetella pertussis
gcgcgaaccccuccgg

SEQ ID NO: 2373091 - RNA, 15 nt, Bordetella pertussis
gcgcgaacgccugcc

SEQ ID NO: 2373092 - RNA, 19 nt, Bordetella pertussis
gcgcgaacgcgcgccggcc

SEQ ID NO: 2373093 - RNA, 23 nt, Bordetella pertussis
gcgcgaacgcgcgccggccagcg

SEQ ID NO: 2373094 - RNA, 14 nt, Bordetella pertussis
gcgcgaacgcggcc

SEQ ID NO: 2373095 - RNA, 15 nt, Bordetella pertussis
gcgcgaacgcggcca

SEQ ID NO: 2373096 - RNA, 19 nt, Bordetella pertussis
gcgcgaacgcggccaugcg

SEQ ID NO: 2373097 - RNA, 15 nt, Bordetella pertussis
gcgcgaacggcgggc

SEQ ID NO: 2373098 - RNA, 23 nt, Bordetella pertussis
gcgcgaacggcuugauggcgaug

SEQ ID NO: 2373099 - RNA, 18 nt, Bordetella pertussis
gcgcgaagcgcccuggcg

SEQ ID NO: 2373100 - RNA, 13 nt, Bordetella pertussis
gcgcgaagcgcug

SEQ ID NO: 2373101 - RNA, 14 nt, Bordetella pertussis
gcgcgaagcgcugg

SEQ ID NO: 2373102 - RNA, 15 nt, Bordetella pertussis
gcgcgaagcgcuggg

SEQ ID NO: 2373103 - RNA, 14 nt, Bordetella pertussis
gcgcgaaggccgcc

SEQ ID NO: 2373104 - RNA, 16 nt, Bordetella pertussis
gcgcgaaggccgcccc

SEQ ID NO: 2373105 - RNA, 16 nt, Bordetella pertussis
gcgcgaaguaccagcg

SEQ ID NO: 2373106 - RNA, 16 nt, Bordetella pertussis
gcgcgacaaccgcggc

SEQ ID NO: 2373107 - RNA, 13 nt, Bordetella pertussis
gcgcgacagcagg

SEQ ID NO: 2373108 - RNA, 14 nt, Bordetella pertussis
gcgcgacagcaggc

SEQ ID NO: 2373109 - RNA, 13 nt, Bordetella pertussis
gcgcgacagccgc

SEQ ID NO: 2373110 - RNA, 14 nt, Bordetella pertussis
gcgcgacagccgcg

SEQ ID NO: 2373111 - RNA, 19 nt, Bordetella pertussis
gcgcgacagccgcgccagc

SEQ ID NO: 2373112 - RNA, 20 nt, Bordetella pertussis
gcgcgacagccgcgccagcg

SEQ ID NO: 2373113 - RNA, 18 nt, Bordetella pertussis
gcgcgacaggcccgcggc

SEQ ID NO: 2373114 - RNA, 15 nt, Bordetella pertussis
gcgcgacaggcggug

SEQ ID NO: 2373115 - RNA, 21 nt, Bordetella pertussis
gcgcgacaggcggugcgcgcg

SEQ ID NO: 2373116 - RNA, 24 nt, Bordetella pertussis
gcgcgacaggcggugcgcgcggcc

SEQ ID NO: 2373117 - RNA, 16 nt, Bordetella pertussis
gcgcgaccacuggcag

SEQ ID NO: 2373118 - RNA, 17 nt, Bordetella pertussis
gcgcgaccacuggcaga

SEQ ID NO: 2373119 - RNA, 19 nt, Bordetella pertussis
gcgcgaccgccuccagcgc

SEQ ID NO: 2373120 - RNA, 20 nt, Bordetella pertussis
gcgcgaccgccuccagcgcg

SEQ ID NO: 2373121 - RNA, 23 nt, Bordetella pertussis
gcgcgaccgccuccagcgcggcg

SEQ ID NO: 2373122 - RNA, 16 nt, Bordetella pertussis
gcgcgaccgcgcggcg

SEQ ID NO: 2373123 - RNA, 18 nt, Bordetella pertussis
gcgcgaccgcgcggcgcu

SEQ ID NO: 2373124 - RNA, 12 nt, Bordetella pertussis
gcgcgcaccggc

SEQ ID NO: 2373125 - RNA, 14 nt, Bordetella pertussis
gcgcgcaccggcuu

SEQ ID NO: 2373126 - RNA, 16 nt, Bordetella pertussis
gcgcgcacgaccacca

SEQ ID NO: 2373127 - RNA, 19 nt, Bordetella pertussis
gcgcgcacgaccaccagcg

SEQ ID NO: 2373128 - RNA, 15 nt, Bordetella pertussis
gcgcgcacgcugggc

SEQ ID NO: 2373129 - RNA, 16 nt, Bordetella pertussis
gcgcgcagacgcgcuc

SEQ ID NO: 2373130 - RNA, 20 nt, Bordetella pertussis
gcgcgcagacgcgcucaggc

SEQ ID NO: 2373131 - RNA, 14 nt, Bordetella pertussis
gcgcgcagcacgcc

SEQ ID NO: 2373132 - RNA, 16 nt, Bordetella pertussis
gcgcgcagcacgccga

SEQ ID NO: 2373133 - RNA, 12 nt, Bordetella pertussis
gcgcgcagcaga

SEQ ID NO: 2373134 - RNA, 18 nt, Bordetella pertussis
gcgcgcagcagcgcaacg

SEQ ID NO: 2373135 - RNA, 12 nt, Bordetella pertussis
gcgcgcagcagg

SEQ ID NO: 2373136 - RNA, 22 nt, Bordetella pertussis
gcgcgcagcaggcccaugccgc

SEQ ID NO: 2373137 - RNA, 16 nt, Bordetella pertussis
gcgcgcagccgcgcca

SEQ ID NO: 2373138 - RNA, 16 nt, Bordetella pertussis
gcgcgcagcgaggccu

SEQ ID NO: 2373139 - RNA, 18 nt, Bordetella pertussis
gcgcgcagcgaggccucg

SEQ ID NO: 2373140 - RNA, 13 nt, Bordetella pertussis
gcgcgcagcgccu

SEQ ID NO: 2373141 - RNA, 14 nt, Bordetella pertussis
gcgcgcagcgccug

SEQ ID NO: 2373142 - RNA, 17 nt, Bordetella pertussis
gcgcgcagcgccugcag

SEQ ID NO: 2373143 - RNA, 15 nt, Bordetella pertussis
gcgcgcagcgcgacc

SEQ ID NO: 2373144 - RNA, 14 nt, Bordetella pertussis
gcgcgcagcgcgcc

SEQ ID NO: 2373145 - RNA, 18 nt, Bordetella pertussis
gcgcgcagcgcgccggac

SEQ ID NO: 2373146 - RNA, 13 nt, Bordetella pertussis
gcgcgcagcuccc

SEQ ID NO: 2373147 - RNA, 18 nt, Bordetella pertussis
gcgcgcaggacaaggcgc

SEQ ID NO: 2373148 - RNA, 23 nt, Bordetella pertussis
gcgcgcaggacaaggcgcgcgcc

SEQ ID NO: 2373149 - RNA, 22 nt, Bordetella pertussis
gcgcgcaggcaguuggcggcgc

SEQ ID NO: 2373150 - RNA, 12 nt, Bordetella pertussis
gcgcgcaggccu

SEQ ID NO: 2373151 - RNA, 15 nt, Bordetella pertussis
gcgcgcaggccucgc

SEQ ID NO: 2373152 - RNA, 20 nt, Bordetella pertussis
gcgcgcaggccucgcccgau

SEQ ID NO: 2373153 - RNA, 13 nt, Bordetella pertussis
gcgcgcagggcgg

SEQ ID NO: 2373154 - RNA, 16 nt, Bordetella pertussis
gcgcgcagggcggccg

SEQ ID NO: 2373155 - RNA, 17 nt, Bordetella pertussis
gcgcgcagggcggccgg

SEQ ID NO: 2373156 - RNA, 22 nt, Bordetella pertussis
gcgcgcaggucguggccgugcg

SEQ ID NO: 2373157 - RNA, 14 nt, Bordetella pertussis
gcgcgcaggugugc

SEQ ID NO: 2373158 - RNA, 20 nt, Bordetella pertussis
gcgcgcaggugugccagccg

SEQ ID NO: 2373159 - RNA, 22 nt, Bordetella pertussis
gcgcgcaguugcgucuccagcg

SEQ ID NO: 2373160 - RNA, 14 nt, Bordetella pertussis
gcgcgcaucacgcu

SEQ ID NO: 2373161 - RNA, 18 nt, Bordetella pertussis
gcgcgcaucacgcuggcc

SEQ ID NO: 2373162 - RNA, 13 nt, Bordetella pertussis
gcgcgcauccagg

SEQ ID NO: 2373163 - RNA, 18 nt, Bordetella pertussis
gcgcgcauccgguggugc

SEQ ID NO: 2373164 - RNA, 13 nt, Bordetella pertussis
gcgcgcaucgcgc

SEQ ID NO: 2373165 - RNA, 15 nt, Bordetella pertussis
gcgcgcaucgcgcgg

SEQ ID NO: 2373166 - RNA, 19 nt, Bordetella pertussis
gcgcgcaucgcgcggcaug

SEQ ID NO: 2373167 - RNA, 13 nt, Bordetella pertussis
gcgcgcaucggcc

SEQ ID NO: 2373168 - RNA, 17 nt, Bordetella pertussis
gcgcgcaucggcgccga

SEQ ID NO: 2373169 - RNA, 13 nt, Bordetella pertussis
gcgcgcaucguca

SEQ ID NO: 2373170 - RNA, 22 nt, Bordetella pertussis
gcgcgcaucgucaggcaggcgc

SEQ ID NO: 2373171 - RNA, 15 nt, Bordetella pertussis
gcgcgcaugcccgac

SEQ ID NO: 2373172 - RNA, 17 nt, Bordetella pertussis
gcgcgcaugcccgaccg

SEQ ID NO: 2373173 - RNA, 15 nt, Bordetella pertussis
gcgcgcaugcgcacg

SEQ ID NO: 2373174 - RNA, 19 nt, Bordetella pertussis
gcgcgcaugcgcacgcgcg

SEQ ID NO: 2373175 - RNA, 20 nt, Bordetella pertussis
gcgcgccaaucagauggcgc

SEQ ID NO: 2373176 - RNA, 22 nt, Bordetella pertussis
gcgcgccaaucagauggcgcag

SEQ ID NO: 2373177 - RNA, 20 nt, Bordetella pertussis
gcgcgccacauccugcacgg

SEQ ID NO: 2373178 - RNA, 21 nt, Bordetella pertussis
gcgcgccaccaccucggugcc

SEQ ID NO: 2373179 - RNA, 13 nt, Bordetella pertussis
gcgcgccacggcg

SEQ ID NO: 2373180 - RNA, 17 nt, Bordetella pertussis
gcgcgccacggcgucgc

SEQ ID NO: 2373181 - RNA, 19 nt, Bordetella pertussis
gcgcgccacggcgucgccg

SEQ ID NO: 2373182 - RNA, 23 nt, Bordetella pertussis
gcgcgccacggcgucgccggcca

SEQ ID NO: 2373183 - RNA, 23 nt, Bordetella pertussis
gcgcgccacgucgaccucgagca

SEQ ID NO: 2373184 - RNA, 16 nt, Bordetella pertussis
gcgcgccacuaugugg

SEQ ID NO: 2373185 - RNA, 13 nt, Bordetella pertussis
gcgcgccagcacg

SEQ ID NO: 2373186 - RNA, 13 nt, Bordetella pertussis
gcgcgccagcagc

SEQ ID NO: 2373187 - RNA, 16 nt, Bordetella pertussis
gcgcgccagcaugacg

SEQ ID NO: 2373188 - RNA, 16 nt, Bordetella pertussis
gcgcgccagcccgccg

SEQ ID NO: 2373189 - RNA, 12 nt, Bordetella pertussis
gcgcgccagccg

SEQ ID NO: 2373190 - RNA, 14 nt, Bordetella pertussis
gcgcgccagccgcg

SEQ ID NO: 2373191 - RNA, 17 nt, Bordetella pertussis
gcgcgccagccgcgcga

SEQ ID NO: 2373192 - RNA, 14 nt, Bordetella pertussis
gcgcgccagccgcu

SEQ ID NO: 2373193 - RNA, 20 nt, Bordetella pertussis
gcgcgccagccgcugcagcg

SEQ ID NO: 2373194 - RNA, 11 nt, Bordetella pertussis
gcgcgccagcg

SEQ ID NO: 2373195 - RNA, 14 nt, Bordetella pertussis
gcgcgccagcgccu

SEQ ID NO: 2373196 - RNA, 13 nt, Bordetella pertussis
gcgcgccagcgcg

SEQ ID NO: 2373197 - RNA, 14 nt, Bordetella pertussis
gcgcgccagcgcgc

SEQ ID NO: 2373198 - RNA, 15 nt, Bordetella pertussis
gcgcgccagcgcgcg

SEQ ID NO: 2373199 - RNA, 16 nt, Bordetella pertussis
gcgcgccagcgcgcga

SEQ ID NO: 2373200 - RNA, 15 nt, Bordetella pertussis
gcgcgccagcgcggc

SEQ ID NO: 2373201 - RNA, 17 nt, Bordetella pertussis
gcgcgccagcgcggcca

SEQ ID NO: 2373202 - RNA, 16 nt, Bordetella pertussis
gcgcgccagcgcggcg

SEQ ID NO: 2373203 - RNA, 20 nt, Bordetella pertussis
gcgcgccagcgcggcgggcc

SEQ ID NO: 2373204 - RNA, 13 nt, Bordetella pertussis
gcgcgccagcggc

SEQ ID NO: 2373205 - RNA, 16 nt, Bordetella pertussis
gcgcgccagcucgcgc

SEQ ID NO: 2373206 - RNA, 23 nt, Bordetella pertussis
gcgcgccagcucgcgcagcaggc

SEQ ID NO: 2373207 - RNA, 21 nt, Bordetella pertussis
gcgcgccagcucuucgagcgc

SEQ ID NO: 2373208 - RNA, 13 nt, Bordetella pertussis
gcgcgccagcugg

SEQ ID NO: 2373209 - RNA, 20 nt, Bordetella pertussis
gcgcgccagcugggcguugu

SEQ ID NO: 2373210 - RNA, 19 nt, Bordetella pertussis
gcgcgccaggaagcgcgcc

SEQ ID NO: 2373211 - RNA, 20 nt, Bordetella pertussis
gcgcgccaggaagcgcgccg

SEQ ID NO: 2373212 - RNA, 11 nt, Bordetella pertussis
gcgcgccaggc

SEQ ID NO: 2373213 - RNA, 12 nt, Bordetella pertussis
gcgcgccaggcc

SEQ ID NO: 2373214 - RNA, 13 nt, Bordetella pertussis
gcgcgccaggccc

SEQ ID NO: 2373215 - RNA, 14 nt, Bordetella pertussis
gcgcgccaggccca

SEQ ID NO: 2373216 - RNA, 16 nt, Bordetella pertussis
gcgcgccaggcccagg

SEQ ID NO: 2373217 - RNA, 20 nt, Bordetella pertussis
gcgcgccaggccuucgacgu

SEQ ID NO: 2373218 - RNA, 14 nt, Bordetella pertussis
gcgcgccaggcgau

SEQ ID NO: 2373219 - RNA, 15 nt, Bordetella pertussis
gcgcgccaggcgaug

SEQ ID NO: 2373220 - RNA, 13 nt, Bordetella pertussis
gcgcgccaggcgc

SEQ ID NO: 2373221 - RNA, 15 nt, Bordetella pertussis
gcgcgccaggcgcau

SEQ ID NO: 2373222 - RNA, 16 nt, Bordetella pertussis
gcgcgccaggcgcgca

SEQ ID NO: 2373223 - RNA, 14 nt, Bordetella pertussis
gcgcgccaggcgcu

SEQ ID NO: 2373224 - RNA, 15 nt, Bordetella pertussis
gcgcgccaggcgcug

SEQ ID NO: 2373225 - RNA, 17 nt, Bordetella pertussis
gcgcgccaggcgcugcg

SEQ ID NO: 2373226 - RNA, 15 nt, Bordetella pertussis
gcgcgccaggggaug

SEQ ID NO: 2373227 - RNA, 18 nt, Bordetella pertussis
gcgcgccaggggaugacg

SEQ ID NO: 2373228 - RNA, 18 nt, Bordetella pertussis
gcgcgccaggucgcgcac

SEQ ID NO: 2373229 - RNA, 20 nt, Bordetella pertussis
gcgcgccaguucaaggcgcg

SEQ ID NO: 2373230 - RNA, 16 nt, Bordetella pertussis
gcgcgccaguugcgca

SEQ ID NO: 2373231 - RNA, 19 nt, Bordetella pertussis
gcgcgccaguugcgcaccg

SEQ ID NO: 2373232 - RNA, 20 nt, Bordetella pertussis
gcgcgccauccggcgcauga

SEQ ID NO: 2373233 - RNA, 22 nt, Bordetella pertussis
gcgcgccauccugaacgccgcg

SEQ ID NO: 2373234 - RNA, 17 nt, Bordetella pertussis
gcgcgccaucgacgggc

SEQ ID NO: 2373235 - RNA, 22 nt, Bordetella pertussis
gcgcgccaucgacgggcggcug

SEQ ID NO: 2373236 - RNA, 14 nt, Bordetella pertussis
gcgcgccaugcaac

SEQ ID NO: 2373237 - RNA, 16 nt, Bordetella pertussis
gcgcgccauggccggc

SEQ ID NO: 2373238 - RNA, 21 nt, Bordetella pertussis
gcgcgccguacagccgcggca

SEQ ID NO: 2373239 - RNA, 15 nt, Bordetella pertussis
gcgcgccguccgggc

SEQ ID NO: 2373240 - RNA, 18 nt, Bordetella pertussis
gcgcgccguccgggccgg

SEQ ID NO: 2373241 - RNA, 14 nt, Bordetella pertussis
gcgcgccgucggcg

SEQ ID NO: 2373242 - RNA, 17 nt, Bordetella pertussis
gcgcgccgucgggggcc

SEQ ID NO: 2373243 - RNA, 13 nt, Bordetella pertussis
gcgcgccguggcu

SEQ ID NO: 2373244 - RNA, 20 nt, Bordetella pertussis
gcgcgccuccagcuccagcg

SEQ ID NO: 2373245 - RNA, 22 nt, Bordetella pertussis
gcgcgccuccagcuccagcgcg

SEQ ID NO: 2373246 - RNA, 18 nt, Bordetella pertussis
gcgcgccucgaugauggc

SEQ ID NO: 2373247 - RNA, 24 nt, Bordetella pertussis
gcgcgccucggcgcgcgcggcgcc

SEQ ID NO: 2373248 - RNA, 21 nt, Bordetella pertussis
gcgcgccucgugcgaggccac

SEQ ID NO: 2373249 - RNA, 22 nt, Bordetella pertussis
gcgcgccucgugcgaggccacg

SEQ ID NO: 2373250 - RNA, 12 nt, Bordetella pertussis
gcgcgccugcag

SEQ ID NO: 2373251 - RNA, 19 nt, Bordetella pertussis
gcgcgccugcagcacggcc

SEQ ID NO: 2373252 - RNA, 21 nt, Bordetella pertussis
gcgcgccugcagcacggccac

SEQ ID NO: 2373253 - RNA, 15 nt, Bordetella pertussis
gcgcgccugcagcag

SEQ ID NO: 2373254 - RNA, 13 nt, Bordetella pertussis
gcgcgccugcaug

SEQ ID NO: 2373255 - RNA, 22 nt, Bordetella pertussis
gcgcgccugcauguccagcggc

SEQ ID NO: 2373256 - RNA, 23 nt, Bordetella pertussis
gcgcgccugcauguccagcggcg

SEQ ID NO: 2373257 - RNA, 12 nt, Bordetella pertussis
gcgcgccugccc

SEQ ID NO: 2373258 - RNA, 17 nt, Bordetella pertussis
gcgcgccugcccaggcc

SEQ ID NO: 2373259 - RNA, 21 nt, Bordetella pertussis
gcgcgccugccccgccugcgc

SEQ ID NO: 2373260 - RNA, 22 nt, Bordetella pertussis
gcgcgccugccccgccugcgcc

SEQ ID NO: 2373261 - RNA, 23 nt, Bordetella pertussis
gcgcgccugccccgccugcgcca

SEQ ID NO: 2373262 - RNA, 16 nt, Bordetella pertussis
gcgcgccugcgagaga

SEQ ID NO: 2373263 - RNA, 12 nt, Bordetella pertussis
gcgcgccugcgc

SEQ ID NO: 2373264 - RNA, 15 nt, Bordetella pertussis
gcgcgccugcgcgcc

SEQ ID NO: 2373265 - RNA, 16 nt, Bordetella pertussis
gcgcgccugcgcgccg

SEQ ID NO: 2373266 - RNA, 23 nt, Bordetella pertussis
gcgcgccugcucgaccugcucgg

SEQ ID NO: 2373267 - RNA, 23 nt, Bordetella pertussis
gcgcgccuggcacgacguggccu

SEQ ID NO: 2373268 - RNA, 17 nt, Bordetella pertussis
gcgcgccuggcgcgccc

SEQ ID NO: 2373269 - RNA, 16 nt, Bordetella pertussis
gcgcgccuuacgcggc

SEQ ID NO: 2373270 - RNA, 18 nt, Bordetella pertussis
gcgcgccuuacgcggcgc

SEQ ID NO: 2373271 - RNA, 22 nt, Bordetella pertussis
gcgcgccuuacgcggcgcgcgc

SEQ ID NO: 2373272 - RNA, 23 nt, Bordetella pertussis
gcgcgccuuacgcggcgcgcgcc

SEQ ID NO: 2373273 - RNA, 17 nt, Bordetella pertussis
gcgcgccuucggcaggc

SEQ ID NO: 2373274 - RNA, 19 nt, Bordetella pertussis
gcgcgccuucggcaggcgc

SEQ ID NO: 2373275 - RNA, 21 nt, Bordetella pertussis
gcgcgccuugaaccccggcug

SEQ ID NO: 2373276 - RNA, 23 nt, Bordetella pertussis
gcgcgccuugaaccccggcugcg

SEQ ID NO: 2373277 - RNA, 17 nt, Bordetella pertussis
gcgcgccuugcgcggcg

SEQ ID NO: 2373278 - RNA, 21 nt, Bordetella pertussis
gcgcgcgaauuuuucuuccag

SEQ ID NO: 2373279 - RNA, 14 nt, Bordetella pertussis
gcgcgcgaccaggc

SEQ ID NO: 2373280 - RNA, 15 nt, Bordetella pertussis
gcgcgcgaccaggcu

SEQ ID NO: 2373281 - RNA, 16 nt, Bordetella pertussis
gcgcgcgacgacagcg

SEQ ID NO: 2373282 - RNA, 21 nt, Bordetella pertussis
gcgcgcgacgacagcggcgag

SEQ ID NO: 2373283 - RNA, 17 nt, Bordetella pertussis
gcgcgcgacggcgccgg

SEQ ID NO: 2373284 - RNA, 18 nt, Bordetella pertussis
gcgcgcgacggcgccggc

SEQ ID NO: 2373285 - RNA, 16 nt, Bordetella pertussis
gcgcgcgacuccaccg

SEQ ID NO: 2373286 - RNA, 19 nt, Bordetella pertussis
gcgcgcgacuccaccggcg

SEQ ID NO: 2373287 - RNA, 20 nt, Bordetella pertussis
gcgcgcgacuccaccggcgu

SEQ ID NO: 2373288 - RNA, 16 nt, Bordetella pertussis
gcgcgcgagcagucga

SEQ ID NO: 2373289 - RNA, 13 nt, Bordetella pertussis
gcgcgcgagcugc

SEQ ID NO: 2373290 - RNA, 16 nt, Bordetella pertussis
gcgcgcgagcugcgcg

SEQ ID NO: 2373291 - RNA, 15 nt, Bordetella pertussis
gcgcgcgaggcggcg

SEQ ID NO: 2373292 - RNA, 15 nt, Bordetella pertussis
gcgcgcgaucgccag

SEQ ID NO: 2373293 - RNA, 16 nt, Bordetella pertussis
gcgcgcgaucgccagc

SEQ ID NO: 2373294 - RNA, 17 nt, Bordetella pertussis
gcgcgcgaucgccagca

SEQ ID NO: 2373295 - RNA, 19 nt, Bordetella pertussis
gcgcgcgaucgccagcagg

SEQ ID NO: 2373296 - RNA, 23 nt, Bordetella pertussis
gcgcgcgaucgccagcaggcgcu

SEQ ID NO: 2373297 - RNA, 17 nt, Bordetella pertussis
gcgcgcgaugcgcaggc

SEQ ID NO: 2373298 - RNA, 17 nt, Bordetella pertussis
gcgcgcgcacaggcgcu

SEQ ID NO: 2373299 - RNA, 12 nt, Bordetella pertussis
gcgcgcgcacgc

SEQ ID NO: 2373300 - RNA, 13 nt, Bordetella pertussis
gcgcgcgcagcca

SEQ ID NO: 2373301 - RNA, 18 nt, Bordetella pertussis
gcgcgcgcagccgcgcca

SEQ ID NO: 2373302 - RNA, 13 nt, Bordetella pertussis
gcgcgcgcaucgg

SEQ ID NO: 2373303 - RNA, 13 nt, Bordetella pertussis
gcgcgcgccagcg

SEQ ID NO: 2373304 - RNA, 13 nt, Bordetella pertussis
gcgcgcgccaggc

SEQ ID NO: 2373305 - RNA, 16 nt, Bordetella pertussis
gcgcgcgccaggccca

SEQ ID NO: 2373306 - RNA, 13 nt, Bordetella pertussis
gcgcgcgccaggu

SEQ ID NO: 2373307 - RNA, 14 nt, Bordetella pertussis
gcgcgcgccaguug

SEQ ID NO: 2373308 - RNA, 20 nt, Bordetella pertussis
gcgcgcgccaucgacgggcg

SEQ ID NO: 2373309 - RNA, 12 nt, Bordetella pertussis
gcgcgcgccaug

SEQ ID NO: 2373310 - RNA, 13 nt, Bordetella pertussis
gcgcgcgccaugu

SEQ ID NO: 2373311 - RNA, 19 nt, Bordetella pertussis
gcgcgcgccaugucgacga

SEQ ID NO: 2373312 - RNA, 14 nt, Bordetella pertussis
gcgcgcgcccaccg

SEQ ID NO: 2373313 - RNA, 17 nt, Bordetella pertussis
gcgcgcgcccugcacgc

SEQ ID NO: 2373314 - RNA, 16 nt, Bordetella pertussis
gcgcgcgccgaugcgc

SEQ ID NO: 2373315 - RNA, 15 nt, Bordetella pertussis
gcgcgcgccgcacgc

SEQ ID NO: 2373316 - RNA, 14 nt, Bordetella pertussis
gcgcgcgccgccgg

SEQ ID NO: 2373317 - RNA, 13 nt, Bordetella pertussis
gcgcgcgccgcgc

SEQ ID NO: 2373318 - RNA, 18 nt, Bordetella pertussis
gcgcgcgccgcgccgggg

SEQ ID NO: 2373319 - RNA, 14 nt, Bordetella pertussis
gcgcgcgccggacg

SEQ ID NO: 2373320 - RNA, 12 nt, Bordetella pertussis
gcgcgcgccggc

SEQ ID NO: 2373321 - RNA, 13 nt, Bordetella pertussis
gcgcgcgccggcg

SEQ ID NO: 2373322 - RNA, 13 nt, Bordetella pertussis
gcgcgcgccggcu

SEQ ID NO: 2373323 - RNA, 11 nt, Bordetella pertussis
gcgcgcgccug

SEQ ID NO: 2373324 - RNA, 17 nt, Bordetella pertussis
gcgcgcgccugccccgc

SEQ ID NO: 2373325 - RNA, 15 nt, Bordetella pertussis
gcgcgcgcgaccacg

SEQ ID NO: 2373326 - RNA, 13 nt, Bordetella pertussis
gcgcgcgcgcaca

SEQ ID NO: 2373327 - RNA, 16 nt, Bordetella pertussis
gcgcgcgcgcacaggc

SEQ ID NO: 2373328 - RNA, 16 nt, Bordetella pertussis
gcgcgcgcgccgacgc

SEQ ID NO: 2373329 - RNA, 14 nt, Bordetella pertussis
gcgcgcgcgcgccg

SEQ ID NO: 2373330 - RNA, 15 nt, Bordetella pertussis
gcgcgcgcgcgccgc

SEQ ID NO: 2373331 - RNA, 16 nt, Bordetella pertussis
gcgcgcgcgcgcgggc

SEQ ID NO: 2373332 - RNA, 13 nt, Bordetella pertussis
gcgcgcgcgcugg

SEQ ID NO: 2373333 - RNA, 13 nt, Bordetella pertussis
gcgcgcgcggcca

SEQ ID NO: 2373334 - RNA, 14 nt, Bordetella pertussis
gcgcgcgcggccag

SEQ ID NO: 2373335 - RNA, 15 nt, Bordetella pertussis
gcgcgcgcggccagu

SEQ ID NO: 2373336 - RNA, 12 nt, Bordetella pertussis
gcgcgcgcggcg

SEQ ID NO: 2373337 - RNA, 13 nt, Bordetella pertussis
gcgcgcgcggcgc

SEQ ID NO: 2373338 - RNA, 12 nt, Bordetella pertussis
gcgcgcgcgggc

SEQ ID NO: 2373339 - RNA, 13 nt, Bordetella pertussis
gcgcgcgcgggcg

SEQ ID NO: 2373340 - RNA, 13 nt, Bordetella pertussis
gcgcgcgcggucc

SEQ ID NO: 2373341 - RNA, 15 nt, Bordetella pertussis
gcgcgcgcgguccau

SEQ ID NO: 2373342 - RNA, 14 nt, Bordetella pertussis
gcgcgcgcggucgg

SEQ ID NO: 2373343 - RNA, 14 nt, Bordetella pertussis
gcgcgcgcguugau

SEQ ID NO: 2373344 - RNA, 17 nt, Bordetella pertussis
gcgcgcgcugcacggcc

SEQ ID NO: 2373345 - RNA, 12 nt, Bordetella pertussis
gcgcgcgcuggg

SEQ ID NO: 2373346 - RNA, 21 nt, Bordetella pertussis
gcgcgcggaucgaaaccggcg

SEQ ID NO: 2373347 - RNA, 15 nt, Bordetella pertussis
gcgcgcggcagggcg

SEQ ID NO: 2373348 - RNA, 17 nt, Bordetella pertussis
gcgcgcggcagggcguc

SEQ ID NO: 2373349 - RNA, 18 nt, Bordetella pertussis
gcgcgcggcagggcgucg

SEQ ID NO: 2373350 - RNA, 22 nt, Bordetella pertussis
gcgcgcggcagggcgucggccg

SEQ ID NO: 2373351 - RNA, 20 nt, Bordetella pertussis
gcgcgcggcauggcagcaca

SEQ ID NO: 2373352 - RNA, 19 nt, Bordetella pertussis
gcgcggaugaccugcgcca

SEQ ID NO: 2373353 - RNA, 22 nt, Bordetella pertussis
gcgcggaugaccugcgccaggu

SEQ ID NO: 2373354 - RNA, 17 nt, Bordetella pertussis
gcgcggaugaucgcgca

SEQ ID NO: 2373355 - RNA, 16 nt, Bordetella pertussis
gcgcggaugccgucca

SEQ ID NO: 2373356 - RNA, 16 nt, Bordetella pertussis
gcgcggaugugggggu

SEQ ID NO: 2373357 - RNA, 17 nt, Bordetella pertussis
gcgcggcaaaaugccgc

SEQ ID NO: 2373358 - RNA, 16 nt, Bordetella pertussis
gcgcggcaaugcgcgc

SEQ ID NO: 2373359 - RNA, 18 nt, Bordetella pertussis
gcgcggcaaugcgcgcgc

SEQ ID NO: 2373360 - RNA, 15 nt, Bordetella pertussis
gcgcggcacgcugcu

SEQ ID NO: 2373361 - RNA, 17 nt, Bordetella pertussis
gcgcggcacgcugcuga

SEQ ID NO: 2373362 - RNA, 15 nt, Bordetella pertussis
gcgcggcacguccga

SEQ ID NO: 2373363 - RNA, 17 nt, Bordetella pertussis
gcgcggcagccuggggc

SEQ ID NO: 2373364 - RNA, 16 nt, Bordetella pertussis
gcgcggcaggcggugc

SEQ ID NO: 2373365 - RNA, 14 nt, Bordetella pertussis
gcgcggcagggcgu

SEQ ID NO: 2373366 - RNA, 14 nt, Bordetella pertussis
gcgcggcagguucu

SEQ ID NO: 2373367 - RNA, 22 nt, Bordetella pertussis
gcgcggcagguucugcgcgucc

SEQ ID NO: 2373368 - RNA, 13 nt, Bordetella pertussis
gcgcggcauacgc

SEQ ID NO: 2373369 - RNA, 19 nt, Bordetella pertussis
gcgcggcauacgccgaugg

SEQ ID NO: 2373370 - RNA, 20 nt, Bordetella pertussis
gcgcggcauagcccaggccg

SEQ ID NO: 2373371 - RNA, 19 nt, Bordetella pertussis
gcgcggcaucggccauggc

SEQ ID NO: 2373372 - RNA, 22 nt, Bordetella pertussis
gcgcggcaucggccauggcggu

SEQ ID NO: 2373373 - RNA, 17 nt, Bordetella pertussis
gcgcggcauggcgccgc

SEQ ID NO: 2373374 - RNA, 18 nt, Bordetella pertussis
gcgcggcauggcgccgcg

SEQ ID NO: 2373375 - RNA, 19 nt, Bordetella pertussis
gcgcggcauggcgccgcgc

SEQ ID NO: 2373376 - RNA, 15 nt, Bordetella pertussis
gcgcggcaugggcac

SEQ ID NO: 2373377 - RNA, 17 nt, Bordetella pertussis
gcgcggccaaccccgag

SEQ ID NO: 2373378 - RNA, 17 nt, Bordetella pertussis
gcgcggccacggccugc

SEQ ID NO: 2373379 - RNA, 18 nt, Bordetella pertussis
gcgcggccacggccugcc

SEQ ID NO: 2373380 - RNA, 11 nt, Bordetella pertussis
gcgcggccagc

SEQ ID NO: 2373381 - RNA, 14 nt, Bordetella pertussis
gcgcggccagcacc

SEQ ID NO: 2373382 - RNA, 16 nt, Bordetella pertussis
gcgcggccagcaccgg

SEQ ID NO: 2373383 - RNA, 18 nt, Bordetella pertussis
gcgcggccagcaccggcc

SEQ ID NO: 2373384 - RNA, 21 nt, Bordetella pertussis
gcgcggccagcaccggcccga

SEQ ID NO: 2373385 - RNA, 19 nt, Bordetella pertussis
gcgcggccagcaccggccg

SEQ ID NO: 2373386 - RNA, 20 nt, Bordetella pertussis
gcgcggccagcaccggccgc

SEQ ID NO: 2373387 - RNA, 12 nt, Bordetella pertussis
gcgcggccagcg

SEQ ID NO: 2373388 - RNA, 14 nt, Bordetella pertussis
gcgcggccagcgcc

SEQ ID NO: 2373389 - RNA, 16 nt, Bordetella pertussis
gcgcggccagcgccgg

SEQ ID NO: 2373390 - RNA, 19 nt, Bordetella pertussis
gcgcggccagcgccggcgc

SEQ ID NO: 2373391 - RNA, 15 nt, Bordetella pertussis
gcgcggccagcgcgg

SEQ ID NO: 2373392 - RNA, 12 nt, Bordetella pertussis
gcgcggccaggc

SEQ ID NO: 2373393 - RNA, 13 nt, Bordetella pertussis
gcgcggccaggcg

SEQ ID NO: 2373394 - RNA, 16 nt, Bordetella pertussis
gcgcggccaggcgcgu

SEQ ID NO: 2373395 - RNA, 15 nt, Bordetella pertussis
gcgcggccaggcgcu

SEQ ID NO: 2373396 - RNA, 20 nt, Bordetella pertussis
gcgcggccaggcgcucagcg

SEQ ID NO: 2373397 - RNA, 14 nt, Bordetella pertussis
gcgcggccagggcu

SEQ ID NO: 2373398 - RNA, 16 nt, Bordetella pertussis
gcgcggccagggcugc

SEQ ID NO: 2373399 - RNA, 20 nt, Bordetella pertussis
gcgcggccagggcugcggcg

SEQ ID NO: 2373400 - RNA, 21 nt, Bordetella pertussis
gcgcggccagggucaggggca

SEQ ID NO: 2373401 - RNA, 20 nt, Bordetella pertussis
gcgcggccaggucggcgucg

SEQ ID NO: 2373402 - RNA, 21 nt, Bordetella pertussis
gcgcggccaguucgacgccca

SEQ ID NO: 2373403 - RNA, 13 nt, Bordetella pertussis
gcgcggccaugcc

SEQ ID NO: 2373404 - RNA, 21 nt, Bordetella pertussis
gcgcggccauguccagcagcu

SEQ ID NO: 2373405 - RNA, 18 nt, Bordetella pertussis
gcgcggccccaugcgcgg

SEQ ID NO: 2373406 - RNA, 22 nt, Bordetella pertussis
gcgcggccccaugcgcggcacg

SEQ ID NO: 2373407 - RNA, 19 nt, Bordetella pertussis
gcgcggccccggcucccgc

SEQ ID NO: 2373408 - RNA, 13 nt, Bordetella pertussis
gcgcggcccgcca

SEQ ID NO: 2373409 - RNA, 21 nt, Bordetella pertussis
gcgcggcccgccacgcaggcg

SEQ ID NO: 2373410 - RNA, 13 nt, Bordetella pertussis
gcgcggcccggcg

SEQ ID NO: 2373411 - RNA, 23 nt, Bordetella pertussis
gcgcggccgacguggaccgcgcg

SEQ ID NO: 2373412 - RNA, 15 nt, Bordetella pertussis
gcgcggccgccgccc

SEQ ID NO: 2373413 - RNA, 16 nt, Bordetella pertussis
gcgcggccgccgcccg

SEQ ID NO: 2373414 - RNA, 19 nt, Bordetella pertussis
gcgcggccgccgcccgccu

SEQ ID NO: 2373415 - RNA, 14 nt, Bordetella pertussis
gcgcggccgcgcgc

SEQ ID NO: 2373416 - RNA, 15 nt, Bordetella pertussis
gcgcggccgcgcgcu

SEQ ID NO: 2373417 - RNA, 14 nt, Bordetella pertussis
gcgcggccggcacc

SEQ ID NO: 2373418 - RNA, 20 nt, Bordetella pertussis
gcgcggccggcaccaucugc

SEQ ID NO: 2373419 - RNA, 12 nt, Bordetella pertussis
gcgcggccggcc

SEQ ID NO: 2373420 - RNA, 15 nt, Bordetella pertussis
gcgcggccggccgcg

SEQ ID NO: 2373421 - RNA, 14 nt, Bordetella pertussis
gcgcggccggcgcg

SEQ ID NO: 2373422 - RNA, 18 nt, Bordetella pertussis
gcgcggccggcgcgccgg

SEQ ID NO: 2373423 - RNA, 22 nt, Bordetella pertussis
gcgcggccgggcuuccaguugc

SEQ ID NO: 2373424 - RNA, 12 nt, Bordetella pertussis
gcgcggccgggg

SEQ ID NO: 2373425 - RNA, 14 nt, Bordetella pertussis
gcgcggccgggucg

SEQ ID NO: 2373426 - RNA, 15 nt, Bordetella pertussis
gcgcggccgggucgg

SEQ ID NO: 2373427 - RNA, 17 nt, Bordetella pertussis
gcgcggccgucaggcgu

SEQ ID NO: 2373428 - RNA, 21 nt, Bordetella pertussis
gcgcggccuauuuggcggccu

SEQ ID NO: 2373429 - RNA, 13 nt, Bordetella pertussis
gcgcggccucgcc

SEQ ID NO: 2373430 - RNA, 20 nt, Bordetella pertussis
gcgcggccucgccggccugg

SEQ ID NO: 2373431 - RNA, 22 nt, Bordetella pertussis
gcgcggccucgccggccuggcg

SEQ ID NO: 2373432 - RNA, 23 nt, Bordetella pertussis
gcgcggccucgccggccuggcgc

SEQ ID NO: 2373433 - RNA, 21 nt, Bordetella pertussis
gcgcggccucguaggccauca

SEQ ID NO: 2373434 - RNA, 11 nt, Bordetella pertussis
gcgcggccugc

SEQ ID NO: 2373435 - RNA, 12 nt, Bordetella pertussis
gcgcggccuggg

SEQ ID NO: 2373436 - RNA, 15 nt, Bordetella pertussis
gcgcggccugggcgg

SEQ ID NO: 2373437 - RNA, 17 nt, Bordetella pertussis
gcgcggccugggcggcg

SEQ ID NO: 2373438 - RNA, 20 nt, Bordetella pertussis
gcgcggccugggcggcgcgc

SEQ ID NO: 2373439 - RNA, 23 nt, Bordetella pertussis
gcgcggccuugcaugcgccgcac

SEQ ID NO: 2373440 - RNA, 15 nt, Bordetella pertussis
gcgcggcgaaggcgc

SEQ ID NO: 2373441 - RNA, 22 nt, Bordetella pertussis
gcgcggcgaaggcgcggcugcg

SEQ ID NO: 2373442 - RNA, 14 nt, Bordetella pertussis
gcgcggcgaccgcg

SEQ ID NO: 2373443 - RNA, 22 nt, Bordetella pertussis
gcgcggcgaccgcgaaccggug

SEQ ID NO: 2373444 - RNA, 15 nt, Bordetella pertussis
gcgcggcgagcgccg

SEQ ID NO: 2373445 - RNA, 21 nt, Bordetella pertussis
gcgcggcgagcgccgccaggc

SEQ ID NO: 2373446 - RNA, 22 nt, Bordetella pertussis
gcgcggcgagcgccgccaggcc

SEQ ID NO: 2373447 - RNA, 13 nt, Bordetella pertussis
gcgcggcgaggcg

SEQ ID NO: 2373448 - RNA, 16 nt, Bordetella pertussis
gcgcggcgauacgcgc

SEQ ID NO: 2373449 - RNA, 15 nt, Bordetella pertussis
gcgcggcgaucgaca

SEQ ID NO: 2373450 - RNA, 13 nt, Bordetella pertussis
gcgcggcgaucgg

SEQ ID NO: 2373451 - RNA, 19 nt, Bordetella pertussis
gcgcggcgauugcggcccg

SEQ ID NO: 2373452 - RNA, 13 nt, Bordetella pertussis
gcgcggcgcagcg

SEQ ID NO: 2373453 - RNA, 18 nt, Bordetella pertussis
gcgcggcgcagcgcacga

SEQ ID NO: 2373454 - RNA, 13 nt, Bordetella pertussis
gcgcggcgcaggc

SEQ ID NO: 2373455 - RNA, 14 nt, Bordetella pertussis
gcgcggcgcaggcc

SEQ ID NO: 2373456 - RNA, 16 nt, Bordetella pertussis
gcgcggcgcaggccug

SEQ ID NO: 2373457 - RNA, 18 nt, Bordetella pertussis
gcgcggcgcaggccugcg

SEQ ID NO: 2373458 - RNA, 13 nt, Bordetella pertussis
gcgcggcgcauug

SEQ ID NO: 2373459 - RNA, 15 nt, Bordetella pertussis
gcgcggcgccagcgc

SEQ ID NO: 2373460 - RNA, 18 nt, Bordetella pertussis
gcgcggcgccagcgcccc

SEQ ID NO: 2373461 - RNA, 12 nt, Bordetella pertussis
gcgcggcgccau

SEQ ID NO: 2373462 - RNA, 15 nt, Bordetella pertussis
gcgcggcgccaugcc

SEQ ID NO: 2373463 - RNA, 17 nt, Bordetella pertussis
gcgcggcgccaugccgc

SEQ ID NO: 2373464 - RNA, 15 nt, Bordetella pertussis
gcgcggcgcccgccu

SEQ ID NO: 2373465 - RNA, 14 nt, Bordetella pertussis
gcgcggcgccgcug

SEQ ID NO: 2373466 - RNA, 15 nt, Bordetella pertussis
gcgcgguauggccgc

SEQ ID NO: 2373467 - RNA, 17 nt, Bordetella pertussis
gcgcgguauggccgccc

SEQ ID NO: 2373468 - RNA, 20 nt, Bordetella pertussis
gcgcgguauggccgcccagc

SEQ ID NO: 2373469 - RNA, 19 nt, Bordetella pertussis
gcgcgguauucgcgcuggc

SEQ ID NO: 2373470 - RNA, 21 nt, Bordetella pertussis
gcgcgguauucgcgcuggcgc

SEQ ID NO: 2373471 - RNA, 17 nt, Bordetella pertussis
gcgcgguauucgcugcu

SEQ ID NO: 2373472 - RNA, 20 nt, Bordetella pertussis
gcgcgguauugcgccacccc

SEQ ID NO: 2373473 - RNA, 21 nt, Bordetella pertussis
gcgcgguauugcgccaccccg

SEQ ID NO: 2373474 - RNA, 15 nt, Bordetella pertussis
gcgcggucagcauga

SEQ ID NO: 2373475 - RNA, 17 nt, Bordetella pertussis
gcgcggucaugccgaac

SEQ ID NO: 2373476 - RNA, 15 nt, Bordetella pertussis
gcgcgguccaccucg

SEQ ID NO: 2373477 - RNA, 21 nt, Bordetella pertussis
gcgcgguccaccucgucgucc

SEQ ID NO: 2373478 - RNA, 23 nt, Bordetella pertussis
gcgcgguccacgcccuggcuggc

SEQ ID NO: 2373479 - RNA, 17 nt, Bordetella pertussis
gcgcgguccacgcgggc

SEQ ID NO: 2373480 - RNA, 13 nt, Bordetella pertussis
gcgcgguccagca

SEQ ID NO: 2373481 - RNA, 15 nt, Bordetella pertussis
gcgcgguccagcaag

SEQ ID NO: 2373482 - RNA, 13 nt, Bordetella pertussis
gcgcggucgacga

SEQ ID NO: 2373483 - RNA, 13 nt, Bordetella pertussis
gcgcggucggcgg

SEQ ID NO: 2373484 - RNA, 15 nt, Bordetella pertussis
gcgcggucggcgggc

SEQ ID NO: 2373485 - RNA, 22 nt, Bordetella pertussis
gcgcggugacguaaucgagcug

SEQ ID NO: 2373486 - RNA, 15 nt, Bordetella pertussis
gcgcggugccgccug

SEQ ID NO: 2373487 - RNA, 19 nt, Bordetella pertussis
gcgcggugcgcaccaggcc

SEQ ID NO: 2373488 - RNA, 21 nt, Bordetella pertussis
gcgcggugcgcaccaggccca

SEQ ID NO: 2373489 - RNA, 15 nt, Bordetella pertussis
gcgcggugcucggcg

SEQ ID NO: 2373490 - RNA, 15 nt, Bordetella pertussis
gcgcgguggccagcg

SEQ ID NO: 2373491 - RNA, 16 nt, Bordetella pertussis
gcgcgguggccagcga

SEQ ID NO: 2373492 - RNA, 15 nt, Bordetella pertussis
gcgcgguggccgccg

SEQ ID NO: 2373493 - RNA, 18 nt, Bordetella pertussis
gcgcgguggccgccgcgc

SEQ ID NO: 2373494 - RNA, 19 nt, Bordetella pertussis
gcgcgguggccgcuucggc

SEQ ID NO: 2373495 - RNA, 17 nt, Bordetella pertussis
gcgcgguggggcgcaaa

SEQ ID NO: 2373496 - RNA, 16 nt, Bordetella pertussis
gcgcggugucgccgcc

SEQ ID NO: 2373497 - RNA, 17 nt, Bordetella pertussis
gcgcgguucaucgccuc

SEQ ID NO: 2373498 - RNA, 18 nt, Bordetella pertussis
gcgcgguugagcgccagg

SEQ ID NO: 2373499 - RNA, 20 nt, Bordetella pertussis
gcgcgguugagcgccagggc

SEQ ID NO: 2373500 - RNA, 16 nt, Bordetella pertussis
gcgcgguugggcgcac

SEQ ID NO: 2373501 - RNA, 17 nt, Bordetella pertussis
gcgcgguugggcgcaca

SEQ ID NO: 2373502 - RNA, 21 nt, Bordetella pertussis
gcgcgguugguuugcggcgcg

SEQ ID NO: 2373503 - RNA, 22 nt, Bordetella pertussis
gcgcgguugguuugcggcgcga

SEQ ID NO: 2373504 - RNA, 23 nt, Bordetella pertussis
gcgcguaauaguggucgccggcg

SEQ ID NO: 2373505 - RNA, 17 nt, Bordetella pertussis
gcgcguacagccgggug

SEQ ID NO: 2373506 - RNA, 13 nt, Bordetella pertussis
gcgcguacgcggc

SEQ ID NO: 2373507 - RNA, 14 nt, Bordetella pertussis
gcgcguacgcggcg

SEQ ID NO: 2373508 - RNA, 19 nt, Bordetella pertussis
gcgcguacguggcgcggcu

SEQ ID NO: 2373509 - RNA, 15 nt, Bordetella pertussis
gcgcguagcgauccg

SEQ ID NO: 2373510 - RNA, 13 nt, Bordetella pertussis
gcgcguaggcgcg

SEQ ID NO: 2373511 - RNA, 22 nt, Bordetella pertussis
gcgcguaggcgcgcgcaucggc

SEQ ID NO: 2373512 - RNA, 18 nt, Bordetella pertussis
gcgcguaguccgagcccg

SEQ ID NO: 2373513 - RNA, 22 nt, Bordetella pertussis
gcgcguaguccgagcccgggcg

SEQ ID NO: 2373514 - RNA, 13 nt, Bordetella pertussis
gcgcguauccagc

SEQ ID NO: 2373515 - RNA, 16 nt, Bordetella pertussis
gcgcguauccagcauc

SEQ ID NO: 2373516 - RNA, 22 nt, Bordetella pertussis
gcgcguaucgaauucgcagauu

SEQ ID NO: 2373517 - RNA, 19 nt, Bordetella pertussis
gcgcguaucggcgcgagcg

SEQ ID NO: 2373518 - RNA, 20 nt, Bordetella pertussis
gcgcguaucggcgcgagcga

SEQ ID NO: 2373519 - RNA, 22 nt, Bordetella pertussis
gcgcguaucggcgcgagcgaug

SEQ ID NO: 2373520 - RNA, 16 nt, Bordetella pertussis
gcgcguaugacgcgcu

SEQ ID NO: 2373521 - RNA, 15 nt, Bordetella pertussis
gcgcguauggcggcg

SEQ ID NO: 2373522 - RNA, 16 nt, Bordetella pertussis
gcgcguauggcggcgc

SEQ ID NO: 2373523 - RNA, 18 nt, Bordetella pertussis
gcgcguauggcggcgccg

SEQ ID NO: 2373524 - RNA, 19 nt, Bordetella pertussis
gcgcguauggcggcgccga

SEQ ID NO: 2373525 - RNA, 14 nt, Bordetella pertussis
gcgcgucaggccgg

SEQ ID NO: 2373526 - RNA, 16 nt, Bordetella pertussis
gcgcgucaggccgggc

SEQ ID NO: 2373527 - RNA, 18 nt, Bordetella pertussis
gcgcgucaggccgggcag

SEQ ID NO: 2373528 - RNA, 21 nt, Bordetella pertussis
gcgcgucaguugggcgcgccc

SEQ ID NO: 2373529 - RNA, 18 nt, Bordetella pertussis
gcgcguccacgccguggc

SEQ ID NO: 2373530 - RNA, 15 nt, Bordetella pertussis
gcgcguccaggccau

SEQ ID NO: 2373531 - RNA, 15 nt, Bordetella pertussis
gcgcguccaggcggu

SEQ ID NO: 2373532 - RNA, 20 nt, Bordetella pertussis
gcgcgucccgguaggccugg

SEQ ID NO: 2373533 - RNA, 21 nt, Bordetella pertussis
gcgcgucccgguaggccuggu

SEQ ID NO: 2373534 - RNA, 14 nt, Bordetella pertussis
gcgcguccugcacg

SEQ ID NO: 2373535 - RNA, 17 nt, Bordetella pertussis
gcgcguccugccaguug

SEQ ID NO: 2373536 - RNA, 17 nt, Bordetella pertussis
gcgcguccugcgccagu

SEQ ID NO: 2373537 - RNA, 13 nt, Bordetella pertussis
gcgcguccuggcg

SEQ ID NO: 2373538 - RNA, 14 nt, Bordetella pertussis
gcgcguccuggcgc

SEQ ID NO: 2373539 - RNA, 13 nt, Bordetella pertussis
gcgcguccugggc

SEQ ID NO: 2373540 - RNA, 15 nt, Bordetella pertussis
gcgcguccugggccg

SEQ ID NO: 2373541 - RNA, 19 nt, Bordetella pertussis
gcgcguccugggccgagcg

SEQ ID NO: 2373542 - RNA, 12 nt, Bordetella pertussis
gcgcgucgagca

SEQ ID NO: 2373543 - RNA, 18 nt, Bordetella pertussis
gcgcgucgagcagcgcau

SEQ ID NO: 2373544 - RNA, 14 nt, Bordetella pertussis
gcgcgucgagcagg

SEQ ID NO: 2373545 - RNA, 17 nt, Bordetella pertussis
gcgcgucgagcaggccg

SEQ ID NO: 2373546 - RNA, 21 nt, Bordetella pertussis
gcgcgucgcacuggguggcca

SEQ ID NO: 2373547 - RNA, 14 nt, Bordetella pertussis
gcgcgucgccgcca

SEQ ID NO: 2373548 - RNA, 13 nt, Bordetella pertussis
gcgcgucgccgcg

SEQ ID NO: 2373549 - RNA, 17 nt, Bordetella pertussis
gcgcgucgccgcuggcc

SEQ ID NO: 2373550 - RNA, 18 nt, Bordetella pertussis
gcgcgucgccgcuggcca

SEQ ID NO: 2373551 - RNA, 14 nt, Bordetella pertussis
gcgcgucgccggcg

SEQ ID NO: 2373552 - RNA, 23 nt, Bordetella pertussis
gcgcgucgcgcgaucaggcggug

SEQ ID NO: 2373553 - RNA, 14 nt, Bordetella pertussis
gcgcgucgcgcgcc

SEQ ID NO: 2373554 - RNA, 15 nt, Bordetella pertussis
gcgcgucgcgcgcca

SEQ ID NO: 2373555 - RNA, 17 nt, Bordetella pertussis
gcgcgucgcgcgccagg

SEQ ID NO: 2373556 - RNA, 18 nt, Bordetella pertussis
gcgcgucgcgcgccaggc

SEQ ID NO: 2373557 - RNA, 18 nt, Bordetella pertussis
gcgcgucgcgcggcggca

SEQ ID NO: 2373558 - RNA, 21 nt, Bordetella pertussis
gcgcgucgcguagcgcggccg

SEQ ID NO: 2373559 - RNA, 13 nt, Bordetella pertussis
gcgcgucgcugcg

SEQ ID NO: 2373560 - RNA, 14 nt, Bordetella pertussis
gcgcgucgcugcgc

SEQ ID NO: 2373561 - RNA, 15 nt, Bordetella pertussis
gcgcgucgcugcgcg

SEQ ID NO: 2373562 - RNA, 14 nt, Bordetella pertussis
gcgcgucggccagg

SEQ ID NO: 2373563 - RNA, 16 nt, Bordetella pertussis
gcgcgucggccaggcg

SEQ ID NO: 2373564 - RNA, 17 nt, Bordetella pertussis
gcgcgucggccaggcgc

SEQ ID NO: 2373565 - RNA, 19 nt, Bordetella pertussis
gcgcgucggccaggcgcca

SEQ ID NO: 2373566 - RNA, 22 nt, Bordetella pertussis
gcgcgucggcgccgauggugcg

SEQ ID NO: 2373567 - RNA, 16 nt, Bordetella pertussis
gcgcgucggcgcgcgc

SEQ ID NO: 2373568 - RNA, 20 nt, Bordetella pertussis
gcgcgucggcgcgcgcgacu

SEQ ID NO: 2373569 - RNA, 14 nt, Bordetella pertussis
gcgcgucggcgcgg

SEQ ID NO: 2373570 - RNA, 23 nt, Bordetella pertussis
gcgcgucguccagcguggcgcag

SEQ ID NO: 2373571 - RNA, 19 nt, Bordetella pertussis
gcgcgucgugcccgccacc

SEQ ID NO: 2373572 - RNA, 14 nt, Bordetella pertussis
gcgcgucuccagcg

SEQ ID NO: 2373573 - RNA, 15 nt, Bordetella pertussis
gcgcgucuccagcgc

SEQ ID NO: 2373574 - RNA, 16 nt, Bordetella pertussis
gcgcgucuccagcgcc

SEQ ID NO: 2373575 - RNA, 19 nt, Bordetella pertussis
gcgcgucuccagcgccggc

SEQ ID NO: 2373576 - RNA, 17 nt, Bordetella pertussis
gcgcgucuggaggacga

SEQ ID NO: 2373577 - RNA, 18 nt, Bordetella pertussis
gcgcgucuggaggacgag

SEQ ID NO: 2373578 - RNA, 20 nt, Bordetella pertussis
gcgcgucuggaggacgagcg

SEQ ID NO: 2373579 - RNA, 21 nt, Bordetella pertussis
gcgcuccagcgucauggccug

SEQ ID NO: 2373580 - RNA, 16 nt, Bordetella pertussis
gcgcuccaugcggcgg

SEQ ID NO: 2373581 - RNA, 17 nt, Bordetella pertussis
gcgcuccaugcggcggc

SEQ ID NO: 2373582 - RNA, 18 nt, Bordetella pertussis
gcgcuccauggcgccggc

SEQ ID NO: 2373583 - RNA, 19 nt, Bordetella pertussis
gcgcuccaugggcguggug

SEQ ID NO: 2373584 - RNA, 13 nt, Bordetella pertussis
gcgcucccgccaa

SEQ ID NO: 2373585 - RNA, 19 nt, Bordetella pertussis
gcgcucccgccaacacgau

SEQ ID NO: 2373586 - RNA, 16 nt, Bordetella pertussis
gcgcuccggcugcgcg

SEQ ID NO: 2373587 - RNA, 17 nt, Bordetella pertussis
gcgcuccggcugcgcgc

SEQ ID NO: 2373588 - RNA, 13 nt, Bordetella pertussis
gcgcuccucgcgc

SEQ ID NO: 2373589 - RNA, 17 nt, Bordetella pertussis
gcgcuccucgcgcgcgg

SEQ ID NO: 2373590 - RNA, 22 nt, Bordetella pertussis
gcgcuccugcucggcgaugcgc

SEQ ID NO: 2373591 - RNA, 20 nt, Bordetella pertussis
gcgcucgaaaaagcccugcg

SEQ ID NO: 2373592 - RNA, 22 nt, Bordetella pertussis
gcgcucgaagcgcaugucgaag

SEQ ID NO: 2373593 - RNA, 15 nt, Bordetella pertussis
gcgcucgaaggcgcc

SEQ ID NO: 2373594 - RNA, 16 nt, Bordetella pertussis
gcgcucgaaggcgccg

SEQ ID NO: 2373595 - RNA, 21 nt, Bordetella pertussis
gcgcucgaaggcgccgacggc

SEQ ID NO: 2373596 - RNA, 18 nt, Bordetella pertussis
gcgcucgaauggcugcgc

SEQ ID NO: 2373597 - RNA, 19 nt, Bordetella pertussis
gcgcucgaauggcugcgcg

SEQ ID NO: 2373598 - RNA, 21 nt, Bordetella pertussis
gcgcucgaauggcugcgcgcc

SEQ ID NO: 2373599 - RNA, 22 nt, Bordetella pertussis
gcgcucgacuucgucgggcucg

SEQ ID NO: 2373600 - RNA, 20 nt, Bordetella pertussis
gcgcucgagcaucuggcgca

SEQ ID NO: 2373601 - RNA, 19 nt, Bordetella pertussis
gcgcucgagcgccugcagc

SEQ ID NO: 2373602 - RNA, 21 nt, Bordetella pertussis
gcgcucgaggcgcuggcgucc

SEQ ID NO: 2373603 - RNA, 13 nt, Bordetella pertussis
gcgcucgcccagc

SEQ ID NO: 2373604 - RNA, 14 nt, Bordetella pertussis
gcgcucgcccagca

SEQ ID NO: 2373605 - RNA, 15 nt, Bordetella pertussis
gcgcucgcccagcac

SEQ ID NO: 2373606 - RNA, 16 nt, Bordetella pertussis
gcgcucgcccagccgc

SEQ ID NO: 2373607 - RNA, 17 nt, Bordetella pertussis
gcgcucgcccagccgcc

SEQ ID NO: 2373608 - RNA, 19 nt, Bordetella pertussis
gcgcucgcccagccgccug

SEQ ID NO: 2373609 - RNA, 17 nt, Bordetella pertussis
gcgcucgccccggcgcg

SEQ ID NO: 2373610 - RNA, 16 nt, Bordetella pertussis
gcgcucgcccggccac

SEQ ID NO: 2373611 - RNA, 23 nt, Bordetella pertussis
gcgcucgcccggccacguguggc

SEQ ID NO: 2373612 - RNA, 16 nt, Bordetella pertussis
gcgcucgcccucgcgc

SEQ ID NO: 2373613 - RNA, 17 nt, Bordetella pertussis
gcgcucgcccucgcgcc

SEQ ID NO: 2373614 - RNA, 20 nt, Bordetella pertussis
gcgcucgcccucgcgccacc

SEQ ID NO: 2373615 - RNA, 13 nt, Bordetella pertussis
gcgcucgccggcg

SEQ ID NO: 2373616 - RNA, 14 nt, Bordetella pertussis
gcgcucgccggcgc

SEQ ID NO: 2373617 - RNA, 19 nt, Bordetella pertussis
gcgcucgccggcgcgcagg

SEQ ID NO: 2373618 - RNA, 14 nt, Bordetella pertussis
gcgcucgcgcaggc

SEQ ID NO: 2373619 - RNA, 16 nt, Bordetella pertussis
gcgcucgcgccaggcc

SEQ ID NO: 2373620 - RNA, 13 nt, Bordetella pertussis
gcgcucgcgccca

SEQ ID NO: 2373621 - RNA, 18 nt, Bordetella pertussis
gcgcucgcgcgccagcag

SEQ ID NO: 2373622 - RNA, 17 nt, Bordetella pertussis
gcgcucgcgcgcgugcu

SEQ ID NO: 2373623 - RNA, 16 nt, Bordetella pertussis
gcgcucgcgcucggcc

SEQ ID NO: 2373624 - RNA, 17 nt, Bordetella pertussis
gcgcucgcgcucggcca

SEQ ID NO: 2373625 - RNA, 13 nt, Bordetella pertussis
gcgcucgcgcugc

SEQ ID NO: 2373626 - RNA, 16 nt, Bordetella pertussis
gcgcucgcgcugcagg

SEQ ID NO: 2373627 - RNA, 19 nt, Bordetella pertussis
gcgcucgcgggugcgcagc

SEQ ID NO: 2373628 - RNA, 22 nt, Bordetella pertussis
gcgcucgcgggugcgcagcaca

SEQ ID NO: 2373629 - RNA, 23 nt, Bordetella pertussis
gcgcucgcucacggggcugucgc

SEQ ID NO: 2373630 - RNA, 13 nt, Bordetella pertussis
gcgcucggacgcc

SEQ ID NO: 2373631 - RNA, 16 nt, Bordetella pertussis
gcgcucggagggcucc

SEQ ID NO: 2373632 - RNA, 13 nt, Bordetella pertussis
gcgcucggccagc

SEQ ID NO: 2373633 - RNA, 17 nt, Bordetella pertussis
gcgcucggccagcaugc

SEQ ID NO: 2373634 - RNA, 19 nt, Bordetella pertussis
gcgcucggccagcgcgcgg

SEQ ID NO: 2373635 - RNA, 22 nt, Bordetella pertussis
gcgcucggccagcgcgcggccg

SEQ ID NO: 2373636 - RNA, 23 nt, Bordetella pertussis
gcgcucggccagcgcgcggccgg

SEQ ID NO: 2373637 - RNA, 13 nt, Bordetella pertussis
gcgcucggccucg

SEQ ID NO: 2373638 - RNA, 16 nt, Bordetella pertussis
gcgcucggccucgguc

SEQ ID NO: 2373639 - RNA, 12 nt, Bordetella pertussis
gcgcucggcgcc

SEQ ID NO: 2373640 - RNA, 17 nt, Bordetella pertussis
gcgcucggcgccgggcu

SEQ ID NO: 2373641 - RNA, 15 nt, Bordetella pertussis
gcgcucggcgcugcc

SEQ ID NO: 2373642 - RNA, 17 nt, Bordetella pertussis
gcgcucggcgcugccgg

SEQ ID NO: 2373643 - RNA, 20 nt, Bordetella pertussis
gcgcucggcuuccugccgca

SEQ ID NO: 2373644 - RNA, 23 nt, Bordetella pertussis
gcgcucggcuuccugccgcacuu

SEQ ID NO: 2373645 - RNA, 18 nt, Bordetella pertussis
gcgcucgggcucgcgcgc

SEQ ID NO: 2373646 - RNA, 20 nt, Bordetella pertussis
gcgcucgggcucgcgcgcgc

SEQ ID NO: 2373647 - RNA, 20 nt, Bordetella pertussis
gcgcucggucauguccagcg

SEQ ID NO: 2373648 - RNA, 21 nt, Bordetella pertussis
gcgcucggucauguccagcgc

SEQ ID NO: 2373649 - RNA, 19 nt, Bordetella pertussis
gcgcucgguccagacgggc

SEQ ID NO: 2373650 - RNA, 20 nt, Bordetella pertussis
gcgcucgguguggauggcgg

SEQ ID NO: 2373651 - RNA, 21 nt, Bordetella pertussis
gcgcucgguguggauggcggu

SEQ ID NO: 2373652 - RNA, 23 nt, Bordetella pertussis
gcgcucgucgaauacgaaacagg

SEQ ID NO: 2373653 - RNA, 16 nt, Bordetella pertussis
gcgcucguugcgcgug

SEQ ID NO: 2373654 - RNA, 12 nt, Bordetella pertussis
gcgcucuugggc

SEQ ID NO: 2373655 - RNA, 20 nt, Bordetella pertussis
gcgcucuugguggugccugc

SEQ ID NO: 2373656 - RNA, 18 nt, Bordetella pertussis
gcgcugaauccggggugc

SEQ ID NO: 2373657 - RNA, 14 nt, Bordetella pertussis
gcgcugacagcgcu

SEQ ID NO: 2373658 - RNA, 16 nt, Bordetella pertussis
gcgcugacagcgcucu

SEQ ID NO: 2373659 - RNA, 16 nt, Bordetella pertussis
gcgcugacgccgaugu

SEQ ID NO: 2373660 - RNA, 18 nt, Bordetella pertussis
gcgcugauccuggcucug

SEQ ID NO: 2373661 - RNA, 16 nt, Bordetella pertussis
gcgcugaugcgcggcg

SEQ ID NO: 2373662 - RNA, 18 nt, Bordetella pertussis
gcgcugaugcgcggcggg

SEQ ID NO: 2373663 - RNA, 19 nt, Bordetella pertussis
gcgcugaugcgcggcgggc

SEQ ID NO: 2373664 - RNA, 11 nt, Bordetella pertussis
gcgcugauucg

SEQ ID NO: 2373665 - RNA, 22 nt, Bordetella pertussis
gcgcugauucgcgucguugcgc

SEQ ID NO: 2373666 - RNA, 19 nt, Bordetella pertussis
gcgcugcaauugcgcggcc

SEQ ID NO: 2373667 - RNA, 20 nt, Bordetella pertussis
gcgcugcaauugcgcggcca

SEQ ID NO: 2373668 - RNA, 22 nt, Bordetella pertussis
gcgcugcaauugcgcggccaug

SEQ ID NO: 2373669 - RNA, 12 nt, Bordetella pertussis
gcgcugcacagg

SEQ ID NO: 2373670 - RNA, 16 nt, Bordetella pertussis
gcgcugcacagggacc

SEQ ID NO: 2373671 - RNA, 14 nt, Bordetella pertussis
gcgcugcacgcagc

SEQ ID NO: 2373672 - RNA, 18 nt, Bordetella pertussis
gcgcugcacgcagcgcag

SEQ ID NO: 2373673 - RNA, 19 nt, Bordetella pertussis
gcgcugcacgcagcgcagg

SEQ ID NO: 2373674 - RNA, 16 nt, Bordetella pertussis
gcgcugcacgcggccg

SEQ ID NO: 2373675 - RNA, 17 nt, Bordetella pertussis
gcgcugcacgcggccgc

SEQ ID NO: 2373676 - RNA, 18 nt, Bordetella pertussis
gcgcugcacgcggccgcg

SEQ ID NO: 2373677 - RNA, 20 nt, Bordetella pertussis
gcgcugcacgcggccgcgca

SEQ ID NO: 2373678 - RNA, 22 nt, Bordetella pertussis
gcgcugcacgcggccgcgcagg

SEQ ID NO: 2373679 - RNA, 23 nt, Bordetella pertussis
gcgcugcacgcggccgcgcagga

SEQ ID NO: 2373680 - RNA, 10 nt, Bordetella pertussis
gcgcugcaga

SEQ ID NO: 2373681 - RNA, 23 nt, Bordetella pertussis
gcgcugcagaucaucgagcaccg

SEQ ID NO: 2373682 - RNA, 12 nt, Bordetella pertussis
gcgcugcagcag

SEQ ID NO: 2373683 - RNA, 20 nt, Bordetella pertussis
gcgcugcagcgcaggauggg

SEQ ID NO: 2373684 - RNA, 17 nt, Bordetella pertussis
gcgcugcagcgucugcu

SEQ ID NO: 2373685 - RNA, 19 nt, Bordetella pertussis
gcgcugcagcgucugcugg

SEQ ID NO: 2373686 - RNA, 19 nt, Bordetella pertussis
gcgcugcaggaucgcggcc

SEQ ID NO: 2373687 - RNA, 22 nt, Bordetella pertussis
gcgcugcaggaucgcggccagc

SEQ ID NO: 2373688 - RNA, 16 nt, Bordetella pertussis
gcgcugcauacgccgc

SEQ ID NO: 2373689 - RNA, 18 nt, Bordetella pertussis
gcgcugcauacgccgcug

SEQ ID NO: 2373690 - RNA, 13 nt, Bordetella pertussis
gcgcugccagcca

SEQ ID NO: 2373691 - RNA, 22 nt, Bordetella pertussis
gcgcugcccaccgccguggccg

SEQ ID NO: 2373692 - RNA, 18 nt, Bordetella pertussis
gcgcugggcgccagcagc

SEQ ID NO: 2373693 - RNA, 20 nt, Bordetella pertussis
gcgcugggcgccagcagcac

SEQ ID NO: 2373694 - RNA, 21 nt, Bordetella pertussis
gcgcugggcgccagcagcacg

SEQ ID NO: 2373695 - RNA, 14 nt, Bordetella pertussis
gcgcugggcgcugc

SEQ ID NO: 2373696 - RNA, 15 nt, Bordetella pertussis
gcgcugggcgcugcu

SEQ ID NO: 2373697 - RNA, 14 nt, Bordetella pertussis
gcgcugggcguggc

SEQ ID NO: 2373698 - RNA, 15 nt, Bordetella pertussis
gcgcuggggaagcgc

SEQ ID NO: 2373699 - RNA, 14 nt, Bordetella pertussis
gcgcuggggcagca

SEQ ID NO: 2373700 - RNA, 21 nt, Bordetella pertussis
gcgcuggggcaggacgccggc

SEQ ID NO: 2373701 - RNA, 18 nt, Bordetella pertussis
gcgcugguaaagggcgcg

SEQ ID NO: 2373702 - RNA, 16 nt, Bordetella pertussis
gcgcugguccgccgcc

SEQ ID NO: 2373703 - RNA, 17 nt, Bordetella pertussis
gcgcuggucgcgcagca

SEQ ID NO: 2373704 - RNA, 23 nt, Bordetella pertussis
gcgcuggucgcgcagcacgaugg

SEQ ID NO: 2373705 - RNA, 22 nt, Bordetella pertussis
gcgcuggucgggaugccccgcc

SEQ ID NO: 2373706 - RNA, 13 nt, Bordetella pertussis
gcgcuggugcugg

SEQ ID NO: 2373707 - RNA, 16 nt, Bordetella pertussis
gcgcuggugcuggccg

SEQ ID NO: 2373708 - RNA, 17 nt, Bordetella pertussis
gcgcuggugcuggccga

SEQ ID NO: 2373709 - RNA, 15 nt, Bordetella pertussis
gcgcugguggccaga

SEQ ID NO: 2373710 - RNA, 15 nt, Bordetella pertussis
gcgcuguaggcgccg

SEQ ID NO: 2373711 - RNA, 18 nt, Bordetella pertussis
gcgcuguaggcgccggcg

SEQ ID NO: 2373712 - RNA, 19 nt, Bordetella pertussis
gcgcuguaggcgccggcgc

SEQ ID NO: 2373713 - RNA, 15 nt, Bordetella pertussis
gcgcuguccaggccg

SEQ ID NO: 2373714 - RNA, 17 nt, Bordetella pertussis
gcgcuguccaggccggg

SEQ ID NO: 2373715 - RNA, 19 nt, Bordetella pertussis
gcgcuguccaggccggggc

SEQ ID NO: 2373716 - RNA, 20 nt, Bordetella pertussis
gcgcuguccaggccggggcc

SEQ ID NO: 2373717 - RNA, 19 nt, Bordetella pertussis
gcgcuguccgaugcgcugc

SEQ ID NO: 2373718 - RNA, 20 nt, Bordetella pertussis
gcgcuguccgaugcgcugcu

SEQ ID NO: 2373719 - RNA, 22 nt, Bordetella pertussis
gcgcuguccgaugcgcugcugg

SEQ ID NO: 2373720 - RNA, 20 nt, Bordetella pertussis
gcgcuguccggcgcucgccc

SEQ ID NO: 2373721 - RNA, 22 nt, Bordetella pertussis
gcgcuguccggcgcucgccccg

SEQ ID NO: 2373722 - RNA, 14 nt, Bordetella pertussis
gcgcugugcgacga

SEQ ID NO: 2373723 - RNA, 19 nt, Bordetella pertussis
gcgcugugcgacgauccgg

SEQ ID NO: 2373724 - RNA, 15 nt, Bordetella pertussis
gcgcuguuccagcca

SEQ ID NO: 2373725 - RNA, 17 nt, Bordetella pertussis
gcgcuguuccagccagu

SEQ ID NO: 2373726 - RNA, 17 nt, Bordetella pertussis
gcgcuguucgggcgcgg

SEQ ID NO: 2373727 - RNA, 18 nt, Bordetella pertussis
gcgcuguucgggcgcggu

SEQ ID NO: 2373728 - RNA, 20 nt, Bordetella pertussis
gcgcuguugcuccaggccgg

SEQ ID NO: 2373729 - RNA, 22 nt, Bordetella pertussis
gcgcuguugcuccaggccggca

SEQ ID NO: 2373730 - RNA, 16 nt, Bordetella pertussis
gcgcuguuggccggcg

SEQ ID NO: 2373731 - RNA, 20 nt, Bordetella pertussis
gcgcuguuggccggcgcgcc

SEQ ID NO: 2373732 - RNA, 21 nt, Bordetella pertussis
gcgcuguuggccggcgcgccc

SEQ ID NO: 2373733 - RNA, 22 nt, Bordetella pertussis
gcgcuguuggccggcgcgcccu

SEQ ID NO: 2373734 - RNA, 18 nt, Bordetella pertussis
gcgcuguuucccuuccug

SEQ ID NO: 2373735 - RNA, 19 nt, Bordetella pertussis
gcgcuguuucccuuccugg

SEQ ID NO: 2373736 - RNA, 22 nt, Bordetella pertussis
gcgcuguuucccuuccuggcca

SEQ ID NO: 2373737 - RNA, 17 nt, Bordetella pertussis
gcgcuguuuccgggccu

SEQ ID NO: 2373738 - RNA, 19 nt, Bordetella pertussis
gcgcuguuuccgggccugg

SEQ ID NO: 2373739 - RNA, 22 nt, Bordetella pertussis
gcgcuguuuccgggccuggccu

SEQ ID NO: 2373740 - RNA, 23 nt, Bordetella pertussis
gcgcuguuuccgggccuggccug

SEQ ID NO: 2373741 - RNA, 16 nt, Bordetella pertussis
gcgcuuaccgcgccgg

SEQ ID NO: 2373742 - RNA, 16 nt, Bordetella pertussis
gcgcuucaggcgccgc

SEQ ID NO: 2373743 - RNA, 18 nt, Bordetella pertussis
gcgcuucaggcgccgcag

SEQ ID NO: 2373744 - RNA, 23 nt, Bordetella pertussis
gcgcuucaggcgccgcagauggc

SEQ ID NO: 2373745 - RNA, 18 nt, Bordetella pertussis
gcgcuucagugcucgggc

SEQ ID NO: 2373746 - RNA, 14 nt, Bordetella pertussis
gcgcuucgagccgg

SEQ ID NO: 2373747 - RNA, 17 nt, Bordetella pertussis
gcgcuucgucggccgcc

SEQ ID NO: 2373748 - RNA, 16 nt, Bordetella pertussis
gcgcuucucggugcgc

SEQ ID NO: 2373749 - RNA, 21 nt, Bordetella pertussis
gcgcuucucggugcgccgccg

SEQ ID NO: 2373750 - RNA, 20 nt, Bordetella pertussis
gcgcuucugccagacggcca

SEQ ID NO: 2373751 - RNA, 21 nt, Bordetella pertussis
gcgcuucugccagacggccag

SEQ ID NO: 2373752 - RNA, 14 nt, Bordetella pertussis
gcgcuucuuggcga

SEQ ID NO: 2373753 - RNA, 17 nt, Bordetella pertussis
gcgcuucuuggcgacca

SEQ ID NO: 2373754 - RNA, 23 nt, Bordetella pertussis
gcgcuugaaaugcguggcgugcc

SEQ ID NO: 2373755 - RNA, 15 nt, Bordetella pertussis
gcgcuugaccgccuc

SEQ ID NO: 2373756 - RNA, 16 nt, Bordetella pertussis
gcgcuugaccgccucg

SEQ ID NO: 2373757 - RNA, 12 nt, Bordetella pertussis
gcgcuugacggc

SEQ ID NO: 2373758 - RNA, 18 nt, Bordetella pertussis
gcgcuugagcggcucgcc

SEQ ID NO: 2373759 - RNA, 17 nt, Bordetella pertussis
gcgcuugaggcugguga

SEQ ID NO: 2373760 - RNA, 13 nt, Bordetella pertussis
gcgcuugcacgcc

SEQ ID NO: 2373761 - RNA, 14 nt, Bordetella pertussis
gcgcuugcacgcca

SEQ ID NO: 2373762 - RNA, 12 nt, Bordetella pertussis
gcgcuugccgcc

SEQ ID NO: 2373763 - RNA, 15 nt, Bordetella pertussis
gcgcuugccgcccac

SEQ ID NO: 2373764 - RNA, 17 nt, Bordetella pertussis
gcgcuugccugacgugc

SEQ ID NO: 2373765 - RNA, 12 nt, Bordetella pertussis
gcgcuugcgcag

SEQ ID NO: 2373766 - RNA, 13 nt, Bordetella pertussis
gcgcuugcgcagg

SEQ ID NO: 2373767 - RNA, 15 nt, Bordetella pertussis
gcgcuugcgcagggc

SEQ ID NO: 2373768 - RNA, 15 nt, Bordetella pertussis
gcgcuugcgcauggc

SEQ ID NO: 2373769 - RNA, 13 nt, Bordetella pertussis
gcgcuugcggccg

SEQ ID NO: 2373770 - RNA, 14 nt, Bordetella pertussis
gcgcuugcggccgu

SEQ ID NO: 2373771 - RNA, 21 nt, Bordetella pertussis
gcgcuugcucggugcgggccg

SEQ ID NO: 2373772 - RNA, 14 nt, Bordetella pertussis
gcgcuuggcaggcg

SEQ ID NO: 2373773 - RNA, 17 nt, Bordetella pertussis
gcgcuuggccagcuggc

SEQ ID NO: 2373774 - RNA, 19 nt, Bordetella pertussis
gcgcuuggccagcuggcgc

SEQ ID NO: 2373775 - RNA, 13 nt, Bordetella pertussis
gcgcuuggcccug

SEQ ID NO: 2373776 - RNA, 14 nt, Bordetella pertussis
gcgcuuggcccugc

SEQ ID NO: 2373777 - RNA, 15 nt, Bordetella pertussis
gcgcuuggcccugca

SEQ ID NO: 2373778 - RNA, 17 nt, Bordetella pertussis
gcgcuuggcccugcagc

SEQ ID NO: 2373779 - RNA, 17 nt, Bordetella pertussis
gcgcuuggucagcauca

SEQ ID NO: 2373780 - RNA, 14 nt, Bordetella pertussis
gcgcuugucgccgc

SEQ ID NO: 2373781 - RNA, 16 nt, Bordetella pertussis
gcgcuugucgccgcug

SEQ ID NO: 2373782 - RNA, 14 nt, Bordetella pertussis
gcgcuugugcgucg

SEQ ID NO: 2373783 - RNA, 15 nt, Bordetella pertussis
gcgcuuguggucggc

SEQ ID NO: 2373784 - RNA, 20 nt, Bordetella pertussis
gcgcuuuuuucuccagcgcc

SEQ ID NO: 2373785 - RNA, 21 nt, Bordetella pertussis
gcgcuuuuuucuccagcgcca

SEQ ID NO: 2373786 - RNA, 18 nt, Bordetella pertussis
gcggaaaacagcaccagc

SEQ ID NO: 2373787 - RNA, 21 nt, Bordetella pertussis
gcggaaaacagcaccagcaug

SEQ ID NO: 2373788 - RNA, 16 nt, Bordetella pertussis
gcggaaacgcgcgcgc

SEQ ID NO: 2373789 - RNA, 18 nt, Bordetella pertussis
gcggaaacgcgcgcgccc

SEQ ID NO: 2373790 - RNA, 19 nt, Bordetella pertussis
gcggaaauccgggcgcugc

SEQ ID NO: 2373791 - RNA, 20 nt, Bordetella pertussis
gcggaaauccgggcgcugcg

SEQ ID NO: 2373792 - RNA, 13 nt, Bordetella pertussis
gcggaaggcuugu

SEQ ID NO: 2373793 - RNA, 19 nt, Bordetella pertussis
gcggaaggcuuguacccca

SEQ ID NO: 2373794 - RNA, 20 nt, Bordetella pertussis
gcggaaguauucgcgcggcg

SEQ ID NO: 2373795 - RNA, 23 nt, Bordetella pertussis
gcggaaguauucgcgcggcgaca

SEQ ID NO: 2373796 - RNA, 19 nt, Bordetella pertussis
gcggaagucgggcaccagc

SEQ ID NO: 2373797 - RNA, 21 nt, Bordetella pertussis
gcggaaugaugguggggcugg

SEQ ID NO: 2373798 - RNA, 21 nt, Bordetella pertussis
gcggaaugucguugcacagca

SEQ ID NO: 2373799 - RNA, 17 nt, Bordetella pertussis
gcggacacgcccuggcc

SEQ ID NO: 2373800 - RNA, 23 nt, Bordetella pertussis
gcggacacgcccuggccguacau

SEQ ID NO: 2373801 - RNA, 22 nt, Bordetella pertussis
gcggaccagcgguugcgccagc

SEQ ID NO: 2373802 - RNA, 18 nt, Bordetella pertussis
gcggacccaggccucggc

SEQ ID NO: 2373803 - RNA, 22 nt, Bordetella pertussis
gcggacccaggccucggcuugc

SEQ ID NO: 2373804 - RNA, 23 nt, Bordetella pertussis
gcggacccaguucggccgccagg

SEQ ID NO: 2373805 - RNA, 17 nt, Bordetella pertussis
gcggcacaaccuggcgc

SEQ ID NO: 2373806 - RNA, 19 nt, Bordetella pertussis
gcggcacaaccuggcgcgc

SEQ ID NO: 2373807 - RNA, 13 nt, Bordetella pertussis
gcggcaccagcag

SEQ ID NO: 2373808 - RNA, 15 nt, Bordetella pertussis
gcggcaccagcaggc

SEQ ID NO: 2373809 - RNA, 19 nt, Bordetella pertussis
gcggcaccagcaggccggu

SEQ ID NO: 2373810 - RNA, 13 nt, Bordetella pertussis
gcggcaccgcgca

SEQ ID NO: 2373811 - RNA, 14 nt, Bordetella pertussis
gcggcaccgcgcag

SEQ ID NO: 2373812 - RNA, 19 nt, Bordetella pertussis
gcggcaccgcgcagcccgg

SEQ ID NO: 2373813 - RNA, 13 nt, Bordetella pertussis
gcggcaccucggc

SEQ ID NO: 2373814 - RNA, 15 nt, Bordetella pertussis
gcggcaccucggccg

SEQ ID NO: 2373815 - RNA, 17 nt, Bordetella pertussis
gcggcaccucggccggg

SEQ ID NO: 2373816 - RNA, 21 nt, Bordetella pertussis
gcggcaccucggccggggcgg

SEQ ID NO: 2373817 - RNA, 13 nt, Bordetella pertussis
gcggcaccugcug

SEQ ID NO: 2373818 - RNA, 19 nt, Bordetella pertussis
gcggcaccugcugcuugac

SEQ ID NO: 2373819 - RNA, 19 nt, Bordetella pertussis
gcggcacgaaaagccgcgg

SEQ ID NO: 2373820 - RNA, 20 nt, Bordetella pertussis
gcggcacgaaaagccgcggc

SEQ ID NO: 2373821 - RNA, 21 nt, Bordetella pertussis
gcggcacgaaaagccgcggcc

SEQ ID NO: 2373822 - RNA, 17 nt, Bordetella pertussis
gcggcacgacgucgucg

SEQ ID NO: 2373823 - RNA, 18 nt, Bordetella pertussis
gcggcacgaucggcgccu

SEQ ID NO: 2373824 - RNA, 16 nt, Bordetella pertussis
gcggcacgauuucgcc

SEQ ID NO: 2373825 - RNA, 15 nt, Bordetella pertussis
gcggcacgcacagca

SEQ ID NO: 2373826 - RNA, 16 nt, Bordetella pertussis
gcggcacgccggcggc

SEQ ID NO: 2373827 - RNA, 15 nt, Bordetella pertussis
gcggcacgcgcgccg

SEQ ID NO: 2373828 - RNA, 18 nt, Bordetella pertussis
gcggcacgcgcgccggca

SEQ ID NO: 2373829 - RNA, 22 nt, Bordetella pertussis
gcggcacgcgcgccggcagggu

SEQ ID NO: 2373830 - RNA, 13 nt, Bordetella pertussis
gcggcacgcugcg

SEQ ID NO: 2373831 - RNA, 13 nt, Bordetella pertussis
gcggcacgcugcu

SEQ ID NO: 2373832 - RNA, 14 nt, Bordetella pertussis
gcggcacggccagc

SEQ ID NO: 2373833 - RNA, 17 nt, Bordetella pertussis
gcggcacggccagcggc

SEQ ID NO: 2373834 - RNA, 14 nt, Bordetella pertussis
gcggcacggccggc

SEQ ID NO: 2373835 - RNA, 13 nt, Bordetella pertussis
gcggcacgguggc

SEQ ID NO: 2373836 - RNA, 23 nt, Bordetella pertussis
gcggcacgguggcgaaggccgcc

SEQ ID NO: 2373837 - RNA, 13 nt, Bordetella pertussis
gcggcacgguuuc

SEQ ID NO: 2373838 - RNA, 14 nt, Bordetella pertussis
gcggcacgugccgg

SEQ ID NO: 2373839 - RNA, 15 nt, Bordetella pertussis
gcggcacgugccgga

SEQ ID NO: 2373840 - RNA, 19 nt, Bordetella pertussis
gcggcacgugccggauggc

SEQ ID NO: 2373841 - RNA, 17 nt, Bordetella pertussis
gcggcacugaugcuggu

SEQ ID NO: 2373842 - RNA, 19 nt, Bordetella pertussis
gcggcacugaugcugguca

SEQ ID NO: 2373843 - RNA, 22 nt, Bordetella pertussis
gcggcagaucuccggauccagc

SEQ ID NO: 2373844 - RNA, 12 nt, Bordetella pertussis
gcggcagcacga

SEQ ID NO: 2373845 - RNA, 19 nt, Bordetella pertussis
gcggcagcacgauggcgcc

SEQ ID NO: 2373846 - RNA, 22 nt, Bordetella pertussis
gcggcagcacgauggcgcccac

SEQ ID NO: 2373847 - RNA, 12 nt, Bordetella pertussis
gcggcagcagcg

SEQ ID NO: 2373848 - RNA, 11 nt, Bordetella pertussis
gcggcagcagg

SEQ ID NO: 2373849 - RNA, 14 nt, Bordetella pertussis
gcggcagcagggcc

SEQ ID NO: 2373850 - RNA, 22 nt, Bordetella pertussis
gcggcagcagggccacgcccag

SEQ ID NO: 2373851 - RNA, 14 nt, Bordetella pertussis
gcggcagcauggcg

SEQ ID NO: 2373852 - RNA, 21 nt, Bordetella pertussis
gcggcagcauggcgcgcgggc

SEQ ID NO: 2373853 - RNA, 14 nt, Bordetella pertussis
gcggcagccaggug

SEQ ID NO: 2373854 - RNA, 23 nt, Bordetella pertussis
gcggcagccagguggcgaugccg

SEQ ID NO: 2373855 - RNA, 14 nt, Bordetella pertussis
gcggcagcccggca

SEQ ID NO: 2373856 - RNA, 16 nt, Bordetella pertussis
gcggcagcccggcacg

SEQ ID NO: 2373857 - RNA, 21 nt, Bordetella pertussis
gcggcagccggccauggccgc

SEQ ID NO: 2373858 - RNA, 12 nt, Bordetella pertussis
gcggcagccugg

SEQ ID NO: 2373859 - RNA, 18 nt, Bordetella pertussis
gcggcagccuggggcgag

SEQ ID NO: 2373860 - RNA, 15 nt, Bordetella pertussis
gcggcagcgcaccgu

SEQ ID NO: 2373861 - RNA, 20 nt, Bordetella pertussis
gcggcagcgcaccgucgcca

SEQ ID NO: 2373862 - RNA, 21 nt, Bordetella pertussis
gcggcagcgcaccgucgccag

SEQ ID NO: 2373863 - RNA, 12 nt, Bordetella pertussis
gcggcagcgccg

SEQ ID NO: 2373864 - RNA, 16 nt, Bordetella pertussis
gcggcagcgccggguc

SEQ ID NO: 2373865 - RNA, 21 nt, Bordetella pertussis
gcggcagcgcgaacggcgggc

SEQ ID NO: 2373866 - RNA, 22 nt, Bordetella pertussis
gcggcagcgcguauuccggguc

SEQ ID NO: 2373867 - RNA, 14 nt, Bordetella pertussis
gcggcagcggccca

SEQ ID NO: 2373868 - RNA, 19 nt, Bordetella pertussis
gcggcagcucggcgaagcc

SEQ ID NO: 2373869 - RNA, 20 nt, Bordetella pertussis
gcggcagcucggcgaagccg

SEQ ID NO: 2373870 - RNA, 22 nt, Bordetella pertussis
gcggcagcucggcgaagccgca

SEQ ID NO: 2373871 - RNA, 21 nt, Bordetella pertussis
gcggcagcuugaccgccucca

SEQ ID NO: 2373872 - RNA, 15 nt, Bordetella pertussis
gcggcaggcccagcu

SEQ ID NO: 2373873 - RNA, 15 nt, Bordetella pertussis
gcggcaggccccggc

SEQ ID NO: 2373874 - RNA, 17 nt, Bordetella pertussis
gcggcaggccccggccc

SEQ ID NO: 2373875 - RNA, 21 nt, Bordetella pertussis
gcggcaggccccggcccggcg

SEQ ID NO: 2373876 - RNA, 16 nt, Bordetella pertussis
gcggcaggcccugccg

SEQ ID NO: 2373877 - RNA, 18 nt, Bordetella pertussis
gcggcaggcccugccgcc

SEQ ID NO: 2373878 - RNA, 12 nt, Bordetella pertussis
gcggcaggccgc

SEQ ID NO: 2373879 - RNA, 13 nt, Bordetella pertussis
gcggcaggccgca

SEQ ID NO: 2373880 - RNA, 15 nt, Bordetella pertussis
gcggcaggccgcagc

SEQ ID NO: 2373881 - RNA, 16 nt, Bordetella pertussis
gcggcaggccgcgcca

SEQ ID NO: 2373882 - RNA, 20 nt, Bordetella pertussis
gcggcaggccgcgccacagg

SEQ ID NO: 2373883 - RNA, 15 nt, Bordetella pertussis
gcggcaggcgccgcc

SEQ ID NO: 2373884 - RNA, 16 nt, Bordetella pertussis
gcggcaggcgccgccg

SEQ ID NO: 2373885 - RNA, 17 nt, Bordetella pertussis
gcggcaggcgccgccgc

SEQ ID NO: 2373886 - RNA, 21 nt, Bordetella pertussis
gcggcaggcgccgccgcccgg

SEQ ID NO: 2373887 - RNA, 13 nt, Bordetella pertussis
gcggcaggcgcga

SEQ ID NO: 2373888 - RNA, 13 nt, Bordetella pertussis
gcggcaggcggca

SEQ ID NO: 2373889 - RNA, 15 nt, Bordetella pertussis
gcggcaggcggcaga

SEQ ID NO: 2373890 - RNA, 23 nt, Bordetella pertussis
gcggcaggcggugcggaggcggc

SEQ ID NO: 2373891 - RNA, 16 nt, Bordetella pertussis
gcggcaggcuggccgg

SEQ ID NO: 2373892 - RNA, 18 nt, Bordetella pertussis
gcggcaggcuggccggcg

SEQ ID NO: 2373893 - RNA, 23 nt, Bordetella pertussis
gcggcaggcuggccggcguggcc

SEQ ID NO: 2373894 - RNA, 19 nt, Bordetella pertussis
gcggcagggccuccugcag

SEQ ID NO: 2373895 - RNA, 13 nt, Bordetella pertussis
gcggcagggcguc

SEQ ID NO: 2373896 - RNA, 18 nt, Bordetella pertussis
gcggcaggggcucgcgcc

SEQ ID NO: 2373897 - RNA, 21 nt, Bordetella pertussis
gcggcaggggcucgcgcccga

SEQ ID NO: 2373898 - RNA, 18 nt, Bordetella pertussis
gcggcagggugugccugu

SEQ ID NO: 2373899 - RNA, 13 nt, Bordetella pertussis
gcggcaggucgcg

SEQ ID NO: 2373900 - RNA, 14 nt, Bordetella pertussis
gcggcaggucgggu

SEQ ID NO: 2373901 - RNA, 14 nt, Bordetella pertussis
gcggcaggugcgcc

SEQ ID NO: 2373902 - RNA, 16 nt, Bordetella pertussis
gcggcaggugcgccag

SEQ ID NO: 2373903 - RNA, 18 nt, Bordetella pertussis
gcggcaggugcgccagca

SEQ ID NO: 2373904 - RNA, 17 nt, Bordetella pertussis
gcggcaggugcgucacg

SEQ ID NO: 2373905 - RNA, 23 nt, Bordetella pertussis
gcggcaggugcgucacgcacagc

SEQ ID NO: 2373906 - RNA, 24 nt, Bordetella pertussis
gcggcaggugcgucacgcacagca

SEQ ID NO: 2373907 - RNA, 20 nt, Bordetella pertussis
gcggcagguucugcgcgucc

SEQ ID NO: 2373908 - RNA, 19 nt, Bordetella pertussis
gcggcauacgccgauggcg

SEQ ID NO: 2373909 - RNA, 21 nt, Bordetella pertussis
gcggcauacgccgauggcgcg

SEQ ID NO: 2373910 - RNA, 20 nt, Bordetella pertussis
gcggcauagcccaggccgcc

SEQ ID NO: 2373911 - RNA, 21 nt, Bordetella pertussis
gcggcaucgacaugcccgccg

SEQ ID NO: 2373912 - RNA, 18 nt, Bordetella pertussis
gcggcaucggccauggcg

SEQ ID NO: 2373913 - RNA, 22 nt, Bordetella pertussis
gcggcaucggccauggcgguga

SEQ ID NO: 2373914 - RNA, 22 nt, Bordetella pertussis
gcggcaucguaguugggcgccu

SEQ ID NO: 2373915 - RNA, 13 nt, Bordetella pertussis
gcggcaucguuca

SEQ ID NO: 2373916 - RNA, 17 nt, Bordetella pertussis
gcggcaucguucaggcg

SEQ ID NO: 2373917 - RNA, 19 nt, Bordetella pertussis
gcggcaucguucaggcgca

SEQ ID NO: 2373918 - RNA, 19 nt, Bordetella pertussis
gcggccaucgccgccacgu

SEQ ID NO: 2373919 - RNA, 14 nt, Bordetella pertussis
gcggccaugacggc

SEQ ID NO: 2373920 - RNA, 22 nt, Bordetella pertussis
gcggccaugacggccauccggc

SEQ ID NO: 2373921 - RNA, 16 nt, Bordetella pertussis
gcggccaugcccaggc

SEQ ID NO: 2373922 - RNA, 17 nt, Bordetella pertussis
gcggccaugcccaggcc

SEQ ID NO: 2373923 - RNA, 21 nt, Bordetella pertussis
gcggccaugcccaggcccagu

SEQ ID NO: 2373924 - RNA, 14 nt, Bordetella pertussis
gcggccaugccgac

SEQ ID NO: 2373925 - RNA, 16 nt, Bordetella pertussis
gcggccaugccgacgg

SEQ ID NO: 2373926 - RNA, 13 nt, Bordetella pertussis
gcggccaugccgg

SEQ ID NO: 2373927 - RNA, 15 nt, Bordetella pertussis
gcggccaugccguca

SEQ ID NO: 2373928 - RNA, 17 nt, Bordetella pertussis
gcggccaugcgccgcuu

SEQ ID NO: 2373929 - RNA, 19 nt, Bordetella pertussis
gcggccaugcggugcgccg

SEQ ID NO: 2373930 - RNA, 15 nt, Bordetella pertussis
gcggccauguccagc

SEQ ID NO: 2373931 - RNA, 16 nt, Bordetella pertussis
gcggccauguccagca

SEQ ID NO: 2373932 - RNA, 15 nt, Bordetella pertussis
gcggcccacagcgcc

SEQ ID NO: 2373933 - RNA, 18 nt, Bordetella pertussis
gcggcccacagcgccccc

SEQ ID NO: 2373934 - RNA, 21 nt, Bordetella pertussis
gcggcccacagcgcccccagc

SEQ ID NO: 2373935 - RNA, 22 nt, Bordetella pertussis
gcggcccacagcgcccccagca

SEQ ID NO: 2373936 - RNA, 22 nt, Bordetella pertussis
gcggcccacccggcacgcgccg

SEQ ID NO: 2373937 - RNA, 23 nt, Bordetella pertussis
gcggcccacccggcacgcgccga

SEQ ID NO: 2373938 - RNA, 13 nt, Bordetella pertussis
gcggcccacggcc

SEQ ID NO: 2373939 - RNA, 17 nt, Bordetella pertussis
gcggcccacggccagca

SEQ ID NO: 2373940 - RNA, 18 nt, Bordetella pertussis
gcggcccagccgcucggc

SEQ ID NO: 2373941 - RNA, 13 nt, Bordetella pertussis
gcggcccagcgcg

SEQ ID NO: 2373942 - RNA, 14 nt, Bordetella pertussis
gcggcccagcgcgg

SEQ ID NO: 2373943 - RNA, 18 nt, Bordetella pertussis
gcggcccagcgcggcggc

SEQ ID NO: 2373944 - RNA, 13 nt, Bordetella pertussis
gcggcccagcggc

SEQ ID NO: 2373945 - RNA, 15 nt, Bordetella pertussis
gcggcccagcggcaa

SEQ ID NO: 2373946 - RNA, 13 nt, Bordetella pertussis
gcggcccaggcgu

SEQ ID NO: 2373947 - RNA, 16 nt, Bordetella pertussis
gcggcccaggcgucca

SEQ ID NO: 2373948 - RNA, 19 nt, Bordetella pertussis
gcggcccauucgcgcaccg

SEQ ID NO: 2373949 - RNA, 20 nt, Bordetella pertussis
gcggcccauucgcgcaccga

SEQ ID NO: 2373950 - RNA, 15 nt, Bordetella pertussis
gcggccccagucgcu

SEQ ID NO: 2373951 - RNA, 17 nt, Bordetella pertussis
gcggccccagucgcugc

SEQ ID NO: 2373952 - RNA, 20 nt, Bordetella pertussis
gcggccccaugcgcggcacg

SEQ ID NO: 2373953 - RNA, 14 nt, Bordetella pertussis
gcggccccggcacc

SEQ ID NO: 2373954 - RNA, 20 nt, Bordetella pertussis
gcggccccucaaggggugga

SEQ ID NO: 2373955 - RNA, 13 nt, Bordetella pertussis
gcggcccgcaugu

SEQ ID NO: 2373956 - RNA, 13 nt, Bordetella pertussis
gcggcccgccacg

SEQ ID NO: 2373957 - RNA, 13 nt, Bordetella pertussis
gcggcccgccagg

SEQ ID NO: 2373958 - RNA, 14 nt, Bordetella pertussis
gcggcccgccaggg

SEQ ID NO: 2373959 - RNA, 16 nt, Bordetella pertussis
gcggcccgccagggcg

SEQ ID NO: 2373960 - RNA, 14 nt, Bordetella pertussis
gcggcccgcccgcg

SEQ ID NO: 2373961 - RNA, 20 nt, Bordetella pertussis
gcggcccgcccgcggaucgg

SEQ ID NO: 2373962 - RNA, 16 nt, Bordetella pertussis
gcggcccgccgacugg

SEQ ID NO: 2373963 - RNA, 13 nt, Bordetella pertussis
gcggcccgcgccc

SEQ ID NO: 2373964 - RNA, 17 nt, Bordetella pertussis
gcggcccgcgcccugcu

SEQ ID NO: 2373965 - RNA, 14 nt, Bordetella pertussis
gcggcccgcggccu

SEQ ID NO: 2373966 - RNA, 15 nt, Bordetella pertussis
gcggcccgcggccuu

SEQ ID NO: 2373967 - RNA, 14 nt, Bordetella pertussis
gcggcccgcuccag

SEQ ID NO: 2373968 - RNA, 16 nt, Bordetella pertussis
gcggcccgcuccaggc

SEQ ID NO: 2373969 - RNA, 19 nt, Bordetella pertussis
gcggcccgcuccaggcggc

SEQ ID NO: 2373970 - RNA, 23 nt, Bordetella pertussis
gcggcccgcuccaggcggccagu

SEQ ID NO: 2373971 - RNA, 12 nt, Bordetella pertussis
gcggcccggcca

SEQ ID NO: 2373972 - RNA, 13 nt, Bordetella pertussis
gcggcccggccaa

SEQ ID NO: 2373973 - RNA, 13 nt, Bordetella pertussis
gcggcccggccgc

SEQ ID NO: 2373974 - RNA, 21 nt, Bordetella pertussis
gcggcccggccgccgccggca

SEQ ID NO: 2373975 - RNA, 18 nt, Bordetella pertussis
gcggcccggcggcaaaaa

SEQ ID NO: 2373976 - RNA, 17 nt, Bordetella pertussis
gcggcccguagcuggac

SEQ ID NO: 2373977 - RNA, 13 nt, Bordetella pertussis
gcggcccugggcc

SEQ ID NO: 2373978 - RNA, 14 nt, Bordetella pertussis
gcggcccugggcca

SEQ ID NO: 2373979 - RNA, 18 nt, Bordetella pertussis
gcggcccugggccagcca

SEQ ID NO: 2373980 - RNA, 21 nt, Bordetella pertussis
gcggcccugggccagccagcg

SEQ ID NO: 2373981 - RNA, 23 nt, Bordetella pertussis
gcggcccugggccagccagcgcc

SEQ ID NO: 2373982 - RNA, 16 nt, Bordetella pertussis
gcggcccuggucgucg

SEQ ID NO: 2373983 - RNA, 17 nt, Bordetella pertussis
gcggcccuggucgucgc

SEQ ID NO: 2373984 - RNA, 20 nt, Bordetella pertussis
gcggcccuggucgucgcggc

SEQ ID NO: 2373985 - RNA, 17 nt, Bordetella pertussis
gcggcccuguucgcgcg

SEQ ID NO: 2373986 - RNA, 20 nt, Bordetella pertussis
gcggcccuguucgcgcggcc

SEQ ID NO: 2373987 - RNA, 13 nt, Bordetella pertussis
gcggcccuugcgc

SEQ ID NO: 2373988 - RNA, 19 nt, Bordetella pertussis
gcggcccuugcgcgaacgg

SEQ ID NO: 2373989 - RNA, 19 nt, Bordetella pertussis
gcggcccuugcgcgaaggc

SEQ ID NO: 2373990 - RNA, 20 nt, Bordetella pertussis
gcggcccuugcgcgaaggcc

SEQ ID NO: 2373991 - RNA, 22 nt, Bordetella pertussis
gcggcccuugcgcgaaggccgc

SEQ ID NO: 2373992 - RNA, 16 nt, Bordetella pertussis
gcggccgaagcgcaag

SEQ ID NO: 2373993 - RNA, 21 nt, Bordetella pertussis
gcggccgaagcgcaagcccag

SEQ ID NO: 2373994 - RNA, 14 nt, Bordetella pertussis
gcggccgaccagca

SEQ ID NO: 2373995 - RNA, 17 nt, Bordetella pertussis
gcggccgacgggcggcu

SEQ ID NO: 2373996 - RNA, 21 nt, Bordetella pertussis
gcggccgacgggcggcugcug

SEQ ID NO: 2373997 - RNA, 14 nt, Bordetella pertussis
gcggccgagcgggc

SEQ ID NO: 2373998 - RNA, 16 nt, Bordetella pertussis
gcggccgagcgggcca

SEQ ID NO: 2373999 - RNA, 17 nt, Bordetella pertussis
gcggccgagcgggccag

SEQ ID NO: 2374000 - RNA, 15 nt, Bordetella pertussis
gcggccgagcuccuc

SEQ ID NO: 2374001 - RNA, 17 nt, Bordetella pertussis
gcggccgaggccagcgu

SEQ ID NO: 2374002 - RNA, 19 nt, Bordetella pertussis
gcggccgaggccagcgugc

SEQ ID NO: 2374003 - RNA, 15 nt, Bordetella pertussis
gcggccgaggucggc

SEQ ID NO: 2374004 - RNA, 18 nt, Bordetella pertussis
gcggccgaggucggcggu

SEQ ID NO: 2374005 - RNA, 21 nt, Bordetella pertussis
gcggccgaggucggcggucca

SEQ ID NO: 2374006 - RNA, 16 nt, Bordetella pertussis
gcggccgauagccgug

SEQ ID NO: 2374007 - RNA, 20 nt, Bordetella pertussis
gcggccgauagccgugaccu

SEQ ID NO: 2374008 - RNA, 23 nt, Bordetella pertussis
gcggccgauagccgugaccugcu

SEQ ID NO: 2374009 - RNA, 12 nt, Bordetella pertussis
gcggccgcagca

SEQ ID NO: 2374010 - RNA, 12 nt, Bordetella pertussis
gcggccgcagcg

SEQ ID NO: 2374011 - RNA, 13 nt, Bordetella pertussis
gcggccgcagcgg

SEQ ID NO: 2374012 - RNA, 16 nt, Bordetella pertussis
gcggccgccagcccga

SEQ ID NO: 2374013 - RNA, 13 nt, Bordetella pertussis
gcggccgccagcg

SEQ ID NO: 2374014 - RNA, 15 nt, Bordetella pertussis
gcggccgccagcgcc

SEQ ID NO: 2374015 - RNA, 16 nt, Bordetella pertussis
gcggccgccagcgcca

SEQ ID NO: 2374016 - RNA, 13 nt, Bordetella pertussis
gcggccgcccagc

SEQ ID NO: 2374017 - RNA, 13 nt, Bordetella pertussis
gcggccgccgcca

SEQ ID NO: 2374018 - RNA, 16 nt, Bordetella pertussis
gcggccgccgccagcg

SEQ ID NO: 2374019 - RNA, 23 nt, Bordetella pertussis
gcggccgccggcggcgccggccu

SEQ ID NO: 2374020 - RNA, 13 nt, Bordetella pertussis
gcggccgccugcg

SEQ ID NO: 2374021 - RNA, 16 nt, Bordetella pertussis
gcggccgccugcgccg

SEQ ID NO: 2374022 - RNA, 20 nt, Bordetella pertussis
gcggccgccuugacgguggc

SEQ ID NO: 2374023 - RNA, 21 nt, Bordetella pertussis
gcggccgcgcaccugcugcgg

SEQ ID NO: 2374024 - RNA, 12 nt, Bordetella pertussis
gcggccgcgcag

SEQ ID NO: 2374025 - RNA, 21 nt, Bordetella pertussis
gcggccgcgcaggauuucauc

SEQ ID NO: 2374026 - RNA, 21 nt, Bordetella pertussis
gcggccgcgcgcuucaggcgc

SEQ ID NO: 2374027 - RNA, 16 nt, Bordetella pertussis
gcggccgcgcgggcgg

SEQ ID NO: 2374028 - RNA, 14 nt, Bordetella pertussis
gcggccgcgcuggc

SEQ ID NO: 2374029 - RNA, 19 nt, Bordetella pertussis
gcggccgcggaagucgggc

SEQ ID NO: 2374030 - RNA, 23 nt, Bordetella pertussis
gcggccgcggaagucgggcacca

SEQ ID NO: 2374031 - RNA, 12 nt, Bordetella pertussis
gcggccgcgggc

SEQ ID NO: 2374032 - RNA, 15 nt, Bordetella pertussis
gcggccuugcgggcc

SEQ ID NO: 2374033 - RNA, 11 nt, Bordetella pertussis
gcggccuuggc

SEQ ID NO: 2374034 - RNA, 13 nt, Bordetella pertussis
gcggccuuggccg

SEQ ID NO: 2374035 - RNA, 16 nt, Bordetella pertussis
gcggccuuggucgcga

SEQ ID NO: 2374036 - RNA, 20 nt, Bordetella pertussis
gcggccuuggucgcgaccuc

SEQ ID NO: 2374037 - RNA, 19 nt, Bordetella pertussis
gcggccuugugcgccagcg

SEQ ID NO: 2374038 - RNA, 19 nt, Bordetella pertussis
gcggccuuuuuuugcggca

SEQ ID NO: 2374039 - RNA, 22 nt, Bordetella pertussis
gcggccuuuuuuugcggcacgg

SEQ ID NO: 2374040 - RNA, 15 nt, Bordetella pertussis
gcggcgaaaugucga

SEQ ID NO: 2374041 - RNA, 16 nt, Bordetella pertussis
gcggcgaaaugucgag

SEQ ID NO: 2374042 - RNA, 18 nt, Bordetella pertussis
gcggcgaaaugucgagcg

SEQ ID NO: 2374043 - RNA, 23 nt, Bordetella pertussis
gcggcgaaaugucgagcgcgaug

SEQ ID NO: 2374044 - RNA, 21 nt, Bordetella pertussis
gcggcgaacacgucgcgggcg

SEQ ID NO: 2374045 - RNA, 13 nt, Bordetella pertussis
gcggcgaaggcgc

SEQ ID NO: 2374046 - RNA, 17 nt, Bordetella pertussis
gcggcgaaggcgcggcu

SEQ ID NO: 2374047 - RNA, 18 nt, Bordetella pertussis
gcggcgaaggcgcggcug

SEQ ID NO: 2374048 - RNA, 20 nt, Bordetella pertussis
gcggcgaaggcgcggcugcg

SEQ ID NO: 2374049 - RNA, 20 nt, Bordetella pertussis
gcggcgacacccccagggcg

SEQ ID NO: 2374050 - RNA, 22 nt, Bordetella pertussis
gcggcgacacccccagggcgcg

SEQ ID NO: 2374051 - RNA, 23 nt, Bordetella pertussis
gcggcgacacccccagggcgcgc

SEQ ID NO: 2374052 - RNA, 15 nt, Bordetella pertussis
gcggcgacagcgauu

SEQ ID NO: 2374053 - RNA, 14 nt, Bordetella pertussis
gcggcgacagggcg

SEQ ID NO: 2374054 - RNA, 16 nt, Bordetella pertussis
gcggcgacagggcguc

SEQ ID NO: 2374055 - RNA, 19 nt, Bordetella pertussis
gcggcgacgaacccgggcg

SEQ ID NO: 2374056 - RNA, 17 nt, Bordetella pertussis
gcggcgacgcagcacgg

SEQ ID NO: 2374057 - RNA, 22 nt, Bordetella pertussis
gcggcgacgcagcacggcuugc

SEQ ID NO: 2374058 - RNA, 14 nt, Bordetella pertussis
gcggcgacggcgcc

SEQ ID NO: 2374059 - RNA, 15 nt, Bordetella pertussis
gcggcgacggcgccu

SEQ ID NO: 2374060 - RNA, 18 nt, Bordetella pertussis
gcggcgacggcgccuggc

SEQ ID NO: 2374061 - RNA, 15 nt, Bordetella pertussis
gcggcgacucggcau

SEQ ID NO: 2374062 - RNA, 18 nt, Bordetella pertussis
gcggcgacugccccagcg

SEQ ID NO: 2374063 - RNA, 23 nt, Bordetella pertussis
gcggcgacugccccagcggcugg

SEQ ID NO: 2374064 - RNA, 14 nt, Bordetella pertussis
gcggcgagaugccg

SEQ ID NO: 2374065 - RNA, 14 nt, Bordetella pertussis
gcggcgagcacggc

SEQ ID NO: 2374066 - RNA, 18 nt, Bordetella pertussis
gcggcgagcacggccugc

SEQ ID NO: 2374067 - RNA, 13 nt, Bordetella pertussis
gcggcgagccgcg

SEQ ID NO: 2374068 - RNA, 15 nt, Bordetella pertussis
gcggcgagccgcgcg

SEQ ID NO: 2374069 - RNA, 19 nt, Bordetella pertussis
gcggcgagcgccgccaggc

SEQ ID NO: 2374070 - RNA, 20 nt, Bordetella pertussis
gcggcgagcgccgccaggcc

SEQ ID NO: 2374071 - RNA, 14 nt, Bordetella pertussis
gcggcgagcgcggc

SEQ ID NO: 2374072 - RNA, 15 nt, Bordetella pertussis
gcggcgagcgcggcg

SEQ ID NO: 2374073 - RNA, 17 nt, Bordetella pertussis
gcggcgagcgcggcgau

SEQ ID NO: 2374074 - RNA, 14 nt, Bordetella pertussis
gcggcgagcucggc

SEQ ID NO: 2374075 - RNA, 19 nt, Bordetella pertussis
gcggcgagcucggcauggc

SEQ ID NO: 2374076 - RNA, 14 nt, Bordetella pertussis
gcggcgagcuggcc

SEQ ID NO: 2374077 - RNA, 15 nt, Bordetella pertussis
gcggcgaggcgucca

SEQ ID NO: 2374078 - RNA, 19 nt, Bordetella pertussis
gcggcgaggcguccagccc

SEQ ID NO: 2374079 - RNA, 21 nt, Bordetella pertussis
gcggcgauaccaguagcgcga

SEQ ID NO: 2374080 - RNA, 16 nt, Bordetella pertussis
gcggcgauacgcgccg

SEQ ID NO: 2374081 - RNA, 17 nt, Bordetella pertussis
gcggcgauacgcgccgc

SEQ ID NO: 2374082 - RNA, 20 nt, Bordetella pertussis
gcggcgauacgcgccgccug

SEQ ID NO: 2374083 - RNA, 22 nt, Bordetella pertussis
gcggcgauacgcgccgccuggc

SEQ ID NO: 2374084 - RNA, 20 nt, Bordetella pertussis
gcggcgaucaacgugcgcca

SEQ ID NO: 2374085 - RNA, 21 nt, Bordetella pertussis
gcggcgaucaacgugcgccag

SEQ ID NO: 2374086 - RNA, 14 nt, Bordetella pertussis
gcggcgaucacgcc

SEQ ID NO: 2374087 - RNA, 16 nt, Bordetella pertussis
gcggcgaucacgccgu

SEQ ID NO: 2374088 - RNA, 16 nt, Bordetella pertussis
gcggcgauccgccgcg

SEQ ID NO: 2374089 - RNA, 22 nt, Bordetella pertussis
gcggcgauccgccgcggccagc

SEQ ID NO: 2374090 - RNA, 19 nt, Bordetella pertussis
gcggcgaucucgcgcgcgc

SEQ ID NO: 2374091 - RNA, 22 nt, Bordetella pertussis
gcggcgaucucgcgcgcgcggu

SEQ ID NO: 2374092 - RNA, 16 nt, Bordetella pertussis
gcggcgaucucgucga

SEQ ID NO: 2374093 - RNA, 15 nt, Bordetella pertussis
gcggcgaugcaccca

SEQ ID NO: 2374094 - RNA, 21 nt, Bordetella pertussis
gcggcgaugcacccaggcgcc

SEQ ID NO: 2374095 - RNA, 16 nt, Bordetella pertussis
gcggcgaugccgcugg

SEQ ID NO: 2374096 - RNA, 19 nt, Bordetella pertussis
gcggcgaugccgcuggcga

SEQ ID NO: 2374097 - RNA, 18 nt, Bordetella pertussis
gcggcgaugccgcugucg

SEQ ID NO: 2374098 - RNA, 21 nt, Bordetella pertussis
gcggcgaugccgcugucggug

SEQ ID NO: 2374099 - RNA, 16 nt, Bordetella pertussis
gcggcgaugccggcca

SEQ ID NO: 2374100 - RNA, 17 nt, Bordetella pertussis
gcggcgaugccggccag

SEQ ID NO: 2374101 - RNA, 19 nt, Bordetella pertussis
gcggcgaugccggccagca

SEQ ID NO: 2374102 - RNA, 23 nt, Bordetella pertussis
gcggcgaugccggccagcagcga

SEQ ID NO: 2374103 - RNA, 15 nt, Bordetella pertussis
gcggcgauguggcgc

SEQ ID NO: 2374104 - RNA, 17 nt, Bordetella pertussis
gcggcgauguggcgcgc

SEQ ID NO: 2374105 - RNA, 19 nt, Bordetella pertussis
gcggcgauguggcgcgcca

SEQ ID NO: 2374106 - RNA, 23 nt, Bordetella pertussis
gcggcgauugcggcccgcggccu

SEQ ID NO: 2374107 - RNA, 17 nt, Bordetella pertussis
gcggcgcaacccggccu

SEQ ID NO: 2374108 - RNA, 15 nt, Bordetella pertussis
gcggcgcacagggcg

SEQ ID NO: 2374109 - RNA, 19 nt, Bordetella pertussis
gcggcgcacagggcgucgc

SEQ ID NO: 2374110 - RNA, 14 nt, Bordetella pertussis
gcggcgcaccagcg

SEQ ID NO: 2374111 - RNA, 16 nt, Bordetella pertussis
gcggcgcaccagcgag

SEQ ID NO: 2374112 - RNA, 11 nt, Bordetella pertussis
gcggcgcaccg

SEQ ID NO: 2374113 - RNA, 15 nt, Bordetella pertussis
gcggcgcaccgacag

SEQ ID NO: 2374114 - RNA, 16 nt, Bordetella pertussis
gcggcgcagcaccagg

SEQ ID NO: 2374115 - RNA, 18 nt, Bordetella pertussis
gcggcgcagcaccaggcu

SEQ ID NO: 2374116 - RNA, 22 nt, Bordetella pertussis
gcggcgcagcaucuugcgccgc

SEQ ID NO: 2374117 - RNA, 16 nt, Bordetella pertussis
gcggcgcagcccagcg

SEQ ID NO: 2374118 - RNA, 19 nt, Bordetella pertussis
gcggcgcagcccagcgcga

SEQ ID NO: 2374119 - RNA, 14 nt, Bordetella pertussis
gcggcgcagccgcc

SEQ ID NO: 2374120 - RNA, 15 nt, Bordetella pertussis
gcggcgcagccgcca

SEQ ID NO: 2374121 - RNA, 13 nt, Bordetella pertussis
gcggcgcagccgg

SEQ ID NO: 2374122 - RNA, 13 nt, Bordetella pertussis
gcggcgcagcgcc

SEQ ID NO: 2374123 - RNA, 14 nt, Bordetella pertussis
gcggcgcagcgccc

SEQ ID NO: 2374124 - RNA, 15 nt, Bordetella pertussis
gcggcgcagcgccca

SEQ ID NO: 2374125 - RNA, 18 nt, Bordetella pertussis
gcggcgcagcgcccaggc

SEQ ID NO: 2374126 - RNA, 14 nt, Bordetella pertussis
gcggcgcagcgcgu

SEQ ID NO: 2374127 - RNA, 20 nt, Bordetella pertussis
gcggcgcaggccgcgccggc

SEQ ID NO: 2374128 - RNA, 13 nt, Bordetella pertussis
gcggcgcaggccu

SEQ ID NO: 2374129 - RNA, 15 nt, Bordetella pertussis
gcggcgcaggcgggc

SEQ ID NO: 2374130 - RNA, 17 nt, Bordetella pertussis
gcggcgcaggcgggcga

SEQ ID NO: 2374131 - RNA, 17 nt, Bordetella pertussis
gcggcgcagguccaccg

SEQ ID NO: 2374132 - RNA, 19 nt, Bordetella pertussis
gcggcgcagguccaccgcc

SEQ ID NO: 2374133 - RNA, 17 nt, Bordetella pertussis
gcggcgcagucgcgcac

SEQ ID NO: 2374134 - RNA, 13 nt, Bordetella pertussis
gcggcgcaucagc

SEQ ID NO: 2374135 - RNA, 17 nt, Bordetella pertussis
gcggcgcaugcagccgc

SEQ ID NO: 2374136 - RNA, 18 nt, Bordetella pertussis
gcggcgcaugcagccgca

SEQ ID NO: 2374137 - RNA, 15 nt, Bordetella pertussis
gcggcgcaugcugcg

SEQ ID NO: 2374138 - RNA, 16 nt, Bordetella pertussis
gcggcgcaugcugcgc

SEQ ID NO: 2374139 - RNA, 17 nt, Bordetella pertussis
gcggcgcauugccgucg

SEQ ID NO: 2374140 - RNA, 13 nt, Bordetella pertussis
gcggcgccacgca

SEQ ID NO: 2374141 - RNA, 14 nt, Bordetella pertussis
gcggcgccagcgcc

SEQ ID NO: 2374142 - RNA, 14 nt, Bordetella pertussis
gcggcgccagcgcu

SEQ ID NO: 2374143 - RNA, 14 nt, Bordetella pertussis
gcggcgccagcgga

SEQ ID NO: 2374144 - RNA, 17 nt, Bordetella pertussis
gcggcgccagcggaugg

SEQ ID NO: 2374145 - RNA, 19 nt, Bordetella pertussis
gcggcgccagcggauggug

SEQ ID NO: 2374146 - RNA, 20 nt, Bordetella pertussis
gcggcgcguucagggcgccg

SEQ ID NO: 2374147 - RNA, 21 nt, Bordetella pertussis
gcggcgcguucagggcgccgc

SEQ ID NO: 2374148 - RNA, 20 nt, Bordetella pertussis
gcggcgcguucgccgcagcc

SEQ ID NO: 2374149 - RNA, 23 nt, Bordetella pertussis
gcggcgcguucucagccgcccgc

SEQ ID NO: 2374150 - RNA, 19 nt, Bordetella pertussis
gcggcgcucaucaucgcgc

SEQ ID NO: 2374151 - RNA, 22 nt, Bordetella pertussis
gcggcgcucaucaucgcgcugg

SEQ ID NO: 2374152 - RNA, 17 nt, Bordetella pertussis
gcggcgcucgaaggcgc

SEQ ID NO: 2374153 - RNA, 21 nt, Bordetella pertussis
gcggcgcucgaaggcgccgac

SEQ ID NO: 2374154 - RNA, 14 nt, Bordetella pertussis
gcggcgcugcuggc

SEQ ID NO: 2374155 - RNA, 22 nt, Bordetella pertussis
gcggcgcugcuggccggccagc

SEQ ID NO: 2374156 - RNA, 11 nt, Bordetella pertussis
gcggcgcuggc

SEQ ID NO: 2374157 - RNA, 17 nt, Bordetella pertussis
gcggcgcuggcgaugcg

SEQ ID NO: 2374158 - RNA, 17 nt, Bordetella pertussis
gcggcgcuggcgccgcg

SEQ ID NO: 2374159 - RNA, 18 nt, Bordetella pertussis
gcggcgcuggcuggacgc

SEQ ID NO: 2374160 - RNA, 20 nt, Bordetella pertussis
gcggcgcuggcuggacgcgc

SEQ ID NO: 2374161 - RNA, 22 nt, Bordetella pertussis
gcggcgcuggcuggacgcgcgc

SEQ ID NO: 2374162 - RNA, 15 nt, Bordetella pertussis
gcggcggaaugugcg

SEQ ID NO: 2374163 - RNA, 15 nt, Bordetella pertussis
gcggcggacugcgcc

SEQ ID NO: 2374164 - RNA, 20 nt, Bordetella pertussis
gcggcggauaacaucauggg

SEQ ID NO: 2374165 - RNA, 21 nt, Bordetella pertussis
gcggcggauucaggcgauccu

SEQ ID NO: 2374166 - RNA, 14 nt, Bordetella pertussis
gcggcggcaccagc

SEQ ID NO: 2374167 - RNA, 16 nt, Bordetella pertussis
gcggcggcacgcgcgc

SEQ ID NO: 2374168 - RNA, 15 nt, Bordetella pertussis
gcggcggcagcgcgu

SEQ ID NO: 2374169 - RNA, 14 nt, Bordetella pertussis
gcggcggcaugcug

SEQ ID NO: 2374170 - RNA, 14 nt, Bordetella pertussis
gcggcggccaggcg

SEQ ID NO: 2374171 - RNA, 14 nt, Bordetella pertussis
gcggcggccaugcc

SEQ ID NO: 2374172 - RNA, 15 nt, Bordetella pertussis
gcggcggccgaagcg

SEQ ID NO: 2374173 - RNA, 18 nt, Bordetella pertussis
gcggcggccgcguccagc

SEQ ID NO: 2374174 - RNA, 19 nt, Bordetella pertussis
gcggcggccgcguccagcg

SEQ ID NO: 2374175 - RNA, 21 nt, Bordetella pertussis
gcggcggccgcguccagcgcg

SEQ ID NO: 2374176 - RNA, 22 nt, Bordetella pertussis
gcggcggccgcguccagcgcgc

SEQ ID NO: 2374177 - RNA, 13 nt, Bordetella pertussis
gcggcggccgggg

SEQ ID NO: 2374178 - RNA, 12 nt, Bordetella pertussis
gcggcggccggu

SEQ ID NO: 2374179 - RNA, 13 nt, Bordetella pertussis
gcggcggccuggg

SEQ ID NO: 2374180 - RNA, 14 nt, Bordetella pertussis
gcggcggccugggc

SEQ ID NO: 2374181 - RNA, 15 nt, Bordetella pertussis
gcggcggccugggcg

SEQ ID NO: 2374182 - RNA, 13 nt, Bordetella pertussis
gcggcggccuugu

SEQ ID NO: 2374183 - RNA, 21 nt, Bordetella pertussis
gcggcggccuugugcgccagc

SEQ ID NO: 2374184 - RNA, 13 nt, Bordetella pertussis
gcggcggcgaccg

SEQ ID NO: 2374185 - RNA, 21 nt, Bordetella pertussis
gcggcggcgaccggcgccggc

SEQ ID NO: 2374186 - RNA, 22 nt, Bordetella pertussis
gcggcggcgaugccgcuggcga

SEQ ID NO: 2374187 - RNA, 13 nt, Bordetella pertussis
gcggcggcgcccg

SEQ ID NO: 2374188 - RNA, 15 nt, Bordetella pertussis
gcggcggcgcggcgc

SEQ ID NO: 2374189 - RNA, 17 nt, Bordetella pertussis
gcggcggcgcggcgcca

SEQ ID NO: 2374190 - RNA, 12 nt, Bordetella pertussis
gcggcggcgcug

SEQ ID NO: 2374191 - RNA, 13 nt, Bordetella pertussis
gcggcggcgcugg

SEQ ID NO: 2374192 - RNA, 15 nt, Bordetella pertussis
gcggcggcgcuggcc

SEQ ID NO: 2374193 - RNA, 16 nt, Bordetella pertussis
gcggcggcgcuggccu

SEQ ID NO: 2374194 - RNA, 17 nt, Bordetella pertussis
gcggcggcgcuggccug

SEQ ID NO: 2374195 - RNA, 15 nt, Bordetella pertussis
gcggcggcggccaug

SEQ ID NO: 2374196 - RNA, 13 nt, Bordetella pertussis
gcggcggcgucgc

SEQ ID NO: 2374197 - RNA, 15 nt, Bordetella pertussis
gcggcggcgucgcgc

SEQ ID NO: 2374198 - RNA, 19 nt, Bordetella pertussis
gcggcggcguuccugggca

SEQ ID NO: 2374199 - RNA, 13 nt, Bordetella pertussis
gcggcggcuucgc

SEQ ID NO: 2374200 - RNA, 18 nt, Bordetella pertussis
gcggcggcuucgcgcagc

SEQ ID NO: 2374201 - RNA, 19 nt, Bordetella pertussis
gcggcggcuucgcgcagca

SEQ ID NO: 2374202 - RNA, 21 nt, Bordetella pertussis
gcggcggcuucgcgcagcaag

SEQ ID NO: 2374203 - RNA, 18 nt, Bordetella pertussis
gcggcggcuugccgucga

SEQ ID NO: 2374204 - RNA, 17 nt, Bordetella pertussis
gcggcgggaccgugccg

SEQ ID NO: 2374205 - RNA, 20 nt, Bordetella pertussis
gcggcgggaccgugccgccg

SEQ ID NO: 2374206 - RNA, 13 nt, Bordetella pertussis
gcggcgggcacga

SEQ ID NO: 2374207 - RNA, 19 nt, Bordetella pertussis
gcggcgggccccgcagggc

SEQ ID NO: 2374208 - RNA, 14 nt, Bordetella pertussis
gcggcgggcgcugg

SEQ ID NO: 2374209 - RNA, 15 nt, Bordetella pertussis
gcggcgggcgcuggc

SEQ ID NO: 2374210 - RNA, 16 nt, Bordetella pertussis
gcggcgggcgcuggcg

SEQ ID NO: 2374211 - RNA, 17 nt, Bordetella pertussis
gcggcgggcgcuggcgc

SEQ ID NO: 2374212 - RNA, 18 nt, Bordetella pertussis
gcggcgggcgcuggcgcg

SEQ ID NO: 2374213 - RNA, 15 nt, Bordetella pertussis
gcggcgggcggccgg

SEQ ID NO: 2374214 - RNA, 17 nt, Bordetella pertussis
gcggcgggcggccggcg

SEQ ID NO: 2374215 - RNA, 18 nt, Bordetella pertussis
gcggcgggcggccggcgc

SEQ ID NO: 2374216 - RNA, 13 nt, Bordetella pertussis
gcggcgggcggcg

SEQ ID NO: 2374217 - RNA, 16 nt, Bordetella pertussis
gcggcgggcggcgcgg

SEQ ID NO: 2374218 - RNA, 17 nt, Bordetella pertussis
gcggcgggcggcgcggc

SEQ ID NO: 2374219 - RNA, 23 nt, Bordetella pertussis
gcggcgggcgggucgaugucgug

SEQ ID NO: 2374220 - RNA, 14 nt, Bordetella pertussis
gcggcgggcucagc

SEQ ID NO: 2374221 - RNA, 18 nt, Bordetella pertussis
gcggcgggcucggcgccg

SEQ ID NO: 2374222 - RNA, 21 nt, Bordetella pertussis
gcggcgggcucggcgccggcg

SEQ ID NO: 2374223 - RNA, 16 nt, Bordetella pertussis
gcggcgggugccgcga

SEQ ID NO: 2374224 - RNA, 14 nt, Bordetella pertussis
gcggcggguggccu

SEQ ID NO: 2374225 - RNA, 16 nt, Bordetella pertussis
gcggcggguggcggcg

SEQ ID NO: 2374226 - RNA, 19 nt, Bordetella pertussis
gcggcggguucgcagggcg

SEQ ID NO: 2374227 - RNA, 20 nt, Bordetella pertussis
gcggcggguucgcagggcgc

SEQ ID NO: 2374228 - RNA, 17 nt, Bordetella pertussis
gcggcgguaccaggccg

SEQ ID NO: 2374229 - RNA, 20 nt, Bordetella pertussis
gcggcgguccucgccgguca

SEQ ID NO: 2374230 - RNA, 15 nt, Bordetella pertussis
gcggcggugccagcg

SEQ ID NO: 2374231 - RNA, 13 nt, Bordetella pertussis
gcggcggugccgc

SEQ ID NO: 2374232 - RNA, 19 nt, Bordetella pertussis
gcggcgguucguccucguc

SEQ ID NO: 2374233 - RNA, 18 nt, Bordetella pertussis
gcggcgguuucggccggg

SEQ ID NO: 2374234 - RNA, 23 nt, Bordetella pertussis
gcggcgguuucggccgggaaggc

SEQ ID NO: 2374235 - RNA, 21 nt, Bordetella pertussis
gcggcgguuucuuccagcagg

SEQ ID NO: 2374236 - RNA, 17 nt, Bordetella pertussis
gcggcguacaggugcug

SEQ ID NO: 2374237 - RNA, 15 nt, Bordetella pertussis
gcggcguacuggcgc

SEQ ID NO: 2374238 - RNA, 20 nt, Bordetella pertussis
gcggcguacuggcgcggcgg

SEQ ID NO: 2374239 - RNA, 21 nt, Bordetella pertussis
gcggcguacuggcgcggcggc

SEQ ID NO: 2374240 - RNA, 23 nt, Bordetella pertussis
gcggcguacuggcgcggcggcca

SEQ ID NO: 2374241 - RNA, 16 nt, Bordetella pertussis
gcggcguagagcgccg

SEQ ID NO: 2374242 - RNA, 17 nt, Bordetella pertussis
gcggcguaguucagcca

SEQ ID NO: 2374243 - RNA, 19 nt, Bordetella pertussis
gcggcguauaggccacccc

SEQ ID NO: 2374244 - RNA, 13 nt, Bordetella pertussis
gcggcguauggcg

SEQ ID NO: 2374245 - RNA, 21 nt, Bordetella pertussis
gcggcguauguccgguacgag

SEQ ID NO: 2374246 - RNA, 22 nt, Bordetella pertussis
gcggcgucaaugccagucgccg

SEQ ID NO: 2374247 - RNA, 17 nt, Bordetella pertussis
gcggcgucaggccgucg

SEQ ID NO: 2374248 - RNA, 19 nt, Bordetella pertussis
gcggcguccgcgccgaacg

SEQ ID NO: 2374249 - RNA, 16 nt, Bordetella pertussis
gcggcguccugccgcg

SEQ ID NO: 2374250 - RNA, 17 nt, Bordetella pertussis
gcggcguccugccgcga

SEQ ID NO: 2374251 - RNA, 20 nt, Bordetella pertussis
gcggcgucgaaggccgccgg

SEQ ID NO: 2374252 - RNA, 22 nt, Bordetella pertussis
gcggcgucgaaggccgccggac

SEQ ID NO: 2374253 - RNA, 15 nt, Bordetella pertussis
gcggcgucgaccgcg

SEQ ID NO: 2374254 - RNA, 16 nt, Bordetella pertussis
gcggcgucgacgcccg

SEQ ID NO: 2374255 - RNA, 17 nt, Bordetella pertussis
gcggcgucgacgcccgc

SEQ ID NO: 2374256 - RNA, 21 nt, Bordetella pertussis
gcggcgucgacgcccgcgccc

SEQ ID NO: 2374257 - RNA, 14 nt, Bordetella pertussis
gcggcgucgaucgg

SEQ ID NO: 2374258 - RNA, 21 nt, Bordetella pertussis
gcggcgucgaucggcgcgccc

SEQ ID NO: 2374259 - RNA, 14 nt, Bordetella pertussis
gcggcuucggccgu

SEQ ID NO: 2374260 - RNA, 16 nt, Bordetella pertussis
gcggcuucggccguca

SEQ ID NO: 2374261 - RNA, 19 nt, Bordetella pertussis
gcggcuucggccgucagca

SEQ ID NO: 2374262 - RNA, 18 nt, Bordetella pertussis
gcggcuugcagcggacgg

SEQ ID NO: 2374263 - RNA, 22 nt, Bordetella pertussis
gcggcuugcagcggacggcgcg

SEQ ID NO: 2374264 - RNA, 13 nt, Bordetella pertussis
gcggcuugccgcg

SEQ ID NO: 2374265 - RNA, 16 nt, Bordetella pertussis
gcggcuugccgcggcg

SEQ ID NO: 2374266 - RNA, 17 nt, Bordetella pertussis
gcggcuugccgcggcgc

SEQ ID NO: 2374267 - RNA, 22 nt, Bordetella pertussis
gcggcuugccgcggcgcggccu

SEQ ID NO: 2374268 - RNA, 21 nt, Bordetella pertussis
gcggcuugccgucgaccgcga

SEQ ID NO: 2374269 - RNA, 22 nt, Bordetella pertussis
gcggcuugguugucgcgcaccg

SEQ ID NO: 2374270 - RNA, 18 nt, Bordetella pertussis
gcggcuuucaugggccug

SEQ ID NO: 2374271 - RNA, 19 nt, Bordetella pertussis
gcggcuuucaugggccugg

SEQ ID NO: 2374272 - RNA, 21 nt, Bordetella pertussis
gcggcuuucaugggccugggc

SEQ ID NO: 2374273 - RNA, 22 nt, Bordetella pertussis
gcggcuuucaugggccugggcg

SEQ ID NO: 2374274 - RNA, 22 nt, Bordetella pertussis
gcggcuuucgauuugcagcagc

SEQ ID NO: 2374275 - RNA, 23 nt, Bordetella pertussis
gcggcuuucgauuugcagcagca

SEQ ID NO: 2374276 - RNA, 19 nt, Bordetella pertussis
gcggcuuucgccggaggcg

SEQ ID NO: 2374277 - RNA, 21 nt, Bordetella pertussis
gcggcuuucgccggaggcgcg

SEQ ID NO: 2374278 - RNA, 18 nt, Bordetella pertussis
gcggcuuuuucucggccu

SEQ ID NO: 2374279 - RNA, 13 nt, Bordetella pertussis
gcgggaagcuguc

SEQ ID NO: 2374280 - RNA, 23 nt, Bordetella pertussis
gcgggaagcugucggcgcuggcc

SEQ ID NO: 2374281 - RNA, 19 nt, Bordetella pertussis
gcgggaaugucccacaggc

SEQ ID NO: 2374282 - RNA, 23 nt, Bordetella pertussis
gcgggaaugucccacaggcgcgc

SEQ ID NO: 2374283 - RNA, 20 nt, Bordetella pertussis
gcgggaauucugaacaaggg

SEQ ID NO: 2374284 - RNA, 16 nt, Bordetella pertussis
gcgggaauugggcgag

SEQ ID NO: 2374285 - RNA, 17 nt, Bordetella pertussis
gcgggaauugggcgagc

SEQ ID NO: 2374286 - RNA, 18 nt, Bordetella pertussis
gcgggaccggcgauggcg

SEQ ID NO: 2374287 - RNA, 14 nt, Bordetella pertussis
gcgggacgcaggcc

SEQ ID NO: 2374288 - RNA, 19 nt, Bordetella pertussis
gcgggacgcaggcccagcc

SEQ ID NO: 2374289 - RNA, 21 nt, Bordetella pertussis
gcgggacgcaggcccagccag

SEQ ID NO: 2374290 - RNA, 14 nt, Bordetella pertussis
gcgggacggccagg

SEQ ID NO: 2374291 - RNA, 15 nt, Bordetella pertussis
gcgggacggccaggg

SEQ ID NO: 2374292 - RNA, 21 nt, Bordetella pertussis
gcgggacuggcgagcacccgc

SEQ ID NO: 2374293 - RNA, 22 nt, Bordetella pertussis
gcgggacuguaccgcgcgaugu

SEQ ID NO: 2374294 - RNA, 22 nt, Bordetella pertussis
gcgggacuugguuggccugggc

SEQ ID NO: 2374295 - RNA, 23 nt, Bordetella pertussis
gcgggagaucuguaccgccgggu

SEQ ID NO: 2374296 - RNA, 15 nt, Bordetella pertussis
gcgggagccuguccc

SEQ ID NO: 2374297 - RNA, 17 nt, Bordetella pertussis
gcgggagccuguccccg

SEQ ID NO: 2374298 - RNA, 19 nt, Bordetella pertussis
gcgggaggaagggugcggc

SEQ ID NO: 2374299 - RNA, 19 nt, Bordetella pertussis
gcgggaucugcaugccgac

SEQ ID NO: 2374300 - RNA, 16 nt, Bordetella pertussis
gcgggauggucgcggc

SEQ ID NO: 2374301 - RNA, 17 nt, Bordetella pertussis
gcgggauggucgcggcc

SEQ ID NO: 2374302 - RNA, 22 nt, Bordetella pertussis
gcgggauggucgcggccgaggc

SEQ ID NO: 2374303 - RNA, 16 nt, Bordetella pertussis
gcgggcaaacggcggc

SEQ ID NO: 2374304 - RNA, 17 nt, Bordetella pertussis
gcgggcaaacggcggca

SEQ ID NO: 2374305 - RNA, 19 nt, Bordetella pertussis
gcgggcaaacggcggcagg

SEQ ID NO: 2374306 - RNA, 20 nt, Bordetella pertussis
gcgggcaaacggcggcaggc

SEQ ID NO: 2374307 - RNA, 22 nt, Bordetella pertussis
gcgggcaaacggcggcaggccg

SEQ ID NO: 2374308 - RNA, 16 nt, Bordetella pertussis
gcgggcaaagcccagc

SEQ ID NO: 2374309 - RNA, 19 nt, Bordetella pertussis
gcgggcaaagcccagcaag

SEQ ID NO: 2374310 - RNA, 22 nt, Bordetella pertussis
gcgggcaauuuuguugauggcg

SEQ ID NO: 2374311 - RNA, 16 nt, Bordetella pertussis
gcgggcacaacccgcc

SEQ ID NO: 2374312 - RNA, 18 nt, Bordetella pertussis
gcgggcacaacccgcccg

SEQ ID NO: 2374313 - RNA, 23 nt, Bordetella pertussis
gcgggcacgagaucgccuggggc

SEQ ID NO: 2374314 - RNA, 21 nt, Bordetella pertussis
gcgggcacucggccauggugc

SEQ ID NO: 2374315 - RNA, 19 nt, Bordetella pertussis
gcgggcagcaccggggcag

SEQ ID NO: 2374316 - RNA, 20 nt, Bordetella pertussis
gcgggcagcaccggggcagg

SEQ ID NO: 2374317 - RNA, 19 nt, Bordetella pertussis
gcgggcaggcuccacagcc

SEQ ID NO: 2374318 - RNA, 18 nt, Bordetella pertussis
gcgggcagugcgccggac

SEQ ID NO: 2374319 - RNA, 13 nt, Bordetella pertussis
gcgggcaucgccc

SEQ ID NO: 2374320 - RNA, 17 nt, Bordetella pertussis
gcgggcaugacgaccgc

SEQ ID NO: 2374321 - RNA, 19 nt, Bordetella pertussis
gcgggcaugacgaccgcga

SEQ ID NO: 2374322 - RNA, 16 nt, Bordetella pertussis
gcgggcauugggcagc

SEQ ID NO: 2374323 - RNA, 17 nt, Bordetella pertussis
gcgggcauugggcagcg

SEQ ID NO: 2374324 - RNA, 21 nt, Bordetella pertussis
gcgggcauugggcagcggacg

SEQ ID NO: 2374325 - RNA, 23 nt, Bordetella pertussis
gcgggcauugggcagcggacggu

SEQ ID NO: 2374326 - RNA, 15 nt, Bordetella pertussis
gcgggccacgccggc

SEQ ID NO: 2374327 - RNA, 16 nt, Bordetella pertussis
gcgggccacgccggcc

SEQ ID NO: 2374328 - RNA, 17 nt, Bordetella pertussis
gcgggccacgccggccg

SEQ ID NO: 2374329 - RNA, 18 nt, Bordetella pertussis
gcgggccacgccggccgg

SEQ ID NO: 2374330 - RNA, 20 nt, Bordetella pertussis
gcgggccacgccggccgggg

SEQ ID NO: 2374331 - RNA, 15 nt, Bordetella pertussis
gcgggccacgcgccg

SEQ ID NO: 2374332 - RNA, 15 nt, Bordetella pertussis
gcgggccagcgcggc

SEQ ID NO: 2374333 - RNA, 16 nt, Bordetella pertussis
gcgggccagcgcggcc

SEQ ID NO: 2374334 - RNA, 17 nt, Bordetella pertussis
gcgggccagcgcggcca

SEQ ID NO: 2374335 - RNA, 15 nt, Bordetella pertussis
gcgggccaggccggu

SEQ ID NO: 2374336 - RNA, 20 nt, Bordetella pertussis
gcgggccaugucggcuucgg

SEQ ID NO: 2374337 - RNA, 19 nt, Bordetella pertussis
gcgggccccgcagggcccg

SEQ ID NO: 2374338 - RNA, 13 nt, Bordetella pertussis
gcgggcccgacag

SEQ ID NO: 2374339 - RNA, 17 nt, Bordetella pertussis
gcgggcccgacagcgcc

SEQ ID NO: 2374340 - RNA, 19 nt, Bordetella pertussis
gcgggcccgacagcgcccc

SEQ ID NO: 2374341 - RNA, 20 nt, Bordetella pertussis
gcgggcccgacagcgccccg

SEQ ID NO: 2374342 - RNA, 15 nt, Bordetella pertussis
gcgggcccgcaucgc

SEQ ID NO: 2374343 - RNA, 17 nt, Bordetella pertussis
gcgggcccgcaucgcgc

SEQ ID NO: 2374344 - RNA, 20 nt, Bordetella pertussis
gcgggcccgcaucgcgcgcc

SEQ ID NO: 2374345 - RNA, 21 nt, Bordetella pertussis
gcgggcccgcaucgcgcgccg

SEQ ID NO: 2374346 - RNA, 22 nt, Bordetella pertussis
gcgggcccgcaucgcgcgccgc

SEQ ID NO: 2374347 - RNA, 15 nt, Bordetella pertussis
gcgggcccgcucggc

SEQ ID NO: 2374348 - RNA, 16 nt, Bordetella pertussis
gcgggcccgcucggcc

SEQ ID NO: 2374349 - RNA, 22 nt, Bordetella pertussis
gcgggcccgucgcgccaggccg

SEQ ID NO: 2374350 - RNA, 19 nt, Bordetella pertussis
gcgggcccuggcguucgcg

SEQ ID NO: 2374351 - RNA, 22 nt, Bordetella pertussis
gcgggcccuggcguucgcgcgc

SEQ ID NO: 2374352 - RNA, 18 nt, Bordetella pertussis
gcgggcccuguguccacg

SEQ ID NO: 2374353 - RNA, 22 nt, Bordetella pertussis
gcgggccgaggcuucgauggcg

SEQ ID NO: 2374354 - RNA, 20 nt, Bordetella pertussis
gcgggccgcacuccguaaag

SEQ ID NO: 2374355 - RNA, 18 nt, Bordetella pertussis
gcgggccgcagcauggcg

SEQ ID NO: 2374356 - RNA, 14 nt, Bordetella pertussis
gcgggccgccgcac

SEQ ID NO: 2374357 - RNA, 20 nt, Bordetella pertussis
gcgggccgcgccccuagcgc

SEQ ID NO: 2374358 - RNA, 14 nt, Bordetella pertussis
gcgggccgcgccgc

SEQ ID NO: 2374359 - RNA, 16 nt, Bordetella pertussis
gcgggccgcgccgcgg

SEQ ID NO: 2374360 - RNA, 21 nt, Bordetella pertussis
gcgggccgcgccgcggcacgg

SEQ ID NO: 2374361 - RNA, 11 nt, Bordetella pertussis
gcgggccgcgg

SEQ ID NO: 2374362 - RNA, 18 nt, Bordetella pertussis
gcgggccgcugguggcca

SEQ ID NO: 2374363 - RNA, 14 nt, Bordetella pertussis
gcgggccggcgaug

SEQ ID NO: 2374364 - RNA, 13 nt, Bordetella pertussis
gcgggccggcgcg

SEQ ID NO: 2374365 - RNA, 15 nt, Bordetella pertussis
gcgggccggcgcgcc

SEQ ID NO: 2374366 - RNA, 16 nt, Bordetella pertussis
gcgggccggcgcgccu

SEQ ID NO: 2374367 - RNA, 23 nt, Bordetella pertussis
gcgggccggcucauucggcgcgc

SEQ ID NO: 2374368 - RNA, 15 nt, Bordetella pertussis
gcgggccggcugggc

SEQ ID NO: 2374369 - RNA, 16 nt, Bordetella pertussis
gcgggccggcugggcg

SEQ ID NO: 2374370 - RNA, 19 nt, Bordetella pertussis
gcgggccgggcaggccgcg

SEQ ID NO: 2374371 - RNA, 15 nt, Bordetella pertussis
gcggggacuggcucc

SEQ ID NO: 2374372 - RNA, 21 nt, Bordetella pertussis
gcggggacuggcucccaccgg

SEQ ID NO: 2374373 - RNA, 20 nt, Bordetella pertussis
gcggggauguuccggcugga

SEQ ID NO: 2374374 - RNA, 13 nt, Bordetella pertussis
gcggggccacaug

SEQ ID NO: 2374375 - RNA, 15 nt, Bordetella pertussis
gcggggccaggcgca

SEQ ID NO: 2374376 - RNA, 17 nt, Bordetella pertussis
gcggggcgcccagcgcg

SEQ ID NO: 2374377 - RNA, 19 nt, Bordetella pertussis
gcggggcgcccagcgcguc

SEQ ID NO: 2374378 - RNA, 23 nt, Bordetella pertussis
gcggggcgcccagcgcgucggcc

SEQ ID NO: 2374379 - RNA, 13 nt, Bordetella pertussis
gcggggcggcagg

SEQ ID NO: 2374380 - RNA, 16 nt, Bordetella pertussis
gcggggcggcaggucg

SEQ ID NO: 2374381 - RNA, 21 nt, Bordetella pertussis
gcggggcggcaggucgcgcga

SEQ ID NO: 2374382 - RNA, 12 nt, Bordetella pertussis
gcggggcggcgg

SEQ ID NO: 2374383 - RNA, 23 nt, Bordetella pertussis
gcggggcgugagcaggcgccugc

SEQ ID NO: 2374384 - RNA, 21 nt, Bordetella pertussis
gcgggguaggccucgaccgcg

SEQ ID NO: 2374385 - RNA, 14 nt, Bordetella pertussis
gcggggugccugca

SEQ ID NO: 2374386 - RNA, 13 nt, Bordetella pertussis
gcggggugccugu

SEQ ID NO: 2374387 - RNA, 16 nt, Bordetella pertussis
gcggggugccuguccc

SEQ ID NO: 2374388 - RNA, 21 nt, Bordetella pertussis
gcgggguggcacagccgcagc

SEQ ID NO: 2374389 - RNA, 17 nt, Bordetella pertussis
gcgggguuggccgccag

SEQ ID NO: 2374390 - RNA, 22 nt, Bordetella pertussis
gcgggguuuuuuuuugggaagg

SEQ ID NO: 2374391 - RNA, 14 nt, Bordetella pertussis
gcggguaaugccgg

SEQ ID NO: 2374392 - RNA, 17 nt, Bordetella pertussis
gcggguacuggccgacg

SEQ ID NO: 2374393 - RNA, 21 nt, Bordetella pertussis
gcggguaggcaaagcgcagca

SEQ ID NO: 2374394 - RNA, 17 nt, Bordetella pertussis
gcgggucaaggcggggc

SEQ ID NO: 2374395 - RNA, 22 nt, Bordetella pertussis
gcgggucaaguccggcgccgcc

SEQ ID NO: 2374396 - RNA, 13 nt, Bordetella pertussis
gcgggucaggccg

SEQ ID NO: 2374397 - RNA, 21 nt, Bordetella pertussis
gcggguccacguggcgacguc

SEQ ID NO: 2374398 - RNA, 13 nt, Bordetella pertussis
gcggguccagcag

SEQ ID NO: 2374399 - RNA, 14 nt, Bordetella pertussis
gcggguccagcagg

SEQ ID NO: 2374400 - RNA, 18 nt, Bordetella pertussis
gcggguccagcaggaugg

SEQ ID NO: 2374401 - RNA, 19 nt, Bordetella pertussis
gcgggucccaaccagggcc

SEQ ID NO: 2374402 - RNA, 23 nt, Bordetella pertussis
gcgggucccaaccagggccgcca

SEQ ID NO: 2374403 - RNA, 17 nt, Bordetella pertussis
gcggguccggcgugcca

SEQ ID NO: 2374404 - RNA, 20 nt, Bordetella pertussis
gcggguccuugccgggcucg

SEQ ID NO: 2374405 - RNA, 20 nt, Bordetella pertussis
gcgggucgaguugcgcgcca

SEQ ID NO: 2374406 - RNA, 14 nt, Bordetella pertussis
gcgggucggcgcca

SEQ ID NO: 2374407 - RNA, 21 nt, Bordetella pertussis
gcgggucggcgccaugaccac

SEQ ID NO: 2374408 - RNA, 16 nt, Bordetella pertussis
gcgggucgucccagcg

SEQ ID NO: 2374409 - RNA, 21 nt, Bordetella pertussis
gcgggucgucccagcgcacgc

SEQ ID NO: 2374410 - RNA, 19 nt, Bordetella pertussis
gcgggucgugaagccuucg

SEQ ID NO: 2374411 - RNA, 22 nt, Bordetella pertussis
gcgggucuugagcggcccgggc

SEQ ID NO: 2374412 - RNA, 17 nt, Bordetella pertussis
gcgggugaugcugcagc

SEQ ID NO: 2374413 - RNA, 15 nt, Bordetella pertussis
gcgggugccaguccc

SEQ ID NO: 2374414 - RNA, 13 nt, Bordetella pertussis
gcgggugccgcga

SEQ ID NO: 2374415 - RNA, 14 nt, Bordetella pertussis
gcgggugccugucc

SEQ ID NO: 2374416 - RNA, 14 nt, Bordetella pertussis
gcgggugcgcagca

SEQ ID NO: 2374417 - RNA, 22 nt, Bordetella pertussis
gcgggugcgggcaaacggcggc

SEQ ID NO: 2374418 - RNA, 14 nt, Bordetella pertussis
gcggguggccgcuc

SEQ ID NO: 2374419 - RNA, 14 nt, Bordetella pertussis
gcggguggccucgc

SEQ ID NO: 2374420 - RNA, 15 nt, Bordetella pertussis
gcggguggccucgcc

SEQ ID NO: 2374421 - RNA, 19 nt, Bordetella pertussis
gcggguggccucgcccugg

SEQ ID NO: 2374422 - RNA, 18 nt, Bordetella pertussis
gcgggugggcauccagcg

SEQ ID NO: 2374423 - RNA, 21 nt, Bordetella pertussis
gcgggugggcauccagcggca

SEQ ID NO: 2374424 - RNA, 16 nt, Bordetella pertussis
gcgggugggcgcgccg

SEQ ID NO: 2374425 - RNA, 15 nt, Bordetella pertussis
gcggguggugcugcu

SEQ ID NO: 2374426 - RNA, 19 nt, Bordetella pertussis
gcgggugucgcuccucccc

SEQ ID NO: 2374427 - RNA, 17 nt, Bordetella pertussis
gcggguucgacgccggc

SEQ ID NO: 2374428 - RNA, 14 nt, Bordetella pertussis
gcggguucgcccgg

SEQ ID NO: 2374429 - RNA, 23 nt, Bordetella pertussis
gcggguucggcgguuccagccug

SEQ ID NO: 2374430 - RNA, 15 nt, Bordetella pertussis
gcggguugcgcgcca

SEQ ID NO: 2374431 - RNA, 16 nt, Bordetella pertussis
gcggguugcgcgccag

SEQ ID NO: 2374432 - RNA, 17 nt, Bordetella pertussis
gcggguugcgcgccagc

SEQ ID NO: 2374433 - RNA, 20 nt, Bordetella pertussis
gcggguugcggcagcgccgc

SEQ ID NO: 2374434 - RNA, 20 nt, Bordetella pertussis
gcggguuggcagucggcagg

SEQ ID NO: 2374435 - RNA, 18 nt, Bordetella pertussis
gcggguuggucgucagcg

SEQ ID NO: 2374436 - RNA, 23 nt, Bordetella pertussis
gcggguuggucgucagcgccgcg

SEQ ID NO: 2374437 - RNA, 21 nt, Bordetella pertussis
gcggguuucucggccuugggc

SEQ ID NO: 2374438 - RNA, 16 nt, Bordetella pertussis
gcgguaagcguccgcg

SEQ ID NO: 2374439 - RNA, 20 nt, Bordetella pertussis
gcgguaagcguccgcgcgcc

SEQ ID NO: 2374440 - RNA, 21 nt, Bordetella pertussis
gcgguaagcguccgcgcgccg

SEQ ID NO: 2374441 - RNA, 16 nt, Bordetella pertussis
gcgguaaggucgggua

SEQ ID NO: 2374442 - RNA, 14 nt, Bordetella pertussis
gcgguacaggccgg

SEQ ID NO: 2374443 - RNA, 15 nt, Bordetella pertussis
gcgguacaggccggc

SEQ ID NO: 2374444 - RNA, 18 nt, Bordetella pertussis
gcgguacaggccggcggc

SEQ ID NO: 2374445 - RNA, 20 nt, Bordetella pertussis
gcgguacaggccggcggcga

SEQ ID NO: 2374446 - RNA, 22 nt, Bordetella pertussis
gcgguacaggcugccgucggcc

SEQ ID NO: 2374447 - RNA, 19 nt, Bordetella pertussis
gcgguacaggucguagacc

SEQ ID NO: 2374448 - RNA, 15 nt, Bordetella pertussis
gcgguaccaggccga

SEQ ID NO: 2374449 - RNA, 20 nt, Bordetella pertussis
gcgguaccaggccgagaugu

SEQ ID NO: 2374450 - RNA, 15 nt, Bordetella pertussis
gcgguacgcaccgcc

SEQ ID NO: 2374451 - RNA, 17 nt, Bordetella pertussis
gcgguacgcaccgccgc

SEQ ID NO: 2374452 - RNA, 18 nt, Bordetella pertussis
gcgguacgcaccgccgcc

SEQ ID NO: 2374453 - RNA, 15 nt, Bordetella pertussis
gcgguacgcccagcu

SEQ ID NO: 2374454 - RNA, 17 nt, Bordetella pertussis
gcgguagacgccgggac

SEQ ID NO: 2374455 - RNA, 13 nt, Bordetella pertussis
gcgguagccggcg

SEQ ID NO: 2374456 - RNA, 20 nt, Bordetella pertussis
gcgguagcgcucguccaugc

SEQ ID NO: 2374457 - RNA, 22 nt, Bordetella pertussis
gcgguaggacggcagcaccgcc

SEQ ID NO: 2374458 - RNA, 22 nt, Bordetella pertussis
gcgguaggcgcccgacggcgcg

SEQ ID NO: 2374459 - RNA, 23 nt, Bordetella pertussis
gcgguaggcgcccgacggcgcgc

SEQ ID NO: 2374460 - RNA, 21 nt, Bordetella pertussis
gcgguagggcgauggcgcguc

SEQ ID NO: 2374461 - RNA, 14 nt, Bordetella pertussis
gcgguagguagcgc

SEQ ID NO: 2374462 - RNA, 21 nt, Bordetella pertussis
gcgguagguagcgcgcagcuc

SEQ ID NO: 2374463 - RNA, 16 nt, Bordetella pertussis
gcgguaguagaccgcg

SEQ ID NO: 2374464 - RNA, 16 nt, Bordetella pertussis
gcgguaguccaucgcg

SEQ ID NO: 2374465 - RNA, 19 nt, Bordetella pertussis
gcgguaguccaucgcgucc

SEQ ID NO: 2374466 - RNA, 16 nt, Bordetella pertussis
gcgguaguucagcagc

SEQ ID NO: 2374467 - RNA, 13 nt, Bordetella pertussis
gcgguaugcggcg

SEQ ID NO: 2374468 - RNA, 16 nt, Bordetella pertussis
gcgguaugcggcgccc

SEQ ID NO: 2374469 - RNA, 20 nt, Bordetella pertussis
gcgguaugcggcgcccaggc

SEQ ID NO: 2374470 - RNA, 13 nt, Bordetella pertussis
gcgguauggccgc

SEQ ID NO: 2374471 - RNA, 19 nt, Bordetella pertussis
gcgguauggccgcccagca

SEQ ID NO: 2374472 - RNA, 20 nt, Bordetella pertussis
gcgguauggccgcccagcau

SEQ ID NO: 2374473 - RNA, 21 nt, Bordetella pertussis
gcgguauucgcgcuggcgcga

SEQ ID NO: 2374474 - RNA, 16 nt, Bordetella pertussis
gcgguauucgcugcug

SEQ ID NO: 2374475 - RNA, 21 nt, Bordetella pertussis
gcgguauucgcugcuggccgc

SEQ ID NO: 2374476 - RNA, 18 nt, Bordetella pertussis
gcgguauugcgccacccc

SEQ ID NO: 2374477 - RNA, 14 nt, Bordetella pertussis
gcggucaaugcggc

SEQ ID NO: 2374478 - RNA, 19 nt, Bordetella pertussis
gcggucaaugcggcggcgc

SEQ ID NO: 2374479 - RNA, 21 nt, Bordetella pertussis
gcggucaauguauuuggcggc

SEQ ID NO: 2374480 - RNA, 22 nt, Bordetella pertussis
gcggucaauguauuuggcggcu

SEQ ID NO: 2374481 - RNA, 19 nt, Bordetella pertussis
gcggucaccgagcugagca

SEQ ID NO: 2374482 - RNA, 16 nt, Bordetella pertussis
gcggucagccagagcg

SEQ ID NO: 2374483 - RNA, 20 nt, Bordetella pertussis
gcgguguagaccaccagcag

SEQ ID NO: 2374484 - RNA, 14 nt, Bordetella pertussis
gcggugucgccgcc

SEQ ID NO: 2374485 - RNA, 19 nt, Bordetella pertussis
gcggugucggacaacugcg

SEQ ID NO: 2374486 - RNA, 20 nt, Bordetella pertussis
gcgguguugcucgugcuggc

SEQ ID NO: 2374487 - RNA, 23 nt, Bordetella pertussis
gcgguguugcucgugcuggccgg

SEQ ID NO: 2374488 - RNA, 15 nt, Bordetella pertussis
gcgguguuggcgucc

SEQ ID NO: 2374489 - RNA, 19 nt, Bordetella pertussis
gcgguucaggguggccgcg

SEQ ID NO: 2374490 - RNA, 12 nt, Bordetella pertussis
gcgguuccagcc

SEQ ID NO: 2374491 - RNA, 18 nt, Bordetella pertussis
gcgguucgccgugcaggg

SEQ ID NO: 2374492 - RNA, 22 nt, Bordetella pertussis
gcgguucgccgugcagggccag

SEQ ID NO: 2374493 - RNA, 18 nt, Bordetella pertussis
gcgguucggcgaaccagu

SEQ ID NO: 2374494 - RNA, 16 nt, Bordetella pertussis
gcgguucguagccggu

SEQ ID NO: 2374495 - RNA, 22 nt, Bordetella pertussis
gcgguucguccucgucggccau

SEQ ID NO: 2374496 - RNA, 20 nt, Bordetella pertussis
gcgguucugggcccgaucgc

SEQ ID NO: 2374497 - RNA, 19 nt, Bordetella pertussis
gcgguugaaggcgaacggc

SEQ ID NO: 2374498 - RNA, 15 nt, Bordetella pertussis
gcgguugcgcugcug

SEQ ID NO: 2374499 - RNA, 14 nt, Bordetella pertussis
gcgguugggcgcac

SEQ ID NO: 2374500 - RNA, 16 nt, Bordetella pertussis
gcgguugguuugcggc

SEQ ID NO: 2374501 - RNA, 18 nt, Bordetella pertussis
gcgguugguuugcggcgc

SEQ ID NO: 2374502 - RNA, 22 nt, Bordetella pertussis
gcgguuucguagaugggcaggc

SEQ ID NO: 2374503 - RNA, 19 nt, Bordetella pertussis
gcgguuucucagcgcgcuu

SEQ ID NO: 2374504 - RNA, 18 nt, Bordetella pertussis
gcgguuucuuccagcagg

SEQ ID NO: 2374505 - RNA, 21 nt, Bordetella pertussis
gcgguuugguagcaggcgcgc

SEQ ID NO: 2374506 - RNA, 12 nt, Bordetella pertussis
gcguaagcccac

SEQ ID NO: 2374507 - RNA, 21 nt, Bordetella pertussis
gcguaauagcuggcggcgcgc

SEQ ID NO: 2374508 - RNA, 18 nt, Bordetella pertussis
gcguaauugggcugguag

SEQ ID NO: 2374509 - RNA, 15 nt, Bordetella pertussis
gcguacaacgccgcg

SEQ ID NO: 2374510 - RNA, 17 nt, Bordetella pertussis
gcguacagcagggugcc

SEQ ID NO: 2374511 - RNA, 20 nt, Bordetella pertussis
gcguacagcagggugccugu

SEQ ID NO: 2374512 - RNA, 22 nt, Bordetella pertussis
gcguacagcccgaacagaaggc

SEQ ID NO: 2374513 - RNA, 19 nt, Bordetella pertussis
gcguacaggugcuggguca

SEQ ID NO: 2374514 - RNA, 14 nt, Bordetella pertussis
gcguaccagcccag

SEQ ID NO: 2374515 - RNA, 18 nt, Bordetella pertussis
gcguaccucggugaggau

SEQ ID NO: 2374516 - RNA, 20 nt, Bordetella pertussis
gcguacgacggggugccugu

SEQ ID NO: 2374517 - RNA, 14 nt, Bordetella pertussis
gcguacgaggaccu

SEQ ID NO: 2374518 - RNA, 20 nt, Bordetella pertussis
gcguacgauagcggaugaug

SEQ ID NO: 2374519 - RNA, 18 nt, Bordetella pertussis
gcguacgcuuaucgcggc

SEQ ID NO: 2374520 - RNA, 14 nt, Bordetella pertussis
gcguacggcgcggu

SEQ ID NO: 2374521 - RNA, 19 nt, Bordetella pertussis
gcguacuggcgcggcggcc

SEQ ID NO: 2374522 - RNA, 20 nt, Bordetella pertussis
gcguagagcagugugccugu

SEQ ID NO: 2374523 - RNA, 15 nt, Bordetella pertussis
gcguagagcgccgcg

SEQ ID NO: 2374524 - RNA, 16 nt, Bordetella pertussis
gcguagauccaggcgg

SEQ ID NO: 2374525 - RNA, 19 nt, Bordetella pertussis
gcguagauccaggcggcca

SEQ ID NO: 2374526 - RNA, 22 nt, Bordetella pertussis
gcguagauccaggcggccacca

SEQ ID NO: 2374527 - RNA, 17 nt, Bordetella pertussis
gcguagccgaucuggcc

SEQ ID NO: 2374528 - RNA, 21 nt, Bordetella pertussis
gcguagccggaaugcaccacg

SEQ ID NO: 2374529 - RNA, 23 nt, Bordetella pertussis
gcguagcgauccgaugcccgguu

SEQ ID NO: 2374530 - RNA, 15 nt, Bordetella pertussis
gcguagcugcgccgc

SEQ ID NO: 2374531 - RNA, 20 nt, Bordetella pertussis
gcguaggcaggggcuccagg

SEQ ID NO: 2374532 - RNA, 13 nt, Bordetella pertussis
gcguaggccucgc

SEQ ID NO: 2374533 - RNA, 16 nt, Bordetella pertussis
gcguaggccuucaccu

SEQ ID NO: 2374534 - RNA, 12 nt, Bordetella pertussis
gcguaggcgcgc

SEQ ID NO: 2374535 - RNA, 14 nt, Bordetella pertussis
gcguaggcgcgcgc

SEQ ID NO: 2374536 - RNA, 21 nt, Bordetella pertussis
gcguaggcgcgcgcaucggcc

SEQ ID NO: 2374537 - RNA, 20 nt, Bordetella pertussis
gcguaggucaggcccacgcc

SEQ ID NO: 2374538 - RNA, 21 nt, Bordetella pertussis
gcguaguccgagcccgggcgu

SEQ ID NO: 2374539 - RNA, 19 nt, Bordetella pertussis
gcguagucguugccggcca

SEQ ID NO: 2374540 - RNA, 17 nt, Bordetella pertussis
gcguaguugucggcgca

SEQ ID NO: 2374541 - RNA, 19 nt, Bordetella pertussis
gcguaguugucggcgcaga

SEQ ID NO: 2374542 - RNA, 13 nt, Bordetella pertussis
gcguauaggccac

SEQ ID NO: 2374543 - RNA, 16 nt, Bordetella pertussis
gcguauaggccacccc

SEQ ID NO: 2374544 - RNA, 23 nt, Bordetella pertussis
gcguaucaacuuccagcgcccgc

SEQ ID NO: 2374545 - RNA, 21 nt, Bordetella pertussis
gcguauccagcaucaccagcu

SEQ ID NO: 2374546 - RNA, 17 nt, Bordetella pertussis
gcguaucgcccgcgcgg

SEQ ID NO: 2374547 - RNA, 14 nt, Bordetella pertussis
gcguaucgccgccg

SEQ ID NO: 2374548 - RNA, 19 nt, Bordetella pertussis
gcguaucgccgccgccggc

SEQ ID NO: 2374549 - RNA, 20 nt, Bordetella pertussis
gcguaucgccgccgccggca

SEQ ID NO: 2374550 - RNA, 17 nt, Bordetella pertussis
gcguaugacagggugcc

SEQ ID NO: 2374551 - RNA, 20 nt, Bordetella pertussis
gcguaugacagggugccugu

SEQ ID NO: 2374552 - RNA, 17 nt, Bordetella pertussis
gcguaugacgcgcugau

SEQ ID NO: 2374553 - RNA, 23 nt, Bordetella pertussis
gcguaugcaccgggccgaacaug

SEQ ID NO: 2374554 - RNA, 16 nt, Bordetella pertussis
gcguaugcccacuccc

SEQ ID NO: 2374555 - RNA, 22 nt, Bordetella pertussis
gcguauggcccgccaccacggc

SEQ ID NO: 2374556 - RNA, 14 nt, Bordetella pertussis
gcguauggcggcgc

SEQ ID NO: 2374557 - RNA, 18 nt, Bordetella pertussis
gcguauuccggguccagc

SEQ ID NO: 2374558 - RNA, 18 nt, Bordetella pertussis
gcguauucgguggcgcgc

SEQ ID NO: 2374559 - RNA, 19 nt, Bordetella pertussis
gcgucaacuacacgguggg

SEQ ID NO: 2374560 - RNA, 23 nt, Bordetella pertussis
gcgucaacuacacggugggcgac

SEQ ID NO: 2374561 - RNA, 18 nt, Bordetella pertussis
gcgucaagccagcggcgc

SEQ ID NO: 2374562 - RNA, 19 nt, Bordetella pertussis
gcgucaauccgccgccagc

SEQ ID NO: 2374563 - RNA, 20 nt, Bordetella pertussis
gcgucaauccgccgccagca

SEQ ID NO: 2374564 - RNA, 21 nt, Bordetella pertussis
gcgucaauccgccgccagcac

SEQ ID NO: 2374565 - RNA, 16 nt, Bordetella pertussis
gcgucaaugccagucg

SEQ ID NO: 2374566 - RNA, 16 nt, Bordetella pertussis
gcgucacaaagacggc

SEQ ID NO: 2374567 - RNA, 14 nt, Bordetella pertussis
gcgucaccagcagg

SEQ ID NO: 2374568 - RNA, 16 nt, Bordetella pertussis
gcgucaccagcaggcg

SEQ ID NO: 2374569 - RNA, 12 nt, Bordetella pertussis
gcgucaccggcg

SEQ ID NO: 2374570 - RNA, 14 nt, Bordetella pertussis
gcgucaccggcgag

SEQ ID NO: 2374571 - RNA, 21 nt, Bordetella pertussis
gcgucacgaaagcgcccaggc

SEQ ID NO: 2374572 - RNA, 22 nt, Bordetella pertussis
gcgucacgaaagcgcccaggcc

SEQ ID NO: 2374573 - RNA, 19 nt, Bordetella pertussis
gcgucacgcacagcaccug

SEQ ID NO: 2374574 - RNA, 22 nt, Bordetella pertussis
gcgucacgcacagcaccuggug

SEQ ID NO: 2374575 - RNA, 12 nt, Bordetella pertussis
gcgucacgcggc

SEQ ID NO: 2374576 - RNA, 18 nt, Bordetella pertussis
gcgucacgcggccgggca

SEQ ID NO: 2374577 - RNA, 17 nt, Bordetella pertussis
gcgucagcacaucgccc

SEQ ID NO: 2374578 - RNA, 20 nt, Bordetella pertussis
gcgucagcacaucgcccggc

SEQ ID NO: 2374579 - RNA, 16 nt, Bordetella pertussis
gcgucagcgugcgccc

SEQ ID NO: 2374580 - RNA, 18 nt, Bordetella pertussis
gcgucagcgugcgccccg

SEQ ID NO: 2374581 - RNA, 19 nt, Bordetella pertussis
gcgucagcgugcgccccgc

SEQ ID NO: 2374582 - RNA, 17 nt, Bordetella pertussis
gcgucagcugggcaugc

SEQ ID NO: 2374583 - RNA, 18 nt, Bordetella pertussis
gcgucagcugggcaugca

SEQ ID NO: 2374584 - RNA, 12 nt, Bordetella pertussis
gcgucaggccgg

SEQ ID NO: 2374585 - RNA, 21 nt, Bordetella pertussis
gcgucaggccgggcagcgaga

SEQ ID NO: 2374586 - RNA, 17 nt, Bordetella pertussis
gcgucaggcgagcgcgg

SEQ ID NO: 2374587 - RNA, 19 nt, Bordetella pertussis
gcgucaggcgagcgcggcg

SEQ ID NO: 2374588 - RNA, 20 nt, Bordetella pertussis
gcgucaggcgagcgcggcgg

SEQ ID NO: 2374589 - RNA, 18 nt, Bordetella pertussis
gcgucaguugggcgcgcc

SEQ ID NO: 2374590 - RNA, 20 nt, Bordetella pertussis
gcgucaguugggcgcgccca

SEQ ID NO: 2374591 - RNA, 21 nt, Bordetella pertussis
gcgucaguugggcgcgcccag

SEQ ID NO: 2374592 - RNA, 17 nt, Bordetella pertussis
gcgucauacacggcgcg

SEQ ID NO: 2374593 - RNA, 15 nt, Bordetella pertussis
gcgucauacgacgcg

SEQ ID NO: 2374594 - RNA, 17 nt, Bordetella pertussis
gcgucaucggcgcgcag

SEQ ID NO: 2374595 - RNA, 15 nt, Bordetella pertussis
gcgucgccgcgcacg

SEQ ID NO: 2374596 - RNA, 14 nt, Bordetella pertussis
gcgucgccgcuggc

SEQ ID NO: 2374597 - RNA, 16 nt, Bordetella pertussis
gcgucgccgcuggcca

SEQ ID NO: 2374598 - RNA, 13 nt, Bordetella pertussis
gcgucgccggcca

SEQ ID NO: 2374599 - RNA, 16 nt, Bordetella pertussis
gcgucgccggccaggc

SEQ ID NO: 2374600 - RNA, 17 nt, Bordetella pertussis
gcgucgccggccaggca

SEQ ID NO: 2374601 - RNA, 18 nt, Bordetella pertussis
gcgucgccggcgaugacg

SEQ ID NO: 2374602 - RNA, 16 nt, Bordetella pertussis
gcgucgccuggucgac

SEQ ID NO: 2374603 - RNA, 22 nt, Bordetella pertussis
gcgucgccuggucgacgccggc

SEQ ID NO: 2374604 - RNA, 16 nt, Bordetella pertussis
gcgucgcgaugcgcca

SEQ ID NO: 2374605 - RNA, 20 nt, Bordetella pertussis
gcgucgcgaugcgccaggcg

SEQ ID NO: 2374606 - RNA, 14 nt, Bordetella pertussis
gcgucgcgcgccag

SEQ ID NO: 2374607 - RNA, 17 nt, Bordetella pertussis
gcgucgcgcgccaggcg

SEQ ID NO: 2374608 - RNA, 14 nt, Bordetella pertussis
gcgucgcgcggcgg

SEQ ID NO: 2374609 - RNA, 15 nt, Bordetella pertussis
gcgucgcgcggcggc

SEQ ID NO: 2374610 - RNA, 14 nt, Bordetella pertussis
gcgucgcgcuucuu

SEQ ID NO: 2374611 - RNA, 17 nt, Bordetella pertussis
gcgucgcggcgucgacc

SEQ ID NO: 2374612 - RNA, 17 nt, Bordetella pertussis
gcgucgcguagcgcggc

SEQ ID NO: 2374613 - RNA, 20 nt, Bordetella pertussis
gcgucgcguagcgcggccgg

SEQ ID NO: 2374614 - RNA, 19 nt, Bordetella pertussis
gcgucgcucugcgcggcau

SEQ ID NO: 2374615 - RNA, 13 nt, Bordetella pertussis
gcgucgcugcgcg

SEQ ID NO: 2374616 - RNA, 13 nt, Bordetella pertussis
gcgucgcugcugg

SEQ ID NO: 2374617 - RNA, 23 nt, Bordetella pertussis
gcgucgcugcuggcggcgcuggu

SEQ ID NO: 2374618 - RNA, 14 nt, Bordetella pertussis
gcgucgcuggccgg

SEQ ID NO: 2374619 - RNA, 17 nt, Bordetella pertussis
gcgucgcuggccggacg

SEQ ID NO: 2374620 - RNA, 15 nt, Bordetella pertussis
gcgucggacgcgcgc

SEQ ID NO: 2374621 - RNA, 19 nt, Bordetella pertussis
gcgucggccaaggccggcg

SEQ ID NO: 2374622 - RNA, 20 nt, Bordetella pertussis
gcgucggccaaggccggcgc

SEQ ID NO: 2374623 - RNA, 14 nt, Bordetella pertussis
gcgucggccacguc

SEQ ID NO: 2374624 - RNA, 17 nt, Bordetella pertussis
gcgucggccacgucgcc

SEQ ID NO: 2374625 - RNA, 19 nt, Bordetella pertussis
gcgucggccacgucgccca

SEQ ID NO: 2374626 - RNA, 13 nt, Bordetella pertussis
gcgucggccagcg

SEQ ID NO: 2374627 - RNA, 14 nt, Bordetella pertussis
gcgucggccagcgc

SEQ ID NO: 2374628 - RNA, 12 nt, Bordetella pertussis
gcgucggccagg

SEQ ID NO: 2374629 - RNA, 13 nt, Bordetella pertussis
gcgucggccaggc

SEQ ID NO: 2374630 - RNA, 21 nt, Bordetella pertussis
gcgucggccaggccgaugaau

SEQ ID NO: 2374631 - RNA, 15 nt, Bordetella pertussis
gcgucggccauggcg

SEQ ID NO: 2374632 - RNA, 21 nt, Bordetella pertussis
gcgucggccauggcgcuguug

SEQ ID NO: 2374633 - RNA, 16 nt, Bordetella pertussis
gcgucggccgcgccca

SEQ ID NO: 2374634 - RNA, 21 nt, Bordetella pertussis
gcgucggccucaucgagcgcc

SEQ ID NO: 2374635 - RNA, 22 nt, Bordetella pertussis
gcgucggccucaucgagcgccu

SEQ ID NO: 2374636 - RNA, 13 nt, Bordetella pertussis
gcgucggccugca

SEQ ID NO: 2374637 - RNA, 14 nt, Bordetella pertussis
gcgucggccugcca

SEQ ID NO: 2374638 - RNA, 15 nt, Bordetella pertussis
gcgucggccugccag

SEQ ID NO: 2374639 - RNA, 13 nt, Bordetella pertussis
gcgucggccuggu

SEQ ID NO: 2374640 - RNA, 21 nt, Bordetella pertussis
gcgucggcgaagcuguccuuc

SEQ ID NO: 2374641 - RNA, 13 nt, Bordetella pertussis
gcgucggcgccga

SEQ ID NO: 2374642 - RNA, 14 nt, Bordetella pertussis
gcgucggcgcgcgc

SEQ ID NO: 2374643 - RNA, 18 nt, Bordetella pertussis
gcgucggcgcgcgcgacu

SEQ ID NO: 2374644 - RNA, 13 nt, Bordetella pertussis
gcgucggcgcggu

SEQ ID NO: 2374645 - RNA, 13 nt, Bordetella pertussis
gcgucggcggccc

SEQ ID NO: 2374646 - RNA, 19 nt, Bordetella pertussis
gcgucggcggcccacagcg

SEQ ID NO: 2374647 - RNA, 20 nt, Bordetella pertussis
gcgucggcguaaggccgccg

SEQ ID NO: 2374648 - RNA, 23 nt, Bordetella pertussis
gcgucggcguaaggccgccggcc

SEQ ID NO: 2374649 - RNA, 23 nt, Bordetella pertussis
gcgucgggcacguccggaucuuc

SEQ ID NO: 2374650 - RNA, 14 nt, Bordetella pertussis
gcgucgggcagcag

SEQ ID NO: 2374651 - RNA, 15 nt, Bordetella pertussis
gcgucgggcagcagg

SEQ ID NO: 2374652 - RNA, 15 nt, Bordetella pertussis
gcgucgggggcggcc

SEQ ID NO: 2374653 - RNA, 16 nt, Bordetella pertussis
gcgucgggggcggccg

SEQ ID NO: 2374654 - RNA, 17 nt, Bordetella pertussis
gcgucgggggcggccgg

SEQ ID NO: 2374655 - RNA, 20 nt, Bordetella pertussis
gcgucgggucagccuugcuc

SEQ ID NO: 2374656 - RNA, 21 nt, Bordetella pertussis
gcgucggugccguccagcgcg

SEQ ID NO: 2374657 - RNA, 17 nt, Bordetella pertussis
gcgucgguggccagcca

SEQ ID NO: 2374658 - RNA, 20 nt, Bordetella pertussis
gcgucgguggccagccaggc

SEQ ID NO: 2374659 - RNA, 21 nt, Bordetella pertussis
gcgucgguggccagccaggcg

SEQ ID NO: 2374660 - RNA, 22 nt, Bordetella pertussis
gcgucgguggccagccaggcgg

SEQ ID NO: 2374661 - RNA, 14 nt, Bordetella pertussis
gcgucguccagcgu

SEQ ID NO: 2374662 - RNA, 24 nt, Bordetella pertussis
gcgucguccagcguggcgcagucg

SEQ ID NO: 2374663 - RNA, 15 nt, Bordetella pertussis
gcgucguccaucgac

SEQ ID NO: 2374664 - RNA, 15 nt, Bordetella pertussis
gcgucguccugcagc

SEQ ID NO: 2374665 - RNA, 22 nt, Bordetella pertussis
gcgucgucgccgucgcccuggc

SEQ ID NO: 2374666 - RNA, 15 nt, Bordetella pertussis
gcgucgucguuuccc

SEQ ID NO: 2374667 - RNA, 21 nt, Bordetella pertussis
gcgucgugcccgccacccagg

SEQ ID NO: 2374668 - RNA, 15 nt, Bordetella pertussis
gcgucguggggcgcg

SEQ ID NO: 2374669 - RNA, 16 nt, Bordetella pertussis
gcgucguucaucgccc

SEQ ID NO: 2374670 - RNA, 20 nt, Bordetella pertussis
gcgucguuggccgcguagcc

SEQ ID NO: 2374671 - RNA, 13 nt, Bordetella pertussis
gcgucuaccugga

SEQ ID NO: 2374672 - RNA, 20 nt, Bordetella pertussis
gcgucuaccuggacgggcug

SEQ ID NO: 2374673 - RNA, 13 nt, Bordetella pertussis
gcgucuccacgcc

SEQ ID NO: 2374674 - RNA, 17 nt, Bordetella pertussis
gcgucuccagcgccggc

SEQ ID NO: 2374675 - RNA, 19 nt, Bordetella pertussis
gcgucuccagcgccggcag

SEQ ID NO: 2374676 - RNA, 15 nt, Bordetella pertussis
gcgucuccagcgcgg

SEQ ID NO: 2374677 - RNA, 23 nt, Bordetella pertussis
gcgucucggaaaacuggcgggug

SEQ ID NO: 2374678 - RNA, 22 nt, Bordetella pertussis
gcgucucgggcugggugaagcc

SEQ ID NO: 2374679 - RNA, 14 nt, Bordetella pertussis
gcgucugcccgcgg

SEQ ID NO: 2374680 - RNA, 15 nt, Bordetella pertussis
gcgucugcccgcggu

SEQ ID NO: 2374681 - RNA, 21 nt, Bordetella pertussis
gcgucugcccgcgguccagca

SEQ ID NO: 2374682 - RNA, 23 nt, Bordetella pertussis
gcgucugcccgcgguccagcacg

SEQ ID NO: 2374683 - RNA, 21 nt, Bordetella pertussis
gcgucugcucgccguucuucg

SEQ ID NO: 2374684 - RNA, 21 nt, Bordetella pertussis
gcgucuggagcggccuggccc

SEQ ID NO: 2374685 - RNA, 16 nt, Bordetella pertussis
gcgucuucgccgacca

SEQ ID NO: 2374686 - RNA, 15 nt, Bordetella pertussis
gcgucuucggcgcgg

SEQ ID NO: 2374687 - RNA, 18 nt, Bordetella pertussis
gcgucuucggcgcggcgg

SEQ ID NO: 2374688 - RNA, 20 nt, Bordetella pertussis
gcgucuucggcgcggcgggc

SEQ ID NO: 2374689 - RNA, 15 nt, Bordetella pertussis
gcgugaaaggccagc

SEQ ID NO: 2374690 - RNA, 16 nt, Bordetella pertussis
gcgugaaaggccagcg

SEQ ID NO: 2374691 - RNA, 18 nt, Bordetella pertussis
gcgugaaaggccagcggc

SEQ ID NO: 2374692 - RNA, 20 nt, Bordetella pertussis
gcgugaacgcgcauucgucg

SEQ ID NO: 2374693 - RNA, 13 nt, Bordetella pertussis
gcgugaaggucgg

SEQ ID NO: 2374694 - RNA, 15 nt, Bordetella pertussis
gcgugaaggucggca

SEQ ID NO: 2374695 - RNA, 15 nt, Bordetella pertussis
gcgugaagucggccg

SEQ ID NO: 2374696 - RNA, 18 nt, Bordetella pertussis
gcgugaauaccgcgcaca

SEQ ID NO: 2374697 - RNA, 20 nt, Bordetella pertussis
gcgugaauaccgcgcacagg

SEQ ID NO: 2374698 - RNA, 23 nt, Bordetella pertussis
gcgugaauaccgcgcacaggucg

SEQ ID NO: 2374699 - RNA, 14 nt, Bordetella pertussis
gcgugacacggcca

SEQ ID NO: 2374700 - RNA, 16 nt, Bordetella pertussis
gcgugaccgacaggcc

SEQ ID NO: 2374701 - RNA, 19 nt, Bordetella pertussis
gcgugaccgacaggccugg

SEQ ID NO: 2374702 - RNA, 19 nt, Bordetella pertussis
gcgugaccgcgacgcgccu

SEQ ID NO: 2374703 - RNA, 20 nt, Bordetella pertussis
gcgugaccggacuguccacg

SEQ ID NO: 2374704 - RNA, 18 nt, Bordetella pertussis
gcgugacgauauccaggc

SEQ ID NO: 2374705 - RNA, 22 nt, Bordetella pertussis
gcgugacgauauccaggcgcgu

SEQ ID NO: 2374706 - RNA, 16 nt, Bordetella pertussis
gcgugacgcgcggguc

SEQ ID NO: 2374707 - RNA, 22 nt, Bordetella pertussis
gcgugacgcgcggguccaggcc

SEQ ID NO: 2374708 - RNA, 21 nt, Bordetella pertussis
gcguggcgcagucgagcaccg

SEQ ID NO: 2374709 - RNA, 22 nt, Bordetella pertussis
gcguggcgcagucgagcaccgc

SEQ ID NO: 2374710 - RNA, 13 nt, Bordetella pertussis
gcguggcgcagug

SEQ ID NO: 2374711 - RNA, 21 nt, Bordetella pertussis
gcguggcgccgaaggcggcgc

SEQ ID NO: 2374712 - RNA, 20 nt, Bordetella pertussis
gcguggcgcgcaaccagggg

SEQ ID NO: 2374713 - RNA, 20 nt, Bordetella pertussis
gcguggcgcgcacacuggcc

SEQ ID NO: 2374714 - RNA, 23 nt, Bordetella pertussis
gcguggcgcgcacacuggccagc

SEQ ID NO: 2374715 - RNA, 16 nt, Bordetella pertussis
gcguggcgcgccagcg

SEQ ID NO: 2374716 - RNA, 13 nt, Bordetella pertussis
gcguggcgcgccc

SEQ ID NO: 2374717 - RNA, 12 nt, Bordetella pertussis
gcguggcgcgcg

SEQ ID NO: 2374718 - RNA, 13 nt, Bordetella pertussis
gcguggcgcgcgc

SEQ ID NO: 2374719 - RNA, 14 nt, Bordetella pertussis
gcguggcgcgcgcc

SEQ ID NO: 2374720 - RNA, 15 nt, Bordetella pertussis
gcguggcgcgcgccg

SEQ ID NO: 2374721 - RNA, 16 nt, Bordetella pertussis
gcguggcgcgcgugcu

SEQ ID NO: 2374722 - RNA, 16 nt, Bordetella pertussis
gcguggcgcggguggc

SEQ ID NO: 2374723 - RNA, 19 nt, Bordetella pertussis
gcguggcgcggguggccgg

SEQ ID NO: 2374724 - RNA, 16 nt, Bordetella pertussis
gcguggcggccaggcc

SEQ ID NO: 2374725 - RNA, 17 nt, Bordetella pertussis
gcguggcggccaggccg

SEQ ID NO: 2374726 - RNA, 12 nt, Bordetella pertussis
gcguggcggcgc

SEQ ID NO: 2374727 - RNA, 12 nt, Bordetella pertussis
gcguggcggcgu

SEQ ID NO: 2374728 - RNA, 14 nt, Bordetella pertussis
gcguggcgggccgc

SEQ ID NO: 2374729 - RNA, 20 nt, Bordetella pertussis
gcguggcgggccgcgccgcg

SEQ ID NO: 2374730 - RNA, 16 nt, Bordetella pertussis
gcguggcggggauggc

SEQ ID NO: 2374731 - RNA, 17 nt, Bordetella pertussis
gcguggcggggauggcu

SEQ ID NO: 2374732 - RNA, 19 nt, Bordetella pertussis
gcguggcggggauggcugg

SEQ ID NO: 2374733 - RNA, 14 nt, Bordetella pertussis
gcguggcgguacgg

SEQ ID NO: 2374734 - RNA, 21 nt, Bordetella pertussis
gcguggcgugccgcagcgagg

SEQ ID NO: 2374735 - RNA, 19 nt, Bordetella pertussis
gcgugggcaugguggcgaa

SEQ ID NO: 2374736 - RNA, 14 nt, Bordetella pertussis
gcgugggccagcaa

SEQ ID NO: 2374737 - RNA, 16 nt, Bordetella pertussis
gcgugggccagcaacu

SEQ ID NO: 2374738 - RNA, 17 nt, Bordetella pertussis
gcgugggcggcggcaug

SEQ ID NO: 2374739 - RNA, 15 nt, Bordetella pertussis
gcguggggagcgcgg

SEQ ID NO: 2374740 - RNA, 16 nt, Bordetella pertussis
gcguggggagcgcggc

SEQ ID NO: 2374741 - RNA, 19 nt, Bordetella pertussis
gcguggggagcgcggcccg

SEQ ID NO: 2374742 - RNA, 22 nt, Bordetella pertussis
gcguggggccggccgcgcgcgc

SEQ ID NO: 2374743 - RNA, 21 nt, Bordetella pertussis
gcgugguacgacgagcgcacc

SEQ ID NO: 2374744 - RNA, 22 nt, Bordetella pertussis
gcgugguacgacgagcgcacca

SEQ ID NO: 2374745 - RNA, 15 nt, Bordetella pertussis
gcgugguaucgcgcc

SEQ ID NO: 2374746 - RNA, 17 nt, Bordetella pertussis
gcgugguaucgcgccag

SEQ ID NO: 2374747 - RNA, 18 nt, Bordetella pertussis
gcgugguaucgcgccagc

SEQ ID NO: 2374748 - RNA, 19 nt, Bordetella pertussis
gcgugguaucgcgccagcg

SEQ ID NO: 2374749 - RNA, 20 nt, Bordetella pertussis
gcgugguaucgcgccagcgc

SEQ ID NO: 2374750 - RNA, 21 nt, Bordetella pertussis
gcgugguaucgcgccagcgcc

SEQ ID NO: 2374751 - RNA, 16 nt, Bordetella pertussis
gcgugguauugguggu

SEQ ID NO: 2374752 - RNA, 16 nt, Bordetella pertussis
gcguggucgcgggugg

SEQ ID NO: 2374753 - RNA, 14 nt, Bordetella pertussis
gcguggugcccugc

SEQ ID NO: 2374754 - RNA, 15 nt, Bordetella pertussis
gcguggugcccugcu

SEQ ID NO: 2374755 - RNA, 14 nt, Bordetella pertussis
gcgugguggccuug

SEQ ID NO: 2374756 - RNA, 18 nt, Bordetella pertussis
gcgugguggccuugcugc

SEQ ID NO: 2374757 - RNA, 14 nt, Bordetella pertussis
gcguguagagcagg

SEQ ID NO: 2374758 - RNA, 17 nt, Bordetella pertussis
gcguguagagcaggccg

SEQ ID NO: 2374759 - RNA, 18 nt, Bordetella pertussis
gcguguagagcaggccgc

SEQ ID NO: 2374760 - RNA, 15 nt, Bordetella pertussis
gcguguaggcggccg

SEQ ID NO: 2374761 - RNA, 16 nt, Bordetella pertussis
gcguguaggcggccgg

SEQ ID NO: 2374762 - RNA, 16 nt, Bordetella pertussis
gcgugucccagccggc

SEQ ID NO: 2374763 - RNA, 15 nt, Bordetella pertussis
gcgugucgaacacca

SEQ ID NO: 2374764 - RNA, 16 nt, Bordetella pertussis
gcgugucgaacaccag

SEQ ID NO: 2374765 - RNA, 17 nt, Bordetella pertussis
gcgugucgaacaccagg

SEQ ID NO: 2374766 - RNA, 18 nt, Bordetella pertussis
gcgugucgaacaccaggu

SEQ ID NO: 2374767 - RNA, 14 nt, Bordetella pertussis
gcgugucgccgacc

SEQ ID NO: 2374768 - RNA, 20 nt, Bordetella pertussis
gcgugucgccgacccgggcg

SEQ ID NO: 2374769 - RNA, 22 nt, Bordetella pertussis
gcgugugcaggacgaacaggcc

SEQ ID NO: 2374770 - RNA, 14 nt, Bordetella pertussis
gcgugugcccagca

SEQ ID NO: 2374771 - RNA, 23 nt, Bordetella pertussis
gcgugugcccagcaccaggccga

SEQ ID NO: 2374772 - RNA, 16 nt, Bordetella pertussis
gcgugugccgccagcg

SEQ ID NO: 2374773 - RNA, 22 nt, Bordetella pertussis
gcguguggugaaagccgccggc

SEQ ID NO: 2374774 - RNA, 19 nt, Bordetella pertussis
gcgugugguuggcgcugcu

SEQ ID NO: 2374775 - RNA, 16 nt, Bordetella pertussis
gcgugugucccggcgg

SEQ ID NO: 2374776 - RNA, 17 nt, Bordetella pertussis
gcguguucagcgcgcgc

SEQ ID NO: 2374777 - RNA, 20 nt, Bordetella pertussis
gcguguucagcgcgcgcgcc

SEQ ID NO: 2374778 - RNA, 19 nt, Bordetella pertussis
gcguucaagucgcccugcu

SEQ ID NO: 2374779 - RNA, 18 nt, Bordetella pertussis
gcguucaaucgcgcuucu

SEQ ID NO: 2374780 - RNA, 23 nt, Bordetella pertussis
gcguucaccaggaagcgcgccug

SEQ ID NO: 2374781 - RNA, 21 nt, Bordetella pertussis
gcguucagcgggcgcgcccgg

SEQ ID NO: 2374782 - RNA, 14 nt, Bordetella pertussis
gcguucaggcgcgg

SEQ ID NO: 2374783 - RNA, 15 nt, Bordetella pertussis
gcguucaggcgcggc

SEQ ID NO: 2374784 - RNA, 17 nt, Bordetella pertussis
gcguucagggcgccgcg

SEQ ID NO: 2374785 - RNA, 19 nt, Bordetella pertussis
gcguucagggcgccgcggc

SEQ ID NO: 2374786 - RNA, 23 nt, Bordetella pertussis
gcguucagguugcuuucggcgac

SEQ ID NO: 2374787 - RNA, 17 nt, Bordetella pertussis
gcguuccagcagaucgc

SEQ ID NO: 2374788 - RNA, 20 nt, Bordetella pertussis
gcguuccagcagaucgcggc

SEQ ID NO: 2374789 - RNA, 23 nt, Bordetella pertussis
gcguuccagcagaucgcggcggg

SEQ ID NO: 2374790 - RNA, 19 nt, Bordetella pertussis
gcguuccaugacguccagc

SEQ ID NO: 2374791 - RNA, 20 nt, Bordetella pertussis
gcguuccaugacguccagcg

SEQ ID NO: 2374792 - RNA, 16 nt, Bordetella pertussis
gcguuccuggcgcugu

SEQ ID NO: 2374793 - RNA, 16 nt, Bordetella pertussis
gcguuccugggcacgc

SEQ ID NO: 2374794 - RNA, 17 nt, Bordetella pertussis
gcguucgaaagccagcg

SEQ ID NO: 2374795 - RNA, 20 nt, Bordetella pertussis
gcguucgaaagccagcgccu

SEQ ID NO: 2374796 - RNA, 15 nt, Bordetella pertussis
gcguucgacgggcag

SEQ ID NO: 2374797 - RNA, 19 nt, Bordetella pertussis
gcguucgacgggcaggccc

SEQ ID NO: 2374798 - RNA, 23 nt, Bordetella pertussis
gcguucgacgggcaggcccagcc

SEQ ID NO: 2374799 - RNA, 16 nt, Bordetella pertussis
gcguucgacuucgucc

SEQ ID NO: 2374800 - RNA, 20 nt, Bordetella pertussis
gcguucgacuucguccggcg

SEQ ID NO: 2374801 - RNA, 14 nt, Bordetella pertussis
gcguucgcaccagu

SEQ ID NO: 2374802 - RNA, 17 nt, Bordetella pertussis
gcguucgcccgugccgc

SEQ ID NO: 2374803 - RNA, 14 nt, Bordetella pertussis
gcguucgccgcagc

SEQ ID NO: 2374804 - RNA, 23 nt, Bordetella pertussis
gcguucgcgccaggcgccgggcc

SEQ ID NO: 2374805 - RNA, 17 nt, Bordetella pertussis
gcguucgcggugggcag

SEQ ID NO: 2374806 - RNA, 22 nt, Bordetella pertussis
gcguucgcggugggcagcggca

SEQ ID NO: 2374807 - RNA, 15 nt, Bordetella pertussis
gcguucggcaccggc

SEQ ID NO: 2374808 - RNA, 19 nt, Bordetella pertussis
gcguucggcaccggcagcc

SEQ ID NO: 2374809 - RNA, 16 nt, Bordetella pertussis
gcguucggccacccgg

SEQ ID NO: 2374810 - RNA, 15 nt, Bordetella pertussis
gcguucggccacuuc

SEQ ID NO: 2374811 - RNA, 19 nt, Bordetella pertussis
gcguucggccacuuccugg

SEQ ID NO: 2374812 - RNA, 21 nt, Bordetella pertussis
gcguucggccacuuccuggug

SEQ ID NO: 2374813 - RNA, 14 nt, Bordetella pertussis
gcguucggccagcc

SEQ ID NO: 2374814 - RNA, 15 nt, Bordetella pertussis
gcguucgggcggcag

SEQ ID NO: 2374815 - RNA, 18 nt, Bordetella pertussis
gcguucgggcggcaggug

SEQ ID NO: 2374816 - RNA, 18 nt, Bordetella pertussis
gcguucgguggcguggug

SEQ ID NO: 2374817 - RNA, 15 nt, Bordetella pertussis
gcguucguggauggg

SEQ ID NO: 2374818 - RNA, 16 nt, Bordetella pertussis
gcguucugcagcgcgg

SEQ ID NO: 2374819 - RNA, 23 nt, Bordetella pertussis
gcguugaaggcgaugggcaccug

SEQ ID NO: 2374820 - RNA, 14 nt, Bordetella pertussis
gcguugaccggcug

SEQ ID NO: 2374821 - RNA, 15 nt, Bordetella pertussis
gcucagggggcgccc

SEQ ID NO: 2374822 - RNA, 17 nt, Bordetella pertussis
gcucagggggcgcccca

SEQ ID NO: 2374823 - RNA, 18 nt, Bordetella pertussis
gcucagguagaccacgcg

SEQ ID NO: 2374824 - RNA, 20 nt, Bordetella pertussis
gcucagguagaccacgcgcu

SEQ ID NO: 2374825 - RNA, 20 nt, Bordetella pertussis
gcucaggucgaacaggcugg

SEQ ID NO: 2374826 - RNA, 16 nt, Bordetella pertussis
gcucagucggccuggc

SEQ ID NO: 2374827 - RNA, 19 nt, Bordetella pertussis
gcucagucggccuggcgcu

SEQ ID NO: 2374828 - RNA, 20 nt, Bordetella pertussis
gcucagucggccuggcgcuc

SEQ ID NO: 2374829 - RNA, 22 nt, Bordetella pertussis
gcucagucggccuggcgcuccu

SEQ ID NO: 2374830 - RNA, 19 nt, Bordetella pertussis
gcucagucgggcagcgccc

SEQ ID NO: 2374831 - RNA, 21 nt, Bordetella pertussis
gcucaucaccagcagguggcg

SEQ ID NO: 2374832 - RNA, 11 nt, Bordetella pertussis
gcucaucaucg

SEQ ID NO: 2374833 - RNA, 13 nt, Bordetella pertussis
gcucaucaucgcg

SEQ ID NO: 2374834 - RNA, 18 nt, Bordetella pertussis
gcucaucaucgcgcuggc

SEQ ID NO: 2374835 - RNA, 20 nt, Bordetella pertussis
gcucaucaucgcgcuggcgc

SEQ ID NO: 2374836 - RNA, 22 nt, Bordetella pertussis
gcucaucaucgcgcuggcgcgc

SEQ ID NO: 2374837 - RNA, 15 nt, Bordetella pertussis
gcucauccaggcgcg

SEQ ID NO: 2374838 - RNA, 15 nt, Bordetella pertussis
gcucaucggcaggcc

SEQ ID NO: 2374839 - RNA, 21 nt, Bordetella pertussis
gcucaucggcaggccggcgcg

SEQ ID NO: 2374840 - RNA, 22 nt, Bordetella pertussis
gcucaucggcaggccggcgcgc

SEQ ID NO: 2374841 - RNA, 18 nt, Bordetella pertussis
gcucaugaaacgaucggc

SEQ ID NO: 2374842 - RNA, 14 nt, Bordetella pertussis
gcucaugaccagcg

SEQ ID NO: 2374843 - RNA, 19 nt, Bordetella pertussis
gcucaugcaaaacgcgccc

SEQ ID NO: 2374844 - RNA, 13 nt, Bordetella pertussis
gcucaugccggca

SEQ ID NO: 2374845 - RNA, 17 nt, Bordetella pertussis
gcucaugccggcaagca

SEQ ID NO: 2374846 - RNA, 20 nt, Bordetella pertussis
gcucauggaggggcgcaggc

SEQ ID NO: 2374847 - RNA, 18 nt, Bordetella pertussis
gcucauggcacagcgcgg

SEQ ID NO: 2374848 - RNA, 20 nt, Bordetella pertussis
gcucauggcacagcgcggcg

SEQ ID NO: 2374849 - RNA, 20 nt, Bordetella pertussis
gcucaugguuucgagcauca

SEQ ID NO: 2374850 - RNA, 17 nt, Bordetella pertussis
gcucauucggcgcgcuc

SEQ ID NO: 2374851 - RNA, 21 nt, Bordetella pertussis
gcuccaaugaaaaaccccgcc

SEQ ID NO: 2374852 - RNA, 13 nt, Bordetella pertussis
gcuccaccagcac

SEQ ID NO: 2374853 - RNA, 14 nt, Bordetella pertussis
gcuccaccagcacc

SEQ ID NO: 2374854 - RNA, 15 nt, Bordetella pertussis
gcuccaccagcaccg

SEQ ID NO: 2374855 - RNA, 23 nt, Bordetella pertussis
gcuccaccagcaccggcagcgua

SEQ ID NO: 2374856 - RNA, 15 nt, Bordetella pertussis
gcuccacgugcggca

SEQ ID NO: 2374857 - RNA, 16 nt, Bordetella pertussis
gcuccacgugcggcag

SEQ ID NO: 2374858 - RNA, 17 nt, Bordetella pertussis
gcuccacgugcggcagg

SEQ ID NO: 2374859 - RNA, 16 nt, Bordetella pertussis
gcuccagaacgcgccg

SEQ ID NO: 2374860 - RNA, 17 nt, Bordetella pertussis
gcuccagcauguacagc

SEQ ID NO: 2374861 - RNA, 20 nt, Bordetella pertussis
gcuccagcauguacagcggu

SEQ ID NO: 2374862 - RNA, 15 nt, Bordetella pertussis
gcuccagcaugucgu

SEQ ID NO: 2374863 - RNA, 15 nt, Bordetella pertussis
gcuccagccaggcgc

SEQ ID NO: 2374864 - RNA, 16 nt, Bordetella pertussis
gcuccagccaggcgcg

SEQ ID NO: 2374865 - RNA, 17 nt, Bordetella pertussis
gcuccagccaggcgcgc

SEQ ID NO: 2374866 - RNA, 19 nt, Bordetella pertussis
gcuccagcccuucgcccgc

SEQ ID NO: 2374867 - RNA, 16 nt, Bordetella pertussis
gcuccagccgcaggcu

SEQ ID NO: 2374868 - RNA, 12 nt, Bordetella pertussis
gcuccagccggg

SEQ ID NO: 2374869 - RNA, 20 nt, Bordetella pertussis
gcuccagcgcuucgugcagc

SEQ ID NO: 2374870 - RNA, 22 nt, Bordetella pertussis
gcuccagcgugucgaacaccag

SEQ ID NO: 2374871 - RNA, 16 nt, Bordetella pertussis
gcuccagcucagcagc

SEQ ID NO: 2374872 - RNA, 17 nt, Bordetella pertussis
gcuccagcucagcagcg

SEQ ID NO: 2374873 - RNA, 18 nt, Bordetella pertussis
gcuccagcucagcagcgc

SEQ ID NO: 2374874 - RNA, 16 nt, Bordetella pertussis
gcuccagcuggcgcac

SEQ ID NO: 2374875 - RNA, 22 nt, Bordetella pertussis
gcuccagcuggcgcaccaggcu

SEQ ID NO: 2374876 - RNA, 23 nt, Bordetella pertussis
gcuccagcuggcgcaccaggcug

SEQ ID NO: 2374877 - RNA, 18 nt, Bordetella pertussis
gcuccaggaaaaccuccu

SEQ ID NO: 2374878 - RNA, 19 nt, Bordetella pertussis
gcuccaggaaaaccuccuc

SEQ ID NO: 2374879 - RNA, 12 nt, Bordetella pertussis
gcuccaggccgc

SEQ ID NO: 2374880 - RNA, 14 nt, Bordetella pertussis
gcuccaggccgccc

SEQ ID NO: 2374881 - RNA, 15 nt, Bordetella pertussis
gcuccaggccgccca

SEQ ID NO: 2374882 - RNA, 19 nt, Bordetella pertussis
gcuccaggccgcccagccg

SEQ ID NO: 2374883 - RNA, 17 nt, Bordetella pertussis
gcuccaggccggcaugc

SEQ ID NO: 2374884 - RNA, 14 nt, Bordetella pertussis
gcuccaggcggcca

SEQ ID NO: 2374885 - RNA, 15 nt, Bordetella pertussis
gcuccaggcggccag

SEQ ID NO: 2374886 - RNA, 16 nt, Bordetella pertussis
gcuccaggcggccagu

SEQ ID NO: 2374887 - RNA, 15 nt, Bordetella pertussis
gcuccagggcgucgg

SEQ ID NO: 2374888 - RNA, 17 nt, Bordetella pertussis
gcuccagggcgucggcg

SEQ ID NO: 2374889 - RNA, 17 nt, Bordetella pertussis
gcuccagucccgcaccg

SEQ ID NO: 2374890 - RNA, 18 nt, Bordetella pertussis
gcuccagucccgcaccgg

SEQ ID NO: 2374891 - RNA, 16 nt, Bordetella pertussis
gcuccaguggugcucc

SEQ ID NO: 2374892 - RNA, 16 nt, Bordetella pertussis
gcuccaugcggcggcg

SEQ ID NO: 2374893 - RNA, 17 nt, Bordetella pertussis
gcuccaugcggcggcgg

SEQ ID NO: 2374894 - RNA, 19 nt, Bordetella pertussis
gcuccaugcggcggcgggc

SEQ ID NO: 2374895 - RNA, 20 nt, Bordetella pertussis
gcuccaugcggcggcgggcg

SEQ ID NO: 2374896 - RNA, 15 nt, Bordetella pertussis
gcuccauggcgccgg

SEQ ID NO: 2374897 - RNA, 16 nt, Bordetella pertussis
gcuccauggcgccggc

SEQ ID NO: 2374898 - RNA, 19 nt, Bordetella pertussis
gcuccauggcgccggcggc

SEQ ID NO: 2374899 - RNA, 17 nt, Bordetella pertussis
gcuccaugggcguggug

SEQ ID NO: 2374900 - RNA, 22 nt, Bordetella pertussis
gcuccauguaaaaacccggccu

SEQ ID NO: 2374901 - RNA, 19 nt, Bordetella pertussis
gcucccacgaacgccacgc

SEQ ID NO: 2374902 - RNA, 20 nt, Bordetella pertussis
gcucccacgaacgccacgcc

SEQ ID NO: 2374903 - RNA, 12 nt, Bordetella pertussis
gcucccaguucu

SEQ ID NO: 2374904 - RNA, 17 nt, Bordetella pertussis
gcucccaguucugcagc

SEQ ID NO: 2374905 - RNA, 20 nt, Bordetella pertussis
gcucccaguucugcagcgug

SEQ ID NO: 2374906 - RNA, 21 nt, Bordetella pertussis
gcucccccaugcggggacagg

SEQ ID NO: 2374907 - RNA, 15 nt, Bordetella pertussis
gcuccccgggcacca

SEQ ID NO: 2374908 - RNA, 20 nt, Bordetella pertussis
gcuccccgggcgugaccagc

SEQ ID NO: 2374909 - RNA, 17 nt, Bordetella pertussis
gcucccgagggaucagc

SEQ ID NO: 2374910 - RNA, 18 nt, Bordetella pertussis
gcucccgagggaucagcc

SEQ ID NO: 2374911 - RNA, 15 nt, Bordetella pertussis
gcucccgcuggcggc

SEQ ID NO: 2374912 - RNA, 16 nt, Bordetella pertussis
gcucccgcuggcggca

SEQ ID NO: 2374913 - RNA, 21 nt, Bordetella pertussis
gcuccgagggacaccgcaggu

SEQ ID NO: 2374914 - RNA, 18 nt, Bordetella pertussis
gcuccgauagcggcgccg

SEQ ID NO: 2374915 - RNA, 20 nt, Bordetella pertussis
gcuccgauucucaccagcgc

SEQ ID NO: 2374916 - RNA, 12 nt, Bordetella pertussis
gcuccgccaugg

SEQ ID NO: 2374917 - RNA, 19 nt, Bordetella pertussis
gcuccgccauggaggcgca

SEQ ID NO: 2374918 - RNA, 13 nt, Bordetella pertussis
gcuccgccauugc

SEQ ID NO: 2374919 - RNA, 15 nt, Bordetella pertussis
gcuccgccauugcgc

SEQ ID NO: 2374920 - RNA, 13 nt, Bordetella pertussis
gcuccggcaugaa

SEQ ID NO: 2374921 - RNA, 22 nt, Bordetella pertussis
gcuccggcgugauggacgccgg

SEQ ID NO: 2374922 - RNA, 23 nt, Bordetella pertussis
gcuccggcgugauggacgccggg

SEQ ID NO: 2374923 - RNA, 15 nt, Bordetella pertussis
gcuccggcugcgcgc

SEQ ID NO: 2374924 - RNA, 19 nt, Bordetella pertussis
gcuccggcugcgcgcgcag

SEQ ID NO: 2374925 - RNA, 21 nt, Bordetella pertussis
gcuccggguagcggaugcggg

SEQ ID NO: 2374926 - RNA, 16 nt, Bordetella pertussis
gcuccguuccgaugcu

SEQ ID NO: 2374927 - RNA, 13 nt, Bordetella pertussis
gcuccucgcccga

SEQ ID NO: 2374928 - RNA, 19 nt, Bordetella pertussis
gcuccucgcccgaccugcu

SEQ ID NO: 2374929 - RNA, 20 nt, Bordetella pertussis
gcuccucgcccgaccugcug

SEQ ID NO: 2374930 - RNA, 13 nt, Bordetella pertussis
gcuccucgcgcgc

SEQ ID NO: 2374931 - RNA, 18 nt, Bordetella pertussis
gcuccucgcgcgcggacu

SEQ ID NO: 2374932 - RNA, 12 nt, Bordetella pertussis
gcuccucggccu

SEQ ID NO: 2374933 - RNA, 19 nt, Bordetella pertussis
gcuccucggccugccggcg

SEQ ID NO: 2374934 - RNA, 13 nt, Bordetella pertussis
gcucgcgcaugca

SEQ ID NO: 2374935 - RNA, 20 nt, Bordetella pertussis
gcucgcgcaugcagcgagcg

SEQ ID NO: 2374936 - RNA, 15 nt, Bordetella pertussis
gcucgcgccagggcc

SEQ ID NO: 2374937 - RNA, 23 nt, Bordetella pertussis
gcucgcgcccaucucggccgcgg

SEQ ID NO: 2374938 - RNA, 17 nt, Bordetella pertussis
gcucgcgcccgagcgcc

SEQ ID NO: 2374939 - RNA, 18 nt, Bordetella pertussis
gcucgcgcccgagcgcca

SEQ ID NO: 2374940 - RNA, 14 nt, Bordetella pertussis
gcucgcgcgagccc

SEQ ID NO: 2374941 - RNA, 14 nt, Bordetella pertussis
gcucgcgcgccagc

SEQ ID NO: 2374942 - RNA, 15 nt, Bordetella pertussis
gcucgcgcgccagca

SEQ ID NO: 2374943 - RNA, 17 nt, Bordetella pertussis
gcucgcgcgccagcagu

SEQ ID NO: 2374944 - RNA, 16 nt, Bordetella pertussis
gcucgcgcgcgcgggc

SEQ ID NO: 2374945 - RNA, 23 nt, Bordetella pertussis
gcucgcgcgcgcgggcgcgcagc

SEQ ID NO: 2374946 - RNA, 14 nt, Bordetella pertussis
gcucgcgcucgccc

SEQ ID NO: 2374947 - RNA, 18 nt, Bordetella pertussis
gcucgcgcucggccagca

SEQ ID NO: 2374948 - RNA, 20 nt, Bordetella pertussis
gcucgcgcucggccagcaug

SEQ ID NO: 2374949 - RNA, 15 nt, Bordetella pertussis
gcucgcgcugcagga

SEQ ID NO: 2374950 - RNA, 17 nt, Bordetella pertussis
gcucgcgcugcgcgccg

SEQ ID NO: 2374951 - RNA, 23 nt, Bordetella pertussis
gcucgcgcugcgcgccgccgcgc

SEQ ID NO: 2374952 - RNA, 15 nt, Bordetella pertussis
gcucgcggcacugau

SEQ ID NO: 2374953 - RNA, 15 nt, Bordetella pertussis
gcucgcggcccuggu

SEQ ID NO: 2374954 - RNA, 16 nt, Bordetella pertussis
gcucgcgggugcgcag

SEQ ID NO: 2374955 - RNA, 17 nt, Bordetella pertussis
gcucgcgggugcgcagc

SEQ ID NO: 2374956 - RNA, 17 nt, Bordetella pertussis
gcucgcgucuaucagga

SEQ ID NO: 2374957 - RNA, 18 nt, Bordetella pertussis
gcucgcgucuaucaggau

SEQ ID NO: 2374958 - RNA, 23 nt, Bordetella pertussis
gcucgcguugcaccgcgucggcc

SEQ ID NO: 2374959 - RNA, 14 nt, Bordetella pertussis
gcucgcugccggcg

SEQ ID NO: 2374960 - RNA, 18 nt, Bordetella pertussis
gcucggaccuggccagcg

SEQ ID NO: 2374961 - RNA, 14 nt, Bordetella pertussis
gcucggccaccaug

SEQ ID NO: 2374962 - RNA, 16 nt, Bordetella pertussis
gcucggccaccaugcg

SEQ ID NO: 2374963 - RNA, 17 nt, Bordetella pertussis
gcucggccaccaugcgg

SEQ ID NO: 2374964 - RNA, 18 nt, Bordetella pertussis
gcucggccacgcgcaacg

SEQ ID NO: 2374965 - RNA, 16 nt, Bordetella pertussis
gcucggccacgcgcug

SEQ ID NO: 2374966 - RNA, 17 nt, Bordetella pertussis
gcucggccacgcgcugc

SEQ ID NO: 2374967 - RNA, 18 nt, Bordetella pertussis
gcucggccacgcgcugcu

SEQ ID NO: 2374968 - RNA, 13 nt, Bordetella pertussis
gcucggccagcag

SEQ ID NO: 2374969 - RNA, 14 nt, Bordetella pertussis
gcucggccagcagu

SEQ ID NO: 2374970 - RNA, 16 nt, Bordetella pertussis
gcucggccagcagugu

SEQ ID NO: 2374971 - RNA, 14 nt, Bordetella pertussis
gcucggccagcaug

SEQ ID NO: 2374972 - RNA, 15 nt, Bordetella pertussis
gcucggccagcaugc

SEQ ID NO: 2374973 - RNA, 15 nt, Bordetella pertussis
gcucggccagcgagg

SEQ ID NO: 2374974 - RNA, 13 nt, Bordetella pertussis
gcucggccagcgc

SEQ ID NO: 2374975 - RNA, 15 nt, Bordetella pertussis
gcucggccagcgcgc

SEQ ID NO: 2374976 - RNA, 13 nt, Bordetella pertussis
gcucggccaggug

SEQ ID NO: 2374977 - RNA, 14 nt, Bordetella pertussis
gcucggccaggugc

SEQ ID NO: 2374978 - RNA, 15 nt, Bordetella pertussis
gcucggccaggugcg

SEQ ID NO: 2374979 - RNA, 20 nt, Bordetella pertussis
gcucggccaggugcgccaug

SEQ ID NO: 2374980 - RNA, 22 nt, Bordetella pertussis
gcucggccaggugcgccaugcg

SEQ ID NO: 2374981 - RNA, 22 nt, Bordetella pertussis
gcucggcccuagagcaugcggc

SEQ ID NO: 2374982 - RNA, 19 nt, Bordetella pertussis
gcucggccucggucagggu

SEQ ID NO: 2374983 - RNA, 20 nt, Bordetella pertussis
gcucggccucggucagggug

SEQ ID NO: 2374984 - RNA, 18 nt, Bordetella pertussis
gcucggccuugccguugg

SEQ ID NO: 2374985 - RNA, 19 nt, Bordetella pertussis
gcucggcgaacugggcguc

SEQ ID NO: 2374986 - RNA, 15 nt, Bordetella pertussis
gcucggcgaagccgc

SEQ ID NO: 2374987 - RNA, 18 nt, Bordetella pertussis
gcucggcgaagccgcagc

SEQ ID NO: 2374988 - RNA, 16 nt, Bordetella pertussis
gcucggcgaccaggcc

SEQ ID NO: 2374989 - RNA, 17 nt, Bordetella pertussis
gcucggcgaccaggccc

SEQ ID NO: 2374990 - RNA, 24 nt, Bordetella pertussis
gcucggcgaccaggcccauggcgu

SEQ ID NO: 2374991 - RNA, 15 nt, Bordetella pertussis
gcucggcgaugcgcc

SEQ ID NO: 2374992 - RNA, 17 nt, Bordetella pertussis
gcucggcgaugcgccau

SEQ ID NO: 2374993 - RNA, 18 nt, Bordetella pertussis
gcucggcgaugcgccaua

SEQ ID NO: 2374994 - RNA, 19 nt, Bordetella pertussis
gcucggcgaugcgcgagcg

SEQ ID NO: 2374995 - RNA, 18 nt, Bordetella pertussis
gcucggcgccggcggcgc

SEQ ID NO: 2374996 - RNA, 14 nt, Bordetella pertussis
gcucggcgccgggc

SEQ ID NO: 2374997 - RNA, 17 nt, Bordetella pertussis
gcucggcgccgggcugg

SEQ ID NO: 2374998 - RNA, 16 nt, Bordetella pertussis
gcucggcggccgccug

SEQ ID NO: 2374999 - RNA, 18 nt, Bordetella pertussis
gcucggcggucagcgcgg

SEQ ID NO: 2375000 - RNA, 14 nt, Bordetella pertussis
gcucggcuggagcu

SEQ ID NO: 2375001 - RNA, 17 nt, Bordetella pertussis
gcucggcuuccugccgc

SEQ ID NO: 2375002 - RNA, 18 nt, Bordetella pertussis
gcucggcuuccugccgca

SEQ ID NO: 2375003 - RNA, 14 nt, Bordetella pertussis
gcucgggacgcagg

SEQ ID NO: 2375004 - RNA, 16 nt, Bordetella pertussis
gcucgggacgcaggcc

SEQ ID NO: 2375005 - RNA, 19 nt, Bordetella pertussis
gcucgggcagcagcagggc

SEQ ID NO: 2375006 - RNA, 13 nt, Bordetella pertussis
gcucgggcgccuc

SEQ ID NO: 2375007 - RNA, 15 nt, Bordetella pertussis
gcucgggcgccucgu

SEQ ID NO: 2375008 - RNA, 14 nt, Bordetella pertussis
gcucgggcgcggca

SEQ ID NO: 2375009 - RNA, 17 nt, Bordetella pertussis
gcucgggcgcggcaucg

SEQ ID NO: 2375010 - RNA, 13 nt, Bordetella pertussis
gcucgggcucgac

SEQ ID NO: 2375011 - RNA, 15 nt, Bordetella pertussis
gcucgggcucgagcc

SEQ ID NO: 2375012 - RNA, 16 nt, Bordetella pertussis
gcucgggcucgcgcgc

SEQ ID NO: 2375013 - RNA, 18 nt, Bordetella pertussis
gcucgggcucgcgcgcgc

SEQ ID NO: 2375014 - RNA, 15 nt, Bordetella pertussis
gcucgggcugcggcu

SEQ ID NO: 2375015 - RNA, 16 nt, Bordetella pertussis
gcucgggcugcggcuc

SEQ ID NO: 2375016 - RNA, 17 nt, Bordetella pertussis
gcucgggcugcggcucc

SEQ ID NO: 2375017 - RNA, 18 nt, Bordetella pertussis
gcucgggcugcggcuccu

SEQ ID NO: 2375018 - RNA, 22 nt, Bordetella pertussis
gcucggggaaauugacggcgcu

SEQ ID NO: 2375019 - RNA, 14 nt, Bordetella pertussis
gcucgggugggccg

SEQ ID NO: 2375020 - RNA, 18 nt, Bordetella pertussis
gcucggucauguccagcg

SEQ ID NO: 2375021 - RNA, 20 nt, Bordetella pertussis
gcucggucauguccagcgcc

SEQ ID NO: 2375022 - RNA, 20 nt, Bordetella pertussis
gcucggucucgcccauggga

SEQ ID NO: 2375023 - RNA, 16 nt, Bordetella pertussis
gcucggugagcggcac

SEQ ID NO: 2375024 - RNA, 19 nt, Bordetella pertussis
gcucggugaugauggccag

SEQ ID NO: 2375025 - RNA, 20 nt, Bordetella pertussis
gcucggugaugauggccagg

SEQ ID NO: 2375026 - RNA, 17 nt, Bordetella pertussis
gcucggugcagcccagc

SEQ ID NO: 2375027 - RNA, 18 nt, Bordetella pertussis
gcucggugcagcccagca

SEQ ID NO: 2375028 - RNA, 16 nt, Bordetella pertussis
gcucggugcgggccgg

SEQ ID NO: 2375029 - RNA, 21 nt, Bordetella pertussis
gcucggugcgggccggcgcgc

SEQ ID NO: 2375030 - RNA, 15 nt, Bordetella pertussis
gcucggugcucuggc

SEQ ID NO: 2375031 - RNA, 19 nt, Bordetella pertussis
gcucgguguggauggcggu

SEQ ID NO: 2375032 - RNA, 21 nt, Bordetella pertussis
gcucguagaucuugccggccg

SEQ ID NO: 2375033 - RNA, 13 nt, Bordetella pertussis
gcucguagcuguc

SEQ ID NO: 2375034 - RNA, 15 nt, Bordetella pertussis
gcucguagcugucga

SEQ ID NO: 2375035 - RNA, 20 nt, Bordetella pertussis
gcucguagcugucgaccgga

SEQ ID NO: 2375036 - RNA, 13 nt, Bordetella pertussis
gcucguaggcgag

SEQ ID NO: 2375037 - RNA, 21 nt, Bordetella pertussis
gcucguaggcgagguccaggc

SEQ ID NO: 2375038 - RNA, 14 nt, Bordetella pertussis
gcucguagucggug

SEQ ID NO: 2375039 - RNA, 17 nt, Bordetella pertussis
gcucgucaugaucccgc

SEQ ID NO: 2375040 - RNA, 12 nt, Bordetella pertussis
gcucguccaggu

SEQ ID NO: 2375041 - RNA, 21 nt, Bordetella pertussis
gcucguccagguugcccgagc

SEQ ID NO: 2375042 - RNA, 17 nt, Bordetella pertussis
gcucguccaucgccugc

SEQ ID NO: 2375043 - RNA, 18 nt, Bordetella pertussis
gcucguccaugccggcca

SEQ ID NO: 2375044 - RNA, 13 nt, Bordetella pertussis
gcucguccccacg

SEQ ID NO: 2375045 - RNA, 16 nt, Bordetella pertussis
gcucgucgaacagcau

SEQ ID NO: 2375046 - RNA, 16 nt, Bordetella pertussis
gcucgucgacgcggcc

SEQ ID NO: 2375047 - RNA, 13 nt, Bordetella pertussis
gcucgucgccaug

SEQ ID NO: 2375048 - RNA, 18 nt, Bordetella pertussis
gcugcaauugcgcggcca

SEQ ID NO: 2375049 - RNA, 20 nt, Bordetella pertussis
gcugcaauugcgcggccaug

SEQ ID NO: 2375050 - RNA, 21 nt, Bordetella pertussis
gcugcaauugcgcggccaugc

SEQ ID NO: 2375051 - RNA, 15 nt, Bordetella pertussis
gcugcacagggacca

SEQ ID NO: 2375052 - RNA, 15 nt, Bordetella pertussis
gcugcaccagcgcgc

SEQ ID NO: 2375053 - RNA, 17 nt, Bordetella pertussis
gcugcaccagcgcgccg

SEQ ID NO: 2375054 - RNA, 22 nt, Bordetella pertussis
gcugcacccacacuuggccggc

SEQ ID NO: 2375055 - RNA, 17 nt, Bordetella pertussis
gcugcaccugccugccg

SEQ ID NO: 2375056 - RNA, 12 nt, Bordetella pertussis
gcugcaccugcg

SEQ ID NO: 2375057 - RNA, 21 nt, Bordetella pertussis
gcugcacgauguugccgccgg

SEQ ID NO: 2375058 - RNA, 15 nt, Bordetella pertussis
gcugcacgcagcgca

SEQ ID NO: 2375059 - RNA, 12 nt, Bordetella pertussis
gcugcacgcgcg

SEQ ID NO: 2375060 - RNA, 18 nt, Bordetella pertussis
gcugcacgcgcgcgggcg

SEQ ID NO: 2375061 - RNA, 22 nt, Bordetella pertussis
gcugcacgcgcgcgggcgcgcc

SEQ ID NO: 2375062 - RNA, 12 nt, Bordetella pertussis
gcugcacgcggc

SEQ ID NO: 2375063 - RNA, 19 nt, Bordetella pertussis
gcugcacgcggccgcgcag

SEQ ID NO: 2375064 - RNA, 15 nt, Bordetella pertussis
gcugcacgguggaca

SEQ ID NO: 2375065 - RNA, 17 nt, Bordetella pertussis
gcugcacgugaugcagg

SEQ ID NO: 2375066 - RNA, 15 nt, Bordetella pertussis
gcugcagaucaucga

SEQ ID NO: 2375067 - RNA, 20 nt, Bordetella pertussis
gcugcagaucaucggcgcca

SEQ ID NO: 2375068 - RNA, 17 nt, Bordetella pertussis
gcugcagcaauccaucg

SEQ ID NO: 2375069 - RNA, 13 nt, Bordetella pertussis
gcugcagcacgca

SEQ ID NO: 2375070 - RNA, 18 nt, Bordetella pertussis
gcugcagcacgcaccagg

SEQ ID NO: 2375071 - RNA, 20 nt, Bordetella pertussis
gcugcagccaguugggccag

SEQ ID NO: 2375072 - RNA, 19 nt, Bordetella pertussis
gcugcagccauucggccac

SEQ ID NO: 2375073 - RNA, 15 nt, Bordetella pertussis
gcugcagcccggcca

SEQ ID NO: 2375074 - RNA, 12 nt, Bordetella pertussis
gcugcagcgacu

SEQ ID NO: 2375075 - RNA, 14 nt, Bordetella pertussis
gcugcagcgcacca

SEQ ID NO: 2375076 - RNA, 23 nt, Bordetella pertussis
gcugcagcgcaggaugggcagcu

SEQ ID NO: 2375077 - RNA, 14 nt, Bordetella pertussis
gcugcagcgcaucg

SEQ ID NO: 2375078 - RNA, 15 nt, Bordetella pertussis
gcugcagcgcaucgc

SEQ ID NO: 2375079 - RNA, 14 nt, Bordetella pertussis
gcugcagcgucugg

SEQ ID NO: 2375080 - RNA, 16 nt, Bordetella pertussis
gcugcagcgucuggca

SEQ ID NO: 2375081 - RNA, 18 nt, Bordetella pertussis
gcugcagcgucuggcacg

SEQ ID NO: 2375082 - RNA, 18 nt, Bordetella pertussis
gcugcagcuugcgcgcca

SEQ ID NO: 2375083 - RNA, 22 nt, Bordetella pertussis
gcugcaggaaguccuucagccg

SEQ ID NO: 2375084 - RNA, 14 nt, Bordetella pertussis
gcugcaggaucgcg

SEQ ID NO: 2375085 - RNA, 18 nt, Bordetella pertussis
gcugcaggaucgcggcca

SEQ ID NO: 2375086 - RNA, 21 nt, Bordetella pertussis
gcugcaggaucgcggccagcg

SEQ ID NO: 2375087 - RNA, 12 nt, Bordetella pertussis
gcugcaggcgcg

SEQ ID NO: 2375088 - RNA, 13 nt, Bordetella pertussis
gcugcaggcgcgg

SEQ ID NO: 2375089 - RNA, 15 nt, Bordetella pertussis
gcugcaggcgcgggu

SEQ ID NO: 2375090 - RNA, 13 nt, Bordetella pertussis
gcugcagggcugc

SEQ ID NO: 2375091 - RNA, 17 nt, Bordetella pertussis
gcugcaguaugcaaccg

SEQ ID NO: 2375092 - RNA, 14 nt, Bordetella pertussis
gcugcaguugcgcc

SEQ ID NO: 2375093 - RNA, 21 nt, Bordetella pertussis
gcugcauacgccgcugauggc

SEQ ID NO: 2375094 - RNA, 21 nt, Bordetella pertussis
gcugcaugccccaacggcgca

SEQ ID NO: 2375095 - RNA, 15 nt, Bordetella pertussis
gcugcaugcgcacgg

SEQ ID NO: 2375096 - RNA, 16 nt, Bordetella pertussis
gcugcaugcgcacgga

SEQ ID NO: 2375097 - RNA, 18 nt, Bordetella pertussis
gcugcaugcgcacggaca

SEQ ID NO: 2375098 - RNA, 20 nt, Bordetella pertussis
gcugcaugcgcgaacgcgcg

SEQ ID NO: 2375099 - RNA, 22 nt, Bordetella pertussis
gcugcaugcgcgaacgcgcgcc

SEQ ID NO: 2375100 - RNA, 18 nt, Bordetella pertussis
gcugcaugcucuggcaca

SEQ ID NO: 2375101 - RNA, 16 nt, Bordetella pertussis
gcugcaugggcggccc

SEQ ID NO: 2375102 - RNA, 19 nt, Bordetella pertussis
gcugcaugggcggcccgcu

SEQ ID NO: 2375103 - RNA, 17 nt, Bordetella pertussis
gcugcauguccugcagg

SEQ ID NO: 2375104 - RNA, 18 nt, Bordetella pertussis
gcugcauguccugcaggu

SEQ ID NO: 2375105 - RNA, 14 nt, Bordetella pertussis
gcugccaaccgcga

SEQ ID NO: 2375106 - RNA, 18 nt, Bordetella pertussis
gcugccaggcuaucgugg

SEQ ID NO: 2375107 - RNA, 19 nt, Bordetella pertussis
gcugccagggugcaccagg

SEQ ID NO: 2375108 - RNA, 23 nt, Bordetella pertussis
gcugccagggugcaccagguggu

SEQ ID NO: 2375109 - RNA, 20 nt, Bordetella pertussis
gcugccagugguccaucagg

SEQ ID NO: 2375110 - RNA, 20 nt, Bordetella pertussis
gcugccaguuguaguggugu

SEQ ID NO: 2375111 - RNA, 16 nt, Bordetella pertussis
gcugccaugccgcgcg

SEQ ID NO: 2375112 - RNA, 20 nt, Bordetella pertussis
gcugccaugccgcgcgccuu

SEQ ID NO: 2375113 - RNA, 16 nt, Bordetella pertussis
gcugccauuccagcuc

SEQ ID NO: 2375114 - RNA, 20 nt, Bordetella pertussis
gcugccauuccagcuccggc

SEQ ID NO: 2375115 - RNA, 15 nt, Bordetella pertussis
gcugcccaccgccgu

SEQ ID NO: 2375116 - RNA, 23 nt, Bordetella pertussis
gcugcccaccgccguggccggca

SEQ ID NO: 2375117 - RNA, 17 nt, Bordetella pertussis
gcugcccaccuuccugc

SEQ ID NO: 2375118 - RNA, 18 nt, Bordetella pertussis
gcugcccaccuuccugcu

SEQ ID NO: 2375119 - RNA, 20 nt, Bordetella pertussis
gcugcccaccuuccugcugg

SEQ ID NO: 2375120 - RNA, 19 nt, Bordetella pertussis
gcugcccaccuugcgcgcg

SEQ ID NO: 2375121 - RNA, 22 nt, Bordetella pertussis
gcugcccaccuugcgcgcgaac

SEQ ID NO: 2375122 - RNA, 14 nt, Bordetella pertussis
gcugcccagcaugg

SEQ ID NO: 2375123 - RNA, 15 nt, Bordetella pertussis
gcugcccagccacac

SEQ ID NO: 2375124 - RNA, 19 nt, Bordetella pertussis
gcugcccagccacaccagg

SEQ ID NO: 2375125 - RNA, 14 nt, Bordetella pertussis
gcugccccccgagg

SEQ ID NO: 2375126 - RNA, 19 nt, Bordetella pertussis
gcugccccccgagggggcu

SEQ ID NO: 2375127 - RNA, 20 nt, Bordetella pertussis
gcugccccccgagggggcuu

SEQ ID NO: 2375128 - RNA, 16 nt, Bordetella pertussis
gcugcccgaagcgcag

SEQ ID NO: 2375129 - RNA, 19 nt, Bordetella pertussis
gcugcccgaagcgcagcac

SEQ ID NO: 2375130 - RNA, 23 nt, Bordetella pertussis
gcugcccgaagcgcagcaccagg

SEQ ID NO: 2375131 - RNA, 14 nt, Bordetella pertussis
gcugcccgacgacg

SEQ ID NO: 2375132 - RNA, 17 nt, Bordetella pertussis
gcugcccgagaagggcu

SEQ ID NO: 2375133 - RNA, 23 nt, Bordetella pertussis
gcugcccgccggcagugccugcg

SEQ ID NO: 2375134 - RNA, 16 nt, Bordetella pertussis
gcugcccuacgacacg

SEQ ID NO: 2375135 - RNA, 22 nt, Bordetella pertussis
gcugcccuacgacacgcucaag

SEQ ID NO: 2375136 - RNA, 14 nt, Bordetella pertussis
gcugcccucgcccg

SEQ ID NO: 2375137 - RNA, 19 nt, Bordetella pertussis
gcugcccucgcccgugcgc

SEQ ID NO: 2375138 - RNA, 19 nt, Bordetella pertussis
gcugcccucggucagcgcc

SEQ ID NO: 2375139 - RNA, 22 nt, Bordetella pertussis
gcugcccucggucagcgccagg

SEQ ID NO: 2375140 - RNA, 23 nt, Bordetella pertussis
gcugcccucggucagcgccaggg

SEQ ID NO: 2375141 - RNA, 21 nt, Bordetella pertussis
gcugcccuggaucaggauggg

SEQ ID NO: 2375142 - RNA, 16 nt, Bordetella pertussis
gcugcccuggcccagg

SEQ ID NO: 2375143 - RNA, 17 nt, Bordetella pertussis
gcugcccuggcccaggc

SEQ ID NO: 2375144 - RNA, 19 nt, Bordetella pertussis
gcugcccuggcccaggccg

SEQ ID NO: 2375145 - RNA, 15 nt, Bordetella pertussis
gcugcccuggcgcug

SEQ ID NO: 2375146 - RNA, 19 nt, Bordetella pertussis
gcugccgaauucguuggug

SEQ ID NO: 2375147 - RNA, 15 nt, Bordetella pertussis
gcugccgaccagcac

SEQ ID NO: 2375148 - RNA, 16 nt, Bordetella pertussis
gcugccgaccagcacg

SEQ ID NO: 2375149 - RNA, 18 nt, Bordetella pertussis
gcugccgauacgggcgcg

SEQ ID NO: 2375150 - RNA, 22 nt, Bordetella pertussis
gcugccgccgaugugcggcgug

SEQ ID NO: 2375151 - RNA, 12 nt, Bordetella pertussis
gcugccgccggc

SEQ ID NO: 2375152 - RNA, 15 nt, Bordetella pertussis
gcugccgccggcgau

SEQ ID NO: 2375153 - RNA, 16 nt, Bordetella pertussis
gcugccgcgcgccggc

SEQ ID NO: 2375154 - RNA, 12 nt, Bordetella pertussis
gcugccgcugca

SEQ ID NO: 2375155 - RNA, 14 nt, Bordetella pertussis
gcugccgcugcagg

SEQ ID NO: 2375156 - RNA, 16 nt, Bordetella pertussis
gcugccgcugcaggcc

SEQ ID NO: 2375157 - RNA, 17 nt, Bordetella pertussis
gcugccgcugcaggccc

SEQ ID NO: 2375158 - RNA, 18 nt, Bordetella pertussis
gcugccgcugcccaccuu

SEQ ID NO: 2375159 - RNA, 17 nt, Bordetella pertussis
gcugccggaccugggca

SEQ ID NO: 2375160 - RNA, 21 nt, Bordetella pertussis
gcugccggaccugggcaucaa

SEQ ID NO: 2375161 - RNA, 21 nt, Bordetella pertussis
gcugcucgagcaugcgggcca

SEQ ID NO: 2375162 - RNA, 16 nt, Bordetella pertussis
gcugcucgcggcacug

SEQ ID NO: 2375163 - RNA, 17 nt, Bordetella pertussis
gcugcucgcggcacuga

SEQ ID NO: 2375164 - RNA, 18 nt, Bordetella pertussis
gcugcucguucugcgcgc

SEQ ID NO: 2375165 - RNA, 15 nt, Bordetella pertussis
gcugcucuccaugcu

SEQ ID NO: 2375166 - RNA, 15 nt, Bordetella pertussis
gcugcucuuggcgcc

SEQ ID NO: 2375167 - RNA, 16 nt, Bordetella pertussis
gcugcucuuggcgccg

SEQ ID NO: 2375168 - RNA, 19 nt, Bordetella pertussis
gcugcucuuggcgccggac

SEQ ID NO: 2375169 - RNA, 16 nt, Bordetella pertussis
gcugcugauccucgcc

SEQ ID NO: 2375170 - RNA, 17 nt, Bordetella pertussis
gcugcugauccucgcca

SEQ ID NO: 2375171 - RNA, 14 nt, Bordetella pertussis
gcugcugcacgcgc

SEQ ID NO: 2375172 - RNA, 15 nt, Bordetella pertussis
gcugcugcaggccgg

SEQ ID NO: 2375173 - RNA, 19 nt, Bordetella pertussis
gcugcugcaggccggcgcg

SEQ ID NO: 2375174 - RNA, 14 nt, Bordetella pertussis
gcugcugcaggcgc

SEQ ID NO: 2375175 - RNA, 15 nt, Bordetella pertussis
gcugcugcaggcgcg

SEQ ID NO: 2375176 - RNA, 13 nt, Bordetella pertussis
gcugcugcccgaa

SEQ ID NO: 2375177 - RNA, 23 nt, Bordetella pertussis
gcugcuggaacggugcgagaucu

SEQ ID NO: 2375178 - RNA, 20 nt, Bordetella pertussis
gcugcuggaccuggccacca

SEQ ID NO: 2375179 - RNA, 15 nt, Bordetella pertussis
gcugcuggagaucgc

SEQ ID NO: 2375180 - RNA, 18 nt, Bordetella pertussis
gcugcuggagaucgccga

SEQ ID NO: 2375181 - RNA, 20 nt, Bordetella pertussis
gcugcuggagaucgccgagc

SEQ ID NO: 2375182 - RNA, 17 nt, Bordetella pertussis
gcugcuggaggccggcg

SEQ ID NO: 2375183 - RNA, 19 nt, Bordetella pertussis
gcugcuggccaagcgcgcc

SEQ ID NO: 2375184 - RNA, 22 nt, Bordetella pertussis
gcugcuggccaagcgcgccggc

SEQ ID NO: 2375185 - RNA, 17 nt, Bordetella pertussis
gcugcuggcccagacca

SEQ ID NO: 2375186 - RNA, 15 nt, Bordetella pertussis
gcugcuggccggcca

SEQ ID NO: 2375187 - RNA, 21 nt, Bordetella pertussis
gcugcuggccggccccauccu

SEQ ID NO: 2375188 - RNA, 22 nt, Bordetella pertussis
gcugcuggccggccccauccuc

SEQ ID NO: 2375189 - RNA, 12 nt, Bordetella pertussis
gcugcuggcgcg

SEQ ID NO: 2375190 - RNA, 14 nt, Bordetella pertussis
gcugcuggcgcgcc

SEQ ID NO: 2375191 - RNA, 16 nt, Bordetella pertussis
gcugcuggcggcgcug

SEQ ID NO: 2375192 - RNA, 19 nt, Bordetella pertussis
gcugcuggcggcgcugguc

SEQ ID NO: 2375193 - RNA, 15 nt, Bordetella pertussis
gcugcugggcaugga

SEQ ID NO: 2375194 - RNA, 15 nt, Bordetella pertussis
gcugcugggccggcg

SEQ ID NO: 2375195 - RNA, 19 nt, Bordetella pertussis
gcugcugggccggcgcgcg

SEQ ID NO: 2375196 - RNA, 16 nt, Bordetella pertussis
gcugcugggcgccaug

SEQ ID NO: 2375197 - RNA, 19 nt, Bordetella pertussis
gcugcugggcgccaugcgc

SEQ ID NO: 2375198 - RNA, 17 nt, Bordetella pertussis
gcugcugucgcgcgacu

SEQ ID NO: 2375199 - RNA, 19 nt, Bordetella pertussis
gcugcuguucgccacgcug

SEQ ID NO: 2375200 - RNA, 15 nt, Bordetella pertussis
gcugcuugcccagcg

SEQ ID NO: 2375201 - RNA, 23 nt, Bordetella pertussis
gcuggaaacuaaaucgcggcucg

SEQ ID NO: 2375202 - RNA, 16 nt, Bordetella pertussis
gcuggaacaccaugcc

SEQ ID NO: 2375203 - RNA, 14 nt, Bordetella pertussis
gcuggaacggugcg

SEQ ID NO: 2375204 - RNA, 22 nt, Bordetella pertussis
gcuggaacguuugcggacgggc

SEQ ID NO: 2375205 - RNA, 15 nt, Bordetella pertussis
gcuggaagacguggc

SEQ ID NO: 2375206 - RNA, 20 nt, Bordetella pertussis
gcuggaagacguggcccgcg

SEQ ID NO: 2375207 - RNA, 12 nt, Bordetella pertussis
gcuggacagauc

SEQ ID NO: 2375208 - RNA, 17 nt, Bordetella pertussis
gcuggacagauccagcg

SEQ ID NO: 2375209 - RNA, 20 nt, Bordetella pertussis
gcuggacagauccagcgcgg

SEQ ID NO: 2375210 - RNA, 23 nt, Bordetella pertussis
gcuggacagauccagcgcggcca

SEQ ID NO: 2375211 - RNA, 19 nt, Bordetella pertussis
gcuggaccccuugcggccg

SEQ ID NO: 2375212 - RNA, 20 nt, Bordetella pertussis
gcuggaccccuugcggccgc

SEQ ID NO: 2375213 - RNA, 23 nt, Bordetella pertussis
gcuggaccccuugcggccgccga

SEQ ID NO: 2375214 - RNA, 19 nt, Bordetella pertussis
gcuggacccggagcugccg

SEQ ID NO: 2375215 - RNA, 15 nt, Bordetella pertussis
gcuggaccgcgccug

SEQ ID NO: 2375216 - RNA, 16 nt, Bordetella pertussis
gcuggacgcccuggcg

SEQ ID NO: 2375217 - RNA, 19 nt, Bordetella pertussis
gcuggacgcccuggcgcag

SEQ ID NO: 2375218 - RNA, 21 nt, Bordetella pertussis
gcuggacgcccuggcgcaggc

SEQ ID NO: 2375219 - RNA, 21 nt, Bordetella pertussis
gcuggacgcgccgaacaccag

SEQ ID NO: 2375220 - RNA, 22 nt, Bordetella pertussis
gcuggacgcgccgaacaccagc

SEQ ID NO: 2375221 - RNA, 23 nt, Bordetella pertussis
gcuggacgcgccgaacaccagcu

SEQ ID NO: 2375222 - RNA, 18 nt, Bordetella pertussis
gcuggacgcgcgcggcga

SEQ ID NO: 2375223 - RNA, 16 nt, Bordetella pertussis
gcuggacuauggccug

SEQ ID NO: 2375224 - RNA, 19 nt, Bordetella pertussis
gcuggacuauggccuggau

SEQ ID NO: 2375225 - RNA, 18 nt, Bordetella pertussis
gcuggacuguccggcaac

SEQ ID NO: 2375226 - RNA, 18 nt, Bordetella pertussis
gcuggagaacaggcggcu

SEQ ID NO: 2375227 - RNA, 20 nt, Bordetella pertussis
gcuggagaacaggcggcuga

SEQ ID NO: 2375228 - RNA, 16 nt, Bordetella pertussis
gcuggagaccggcaug

SEQ ID NO: 2375229 - RNA, 14 nt, Bordetella pertussis
gcuggagaucgccg

SEQ ID NO: 2375230 - RNA, 18 nt, Bordetella pertussis
gcuggagaucgccgagcg

SEQ ID NO: 2375231 - RNA, 18 nt, Bordetella pertussis
gcuggagcgccacgccgu

SEQ ID NO: 2375232 - RNA, 13 nt, Bordetella pertussis
gcuggaggccggc

SEQ ID NO: 2375233 - RNA, 14 nt, Bordetella pertussis
gcuggaggccggcg

SEQ ID NO: 2375234 - RNA, 16 nt, Bordetella pertussis
gcuggaucccggcgau

SEQ ID NO: 2375235 - RNA, 19 nt, Bordetella pertussis
gcuggauccggcgcuggcg

SEQ ID NO: 2375236 - RNA, 15 nt, Bordetella pertussis
gcuggauggccugcu

SEQ ID NO: 2375237 - RNA, 16 nt, Bordetella pertussis
gcuggauggcucgggc

SEQ ID NO: 2375238 - RNA, 21 nt, Bordetella pertussis
gcuggauggucacgcccaggc

SEQ ID NO: 2375239 - RNA, 17 nt, Bordetella pertussis
gcuggauggugccgccg

SEQ ID NO: 2375240 - RNA, 19 nt, Bordetella pertussis
gcuggauggugccgccgcc

SEQ ID NO: 2375241 - RNA, 16 nt, Bordetella pertussis
gcuggauucgccgguc

SEQ ID NO: 2375242 - RNA, 15 nt, Bordetella pertussis
gcuggcaaagcgcgc

SEQ ID NO: 2375243 - RNA, 21 nt, Bordetella pertussis
gcuggcaaagcgcgcguccug

SEQ ID NO: 2375244 - RNA, 13 nt, Bordetella pertussis
gcuggcaccgcga

SEQ ID NO: 2375245 - RNA, 19 nt, Bordetella pertussis
gcuggcaccgcgacgaccc

SEQ ID NO: 2375246 - RNA, 13 nt, Bordetella pertussis
gcuggcagccuug

SEQ ID NO: 2375247 - RNA, 14 nt, Bordetella pertussis
gcuggcagccuuga

SEQ ID NO: 2375248 - RNA, 15 nt, Bordetella pertussis
gcuggcagcgaccgc

SEQ ID NO: 2375249 - RNA, 15 nt, Bordetella pertussis
gcuggcaucgucgcg

SEQ ID NO: 2375250 - RNA, 13 nt, Bordetella pertussis
gcuggcaugcggc

SEQ ID NO: 2375251 - RNA, 18 nt, Bordetella pertussis
gcuggcaugcggcggacu

SEQ ID NO: 2375252 - RNA, 16 nt, Bordetella pertussis
gcuggcauggcggucu

SEQ ID NO: 2375253 - RNA, 17 nt, Bordetella pertussis
gcuggcauugacgacgc

SEQ ID NO: 2375254 - RNA, 17 nt, Bordetella pertussis
gcuggccaacgccacgc

SEQ ID NO: 2375255 - RNA, 19 nt, Bordetella pertussis
gcuggccaacgccacgccc

SEQ ID NO: 2375256 - RNA, 15 nt, Bordetella pertussis
gcuggccaagcgcgc

SEQ ID NO: 2375257 - RNA, 16 nt, Bordetella pertussis
gcuggccaagcgcgcc

SEQ ID NO: 2375258 - RNA, 17 nt, Bordetella pertussis
gcuggccaagcgcgccg

SEQ ID NO: 2375259 - RNA, 19 nt, Bordetella pertussis
gcuggccaccgaagcggcg

SEQ ID NO: 2375260 - RNA, 17 nt, Bordetella pertussis
gcuggccaccgucgcca

SEQ ID NO: 2375261 - RNA, 12 nt, Bordetella pertussis
gcuggccacguu

SEQ ID NO: 2375262 - RNA, 13 nt, Bordetella pertussis
gcuggccagccgc

SEQ ID NO: 2375263 - RNA, 14 nt, Bordetella pertussis
gcuggccagccgcu

SEQ ID NO: 2375264 - RNA, 15 nt, Bordetella pertussis
gcuggccagccggcc

SEQ ID NO: 2375265 - RNA, 16 nt, Bordetella pertussis
gcuggccagccggccc

SEQ ID NO: 2375266 - RNA, 23 nt, Bordetella pertussis
gcuggccagccggcccagcaugc

SEQ ID NO: 2375267 - RNA, 20 nt, Bordetella pertussis
gcuggccagcgguacgccga

SEQ ID NO: 2375268 - RNA, 13 nt, Bordetella pertussis
gcuggccagcugg

SEQ ID NO: 2375269 - RNA, 14 nt, Bordetella pertussis
gcuggccagcuggc

SEQ ID NO: 2375270 - RNA, 16 nt, Bordetella pertussis
gcuggccaucaccgcc

SEQ ID NO: 2375271 - RNA, 12 nt, Bordetella pertussis
gcuggccaugcc

SEQ ID NO: 2375272 - RNA, 20 nt, Bordetella pertussis
gcuggccaugccgucgcgca

SEQ ID NO: 2375273 - RNA, 17 nt, Bordetella pertussis
gcuggcccacucggugc

SEQ ID NO: 2375274 - RNA, 19 nt, Bordetella pertussis
gcugggcacauccagcgcc

SEQ ID NO: 2375275 - RNA, 20 nt, Bordetella pertussis
gcugggcacauccagcgcca

SEQ ID NO: 2375276 - RNA, 22 nt, Bordetella pertussis
gcugggcacauccagcgccagc

SEQ ID NO: 2375277 - RNA, 14 nt, Bordetella pertussis
gcugggcaggcugg

SEQ ID NO: 2375278 - RNA, 20 nt, Bordetella pertussis
gcugggcaggcuggcgcggu

SEQ ID NO: 2375279 - RNA, 21 nt, Bordetella pertussis
gcugggcaggcuggcgcgguc

SEQ ID NO: 2375280 - RNA, 22 nt, Bordetella pertussis
gcugggcaugauggugcugccg

SEQ ID NO: 2375281 - RNA, 14 nt, Bordetella pertussis
gcugggcaugggcg

SEQ ID NO: 2375282 - RNA, 22 nt, Bordetella pertussis
gcugggcaugggcggcccggcc

SEQ ID NO: 2375283 - RNA, 21 nt, Bordetella pertussis
gcugggccagaccgcgcgcac

SEQ ID NO: 2375284 - RNA, 12 nt, Bordetella pertussis
gcugggccagca

SEQ ID NO: 2375285 - RNA, 12 nt, Bordetella pertussis
gcugggccaggc

SEQ ID NO: 2375286 - RNA, 17 nt, Bordetella pertussis
gcugggccaggccggcc

SEQ ID NO: 2375287 - RNA, 13 nt, Bordetella pertussis
gcugggccgcgcu

SEQ ID NO: 2375288 - RNA, 17 nt, Bordetella pertussis
gcugggcgaggcgcugg

SEQ ID NO: 2375289 - RNA, 16 nt, Bordetella pertussis
gcugggcgccagcagc

SEQ ID NO: 2375290 - RNA, 19 nt, Bordetella pertussis
gcugggcgccaugcgcccg

SEQ ID NO: 2375291 - RNA, 20 nt, Bordetella pertussis
gcugggcgccaugcgcccgg

SEQ ID NO: 2375292 - RNA, 22 nt, Bordetella pertussis
gcugggcgccaugcgcccggcc

SEQ ID NO: 2375293 - RNA, 12 nt, Bordetella pertussis
gcugggcgcgca

SEQ ID NO: 2375294 - RNA, 14 nt, Bordetella pertussis
gcugggcgcgcaca

SEQ ID NO: 2375295 - RNA, 17 nt, Bordetella pertussis
gcugggcgcgcacaagc

SEQ ID NO: 2375296 - RNA, 18 nt, Bordetella pertussis
gcugggcgcgcacaagcg

SEQ ID NO: 2375297 - RNA, 12 nt, Bordetella pertussis
gcugggcggcca

SEQ ID NO: 2375298 - RNA, 14 nt, Bordetella pertussis
gcugggcggccagg

SEQ ID NO: 2375299 - RNA, 19 nt, Bordetella pertussis
gcugggcggccaggcggau

SEQ ID NO: 2375300 - RNA, 18 nt, Bordetella pertussis
gcugggcggccuuggccg

SEQ ID NO: 2375301 - RNA, 22 nt, Bordetella pertussis
gcugggcggccuuggccgcagc

SEQ ID NO: 2375302 - RNA, 23 nt, Bordetella pertussis
gcugggcggccuuggccgcagcc

SEQ ID NO: 2375303 - RNA, 13 nt, Bordetella pertussis
gcugggcggcggg

SEQ ID NO: 2375304 - RNA, 14 nt, Bordetella pertussis
gcugggcggcgggc

SEQ ID NO: 2375305 - RNA, 16 nt, Bordetella pertussis
gcugggcggcgggcac

SEQ ID NO: 2375306 - RNA, 20 nt, Bordetella pertussis
gcugggcggcgugaccgcga

SEQ ID NO: 2375307 - RNA, 13 nt, Bordetella pertussis
gcugggcgggcug

SEQ ID NO: 2375308 - RNA, 14 nt, Bordetella pertussis
gcugggcgggcugg

SEQ ID NO: 2375309 - RNA, 16 nt, Bordetella pertussis
gcugggcgggcuggug

SEQ ID NO: 2375310 - RNA, 18 nt, Bordetella pertussis
gcugggcgggcugguggu

SEQ ID NO: 2375311 - RNA, 20 nt, Bordetella pertussis
gcugggcgguugcgcugcug

SEQ ID NO: 2375312 - RNA, 21 nt, Bordetella pertussis
gcugggcguggcgcgcgugcu

SEQ ID NO: 2375313 - RNA, 17 nt, Bordetella pertussis
gcugggcuuugccugcg

SEQ ID NO: 2375314 - RNA, 15 nt, Bordetella pertussis
gcuggggcaggcacu

SEQ ID NO: 2375315 - RNA, 16 nt, Bordetella pertussis
gcuggggcaggcacug

SEQ ID NO: 2375316 - RNA, 19 nt, Bordetella pertussis
gcuggggccgagcgugccg

SEQ ID NO: 2375317 - RNA, 15 nt, Bordetella pertussis
gcuggggccgcgcgc

SEQ ID NO: 2375318 - RNA, 16 nt, Bordetella pertussis
gcuggggccgcgcgcc

SEQ ID NO: 2375319 - RNA, 17 nt, Bordetella pertussis
gcuggggcgucccggug

SEQ ID NO: 2375320 - RNA, 19 nt, Bordetella pertussis
gcuggggcugcugggccgg

SEQ ID NO: 2375321 - RNA, 14 nt, Bordetella pertussis
gcuggggcugucgc

SEQ ID NO: 2375322 - RNA, 19 nt, Bordetella pertussis
gcugggguggagcgcggcg

SEQ ID NO: 2375323 - RNA, 13 nt, Bordetella pertussis
gcugggucagguc

SEQ ID NO: 2375324 - RNA, 18 nt, Bordetella pertussis
gcugggucaggucgcugc

SEQ ID NO: 2375325 - RNA, 16 nt, Bordetella pertussis
gcugguaaagggcgcg

SEQ ID NO: 2375326 - RNA, 19 nt, Bordetella pertussis
gcugguaaagggcgcggau

SEQ ID NO: 2375327 - RNA, 14 nt, Bordetella pertussis
gcugguacagcccc

SEQ ID NO: 2375328 - RNA, 17 nt, Bordetella pertussis
gcugguacagccccagc

SEQ ID NO: 2375329 - RNA, 22 nt, Bordetella pertussis
gcugguagaaguucucgcgcuu

SEQ ID NO: 2375330 - RNA, 16 nt, Bordetella pertussis
gcugguaggggaugcg

SEQ ID NO: 2375331 - RNA, 19 nt, Bordetella pertussis
gcugguaguaggccacugc

SEQ ID NO: 2375332 - RNA, 14 nt, Bordetella pertussis
gcuggucaccgccc

SEQ ID NO: 2375333 - RNA, 15 nt, Bordetella pertussis
gcuggucagccuggg

SEQ ID NO: 2375334 - RNA, 23 nt, Bordetella pertussis
gcuggucaucuacagcgccuggc

SEQ ID NO: 2375335 - RNA, 18 nt, Bordetella pertussis
gcuggucauugaccugcu

SEQ ID NO: 2375336 - RNA, 23 nt, Bordetella pertussis
gcugguccaccaccuucagggcg

SEQ ID NO: 2375337 - RNA, 22 nt, Bordetella pertussis
gcuggucgagagccugggcgcg

SEQ ID NO: 2375338 - RNA, 23 nt, Bordetella pertussis
gcuggucgagagccugggcgcgc

SEQ ID NO: 2375339 - RNA, 22 nt, Bordetella pertussis
gcuggucgccaucugcugcgag

SEQ ID NO: 2375340 - RNA, 14 nt, Bordetella pertussis
gcuggucgcgcacc

SEQ ID NO: 2375341 - RNA, 15 nt, Bordetella pertussis
gcuggucgcgcaccu

SEQ ID NO: 2375342 - RNA, 17 nt, Bordetella pertussis
gcuggucgcgcaccugu

SEQ ID NO: 2375343 - RNA, 14 nt, Bordetella pertussis
gcuggucgcgcagc

SEQ ID NO: 2375344 - RNA, 15 nt, Bordetella pertussis
gcuggucgcgcagca

SEQ ID NO: 2375345 - RNA, 13 nt, Bordetella pertussis
gcuggucgcgccg

SEQ ID NO: 2375346 - RNA, 16 nt, Bordetella pertussis
gcuggucgcgccgguc

SEQ ID NO: 2375347 - RNA, 16 nt, Bordetella pertussis
gcuggucgcgggccag

SEQ ID NO: 2375348 - RNA, 21 nt, Bordetella pertussis
gcuggucgcgggccaggccgg

SEQ ID NO: 2375349 - RNA, 18 nt, Bordetella pertussis
gcuggucgggaugccccg

SEQ ID NO: 2375350 - RNA, 20 nt, Bordetella pertussis
gcuggucguaucgccgcuga

SEQ ID NO: 2375351 - RNA, 21 nt, Bordetella pertussis
gcuggugaagucggcccuguc

SEQ ID NO: 2375352 - RNA, 18 nt, Bordetella pertussis
gcuggugauguccugcag

SEQ ID NO: 2375353 - RNA, 22 nt, Bordetella pertussis
gcuggugauguccugcaggccc

SEQ ID NO: 2375354 - RNA, 23 nt, Bordetella pertussis
gcuggugauguccugcaggcccg

SEQ ID NO: 2375355 - RNA, 15 nt, Bordetella pertussis
gcuggugccaguccc

SEQ ID NO: 2375356 - RNA, 13 nt, Bordetella pertussis
gcuggugccgcug

SEQ ID NO: 2375357 - RNA, 16 nt, Bordetella pertussis
gcuggugccgcuggcg

SEQ ID NO: 2375358 - RNA, 14 nt, Bordetella pertussis
gcuggugcgccgug

SEQ ID NO: 2375359 - RNA, 16 nt, Bordetella pertussis
gcuggugcgccgugcc

SEQ ID NO: 2375360 - RNA, 16 nt, Bordetella pertussis
gcuggugcuggugccg

SEQ ID NO: 2375361 - RNA, 18 nt, Bordetella pertussis
gcuggugcuggugcuggu

SEQ ID NO: 2375362 - RNA, 19 nt, Bordetella pertussis
gcuggugcuggugcuggug

SEQ ID NO: 2375363 - RNA, 16 nt, Bordetella pertussis
gcugguggccaccagc

SEQ ID NO: 2375364 - RNA, 17 nt, Bordetella pertussis
gcugguggccaccagcc

SEQ ID NO: 2375365 - RNA, 18 nt, Bordetella pertussis
gcugguggccaccagccc

SEQ ID NO: 2375366 - RNA, 20 nt, Bordetella pertussis
gcuguaccgguagcccgcgu

SEQ ID NO: 2375367 - RNA, 14 nt, Bordetella pertussis
gcuguacgacagca

SEQ ID NO: 2375368 - RNA, 23 nt, Bordetella pertussis
gcuguacgacagcaagggcgucu

SEQ ID NO: 2375369 - RNA, 13 nt, Bordetella pertussis
gcuguagcccugg

SEQ ID NO: 2375370 - RNA, 16 nt, Bordetella pertussis
gcuguagcccuggcgc

SEQ ID NO: 2375371 - RNA, 14 nt, Bordetella pertussis
gcuguagcgcagcc

SEQ ID NO: 2375372 - RNA, 15 nt, Bordetella pertussis
gcuguaggcgccggc

SEQ ID NO: 2375373 - RNA, 16 nt, Bordetella pertussis
gcuguaggcgccggcg

SEQ ID NO: 2375374 - RNA, 19 nt, Bordetella pertussis
gcuguaggcgccggcgccg

SEQ ID NO: 2375375 - RNA, 23 nt, Bordetella pertussis
gcuguauauauagggggcauggc

SEQ ID NO: 2375376 - RNA, 16 nt, Bordetella pertussis
gcuguaucuggccugu

SEQ ID NO: 2375377 - RNA, 12 nt, Bordetella pertussis
gcuguccaagcg

SEQ ID NO: 2375378 - RNA, 19 nt, Bordetella pertussis
gcuguccaagcgcguggcc

SEQ ID NO: 2375379 - RNA, 15 nt, Bordetella pertussis
gcuguccaccugcac

SEQ ID NO: 2375380 - RNA, 14 nt, Bordetella pertussis
gcuguccaggccgg

SEQ ID NO: 2375381 - RNA, 16 nt, Bordetella pertussis
gcuguccaggccgggg

SEQ ID NO: 2375382 - RNA, 21 nt, Bordetella pertussis
gcuguccagucuggauggcgu

SEQ ID NO: 2375383 - RNA, 23 nt, Bordetella pertussis
gcuguccagucuggauggcguau

SEQ ID NO: 2375384 - RNA, 19 nt, Bordetella pertussis
gcugucccagauggcgccu

SEQ ID NO: 2375385 - RNA, 14 nt, Bordetella pertussis
gcuguccccgcaug

SEQ ID NO: 2375386 - RNA, 18 nt, Bordetella pertussis
gcuguccccgcauggaga

SEQ ID NO: 2375387 - RNA, 19 nt, Bordetella pertussis
gcuucgucauggucgacca

SEQ ID NO: 2375388 - RNA, 13 nt, Bordetella pertussis
gcuucgucgacca

SEQ ID NO: 2375389 - RNA, 16 nt, Bordetella pertussis
gcuucgucgccggcgu

SEQ ID NO: 2375390 - RNA, 21 nt, Bordetella pertussis
gcuucgucgccggcguuggug

SEQ ID NO: 2375391 - RNA, 22 nt, Bordetella pertussis
gcuucgucgccggcguugguga

SEQ ID NO: 2375392 - RNA, 13 nt, Bordetella pertussis
gcuucgucggccg

SEQ ID NO: 2375393 - RNA, 14 nt, Bordetella pertussis
gcuucgucggccgc

SEQ ID NO: 2375394 - RNA, 21 nt, Bordetella pertussis
gcuucgucggccgccagccac

SEQ ID NO: 2375395 - RNA, 17 nt, Bordetella pertussis
gcuucgucggcgucgaa

SEQ ID NO: 2375396 - RNA, 16 nt, Bordetella pertussis
gcuucgucgggcagcg

SEQ ID NO: 2375397 - RNA, 19 nt, Bordetella pertussis
gcuucgucgggcagcgcgg

SEQ ID NO: 2375398 - RNA, 21 nt, Bordetella pertussis
gcuucgucgggcagcgcggcg

SEQ ID NO: 2375399 - RNA, 16 nt, Bordetella pertussis
gcuucgugcagcgcgu

SEQ ID NO: 2375400 - RNA, 22 nt, Bordetella pertussis
gcuucguuggugucggcggcga

SEQ ID NO: 2375401 - RNA, 23 nt, Bordetella pertussis
gcuucuaggagacggucaccgcg

SEQ ID NO: 2375402 - RNA, 18 nt, Bordetella pertussis
gcuucucacugcccgcgc

SEQ ID NO: 2375403 - RNA, 19 nt, Bordetella pertussis
gcuucucgcaagugcuggc

SEQ ID NO: 2375404 - RNA, 20 nt, Bordetella pertussis
gcuucucgcaagugcuggcc

SEQ ID NO: 2375405 - RNA, 18 nt, Bordetella pertussis
gcuucucggugcgccgcc

SEQ ID NO: 2375406 - RNA, 20 nt, Bordetella pertussis
gcuucucggugcgccgccgc

SEQ ID NO: 2375407 - RNA, 18 nt, Bordetella pertussis
gcuucugccagacggcca

SEQ ID NO: 2375408 - RNA, 23 nt, Bordetella pertussis
gcuucugccagacggccagcgcg

SEQ ID NO: 2375409 - RNA, 13 nt, Bordetella pertussis
gcuucugcgccug

SEQ ID NO: 2375410 - RNA, 14 nt, Bordetella pertussis
gcuucugcgccugc

SEQ ID NO: 2375411 - RNA, 18 nt, Bordetella pertussis
gcuucugcgccugcuggu

SEQ ID NO: 2375412 - RNA, 23 nt, Bordetella pertussis
gcuucuggaucaccgccggcggc

SEQ ID NO: 2375413 - RNA, 20 nt, Bordetella pertussis
gcuucuucuuugcccuggcc

SEQ ID NO: 2375414 - RNA, 21 nt, Bordetella pertussis
gcuucuugaacucggccagca

SEQ ID NO: 2375415 - RNA, 14 nt, Bordetella pertussis
gcuugaacaggcag

SEQ ID NO: 2375416 - RNA, 17 nt, Bordetella pertussis
gcuugaagacgcccagg

SEQ ID NO: 2375417 - RNA, 17 nt, Bordetella pertussis
gcuugaccacggccagc

SEQ ID NO: 2375418 - RNA, 18 nt, Bordetella pertussis
gcuugaccacggccagca

SEQ ID NO: 2375419 - RNA, 19 nt, Bordetella pertussis
gcuugaccacggccagcag

SEQ ID NO: 2375420 - RNA, 20 nt, Bordetella pertussis
gcuugaccacggccagcagc

SEQ ID NO: 2375421 - RNA, 22 nt, Bordetella pertussis
gcuugaccacggccagcagcac

SEQ ID NO: 2375422 - RNA, 23 nt, Bordetella pertussis
gcuugaccagggcggugggcagc

SEQ ID NO: 2375423 - RNA, 19 nt, Bordetella pertussis
gcuugacccguuugcgcag

SEQ ID NO: 2375424 - RNA, 22 nt, Bordetella pertussis
gcuugacccguuugcgcagcuc

SEQ ID NO: 2375425 - RNA, 16 nt, Bordetella pertussis
gcuugaccgccagcau

SEQ ID NO: 2375426 - RNA, 17 nt, Bordetella pertussis
gcuugaccgccagcauc

SEQ ID NO: 2375427 - RNA, 17 nt, Bordetella pertussis
gcuugaccuugagcacg

SEQ ID NO: 2375428 - RNA, 22 nt, Bordetella pertussis
gcuugaccuugagcacgcuggc

SEQ ID NO: 2375429 - RNA, 21 nt, Bordetella pertussis
gcuugacguagcggaucgcgg

SEQ ID NO: 2375430 - RNA, 22 nt, Bordetella pertussis
gcuugacguagcggaucgcggc

SEQ ID NO: 2375431 - RNA, 14 nt, Bordetella pertussis
gcuugacguccagc

SEQ ID NO: 2375432 - RNA, 16 nt, Bordetella pertussis
gcuugacguccagcca

SEQ ID NO: 2375433 - RNA, 17 nt, Bordetella pertussis
gcuugacguccagccag

SEQ ID NO: 2375434 - RNA, 17 nt, Bordetella pertussis
gcuugacguccagcgac

SEQ ID NO: 2375435 - RNA, 21 nt, Bordetella pertussis
gcuugagauacuugcgcagcg

SEQ ID NO: 2375436 - RNA, 13 nt, Bordetella pertussis
gcuugagcagcca

SEQ ID NO: 2375437 - RNA, 15 nt, Bordetella pertussis
gcuugagcagccacu

SEQ ID NO: 2375438 - RNA, 16 nt, Bordetella pertussis
gcuugaggccgcgcgc

SEQ ID NO: 2375439 - RNA, 17 nt, Bordetella pertussis
gcuugaggccgcgcgcc

SEQ ID NO: 2375440 - RNA, 15 nt, Bordetella pertussis
gcuugaguuuggcga

SEQ ID NO: 2375441 - RNA, 23 nt, Bordetella pertussis
gcuugauaugggcgagcaggccc

SEQ ID NO: 2375442 - RNA, 16 nt, Bordetella pertussis
gcuugaugccggcguu

SEQ ID NO: 2375443 - RNA, 15 nt, Bordetella pertussis
gcuugauggccagcg

SEQ ID NO: 2375444 - RNA, 18 nt, Bordetella pertussis
gcuugauggccagcgcgc

SEQ ID NO: 2375445 - RNA, 22 nt, Bordetella pertussis
gcuugauggccagcgcgcgggc

SEQ ID NO: 2375446 - RNA, 16 nt, Bordetella pertussis
gcuugcacgccggcca

SEQ ID NO: 2375447 - RNA, 19 nt, Bordetella pertussis
gcuugcacgccggccacga

SEQ ID NO: 2375448 - RNA, 17 nt, Bordetella pertussis
gcuugcagcggacggcg

SEQ ID NO: 2375449 - RNA, 19 nt, Bordetella pertussis
gcuugccagcucgacgcgc

SEQ ID NO: 2375450 - RNA, 14 nt, Bordetella pertussis
gcuugccauaggcc

SEQ ID NO: 2375451 - RNA, 17 nt, Bordetella pertussis
gcuugccauaggccagc

SEQ ID NO: 2375452 - RNA, 20 nt, Bordetella pertussis
gcuugccauaggccagcgcc

SEQ ID NO: 2375453 - RNA, 12 nt, Bordetella pertussis
gcuugcccggcg

SEQ ID NO: 2375454 - RNA, 22 nt, Bordetella pertussis
gcuugcccggcgugcugaggcu

SEQ ID NO: 2375455 - RNA, 19 nt, Bordetella pertussis
gcuugcccgucaugcgccg

SEQ ID NO: 2375456 - RNA, 22 nt, Bordetella pertussis
gcuugcccgugcgugugccugu

SEQ ID NO: 2375457 - RNA, 13 nt, Bordetella pertussis
gcuugccgcagcg

SEQ ID NO: 2375458 - RNA, 18 nt, Bordetella pertussis
gcuugccgcagcggccau

SEQ ID NO: 2375459 - RNA, 23 nt, Bordetella pertussis
gcuugccgcccacugccaggcga

SEQ ID NO: 2375460 - RNA, 15 nt, Bordetella pertussis
gcuugccggcgauca

SEQ ID NO: 2375461 - RNA, 16 nt, Bordetella pertussis
gcuugcgauaggugcg

SEQ ID NO: 2375462 - RNA, 19 nt, Bordetella pertussis
gcuugcgauaggugcgcag

SEQ ID NO: 2375463 - RNA, 19 nt, Bordetella pertussis
gcuugcgcaagccggccgc

SEQ ID NO: 2375464 - RNA, 18 nt, Bordetella pertussis
gcuugcgcagggcgggcg

SEQ ID NO: 2375465 - RNA, 14 nt, Bordetella pertussis
gcuugcgccagcca

SEQ ID NO: 2375466 - RNA, 21 nt, Bordetella pertussis
gcuugcgccagccacgcgcgc

SEQ ID NO: 2375467 - RNA, 22 nt, Bordetella pertussis
gcuugcgccagccacgcgcgcu

SEQ ID NO: 2375468 - RNA, 13 nt, Bordetella pertussis
gcuugcgcgccag

SEQ ID NO: 2375469 - RNA, 14 nt, Bordetella pertussis
gcuugcgcgccgca

SEQ ID NO: 2375470 - RNA, 18 nt, Bordetella pertussis
gcuugcgcgccugcuggu

SEQ ID NO: 2375471 - RNA, 17 nt, Bordetella pertussis
gcuugcgcguaggcgcg

SEQ ID NO: 2375472 - RNA, 21 nt, Bordetella pertussis
gcuugcgcguaggcgcgcgca

SEQ ID NO: 2375473 - RNA, 12 nt, Bordetella pertussis
gcuugcgcuggc

SEQ ID NO: 2375474 - RNA, 15 nt, Bordetella pertussis
gcuugcgcuggcgcg

SEQ ID NO: 2375475 - RNA, 15 nt, Bordetella pertussis
gcuugcgcuuggcag

SEQ ID NO: 2375476 - RNA, 16 nt, Bordetella pertussis
gcuugcggccaggcgg

SEQ ID NO: 2375477 - RNA, 21 nt, Bordetella pertussis
gcuugcggccaggcggggugg

SEQ ID NO: 2375478 - RNA, 14 nt, Bordetella pertussis
gcuugcggccggcg

SEQ ID NO: 2375479 - RNA, 16 nt, Bordetella pertussis
gcuugcggccggcgcu

SEQ ID NO: 2375480 - RNA, 19 nt, Bordetella pertussis
gcuugcggccggcgcugau

SEQ ID NO: 2375481 - RNA, 16 nt, Bordetella pertussis
gcuugcggcgcuggcu

SEQ ID NO: 2375482 - RNA, 17 nt, Bordetella pertussis
gcuugcggcgcuggcug

SEQ ID NO: 2375483 - RNA, 14 nt, Bordetella pertussis
gcuugcggcugucc

SEQ ID NO: 2375484 - RNA, 22 nt, Bordetella pertussis
gcuugcgguccguacgccacuu

SEQ ID NO: 2375485 - RNA, 18 nt, Bordetella pertussis
gcuugcguuggcauggcg

SEQ ID NO: 2375486 - RNA, 20 nt, Bordetella pertussis
gcuugcguuggcauggcgcg

SEQ ID NO: 2375487 - RNA, 15 nt, Bordetella pertussis
gcuugcugccccccg

SEQ ID NO: 2375488 - RNA, 23 nt, Bordetella pertussis
gcuugcuucaggcuggccugcag

SEQ ID NO: 2375489 - RNA, 15 nt, Bordetella pertussis
gcuugcuugccagcu

SEQ ID NO: 2375490 - RNA, 14 nt, Bordetella pertussis
gcuuggcagccuug

SEQ ID NO: 2375491 - RNA, 13 nt, Bordetella pertussis
gcuuggcaggcgu

SEQ ID NO: 2375492 - RNA, 16 nt, Bordetella pertussis
gcuuggccaccacgcc

SEQ ID NO: 2375493 - RNA, 17 nt, Bordetella pertussis
gcuuggccaccacgccc

SEQ ID NO: 2375494 - RNA, 12 nt, Bordetella pertussis
gcuuggccagcu

SEQ ID NO: 2375495 - RNA, 14 nt, Bordetella pertussis
gcuuggccagcugg

SEQ ID NO: 2375496 - RNA, 14 nt, Bordetella pertussis
gcuuggccaggcug

SEQ ID NO: 2375497 - RNA, 19 nt, Bordetella pertussis
gcuuggcccugcagcggcc

SEQ ID NO: 2375498 - RNA, 17 nt, Bordetella pertussis
gcuuggccugcggaugc

SEQ ID NO: 2375499 - RNA, 14 nt, Bordetella pertussis
ggaauaccgccagc

SEQ ID NO: 2375500 - RNA, 19 nt, Bordetella pertussis
ggaauacgccguugcggcc

SEQ ID NO: 2375501 - RNA, 16 nt, Bordetella pertussis
ggaaucauuggccagc

SEQ ID NO: 2375502 - RNA, 12 nt, Bordetella pertussis
ggaauccacagc

SEQ ID NO: 2375503 - RNA, 17 nt, Bordetella pertussis
ggaauccuggugccagu

SEQ ID NO: 2375504 - RNA, 15 nt, Bordetella pertussis
ggaaucgcguucacg

SEQ ID NO: 2375505 - RNA, 13 nt, Bordetella pertussis
ggaaucggcaccu

SEQ ID NO: 2375506 - RNA, 20 nt, Bordetella pertussis
ggaaugaagcgcgacaugac

SEQ ID NO: 2375507 - RNA, 22 nt, Bordetella pertussis
ggaaugggagguugcccgcccg

SEQ ID NO: 2375508 - RNA, 18 nt, Bordetella pertussis
ggaauucugaacaagggc

SEQ ID NO: 2375509 - RNA, 14 nt, Bordetella pertussis
ggaauuggcggcga

SEQ ID NO: 2375510 - RNA, 19 nt, Bordetella pertussis
ggaauugggcgagcccagg

SEQ ID NO: 2375511 - RNA, 21 nt, Bordetella pertussis
ggacaagaaagcggcgauacg

SEQ ID NO: 2375512 - RNA, 18 nt, Bordetella pertussis
ggacacacgcucuugcgc

SEQ ID NO: 2375513 - RNA, 20 nt, Bordetella pertussis
ggacacacgcucuugcgcgc

SEQ ID NO: 2375514 - RNA, 14 nt, Bordetella pertussis
ggacacgcagcuga

SEQ ID NO: 2375515 - RNA, 23 nt, Bordetella pertussis
ggacagauacuguucgccgcacc

SEQ ID NO: 2375516 - RNA, 15 nt, Bordetella pertussis
ggacagauccagcgc

SEQ ID NO: 2375517 - RNA, 19 nt, Bordetella pertussis
ggacagauccagcgcggcc

SEQ ID NO: 2375518 - RNA, 16 nt, Bordetella pertussis
ggacagcaccgacagg

SEQ ID NO: 2375519 - RNA, 22 nt, Bordetella pertussis
ggacagcaguucggccggcggc

SEQ ID NO: 2375520 - RNA, 23 nt, Bordetella pertussis
ggacagcaguuucugcaccggcg

SEQ ID NO: 2375521 - RNA, 16 nt, Bordetella pertussis
ggacagccccagcagc

SEQ ID NO: 2375522 - RNA, 15 nt, Bordetella pertussis
ggacagcgccagccc

SEQ ID NO: 2375523 - RNA, 16 nt, Bordetella pertussis
ggacagcgccagcccg

SEQ ID NO: 2375524 - RNA, 16 nt, Bordetella pertussis
ggacagcgcguuggcg

SEQ ID NO: 2375525 - RNA, 20 nt, Bordetella pertussis
ggacagcgcguuggcguugc

SEQ ID NO: 2375526 - RNA, 20 nt, Bordetella pertussis
ggacaggaacuccggcggcg

SEQ ID NO: 2375527 - RNA, 21 nt, Bordetella pertussis
ggacaggaacuccggcggcgc

SEQ ID NO: 2375528 - RNA, 14 nt, Bordetella pertussis
ggacaggcacaccg

SEQ ID NO: 2375529 - RNA, 15 nt, Bordetella pertussis
ggacaggcacccaug

SEQ ID NO: 2375530 - RNA, 18 nt, Bordetella pertussis
ggacaggcaccccagcac

SEQ ID NO: 2375531 - RNA, 22 nt, Bordetella pertussis
ggacaggcaccccagcaccccg

SEQ ID NO: 2375532 - RNA, 15 nt, Bordetella pertussis
ggacaggcacccccg

SEQ ID NO: 2375533 - RNA, 14 nt, Bordetella pertussis
ggacaggcaccccg

SEQ ID NO: 2375534 - RNA, 20 nt, Bordetella pertussis
ggacaggcaccccggcgccg

SEQ ID NO: 2375535 - RNA, 21 nt, Bordetella pertussis
ggacaggcaccccggcgccgc

SEQ ID NO: 2375536 - RNA, 21 nt, Bordetella pertussis
ggacaggcacccgcgcgcagc

SEQ ID NO: 2375537 - RNA, 15 nt, Bordetella pertussis
ggacaggcacccugu

SEQ ID NO: 2375538 - RNA, 18 nt, Bordetella pertussis
ggacaggcacccuugccg

SEQ ID NO: 2375539 - RNA, 22 nt, Bordetella pertussis
ggacaggcacccuugccgcagc

SEQ ID NO: 2375540 - RNA, 23 nt, Bordetella pertussis
ggacaggcaccgaacgggcgugg

SEQ ID NO: 2375541 - RNA, 15 nt, Bordetella pertussis
ggacaggcaccgccg

SEQ ID NO: 2375542 - RNA, 12 nt, Bordetella pertussis
ggacaggcaccu

SEQ ID NO: 2375543 - RNA, 16 nt, Bordetella pertussis
ggacaggcaccugcga

SEQ ID NO: 2375544 - RNA, 17 nt, Bordetella pertussis
ggacaggcaccuuggcc

SEQ ID NO: 2375545 - RNA, 21 nt, Bordetella pertussis
ggacaggcaccuuggcccggc

SEQ ID NO: 2375546 - RNA, 22 nt, Bordetella pertussis
ggacaggcaccuuggcccggcg

SEQ ID NO: 2375547 - RNA, 11 nt, Bordetella pertussis
ggacaggcacg

SEQ ID NO: 2375548 - RNA, 14 nt, Bordetella pertussis
ggacaggcacgccg

SEQ ID NO: 2375549 - RNA, 13 nt, Bordetella pertussis
ggacaggcccagc

SEQ ID NO: 2375550 - RNA, 16 nt, Bordetella pertussis
ggacaggcccagcccg

SEQ ID NO: 2375551 - RNA, 18 nt, Bordetella pertussis
ggacaggcccucggugcg

SEQ ID NO: 2375552 - RNA, 13 nt, Bordetella pertussis
ggacaggcgccac

SEQ ID NO: 2375553 - RNA, 16 nt, Bordetella pertussis
ggacaggcgugcgcag

SEQ ID NO: 2375554 - RNA, 18 nt, Bordetella pertussis
ggacaggcgugcgcagcu

SEQ ID NO: 2375555 - RNA, 13 nt, Bordetella pertussis
ggacaggcucccg

SEQ ID NO: 2375556 - RNA, 21 nt, Bordetella pertussis
ggacaggcucccgcuggcggc

SEQ ID NO: 2375557 - RNA, 17 nt, Bordetella pertussis
ggacaggcuccgaggga

SEQ ID NO: 2375558 - RNA, 22 nt, Bordetella pertussis
ggacaggcucuuuuucccggcg

SEQ ID NO: 2375559 - RNA, 16 nt, Bordetella pertussis
ggacagggccgcgagc

SEQ ID NO: 2375560 - RNA, 13 nt, Bordetella pertussis
ggacaggucggcg

SEQ ID NO: 2375561 - RNA, 16 nt, Bordetella pertussis
ggacaggucggcgccc

SEQ ID NO: 2375562 - RNA, 23 nt, Bordetella pertussis
ggacauccguuucccgauuccag

SEQ ID NO: 2375563 - RNA, 17 nt, Bordetella pertussis
ggaccaauacgccgcca

SEQ ID NO: 2375564 - RNA, 22 nt, Bordetella pertussis
ggaccaccccgagauaggcggc

SEQ ID NO: 2375565 - RNA, 20 nt, Bordetella pertussis
ggaccagcaguugcgccagu

SEQ ID NO: 2375566 - RNA, 20 nt, Bordetella pertussis
ggaccagcgguugcgccagc

SEQ ID NO: 2375567 - RNA, 21 nt, Bordetella pertussis
ggaccagcgguugcgccagcu

SEQ ID NO: 2375568 - RNA, 22 nt, Bordetella pertussis
ggaccaugcgcugggcaugggc

SEQ ID NO: 2375569 - RNA, 12 nt, Bordetella pertussis
ggacccaggccu

SEQ ID NO: 2375570 - RNA, 20 nt, Bordetella pertussis
ggacccaguucggccgccag

SEQ ID NO: 2375571 - RNA, 20 nt, Bordetella pertussis
ggaccccaguuccagcacga

SEQ ID NO: 2375572 - RNA, 23 nt, Bordetella pertussis
ggaccccguggucgccagcacgc

SEQ ID NO: 2375573 - RNA, 15 nt, Bordetella pertussis
ggacccggagcugcc

SEQ ID NO: 2375574 - RNA, 18 nt, Bordetella pertussis
ggaccgaacggccgguca

SEQ ID NO: 2375575 - RNA, 19 nt, Bordetella pertussis
ggaccgaggugccagccug

SEQ ID NO: 2375576 - RNA, 16 nt, Bordetella pertussis
ggaccgcgaugcugcg

SEQ ID NO: 2375577 - RNA, 17 nt, Bordetella pertussis
ggaccgcgaugcugcgc

SEQ ID NO: 2375578 - RNA, 18 nt, Bordetella pertussis
ggaccgcgccgccgcgcc

SEQ ID NO: 2375579 - RNA, 24 nt, Bordetella pertussis
ggaccgcgccugggggcuggaggc

SEQ ID NO: 2375580 - RNA, 13 nt, Bordetella pertussis
ggaccgcgcgcga

SEQ ID NO: 2375581 - RNA, 17 nt, Bordetella pertussis
ggaccgcgcugcgguca

SEQ ID NO: 2375582 - RNA, 23 nt, Bordetella pertussis
ggaccgcgcugcggucagcugug

SEQ ID NO: 2375583 - RNA, 15 nt, Bordetella pertussis
ggaccggcgauggcg

SEQ ID NO: 2375584 - RNA, 19 nt, Bordetella pertussis
ggaccggcguccaugaaaa

SEQ ID NO: 2375585 - RNA, 14 nt, Bordetella pertussis
ggaccgggaauggc

SEQ ID NO: 2375586 - RNA, 16 nt, Bordetella pertussis
ggaccguccgcgacgg

SEQ ID NO: 2375587 - RNA, 19 nt, Bordetella pertussis
ggaccugccguucgcgcug

SEQ ID NO: 2375588 - RNA, 18 nt, Bordetella pertussis
ggaccugcucgagcggcg

SEQ ID NO: 2375589 - RNA, 19 nt, Bordetella pertussis
ggaccugcucgagcggcgg

SEQ ID NO: 2375590 - RNA, 20 nt, Bordetella pertussis
ggaccuggacgagggccgcg

SEQ ID NO: 2375591 - RNA, 13 nt, Bordetella pertussis
ggaccuggccacc

SEQ ID NO: 2375592 - RNA, 15 nt, Bordetella pertussis
ggaccuguacuggcu

SEQ ID NO: 2375593 - RNA, 17 nt, Bordetella pertussis
ggaccuguggcgcaccc

SEQ ID NO: 2375594 - RNA, 18 nt, Bordetella pertussis
ggaccuguggcgcacccu

SEQ ID NO: 2375595 - RNA, 22 nt, Bordetella pertussis
ggaccuugcgaggcccggccug

SEQ ID NO: 2375596 - RNA, 14 nt, Bordetella pertussis
ggacgaacaggccg

SEQ ID NO: 2375597 - RNA, 22 nt, Bordetella pertussis
ggacgaagccuaggcugcagcc

SEQ ID NO: 2375598 - RNA, 19 nt, Bordetella pertussis
ggacgaauacgcuggcgcg

SEQ ID NO: 2375599 - RNA, 13 nt, Bordetella pertussis
ggacgacaggcau

SEQ ID NO: 2375600 - RNA, 21 nt, Bordetella pertussis
ggacgaccaacucgaggcggc

SEQ ID NO: 2375601 - RNA, 22 nt, Bordetella pertussis
ggacgaccaacucgaggcggcg

SEQ ID NO: 2375602 - RNA, 23 nt, Bordetella pertussis
ggacgaccaacucgaggcggcgc

SEQ ID NO: 2375603 - RNA, 14 nt, Bordetella pertussis
ggacgagacaggcg

SEQ ID NO: 2375604 - RNA, 14 nt, Bordetella pertussis
ggacgagcgcagca

SEQ ID NO: 2375605 - RNA, 16 nt, Bordetella pertussis
ggacgagcgcagcaag

SEQ ID NO: 2375606 - RNA, 21 nt, Bordetella pertussis
ggacgagcgggugaugcugca

SEQ ID NO: 2375607 - RNA, 15 nt, Bordetella pertussis
ggacgagggccggcg

SEQ ID NO: 2375608 - RNA, 15 nt, Bordetella pertussis
ggacgaucccggcca

SEQ ID NO: 2375609 - RNA, 13 nt, Bordetella pertussis
ggacgaugcgcga

SEQ ID NO: 2375610 - RNA, 22 nt, Bordetella pertussis
ggacgaugcgcgaagcgcccug

SEQ ID NO: 2375611 - RNA, 18 nt, Bordetella pertussis
ggagcugcugugcgccgg

SEQ ID NO: 2375612 - RNA, 20 nt, Bordetella pertussis
ggagcugcugugcgccgggg

SEQ ID NO: 2375613 - RNA, 22 nt, Bordetella pertussis
ggagcugcugugcgccggggcg

SEQ ID NO: 2375614 - RNA, 23 nt, Bordetella pertussis
ggagcugcugugcgccggggcgc

SEQ ID NO: 2375615 - RNA, 15 nt, Bordetella pertussis
ggaggaacugggcgc

SEQ ID NO: 2375616 - RNA, 13 nt, Bordetella pertussis
ggaggacgccgac

SEQ ID NO: 2375617 - RNA, 14 nt, Bordetella pertussis
ggaggacgccgacc

SEQ ID NO: 2375618 - RNA, 20 nt, Bordetella pertussis
ggaggagguuuuccuggagc

SEQ ID NO: 2375619 - RNA, 17 nt, Bordetella pertussis
ggaggauacggccagcg

SEQ ID NO: 2375620 - RNA, 22 nt, Bordetella pertussis
ggaggcacuccgucauggcgcc

SEQ ID NO: 2375621 - RNA, 22 nt, Bordetella pertussis
ggaggccgagcgcgagcagggc

SEQ ID NO: 2375622 - RNA, 13 nt, Bordetella pertussis
ggaggcgcagcgc

SEQ ID NO: 2375623 - RNA, 17 nt, Bordetella pertussis
ggaggcgcagcgcggca

SEQ ID NO: 2375624 - RNA, 14 nt, Bordetella pertussis
ggaggcgcgcagcu

SEQ ID NO: 2375625 - RNA, 19 nt, Bordetella pertussis
ggagggcuccaggcugagc

SEQ ID NO: 2375626 - RNA, 15 nt, Bordetella pertussis
ggagggugcgcaaug

SEQ ID NO: 2375627 - RNA, 22 nt, Bordetella pertussis
ggagguaugcacgaccaggccg

SEQ ID NO: 2375628 - RNA, 23 nt, Bordetella pertussis
ggagguucgaauccucucgcccc

SEQ ID NO: 2375629 - RNA, 20 nt, Bordetella pertussis
ggaguagccgcucagguaga

SEQ ID NO: 2375630 - RNA, 17 nt, Bordetella pertussis
ggagucggcgccgcgca

SEQ ID NO: 2375631 - RNA, 13 nt, Bordetella pertussis
ggagucgugcagg

SEQ ID NO: 2375632 - RNA, 14 nt, Bordetella pertussis
ggagucgugcagga

SEQ ID NO: 2375633 - RNA, 18 nt, Bordetella pertussis
ggagucgugcaggauggc

SEQ ID NO: 2375634 - RNA, 18 nt, Bordetella pertussis
ggagugcgaggacgaccu

SEQ ID NO: 2375635 - RNA, 23 nt, Bordetella pertussis
ggaguuccgcgucuaccuggacg

SEQ ID NO: 2375636 - RNA, 19 nt, Bordetella pertussis
ggaguucuucuuggccaga

SEQ ID NO: 2375637 - RNA, 16 nt, Bordetella pertussis
ggauaauugggcggca

SEQ ID NO: 2375638 - RNA, 17 nt, Bordetella pertussis
ggauaauugggcggcau

SEQ ID NO: 2375639 - RNA, 23 nt, Bordetella pertussis
ggauacgcgucauaccgaaggac

SEQ ID NO: 2375640 - RNA, 15 nt, Bordetella pertussis
ggauacggccagcgc

SEQ ID NO: 2375641 - RNA, 16 nt, Bordetella pertussis
ggauacggccagcgcc

SEQ ID NO: 2375642 - RNA, 16 nt, Bordetella pertussis
ggauagacccuccucg

SEQ ID NO: 2375643 - RNA, 20 nt, Bordetella pertussis
ggauagaguucggcgcggcc

SEQ ID NO: 2375644 - RNA, 15 nt, Bordetella pertussis
ggauagcgccguacc

SEQ ID NO: 2375645 - RNA, 21 nt, Bordetella pertussis
ggauagcgccguaccagcgcg

SEQ ID NO: 2375646 - RNA, 16 nt, Bordetella pertussis
ggauaucggccaggcg

SEQ ID NO: 2375647 - RNA, 12 nt, Bordetella pertussis
ggauauggcgcc

SEQ ID NO: 2375648 - RNA, 15 nt, Bordetella pertussis
ggauauucgucggcc

SEQ ID NO: 2375649 - RNA, 19 nt, Bordetella pertussis
ggaucaagcggcccgcgcc

SEQ ID NO: 2375650 - RNA, 13 nt, Bordetella pertussis
ggaucaaggcccg

SEQ ID NO: 2375651 - RNA, 18 nt, Bordetella pertussis
ggaucaccagcccggcgg

SEQ ID NO: 2375652 - RNA, 15 nt, Bordetella pertussis
ggaucacccagcggc

SEQ ID NO: 2375653 - RNA, 20 nt, Bordetella pertussis
ggaucacccagcggcuggcc

SEQ ID NO: 2375654 - RNA, 16 nt, Bordetella pertussis
ggaucaccgccgcgcc

SEQ ID NO: 2375655 - RNA, 13 nt, Bordetella pertussis
ggaucaccgccgg

SEQ ID NO: 2375656 - RNA, 17 nt, Bordetella pertussis
ggaucaccguucuuccg

SEQ ID NO: 2375657 - RNA, 18 nt, Bordetella pertussis
ggaucacgcuaaauacgc

SEQ ID NO: 2375658 - RNA, 21 nt, Bordetella pertussis
ggaucagcuugaugccggcgu

SEQ ID NO: 2375659 - RNA, 18 nt, Bordetella pertussis
ggaucaggaugggcgcgg

SEQ ID NO: 2375660 - RNA, 12 nt, Bordetella pertussis
ggaucaggguga

SEQ ID NO: 2375661 - RNA, 19 nt, Bordetella pertussis
ggauccacgccgccggcca

SEQ ID NO: 2375662 - RNA, 20 nt, Bordetella pertussis
ggauccacgccgccggccag

SEQ ID NO: 2375663 - RNA, 22 nt, Bordetella pertussis
ggauccagccauggaagcggca

SEQ ID NO: 2375664 - RNA, 12 nt, Bordetella pertussis
ggaucccaggcc

SEQ ID NO: 2375665 - RNA, 16 nt, Bordetella pertussis
ggaucccaggccggcu

SEQ ID NO: 2375666 - RNA, 16 nt, Bordetella pertussis
ggauccccagcacaua

SEQ ID NO: 2375667 - RNA, 18 nt, Bordetella pertussis
ggaucccggcgccagcca

SEQ ID NO: 2375668 - RNA, 21 nt, Bordetella pertussis
ggaucccggcgccagccagau

SEQ ID NO: 2375669 - RNA, 13 nt, Bordetella pertussis
ggauccggcagca

SEQ ID NO: 2375670 - RNA, 14 nt, Bordetella pertussis
ggauccggcagcac

SEQ ID NO: 2375671 - RNA, 15 nt, Bordetella pertussis
ggauccggcgcuggc

SEQ ID NO: 2375672 - RNA, 17 nt, Bordetella pertussis
ggauccugcggcgcggu

SEQ ID NO: 2375673 - RNA, 15 nt, Bordetella pertussis
ggaucgaacgccucg

SEQ ID NO: 2375674 - RNA, 17 nt, Bordetella pertussis
ggaucgacaggaacagc

SEQ ID NO: 2375675 - RNA, 14 nt, Bordetella pertussis
ggaucgagcgcggu

SEQ ID NO: 2375676 - RNA, 17 nt, Bordetella pertussis
ggaucgcacacaccgcg

SEQ ID NO: 2375677 - RNA, 14 nt, Bordetella pertussis
ggaucgcgccaggc

SEQ ID NO: 2375678 - RNA, 14 nt, Bordetella pertussis
ggaucgcgcccagc

SEQ ID NO: 2375679 - RNA, 15 nt, Bordetella pertussis
ggaucgcgcccagcg

SEQ ID NO: 2375680 - RNA, 18 nt, Bordetella pertussis
ggaucgcggccagcggca

SEQ ID NO: 2375681 - RNA, 23 nt, Bordetella pertussis
ggaucgcggccagcggcaggggc

SEQ ID NO: 2375682 - RNA, 24 nt, Bordetella pertussis
ggaucggcguauugcuccacaggc

SEQ ID NO: 2375683 - RNA, 21 nt, Bordetella pertussis
ggaucggggggugcgaggcga

SEQ ID NO: 2375684 - RNA, 23 nt, Bordetella pertussis
ggaucggggggugcgaggcgaac

SEQ ID NO: 2375685 - RNA, 21 nt, Bordetella pertussis
ggaucgugcccagcuggcacc

SEQ ID NO: 2375686 - RNA, 21 nt, Bordetella pertussis
ggaucucggccagcagcgccu

SEQ ID NO: 2375687 - RNA, 20 nt, Bordetella pertussis
ggaucugcaccuuguacugg

SEQ ID NO: 2375688 - RNA, 17 nt, Bordetella pertussis
ggaucugcaugccgacc

SEQ ID NO: 2375689 - RNA, 13 nt, Bordetella pertussis
ggaucugcgagcc

SEQ ID NO: 2375690 - RNA, 14 nt, Bordetella pertussis
ggaucuggccggcg

SEQ ID NO: 2375691 - RNA, 19 nt, Bordetella pertussis
ggaugaacagcgagaagca

SEQ ID NO: 2375692 - RNA, 23 nt, Bordetella pertussis
ggaugaacaucggcagcgaggcg

SEQ ID NO: 2375693 - RNA, 19 nt, Bordetella pertussis
ggaugaagcguucggccuu

SEQ ID NO: 2375694 - RNA, 19 nt, Bordetella pertussis
ggaugaccugcgccaggug

SEQ ID NO: 2375695 - RNA, 18 nt, Bordetella pertussis
ggaugaccuggugcacca

SEQ ID NO: 2375696 - RNA, 15 nt, Bordetella pertussis
ggaugacgggcgagc

SEQ ID NO: 2375697 - RNA, 23 nt, Bordetella pertussis
ggaugacucgggcaugcgccugc

SEQ ID NO: 2375698 - RNA, 15 nt, Bordetella pertussis
ggaugagcaggccgg

SEQ ID NO: 2375699 - RNA, 15 nt, Bordetella pertussis
ggaugaucgcgcagc

SEQ ID NO: 2375700 - RNA, 14 nt, Bordetella pertussis
ggaugaugcggcgc

SEQ ID NO: 2375701 - RNA, 15 nt, Bordetella pertussis
ggaugaugggcaucg

SEQ ID NO: 2375702 - RNA, 20 nt, Bordetella pertussis
ggaugauggucugccacauc

SEQ ID NO: 2375703 - RNA, 18 nt, Bordetella pertussis
ggaugcacguagcgcagc

SEQ ID NO: 2375704 - RNA, 21 nt, Bordetella pertussis
ggaugcacguagcgcagcacc

SEQ ID NO: 2375705 - RNA, 21 nt, Bordetella pertussis
ggaugcaggucggggcgcucg

SEQ ID NO: 2375706 - RNA, 17 nt, Bordetella pertussis
ggaugccaugccgggca

SEQ ID NO: 2375707 - RNA, 13 nt, Bordetella pertussis
ggaugccccgccc

SEQ ID NO: 2375708 - RNA, 14 nt, Bordetella pertussis
ggaugccccgcccg

SEQ ID NO: 2375709 - RNA, 12 nt, Bordetella pertussis
ggaugcccgcgg

SEQ ID NO: 2375710 - RNA, 21 nt, Bordetella pertussis
ggaugcccuggguggcggggc

SEQ ID NO: 2375711 - RNA, 22 nt, Bordetella pertussis
ggaugcccuggguggcggggcg

SEQ ID NO: 2375712 - RNA, 18 nt, Bordetella pertussis
ggaugcccuuggcggcga

SEQ ID NO: 2375713 - RNA, 19 nt, Bordetella pertussis
ggaugccgguucgggcggg

SEQ ID NO: 2375714 - RNA, 20 nt, Bordetella pertussis
ggaugccgucuuggcgggcu

SEQ ID NO: 2375715 - RNA, 13 nt, Bordetella pertussis
ggaugcgcaccgg

SEQ ID NO: 2375716 - RNA, 16 nt, Bordetella pertussis
ggaugcgcaccggcca

SEQ ID NO: 2375717 - RNA, 18 nt, Bordetella pertussis
ggaugcgcaggacggcgc

SEQ ID NO: 2375718 - RNA, 16 nt, Bordetella pertussis
ggaugcgcgccaggcu

SEQ ID NO: 2375719 - RNA, 13 nt, Bordetella pertussis
ggaugcgcgcccc

SEQ ID NO: 2375720 - RNA, 20 nt, Bordetella pertussis
ggaugcgcgccccgucggcc

SEQ ID NO: 2375721 - RNA, 23 nt, Bordetella pertussis
ggaugcgcgccccgucggccguc

SEQ ID NO: 2375722 - RNA, 14 nt, Bordetella pertussis
ggaugcgcgcggcc

SEQ ID NO: 2375723 - RNA, 14 nt, Bordetella pertussis
ggaugcgcuggccg

SEQ ID NO: 2375724 - RNA, 19 nt, Bordetella pertussis
ggcacaccgugccgcagau

SEQ ID NO: 2375725 - RNA, 22 nt, Bordetella pertussis
ggcacaccguggcaugccaugc

SEQ ID NO: 2375726 - RNA, 14 nt, Bordetella pertussis
ggcacacgaccggc

SEQ ID NO: 2375727 - RNA, 13 nt, Bordetella pertussis
ggcacagcgcggc

SEQ ID NO: 2375728 - RNA, 14 nt, Bordetella pertussis
ggcacagcgcggcg

SEQ ID NO: 2375729 - RNA, 23 nt, Bordetella pertussis
ggcacagcgcggcgaaggcgcgg

SEQ ID NO: 2375730 - RNA, 16 nt, Bordetella pertussis
ggcacaggaacagccu

SEQ ID NO: 2375731 - RNA, 17 nt, Bordetella pertussis
ggcacaggccaucggcg

SEQ ID NO: 2375732 - RNA, 19 nt, Bordetella pertussis
ggcacaggccaucggcgcc

SEQ ID NO: 2375733 - RNA, 20 nt, Bordetella pertussis
ggcacaggccaucggcgcca

SEQ ID NO: 2375734 - RNA, 23 nt, Bordetella pertussis
ggcacaggccaucggcgccaagc

SEQ ID NO: 2375735 - RNA, 22 nt, Bordetella pertussis
ggcacauacagcggagccgcgc

SEQ ID NO: 2375736 - RNA, 19 nt, Bordetella pertussis
ggcacauccagcgccagca

SEQ ID NO: 2375737 - RNA, 22 nt, Bordetella pertussis
ggcacaucggaauuggcggcga

SEQ ID NO: 2375738 - RNA, 18 nt, Bordetella pertussis
ggcaccaccaccgcccgc

SEQ ID NO: 2375739 - RNA, 22 nt, Bordetella pertussis
ggcaccaccaccgcccgcaugu

SEQ ID NO: 2375740 - RNA, 13 nt, Bordetella pertussis
ggcaccagcaggc

SEQ ID NO: 2375741 - RNA, 15 nt, Bordetella pertussis
ggcaccagcaggccg

SEQ ID NO: 2375742 - RNA, 14 nt, Bordetella pertussis
ggcaccagcgccac

SEQ ID NO: 2375743 - RNA, 20 nt, Bordetella pertussis
ggcaccaggaacagcaacgc

SEQ ID NO: 2375744 - RNA, 15 nt, Bordetella pertussis
ggcaccagguccugg

SEQ ID NO: 2375745 - RNA, 16 nt, Bordetella pertussis
ggcaccagguccuggc

SEQ ID NO: 2375746 - RNA, 21 nt, Bordetella pertussis
ggcaccagguccuggcggccg

SEQ ID NO: 2375747 - RNA, 16 nt, Bordetella pertussis
ggcaccaucgccgccu

SEQ ID NO: 2375748 - RNA, 18 nt, Bordetella pertussis
ggcaccaucgccgccugc

SEQ ID NO: 2375749 - RNA, 23 nt, Bordetella pertussis
ggcaccaucugcgucgcguuggu

SEQ ID NO: 2375750 - RNA, 19 nt, Bordetella pertussis
ggcaccaugcgcaccaggc

SEQ ID NO: 2375751 - RNA, 19 nt, Bordetella pertussis
ggcaccaugcgcgagggca

SEQ ID NO: 2375752 - RNA, 20 nt, Bordetella pertussis
ggcacccagccggacccgcg

SEQ ID NO: 2375753 - RNA, 18 nt, Bordetella pertussis
ggcacccccgaccgagcc

SEQ ID NO: 2375754 - RNA, 20 nt, Bordetella pertussis
ggcacccccgaccgagccac

SEQ ID NO: 2375755 - RNA, 17 nt, Bordetella pertussis
ggcaccccggcgccgcg

SEQ ID NO: 2375756 - RNA, 14 nt, Bordetella pertussis
ggcaccccgucguc

SEQ ID NO: 2375757 - RNA, 13 nt, Bordetella pertussis
ggcacccgcacgg

SEQ ID NO: 2375758 - RNA, 18 nt, Bordetella pertussis
ggcacccgcaugguggcg

SEQ ID NO: 2375759 - RNA, 17 nt, Bordetella pertussis
ggcacccgcgcgcagcg

SEQ ID NO: 2375760 - RNA, 20 nt, Bordetella pertussis
ggcacccggcucagccucga

SEQ ID NO: 2375761 - RNA, 19 nt, Bordetella pertussis
ggcacccugccccauccca

SEQ ID NO: 2375762 - RNA, 22 nt, Bordetella pertussis
ggcacccuugcucagucgggca

SEQ ID NO: 2375763 - RNA, 19 nt, Bordetella pertussis
ggcaccgaacgggcguggc

SEQ ID NO: 2375764 - RNA, 24 nt, Bordetella pertussis
ggcaccgaauacgucagagcccuu

SEQ ID NO: 2375765 - RNA, 17 nt, Bordetella pertussis
ggcaccgacacgcuggc

SEQ ID NO: 2375766 - RNA, 19 nt, Bordetella pertussis
ggcaccgacacgcuggcgg

SEQ ID NO: 2375767 - RNA, 18 nt, Bordetella pertussis
ggcaccgagcacagcaac

SEQ ID NO: 2375768 - RNA, 16 nt, Bordetella pertussis
ggcaccgccaggcaga

SEQ ID NO: 2375769 - RNA, 17 nt, Bordetella pertussis
ggcaccgccgcacagcc

SEQ ID NO: 2375770 - RNA, 15 nt, Bordetella pertussis
ggcaccgcgcagccc

SEQ ID NO: 2375771 - RNA, 21 nt, Bordetella pertussis
ggcaccgcgcagcccggcgug

SEQ ID NO: 2375772 - RNA, 15 nt, Bordetella pertussis
ggcaccggccaagcu

SEQ ID NO: 2375773 - RNA, 19 nt, Bordetella pertussis
ggcaccgugaugcgcgccg

SEQ ID NO: 2375774 - RNA, 20 nt, Bordetella pertussis
ggcaccgugaugcgcgccgc

SEQ ID NO: 2375775 - RNA, 21 nt, Bordetella pertussis
ggcaccgugaugcgcgccgcu

SEQ ID NO: 2375776 - RNA, 19 nt, Bordetella pertussis
ggcaccucggccggggcgg

SEQ ID NO: 2375777 - RNA, 15 nt, Bordetella pertussis
ggcaccucggcgccg

SEQ ID NO: 2375778 - RNA, 17 nt, Bordetella pertussis
ggcaccucggcgccgcg

SEQ ID NO: 2375779 - RNA, 14 nt, Bordetella pertussis
ggcaccucggggug

SEQ ID NO: 2375780 - RNA, 18 nt, Bordetella pertussis
ggcaccugcgaccgagcc

SEQ ID NO: 2375781 - RNA, 20 nt, Bordetella pertussis
ggcaccugcgaccgagccac

SEQ ID NO: 2375782 - RNA, 21 nt, Bordetella pertussis
ggcaccugcugcuugaccuug

SEQ ID NO: 2375783 - RNA, 16 nt, Bordetella pertussis
ggcaccugcuugagca

SEQ ID NO: 2375784 - RNA, 22 nt, Bordetella pertussis
ggcaccuucgcgcagcggcgcg

SEQ ID NO: 2375785 - RNA, 22 nt, Bordetella pertussis
ggcaccuuuuuccuugcgggcc

SEQ ID NO: 2375786 - RNA, 19 nt, Bordetella pertussis
ggcacgaaaagccgcggcc

SEQ ID NO: 2375787 - RNA, 22 nt, Bordetella pertussis
ggcacgaaaagccgcggccgcc

SEQ ID NO: 2375788 - RNA, 15 nt, Bordetella pertussis
ggcacgacgcguuug

SEQ ID NO: 2375789 - RNA, 22 nt, Bordetella pertussis
ggcacgacgcugaugcccagcc

SEQ ID NO: 2375790 - RNA, 15 nt, Bordetella pertussis
ggcacgacggccucc

SEQ ID NO: 2375791 - RNA, 16 nt, Bordetella pertussis
ggcacgacggccuccg

SEQ ID NO: 2375792 - RNA, 21 nt, Bordetella pertussis
ggcacgacggccuccgcgccg

SEQ ID NO: 2375793 - RNA, 19 nt, Bordetella pertussis
ggcacgacgucgucggugg

SEQ ID NO: 2375794 - RNA, 18 nt, Bordetella pertussis
ggcacgaucaccgccgcg

SEQ ID NO: 2375795 - RNA, 21 nt, Bordetella pertussis
ggcacgaucaccgccgcggcg

SEQ ID NO: 2375796 - RNA, 15 nt, Bordetella pertussis
ggcacgaucggcgcc

SEQ ID NO: 2375797 - RNA, 18 nt, Bordetella pertussis
ggcacgaucggcgccugg

SEQ ID NO: 2375798 - RNA, 12 nt, Bordetella pertussis
ggcacgauggcc

SEQ ID NO: 2375799 - RNA, 17 nt, Bordetella pertussis
ggcacgauuucgccgau

SEQ ID NO: 2375800 - RNA, 20 nt, Bordetella pertussis
ggcacgauuucgccgauccg

SEQ ID NO: 2375801 - RNA, 16 nt, Bordetella pertussis
ggcacgcacagcaugc

SEQ ID NO: 2375802 - RNA, 18 nt, Bordetella pertussis
ggcacgcacagcaugcgc

SEQ ID NO: 2375803 - RNA, 22 nt, Bordetella pertussis
ggcacgcccagccgcagcaggc

SEQ ID NO: 2375804 - RNA, 13 nt, Bordetella pertussis
ggcacgccgauga

SEQ ID NO: 2375805 - RNA, 14 nt, Bordetella pertussis
ggcacgccggccuu

SEQ ID NO: 2375806 - RNA, 17 nt, Bordetella pertussis
ggcacgccggccuugcu

SEQ ID NO: 2375807 - RNA, 14 nt, Bordetella pertussis
ggcacgccggcggc

SEQ ID NO: 2375808 - RNA, 15 nt, Bordetella pertussis
ggcacgccggcggcg

SEQ ID NO: 2375809 - RNA, 13 nt, Bordetella pertussis
ggcacgcgccagc

SEQ ID NO: 2375810 - RNA, 15 nt, Bordetella pertussis
ggcacgcgccaggcg

SEQ ID NO: 2375811 - RNA, 16 nt, Bordetella pertussis
ggcacgcgccaggcgu

SEQ ID NO: 2375812 - RNA, 19 nt, Bordetella pertussis
ggcacgcgccaggcguuga

SEQ ID NO: 2375813 - RNA, 12 nt, Bordetella pertussis
ggcacgcgccga

SEQ ID NO: 2375814 - RNA, 15 nt, Bordetella pertussis
ggcacgcgcgccggc

SEQ ID NO: 2375815 - RNA, 15 nt, Bordetella pertussis
ggcacgcgcgcggcg

SEQ ID NO: 2375816 - RNA, 12 nt, Bordetella pertussis
ggcacgcgcggu

SEQ ID NO: 2375817 - RNA, 16 nt, Bordetella pertussis
ggcacgcugaucgccg

SEQ ID NO: 2375818 - RNA, 16 nt, Bordetella pertussis
ggcacgcugcgcaggc

SEQ ID NO: 2375819 - RNA, 19 nt, Bordetella pertussis
ggcacgcugcgcaggcgcg

SEQ ID NO: 2375820 - RNA, 22 nt, Bordetella pertussis
ggcacgcugcgcaggcgcgcgg

SEQ ID NO: 2375821 - RNA, 23 nt, Bordetella pertussis
ggcacgcugcugauccucgccag

SEQ ID NO: 2375822 - RNA, 13 nt, Bordetella pertussis
ggcacgcuugccg

SEQ ID NO: 2375823 - RNA, 17 nt, Bordetella pertussis
ggcacggaaacguugcg

SEQ ID NO: 2375824 - RNA, 14 nt, Bordetella pertussis
ggcacggcacgccu

SEQ ID NO: 2375825 - RNA, 13 nt, Bordetella pertussis
ggcacggccagca

SEQ ID NO: 2375826 - RNA, 19 nt, Bordetella pertussis
ggcacggccagcaccaugg

SEQ ID NO: 2375827 - RNA, 14 nt, Bordetella pertussis
ggcacggccagcau

SEQ ID NO: 2375828 - RNA, 16 nt, Bordetella pertussis
ggcacggccagcggcg

SEQ ID NO: 2375829 - RNA, 17 nt, Bordetella pertussis
ggcacggccagcggcga

SEQ ID NO: 2375830 - RNA, 18 nt, Bordetella pertussis
ggcacggccggccaggcg

SEQ ID NO: 2375831 - RNA, 20 nt, Bordetella pertussis
ggcacggccggccaggcgcc

SEQ ID NO: 2375832 - RNA, 23 nt, Bordetella pertussis
ggcacggccggccaggcgccgcu

SEQ ID NO: 2375833 - RNA, 14 nt, Bordetella pertussis
ggcacggccggccu

SEQ ID NO: 2375834 - RNA, 16 nt, Bordetella pertussis
ggcacggccggccugc

SEQ ID NO: 2375835 - RNA, 14 nt, Bordetella pertussis
ggcacggggcauca

SEQ ID NO: 2375836 - RNA, 14 nt, Bordetella pertussis
ggcacgggucaggc

SEQ ID NO: 2375837 - RNA, 14 nt, Bordetella pertussis
ggcagcggccagcg

SEQ ID NO: 2375838 - RNA, 19 nt, Bordetella pertussis
ggcagcggccagcgcggcg

SEQ ID NO: 2375839 - RNA, 14 nt, Bordetella pertussis
ggcagcggccgcgc

SEQ ID NO: 2375840 - RNA, 17 nt, Bordetella pertussis
ggcagcggccgcgcggg

SEQ ID NO: 2375841 - RNA, 18 nt, Bordetella pertussis
ggcagcggcgacggcgcc

SEQ ID NO: 2375842 - RNA, 13 nt, Bordetella pertussis
ggcagcggcgcca

SEQ ID NO: 2375843 - RNA, 16 nt, Bordetella pertussis
ggcagcggcgccaugc

SEQ ID NO: 2375844 - RNA, 17 nt, Bordetella pertussis
ggcagcggcgccaugcg

SEQ ID NO: 2375845 - RNA, 19 nt, Bordetella pertussis
ggcagcggcgccaugcgca

SEQ ID NO: 2375846 - RNA, 19 nt, Bordetella pertussis
ggcagcgggccgcagcaug

SEQ ID NO: 2375847 - RNA, 17 nt, Bordetella pertussis
ggcagcguaucgcccgc

SEQ ID NO: 2375848 - RNA, 19 nt, Bordetella pertussis
ggcagcguaucgcccgcgc

SEQ ID NO: 2375849 - RNA, 22 nt, Bordetella pertussis
ggcagcguaucgcccgcgcggu

SEQ ID NO: 2375850 - RNA, 19 nt, Bordetella pertussis
ggcagcgucaauccgccgc

SEQ ID NO: 2375851 - RNA, 20 nt, Bordetella pertussis
ggcagcgucaauccgccgcc

SEQ ID NO: 2375852 - RNA, 22 nt, Bordetella pertussis
ggcagcgucaauccgccgccag

SEQ ID NO: 2375853 - RNA, 23 nt, Bordetella pertussis
ggcagcgucaauccgccgccagc

SEQ ID NO: 2375854 - RNA, 24 nt, Bordetella pertussis
ggcagcgucaauccgccgccagca

SEQ ID NO: 2375855 - RNA, 12 nt, Bordetella pertussis
ggcagcucgccu

SEQ ID NO: 2375856 - RNA, 19 nt, Bordetella pertussis
ggcagcucgcgcugcgcgc

SEQ ID NO: 2375857 - RNA, 22 nt, Bordetella pertussis
ggcagcucgcgcugcgcgccgc

SEQ ID NO: 2375858 - RNA, 16 nt, Bordetella pertussis
ggcagcucgcggucgu

SEQ ID NO: 2375859 - RNA, 23 nt, Bordetella pertussis
ggcagcucggcgaagccgcagcg

SEQ ID NO: 2375860 - RNA, 21 nt, Bordetella pertussis
ggcagcucggugcagcccagc

SEQ ID NO: 2375861 - RNA, 22 nt, Bordetella pertussis
ggcagcucggugcagcccagca

SEQ ID NO: 2375862 - RNA, 17 nt, Bordetella pertussis
ggcagcugacgggucuc

SEQ ID NO: 2375863 - RNA, 13 nt, Bordetella pertussis
ggcagcugcgcgu

SEQ ID NO: 2375864 - RNA, 21 nt, Bordetella pertussis
ggcagcugcgcgucgacagca

SEQ ID NO: 2375865 - RNA, 13 nt, Bordetella pertussis
ggcagcuggcgcg

SEQ ID NO: 2375866 - RNA, 17 nt, Bordetella pertussis
ggcagcuggcgcgggcg

SEQ ID NO: 2375867 - RNA, 18 nt, Bordetella pertussis
ggcagcuggcgcgggcgg

SEQ ID NO: 2375868 - RNA, 20 nt, Bordetella pertussis
ggcagcuggcgcgggcggcc

SEQ ID NO: 2375869 - RNA, 18 nt, Bordetella pertussis
ggcagcuugaccgccucc

SEQ ID NO: 2375870 - RNA, 17 nt, Bordetella pertussis
ggcagcuuggcgcgccg

SEQ ID NO: 2375871 - RNA, 17 nt, Bordetella pertussis
ggcagcuuguagcgcuc

SEQ ID NO: 2375872 - RNA, 17 nt, Bordetella pertussis
ggcaggaagccggcccg

SEQ ID NO: 2375873 - RNA, 15 nt, Bordetella pertussis
ggcaggacgccggcg

SEQ ID NO: 2375874 - RNA, 17 nt, Bordetella pertussis
ggcaggacgccggcgcc

SEQ ID NO: 2375875 - RNA, 19 nt, Bordetella pertussis
ggcaggcacacgaccggcu

SEQ ID NO: 2375876 - RNA, 15 nt, Bordetella pertussis
ggcaggcacuggcgc

SEQ ID NO: 2375877 - RNA, 22 nt, Bordetella pertussis
ggcaggcacuggcgcggcgcua

SEQ ID NO: 2375878 - RNA, 22 nt, Bordetella pertussis
ggcaggcauucgaacaacagcg

SEQ ID NO: 2375879 - RNA, 23 nt, Bordetella pertussis
ggcaggcauucgaacaacagcgc

SEQ ID NO: 2375880 - RNA, 16 nt, Bordetella pertussis
ggcaggccagcauggc

SEQ ID NO: 2375881 - RNA, 12 nt, Bordetella pertussis
ggcaggccagcg

SEQ ID NO: 2375882 - RNA, 14 nt, Bordetella pertussis
ggcaggccagcgcc

SEQ ID NO: 2375883 - RNA, 15 nt, Bordetella pertussis
ggcaggccagcgcca

SEQ ID NO: 2375884 - RNA, 16 nt, Bordetella pertussis
ggcaggcccagccagc

SEQ ID NO: 2375885 - RNA, 23 nt, Bordetella pertussis
ggcaggcccagccagcggugcgc

SEQ ID NO: 2375886 - RNA, 15 nt, Bordetella pertussis
ggcaggcccagcuug

SEQ ID NO: 2375887 - RNA, 17 nt, Bordetella pertussis
ggcaggcccaugacgcc

SEQ ID NO: 2375888 - RNA, 11 nt, Bordetella pertussis
ggcaggccgau

SEQ ID NO: 2375889 - RNA, 17 nt, Bordetella pertussis
ggcaggccgcagcgggc

SEQ ID NO: 2375890 - RNA, 22 nt, Bordetella pertussis
ggcaggccgcgccacaggcgcu

SEQ ID NO: 2375891 - RNA, 14 nt, Bordetella pertussis
ggcaggccgcgcug

SEQ ID NO: 2375892 - RNA, 13 nt, Bordetella pertussis
ggcaggccgcggu

SEQ ID NO: 2375893 - RNA, 17 nt, Bordetella pertussis
ggcaggccgcuucgaug

SEQ ID NO: 2375894 - RNA, 16 nt, Bordetella pertussis
ggcaggccggccagca

SEQ ID NO: 2375895 - RNA, 12 nt, Bordetella pertussis
ggcaggccggcg

SEQ ID NO: 2375896 - RNA, 13 nt, Bordetella pertussis
ggcaggcgcacgc

SEQ ID NO: 2375897 - RNA, 12 nt, Bordetella pertussis
ggcaggcgcagc

SEQ ID NO: 2375898 - RNA, 15 nt, Bordetella pertussis
ggcaggcgcagcggc

SEQ ID NO: 2375899 - RNA, 19 nt, Bordetella pertussis
ggcaggcgcagcggcggcg

SEQ ID NO: 2375900 - RNA, 12 nt, Bordetella pertussis
ggcaggcgccgc

SEQ ID NO: 2375901 - RNA, 13 nt, Bordetella pertussis
ggcaggcgccgcc

SEQ ID NO: 2375902 - RNA, 15 nt, Bordetella pertussis
ggcaggcgccgccgc

SEQ ID NO: 2375903 - RNA, 14 nt, Bordetella pertussis
ggcaggcgccggcu

SEQ ID NO: 2375904 - RNA, 20 nt, Bordetella pertussis
ggcaggcgccugcccugcgu

SEQ ID NO: 2375905 - RNA, 22 nt, Bordetella pertussis
ggcaggcgcgagguggcgcucg

SEQ ID NO: 2375906 - RNA, 13 nt, Bordetella pertussis
ggcaggcgcgcca

SEQ ID NO: 2375907 - RNA, 14 nt, Bordetella pertussis
ggcaggcgcgccgg

SEQ ID NO: 2375908 - RNA, 15 nt, Bordetella pertussis
ggcaggcgcgccggg

SEQ ID NO: 2375909 - RNA, 18 nt, Bordetella pertussis
ggcaggcgcgccgggccg

SEQ ID NO: 2375910 - RNA, 19 nt, Bordetella pertussis
ggcaggcgcgccgggccgg

SEQ ID NO: 2375911 - RNA, 16 nt, Bordetella pertussis
ggcaggcggcagaagg

SEQ ID NO: 2375912 - RNA, 17 nt, Bordetella pertussis
ggcaggcggcagaaggc

SEQ ID NO: 2375913 - RNA, 12 nt, Bordetella pertussis
ggcaggcggcuu

SEQ ID NO: 2375914 - RNA, 13 nt, Bordetella pertussis
ggcaggcgggcca

SEQ ID NO: 2375915 - RNA, 19 nt, Bordetella pertussis
ggcaggcgggccaggccgg

SEQ ID NO: 2375916 - RNA, 16 nt, Bordetella pertussis
ggcaggcgggcccgca

SEQ ID NO: 2375917 - RNA, 22 nt, Bordetella pertussis
ggcaggcggugcggaggcggcc

SEQ ID NO: 2375918 - RNA, 14 nt, Bordetella pertussis
ggcaggcgucggcc

SEQ ID NO: 2375919 - RNA, 20 nt, Bordetella pertussis
ggcaggcgucggccagcgcg

SEQ ID NO: 2375920 - RNA, 16 nt, Bordetella pertussis
ggcaggcucagcccgg

SEQ ID NO: 2375921 - RNA, 13 nt, Bordetella pertussis
ggcaggcuccaca

SEQ ID NO: 2375922 - RNA, 15 nt, Bordetella pertussis
ggcaggcuccacagc

SEQ ID NO: 2375923 - RNA, 22 nt, Bordetella pertussis
ggcaggcuggcauugagggcgu

SEQ ID NO: 2375924 - RNA, 18 nt, Bordetella pertussis
ggcaggcuggccggcgug

SEQ ID NO: 2375925 - RNA, 16 nt, Bordetella pertussis
ggcaggcuggcgcggu

SEQ ID NO: 2375926 - RNA, 12 nt, Bordetella pertussis
ggcagggccagc

SEQ ID NO: 2375927 - RNA, 13 nt, Bordetella pertussis
ggcagggcgccgc

SEQ ID NO: 2375928 - RNA, 14 nt, Bordetella pertussis
ggcagggcgccgcg

SEQ ID NO: 2375929 - RNA, 12 nt, Bordetella pertussis
ggcagggcgccu

SEQ ID NO: 2375930 - RNA, 19 nt, Bordetella pertussis
ggcagggcggccaggccgg

SEQ ID NO: 2375931 - RNA, 14 nt, Bordetella pertussis
ggcagggcgggcgg

SEQ ID NO: 2375932 - RNA, 16 nt, Bordetella pertussis
ggcagggcgucggccg

SEQ ID NO: 2375933 - RNA, 17 nt, Bordetella pertussis
ggcaggggcucgcgccc

SEQ ID NO: 2375934 - RNA, 13 nt, Bordetella pertussis
ggcagggucucgg

SEQ ID NO: 2375935 - RNA, 16 nt, Bordetella pertussis
ggcagggucucggcca

SEQ ID NO: 2375936 - RNA, 20 nt, Bordetella pertussis
ggcagggucucggccacggu

SEQ ID NO: 2375937 - RNA, 14 nt, Bordetella pertussis
ggcagggugacggg

SEQ ID NO: 2375938 - RNA, 18 nt, Bordetella pertussis
ggcagggugacgggcugg

SEQ ID NO: 2375939 - RNA, 22 nt, Bordetella pertussis
ggcaggguucggugccuguccc

SEQ ID NO: 2375940 - RNA, 21 nt, Bordetella pertussis
ggcaggguuuuauacggcgcg

SEQ ID NO: 2375941 - RNA, 22 nt, Bordetella pertussis
ggcaggguuuuauacggcgcga

SEQ ID NO: 2375942 - RNA, 22 nt, Bordetella pertussis
ggcaggucgauggggucgggcc

SEQ ID NO: 2375943 - RNA, 14 nt, Bordetella pertussis
ggcaggucgccagc

SEQ ID NO: 2375944 - RNA, 15 nt, Bordetella pertussis
ggcaggucgccagca

SEQ ID NO: 2375945 - RNA, 18 nt, Bordetella pertussis
ggcaggucgccagcaggc

SEQ ID NO: 2375946 - RNA, 13 nt, Bordetella pertussis
ggcaggucgcgcg

SEQ ID NO: 2375947 - RNA, 15 nt, Bordetella pertussis
ggcaggucggccagc

SEQ ID NO: 2375948 - RNA, 18 nt, Bordetella pertussis
ggcaggucggccagcgug

SEQ ID NO: 2375949 - RNA, 14 nt, Bordetella pertussis
ggcaggucggcgcg

SEQ ID NO: 2375950 - RNA, 19 nt, Bordetella pertussis
ggcaggucggugcacacgc

SEQ ID NO: 2375951 - RNA, 13 nt, Bordetella pertussis
ggcauuucgcugg

SEQ ID NO: 2375952 - RNA, 23 nt, Bordetella pertussis
ggccaaccacgagcugcagcccg

SEQ ID NO: 2375953 - RNA, 16 nt, Bordetella pertussis
ggccaaccccgagggc

SEQ ID NO: 2375954 - RNA, 18 nt, Bordetella pertussis
ggccaaccccgagggcgc

SEQ ID NO: 2375955 - RNA, 21 nt, Bordetella pertussis
ggccaacgauuccgcguccau

SEQ ID NO: 2375956 - RNA, 20 nt, Bordetella pertussis
ggccaacggaagagggcggg

SEQ ID NO: 2375957 - RNA, 16 nt, Bordetella pertussis
ggccaacgggauccgg

SEQ ID NO: 2375958 - RNA, 20 nt, Bordetella pertussis
ggccaacgggauccggcagc

SEQ ID NO: 2375959 - RNA, 20 nt, Bordetella pertussis
ggccaagacgguaucugucc

SEQ ID NO: 2375960 - RNA, 21 nt, Bordetella pertussis
ggccaagacgguaucuguccc

SEQ ID NO: 2375961 - RNA, 18 nt, Bordetella pertussis
ggccaagauccagcuuca

SEQ ID NO: 2375962 - RNA, 16 nt, Bordetella pertussis
ggccaagcgcgccggc

SEQ ID NO: 2375963 - RNA, 14 nt, Bordetella pertussis
ggccaagcuccagg

SEQ ID NO: 2375964 - RNA, 22 nt, Bordetella pertussis
ggccaagcuggagaagcgccgc

SEQ ID NO: 2375965 - RNA, 16 nt, Bordetella pertussis
ggccaaggcauuggcg

SEQ ID NO: 2375966 - RNA, 19 nt, Bordetella pertussis
ggccaaggcauuggcgccg

SEQ ID NO: 2375967 - RNA, 13 nt, Bordetella pertussis
ggccaagggcgcc

SEQ ID NO: 2375968 - RNA, 17 nt, Bordetella pertussis
ggccaagggcgccgcgc

SEQ ID NO: 2375969 - RNA, 19 nt, Bordetella pertussis
ggccaagggcgccgcgccg

SEQ ID NO: 2375970 - RNA, 21 nt, Bordetella pertussis
ggccaagggcgccgcgccggg

SEQ ID NO: 2375971 - RNA, 19 nt, Bordetella pertussis
ggccaaggugccugucccc

SEQ ID NO: 2375972 - RNA, 22 nt, Bordetella pertussis
ggccaaggugccuguccccgcg

SEQ ID NO: 2375973 - RNA, 15 nt, Bordetella pertussis
ggccaaucggccugc

SEQ ID NO: 2375974 - RNA, 16 nt, Bordetella pertussis
ggccaaucggccugcu

SEQ ID NO: 2375975 - RNA, 14 nt, Bordetella pertussis
ggccaaugaccgac

SEQ ID NO: 2375976 - RNA, 18 nt, Bordetella pertussis
ggccaaugaccgacgccg

SEQ ID NO: 2375977 - RNA, 21 nt, Bordetella pertussis
ggccaaugccuauuggcugua

SEQ ID NO: 2375978 - RNA, 16 nt, Bordetella pertussis
ggccaauggccgcggc

SEQ ID NO: 2375979 - RNA, 19 nt, Bordetella pertussis
ggccaauggccgcggcgug

SEQ ID NO: 2375980 - RNA, 16 nt, Bordetella pertussis
ggccaauggccgguga

SEQ ID NO: 2375981 - RNA, 17 nt, Bordetella pertussis
ggccacagggcgaaggc

SEQ ID NO: 2375982 - RNA, 18 nt, Bordetella pertussis
ggccacagggcgaaggcc

SEQ ID NO: 2375983 - RNA, 21 nt, Bordetella pertussis
ggccacagggcgaaggccagc

SEQ ID NO: 2375984 - RNA, 22 nt, Bordetella pertussis
ggccacagggcgaaggccagcg

SEQ ID NO: 2375985 - RNA, 22 nt, Bordetella pertussis
ggccacaucaucgaccaccagc

SEQ ID NO: 2375986 - RNA, 23 nt, Bordetella pertussis
ggccacaucaucgaccaccagcg

SEQ ID NO: 2375987 - RNA, 22 nt, Bordetella pertussis
ggccacauggucgcccagcaga

SEQ ID NO: 2375988 - RNA, 13 nt, Bordetella pertussis
ggccaccaccagg

SEQ ID NO: 2375989 - RNA, 14 nt, Bordetella pertussis
ggccaccacgccca

SEQ ID NO: 2375990 - RNA, 19 nt, Bordetella pertussis
ggccaccacgcccaucugc

SEQ ID NO: 2375991 - RNA, 23 nt, Bordetella pertussis
ggccaccacgcccaucugccagg

SEQ ID NO: 2375992 - RNA, 12 nt, Bordetella pertussis
ggccaccagccc

SEQ ID NO: 2375993 - RNA, 18 nt, Bordetella pertussis
ggccaccagcggcgccgg

SEQ ID NO: 2375994 - RNA, 14 nt, Bordetella pertussis
ggccaccagcgugu

SEQ ID NO: 2375995 - RNA, 13 nt, Bordetella pertussis
ggccaccaggccg

SEQ ID NO: 2375996 - RNA, 19 nt, Bordetella pertussis
ggccaccaggccgucggcc

SEQ ID NO: 2375997 - RNA, 14 nt, Bordetella pertussis
ggccaccaggcgcg

SEQ ID NO: 2375998 - RNA, 13 nt, Bordetella pertussis
ggccaccaggcug

SEQ ID NO: 2375999 - RNA, 17 nt, Bordetella pertussis
ggccaccagggcccgga

SEQ ID NO: 2376000 - RNA, 21 nt, Bordetella pertussis
ggccaccaggguuuccucgcc

SEQ ID NO: 2376001 - RNA, 22 nt, Bordetella pertussis
ggccaccaggguuuccucgccg

SEQ ID NO: 2376002 - RNA, 23 nt, Bordetella pertussis
ggccaccccguugcagcccagcg

SEQ ID NO: 2376003 - RNA, 21 nt, Bordetella pertussis
ggccacccgaagguggcccga

SEQ ID NO: 2376004 - RNA, 12 nt, Bordetella pertussis
ggccacccgccg

SEQ ID NO: 2376005 - RNA, 13 nt, Bordetella pertussis
ggccacccgccgc

SEQ ID NO: 2376006 - RNA, 14 nt, Bordetella pertussis
ggccacccgccgcc

SEQ ID NO: 2376007 - RNA, 15 nt, Bordetella pertussis
ggccacccgccgccg

SEQ ID NO: 2376008 - RNA, 16 nt, Bordetella pertussis
ggccacccgccgccgg

SEQ ID NO: 2376009 - RNA, 13 nt, Bordetella pertussis
ggccacccugccg

SEQ ID NO: 2376010 - RNA, 21 nt, Bordetella pertussis
ggccaccgaagcggcguucug

SEQ ID NO: 2376011 - RNA, 17 nt, Bordetella pertussis
ggccaccgacggcgcgg

SEQ ID NO: 2376012 - RNA, 13 nt, Bordetella pertussis
ggccaccgccugu

SEQ ID NO: 2376013 - RNA, 21 nt, Bordetella pertussis
ggccaccgccugugccagcug

SEQ ID NO: 2376014 - RNA, 13 nt, Bordetella pertussis
ggccaccgcggcg

SEQ ID NO: 2376015 - RNA, 15 nt, Bordetella pertussis
ggccaccgcggcgga

SEQ ID NO: 2376016 - RNA, 21 nt, Bordetella pertussis
ggccaccgcguugagcgccga

SEQ ID NO: 2376017 - RNA, 23 nt, Bordetella pertussis
ggccaccgcguugagcgccgacg

SEQ ID NO: 2376018 - RNA, 20 nt, Bordetella pertussis
ggccaccucuucagcccggc

SEQ ID NO: 2376019 - RNA, 20 nt, Bordetella pertussis
ggccaccuggcgcaaggcgu

SEQ ID NO: 2376020 - RNA, 13 nt, Bordetella pertussis
ggccaccuuggug

SEQ ID NO: 2376021 - RNA, 22 nt, Bordetella pertussis
ggccacgaagacgaagucccag

SEQ ID NO: 2376022 - RNA, 15 nt, Bordetella pertussis
ggccacgaagcgcag

SEQ ID NO: 2376023 - RNA, 21 nt, Bordetella pertussis
ggccacgaagcgcagcaccgc

SEQ ID NO: 2376024 - RNA, 22 nt, Bordetella pertussis
ggccacgaagcgcagcaccgcg

SEQ ID NO: 2376025 - RNA, 19 nt, Bordetella pertussis
ggccacgaauuccucgccg

SEQ ID NO: 2376026 - RNA, 21 nt, Bordetella pertussis
ggccacgaauuccucgccgcc

SEQ ID NO: 2376027 - RNA, 20 nt, Bordetella pertussis
ggccacgaccaccagcguca

SEQ ID NO: 2376028 - RNA, 14 nt, Bordetella pertussis
ggccacgaccggcu

SEQ ID NO: 2376029 - RNA, 17 nt, Bordetella pertussis
ggccacgaccggcucga

SEQ ID NO: 2376030 - RNA, 23 nt, Bordetella pertussis
ggccacgaccggcucgaucgccg

SEQ ID NO: 2376031 - RNA, 20 nt, Bordetella pertussis
ggccacgagcaguacacgcg

SEQ ID NO: 2376032 - RNA, 15 nt, Bordetella pertussis
ggccacgaucaucag

SEQ ID NO: 2376033 - RNA, 16 nt, Bordetella pertussis
ggccacgaucaucagg

SEQ ID NO: 2376034 - RNA, 20 nt, Bordetella pertussis
ggccacgaugauggaggcca

SEQ ID NO: 2376035 - RNA, 22 nt, Bordetella pertussis
ggccacgauguugcgcaggcug

SEQ ID NO: 2376036 - RNA, 23 nt, Bordetella pertussis
ggccacgauguugcgcaggcugu

SEQ ID NO: 2376037 - RNA, 13 nt, Bordetella pertussis
ggccacgcccaag

SEQ ID NO: 2376038 - RNA, 17 nt, Bordetella pertussis
ggccacgcccacgcgcc

SEQ ID NO: 2376039 - RNA, 14 nt, Bordetella pertussis
ggccacgcccaggc

SEQ ID NO: 2376040 - RNA, 13 nt, Bordetella pertussis
ggccacgccggcc

SEQ ID NO: 2376041 - RNA, 17 nt, Bordetella pertussis
ggccacgccggccgccu

SEQ ID NO: 2376042 - RNA, 14 nt, Bordetella pertussis
ggccacgcgcgggc

SEQ ID NO: 2376043 - RNA, 15 nt, Bordetella pertussis
ggccacgcgcgggcu

SEQ ID NO: 2376044 - RNA, 16 nt, Bordetella pertussis
ggccacgcgcgggcug

SEQ ID NO: 2376045 - RNA, 19 nt, Bordetella pertussis
ggccacgcgcugcagcagc

SEQ ID NO: 2376046 - RNA, 19 nt, Bordetella pertussis
ggccacgcgcuugcgcgcc

SEQ ID NO: 2376047 - RNA, 14 nt, Bordetella pertussis
ggccacgcgggcgu

SEQ ID NO: 2376048 - RNA, 16 nt, Bordetella pertussis
ggccacgcgggcgugg

SEQ ID NO: 2376049 - RNA, 16 nt, Bordetella pertussis
ggccacgcucacgccc

SEQ ID NO: 2376050 - RNA, 17 nt, Bordetella pertussis
ggccacgcucacgcccg

SEQ ID NO: 2376051 - RNA, 15 nt, Bordetella pertussis
ggccacgcugcccug

SEQ ID NO: 2376052 - RNA, 19 nt, Bordetella pertussis
ggccacgcugcccugcugc

SEQ ID NO: 2376053 - RNA, 21 nt, Bordetella pertussis
ggccacgcugcccugcugcug

SEQ ID NO: 2376054 - RNA, 19 nt, Bordetella pertussis
ggccacggcaaugucgcag

SEQ ID NO: 2376055 - RNA, 14 nt, Bordetella pertussis
ggccacggccgcga

SEQ ID NO: 2376056 - RNA, 14 nt, Bordetella pertussis
ggccacggccggca

SEQ ID NO: 2376057 - RNA, 18 nt, Bordetella pertussis
ggccacggccgggccuca

SEQ ID NO: 2376058 - RNA, 14 nt, Bordetella pertussis
ggccacggccugcc

SEQ ID NO: 2376059 - RNA, 16 nt, Bordetella pertussis
ggccacggccugcccg

SEQ ID NO: 2376060 - RNA, 22 nt, Bordetella pertussis
ggccacggccugcccgggcggg

SEQ ID NO: 2376061 - RNA, 12 nt, Bordetella pertussis
ggccacggcugg

SEQ ID NO: 2376062 - RNA, 14 nt, Bordetella pertussis
ggccacggcuggaa

SEQ ID NO: 2376063 - RNA, 15 nt, Bordetella pertussis
ggccacguaggccau

SEQ ID NO: 2376064 - RNA, 16 nt, Bordetella pertussis
ggccagcgccagcacg

SEQ ID NO: 2376065 - RNA, 15 nt, Bordetella pertussis
ggccagcgccagccg

SEQ ID NO: 2376066 - RNA, 11 nt, Bordetella pertussis
ggccagcgccg

SEQ ID NO: 2376067 - RNA, 12 nt, Bordetella pertussis
ggccagcgccga

SEQ ID NO: 2376068 - RNA, 14 nt, Bordetella pertussis
ggccagcgccgcca

SEQ ID NO: 2376069 - RNA, 15 nt, Bordetella pertussis
ggccagcgccgccag

SEQ ID NO: 2376070 - RNA, 16 nt, Bordetella pertussis
ggccagcgccgccagc

SEQ ID NO: 2376071 - RNA, 13 nt, Bordetella pertussis
ggccagcgccgcg

SEQ ID NO: 2376072 - RNA, 14 nt, Bordetella pertussis
ggccagcgccgcga

SEQ ID NO: 2376073 - RNA, 15 nt, Bordetella pertussis
ggccagcgccgcggc

SEQ ID NO: 2376074 - RNA, 14 nt, Bordetella pertussis
ggccagcgccggcg

SEQ ID NO: 2376075 - RNA, 13 nt, Bordetella pertussis
ggccagcgccugg

SEQ ID NO: 2376076 - RNA, 16 nt, Bordetella pertussis
ggccagcgccugggcg

SEQ ID NO: 2376077 - RNA, 22 nt, Bordetella pertussis
ggccagcgcgaaguaccagcgc

SEQ ID NO: 2376078 - RNA, 13 nt, Bordetella pertussis
ggccagcgcgacg

SEQ ID NO: 2376079 - RNA, 23 nt, Bordetella pertussis
ggccagcgcgaucucgcgcaggg

SEQ ID NO: 2376080 - RNA, 14 nt, Bordetella pertussis
ggccagcgcgcagg

SEQ ID NO: 2376081 - RNA, 13 nt, Bordetella pertussis
ggccagcgcgccg

SEQ ID NO: 2376082 - RNA, 15 nt, Bordetella pertussis
ggccagcgcgccgcc

SEQ ID NO: 2376083 - RNA, 22 nt, Bordetella pertussis
ggccagcgcgccgccagcgcgc

SEQ ID NO: 2376084 - RNA, 16 nt, Bordetella pertussis
ggccagcgcgccggcc

SEQ ID NO: 2376085 - RNA, 14 nt, Bordetella pertussis
ggccagcgcgccuu

SEQ ID NO: 2376086 - RNA, 14 nt, Bordetella pertussis
ggccagcgcgcgcc

SEQ ID NO: 2376087 - RNA, 16 nt, Bordetella pertussis
ggccagcgcgcgccag

SEQ ID NO: 2376088 - RNA, 16 nt, Bordetella pertussis
ggccagcgcgcggccg

SEQ ID NO: 2376089 - RNA, 17 nt, Bordetella pertussis
ggccagcgcgcggccgg

SEQ ID NO: 2376090 - RNA, 19 nt, Bordetella pertussis
ggccagcgcgcggccggcc

SEQ ID NO: 2376091 - RNA, 15 nt, Bordetella pertussis
ggccagcgcgcggcg

SEQ ID NO: 2376092 - RNA, 18 nt, Bordetella pertussis
ggccagcgcgcggcgcag

SEQ ID NO: 2376093 - RNA, 13 nt, Bordetella pertussis
ggccagcgcggcc

SEQ ID NO: 2376094 - RNA, 18 nt, Bordetella pertussis
ggccagcgcggcggcagc

SEQ ID NO: 2376095 - RNA, 22 nt, Bordetella pertussis
ggccagcgcggcggcagcgcgu

SEQ ID NO: 2376096 - RNA, 14 nt, Bordetella pertussis
ggccagcgcgucga

SEQ ID NO: 2376097 - RNA, 19 nt, Bordetella pertussis
ggccagcggaugaugcggc

SEQ ID NO: 2376098 - RNA, 22 nt, Bordetella pertussis
ggccagcggaugaugcggcgcc

SEQ ID NO: 2376099 - RNA, 23 nt, Bordetella pertussis
ggccagcggaugaugcggcgcca

SEQ ID NO: 2376100 - RNA, 11 nt, Bordetella pertussis
ggccagcggca

SEQ ID NO: 2376101 - RNA, 14 nt, Bordetella pertussis
ggccagcggcagga

SEQ ID NO: 2376102 - RNA, 15 nt, Bordetella pertussis
ggccagcggcaggcc

SEQ ID NO: 2376103 - RNA, 19 nt, Bordetella pertussis
ggccagcggcaggcccagc

SEQ ID NO: 2376104 - RNA, 15 nt, Bordetella pertussis
ggccagcggcagggg

SEQ ID NO: 2376105 - RNA, 13 nt, Bordetella pertussis
ggccagcggcggu

SEQ ID NO: 2376106 - RNA, 20 nt, Bordetella pertussis
ggccagcggcgguucguccu

SEQ ID NO: 2376107 - RNA, 22 nt, Bordetella pertussis
ggccagcggcgguucguccucg

SEQ ID NO: 2376108 - RNA, 17 nt, Bordetella pertussis
ggccagcggggccguga

SEQ ID NO: 2376109 - RNA, 19 nt, Bordetella pertussis
ggccagcggggccgugacg

SEQ ID NO: 2376110 - RNA, 17 nt, Bordetella pertussis
ggccagcgguacgccga

SEQ ID NO: 2376111 - RNA, 19 nt, Bordetella pertussis
ggccagcgguacgccgaac

SEQ ID NO: 2376112 - RNA, 13 nt, Bordetella pertussis
ggccagcgucagc

SEQ ID NO: 2376113 - RNA, 13 nt, Bordetella pertussis
ggccagcgugccc

SEQ ID NO: 2376114 - RNA, 16 nt, Bordetella pertussis
ggccagcgugcccagc

SEQ ID NO: 2376115 - RNA, 17 nt, Bordetella pertussis
ggccagcgugcccagcg

SEQ ID NO: 2376116 - RNA, 17 nt, Bordetella pertussis
ggccagcgugccgguga

SEQ ID NO: 2376117 - RNA, 17 nt, Bordetella pertussis
ggccagcguggggacgc

SEQ ID NO: 2376118 - RNA, 23 nt, Bordetella pertussis
ggccagcguggggacgcgggcca

SEQ ID NO: 2376119 - RNA, 15 nt, Bordetella pertussis
ggccagcuccaccgg

SEQ ID NO: 2376120 - RNA, 19 nt, Bordetella pertussis
ggccagcuccaccgggcug

SEQ ID NO: 2376121 - RNA, 18 nt, Bordetella pertussis
ggccagcuccccgggcgu

SEQ ID NO: 2376122 - RNA, 19 nt, Bordetella pertussis
ggccagcuccccgggcgug

SEQ ID NO: 2376123 - RNA, 22 nt, Bordetella pertussis
ggccagcucggcggccgccugc

SEQ ID NO: 2376124 - RNA, 14 nt, Bordetella pertussis
ggccagcugcaugc

SEQ ID NO: 2376125 - RNA, 19 nt, Bordetella pertussis
ggccagcugcaugcgcacg

SEQ ID NO: 2376126 - RNA, 14 nt, Bordetella pertussis
ggccagcugcgccc

SEQ ID NO: 2376127 - RNA, 19 nt, Bordetella pertussis
ggccagcuggcgcguggcc

SEQ ID NO: 2376128 - RNA, 18 nt, Bordetella pertussis
ggccagcuggcggcgcag

SEQ ID NO: 2376129 - RNA, 20 nt, Bordetella pertussis
ggccagcuggcggcgcagca

SEQ ID NO: 2376130 - RNA, 23 nt, Bordetella pertussis
ggccagcuggcggcgcagcacca

SEQ ID NO: 2376131 - RNA, 19 nt, Bordetella pertussis
ggccagcugggaggcgugc

SEQ ID NO: 2376132 - RNA, 16 nt, Bordetella pertussis
ggccagcuugaccgcc

SEQ ID NO: 2376133 - RNA, 19 nt, Bordetella pertussis
ggccagcuugaccgccagc

SEQ ID NO: 2376134 - RNA, 23 nt, Bordetella pertussis
ggccagcuugaccgccagcaucc

SEQ ID NO: 2376135 - RNA, 22 nt, Bordetella pertussis
ggccagcuugacguccagccag

SEQ ID NO: 2376136 - RNA, 13 nt, Bordetella pertussis
ggccagcuugagc

SEQ ID NO: 2376137 - RNA, 17 nt, Bordetella pertussis
ggccagcuugagcaggc

SEQ ID NO: 2376138 - RNA, 20 nt, Bordetella pertussis
ggccagcuugagcaggcgcg

SEQ ID NO: 2376139 - RNA, 22 nt, Bordetella pertussis
ggccagcuuguagcggccaucg

SEQ ID NO: 2376140 - RNA, 17 nt, Bordetella pertussis
ggccaggaaagccggcg

SEQ ID NO: 2376141 - RNA, 15 nt, Bordetella pertussis
ggccaggaagcggcg

SEQ ID NO: 2376142 - RNA, 16 nt, Bordetella pertussis
ggccaggaagcggcgc

SEQ ID NO: 2376143 - RNA, 22 nt, Bordetella pertussis
ggccaggaagcggcgcaccagc

SEQ ID NO: 2376144 - RNA, 23 nt, Bordetella pertussis
ggccaggaccgaggugccagccu

SEQ ID NO: 2376145 - RNA, 20 nt, Bordetella pertussis
ggccaggacggugucgcuga

SEQ ID NO: 2376146 - RNA, 16 nt, Bordetella pertussis
ggccaggaucgcggcc

SEQ ID NO: 2376147 - RNA, 19 nt, Bordetella pertussis
ggccaggaucgcggccagc

SEQ ID NO: 2376148 - RNA, 22 nt, Bordetella pertussis
ggccaggaucgcggccagccgg

SEQ ID NO: 2376149 - RNA, 20 nt, Bordetella pertussis
ggccaggaugagggcgauca

SEQ ID NO: 2376150 - RNA, 23 nt, Bordetella pertussis
ggccaggauggcguugccggccu

SEQ ID NO: 2376151 - RNA, 13 nt, Bordetella pertussis
ggccaggcaaucg

SEQ ID NO: 2376152 - RNA, 15 nt, Bordetella pertussis
ggccaggccauggcg

SEQ ID NO: 2376153 - RNA, 15 nt, Bordetella pertussis
ggccaggcccacggc

SEQ ID NO: 2376154 - RNA, 19 nt, Bordetella pertussis
ggccaggcccacggcgcca

SEQ ID NO: 2376155 - RNA, 23 nt, Bordetella pertussis
ggccaggcccacggcgccaaagc

SEQ ID NO: 2376156 - RNA, 14 nt, Bordetella pertussis
ggccaggcccucgc

SEQ ID NO: 2376157 - RNA, 18 nt, Bordetella pertussis
ggccaggcccucgcggcc

SEQ ID NO: 2376158 - RNA, 19 nt, Bordetella pertussis
ggccaggcccucgcggccg

SEQ ID NO: 2376159 - RNA, 12 nt, Bordetella pertussis
ggccaggcccug

SEQ ID NO: 2376160 - RNA, 17 nt, Bordetella pertussis
ggccaggcccugcgcgu

SEQ ID NO: 2376161 - RNA, 12 nt, Bordetella pertussis
ggccaggccgau

SEQ ID NO: 2376162 - RNA, 22 nt, Bordetella pertussis
ggccaggccgauuucggccgcc

SEQ ID NO: 2376163 - RNA, 23 nt, Bordetella pertussis
ggccaggccgauuucggccgccg

SEQ ID NO: 2376164 - RNA, 16 nt, Bordetella pertussis
ggccaggccgccgccg

SEQ ID NO: 2376165 - RNA, 12 nt, Bordetella pertussis
ggccaggccggc

SEQ ID NO: 2376166 - RNA, 15 nt, Bordetella pertussis
ggccaggccggccug

SEQ ID NO: 2376167 - RNA, 17 nt, Bordetella pertussis
ggccaggccggccugca

SEQ ID NO: 2376168 - RNA, 19 nt, Bordetella pertussis
ggccaggccggccuuggcc

SEQ ID NO: 2376169 - RNA, 15 nt, Bordetella pertussis
ggccaggccggcgcg

SEQ ID NO: 2376170 - RNA, 20 nt, Bordetella pertussis
ggccaggccggcgcgccggc

SEQ ID NO: 2376171 - RNA, 15 nt, Bordetella pertussis
ggccaggccggggcc

SEQ ID NO: 2376172 - RNA, 13 nt, Bordetella pertussis
ggccaggccggug

SEQ ID NO: 2376173 - RNA, 14 nt, Bordetella pertussis
ggccaggcgccaga

SEQ ID NO: 2376174 - RNA, 13 nt, Bordetella pertussis
ggccaggcgccgc

SEQ ID NO: 2376175 - RNA, 14 nt, Bordetella pertussis
ggccaggcgccggc

SEQ ID NO: 2376176 - RNA, 16 nt, Bordetella pertussis
ggccaggcgccugagc

SEQ ID NO: 2376177 - RNA, 14 nt, Bordetella pertussis
ggccaggcgcgccg

SEQ ID NO: 2376178 - RNA, 21 nt, Bordetella pertussis
ggccauguccuggcaggccgc

SEQ ID NO: 2376179 - RNA, 16 nt, Bordetella pertussis
ggccauguggcgcagc

SEQ ID NO: 2376180 - RNA, 15 nt, Bordetella pertussis
ggccauguucuucag

SEQ ID NO: 2376181 - RNA, 17 nt, Bordetella pertussis
ggccauguucuucaggc

SEQ ID NO: 2376182 - RNA, 14 nt, Bordetella pertussis
ggccauugcuggcg

SEQ ID NO: 2376183 - RNA, 22 nt, Bordetella pertussis
ggccauuugcggaugcccggga

SEQ ID NO: 2376184 - RNA, 14 nt, Bordetella pertussis
ggcccacaaugccc

SEQ ID NO: 2376185 - RNA, 13 nt, Bordetella pertussis
ggcccacagcgcc

SEQ ID NO: 2376186 - RNA, 23 nt, Bordetella pertussis
ggcccacagcgcccccagcacgg

SEQ ID NO: 2376187 - RNA, 12 nt, Bordetella pertussis
ggcccaccaggg

SEQ ID NO: 2376188 - RNA, 23 nt, Bordetella pertussis
ggcccaccagggaccaauacgcc

SEQ ID NO: 2376189 - RNA, 17 nt, Bordetella pertussis
ggcccaccagggccagc

SEQ ID NO: 2376190 - RNA, 19 nt, Bordetella pertussis
ggcccaccagggccagcuu

SEQ ID NO: 2376191 - RNA, 15 nt, Bordetella pertussis
ggcccaccgcaucgc

SEQ ID NO: 2376192 - RNA, 20 nt, Bordetella pertussis
ggcccaccgcaucgcgcagc

SEQ ID NO: 2376193 - RNA, 21 nt, Bordetella pertussis
ggcccaccgcaucgcgcagcg

SEQ ID NO: 2376194 - RNA, 16 nt, Bordetella pertussis
ggcccaccggcaugcc

SEQ ID NO: 2376195 - RNA, 20 nt, Bordetella pertussis
ggcccaccggcaugccgucc

SEQ ID NO: 2376196 - RNA, 23 nt, Bordetella pertussis
ggcccacgacgaacaacacgaug

SEQ ID NO: 2376197 - RNA, 17 nt, Bordetella pertussis
ggcccacgaugcgggca

SEQ ID NO: 2376198 - RNA, 18 nt, Bordetella pertussis
ggcccacgaugcgggcau

SEQ ID NO: 2376199 - RNA, 21 nt, Bordetella pertussis
ggcccacgaugcgggcaucgc

SEQ ID NO: 2376200 - RNA, 14 nt, Bordetella pertussis
ggcccacgccgccg

SEQ ID NO: 2376201 - RNA, 13 nt, Bordetella pertussis
ggcccacgccgcg

SEQ ID NO: 2376202 - RNA, 23 nt, Bordetella pertussis
ggcccacgccgcguucguucuug

SEQ ID NO: 2376203 - RNA, 22 nt, Bordetella pertussis
ggcccacgcgcacgacgucgcg

SEQ ID NO: 2376204 - RNA, 17 nt, Bordetella pertussis
ggcccacggcaucgccg

SEQ ID NO: 2376205 - RNA, 20 nt, Bordetella pertussis
ggcccacggcaucgccgcgg

SEQ ID NO: 2376206 - RNA, 17 nt, Bordetella pertussis
ggcccacggccagcacu

SEQ ID NO: 2376207 - RNA, 15 nt, Bordetella pertussis
ggcccacggcgccaa

SEQ ID NO: 2376208 - RNA, 22 nt, Bordetella pertussis
ggcccacguaggcaaagcgcgg

SEQ ID NO: 2376209 - RNA, 20 nt, Bordetella pertussis
ggcccacucggugcgcgcgc

SEQ ID NO: 2376210 - RNA, 20 nt, Bordetella pertussis
ggcccacuggaucgccgauc

SEQ ID NO: 2376211 - RNA, 19 nt, Bordetella pertussis
ggcccagaccaagcgccac

SEQ ID NO: 2376212 - RNA, 12 nt, Bordetella pertussis
ggcccagcaccg

SEQ ID NO: 2376213 - RNA, 23 nt, Bordetella pertussis
ggcccagcaccgccgccaguucg

SEQ ID NO: 2376214 - RNA, 14 nt, Bordetella pertussis
ggcccagcacgccg

SEQ ID NO: 2376215 - RNA, 18 nt, Bordetella pertussis
ggcccagcacgccgcgcu

SEQ ID NO: 2376216 - RNA, 21 nt, Bordetella pertussis
ggcccagcacgccgcgcucgu

SEQ ID NO: 2376217 - RNA, 14 nt, Bordetella pertussis
ggcccagcacgcgc

SEQ ID NO: 2376218 - RNA, 15 nt, Bordetella pertussis
ggcccagcacgcgcg

SEQ ID NO: 2376219 - RNA, 17 nt, Bordetella pertussis
ggcccagcacgcgcgcc

SEQ ID NO: 2376220 - RNA, 23 nt, Bordetella pertussis
ggcccagcacgcgcgccagcugg

SEQ ID NO: 2376221 - RNA, 16 nt, Bordetella pertussis
ggcccagcaugccgau

SEQ ID NO: 2376222 - RNA, 18 nt, Bordetella pertussis
ggcccagccagcccuggc

SEQ ID NO: 2376223 - RNA, 20 nt, Bordetella pertussis
ggcccagccagcccuggccc

SEQ ID NO: 2376224 - RNA, 20 nt, Bordetella pertussis
ggcccagccagcggugcgcg

SEQ ID NO: 2376225 - RNA, 14 nt, Bordetella pertussis
ggcccagcccgccg

SEQ ID NO: 2376226 - RNA, 20 nt, Bordetella pertussis
ggcccagcccgccgauccac

SEQ ID NO: 2376227 - RNA, 20 nt, Bordetella pertussis
ggcccagccgcaugccggcg

SEQ ID NO: 2376228 - RNA, 13 nt, Bordetella pertussis
ggcccagccgcuc

SEQ ID NO: 2376229 - RNA, 23 nt, Bordetella pertussis
ggcccagccgcucggccacgcgc

SEQ ID NO: 2376230 - RNA, 14 nt, Bordetella pertussis
ggcccagcgccagc

SEQ ID NO: 2376231 - RNA, 15 nt, Bordetella pertussis
ggcccagcgccagca

SEQ ID NO: 2376232 - RNA, 13 nt, Bordetella pertussis
ggcccagcgccau

SEQ ID NO: 2376233 - RNA, 14 nt, Bordetella pertussis
ggcccagcgccauc

SEQ ID NO: 2376234 - RNA, 14 nt, Bordetella pertussis
ggcccagcgcgucc

SEQ ID NO: 2376235 - RNA, 12 nt, Bordetella pertussis
ggcccagcggca

SEQ ID NO: 2376236 - RNA, 14 nt, Bordetella pertussis
ggcccagcuccagc

SEQ ID NO: 2376237 - RNA, 17 nt, Bordetella pertussis
ggcccagcuccagcugg

SEQ ID NO: 2376238 - RNA, 22 nt, Bordetella pertussis
ggcccagcuccagcuggcgcac

SEQ ID NO: 2376239 - RNA, 22 nt, Bordetella pertussis
ggcccagcucugguccaggcgg

SEQ ID NO: 2376240 - RNA, 14 nt, Bordetella pertussis
ggcccagcugggcg

SEQ ID NO: 2376241 - RNA, 15 nt, Bordetella pertussis
ggcccagcugggcgg

SEQ ID NO: 2376242 - RNA, 16 nt, Bordetella pertussis
ggcccagcugggcggc

SEQ ID NO: 2376243 - RNA, 19 nt, Bordetella pertussis
ggcccagcugggcggcgug

SEQ ID NO: 2376244 - RNA, 20 nt, Bordetella pertussis
ggcccagcugggcggcguga

SEQ ID NO: 2376245 - RNA, 22 nt, Bordetella pertussis
ggcccaggaaaccggcgaccac

SEQ ID NO: 2376246 - RNA, 17 nt, Bordetella pertussis
ggcccaggauggcgcca

SEQ ID NO: 2376247 - RNA, 18 nt, Bordetella pertussis
ggcccaggauggcgccag

SEQ ID NO: 2376248 - RNA, 20 nt, Bordetella pertussis
ggcccaggauggcgccagcc

SEQ ID NO: 2376249 - RNA, 21 nt, Bordetella pertussis
ggcccaggauggcgccagccc

SEQ ID NO: 2376250 - RNA, 18 nt, Bordetella pertussis
ggcccaggcaaugcgcag

SEQ ID NO: 2376251 - RNA, 22 nt, Bordetella pertussis
ggcccaggcaaugcgcaggccc

SEQ ID NO: 2376252 - RNA, 14 nt, Bordetella pertussis
ggcccaggccgggc

SEQ ID NO: 2376253 - RNA, 17 nt, Bordetella pertussis
ggcccaggcgacccagc

SEQ ID NO: 2376254 - RNA, 14 nt, Bordetella pertussis
ggcccaggcgcgcu

SEQ ID NO: 2376255 - RNA, 15 nt, Bordetella pertussis
ggcccaggcguccag

SEQ ID NO: 2376256 - RNA, 18 nt, Bordetella pertussis
ggcccaggcguccaggcu

SEQ ID NO: 2376257 - RNA, 22 nt, Bordetella pertussis
ggcccaggcguccaggcugccg

SEQ ID NO: 2376258 - RNA, 16 nt, Bordetella pertussis
ggcccagggcagcggc

SEQ ID NO: 2376259 - RNA, 17 nt, Bordetella pertussis
ggcccagggcagcggcc

SEQ ID NO: 2376260 - RNA, 15 nt, Bordetella pertussis
ggcccagggccaggu

SEQ ID NO: 2376261 - RNA, 21 nt, Bordetella pertussis
ggcccaggucaucgccaggcg

SEQ ID NO: 2376262 - RNA, 22 nt, Bordetella pertussis
ggcccaggucaucgccaggcgc

SEQ ID NO: 2376263 - RNA, 15 nt, Bordetella pertussis
ggcccaguacggccu

SEQ ID NO: 2376264 - RNA, 17 nt, Bordetella pertussis
ggcccaguacggccugc

SEQ ID NO: 2376265 - RNA, 17 nt, Bordetella pertussis
ggcccaguccagggugu

SEQ ID NO: 2376266 - RNA, 17 nt, Bordetella pertussis
ggcccaguucgcgcagc

SEQ ID NO: 2376267 - RNA, 19 nt, Bordetella pertussis
ggcccaguucgcgcagcag

SEQ ID NO: 2376268 - RNA, 18 nt, Bordetella pertussis
ggcccaguucggcgacga

SEQ ID NO: 2376269 - RNA, 20 nt, Bordetella pertussis
ggcccaguugaaucggcgcg

SEQ ID NO: 2376270 - RNA, 24 nt, Bordetella pertussis
ggcccaguugaaucggcgcgagcg

SEQ ID NO: 2376271 - RNA, 18 nt, Bordetella pertussis
ggcccaguugacgaugcc

SEQ ID NO: 2376272 - RNA, 18 nt, Bordetella pertussis
ggcccauaugccgccggc

SEQ ID NO: 2376273 - RNA, 20 nt, Bordetella pertussis
ggcccauaugccgccggccu

SEQ ID NO: 2376274 - RNA, 21 nt, Bordetella pertussis
ggcccauaugccgccggccug

SEQ ID NO: 2376275 - RNA, 20 nt, Bordetella pertussis
ggcccauccaucugguggug

SEQ ID NO: 2376276 - RNA, 20 nt, Bordetella pertussis
ggcccaucuguacggccggc

SEQ ID NO: 2376277 - RNA, 12 nt, Bordetella pertussis
ggcccaugaagg

SEQ ID NO: 2376278 - RNA, 18 nt, Bordetella pertussis
ggcccaugaaggcggcca

SEQ ID NO: 2376279 - RNA, 17 nt, Bordetella pertussis
ggcccaugaccggcgug

SEQ ID NO: 2376280 - RNA, 20 nt, Bordetella pertussis
ggcccaugacgaccuugcgg

SEQ ID NO: 2376281 - RNA, 12 nt, Bordetella pertussis
ggcccaugacgc

SEQ ID NO: 2376282 - RNA, 17 nt, Bordetella pertussis
ggcccaugccgcggacc

SEQ ID NO: 2376283 - RNA, 21 nt, Bordetella pertussis
ggcccaugccgcggacccagg

SEQ ID NO: 2376284 - RNA, 17 nt, Bordetella pertussis
ggcccauucgcgcaccg

SEQ ID NO: 2376285 - RNA, 15 nt, Bordetella pertussis
ggcccauugcggcac

SEQ ID NO: 2376286 - RNA, 20 nt, Bordetella pertussis
ggcccauugcggcaccugcu

SEQ ID NO: 2376287 - RNA, 21 nt, Bordetella pertussis
ggcccauugcggcaccugcug

SEQ ID NO: 2376288 - RNA, 12 nt, Bordetella pertussis
ggccccagcauc

SEQ ID NO: 2376289 - RNA, 20 nt, Bordetella pertussis
ggccccagcaucugccccag

SEQ ID NO: 2376290 - RNA, 15 nt, Bordetella pertussis
ggcccggugcagccg

SEQ ID NO: 2376291 - RNA, 21 nt, Bordetella pertussis
ggcccgguuggggucgcgcug

SEQ ID NO: 2376292 - RNA, 23 nt, Bordetella pertussis
ggcccgguuggggucgcgcuggg

SEQ ID NO: 2376293 - RNA, 15 nt, Bordetella pertussis
ggcccgucgcgccag

SEQ ID NO: 2376294 - RNA, 16 nt, Bordetella pertussis
ggcccgucgcgccagg

SEQ ID NO: 2376295 - RNA, 18 nt, Bordetella pertussis
ggcccgucgcgccaggcc

SEQ ID NO: 2376296 - RNA, 19 nt, Bordetella pertussis
ggcccgugcgcaacgcgcg

SEQ ID NO: 2376297 - RNA, 16 nt, Bordetella pertussis
ggcccguguagacggc

SEQ ID NO: 2376298 - RNA, 15 nt, Bordetella pertussis
ggcccguuggcaggc

SEQ ID NO: 2376299 - RNA, 20 nt, Bordetella pertussis
ggcccguuggcaggccagca

SEQ ID NO: 2376300 - RNA, 18 nt, Bordetella pertussis
ggcccuagagcaugcggc

SEQ ID NO: 2376301 - RNA, 20 nt, Bordetella pertussis
ggcccuagagcaugcggcgu

SEQ ID NO: 2376302 - RNA, 20 nt, Bordetella pertussis
ggcccuccggcgccagcaug

SEQ ID NO: 2376303 - RNA, 15 nt, Bordetella pertussis
ggcccucgcggccgu

SEQ ID NO: 2376304 - RNA, 21 nt, Bordetella pertussis
ggcccucgcggccgucggcgc

SEQ ID NO: 2376305 - RNA, 21 nt, Bordetella pertussis
ggcccucggugcggaagacga

SEQ ID NO: 2376306 - RNA, 14 nt, Bordetella pertussis
ggcccugccgcccu

SEQ ID NO: 2376307 - RNA, 16 nt, Bordetella pertussis
ggcccugccgcccugg

SEQ ID NO: 2376308 - RNA, 17 nt, Bordetella pertussis
ggcccugccgcccuggc

SEQ ID NO: 2376309 - RNA, 22 nt, Bordetella pertussis
ggcccugccgcccuggcgcagg

SEQ ID NO: 2376310 - RNA, 14 nt, Bordetella pertussis
ggcccugccgccuc

SEQ ID NO: 2376311 - RNA, 17 nt, Bordetella pertussis
ggcccuggagaucgccg

SEQ ID NO: 2376312 - RNA, 19 nt, Bordetella pertussis
ggcccuggagaucgccgcc

SEQ ID NO: 2376313 - RNA, 20 nt, Bordetella pertussis
ggcccuggcagacguacuug

SEQ ID NO: 2376314 - RNA, 22 nt, Bordetella pertussis
ggcccuggcaugugccaccgcc

SEQ ID NO: 2376315 - RNA, 18 nt, Bordetella pertussis
ggcccuggcgggccggaa

SEQ ID NO: 2376316 - RNA, 12 nt, Bordetella pertussis
ggcccuggcugg

SEQ ID NO: 2376317 - RNA, 19 nt, Bordetella pertussis
ggcccuggcuggccagccg

SEQ ID NO: 2376318 - RNA, 14 nt, Bordetella pertussis
ggcccugggccagc

SEQ ID NO: 2376319 - RNA, 16 nt, Bordetella pertussis
ggcccugggccagcag

SEQ ID NO: 2376320 - RNA, 16 nt, Bordetella pertussis
ggcccugggccagcca

SEQ ID NO: 2376321 - RNA, 17 nt, Bordetella pertussis
ggcccugggccagccag

SEQ ID NO: 2376322 - RNA, 22 nt, Bordetella pertussis
ggcccugggcgagguagggcgc

SEQ ID NO: 2376323 - RNA, 12 nt, Bordetella pertussis
ggcccuggggcc

SEQ ID NO: 2376324 - RNA, 13 nt, Bordetella pertussis
ggcccuggggccg

SEQ ID NO: 2376325 - RNA, 17 nt, Bordetella pertussis
ggcccuggggccgcggc

SEQ ID NO: 2376326 - RNA, 19 nt, Bordetella pertussis
ggcccuggggccgcggcgc

SEQ ID NO: 2376327 - RNA, 15 nt, Bordetella pertussis
ggcccugucggccga

SEQ ID NO: 2376328 - RNA, 20 nt, Bordetella pertussis
ggcccuugaucaggcgcaua

SEQ ID NO: 2376329 - RNA, 14 nt, Bordetella pertussis
ggcccuugauggcc

SEQ ID NO: 2376330 - RNA, 18 nt, Bordetella pertussis
ggcccuugauggccgggc

SEQ ID NO: 2376331 - RNA, 14 nt, Bordetella pertussis
ggcccuugcccagc

SEQ ID NO: 2376332 - RNA, 16 nt, Bordetella pertussis
ggcccuugccgccuuc

SEQ ID NO: 2376333 - RNA, 20 nt, Bordetella pertussis
ggcccuugcgcgaacggcag

SEQ ID NO: 2376334 - RNA, 22 nt, Bordetella pertussis
ggcccuugcgcgaaggccgccc

SEQ ID NO: 2376335 - RNA, 18 nt, Bordetella pertussis
ggcccuugugcguuggcg

SEQ ID NO: 2376336 - RNA, 16 nt, Bordetella pertussis
ggccgaaaccgccgcg

SEQ ID NO: 2376337 - RNA, 20 nt, Bordetella pertussis
ggccgaaaccgccgcggcuu

SEQ ID NO: 2376338 - RNA, 18 nt, Bordetella pertussis
ggccgaaauggcggcggu

SEQ ID NO: 2376339 - RNA, 20 nt, Bordetella pertussis
ggccgaaauggcggcgguag

SEQ ID NO: 2376340 - RNA, 14 nt, Bordetella pertussis
ggccgaaccgcgca

SEQ ID NO: 2376341 - RNA, 16 nt, Bordetella pertussis
ggccgaaccgcgcagc

SEQ ID NO: 2376342 - RNA, 18 nt, Bordetella pertussis
ggccgaaccgcgcagccg

SEQ ID NO: 2376343 - RNA, 20 nt, Bordetella pertussis
ggccgaaccgcgcagccgcu

SEQ ID NO: 2376344 - RNA, 16 nt, Bordetella pertussis
ggccgaacgccgccgc

SEQ ID NO: 2376345 - RNA, 21 nt, Bordetella pertussis
ggccgaacgccgccgcagccg

SEQ ID NO: 2376346 - RNA, 18 nt, Bordetella pertussis
ggccgaacugggacaggc

SEQ ID NO: 2376347 - RNA, 17 nt, Bordetella pertussis
ggccgaacuucagcccg

SEQ ID NO: 2376348 - RNA, 21 nt, Bordetella pertussis
ggccgaacuucagcccgggca

SEQ ID NO: 2376349 - RNA, 23 nt, Bordetella pertussis
ggccgaacuucagcccgggcaug

SEQ ID NO: 2376350 - RNA, 23 nt, Bordetella pertussis
ggccgaagccaccgucucgccca

SEQ ID NO: 2376351 - RNA, 22 nt, Bordetella pertussis
ggccgaaucguucacgcccgag

SEQ ID NO: 2376352 - RNA, 19 nt, Bordetella pertussis
ggccgaaugcccgcccuug

SEQ ID NO: 2376353 - RNA, 16 nt, Bordetella pertussis
ggccgaauugccgccg

SEQ ID NO: 2376354 - RNA, 23 nt, Bordetella pertussis
ggccgaauugccgccgcugccgg

SEQ ID NO: 2376355 - RNA, 19 nt, Bordetella pertussis
ggccgacaaggagacauca

SEQ ID NO: 2376356 - RNA, 15 nt, Bordetella pertussis
ggccgacagcgucga

SEQ ID NO: 2376357 - RNA, 23 nt, Bordetella pertussis
ggccgacaggugguagaccgggu

SEQ ID NO: 2376358 - RNA, 12 nt, Bordetella pertussis
ggccgaccagca

SEQ ID NO: 2376359 - RNA, 13 nt, Bordetella pertussis
ggccgaccagcac

SEQ ID NO: 2376360 - RNA, 14 nt, Bordetella pertussis
ggccgaccaggccg

SEQ ID NO: 2376361 - RNA, 16 nt, Bordetella pertussis
ggccgaccaggccggc

SEQ ID NO: 2376362 - RNA, 19 nt, Bordetella pertussis
ggccgaccaggccggcggc

SEQ ID NO: 2376363 - RNA, 20 nt, Bordetella pertussis
ggccgaccaggccggcggcg

SEQ ID NO: 2376364 - RNA, 23 nt, Bordetella pertussis
ggccgaccaggccggcggcgggc

SEQ ID NO: 2376365 - RNA, 21 nt, Bordetella pertussis
ggccgaccauguggcagaugg

SEQ ID NO: 2376366 - RNA, 12 nt, Bordetella pertussis
ggccgacccgcg

SEQ ID NO: 2376367 - RNA, 15 nt, Bordetella pertussis
ggccgacccgcggcc

SEQ ID NO: 2376368 - RNA, 20 nt, Bordetella pertussis
ggccgacccgcggcccuugc

SEQ ID NO: 2376369 - RNA, 22 nt, Bordetella pertussis
ggccgacccgcggcccuugcgc

SEQ ID NO: 2376370 - RNA, 14 nt, Bordetella pertussis
ggccgaccggcgcg

SEQ ID NO: 2376371 - RNA, 19 nt, Bordetella pertussis
ggccgaccggcgcgcgcgu

SEQ ID NO: 2376372 - RNA, 17 nt, Bordetella pertussis
ggccgacgaggcgcugu

SEQ ID NO: 2376373 - RNA, 13 nt, Bordetella pertussis
ggccgacgcgccc

SEQ ID NO: 2376374 - RNA, 12 nt, Bordetella pertussis
ggccgacgcgcu

SEQ ID NO: 2376375 - RNA, 22 nt, Bordetella pertussis
ggccgacgcgcugguccgccgc

SEQ ID NO: 2376376 - RNA, 14 nt, Bordetella pertussis
ggccgacgcgcugu

SEQ ID NO: 2376377 - RNA, 20 nt, Bordetella pertussis
ggccgacgcgcuguccgaug

SEQ ID NO: 2376378 - RNA, 22 nt, Bordetella pertussis
ggccgacggcaagaucgccggc

SEQ ID NO: 2376379 - RNA, 14 nt, Bordetella pertussis
ggccgacggccucg

SEQ ID NO: 2376380 - RNA, 16 nt, Bordetella pertussis
ggccgacggccucggc

SEQ ID NO: 2376381 - RNA, 14 nt, Bordetella pertussis
ggccgacggcucgc

SEQ ID NO: 2376382 - RNA, 22 nt, Bordetella pertussis
ggccgacggguggguggacagg

SEQ ID NO: 2376383 - RNA, 19 nt, Bordetella pertussis
ggccgacguggaccgcgcg

SEQ ID NO: 2376384 - RNA, 21 nt, Bordetella pertussis
ggccgacguggaccgcgcggu

SEQ ID NO: 2376385 - RNA, 21 nt, Bordetella pertussis
ggccgacucgaaacgggcggc

SEQ ID NO: 2376386 - RNA, 22 nt, Bordetella pertussis
ggccgacugcuguacgacagca

SEQ ID NO: 2376387 - RNA, 19 nt, Bordetella pertussis
ggccgagaugccguucuug

SEQ ID NO: 2376388 - RNA, 22 nt, Bordetella pertussis
ggccgagccauugucggugagc

SEQ ID NO: 2376389 - RNA, 14 nt, Bordetella pertussis
ggccgagcccgcgu

SEQ ID NO: 2376390 - RNA, 20 nt, Bordetella pertussis
ggccgagccgccccggcgcg

SEQ ID NO: 2376391 - RNA, 22 nt, Bordetella pertussis
ggccgagccgccccggcgcggc

SEQ ID NO: 2376392 - RNA, 12 nt, Bordetella pertussis
ggccgagcgcac

SEQ ID NO: 2376393 - RNA, 22 nt, Bordetella pertussis
ggccgagcgcgagcagggcauc

SEQ ID NO: 2376394 - RNA, 14 nt, Bordetella pertussis
ggccgagcgcgcca

SEQ ID NO: 2376395 - RNA, 15 nt, Bordetella pertussis
ggccgagcgcgccag

SEQ ID NO: 2376396 - RNA, 19 nt, Bordetella pertussis
ggccgagcgcgccagcacg

SEQ ID NO: 2376397 - RNA, 12 nt, Bordetella pertussis
ggccgagcgcgg

SEQ ID NO: 2376398 - RNA, 13 nt, Bordetella pertussis
ggccgagcgcgga

SEQ ID NO: 2376399 - RNA, 13 nt, Bordetella pertussis
ggccgagcgcggc

SEQ ID NO: 2376400 - RNA, 17 nt, Bordetella pertussis
ggccgagcgggccagcg

SEQ ID NO: 2376401 - RNA, 19 nt, Bordetella pertussis
ggccgagcgggccagcgcg

SEQ ID NO: 2376402 - RNA, 12 nt, Bordetella pertussis
ggccgccagcac

SEQ ID NO: 2376403 - RNA, 16 nt, Bordetella pertussis
ggccgccagcaccugc

SEQ ID NO: 2376404 - RNA, 17 nt, Bordetella pertussis
ggccgccagcaccugcu

SEQ ID NO: 2376405 - RNA, 12 nt, Bordetella pertussis
ggccgccagcca

SEQ ID NO: 2376406 - RNA, 13 nt, Bordetella pertussis
ggccgccagcccg

SEQ ID NO: 2376407 - RNA, 18 nt, Bordetella pertussis
ggccgccagcccgaggca

SEQ ID NO: 2376408 - RNA, 13 nt, Bordetella pertussis
ggccgccagccgg

SEQ ID NO: 2376409 - RNA, 14 nt, Bordetella pertussis
ggccgccagccggc

SEQ ID NO: 2376410 - RNA, 16 nt, Bordetella pertussis
ggccgccagccggccc

SEQ ID NO: 2376411 - RNA, 19 nt, Bordetella pertussis
ggccgccagccggcccagc

SEQ ID NO: 2376412 - RNA, 22 nt, Bordetella pertussis
ggccgccagccggcccagcacg

SEQ ID NO: 2376413 - RNA, 11 nt, Bordetella pertussis
ggccgccagcg

SEQ ID NO: 2376414 - RNA, 12 nt, Bordetella pertussis
ggccgccagcgc

SEQ ID NO: 2376415 - RNA, 13 nt, Bordetella pertussis
ggccgccagcgcc

SEQ ID NO: 2376416 - RNA, 14 nt, Bordetella pertussis
ggccgccagcgcca

SEQ ID NO: 2376417 - RNA, 23 nt, Bordetella pertussis
ggccgccagcgccaugaugucgc

SEQ ID NO: 2376418 - RNA, 13 nt, Bordetella pertussis
ggccgccagcggc

SEQ ID NO: 2376419 - RNA, 14 nt, Bordetella pertussis
ggccgccagcggcu

SEQ ID NO: 2376420 - RNA, 15 nt, Bordetella pertussis
ggccgccagcggcug

SEQ ID NO: 2376421 - RNA, 16 nt, Bordetella pertussis
ggccgccagcggcugg

SEQ ID NO: 2376422 - RNA, 19 nt, Bordetella pertussis
ggccgccagcggcuggcgc

SEQ ID NO: 2376423 - RNA, 12 nt, Bordetella pertussis
ggccgccagcgu

SEQ ID NO: 2376424 - RNA, 22 nt, Bordetella pertussis
ggccgccagcguaucgccgccg

SEQ ID NO: 2376425 - RNA, 16 nt, Bordetella pertussis
ggccgccagggcggcu

SEQ ID NO: 2376426 - RNA, 19 nt, Bordetella pertussis
ggccgccagggcggcugcc

SEQ ID NO: 2376427 - RNA, 20 nt, Bordetella pertussis
ggccgccagggcggcugccg

SEQ ID NO: 2376428 - RNA, 12 nt, Bordetella pertussis
ggccgccaggua

SEQ ID NO: 2376429 - RNA, 23 nt, Bordetella pertussis
ggccgccaggucggccaccgccg

SEQ ID NO: 2376430 - RNA, 17 nt, Bordetella pertussis
ggccgccauggccggcg

SEQ ID NO: 2376431 - RNA, 18 nt, Bordetella pertussis
ggccgccauggccggcgu

SEQ ID NO: 2376432 - RNA, 23 nt, Bordetella pertussis
ggccgccauggccggcguugccg

SEQ ID NO: 2376433 - RNA, 17 nt, Bordetella pertussis
ggccgccauggcgcugg

SEQ ID NO: 2376434 - RNA, 14 nt, Bordetella pertussis
ggccgcccagcacc

SEQ ID NO: 2376435 - RNA, 15 nt, Bordetella pertussis
ggccgcccagcaccu

SEQ ID NO: 2376436 - RNA, 13 nt, Bordetella pertussis
ggccgcccagcag

SEQ ID NO: 2376437 - RNA, 13 nt, Bordetella pertussis
ggccgcccagccg

SEQ ID NO: 2376438 - RNA, 22 nt, Bordetella pertussis
ggccgcccagccgcgccagggc

SEQ ID NO: 2376439 - RNA, 14 nt, Bordetella pertussis
ggccgcccagcgca

SEQ ID NO: 2376440 - RNA, 22 nt, Bordetella pertussis
ggccgcccagcgcauaggacgc

SEQ ID NO: 2376441 - RNA, 16 nt, Bordetella pertussis
ggccgcccagcgccug

SEQ ID NO: 2376442 - RNA, 15 nt, Bordetella pertussis
ggccgcccaggcgca

SEQ ID NO: 2376443 - RNA, 14 nt, Bordetella pertussis
ggccgcccagucgu

SEQ ID NO: 2376444 - RNA, 15 nt, Bordetella pertussis
ggccgcccagucguc

SEQ ID NO: 2376445 - RNA, 21 nt, Bordetella pertussis
ggccgcccccagcgcgccugc

SEQ ID NO: 2376446 - RNA, 13 nt, Bordetella pertussis
ggccgcccgcccc

SEQ ID NO: 2376447 - RNA, 17 nt, Bordetella pertussis
ggccgcccgccugccgg

SEQ ID NO: 2376448 - RNA, 22 nt, Bordetella pertussis
ggccgcccgccugccggccugg

SEQ ID NO: 2376449 - RNA, 14 nt, Bordetella pertussis
ggccgcccgcggcc

SEQ ID NO: 2376450 - RNA, 14 nt, Bordetella pertussis
ggccgcccuggcgc

SEQ ID NO: 2376451 - RNA, 19 nt, Bordetella pertussis
ggccgccgaacgaggcgcg

SEQ ID NO: 2376452 - RNA, 14 nt, Bordetella pertussis
ggccgccgaacggc

SEQ ID NO: 2376453 - RNA, 18 nt, Bordetella pertussis
ggccgccgaacggcagca

SEQ ID NO: 2376454 - RNA, 14 nt, Bordetella pertussis
ggccgccgacgccg

SEQ ID NO: 2376455 - RNA, 16 nt, Bordetella pertussis
ggccgccgacgccgcc

SEQ ID NO: 2376456 - RNA, 23 nt, Bordetella pertussis
ggccgccgacgccgccacgcugg

SEQ ID NO: 2376457 - RNA, 14 nt, Bordetella pertussis
ggccgccgcacagc

SEQ ID NO: 2376458 - RNA, 16 nt, Bordetella pertussis
ggccgccgcacagcgu

SEQ ID NO: 2376459 - RNA, 17 nt, Bordetella pertussis
ggccgccgcacagcgug

SEQ ID NO: 2376460 - RNA, 13 nt, Bordetella pertussis
ggccgccgccacc

SEQ ID NO: 2376461 - RNA, 23 nt, Bordetella pertussis
ggccgccgccaccaccucggccu

SEQ ID NO: 2376462 - RNA, 14 nt, Bordetella pertussis
ggccgccgccagcg

SEQ ID NO: 2376463 - RNA, 15 nt, Bordetella pertussis
ggccgccgccagcgc

SEQ ID NO: 2376464 - RNA, 13 nt, Bordetella pertussis
ggccgccgcccgc

SEQ ID NO: 2376465 - RNA, 20 nt, Bordetella pertussis
ggccgccgcccgccucaggc

SEQ ID NO: 2376466 - RNA, 12 nt, Bordetella pertussis
ggccgccgccgg

SEQ ID NO: 2376467 - RNA, 14 nt, Bordetella pertussis
ggccgccgccgguc

SEQ ID NO: 2376468 - RNA, 15 nt, Bordetella pertussis
ggccgccgccgguca

SEQ ID NO: 2376469 - RNA, 14 nt, Bordetella pertussis
ggccgccgcgccca

SEQ ID NO: 2376470 - RNA, 16 nt, Bordetella pertussis
ggccgccgcgcccagc

SEQ ID NO: 2376471 - RNA, 18 nt, Bordetella pertussis
ggccgccgcgcccagcag

SEQ ID NO: 2376472 - RNA, 23 nt, Bordetella pertussis
ggccgccgcgcccagcagcgcca

SEQ ID NO: 2376473 - RNA, 20 nt, Bordetella pertussis
ggccgccgcgcccagccgcg

SEQ ID NO: 2376474 - RNA, 12 nt, Bordetella pertussis
ggccgccgcgcg

SEQ ID NO: 2376475 - RNA, 15 nt, Bordetella pertussis
ggccgccgcgcgccg

SEQ ID NO: 2376476 - RNA, 16 nt, Bordetella pertussis
ggccgccgcgcgccgc

SEQ ID NO: 2376477 - RNA, 15 nt, Bordetella pertussis
ggccgccgcggccuc

SEQ ID NO: 2376478 - RNA, 16 nt, Bordetella pertussis
ggccgccgcggccucg

SEQ ID NO: 2376479 - RNA, 20 nt, Bordetella pertussis
ggccgccgcggccucggccg

SEQ ID NO: 2376480 - RNA, 15 nt, Bordetella pertussis
ggccgccgcgggcgc

SEQ ID NO: 2376481 - RNA, 18 nt, Bordetella pertussis
ggccgccgcgggcgccgc

SEQ ID NO: 2376482 - RNA, 12 nt, Bordetella pertussis
ggccgccggacg

SEQ ID NO: 2376483 - RNA, 17 nt, Bordetella pertussis
ggccgccggacgcaggu

SEQ ID NO: 2376484 - RNA, 23 nt, Bordetella pertussis
ggccgccggacgcaggucgucgu

SEQ ID NO: 2376485 - RNA, 16 nt, Bordetella pertussis
ggccgccggccaccag

SEQ ID NO: 2376486 - RNA, 19 nt, Bordetella pertussis
ggccgccggccaccagcgg

SEQ ID NO: 2376487 - RNA, 14 nt, Bordetella pertussis
ggccgccggccagc

SEQ ID NO: 2376488 - RNA, 18 nt, Bordetella pertussis
ggccgccggccagcgcca

SEQ ID NO: 2376489 - RNA, 19 nt, Bordetella pertussis
ggccgccggccagcgccag

SEQ ID NO: 2376490 - RNA, 12 nt, Bordetella pertussis
ggccgccggccu

SEQ ID NO: 2376491 - RNA, 13 nt, Bordetella pertussis
ggccgccggcgcg

SEQ ID NO: 2376492 - RNA, 15 nt, Bordetella pertussis
ggccgccggcgcggu

SEQ ID NO: 2376493 - RNA, 24 nt, Bordetella pertussis
ggccgccggcgcgguggccaugcu

SEQ ID NO: 2376494 - RNA, 17 nt, Bordetella pertussis
ggccgccggcggcgucg

SEQ ID NO: 2376495 - RNA, 14 nt, Bordetella pertussis
ggccgccgggccgc

SEQ ID NO: 2376496 - RNA, 22 nt, Bordetella pertussis
ggccgccggggaggccucgacg

SEQ ID NO: 2376497 - RNA, 22 nt, Bordetella pertussis
ggccgccgugacuucggccgcc

SEQ ID NO: 2376498 - RNA, 20 nt, Bordetella pertussis
ggccgccuauguaggcgccg

SEQ ID NO: 2376499 - RNA, 23 nt, Bordetella pertussis
ggccgccucaccgcgccgggcgu

SEQ ID NO: 2376500 - RNA, 18 nt, Bordetella pertussis
ggccgccuccaggcggcg

SEQ ID NO: 2376501 - RNA, 19 nt, Bordetella pertussis
ggccgccuccaggcggcgg

SEQ ID NO: 2376502 - RNA, 20 nt, Bordetella pertussis
ggccgccuccaggcggcggu

SEQ ID NO: 2376503 - RNA, 13 nt, Bordetella pertussis
ggccgccucggcg

SEQ ID NO: 2376504 - RNA, 17 nt, Bordetella pertussis
ggccgccucggcggcca

SEQ ID NO: 2376505 - RNA, 23 nt, Bordetella pertussis
ggccgccucggcggccagcgcgc

SEQ ID NO: 2376506 - RNA, 14 nt, Bordetella pertussis
ggccgccugcgccg

SEQ ID NO: 2376507 - RNA, 15 nt, Bordetella pertussis
ggccgccugcugcgc

SEQ ID NO: 2376508 - RNA, 16 nt, Bordetella pertussis
ggccgccugcugcgcc

SEQ ID NO: 2376509 - RNA, 20 nt, Bordetella pertussis
ggccgccugcugggccgcgc

SEQ ID NO: 2376510 - RNA, 13 nt, Bordetella pertussis
ggccgccuggccc

SEQ ID NO: 2376511 - RNA, 14 nt, Bordetella pertussis
ggccgccuggccca

SEQ ID NO: 2376512 - RNA, 23 nt, Bordetella pertussis
ggccgccuugacgguggccgcgg

SEQ ID NO: 2376513 - RNA, 18 nt, Bordetella pertussis
ggccgccuuuucgcagcg

SEQ ID NO: 2376514 - RNA, 22 nt, Bordetella pertussis
ggccgccuuuucgcagcggaug

SEQ ID NO: 2376515 - RNA, 22 nt, Bordetella pertussis
ggccgcgaacagauccacgccc

SEQ ID NO: 2376516 - RNA, 22 nt, Bordetella pertussis
ggccgcuaggccuugccgccgc

SEQ ID NO: 2376517 - RNA, 19 nt, Bordetella pertussis
ggccgcuccagagcgcgca

SEQ ID NO: 2376518 - RNA, 15 nt, Bordetella pertussis
ggccgcuccgccaug

SEQ ID NO: 2376519 - RNA, 17 nt, Bordetella pertussis
ggccgcuccgccaugga

SEQ ID NO: 2376520 - RNA, 16 nt, Bordetella pertussis
ggccgcuggcccgggu

SEQ ID NO: 2376521 - RNA, 21 nt, Bordetella pertussis
ggccgcugggcacauccagcg

SEQ ID NO: 2376522 - RNA, 20 nt, Bordetella pertussis
ggccgcuggucaccgccccg

SEQ ID NO: 2376523 - RNA, 22 nt, Bordetella pertussis
ggccgcuggucaccgccccgac

SEQ ID NO: 2376524 - RNA, 23 nt, Bordetella pertussis
ggccgcuggucaccgccccgacc

SEQ ID NO: 2376525 - RNA, 21 nt, Bordetella pertussis
ggccgcuguucggcgagccgg

SEQ ID NO: 2376526 - RNA, 17 nt, Bordetella pertussis
ggccgcuucgaugcugg

SEQ ID NO: 2376527 - RNA, 21 nt, Bordetella pertussis
ggccgcuucgaugcuggcggc

SEQ ID NO: 2376528 - RNA, 19 nt, Bordetella pertussis
ggccgcuucggccugcgcc

SEQ ID NO: 2376529 - RNA, 20 nt, Bordetella pertussis
ggccgcuucggccugcgcca

SEQ ID NO: 2376530 - RNA, 21 nt, Bordetella pertussis
ggccgcuucggccugcgccac

SEQ ID NO: 2376531 - RNA, 18 nt, Bordetella pertussis
ggccgcuucggcggccau

SEQ ID NO: 2376532 - RNA, 20 nt, Bordetella pertussis
ggccgcuucggcggccaugg

SEQ ID NO: 2376533 - RNA, 21 nt, Bordetella pertussis
ggccgcuucggcggccauggc

SEQ ID NO: 2376534 - RNA, 17 nt, Bordetella pertussis
ggccgcuucggcggccg

SEQ ID NO: 2376535 - RNA, 20 nt, Bordetella pertussis
ggccgcuucggcggccgcgu

SEQ ID NO: 2376536 - RNA, 17 nt, Bordetella pertussis
ggccgcuucgugcggcc

SEQ ID NO: 2376537 - RNA, 20 nt, Bordetella pertussis
ggccgcuucgugcggccgca

SEQ ID NO: 2376538 - RNA, 21 nt, Bordetella pertussis
ggccgcuucgugcggccgcag

SEQ ID NO: 2376539 - RNA, 20 nt, Bordetella pertussis
ggccgcuugucgaugacgcg

SEQ ID NO: 2376540 - RNA, 18 nt, Bordetella pertussis
ggccgcuuucgaccagcg

SEQ ID NO: 2376541 - RNA, 16 nt, Bordetella pertussis
ggccggaaaugccgcg

SEQ ID NO: 2376542 - RNA, 18 nt, Bordetella pertussis
ggccggaaaugccgcgcg

SEQ ID NO: 2376543 - RNA, 14 nt, Bordetella pertussis
ggccggaacagcgu

SEQ ID NO: 2376544 - RNA, 17 nt, Bordetella pertussis
ggccggaacagcgucca

SEQ ID NO: 2376545 - RNA, 19 nt, Bordetella pertussis
ggccggaacagcguccagc

SEQ ID NO: 2376546 - RNA, 18 nt, Bordetella pertussis
ggccggaacugaugccga

SEQ ID NO: 2376547 - RNA, 15 nt, Bordetella pertussis
ggccggacagggccg

SEQ ID NO: 2376548 - RNA, 15 nt, Bordetella pertussis
ggccggaccuugcga

SEQ ID NO: 2376549 - RNA, 16 nt, Bordetella pertussis
ggccggacgcaaccgg

SEQ ID NO: 2376550 - RNA, 14 nt, Bordetella pertussis
ggccggacuggcgc

SEQ ID NO: 2376551 - RNA, 16 nt, Bordetella pertussis
ggccggaggccgccca

SEQ ID NO: 2376552 - RNA, 17 nt, Bordetella pertussis
ggccggaggccgcccac

SEQ ID NO: 2376553 - RNA, 24 nt, Bordetella pertussis
ggccggauccagcugcgaaagcgc

SEQ ID NO: 2376554 - RNA, 20 nt, Bordetella pertussis
ggccggaucguagugcgugg

SEQ ID NO: 2376555 - RNA, 14 nt, Bordetella pertussis
ggccggcaagaugc

SEQ ID NO: 2376556 - RNA, 19 nt, Bordetella pertussis
ggccggcaaggggccagcc

SEQ ID NO: 2376557 - RNA, 20 nt, Bordetella pertussis
ggccggcaaggggccagccu

SEQ ID NO: 2376558 - RNA, 21 nt, Bordetella pertussis
ggccggcaaggggccagccug

SEQ ID NO: 2376559 - RNA, 17 nt, Bordetella pertussis
ggccggcaaggucagca

SEQ ID NO: 2376560 - RNA, 11 nt, Bordetella pertussis
ggccggcacca

SEQ ID NO: 2376561 - RNA, 20 nt, Bordetella pertussis
ggccggcaccacgaccggcu

SEQ ID NO: 2376562 - RNA, 13 nt, Bordetella pertussis
ggccggcaccagg

SEQ ID NO: 2376563 - RNA, 13 nt, Bordetella pertussis
ggccggcacgccc

SEQ ID NO: 2376564 - RNA, 15 nt, Bordetella pertussis
ggccggcacgccgau

SEQ ID NO: 2376565 - RNA, 17 nt, Bordetella pertussis
ggccggcacgccgauga

SEQ ID NO: 2376566 - RNA, 18 nt, Bordetella pertussis
ggccggcacggccggcca

SEQ ID NO: 2376567 - RNA, 15 nt, Bordetella pertussis
ggccggcagcgccuu

SEQ ID NO: 2376568 - RNA, 18 nt, Bordetella pertussis
ggccggcagcgccuugcc

SEQ ID NO: 2376569 - RNA, 14 nt, Bordetella pertussis
ggccggcagcgcga

SEQ ID NO: 2376570 - RNA, 20 nt, Bordetella pertussis
ggccggcagcgcgaccggcg

SEQ ID NO: 2376571 - RNA, 13 nt, Bordetella pertussis
ggccggcagcggc

SEQ ID NO: 2376572 - RNA, 14 nt, Bordetella pertussis
ggccggcagcggcg

SEQ ID NO: 2376573 - RNA, 16 nt, Bordetella pertussis
ggccggcaggccggcc

SEQ ID NO: 2376574 - RNA, 20 nt, Bordetella pertussis
ggccggcaggccggccagca

SEQ ID NO: 2376575 - RNA, 17 nt, Bordetella pertussis
ggccggcaucgcgcuga

SEQ ID NO: 2376576 - RNA, 16 nt, Bordetella pertussis
ggccggcaugcgccgg

SEQ ID NO: 2376577 - RNA, 18 nt, Bordetella pertussis
ggccggcaugcgccggcc

SEQ ID NO: 2376578 - RNA, 14 nt, Bordetella pertussis
ggccggccaacagc

SEQ ID NO: 2376579 - RNA, 23 nt, Bordetella pertussis
ggccggccaacagcucgcgccag

SEQ ID NO: 2376580 - RNA, 13 nt, Bordetella pertussis
ggccggccaggcg

SEQ ID NO: 2376581 - RNA, 15 nt, Bordetella pertussis
ggccggccaggcgcc

SEQ ID NO: 2376582 - RNA, 16 nt, Bordetella pertussis
ggccggccaggcgccg

SEQ ID NO: 2376583 - RNA, 19 nt, Bordetella pertussis
ggccggccaggcgccgcuc

SEQ ID NO: 2376584 - RNA, 21 nt, Bordetella pertussis
ggccggccagggccacgccgg

SEQ ID NO: 2376585 - RNA, 22 nt, Bordetella pertussis
ggccggccagggccacgccggc

SEQ ID NO: 2376586 - RNA, 14 nt, Bordetella pertussis
ggccggcccgcgcg

SEQ ID NO: 2376587 - RNA, 12 nt, Bordetella pertussis
ggccggccgccg

SEQ ID NO: 2376588 - RNA, 15 nt, Bordetella pertussis
ggccggccgccggcg

SEQ ID NO: 2376589 - RNA, 14 nt, Bordetella pertussis
ggccggccgccggg

SEQ ID NO: 2376590 - RNA, 15 nt, Bordetella pertussis
ggccggccgccgggc

SEQ ID NO: 2376591 - RNA, 14 nt, Bordetella pertussis
ggccggccgcgccc

SEQ ID NO: 2376592 - RNA, 12 nt, Bordetella pertussis
ggccggccgcgu

SEQ ID NO: 2376593 - RNA, 17 nt, Bordetella pertussis
ggccggccgcguggccg

SEQ ID NO: 2376594 - RNA, 14 nt, Bordetella pertussis
ggccggccgggcag

SEQ ID NO: 2376595 - RNA, 18 nt, Bordetella pertussis
ggccggccugcaggcucu

SEQ ID NO: 2376596 - RNA, 23 nt, Bordetella pertussis
ggccggccugcaggugccgccgg

SEQ ID NO: 2376597 - RNA, 16 nt, Bordetella pertussis
ggccggccugccggcg

SEQ ID NO: 2376598 - RNA, 18 nt, Bordetella pertussis
ggccggccugcgggcuga

SEQ ID NO: 2376599 - RNA, 20 nt, Bordetella pertussis
ggccggccugcgucgccacc

SEQ ID NO: 2376600 - RNA, 15 nt, Bordetella pertussis
ggccggccugcuugg

SEQ ID NO: 2376601 - RNA, 12 nt, Bordetella pertussis
ggccggccuggc

SEQ ID NO: 2376602 - RNA, 20 nt, Bordetella pertussis
ggccggccuggggacgggcg

SEQ ID NO: 2376603 - RNA, 13 nt, Bordetella pertussis
ggccggccuuggc

SEQ ID NO: 2376604 - RNA, 17 nt, Bordetella pertussis
ggccggccuuggccaug

SEQ ID NO: 2376605 - RNA, 20 nt, Bordetella pertussis
ggccggcgauugcgccagcg

SEQ ID NO: 2376606 - RNA, 12 nt, Bordetella pertussis
ggccggcgccag

SEQ ID NO: 2376607 - RNA, 13 nt, Bordetella pertussis
ggccggcgccagc

SEQ ID NO: 2376608 - RNA, 16 nt, Bordetella pertussis
ggccggcgccagcauc

SEQ ID NO: 2376609 - RNA, 16 nt, Bordetella pertussis
ggccggcgccagccgc

SEQ ID NO: 2376610 - RNA, 23 nt, Bordetella pertussis
ggccggcgccgacaacggcgugc

SEQ ID NO: 2376611 - RNA, 12 nt, Bordetella pertussis
ggccggcgccgg

SEQ ID NO: 2376612 - RNA, 13 nt, Bordetella pertussis
ggccggcgccggc

SEQ ID NO: 2376613 - RNA, 14 nt, Bordetella pertussis
ggccggcgccggca

SEQ ID NO: 2376614 - RNA, 13 nt, Bordetella pertussis
ggccggcgccggu

SEQ ID NO: 2376615 - RNA, 14 nt, Bordetella pertussis
ggccggcgccggug

SEQ ID NO: 2376616 - RNA, 22 nt, Bordetella pertussis
ggccggcgccguuuucagcgca

SEQ ID NO: 2376617 - RNA, 11 nt, Bordetella pertussis
ggccggcgccu

SEQ ID NO: 2376618 - RNA, 17 nt, Bordetella pertussis
ggccggcgccuggggcg

SEQ ID NO: 2376619 - RNA, 22 nt, Bordetella pertussis
ggccggcgccuggggcgggcgg

SEQ ID NO: 2376620 - RNA, 13 nt, Bordetella pertussis
ggccggcgcgacc

SEQ ID NO: 2376621 - RNA, 23 nt, Bordetella pertussis
ggccggcgcgaccgccuccagcg

SEQ ID NO: 2376622 - RNA, 13 nt, Bordetella pertussis
ggccggcgcgccg

SEQ ID NO: 2376623 - RNA, 16 nt, Bordetella pertussis
ggccggcgcgccggcc

SEQ ID NO: 2376624 - RNA, 19 nt, Bordetella pertussis
ggccggcgcgccggccugc

SEQ ID NO: 2376625 - RNA, 17 nt, Bordetella pertussis
ggccggcgcgccugccg

SEQ ID NO: 2376626 - RNA, 18 nt, Bordetella pertussis
ggccggcgcgccugccgu

SEQ ID NO: 2376627 - RNA, 14 nt, Bordetella pertussis
ggccggcgcgcgca

SEQ ID NO: 2376628 - RNA, 17 nt, Bordetella pertussis
ggccggcgcgcgcgacc

SEQ ID NO: 2376629 - RNA, 23 nt, Bordetella pertussis
ggccgucaauaucacgcguacgg

SEQ ID NO: 2376630 - RNA, 14 nt, Bordetella pertussis
ggccgucaccgccg

SEQ ID NO: 2376631 - RNA, 19 nt, Bordetella pertussis
ggccgucaccgccgccgcg

SEQ ID NO: 2376632 - RNA, 23 nt, Bordetella pertussis
ggccgucaccgccgccgcgccgc

SEQ ID NO: 2376633 - RNA, 18 nt, Bordetella pertussis
ggccgucagcagcaggcu

SEQ ID NO: 2376634 - RNA, 23 nt, Bordetella pertussis
ggccgucagcagcaggcuggcca

SEQ ID NO: 2376635 - RNA, 13 nt, Bordetella pertussis
ggccgucaggcgu

SEQ ID NO: 2376636 - RNA, 17 nt, Bordetella pertussis
ggccgucaugcgccguc

SEQ ID NO: 2376637 - RNA, 21 nt, Bordetella pertussis
ggccguccaaaacagacaggc

SEQ ID NO: 2376638 - RNA, 16 nt, Bordetella pertussis
ggccguccacgaaggc

SEQ ID NO: 2376639 - RNA, 20 nt, Bordetella pertussis
ggccguccacgaaggcagca

SEQ ID NO: 2376640 - RNA, 13 nt, Bordetella pertussis
ggccguccggccg

SEQ ID NO: 2376641 - RNA, 17 nt, Bordetella pertussis
ggccguccggccgugcc

SEQ ID NO: 2376642 - RNA, 18 nt, Bordetella pertussis
ggccgucgagcacggggc

SEQ ID NO: 2376643 - RNA, 14 nt, Bordetella pertussis
ggccgucgagccgg

SEQ ID NO: 2376644 - RNA, 17 nt, Bordetella pertussis
ggccgucgagccgggcg

SEQ ID NO: 2376645 - RNA, 18 nt, Bordetella pertussis
ggccgucgagccgggcgc

SEQ ID NO: 2376646 - RNA, 20 nt, Bordetella pertussis
ggccgucgagccgggcgccg

SEQ ID NO: 2376647 - RNA, 15 nt, Bordetella pertussis
ggccgucgccgccca

SEQ ID NO: 2376648 - RNA, 18 nt, Bordetella pertussis
ggccgucgccgcccaugc

SEQ ID NO: 2376649 - RNA, 20 nt, Bordetella pertussis
ggccgucgccgcccaugcgc

SEQ ID NO: 2376650 - RNA, 20 nt, Bordetella pertussis
ggccgucgccuucggcggcg

SEQ ID NO: 2376651 - RNA, 15 nt, Bordetella pertussis
ggccgucggccaggg

SEQ ID NO: 2376652 - RNA, 13 nt, Bordetella pertussis
ggccgucggggcc

SEQ ID NO: 2376653 - RNA, 14 nt, Bordetella pertussis
ggccgucggggccg

SEQ ID NO: 2376654 - RNA, 21 nt, Bordetella pertussis
ggccgucggugguggugacgu

SEQ ID NO: 2376655 - RNA, 20 nt, Bordetella pertussis
ggccgucgucaucgccaucg

SEQ ID NO: 2376656 - RNA, 14 nt, Bordetella pertussis
ggccgucgugcagc

SEQ ID NO: 2376657 - RNA, 19 nt, Bordetella pertussis
ggccgucgugcgccuggcg

SEQ ID NO: 2376658 - RNA, 16 nt, Bordetella pertussis
ggccgucuacaggccc

SEQ ID NO: 2376659 - RNA, 19 nt, Bordetella pertussis
ggccgucuacaggcccagc

SEQ ID NO: 2376660 - RNA, 23 nt, Bordetella pertussis
ggccgucuacaggcccagcgcca

SEQ ID NO: 2376661 - RNA, 16 nt, Bordetella pertussis
ggccgucugggcguga

SEQ ID NO: 2376662 - RNA, 15 nt, Bordetella pertussis
ggccgugacgugcuu

SEQ ID NO: 2376663 - RNA, 14 nt, Bordetella pertussis
ggccgugagcgccg

SEQ ID NO: 2376664 - RNA, 15 nt, Bordetella pertussis
ggccgugagcgccgc

SEQ ID NO: 2376665 - RNA, 16 nt, Bordetella pertussis
ggccgugagcgccgcc

SEQ ID NO: 2376666 - RNA, 22 nt, Bordetella pertussis
ggccgugaucuugaugccgccc

SEQ ID NO: 2376667 - RNA, 23 nt, Bordetella pertussis
ggccgugaucuugaugccgccca

SEQ ID NO: 2376668 - RNA, 15 nt, Bordetella pertussis
ggccgugccgcccgg

SEQ ID NO: 2376669 - RNA, 23 nt, Bordetella pertussis
ggccgugccucaacuggccggcc

SEQ ID NO: 2376670 - RNA, 20 nt, Bordetella pertussis
ggccgugcgaggcgaacagg

SEQ ID NO: 2376671 - RNA, 21 nt, Bordetella pertussis
ggccgugcgaggcgaacaggc

SEQ ID NO: 2376672 - RNA, 14 nt, Bordetella pertussis
ggccgugcgccagc

SEQ ID NO: 2376673 - RNA, 12 nt, Bordetella pertussis
ggccgugcgccc

SEQ ID NO: 2376674 - RNA, 16 nt, Bordetella pertussis
ggccgugcgcccgacg

SEQ ID NO: 2376675 - RNA, 17 nt, Bordetella pertussis
ggccgugcgccgggcgu

SEQ ID NO: 2376676 - RNA, 13 nt, Bordetella pertussis
ggccguggcccag

SEQ ID NO: 2376677 - RNA, 15 nt, Bordetella pertussis
ggccguggcccagcc

SEQ ID NO: 2376678 - RNA, 20 nt, Bordetella pertussis
ggccguggccgggcccggcg

SEQ ID NO: 2376679 - RNA, 17 nt, Bordetella pertussis
ggccguggcgcaccagg

SEQ ID NO: 2376680 - RNA, 13 nt, Bordetella pertussis
ggccguggcggcc

SEQ ID NO: 2376681 - RNA, 17 nt, Bordetella pertussis
ggccguggcggccugcg

SEQ ID NO: 2376682 - RNA, 20 nt, Bordetella pertussis
ggccguggcgugcaggccgg

SEQ ID NO: 2376683 - RNA, 21 nt, Bordetella pertussis
ggccguggcgugcaggccggc

SEQ ID NO: 2376684 - RNA, 21 nt, Bordetella pertussis
ggccguuaugguucggccucg

SEQ ID NO: 2376685 - RNA, 15 nt, Bordetella pertussis
ggccguuccagucca

SEQ ID NO: 2376686 - RNA, 19 nt, Bordetella pertussis
ggccguuccaguccagcgu

SEQ ID NO: 2376687 - RNA, 18 nt, Bordetella pertussis
ggccguucggugcgcagc

SEQ ID NO: 2376688 - RNA, 20 nt, Bordetella pertussis
ggccguucggugcgcagcgg

SEQ ID NO: 2376689 - RNA, 22 nt, Bordetella pertussis
ggccguucggugcgcagcggca

SEQ ID NO: 2376690 - RNA, 15 nt, Bordetella pertussis
ggccguugcgccugc

SEQ ID NO: 2376691 - RNA, 16 nt, Bordetella pertussis
ggccguugcgccugcc

SEQ ID NO: 2376692 - RNA, 14 nt, Bordetella pertussis
ggccguuggccagc

SEQ ID NO: 2376693 - RNA, 17 nt, Bordetella pertussis
ggccguuggccagcgcc

SEQ ID NO: 2376694 - RNA, 18 nt, Bordetella pertussis
ggccguuggccagcgccg

SEQ ID NO: 2376695 - RNA, 19 nt, Bordetella pertussis
ggccguuggccagcgccgc

SEQ ID NO: 2376696 - RNA, 23 nt, Bordetella pertussis
ggccguuggcgauggcgcggccg

SEQ ID NO: 2376697 - RNA, 21 nt, Bordetella pertussis
ggccguuggcgcgccuugcgc

SEQ ID NO: 2376698 - RNA, 15 nt, Bordetella pertussis
ggccguuggcgugca

SEQ ID NO: 2376699 - RNA, 18 nt, Bordetella pertussis
ggccguuggcgugcagcc

SEQ ID NO: 2376700 - RNA, 15 nt, Bordetella pertussis
ggccguuguccuggc

SEQ ID NO: 2376701 - RNA, 17 nt, Bordetella pertussis
ggccguuguccuggcgc

SEQ ID NO: 2376702 - RNA, 21 nt, Bordetella pertussis
ggccguuguccuggcgcgcca

SEQ ID NO: 2376703 - RNA, 23 nt, Bordetella pertussis
ggccguuguccuggcgcgccagg

SEQ ID NO: 2376704 - RNA, 16 nt, Bordetella pertussis
ggccguuuacucccca

SEQ ID NO: 2376705 - RNA, 20 nt, Bordetella pertussis
ggccguuuacuccccagacg

SEQ ID NO: 2376706 - RNA, 22 nt, Bordetella pertussis
ggccguuuccucuggagacggc

SEQ ID NO: 2376707 - RNA, 19 nt, Bordetella pertussis
ggccguuugccccucggcg

SEQ ID NO: 2376708 - RNA, 21 nt, Bordetella pertussis
ggccguuugccccucggcggg

SEQ ID NO: 2376709 - RNA, 17 nt, Bordetella pertussis
ggccuacugggccagau

SEQ ID NO: 2376710 - RNA, 16 nt, Bordetella pertussis
ggccuacuugccggcg

SEQ ID NO: 2376711 - RNA, 22 nt, Bordetella pertussis
ggccuacuugccggcgcucagc

SEQ ID NO: 2376712 - RNA, 13 nt, Bordetella pertussis
ggccuagcccggc

SEQ ID NO: 2376713 - RNA, 14 nt, Bordetella pertussis
ggccuagcccggcg

SEQ ID NO: 2376714 - RNA, 16 nt, Bordetella pertussis
ggccuagcccggcgcc

SEQ ID NO: 2376715 - RNA, 19 nt, Bordetella pertussis
ggccuagcccggcgccacc

SEQ ID NO: 2376716 - RNA, 19 nt, Bordetella pertussis
ggccuauuuggcggccugg

SEQ ID NO: 2376717 - RNA, 17 nt, Bordetella pertussis
ggccucaaccgcgcgua

SEQ ID NO: 2376718 - RNA, 18 nt, Bordetella pertussis
ggccucagcggccgcugc

SEQ ID NO: 2376719 - RNA, 13 nt, Bordetella pertussis
ggccucaucccga

SEQ ID NO: 2376720 - RNA, 17 nt, Bordetella pertussis
ggccucaucgagcgccu

SEQ ID NO: 2376721 - RNA, 22 nt, Bordetella pertussis
ggccucaucgagcgccugggcg

SEQ ID NO: 2376722 - RNA, 14 nt, Bordetella pertussis
ggccucaugacggg

SEQ ID NO: 2376723 - RNA, 17 nt, Bordetella pertussis
ggccucaugacggggcc

SEQ ID NO: 2376724 - RNA, 21 nt, Bordetella pertussis
ggccucaugacggggccuuca

SEQ ID NO: 2376725 - RNA, 12 nt, Bordetella pertussis
ggccuccagcag

SEQ ID NO: 2376726 - RNA, 13 nt, Bordetella pertussis
ggccuccgcgcac

SEQ ID NO: 2376727 - RNA, 16 nt, Bordetella pertussis
ggccuccgcgcacagc

SEQ ID NO: 2376728 - RNA, 22 nt, Bordetella pertussis
ggccuccgcgcacagcgcggcg

SEQ ID NO: 2376729 - RNA, 19 nt, Bordetella pertussis
ggccucgaagcccggcagg

SEQ ID NO: 2376730 - RNA, 18 nt, Bordetella pertussis
ggccucgacggccgccgg

SEQ ID NO: 2376731 - RNA, 21 nt, Bordetella pertussis
ggccucgacggggaaccccgc

SEQ ID NO: 2376732 - RNA, 17 nt, Bordetella pertussis
ggccucgaugaccgggu

SEQ ID NO: 2376733 - RNA, 22 nt, Bordetella pertussis
ggccucgcccgaucggccggcc

SEQ ID NO: 2376734 - RNA, 13 nt, Bordetella pertussis
ggccucgcgcagg

SEQ ID NO: 2376735 - RNA, 19 nt, Bordetella pertussis
ggccucgcgcagggcggcc

SEQ ID NO: 2376736 - RNA, 23 nt, Bordetella pertussis
ggccucgcgcagggcggccucga

SEQ ID NO: 2376737 - RNA, 12 nt, Bordetella pertussis
ggccucgcgcuc

SEQ ID NO: 2376738 - RNA, 14 nt, Bordetella pertussis
ggccucgcgcucgc

SEQ ID NO: 2376739 - RNA, 16 nt, Bordetella pertussis
ggccucgcgcucgcgc

SEQ ID NO: 2376740 - RNA, 20 nt, Bordetella pertussis
ggccucgcgcucgcgcucgg

SEQ ID NO: 2376741 - RNA, 19 nt, Bordetella pertussis
ggccugcuuggcgcgcagc

SEQ ID NO: 2376742 - RNA, 22 nt, Bordetella pertussis
ggccugcuuggcgcgcagcagc

SEQ ID NO: 2376743 - RNA, 17 nt, Bordetella pertussis
ggccuggaagcuggcca

SEQ ID NO: 2376744 - RNA, 19 nt, Bordetella pertussis
ggccuggaagcuggccagc

SEQ ID NO: 2376745 - RNA, 17 nt, Bordetella pertussis
ggccuggaugugcaggc

SEQ ID NO: 2376746 - RNA, 21 nt, Bordetella pertussis
ggccuggcagaugcgcgccag

SEQ ID NO: 2376747 - RNA, 14 nt, Bordetella pertussis
ggccuggcccagcu

SEQ ID NO: 2376748 - RNA, 17 nt, Bordetella pertussis
ggccuggcccagcucca

SEQ ID NO: 2376749 - RNA, 19 nt, Bordetella pertussis
ggccuggccccaggcgccc

SEQ ID NO: 2376750 - RNA, 14 nt, Bordetella pertussis
ggccuggccgccgg

SEQ ID NO: 2376751 - RNA, 15 nt, Bordetella pertussis
ggccuggccgccggc

SEQ ID NO: 2376752 - RNA, 20 nt, Bordetella pertussis
ggccuggccgccggcggcgc

SEQ ID NO: 2376753 - RNA, 13 nt, Bordetella pertussis
ggccuggccgggg

SEQ ID NO: 2376754 - RNA, 20 nt, Bordetella pertussis
ggccuggccggggaagccgc

SEQ ID NO: 2376755 - RNA, 16 nt, Bordetella pertussis
ggccuggccugcgccg

SEQ ID NO: 2376756 - RNA, 17 nt, Bordetella pertussis
ggccuggccugcgccgc

SEQ ID NO: 2376757 - RNA, 15 nt, Bordetella pertussis
ggccuggcgcgcauc

SEQ ID NO: 2376758 - RNA, 22 nt, Bordetella pertussis
ggccuggcgcgcaucggcgccg

SEQ ID NO: 2376759 - RNA, 14 nt, Bordetella pertussis
ggccuggcgcgcgg

SEQ ID NO: 2376760 - RNA, 16 nt, Bordetella pertussis
ggccuggcgcgcggcc

SEQ ID NO: 2376761 - RNA, 17 nt, Bordetella pertussis
ggccuggcgcgcggccu

SEQ ID NO: 2376762 - RNA, 15 nt, Bordetella pertussis
ggccuggcgcuccuc

SEQ ID NO: 2376763 - RNA, 18 nt, Bordetella pertussis
ggccuggcgcuccucgcg

SEQ ID NO: 2376764 - RNA, 20 nt, Bordetella pertussis
ggccuggcgcuccucgcgcg

SEQ ID NO: 2376765 - RNA, 22 nt, Bordetella pertussis
ggccuggcggaucucggccagc

SEQ ID NO: 2376766 - RNA, 22 nt, Bordetella pertussis
ggccuggcgguaugcggcgccc

SEQ ID NO: 2376767 - RNA, 19 nt, Bordetella pertussis
ggccuggcguucggcaccg

SEQ ID NO: 2376768 - RNA, 22 nt, Bordetella pertussis
ggccuggcucagucggccuggc

SEQ ID NO: 2376769 - RNA, 18 nt, Bordetella pertussis
ggccuggcuuggcggcca

SEQ ID NO: 2376770 - RNA, 13 nt, Bordetella pertussis
ggccugggaacgc

SEQ ID NO: 2376771 - RNA, 17 nt, Bordetella pertussis
ggccugggaggcgcuga

SEQ ID NO: 2376772 - RNA, 15 nt, Bordetella pertussis
ggccugggccauggc

SEQ ID NO: 2376773 - RNA, 15 nt, Bordetella pertussis
ggccugggccgacau

SEQ ID NO: 2376774 - RNA, 17 nt, Bordetella pertussis
ggccugggccgacaugc

SEQ ID NO: 2376775 - RNA, 13 nt, Bordetella pertussis
ggccugggcgcga

SEQ ID NO: 2376776 - RNA, 14 nt, Bordetella pertussis
ggccugggcggcgc

SEQ ID NO: 2376777 - RNA, 13 nt, Bordetella pertussis
ggccugggcgucg

SEQ ID NO: 2376778 - RNA, 18 nt, Bordetella pertussis
ggccuggguggccagcug

SEQ ID NO: 2376779 - RNA, 16 nt, Bordetella pertussis
ggccuggucagcgccg

SEQ ID NO: 2376780 - RNA, 18 nt, Bordetella pertussis
ggccuggucagcgccgac

SEQ ID NO: 2376781 - RNA, 20 nt, Bordetella pertussis
ggccuggucaugacgggcgg

SEQ ID NO: 2376782 - RNA, 16 nt, Bordetella pertussis
ggccugguccgccgcg

SEQ ID NO: 2376783 - RNA, 21 nt, Bordetella pertussis
ggccuggucgagcgggcgcca

SEQ ID NO: 2376784 - RNA, 20 nt, Bordetella pertussis
ggccuggucggggucggcca

SEQ ID NO: 2376785 - RNA, 22 nt, Bordetella pertussis
ggccuggugcccgacgccgcgc

SEQ ID NO: 2376786 - RNA, 17 nt, Bordetella pertussis
ggccugguuggccgccu

SEQ ID NO: 2376787 - RNA, 19 nt, Bordetella pertussis
ggccugguuggccgccugg

SEQ ID NO: 2376788 - RNA, 13 nt, Bordetella pertussis
ggccuguccggca

SEQ ID NO: 2376789 - RNA, 16 nt, Bordetella pertussis
ggccugucuguuugcg

SEQ ID NO: 2376790 - RNA, 22 nt, Bordetella pertussis
ggccugugcggcccaugucacg

SEQ ID NO: 2376791 - RNA, 15 nt, Bordetella pertussis
ggccuguucggacgc

SEQ ID NO: 2376792 - RNA, 22 nt, Bordetella pertussis
ggccuucaccccgccaccgccc

SEQ ID NO: 2376793 - RNA, 16 nt, Bordetella pertussis
ggccuucauggcgucg

SEQ ID NO: 2376794 - RNA, 23 nt, Bordetella pertussis
ggccuuccaaguugcucauggcg

SEQ ID NO: 2376795 - RNA, 15 nt, Bordetella pertussis
ggccuuccggcauca

SEQ ID NO: 2376796 - RNA, 15 nt, Bordetella pertussis
ggccuuccugcugac

SEQ ID NO: 2376797 - RNA, 17 nt, Bordetella pertussis
ggccuucgaccugcccg

SEQ ID NO: 2376798 - RNA, 18 nt, Bordetella pertussis
ggccuucgacguccagcc

SEQ ID NO: 2376799 - RNA, 22 nt, Bordetella pertussis
ggccuucgacguccagcccgug

SEQ ID NO: 2376800 - RNA, 20 nt, Bordetella pertussis
ggccuucgcgguaggacggc

SEQ ID NO: 2376801 - RNA, 16 nt, Bordetella pertussis
ggccuucgcugcccug

SEQ ID NO: 2376802 - RNA, 22 nt, Bordetella pertussis
ggccuucggcgaucugggccuc

SEQ ID NO: 2376803 - RNA, 16 nt, Bordetella pertussis
ggccuucggcggcgcg

SEQ ID NO: 2376804 - RNA, 19 nt, Bordetella pertussis
ggccuucguaaacaucgcg

SEQ ID NO: 2376805 - RNA, 16 nt, Bordetella pertussis
ggccuucugcgccagc

SEQ ID NO: 2376806 - RNA, 18 nt, Bordetella pertussis
ggccuucugcgccagcgg

SEQ ID NO: 2376807 - RNA, 21 nt, Bordetella pertussis
ggccuucuucacguagccggc

SEQ ID NO: 2376808 - RNA, 23 nt, Bordetella pertussis
ggccuucuucacguagccggcca

SEQ ID NO: 2376809 - RNA, 22 nt, Bordetella pertussis
ggccuugagcaucugcggcacg

SEQ ID NO: 2376810 - RNA, 13 nt, Bordetella pertussis
ggccuugccauug

SEQ ID NO: 2376811 - RNA, 15 nt, Bordetella pertussis
ggccuugccauuggu

SEQ ID NO: 2376812 - RNA, 23 nt, Bordetella pertussis
ggccuugccauuggucugugggc

SEQ ID NO: 2376813 - RNA, 21 nt, Bordetella pertussis
ggccuugcccaggcugggcca

SEQ ID NO: 2376814 - RNA, 19 nt, Bordetella pertussis
ggccuugcccuuggcggcc

SEQ ID NO: 2376815 - RNA, 13 nt, Bordetella pertussis
ggccuugccguug

SEQ ID NO: 2376816 - RNA, 15 nt, Bordetella pertussis
ggccuugcgcgucca

SEQ ID NO: 2376817 - RNA, 17 nt, Bordetella pertussis
ggccuugcgggccggcu

SEQ ID NO: 2376818 - RNA, 20 nt, Bordetella pertussis
ggccuugcucgcccauggca

SEQ ID NO: 2376819 - RNA, 23 nt, Bordetella pertussis
ggccuugcugcccgacggcgccg

SEQ ID NO: 2376820 - RNA, 19 nt, Bordetella pertussis
ggccuuggaguagccgcuc

SEQ ID NO: 2376821 - RNA, 13 nt, Bordetella pertussis
ggccuuggccagc

SEQ ID NO: 2376822 - RNA, 14 nt, Bordetella pertussis
ggccuuggccagca

SEQ ID NO: 2376823 - RNA, 15 nt, Bordetella pertussis
ggccuuggccagcag

SEQ ID NO: 2376824 - RNA, 13 nt, Bordetella pertussis
ggccuuggccgca

SEQ ID NO: 2376825 - RNA, 17 nt, Bordetella pertussis
ggccuuggccgcagccg

SEQ ID NO: 2376826 - RNA, 18 nt, Bordetella pertussis
ggccuuggccgcagccgg

SEQ ID NO: 2376827 - RNA, 14 nt, Bordetella pertussis
ggccuuggcggccc

SEQ ID NO: 2376828 - RNA, 14 nt, Bordetella pertussis
ggccuugggcgcgg

SEQ ID NO: 2376829 - RNA, 22 nt, Bordetella pertussis
ggccuugugcgccgucgcacug

SEQ ID NO: 2376830 - RNA, 20 nt, Bordetella pertussis
ggccuuuuccaggcgugccc

SEQ ID NO: 2376831 - RNA, 19 nt, Bordetella pertussis
ggccuuuuuuugcggcacg

SEQ ID NO: 2376832 - RNA, 20 nt, Bordetella pertussis
ggccuuuuuuugcggcacgg

SEQ ID NO: 2376833 - RNA, 16 nt, Bordetella pertussis
ggcgaaacggccagcg

SEQ ID NO: 2376834 - RNA, 16 nt, Bordetella pertussis
ggcgaaacuggccgac

SEQ ID NO: 2376835 - RNA, 18 nt, Bordetella pertussis
ggcgaaacuggccgacga

SEQ ID NO: 2376836 - RNA, 21 nt, Bordetella pertussis
ggcgaaauacaccuuguuggc

SEQ ID NO: 2376837 - RNA, 22 nt, Bordetella pertussis
ggcgaaauacaccuuguuggcg

SEQ ID NO: 2376838 - RNA, 19 nt, Bordetella pertussis
ggcgaacaccaggguggcg

SEQ ID NO: 2376839 - RNA, 14 nt, Bordetella pertussis
ggcgaacaggcaca

SEQ ID NO: 2376840 - RNA, 13 nt, Bordetella pertussis
ggcgaaccgcggc

SEQ ID NO: 2376841 - RNA, 14 nt, Bordetella pertussis
ggcgaaccgcggcg

SEQ ID NO: 2376842 - RNA, 16 nt, Bordetella pertussis
ggcgaaccgcucagcc

SEQ ID NO: 2376843 - RNA, 22 nt, Bordetella pertussis
ggcgaacgacagaccguagcgc

SEQ ID NO: 2376844 - RNA, 15 nt, Bordetella pertussis
ggcgaacgugcgcgc

SEQ ID NO: 2376845 - RNA, 16 nt, Bordetella pertussis
ggcgaacgugcgcgcc

SEQ ID NO: 2376846 - RNA, 18 nt, Bordetella pertussis
ggcgaacgugcgcgccag

SEQ ID NO: 2376847 - RNA, 17 nt, Bordetella pertussis
ggcgaacugggcgucgu

SEQ ID NO: 2376848 - RNA, 20 nt, Bordetella pertussis
ggcgaagaacaccgccgcgc

SEQ ID NO: 2376849 - RNA, 15 nt, Bordetella pertussis
ggcgaagaccgugau

SEQ ID NO: 2376850 - RNA, 16 nt, Bordetella pertussis
ggcgaagacgauggcg

SEQ ID NO: 2376851 - RNA, 20 nt, Bordetella pertussis
ggcgaagacgauggcgaucu

SEQ ID NO: 2376852 - RNA, 18 nt, Bordetella pertussis
ggcgaagccacggcccgc

SEQ ID NO: 2376853 - RNA, 20 nt, Bordetella pertussis
ggcgaagccgcagcggcagc

SEQ ID NO: 2376854 - RNA, 13 nt, Bordetella pertussis
ggcgagggcugcc

SEQ ID NO: 2376855 - RNA, 19 nt, Bordetella pertussis
ggcgagguagggcgcggcc

SEQ ID NO: 2376856 - RNA, 16 nt, Bordetella pertussis
ggcgaggucagcauga

SEQ ID NO: 2376857 - RNA, 16 nt, Bordetella pertussis
ggcgaggucagcccgg

SEQ ID NO: 2376858 - RNA, 18 nt, Bordetella pertussis
ggcgagguugcaggccag

SEQ ID NO: 2376859 - RNA, 18 nt, Bordetella pertussis
ggcgauagcgcuccagcg

SEQ ID NO: 2376860 - RNA, 17 nt, Bordetella pertussis
ggcgauauccagguagg

SEQ ID NO: 2376861 - RNA, 18 nt, Bordetella pertussis
ggcgauauccaucggcgc

SEQ ID NO: 2376862 - RNA, 22 nt, Bordetella pertussis
ggcgauauccaucggcgcgcgc

SEQ ID NO: 2376863 - RNA, 17 nt, Bordetella pertussis
ggcgauauggccagggu

SEQ ID NO: 2376864 - RNA, 21 nt, Bordetella pertussis
ggcgaucaacgugcgccaggc

SEQ ID NO: 2376865 - RNA, 22 nt, Bordetella pertussis
ggcgaucaccgacagcgccagc

SEQ ID NO: 2376866 - RNA, 21 nt, Bordetella pertussis
ggcgaucaccugcguggccgc

SEQ ID NO: 2376867 - RNA, 22 nt, Bordetella pertussis
ggcgaucacgccgaaggcguga

SEQ ID NO: 2376868 - RNA, 20 nt, Bordetella pertussis
ggcgaucacgccgucgagcu

SEQ ID NO: 2376869 - RNA, 18 nt, Bordetella pertussis
ggcgaucagcaccgcggc

SEQ ID NO: 2376870 - RNA, 22 nt, Bordetella pertussis
ggcgaucagcaccgcggcgggc

SEQ ID NO: 2376871 - RNA, 20 nt, Bordetella pertussis
ggcgaucaggaaaagcaggc

SEQ ID NO: 2376872 - RNA, 15 nt, Bordetella pertussis
ggcgaucaggccgcc

SEQ ID NO: 2376873 - RNA, 16 nt, Bordetella pertussis
ggcgaucaggccgccc

SEQ ID NO: 2376874 - RNA, 14 nt, Bordetella pertussis
ggcgauccaggcca

SEQ ID NO: 2376875 - RNA, 22 nt, Bordetella pertussis
ggcgauccaggccaccgcggcg

SEQ ID NO: 2376876 - RNA, 18 nt, Bordetella pertussis
ggcgauccagggccgcca

SEQ ID NO: 2376877 - RNA, 20 nt, Bordetella pertussis
ggcgauccagggccgccagc

SEQ ID NO: 2376878 - RNA, 16 nt, Bordetella pertussis
ggcgauccgccgcggc

SEQ ID NO: 2376879 - RNA, 18 nt, Bordetella pertussis
ggcgauccgccgcggcca

SEQ ID NO: 2376880 - RNA, 13 nt, Bordetella pertussis
ggcgaucgaacgc

SEQ ID NO: 2376881 - RNA, 19 nt, Bordetella pertussis
ggcgaucgaacgcggccag

SEQ ID NO: 2376882 - RNA, 22 nt, Bordetella pertussis
ggcgaucgccuguaucugcgcc

SEQ ID NO: 2376883 - RNA, 17 nt, Bordetella pertussis
ggcgaucggcccgggcg

SEQ ID NO: 2376884 - RNA, 18 nt, Bordetella pertussis
ggcgaucggcccgggcgu

SEQ ID NO: 2376885 - RNA, 13 nt, Bordetella pertussis
ggcgaucgucacc

SEQ ID NO: 2376886 - RNA, 21 nt, Bordetella pertussis
ggcgaucgucaccaucgccgc

SEQ ID NO: 2376887 - RNA, 20 nt, Bordetella pertussis
ggcgaucucgcgcgcgcggu

SEQ ID NO: 2376888 - RNA, 16 nt, Bordetella pertussis
ggcgaucucgucgacc

SEQ ID NO: 2376889 - RNA, 15 nt, Bordetella pertussis
ggcgaucugcgcggc

SEQ ID NO: 2376890 - RNA, 16 nt, Bordetella pertussis
ggcgaucuugccggcc

SEQ ID NO: 2376891 - RNA, 19 nt, Bordetella pertussis
ggcgaucuugccggccugg

SEQ ID NO: 2376892 - RNA, 20 nt, Bordetella pertussis
ggcgaucuugccggccuggc

SEQ ID NO: 2376893 - RNA, 22 nt, Bordetella pertussis
ggcgaugaacagcggcacgccg

SEQ ID NO: 2376894 - RNA, 22 nt, Bordetella pertussis
ggcgaugaagucgcggcccgcc

SEQ ID NO: 2376895 - RNA, 16 nt, Bordetella pertussis
ggcgaugaccggcaag

SEQ ID NO: 2376896 - RNA, 14 nt, Bordetella pertussis
ggcgaugaccucgg

SEQ ID NO: 2376897 - RNA, 14 nt, Bordetella pertussis
ggcgaugaucgccu

SEQ ID NO: 2376898 - RNA, 19 nt, Bordetella pertussis
ggcgaugauggggucgccg

SEQ ID NO: 2376899 - RNA, 20 nt, Bordetella pertussis
ggcgaugauggggucgccgg

SEQ ID NO: 2376900 - RNA, 19 nt, Bordetella pertussis
ggcgaugcauucggcggcc

SEQ ID NO: 2376901 - RNA, 20 nt, Bordetella pertussis
ggcgaugcauucggcggccg

SEQ ID NO: 2376902 - RNA, 21 nt, Bordetella pertussis
ggcgaugcccaccagccgccc

SEQ ID NO: 2376903 - RNA, 22 nt, Bordetella pertussis
ggcgaugcccaccagccgcccg

SEQ ID NO: 2376904 - RNA, 23 nt, Bordetella pertussis
ggcgaugcccaccagccgcccgg

SEQ ID NO: 2376905 - RNA, 12 nt, Bordetella pertussis
ggcgaugcccag

SEQ ID NO: 2376906 - RNA, 13 nt, Bordetella pertussis
ggcgaugcccagc

SEQ ID NO: 2376907 - RNA, 21 nt, Bordetella pertussis
ggcgaugcccagcgccgccga

SEQ ID NO: 2376908 - RNA, 21 nt, Bordetella pertussis
ggcgaugccccaguccaggcc

SEQ ID NO: 2376909 - RNA, 22 nt, Bordetella pertussis
ggcgaugccccgguagucgccg

SEQ ID NO: 2376910 - RNA, 14 nt, Bordetella pertussis
ggcgaugccgcaga

SEQ ID NO: 2376911 - RNA, 15 nt, Bordetella pertussis
ggcgaugccgcagau

SEQ ID NO: 2376912 - RNA, 14 nt, Bordetella pertussis
ggcgaugccggcca

SEQ ID NO: 2376913 - RNA, 15 nt, Bordetella pertussis
ggcgaugccggccag

SEQ ID NO: 2376914 - RNA, 16 nt, Bordetella pertussis
ggcgaugccggccagc

SEQ ID NO: 2376915 - RNA, 17 nt, Bordetella pertussis
ggcgaugccggccagca

SEQ ID NO: 2376916 - RNA, 21 nt, Bordetella pertussis
ggcgaugccggccagcagcga

SEQ ID NO: 2376917 - RNA, 16 nt, Bordetella pertussis
ggcgaugccguacuug

SEQ ID NO: 2376918 - RNA, 15 nt, Bordetella pertussis
ggcgaugcgccauac

SEQ ID NO: 2376919 - RNA, 15 nt, Bordetella pertussis
ggcgaugcgcgagcg

SEQ ID NO: 2376920 - RNA, 16 nt, Bordetella pertussis
ggcgaugcgcgagcgc

SEQ ID NO: 2376921 - RNA, 13 nt, Bordetella pertussis
ggcgaugcgcggg

SEQ ID NO: 2376922 - RNA, 22 nt, Bordetella pertussis
ggcgaugcggcggccgaagcgc

SEQ ID NO: 2376923 - RNA, 13 nt, Bordetella pertussis
ggcgaugcgggcc

SEQ ID NO: 2376924 - RNA, 14 nt, Bordetella pertussis
ggcgaugcgggcgg

SEQ ID NO: 2376925 - RNA, 16 nt, Bordetella pertussis
ggcgaugcgggcggcg

SEQ ID NO: 2376926 - RNA, 23 nt, Bordetella pertussis
ggcgaugcucacgcccaguccca

SEQ ID NO: 2376927 - RNA, 20 nt, Bordetella pertussis
ggcgaugcugccgucgccaa

SEQ ID NO: 2376928 - RNA, 15 nt, Bordetella pertussis
ggcgauggcaucggg

SEQ ID NO: 2376929 - RNA, 13 nt, Bordetella pertussis
ggcgauggcccgg

SEQ ID NO: 2376930 - RNA, 15 nt, Bordetella pertussis
ggcgauggcccggua

SEQ ID NO: 2376931 - RNA, 14 nt, Bordetella pertussis
ggcgauggccgcca

SEQ ID NO: 2376932 - RNA, 16 nt, Bordetella pertussis
ggcgauggccgccagc

SEQ ID NO: 2376933 - RNA, 17 nt, Bordetella pertussis
ggcgauggccgccagcg

SEQ ID NO: 2376934 - RNA, 21 nt, Bordetella pertussis
ggcgauggccgggagcggcca

SEQ ID NO: 2376935 - RNA, 13 nt, Bordetella pertussis
ggcgauggccuga

SEQ ID NO: 2376936 - RNA, 13 nt, Bordetella pertussis
ggcgauggcgcgc

SEQ ID NO: 2376937 - RNA, 16 nt, Bordetella pertussis
ggcgauggcgcggccg

SEQ ID NO: 2376938 - RNA, 16 nt, Bordetella pertussis
ggcgauggcgcgucgc

SEQ ID NO: 2376939 - RNA, 19 nt, Bordetella pertussis
ggcgauggcgcgucgccgc

SEQ ID NO: 2376940 - RNA, 20 nt, Bordetella pertussis
ggcgauggcgcgucgccgcg

SEQ ID NO: 2376941 - RNA, 14 nt, Bordetella pertussis
ggcgauggcguuga

SEQ ID NO: 2376942 - RNA, 14 nt, Bordetella pertussis
ggcgaugggcaccu

SEQ ID NO: 2376943 - RNA, 15 nt, Bordetella pertussis
ggcgaugggcaccug

SEQ ID NO: 2376944 - RNA, 16 nt, Bordetella pertussis
ggcgaugguggauccg

SEQ ID NO: 2376945 - RNA, 16 nt, Bordetella pertussis
ggcgauguaggccagg

SEQ ID NO: 2376946 - RNA, 14 nt, Bordetella pertussis
ggcgauguccagcg

SEQ ID NO: 2376947 - RNA, 22 nt, Bordetella pertussis
ggcgauguccugguugccgagg

SEQ ID NO: 2376948 - RNA, 23 nt, Bordetella pertussis
ggcgauguccugguugccgagga

SEQ ID NO: 2376949 - RNA, 18 nt, Bordetella pertussis
ggcgauguggcgcgccau

SEQ ID NO: 2376950 - RNA, 16 nt, Bordetella pertussis
ggcgauguugaagccg

SEQ ID NO: 2376951 - RNA, 23 nt, Bordetella pertussis
ggcgauuccgccaacucgcucca

SEQ ID NO: 2376952 - RNA, 16 nt, Bordetella pertussis
ggcgauugcgccagcg

SEQ ID NO: 2376953 - RNA, 15 nt, Bordetella pertussis
ggcgauugcucgaca

SEQ ID NO: 2376954 - RNA, 21 nt, Bordetella pertussis
ggcgauuucgucaucggugcg

SEQ ID NO: 2376955 - RNA, 13 nt, Bordetella pertussis
ggcgauuugccgc

SEQ ID NO: 2376956 - RNA, 17 nt, Bordetella pertussis
ggcgauuugccgcagcc

SEQ ID NO: 2376957 - RNA, 20 nt, Bordetella pertussis
ggcgauuugccgcagcccgc

SEQ ID NO: 2376958 - RNA, 18 nt, Bordetella pertussis
ggcgcaaaagcaacaacc

SEQ ID NO: 2376959 - RNA, 17 nt, Bordetella pertussis
ggcgcaaaccacgucgg

SEQ ID NO: 2376960 - RNA, 16 nt, Bordetella pertussis
ggcgcaacgccggccg

SEQ ID NO: 2376961 - RNA, 15 nt, Bordetella pertussis
ggcgcaacgggccga

SEQ ID NO: 2376962 - RNA, 18 nt, Bordetella pertussis
ggcgcaacgggccgagug

SEQ ID NO: 2376963 - RNA, 16 nt, Bordetella pertussis
ggcgcaacgucgaaca

SEQ ID NO: 2376964 - RNA, 23 nt, Bordetella pertussis
ggcgcaacgucgaacagcuucuc

SEQ ID NO: 2376965 - RNA, 13 nt, Bordetella pertussis
ggcgcaagccagc

SEQ ID NO: 2376966 - RNA, 14 nt, Bordetella pertussis
ggcgcaagccagca

SEQ ID NO: 2376967 - RNA, 16 nt, Bordetella pertussis
ggcgcaucgacagcgc

SEQ ID NO: 2376968 - RNA, 19 nt, Bordetella pertussis
ggcgcaucgacagcgcgcc

SEQ ID NO: 2376969 - RNA, 20 nt, Bordetella pertussis
ggcgcaucgacagcgcgccc

SEQ ID NO: 2376970 - RNA, 21 nt, Bordetella pertussis
ggcgcaucgacagcgcgcccg

SEQ ID NO: 2376971 - RNA, 17 nt, Bordetella pertussis
ggcgcaucggcgccagu

SEQ ID NO: 2376972 - RNA, 18 nt, Bordetella pertussis
ggcgcaucucgucgagga

SEQ ID NO: 2376973 - RNA, 15 nt, Bordetella pertussis
ggcgcaugacgaggu

SEQ ID NO: 2376974 - RNA, 21 nt, Bordetella pertussis
ggcgcaugacgaggugccugu

SEQ ID NO: 2376975 - RNA, 21 nt, Bordetella pertussis
ggcgcaugacggcgucgagca

SEQ ID NO: 2376976 - RNA, 16 nt, Bordetella pertussis
ggcgcaugagccggca

SEQ ID NO: 2376977 - RNA, 18 nt, Bordetella pertussis
ggcgcaugagccggcaga

SEQ ID NO: 2376978 - RNA, 17 nt, Bordetella pertussis
ggcgcaugauggccggc

SEQ ID NO: 2376979 - RNA, 21 nt, Bordetella pertussis
ggcgcaugauggccggccugc

SEQ ID NO: 2376980 - RNA, 15 nt, Bordetella pertussis
ggcgcaugcagccgc

SEQ ID NO: 2376981 - RNA, 22 nt, Bordetella pertussis
ggcgcaugcgcgcggcucgccg

SEQ ID NO: 2376982 - RNA, 21 nt, Bordetella pertussis
ggcgcaugcugcgcgaggugg

SEQ ID NO: 2376983 - RNA, 13 nt, Bordetella pertussis
ggcgcaugcugga

SEQ ID NO: 2376984 - RNA, 14 nt, Bordetella pertussis
ggcgcauucgccgg

SEQ ID NO: 2376985 - RNA, 14 nt, Bordetella pertussis
ggcgcauugccguc

SEQ ID NO: 2376986 - RNA, 17 nt, Bordetella pertussis
ggcgcauugccgucggc

SEQ ID NO: 2376987 - RNA, 20 nt, Bordetella pertussis
ggcgcauuggcccugcuggg

SEQ ID NO: 2376988 - RNA, 16 nt, Bordetella pertussis
ggcgccaaagcacagg

SEQ ID NO: 2376989 - RNA, 16 nt, Bordetella pertussis
ggcgccacagggccug

SEQ ID NO: 2376990 - RNA, 22 nt, Bordetella pertussis
ggcgccacaggugcgcggcgcg

SEQ ID NO: 2376991 - RNA, 18 nt, Bordetella pertussis
ggcgccaccuucgccgcg

SEQ ID NO: 2376992 - RNA, 22 nt, Bordetella pertussis
ggcgccaccuucgccgcgcaca

SEQ ID NO: 2376993 - RNA, 18 nt, Bordetella pertussis
ggcgccacggcuugcgcg

SEQ ID NO: 2376994 - RNA, 16 nt, Bordetella pertussis
ggcgccacugccaggc

SEQ ID NO: 2376995 - RNA, 20 nt, Bordetella pertussis
ggcgccacugccaggcgccc

SEQ ID NO: 2376996 - RNA, 17 nt, Bordetella pertussis
ggcgccagaugcgccgc

SEQ ID NO: 2376997 - RNA, 14 nt, Bordetella pertussis
ggcgccagcagcac

SEQ ID NO: 2376998 - RNA, 16 nt, Bordetella pertussis
ggcgccagcagcgggc

SEQ ID NO: 2376999 - RNA, 17 nt, Bordetella pertussis
ggcgccagcagcgggcu

SEQ ID NO: 2377000 - RNA, 20 nt, Bordetella pertussis
ggcgccagcagcgggcuggg

SEQ ID NO: 2377001 - RNA, 22 nt, Bordetella pertussis
ggcgccagcagcgggcuggggc

SEQ ID NO: 2377002 - RNA, 12 nt, Bordetella pertussis
ggcgccagcaug

SEQ ID NO: 2377003 - RNA, 19 nt, Bordetella pertussis
ggcgccagcaugcgcgcgg

SEQ ID NO: 2377004 - RNA, 21 nt, Bordetella pertussis
ggcgccagcaugcgcgcggcc

SEQ ID NO: 2377005 - RNA, 22 nt, Bordetella pertussis
ggcgccagcaugcgcgcggccu

SEQ ID NO: 2377006 - RNA, 13 nt, Bordetella pertussis
ggcgccagcccgc

SEQ ID NO: 2377007 - RNA, 19 nt, Bordetella pertussis
ggcgccagcccgcccgcga

SEQ ID NO: 2377008 - RNA, 14 nt, Bordetella pertussis
ggcgccagcgccgc

SEQ ID NO: 2377009 - RNA, 22 nt, Bordetella pertussis
ggcgccagcgccgcgucgagcg

SEQ ID NO: 2377010 - RNA, 12 nt, Bordetella pertussis
ggcgccagcugg

SEQ ID NO: 2377011 - RNA, 21 nt, Bordetella pertussis
ggcgccagcuggaccgccugg

SEQ ID NO: 2377012 - RNA, 22 nt, Bordetella pertussis
ggcgccagcugggcgaucuuca

SEQ ID NO: 2377013 - RNA, 17 nt, Bordetella pertussis
ggcgccaguagcgccgg

SEQ ID NO: 2377014 - RNA, 20 nt, Bordetella pertussis
ggcgccaguccccaugcggg

SEQ ID NO: 2377015 - RNA, 11 nt, Bordetella pertussis
ggcgccaugac

SEQ ID NO: 2377016 - RNA, 19 nt, Bordetella pertussis
ggcgccaugaucgccggca

SEQ ID NO: 2377017 - RNA, 19 nt, Bordetella pertussis
ggcgccaugcgacagcccg

SEQ ID NO: 2377018 - RNA, 21 nt, Bordetella pertussis
ggcgccaugcgacagcccggg

SEQ ID NO: 2377019 - RNA, 19 nt, Bordetella pertussis
ggcgccaugcgcaccaccg

SEQ ID NO: 2377020 - RNA, 17 nt, Bordetella pertussis
ggcgccaugcgcccggc

SEQ ID NO: 2377021 - RNA, 21 nt, Bordetella pertussis
ggcgcccaacccaggucgccg

SEQ ID NO: 2377022 - RNA, 13 nt, Bordetella pertussis
ggcgcccacgccg

SEQ ID NO: 2377023 - RNA, 13 nt, Bordetella pertussis
ggcgcccacggcc

SEQ ID NO: 2377024 - RNA, 19 nt, Bordetella pertussis
ggcgcccacggccgcaugc

SEQ ID NO: 2377025 - RNA, 14 nt, Bordetella pertussis
ggcgcccagcgcca

SEQ ID NO: 2377026 - RNA, 14 nt, Bordetella pertussis
ggcgcccagcgcgu

SEQ ID NO: 2377027 - RNA, 21 nt, Bordetella pertussis
ggcgcccagcgcgucggccag

SEQ ID NO: 2377028 - RNA, 17 nt, Bordetella pertussis
ggcgcccagcuccaccc

SEQ ID NO: 2377029 - RNA, 15 nt, Bordetella pertussis
ggcgcccagcugcuu

SEQ ID NO: 2377030 - RNA, 14 nt, Bordetella pertussis
ggcgcccagcuggc

SEQ ID NO: 2377031 - RNA, 23 nt, Bordetella pertussis
ggcgcccagguacaucaucccca

SEQ ID NO: 2377032 - RNA, 20 nt, Bordetella pertussis
ggcgcccaucgcggucaucg

SEQ ID NO: 2377033 - RNA, 14 nt, Bordetella pertussis
ggcgcccauuccga

SEQ ID NO: 2377034 - RNA, 23 nt, Bordetella pertussis
ggcgcccauuccgagcgggcccg

SEQ ID NO: 2377035 - RNA, 21 nt, Bordetella pertussis
ggcgccccaacgcggccagcg

SEQ ID NO: 2377036 - RNA, 18 nt, Bordetella pertussis
ggcgccccacccggguac

SEQ ID NO: 2377037 - RNA, 19 nt, Bordetella pertussis
ggcgccccaggcgucggcg

SEQ ID NO: 2377038 - RNA, 13 nt, Bordetella pertussis
ggcgcccccagca

SEQ ID NO: 2377039 - RNA, 15 nt, Bordetella pertussis
ggcgcccccgcggcg

SEQ ID NO: 2377040 - RNA, 18 nt, Bordetella pertussis
ggcgccccgaucggcgcc

SEQ ID NO: 2377041 - RNA, 21 nt, Bordetella pertussis
ggcgccccgaucggcgccgcg

SEQ ID NO: 2377042 - RNA, 22 nt, Bordetella pertussis
ggcgccccgaucggcgccgcgc

SEQ ID NO: 2377043 - RNA, 17 nt, Bordetella pertussis
ggcgccccgugccaugg

SEQ ID NO: 2377044 - RNA, 16 nt, Bordetella pertussis
ggcgcccgacggcgcg

SEQ ID NO: 2377045 - RNA, 17 nt, Bordetella pertussis
ggcgcccgacggcgcgc

SEQ ID NO: 2377046 - RNA, 22 nt, Bordetella pertussis
ggcgcccgacggcgcgcccgcc

SEQ ID NO: 2377047 - RNA, 13 nt, Bordetella pertussis
ggcgcccgcaugg

SEQ ID NO: 2377048 - RNA, 12 nt, Bordetella pertussis
ggcgcccgccac

SEQ ID NO: 2377049 - RNA, 12 nt, Bordetella pertussis
ggcgcccgccgc

SEQ ID NO: 2377050 - RNA, 21 nt, Bordetella pertussis
ggcgcccgccgccgggcgcgc

SEQ ID NO: 2377051 - RNA, 16 nt, Bordetella pertussis
ggcgcccgccugcgcc

SEQ ID NO: 2377052 - RNA, 19 nt, Bordetella pertussis
ggcgcccgccugcgccagc

SEQ ID NO: 2377053 - RNA, 17 nt, Bordetella pertussis
ggcgcccgccugcgugg

SEQ ID NO: 2377054 - RNA, 21 nt, Bordetella pertussis
ggcgcccgccugcguggcggg

SEQ ID NO: 2377055 - RNA, 15 nt, Bordetella pertussis
ggcgcccgcgcaugc

SEQ ID NO: 2377056 - RNA, 17 nt, Bordetella pertussis
ggcgcccgcgcgcgagc

SEQ ID NO: 2377057 - RNA, 22 nt, Bordetella pertussis
ggcgcccgcgcgcgagcugcgc

SEQ ID NO: 2377058 - RNA, 16 nt, Bordetella pertussis
ggcgcccgcggccugc

SEQ ID NO: 2377059 - RNA, 13 nt, Bordetella pertussis
ggcgcccggccgg

SEQ ID NO: 2377060 - RNA, 16 nt, Bordetella pertussis
ggcgcccggccggccu

SEQ ID NO: 2377061 - RNA, 13 nt, Bordetella pertussis
ggcgcccggccug

SEQ ID NO: 2377062 - RNA, 12 nt, Bordetella pertussis
ggcgcccggcgg

SEQ ID NO: 2377063 - RNA, 13 nt, Bordetella pertussis
ggcgcccggcggc

SEQ ID NO: 2377064 - RNA, 14 nt, Bordetella pertussis
ggcgcccggcggcg

SEQ ID NO: 2377065 - RNA, 15 nt, Bordetella pertussis
ggcgcccggcgugac

SEQ ID NO: 2377066 - RNA, 17 nt, Bordetella pertussis
ggcgcccggcgugacgc

SEQ ID NO: 2377067 - RNA, 14 nt, Bordetella pertussis
ggcgcccgggcugc

SEQ ID NO: 2377068 - RNA, 17 nt, Bordetella pertussis
ggcgcccggugcgcgca

SEQ ID NO: 2377069 - RNA, 13 nt, Bordetella pertussis
ggcgcccgugcgc

SEQ ID NO: 2377070 - RNA, 22 nt, Bordetella pertussis
ggcgcccuugaugccgucggcg

SEQ ID NO: 2377071 - RNA, 16 nt, Bordetella pertussis
ggcgccgaaggcggcg

SEQ ID NO: 2377072 - RNA, 17 nt, Bordetella pertussis
ggcgccgaaggcggcgc

SEQ ID NO: 2377073 - RNA, 18 nt, Bordetella pertussis
ggcgccgaaggcggcgcc

SEQ ID NO: 2377074 - RNA, 19 nt, Bordetella pertussis
ggcgccgaaggcggcgccg

SEQ ID NO: 2377075 - RNA, 18 nt, Bordetella pertussis
ggcgccgacaacggcgug

SEQ ID NO: 2377076 - RNA, 16 nt, Bordetella pertussis
ggcgccgacccugccc

SEQ ID NO: 2377077 - RNA, 17 nt, Bordetella pertussis
ggcgccgacccugcccg

SEQ ID NO: 2377078 - RNA, 15 nt, Bordetella pertussis
ggcgccgaccgggcc

SEQ ID NO: 2377079 - RNA, 20 nt, Bordetella pertussis
ggcgccgaccgggccgacca

SEQ ID NO: 2377080 - RNA, 23 nt, Bordetella pertussis
ggcgccggguggguucgggcguu

SEQ ID NO: 2377081 - RNA, 17 nt, Bordetella pertussis
ggcgccgguccagcgcc

SEQ ID NO: 2377082 - RNA, 20 nt, Bordetella pertussis
ggcgccggucugggcgcgga

SEQ ID NO: 2377083 - RNA, 19 nt, Bordetella pertussis
ggcgccggugaccgccagc

SEQ ID NO: 2377084 - RNA, 17 nt, Bordetella pertussis
ggcgccggugcgcggcg

SEQ ID NO: 2377085 - RNA, 19 nt, Bordetella pertussis
ggcgccggugcgcggcgcc

SEQ ID NO: 2377086 - RNA, 17 nt, Bordetella pertussis
ggcgccguccagcgcgg

SEQ ID NO: 2377087 - RNA, 19 nt, Bordetella pertussis
ggcgccgucgaagccggcg

SEQ ID NO: 2377088 - RNA, 22 nt, Bordetella pertussis
ggcgccgucuucgguggcccgc

SEQ ID NO: 2377089 - RNA, 23 nt, Bordetella pertussis
ggcgccgugaaugcgccuggcgu

SEQ ID NO: 2377090 - RNA, 19 nt, Bordetella pertussis
ggcgccgugcccgacggac

SEQ ID NO: 2377091 - RNA, 15 nt, Bordetella pertussis
ggcgccgugcuggag

SEQ ID NO: 2377092 - RNA, 18 nt, Bordetella pertussis
ggcgccguguuguccugg

SEQ ID NO: 2377093 - RNA, 14 nt, Bordetella pertussis
ggcgccguucgucg

SEQ ID NO: 2377094 - RNA, 20 nt, Bordetella pertussis
ggcgccguucgucgcgcagc

SEQ ID NO: 2377095 - RNA, 18 nt, Bordetella pertussis
ggcgccuacacgguggcg

SEQ ID NO: 2377096 - RNA, 21 nt, Bordetella pertussis
ggcgccuacacgguggcggug

SEQ ID NO: 2377097 - RNA, 16 nt, Bordetella pertussis
ggcgccuacggcggcg

SEQ ID NO: 2377098 - RNA, 16 nt, Bordetella pertussis
ggcgccucgcgacggc

SEQ ID NO: 2377099 - RNA, 15 nt, Bordetella pertussis
ggcgccugagccgau

SEQ ID NO: 2377100 - RNA, 14 nt, Bordetella pertussis
ggcgccugcaagau

SEQ ID NO: 2377101 - RNA, 18 nt, Bordetella pertussis
ggcgccugccccggcaga

SEQ ID NO: 2377102 - RNA, 14 nt, Bordetella pertussis
ggcgccugcccugc

SEQ ID NO: 2377103 - RNA, 12 nt, Bordetella pertussis
ggcgccugcgcc

SEQ ID NO: 2377104 - RNA, 20 nt, Bordetella pertussis
ggcgccugcgccaccuggcg

SEQ ID NO: 2377105 - RNA, 22 nt, Bordetella pertussis
ggcgccugcgccaccuggcgcc

SEQ ID NO: 2377106 - RNA, 24 nt, Bordetella pertussis
ggcgccugcgccaccuggcgcccg

SEQ ID NO: 2377107 - RNA, 19 nt, Bordetella pertussis
ggcgccugcgcgcgcuggg

SEQ ID NO: 2377108 - RNA, 15 nt, Bordetella pertussis
ggcgccugcggcagg

SEQ ID NO: 2377109 - RNA, 20 nt, Bordetella pertussis
ggcgccugcggcaggccgca

SEQ ID NO: 2377110 - RNA, 19 nt, Bordetella pertussis
ggcgccugcggcauggugu

SEQ ID NO: 2377111 - RNA, 14 nt, Bordetella pertussis
ggcgccugcggggc

SEQ ID NO: 2377112 - RNA, 16 nt, Bordetella pertussis
ggcgccugcggggccg

SEQ ID NO: 2377113 - RNA, 18 nt, Bordetella pertussis
ggcgccugcggggccgcu

SEQ ID NO: 2377114 - RNA, 17 nt, Bordetella pertussis
ggcgccugcgucguugc

SEQ ID NO: 2377115 - RNA, 22 nt, Bordetella pertussis
ggcgccugcucacgccccgccc

SEQ ID NO: 2377116 - RNA, 12 nt, Bordetella pertussis
ggcgccuggccg

SEQ ID NO: 2377117 - RNA, 14 nt, Bordetella pertussis
ggcgccuggccgcc

SEQ ID NO: 2377118 - RNA, 15 nt, Bordetella pertussis
ggcgccuggccgccc

SEQ ID NO: 2377119 - RNA, 18 nt, Bordetella pertussis
ggcgccuggccgcccagc

SEQ ID NO: 2377120 - RNA, 24 nt, Bordetella pertussis
ggcgccuggccgcccagcgccugc

SEQ ID NO: 2377121 - RNA, 13 nt, Bordetella pertussis
ggcgccuggggcg

SEQ ID NO: 2377122 - RNA, 22 nt, Bordetella pertussis
ggcgccuggggcgggcgggcgc

SEQ ID NO: 2377123 - RNA, 14 nt, Bordetella pertussis
ggcgccuggggcgu

SEQ ID NO: 2377124 - RNA, 19 nt, Bordetella pertussis
ggcgccuggggcgugcccu

SEQ ID NO: 2377125 - RNA, 22 nt, Bordetella pertussis
ggcgccugguacgacagcucgg

SEQ ID NO: 2377126 - RNA, 14 nt, Bordetella pertussis
ggcgccuggucgcg

SEQ ID NO: 2377127 - RNA, 19 nt, Bordetella pertussis
ggcgccuggucgcgcgccu

SEQ ID NO: 2377128 - RNA, 21 nt, Bordetella pertussis
ggcgccuggucgcgcgccugc

SEQ ID NO: 2377129 - RNA, 21 nt, Bordetella pertussis
ggcgccuguccccgcugcggc

SEQ ID NO: 2377130 - RNA, 22 nt, Bordetella pertussis
ggcgccugucccgcugggggcg

SEQ ID NO: 2377131 - RNA, 15 nt, Bordetella pertussis
ggcgccuuccggcag

SEQ ID NO: 2377132 - RNA, 17 nt, Bordetella pertussis
ggcgccuuccggcagcg

SEQ ID NO: 2377133 - RNA, 20 nt, Bordetella pertussis
ggcgccuuccggcagcggcc

SEQ ID NO: 2377134 - RNA, 14 nt, Bordetella pertussis
ggcgccuucgaucu

SEQ ID NO: 2377135 - RNA, 22 nt, Bordetella pertussis
ggcgccuucggcgcggcgggcg

SEQ ID NO: 2377136 - RNA, 15 nt, Bordetella pertussis
ggcgccuugccgccg

SEQ ID NO: 2377137 - RNA, 18 nt, Bordetella pertussis
ggcgccuugccgccgcgc

SEQ ID NO: 2377138 - RNA, 19 nt, Bordetella pertussis
ggcgccuuucccgcgccga

SEQ ID NO: 2377139 - RNA, 22 nt, Bordetella pertussis
ggcgccuuucccgcgccgagcg

SEQ ID NO: 2377140 - RNA, 12 nt, Bordetella pertussis
ggcgcgaaacug

SEQ ID NO: 2377141 - RNA, 16 nt, Bordetella pertussis
ggcgcgaaacugcacu

SEQ ID NO: 2377142 - RNA, 20 nt, Bordetella pertussis
ggcgcgaacaccggcaggcc

SEQ ID NO: 2377143 - RNA, 20 nt, Bordetella pertussis
ggcgcgaaccccuccggcgu

SEQ ID NO: 2377144 - RNA, 22 nt, Bordetella pertussis
ggcgcgacagauagaacgaggu

SEQ ID NO: 2377145 - RNA, 20 nt, Bordetella pertussis
ggcgcgacaggcggugcgcg

SEQ ID NO: 2377146 - RNA, 22 nt, Bordetella pertussis
ggcgcgaccgccuccagcgcgg

SEQ ID NO: 2377147 - RNA, 15 nt, Bordetella pertussis
ggcgcgaccugcgcg

SEQ ID NO: 2377148 - RNA, 15 nt, Bordetella pertussis
ggcgcgacgcgcuug

SEQ ID NO: 2377149 - RNA, 17 nt, Bordetella pertussis
ggcgcgagcgaugcccu

SEQ ID NO: 2377150 - RNA, 12 nt, Bordetella pertussis
ggcgcgagcgca

SEQ ID NO: 2377151 - RNA, 14 nt, Bordetella pertussis
ggcgcgagcgccgg

SEQ ID NO: 2377152 - RNA, 19 nt, Bordetella pertussis
ggcgcgagcgccgggcgcc

SEQ ID NO: 2377153 - RNA, 21 nt, Bordetella pertussis
ggcgcgagcgccgggcgccgc

SEQ ID NO: 2377154 - RNA, 14 nt, Bordetella pertussis
ggcgcgaggcggcg

SEQ ID NO: 2377155 - RNA, 17 nt, Bordetella pertussis
ggcgcgaggcggcgacg

SEQ ID NO: 2377156 - RNA, 21 nt, Bordetella pertussis
ggcgcgaggcggcgacgcagc

SEQ ID NO: 2377157 - RNA, 20 nt, Bordetella pertussis
ggcgcgagguggcgcucgcg

SEQ ID NO: 2377158 - RNA, 21 nt, Bordetella pertussis
ggcgcgaguauucacgccgcg

SEQ ID NO: 2377159 - RNA, 13 nt, Bordetella pertussis
ggcgcgauagcgc

SEQ ID NO: 2377160 - RNA, 17 nt, Bordetella pertussis
ggcgcgauagcgcuugc

SEQ ID NO: 2377161 - RNA, 22 nt, Bordetella pertussis
ggcgcgauagcgcuugccugac

SEQ ID NO: 2377162 - RNA, 14 nt, Bordetella pertussis
ggcgcgaugggccu

SEQ ID NO: 2377163 - RNA, 18 nt, Bordetella pertussis
ggcgcgaugggccugccc

SEQ ID NO: 2377164 - RNA, 19 nt, Bordetella pertussis
ggcgcgaugggccugccca

SEQ ID NO: 2377165 - RNA, 22 nt, Bordetella pertussis
ggcgcgaugggccugcccaugg

SEQ ID NO: 2377166 - RNA, 19 nt, Bordetella pertussis
ggcgcgaugugacggcucg

SEQ ID NO: 2377167 - RNA, 20 nt, Bordetella pertussis
ggcgcgauguucggaugcgc

SEQ ID NO: 2377168 - RNA, 21 nt, Bordetella pertussis
ggcgcgcaaaccgacgcggcc

SEQ ID NO: 2377169 - RNA, 23 nt, Bordetella pertussis
ggcgcgcaaaccgacgcggccag

SEQ ID NO: 2377170 - RNA, 24 nt, Bordetella pertussis
ggcgcgcaaaccgacgcggccagc

SEQ ID NO: 2377171 - RNA, 23 nt, Bordetella pertussis
ggcgcgcaacacgcgcgacgccg

SEQ ID NO: 2377172 - RNA, 20 nt, Bordetella pertussis
ggcgcgcaaccaggggcggc

SEQ ID NO: 2377173 - RNA, 18 nt, Bordetella pertussis
ggcgcgcacacuggccag

SEQ ID NO: 2377174 - RNA, 14 nt, Bordetella pertussis
ggcgcgcaccagcc

SEQ ID NO: 2377175 - RNA, 17 nt, Bordetella pertussis
ggcgcgcaccagcccgc

SEQ ID NO: 2377176 - RNA, 14 nt, Bordetella pertussis
ggcgcgcaccaucg

SEQ ID NO: 2377177 - RNA, 18 nt, Bordetella pertussis
ggcgcgcaccaucgccga

SEQ ID NO: 2377178 - RNA, 21 nt, Bordetella pertussis
ggcgcgcaccaucgccgagcc

SEQ ID NO: 2377179 - RNA, 14 nt, Bordetella pertussis
ggcgcgcaccaugg

SEQ ID NO: 2377180 - RNA, 11 nt, Bordetella pertussis
ggcgcgcaccu

SEQ ID NO: 2377181 - RNA, 12 nt, Bordetella pertussis
ggcgcgcacgcu

SEQ ID NO: 2377182 - RNA, 16 nt, Bordetella pertussis
ggcgcgcacgcucugc

SEQ ID NO: 2377183 - RNA, 13 nt, Bordetella pertussis
ggcgcgcacgggc

SEQ ID NO: 2377184 - RNA, 16 nt, Bordetella pertussis
ggcgcgcacgggcgag

SEQ ID NO: 2377185 - RNA, 18 nt, Bordetella pertussis
ggcgcgcacgggcgaggc

SEQ ID NO: 2377186 - RNA, 11 nt, Bordetella pertussis
ggcgcgcagca

SEQ ID NO: 2377187 - RNA, 14 nt, Bordetella pertussis
ggcgcgcagcacau

SEQ ID NO: 2377188 - RNA, 14 nt, Bordetella pertussis
ggcgcgcagcacgc

SEQ ID NO: 2377189 - RNA, 17 nt, Bordetella pertussis
ggcgcgcagcacgccga

SEQ ID NO: 2377190 - RNA, 21 nt, Bordetella pertussis
ggcgcgcagcacgccgaucgc

SEQ ID NO: 2377191 - RNA, 12 nt, Bordetella pertussis
ggcgcgcagcag

SEQ ID NO: 2377192 - RNA, 20 nt, Bordetella pertussis
ggcgcgcgcggcgccgcgcg

SEQ ID NO: 2377193 - RNA, 18 nt, Bordetella pertussis
ggcgcgcgcggcgccugg

SEQ ID NO: 2377194 - RNA, 22 nt, Bordetella pertussis
ggcgcgcgcggcgccuggggcg

SEQ ID NO: 2377195 - RNA, 16 nt, Bordetella pertussis
ggcgcgcgcggucggu

SEQ ID NO: 2377196 - RNA, 19 nt, Bordetella pertussis
ggcgcgcgcguacagccgg

SEQ ID NO: 2377197 - RNA, 22 nt, Bordetella pertussis
ggcgcgcgcguucguggauggg

SEQ ID NO: 2377198 - RNA, 22 nt, Bordetella pertussis
ggcgcgcggaugaucgcgcagc

SEQ ID NO: 2377199 - RNA, 14 nt, Bordetella pertussis
ggcgcgcggccgcg

SEQ ID NO: 2377200 - RNA, 15 nt, Bordetella pertussis
ggcgcgcggccucga

SEQ ID NO: 2377201 - RNA, 17 nt, Bordetella pertussis
ggcgcgcggccugggcg

SEQ ID NO: 2377202 - RNA, 22 nt, Bordetella pertussis
ggcgcgcggcgcgccagcgcgg

SEQ ID NO: 2377203 - RNA, 14 nt, Bordetella pertussis
ggcgcgcggcuggg

SEQ ID NO: 2377204 - RNA, 16 nt, Bordetella pertussis
ggcgcgcggcuggggc

SEQ ID NO: 2377205 - RNA, 21 nt, Bordetella pertussis
ggcgcgcgguggcacgacgcg

SEQ ID NO: 2377206 - RNA, 21 nt, Bordetella pertussis
ggcgcgcgugcugggccaugc

SEQ ID NO: 2377207 - RNA, 18 nt, Bordetella pertussis
ggcgcgcucaggccgccg

SEQ ID NO: 2377208 - RNA, 19 nt, Bordetella pertussis
ggcgcgcucaggccgccgg

SEQ ID NO: 2377209 - RNA, 14 nt, Bordetella pertussis
ggcgcgcuccagca

SEQ ID NO: 2377210 - RNA, 16 nt, Bordetella pertussis
ggcgcgcuccagcaug

SEQ ID NO: 2377211 - RNA, 13 nt, Bordetella pertussis
ggcgcgcucgcug

SEQ ID NO: 2377212 - RNA, 19 nt, Bordetella pertussis
ggcgcgcucgcugccggcg

SEQ ID NO: 2377213 - RNA, 15 nt, Bordetella pertussis
ggcgcgcucggcgcc

SEQ ID NO: 2377214 - RNA, 21 nt, Bordetella pertussis
ggcgcgcucggcgccgggcug

SEQ ID NO: 2377215 - RNA, 22 nt, Bordetella pertussis
ggcgcgcucuccgaacaggcgg

SEQ ID NO: 2377216 - RNA, 15 nt, Bordetella pertussis
ggcgcgcugcccagc

SEQ ID NO: 2377217 - RNA, 17 nt, Bordetella pertussis
ggcgcgcugcccagcca

SEQ ID NO: 2377218 - RNA, 18 nt, Bordetella pertussis
ggcgcgcuugagcggcuc

SEQ ID NO: 2377219 - RNA, 19 nt, Bordetella pertussis
ggcgcgcuugagcggcucg

SEQ ID NO: 2377220 - RNA, 17 nt, Bordetella pertussis
ggcgcgcuuggucagca

SEQ ID NO: 2377221 - RNA, 19 nt, Bordetella pertussis
ggcgcggaccugcucgagc

SEQ ID NO: 2377222 - RNA, 20 nt, Bordetella pertussis
ggcgcggaccugcucgagcg

SEQ ID NO: 2377223 - RNA, 13 nt, Bordetella pertussis
ggcgcggaucaug

SEQ ID NO: 2377224 - RNA, 22 nt, Bordetella pertussis
ggcgcggaucaugggcucgcgc

SEQ ID NO: 2377225 - RNA, 23 nt, Bordetella pertussis
ggcgcggaucaugggcucgcgcg

SEQ ID NO: 2377226 - RNA, 20 nt, Bordetella pertussis
ggcgcggaucgaacccaugc

SEQ ID NO: 2377227 - RNA, 19 nt, Bordetella pertussis
ggcgcggaugaccugcgcc

SEQ ID NO: 2377228 - RNA, 22 nt, Bordetella pertussis
ggcgcggaugccguccacgccg

SEQ ID NO: 2377229 - RNA, 22 nt, Bordetella pertussis
ggcgcggauugaugucgcgcac

SEQ ID NO: 2377230 - RNA, 24 nt, Bordetella pertussis
ggcgcggauugaugucgcgcaccg

SEQ ID NO: 2377231 - RNA, 15 nt, Bordetella pertussis
ggcgcggcagugggc

SEQ ID NO: 2377232 - RNA, 17 nt, Bordetella pertussis
ggcgcggcauggcgccg

SEQ ID NO: 2377233 - RNA, 21 nt, Bordetella pertussis
ggcgcggccaaccccgagggc

SEQ ID NO: 2377234 - RNA, 12 nt, Bordetella pertussis
ggcgcggccagc

SEQ ID NO: 2377235 - RNA, 13 nt, Bordetella pertussis
ggcgcggccagca

SEQ ID NO: 2377236 - RNA, 15 nt, Bordetella pertussis
ggcgcggccagcacg

SEQ ID NO: 2377237 - RNA, 15 nt, Bordetella pertussis
ggcgcggccagcagc

SEQ ID NO: 2377238 - RNA, 16 nt, Bordetella pertussis
ggcgcggccagcagcg

SEQ ID NO: 2377239 - RNA, 17 nt, Bordetella pertussis
ggcgcggccagcagcgc

SEQ ID NO: 2377240 - RNA, 15 nt, Bordetella pertussis
ggcgcggccaggcgc

SEQ ID NO: 2377241 - RNA, 18 nt, Bordetella pertussis
ggcgcggccaggcgcuca

SEQ ID NO: 2377242 - RNA, 22 nt, Bordetella pertussis
ggcgcggccccaugcgcggcac

SEQ ID NO: 2377243 - RNA, 15 nt, Bordetella pertussis
ggcgcggcccgccac

SEQ ID NO: 2377244 - RNA, 17 nt, Bordetella pertussis
ggcgcggcccgccacgc

SEQ ID NO: 2377245 - RNA, 21 nt, Bordetella pertussis
ggcgcggcccgccacgcaggc

SEQ ID NO: 2377246 - RNA, 15 nt, Bordetella pertussis
ggcgcggcccggcgu

SEQ ID NO: 2377247 - RNA, 17 nt, Bordetella pertussis
ggcgcggcccggcgucg

SEQ ID NO: 2377248 - RNA, 12 nt, Bordetella pertussis
ggcgcggccgac

SEQ ID NO: 2377249 - RNA, 13 nt, Bordetella pertussis
ggcgcggccgacg

SEQ ID NO: 2377250 - RNA, 14 nt, Bordetella pertussis
ggcgcggccgccgc

SEQ ID NO: 2377251 - RNA, 22 nt, Bordetella pertussis
ggcgcggccggaggccgcccac

SEQ ID NO: 2377252 - RNA, 13 nt, Bordetella pertussis
ggcgcggccgggc

SEQ ID NO: 2377253 - RNA, 14 nt, Bordetella pertussis
ggcgcggccgggcu

SEQ ID NO: 2377254 - RNA, 12 nt, Bordetella pertussis
ggcgcggccggu

SEQ ID NO: 2377255 - RNA, 13 nt, Bordetella pertussis
ggcgcggcgagca

SEQ ID NO: 2377256 - RNA, 17 nt, Bordetella pertussis
ggcgcggcgagcacggc

SEQ ID NO: 2377257 - RNA, 19 nt, Bordetella pertussis
ggcgcggcgauugcggccc

SEQ ID NO: 2377258 - RNA, 14 nt, Bordetella pertussis
ggcgcggcgcaggc

SEQ ID NO: 2377259 - RNA, 16 nt, Bordetella pertussis
ggcgcggcgcaggccu

SEQ ID NO: 2377260 - RNA, 15 nt, Bordetella pertussis
ggcgcggcgccaugc

SEQ ID NO: 2377261 - RNA, 22 nt, Bordetella pertussis
ggcgcggcgccaugccgcgccc

SEQ ID NO: 2377262 - RNA, 23 nt, Bordetella pertussis
ggcgcggcgccaugccgcgcccg

SEQ ID NO: 2377263 - RNA, 12 nt, Bordetella pertussis
ggcgcggcgccg

SEQ ID NO: 2377264 - RNA, 17 nt, Bordetella pertussis
ggcgcggcgccguccag

SEQ ID NO: 2377265 - RNA, 19 nt, Bordetella pertussis
ggcgcggcgccguccagcg

SEQ ID NO: 2377266 - RNA, 12 nt, Bordetella pertussis
ggcgcggcgcgc

SEQ ID NO: 2377267 - RNA, 14 nt, Bordetella pertussis
ggcgcggcgcgcgc

SEQ ID NO: 2377268 - RNA, 16 nt, Bordetella pertussis
ggcgcggcgcgcgccg

SEQ ID NO: 2377269 - RNA, 17 nt, Bordetella pertussis
ggcgcggcgcgcgccga

SEQ ID NO: 2377270 - RNA, 14 nt, Bordetella pertussis
ggcgcggcgcgugc

SEQ ID NO: 2377271 - RNA, 18 nt, Bordetella pertussis
ggcgcggcgcgugccagc

SEQ ID NO: 2377272 - RNA, 20 nt, Bordetella pertussis
ggcgcggcgcuacgccgccg

SEQ ID NO: 2377273 - RNA, 17 nt, Bordetella pertussis
ggcgcggcgcuggcgcc

SEQ ID NO: 2377274 - RNA, 12 nt, Bordetella pertussis
ggcgcggcggcc

SEQ ID NO: 2377275 - RNA, 13 nt, Bordetella pertussis
ggcgcggcggccu

SEQ ID NO: 2377276 - RNA, 18 nt, Bordetella pertussis
ggcgcggcggccugggcg

SEQ ID NO: 2377277 - RNA, 15 nt, Bordetella pertussis
ggcgcggcggcggcc

SEQ ID NO: 2377278 - RNA, 20 nt, Bordetella pertussis
ggcgcggcggcggccaugac

SEQ ID NO: 2377279 - RNA, 17 nt, Bordetella pertussis
ggcgcggcggcguuccu

SEQ ID NO: 2377280 - RNA, 14 nt, Bordetella pertussis
ggcgcggcgggcgc

SEQ ID NO: 2377281 - RNA, 21 nt, Bordetella pertussis
ggcgcggcgggcgcuggcgcg

SEQ ID NO: 2377282 - RNA, 20 nt, Bordetella pertussis
ggcgcggcgggcucagcccg

SEQ ID NO: 2377283 - RNA, 22 nt, Bordetella pertussis
ggcgcggcgucgaaggccgccg

SEQ ID NO: 2377284 - RNA, 14 nt, Bordetella pertussis
ggcgcggcucgccg

SEQ ID NO: 2377285 - RNA, 15 nt, Bordetella pertussis
ggcgcggcucgccgg

SEQ ID NO: 2377286 - RNA, 20 nt, Bordetella pertussis
ggcgcggcugcccucgguca

SEQ ID NO: 2377287 - RNA, 14 nt, Bordetella pertussis
ggcgcggcuggaug

SEQ ID NO: 2377288 - RNA, 22 nt, Bordetella pertussis
ggcgcggcuuucgccggaggcg

SEQ ID NO: 2377289 - RNA, 13 nt, Bordetella pertussis
ggcgcgggagccc

SEQ ID NO: 2377290 - RNA, 21 nt, Bordetella pertussis
ggcgcgggcacucggccaugg

SEQ ID NO: 2377291 - RNA, 16 nt, Bordetella pertussis
ggcgcgggcagcaccg

SEQ ID NO: 2377292 - RNA, 17 nt, Bordetella pertussis
ggcgcgggcagcaccgg

SEQ ID NO: 2377293 - RNA, 17 nt, Bordetella pertussis
ggcgcgggccagcucuu

SEQ ID NO: 2377294 - RNA, 12 nt, Bordetella pertussis
ggcgcgggcggc

SEQ ID NO: 2377295 - RNA, 14 nt, Bordetella pertussis
ggcgcgggcggccu

SEQ ID NO: 2377296 - RNA, 18 nt, Bordetella pertussis
ggcgcgggcggccuauca

SEQ ID NO: 2377297 - RNA, 17 nt, Bordetella pertussis
ggcgcgggcggucggcg

SEQ ID NO: 2377298 - RNA, 15 nt, Bordetella pertussis
ggcgcgguagcgccc

SEQ ID NO: 2377299 - RNA, 17 nt, Bordetella pertussis
ggcgcgguagcgccccu

SEQ ID NO: 2377300 - RNA, 22 nt, Bordetella pertussis
ggcgcgguauggccgcccagca

SEQ ID NO: 2377301 - RNA, 23 nt, Bordetella pertussis
ggcgcgguauucgcgcuggcgcg

SEQ ID NO: 2377302 - RNA, 13 nt, Bordetella pertussis
ggcgcggucagca

SEQ ID NO: 2377303 - RNA, 15 nt, Bordetella pertussis
ggcgcgguccacgcc

SEQ ID NO: 2377304 - RNA, 19 nt, Bordetella pertussis
ggcgcgguccacgcccugg

SEQ ID NO: 2377305 - RNA, 13 nt, Bordetella pertussis
ggcgcuggccugc

SEQ ID NO: 2377306 - RNA, 14 nt, Bordetella pertussis
ggcgcuggccugcc

SEQ ID NO: 2377307 - RNA, 22 nt, Bordetella pertussis
ggcgcuggccugccgcgccgac

SEQ ID NO: 2377308 - RNA, 16 nt, Bordetella pertussis
ggcgcuggccuggccg

SEQ ID NO: 2377309 - RNA, 17 nt, Bordetella pertussis
ggcgcuggccuggccgc

SEQ ID NO: 2377310 - RNA, 13 nt, Bordetella pertussis
ggcgcuggcgaug

SEQ ID NO: 2377311 - RNA, 21 nt, Bordetella pertussis
ggcgcuggcgaugcgggccac

SEQ ID NO: 2377312 - RNA, 14 nt, Bordetella pertussis
ggcgcuggcgccgc

SEQ ID NO: 2377313 - RNA, 15 nt, Bordetella pertussis
ggcgcuggcgccgcg

SEQ ID NO: 2377314 - RNA, 17 nt, Bordetella pertussis
ggcgcuggcggcugcgc

SEQ ID NO: 2377315 - RNA, 18 nt, Bordetella pertussis
ggcgcuggcggcugcgcg

SEQ ID NO: 2377316 - RNA, 15 nt, Bordetella pertussis
ggcgcuggcguccag

SEQ ID NO: 2377317 - RNA, 16 nt, Bordetella pertussis
ggcgcuggcguccagc

SEQ ID NO: 2377318 - RNA, 17 nt, Bordetella pertussis
ggcgcuggcguccagcc

SEQ ID NO: 2377319 - RNA, 19 nt, Bordetella pertussis
ggcgcuggcguccagccug

SEQ ID NO: 2377320 - RNA, 21 nt, Bordetella pertussis
ggcgcuggcguccagccugcc

SEQ ID NO: 2377321 - RNA, 19 nt, Bordetella pertussis
ggcgcuggcguucagcggg

SEQ ID NO: 2377322 - RNA, 17 nt, Bordetella pertussis
ggcgcuggcuggacgcg

SEQ ID NO: 2377323 - RNA, 23 nt, Bordetella pertussis
ggcgcuggcuggacgcgcgcggc

SEQ ID NO: 2377324 - RNA, 17 nt, Bordetella pertussis
ggcgcugggcaggcugg

SEQ ID NO: 2377325 - RNA, 21 nt, Bordetella pertussis
ggcgcugggcaggcuggcgcg

SEQ ID NO: 2377326 - RNA, 20 nt, Bordetella pertussis
ggcgcuggggaagcgcucgu

SEQ ID NO: 2377327 - RNA, 19 nt, Bordetella pertussis
ggcgcugguaaagggcgcg

SEQ ID NO: 2377328 - RNA, 22 nt, Bordetella pertussis
ggcgcuguauauauagggggca

SEQ ID NO: 2377329 - RNA, 15 nt, Bordetella pertussis
ggcgcuguccggcgc

SEQ ID NO: 2377330 - RNA, 19 nt, Bordetella pertussis
ggcgcuguccggcgcucgc

SEQ ID NO: 2377331 - RNA, 20 nt, Bordetella pertussis
ggcgcuguucgauacggcca

SEQ ID NO: 2377332 - RNA, 23 nt, Bordetella pertussis
ggcgcuguucgauacggccacgc

SEQ ID NO: 2377333 - RNA, 16 nt, Bordetella pertussis
ggcgcuguuggccggc

SEQ ID NO: 2377334 - RNA, 17 nt, Bordetella pertussis
ggcgcuguuggccggcg

SEQ ID NO: 2377335 - RNA, 19 nt, Bordetella pertussis
ggcgcuguuggccggcgcg

SEQ ID NO: 2377336 - RNA, 17 nt, Bordetella pertussis
ggcgcuguuuccgggcc

SEQ ID NO: 2377337 - RNA, 19 nt, Bordetella pertussis
ggcgcuuaccgcgccggcu

SEQ ID NO: 2377338 - RNA, 21 nt, Bordetella pertussis
ggcgcuuaccgcgccggcucg

SEQ ID NO: 2377339 - RNA, 20 nt, Bordetella pertussis
ggcgcuucgucggccgccag

SEQ ID NO: 2377340 - RNA, 21 nt, Bordetella pertussis
ggcgcuucgucggccgccagc

SEQ ID NO: 2377341 - RNA, 23 nt, Bordetella pertussis
ggcgcuugacccguuugcgcagc

SEQ ID NO: 2377342 - RNA, 12 nt, Bordetella pertussis
ggcgcuugcccg

SEQ ID NO: 2377343 - RNA, 16 nt, Bordetella pertussis
ggcgcuugcgcagggc

SEQ ID NO: 2377344 - RNA, 20 nt, Bordetella pertussis
ggcgcuugcgcagggcgggc

SEQ ID NO: 2377345 - RNA, 14 nt, Bordetella pertussis
ggcgcuuggccagc

SEQ ID NO: 2377346 - RNA, 16 nt, Bordetella pertussis
ggcgcuuggccagcug

SEQ ID NO: 2377347 - RNA, 17 nt, Bordetella pertussis
ggcgcuuggccagcugg

SEQ ID NO: 2377348 - RNA, 21 nt, Bordetella pertussis
ggcgcuuggccagcuggcgcg

SEQ ID NO: 2377349 - RNA, 18 nt, Bordetella pertussis
ggcgcuuggcccugcagc

SEQ ID NO: 2377350 - RNA, 20 nt, Bordetella pertussis
ggcgcuugugcgucggcucg

SEQ ID NO: 2377351 - RNA, 18 nt, Bordetella pertussis
ggcgcuuuccgagccggu

SEQ ID NO: 2377352 - RNA, 17 nt, Bordetella pertussis
ggcggaaaacagcacca

SEQ ID NO: 2377353 - RNA, 20 nt, Bordetella pertussis
ggcggaaaacagcaccagca

SEQ ID NO: 2377354 - RNA, 21 nt, Bordetella pertussis
ggcggaaaacagcaccagcau

SEQ ID NO: 2377355 - RNA, 23 nt, Bordetella pertussis
ggcggaaaacagcaccagcaugc

SEQ ID NO: 2377356 - RNA, 17 nt, Bordetella pertussis
ggcggaaauucauccgg

SEQ ID NO: 2377357 - RNA, 21 nt, Bordetella pertussis
ggcggaaugcggcgacagggc

SEQ ID NO: 2377358 - RNA, 22 nt, Bordetella pertussis
ggcggaaugugcgagggcucga

SEQ ID NO: 2377359 - RNA, 15 nt, Bordetella pertussis
ggcggacacgcaugc

SEQ ID NO: 2377360 - RNA, 21 nt, Bordetella pertussis
ggcggacacgcccuggccgua

SEQ ID NO: 2377361 - RNA, 14 nt, Bordetella pertussis
ggcggacaggcccu

SEQ ID NO: 2377362 - RNA, 23 nt, Bordetella pertussis
ggcggaccacacgaucgucagca

SEQ ID NO: 2377363 - RNA, 14 nt, Bordetella pertussis
ggcggacugcgccg

SEQ ID NO: 2377364 - RNA, 13 nt, Bordetella pertussis
ggcggacuggccg

SEQ ID NO: 2377365 - RNA, 16 nt, Bordetella pertussis
ggcggacuggccgcgc

SEQ ID NO: 2377366 - RNA, 18 nt, Bordetella pertussis
ggcggaucacccagcggc

SEQ ID NO: 2377367 - RNA, 21 nt, Bordetella pertussis
ggcggaucacccagcggcugg

SEQ ID NO: 2377368 - RNA, 23 nt, Bordetella pertussis
ggcggaucgccgaagucggcgcg

SEQ ID NO: 2377369 - RNA, 21 nt, Bordetella pertussis
ggcggaucgucuacgcgaacc

SEQ ID NO: 2377370 - RNA, 19 nt, Bordetella pertussis
ggcggaucucggccagcag

SEQ ID NO: 2377371 - RNA, 20 nt, Bordetella pertussis
ggcggaucucggccagcagc

SEQ ID NO: 2377372 - RNA, 21 nt, Bordetella pertussis
ggcggaucucggccagcagcg

SEQ ID NO: 2377373 - RNA, 22 nt, Bordetella pertussis
ggcggaucucuccgaacgcgac

SEQ ID NO: 2377374 - RNA, 16 nt, Bordetella pertussis
ggcggaucuucccgcc

SEQ ID NO: 2377375 - RNA, 20 nt, Bordetella pertussis
ggcggaucuucccgccaugg

SEQ ID NO: 2377376 - RNA, 22 nt, Bordetella pertussis
ggcggaucuucccgccauggga

SEQ ID NO: 2377377 - RNA, 14 nt, Bordetella pertussis
ggcggaugagcagg

SEQ ID NO: 2377378 - RNA, 18 nt, Bordetella pertussis
ggcggaugagcaggccgg

SEQ ID NO: 2377379 - RNA, 23 nt, Bordetella pertussis
ggcggaugagcaggccgggucgu

SEQ ID NO: 2377380 - RNA, 21 nt, Bordetella pertussis
ggcggaugcgcacgggcgagg

SEQ ID NO: 2377381 - RNA, 15 nt, Bordetella pertussis
ggcggauggcuuccu

SEQ ID NO: 2377382 - RNA, 20 nt, Bordetella pertussis
ggcggauucaggcgauccug

SEQ ID NO: 2377383 - RNA, 18 nt, Bordetella pertussis
ggcggauuugcucgcguc

SEQ ID NO: 2377384 - RNA, 20 nt, Bordetella pertussis
ggcggcaaagucggggcgcc

SEQ ID NO: 2377385 - RNA, 19 nt, Bordetella pertussis
ggcggcaacgugcaggcca

SEQ ID NO: 2377386 - RNA, 12 nt, Bordetella pertussis
ggcggcaagcag

SEQ ID NO: 2377387 - RNA, 16 nt, Bordetella pertussis
ggcggcaagcagccgg

SEQ ID NO: 2377388 - RNA, 18 nt, Bordetella pertussis
ggcggcaauaucggcacc

SEQ ID NO: 2377389 - RNA, 15 nt, Bordetella pertussis
ggcggcaccagcagg

SEQ ID NO: 2377390 - RNA, 16 nt, Bordetella pertussis
ggcggcaccagcaggc

SEQ ID NO: 2377391 - RNA, 18 nt, Bordetella pertussis
ggcggcaccagcaggccg

SEQ ID NO: 2377392 - RNA, 18 nt, Bordetella pertussis
ggcggcaccauugccggc

SEQ ID NO: 2377393 - RNA, 20 nt, Bordetella pertussis
ggcggcaccauugccggcgc

SEQ ID NO: 2377394 - RNA, 23 nt, Bordetella pertussis
ggcggcaccauugccggcgcgca

SEQ ID NO: 2377395 - RNA, 16 nt, Bordetella pertussis
ggcggcaccgcgcagc

SEQ ID NO: 2377396 - RNA, 21 nt, Bordetella pertussis
ggcggcaccgcgcagcccggc

SEQ ID NO: 2377397 - RNA, 13 nt, Bordetella pertussis
ggcggcacgcgcg

SEQ ID NO: 2377398 - RNA, 15 nt, Bordetella pertussis
ggcggcacgcgcgcc

SEQ ID NO: 2377399 - RNA, 19 nt, Bordetella pertussis
ggcggcacgcugcgcaggc

SEQ ID NO: 2377400 - RNA, 21 nt, Bordetella pertussis
ggcggcacgcugcgcaggcgc

SEQ ID NO: 2377401 - RNA, 13 nt, Bordetella pertussis
ggcggcacggccg

SEQ ID NO: 2377402 - RNA, 19 nt, Bordetella pertussis
ggcggcacggccggccugc

SEQ ID NO: 2377403 - RNA, 15 nt, Bordetella pertussis
ggcggcagaaggcga

SEQ ID NO: 2377404 - RNA, 20 nt, Bordetella pertussis
ggcggcagaaggcgacaucg

SEQ ID NO: 2377405 - RNA, 16 nt, Bordetella pertussis
ggcggcagcaggcgcg

SEQ ID NO: 2377406 - RNA, 13 nt, Bordetella pertussis
ggcggcagccggc

SEQ ID NO: 2377407 - RNA, 17 nt, Bordetella pertussis
ggcggcagccggccaug

SEQ ID NO: 2377408 - RNA, 18 nt, Bordetella pertussis
ggcggcagccggccaugg

SEQ ID NO: 2377409 - RNA, 13 nt, Bordetella pertussis
ggcggcagcgcga

SEQ ID NO: 2377410 - RNA, 23 nt, Bordetella pertussis
ggcggcagcucgcgcugcgcgcc

SEQ ID NO: 2377411 - RNA, 15 nt, Bordetella pertussis
ggcggcaggccgcgc

SEQ ID NO: 2377412 - RNA, 17 nt, Bordetella pertussis
ggcggcaggcgccgccg

SEQ ID NO: 2377413 - RNA, 13 nt, Bordetella pertussis
ggcggcaggcgcg

SEQ ID NO: 2377414 - RNA, 14 nt, Bordetella pertussis
ggcggcaggcgcga

SEQ ID NO: 2377415 - RNA, 19 nt, Bordetella pertussis
ggcggcaucguucaggcgc

SEQ ID NO: 2377416 - RNA, 20 nt, Bordetella pertussis
ggcggcaucguucaggcgca

SEQ ID NO: 2377417 - RNA, 22 nt, Bordetella pertussis
ggcggcgaucucgcgcgcgcgg

SEQ ID NO: 2377418 - RNA, 15 nt, Bordetella pertussis
ggcggcgaugccgcu

SEQ ID NO: 2377419 - RNA, 12 nt, Bordetella pertussis
ggcggcgcacca

SEQ ID NO: 2377420 - RNA, 19 nt, Bordetella pertussis
ggcggcgcagcaccaggcu

SEQ ID NO: 2377421 - RNA, 22 nt, Bordetella pertussis
ggcggcgcagcauuucggcgcc

SEQ ID NO: 2377422 - RNA, 15 nt, Bordetella pertussis
ggcggcgcagccgcc

SEQ ID NO: 2377423 - RNA, 14 nt, Bordetella pertussis
ggcggcgcagcgcc

SEQ ID NO: 2377424 - RNA, 21 nt, Bordetella pertussis
ggcggcgcagcgcccaggcga

SEQ ID NO: 2377425 - RNA, 12 nt, Bordetella pertussis
ggcggcgcaggc

SEQ ID NO: 2377426 - RNA, 15 nt, Bordetella pertussis
ggcggcgcaggccag

SEQ ID NO: 2377427 - RNA, 16 nt, Bordetella pertussis
ggcggcgcaggccgcg

SEQ ID NO: 2377428 - RNA, 13 nt, Bordetella pertussis
ggcggcgccagcg

SEQ ID NO: 2377429 - RNA, 15 nt, Bordetella pertussis
ggcggcgcccgcaug

SEQ ID NO: 2377430 - RNA, 14 nt, Bordetella pertussis
ggcggcgccggccg

SEQ ID NO: 2377431 - RNA, 23 nt, Bordetella pertussis
ggcggcgccggugaccgccagca

SEQ ID NO: 2377432 - RNA, 22 nt, Bordetella pertussis
ggcggcgcgcccagcggcaggc

SEQ ID NO: 2377433 - RNA, 16 nt, Bordetella pertussis
ggcggcgcgcccgccu

SEQ ID NO: 2377434 - RNA, 14 nt, Bordetella pertussis
ggcggcgcgcggcu

SEQ ID NO: 2377435 - RNA, 15 nt, Bordetella pertussis
ggcggcgcgcggcug

SEQ ID NO: 2377436 - RNA, 17 nt, Bordetella pertussis
ggcggcgcgcggcuggg

SEQ ID NO: 2377437 - RNA, 23 nt, Bordetella pertussis
ggcggcgcgcucuccgaacaggc

SEQ ID NO: 2377438 - RNA, 12 nt, Bordetella pertussis
ggcggcgcgcug

SEQ ID NO: 2377439 - RNA, 21 nt, Bordetella pertussis
ggcggcgcgcuuggucagcau

SEQ ID NO: 2377440 - RNA, 13 nt, Bordetella pertussis
ggcggcgcggcga

SEQ ID NO: 2377441 - RNA, 14 nt, Bordetella pertussis
ggcggcgcggcgau

SEQ ID NO: 2377442 - RNA, 15 nt, Bordetella pertussis
ggcggcgcggcgcca

SEQ ID NO: 2377443 - RNA, 15 nt, Bordetella pertussis
ggcggcgcggcgcug

SEQ ID NO: 2377444 - RNA, 16 nt, Bordetella pertussis
ggcggcgcggcgcugg

SEQ ID NO: 2377445 - RNA, 12 nt, Bordetella pertussis
ggcggcgcggcu

SEQ ID NO: 2377446 - RNA, 13 nt, Bordetella pertussis
ggcggcgcgggcg

SEQ ID NO: 2377447 - RNA, 15 nt, Bordetella pertussis
ggcggcgcgggcggc

SEQ ID NO: 2377448 - RNA, 22 nt, Bordetella pertussis
ggcggcgcgggucuugagcggc

SEQ ID NO: 2377449 - RNA, 16 nt, Bordetella pertussis
ggcggcgcggucagca

SEQ ID NO: 2377450 - RNA, 14 nt, Bordetella pertussis
ggcggcgcucauca

SEQ ID NO: 2377451 - RNA, 20 nt, Bordetella pertussis
ggcggcgcucgaaggcgccg

SEQ ID NO: 2377452 - RNA, 12 nt, Bordetella pertussis
ggcggcgcuggc

SEQ ID NO: 2377453 - RNA, 14 nt, Bordetella pertussis
ggcggcgcuggcgu

SEQ ID NO: 2377454 - RNA, 12 nt, Bordetella pertussis
ggcggcgcuggu

SEQ ID NO: 2377455 - RNA, 14 nt, Bordetella pertussis
ggcggcggccacga

SEQ ID NO: 2377456 - RNA, 15 nt, Bordetella pertussis
ggcggcggccggggc

SEQ ID NO: 2377457 - RNA, 15 nt, Bordetella pertussis
ggcggcggcgcgcgc

SEQ ID NO: 2377458 - RNA, 15 nt, Bordetella pertussis
ggcggcggcgguggu

SEQ ID NO: 2377459 - RNA, 12 nt, Bordetella pertussis
ggcggcggcguc

SEQ ID NO: 2377460 - RNA, 12 nt, Bordetella pertussis
ggcggcggcguu

SEQ ID NO: 2377461 - RNA, 14 nt, Bordetella pertussis
ggcggcgggcguga

SEQ ID NO: 2377462 - RNA, 14 nt, Bordetella pertussis
ggcggcgggcugca

SEQ ID NO: 2377463 - RNA, 24 nt, Bordetella pertussis
ggcggcgguuucuuccagcagggc

SEQ ID NO: 2377464 - RNA, 17 nt, Bordetella pertussis
ggcggcguacaggugcu

SEQ ID NO: 2377465 - RNA, 19 nt, Bordetella pertussis
ggcggcguagagcgccgcg

SEQ ID NO: 2377466 - RNA, 19 nt, Bordetella pertussis
ggcggcgucgaucggcgcg

SEQ ID NO: 2377467 - RNA, 17 nt, Bordetella pertussis
ggcggcgucgccgcgca

SEQ ID NO: 2377468 - RNA, 19 nt, Bordetella pertussis
ggcggcgucgcuggcagcc

SEQ ID NO: 2377469 - RNA, 16 nt, Bordetella pertussis
ggcggcgucggcgccc

SEQ ID NO: 2377470 - RNA, 19 nt, Bordetella pertussis
ggcggcgucggcgcccggc

SEQ ID NO: 2377471 - RNA, 16 nt, Bordetella pertussis
ggcggcgucuucgcgg

SEQ ID NO: 2377472 - RNA, 16 nt, Bordetella pertussis
ggcggcgugaccgcga

SEQ ID NO: 2377473 - RNA, 15 nt, Bordetella pertussis
ggcggcgugcccugc

SEQ ID NO: 2377474 - RNA, 20 nt, Bordetella pertussis
ggcggcguggccgugcuggu

SEQ ID NO: 2377475 - RNA, 23 nt, Bordetella pertussis
ggcggcguggccgugcuggucau

SEQ ID NO: 2377476 - RNA, 16 nt, Bordetella pertussis
ggcggcuaggcgcagc

SEQ ID NO: 2377477 - RNA, 17 nt, Bordetella pertussis
ggcggcuaggcgcagca

SEQ ID NO: 2377478 - RNA, 20 nt, Bordetella pertussis
ggcggcuaggcgcagcaggc

SEQ ID NO: 2377479 - RNA, 20 nt, Bordetella pertussis
ggcggcugaagaagcccggc

SEQ ID NO: 2377480 - RNA, 16 nt, Bordetella pertussis
ggcggcugccaguggu

SEQ ID NO: 2377481 - RNA, 12 nt, Bordetella pertussis
ggcggcugccca

SEQ ID NO: 2377482 - RNA, 15 nt, Bordetella pertussis
ggcggcugcccaccu

SEQ ID NO: 2377483 - RNA, 21 nt, Bordetella pertussis
ggcggcugccgauacgggcgc

SEQ ID NO: 2377484 - RNA, 15 nt, Bordetella pertussis
ggcggcugcuggccc

SEQ ID NO: 2377485 - RNA, 13 nt, Bordetella pertussis
ggcggcuggcgcg

SEQ ID NO: 2377486 - RNA, 17 nt, Bordetella pertussis
ggcggcuguagucgccg

SEQ ID NO: 2377487 - RNA, 21 nt, Bordetella pertussis
ggcggcugucgggcggcgccu

SEQ ID NO: 2377488 - RNA, 16 nt, Bordetella pertussis
ggcggcuucaggcgcg

SEQ ID NO: 2377489 - RNA, 17 nt, Bordetella pertussis
ggcggcuucaggcgcgc

SEQ ID NO: 2377490 - RNA, 19 nt, Bordetella pertussis
ggcggcuucaggcgcgcgg

SEQ ID NO: 2377491 - RNA, 23 nt, Bordetella pertussis
ggcggcuucaggcgcgcggcagg

SEQ ID NO: 2377492 - RNA, 17 nt, Bordetella pertussis
ggcggcuuccuggucac

SEQ ID NO: 2377493 - RNA, 16 nt, Bordetella pertussis
ggcggcuucgcgcagc

SEQ ID NO: 2377494 - RNA, 18 nt, Bordetella pertussis
ggcggcuucgcgcagcaa

SEQ ID NO: 2377495 - RNA, 19 nt, Bordetella pertussis
ggcggcuucgcgcagcaag

SEQ ID NO: 2377496 - RNA, 15 nt, Bordetella pertussis
ggcggcuugcggucc

SEQ ID NO: 2377497 - RNA, 21 nt, Bordetella pertussis
ggcggcuuucgauuugcagca

SEQ ID NO: 2377498 - RNA, 22 nt, Bordetella pertussis
ggcggcuuucgauuugcagcag

SEQ ID NO: 2377499 - RNA, 19 nt, Bordetella pertussis
ggcgggaauauccuggucg

SEQ ID NO: 2377500 - RNA, 20 nt, Bordetella pertussis
ggcgggaaugucccacaggc

SEQ ID NO: 2377501 - RNA, 22 nt, Bordetella pertussis
ggcgggaaugucccacaggcgc

SEQ ID NO: 2377502 - RNA, 21 nt, Bordetella pertussis
ggcgggaccgugccgccgagg

SEQ ID NO: 2377503 - RNA, 17 nt, Bordetella pertussis
ggcgggacgcaggccca

SEQ ID NO: 2377504 - RNA, 21 nt, Bordetella pertussis
ggcgggacgcaggcccagcca

SEQ ID NO: 2377505 - RNA, 16 nt, Bordetella pertussis
ggcgggacuggcgagc

SEQ ID NO: 2377506 - RNA, 19 nt, Bordetella pertussis
ggcgggcacaacccgcccg

SEQ ID NO: 2377507 - RNA, 18 nt, Bordetella pertussis
ggcgggcaccaugcgcga

SEQ ID NO: 2377508 - RNA, 15 nt, Bordetella pertussis
ggcgggcagcauggc

SEQ ID NO: 2377509 - RNA, 14 nt, Bordetella pertussis
ggcgggcagcggcg

SEQ ID NO: 2377510 - RNA, 15 nt, Bordetella pertussis
ggcgggcagcggcga

SEQ ID NO: 2377511 - RNA, 17 nt, Bordetella pertussis
ggcgggcagcggcgacg

SEQ ID NO: 2377512 - RNA, 20 nt, Bordetella pertussis
ggcgggcagcggcgacggcg

SEQ ID NO: 2377513 - RNA, 13 nt, Bordetella pertussis
ggcgggcaggcgg

SEQ ID NO: 2377514 - RNA, 18 nt, Bordetella pertussis
ggcgggcaucgcccacca

SEQ ID NO: 2377515 - RNA, 15 nt, Bordetella pertussis
ggcgggccagcuccc

SEQ ID NO: 2377516 - RNA, 16 nt, Bordetella pertussis
ggcgggccgcgccgcg

SEQ ID NO: 2377517 - RNA, 17 nt, Bordetella pertussis
ggcgggccggcucggcg

SEQ ID NO: 2377518 - RNA, 12 nt, Bordetella pertussis
ggcgggccuggg

SEQ ID NO: 2377519 - RNA, 15 nt, Bordetella pertussis
ggcgggcgacauugc

SEQ ID NO: 2377520 - RNA, 15 nt, Bordetella pertussis
ggcgggcgagaucag

SEQ ID NO: 2377521 - RNA, 23 nt, Bordetella pertussis
ggcgggcgauauccaucggcgcg

SEQ ID NO: 2377522 - RNA, 20 nt, Bordetella pertussis
ggcgggcgccccgaucggcg

SEQ ID NO: 2377523 - RNA, 23 nt, Bordetella pertussis
ggcgggcgccccgaucggcgccg

SEQ ID NO: 2377524 - RNA, 15 nt, Bordetella pertussis
ggcgggcgcgcaggc

SEQ ID NO: 2377525 - RNA, 15 nt, Bordetella pertussis
ggcgggcgcuggcgc

SEQ ID NO: 2377526 - RNA, 23 nt, Bordetella pertussis
ggcgggcgcuucgucggccgcca

SEQ ID NO: 2377527 - RNA, 15 nt, Bordetella pertussis
ggcgggcggccggcg

SEQ ID NO: 2377528 - RNA, 14 nt, Bordetella pertussis
ggcgggcggcgcca

SEQ ID NO: 2377529 - RNA, 13 nt, Bordetella pertussis
ggcgggcggcgcg

SEQ ID NO: 2377530 - RNA, 17 nt, Bordetella pertussis
ggcgggcggcgcggcca

SEQ ID NO: 2377531 - RNA, 14 nt, Bordetella pertussis
ggcguccagcagca

SEQ ID NO: 2377532 - RNA, 16 nt, Bordetella pertussis
ggcguccagccccugc

SEQ ID NO: 2377533 - RNA, 14 nt, Bordetella pertussis
ggcguccagccugc

SEQ ID NO: 2377534 - RNA, 17 nt, Bordetella pertussis
ggcguccagccugcccg

SEQ ID NO: 2377535 - RNA, 18 nt, Bordetella pertussis
ggcguccagccugcccgg

SEQ ID NO: 2377536 - RNA, 23 nt, Bordetella pertussis
ggcguccagccugcccgggcagc

SEQ ID NO: 2377537 - RNA, 19 nt, Bordetella pertussis
ggcguccaggcgcgccagc

SEQ ID NO: 2377538 - RNA, 17 nt, Bordetella pertussis
ggcguccaggcugccgg

SEQ ID NO: 2377539 - RNA, 20 nt, Bordetella pertussis
ggcguccaggcugccggcgu

SEQ ID NO: 2377540 - RNA, 12 nt, Bordetella pertussis
ggcguccaugca

SEQ ID NO: 2377541 - RNA, 12 nt, Bordetella pertussis
ggcguccaugcu

SEQ ID NO: 2377542 - RNA, 21 nt, Bordetella pertussis
ggcguccauuagggcccagcu

SEQ ID NO: 2377543 - RNA, 23 nt, Bordetella pertussis
ggcguccauuagggcccagcugc

SEQ ID NO: 2377544 - RNA, 15 nt, Bordetella pertussis
ggcgucccaggccac

SEQ ID NO: 2377545 - RNA, 16 nt, Bordetella pertussis
ggcgucccaggccacg

SEQ ID NO: 2377546 - RNA, 16 nt, Bordetella pertussis
ggcguccgcgucgccg

SEQ ID NO: 2377547 - RNA, 15 nt, Bordetella pertussis
ggcguccggccccag

SEQ ID NO: 2377548 - RNA, 13 nt, Bordetella pertussis
ggcguccucgcgg

SEQ ID NO: 2377549 - RNA, 17 nt, Bordetella pertussis
ggcguccugccgcgacc

SEQ ID NO: 2377550 - RNA, 17 nt, Bordetella pertussis
ggcguccugcggcggca

SEQ ID NO: 2377551 - RNA, 18 nt, Bordetella pertussis
ggcgucgaaacgcugcgc

SEQ ID NO: 2377552 - RNA, 19 nt, Bordetella pertussis
ggcgucgaaacgcugcgcg

SEQ ID NO: 2377553 - RNA, 21 nt, Bordetella pertussis
ggcgucgaaggcggccggcag

SEQ ID NO: 2377554 - RNA, 22 nt, Bordetella pertussis
ggcgucgaaggcggccggcagg

SEQ ID NO: 2377555 - RNA, 21 nt, Bordetella pertussis
ggcgucgaagguuucgcugcg

SEQ ID NO: 2377556 - RNA, 22 nt, Bordetella pertussis
ggcgucgaagguuucgcugcgc

SEQ ID NO: 2377557 - RNA, 14 nt, Bordetella pertussis
ggcgucgacgcccg

SEQ ID NO: 2377558 - RNA, 19 nt, Bordetella pertussis
ggcgucgacgcccgcgccc

SEQ ID NO: 2377559 - RNA, 20 nt, Bordetella pertussis
ggcgucgacgcccgcgccca

SEQ ID NO: 2377560 - RNA, 14 nt, Bordetella pertussis
ggcgucgagcacgc

SEQ ID NO: 2377561 - RNA, 15 nt, Bordetella pertussis
ggcgucgagcacgcg

SEQ ID NO: 2377562 - RNA, 18 nt, Bordetella pertussis
ggcgucgagcacgcggcg

SEQ ID NO: 2377563 - RNA, 22 nt, Bordetella pertussis
ggcgucgagcacgcggcgcggc

SEQ ID NO: 2377564 - RNA, 23 nt, Bordetella pertussis
ggcgucgagcacgcggcgcggca

SEQ ID NO: 2377565 - RNA, 15 nt, Bordetella pertussis
ggcgucgaucggcgc

SEQ ID NO: 2377566 - RNA, 18 nt, Bordetella pertussis
ggcgucgaucggcgcgcc

SEQ ID NO: 2377567 - RNA, 19 nt, Bordetella pertussis
ggcgucgaucggcgcgccc

SEQ ID NO: 2377568 - RNA, 13 nt, Bordetella pertussis
ggcgucgaugcgc

SEQ ID NO: 2377569 - RNA, 19 nt, Bordetella pertussis
ggcgucgaugcgcgcgcgg

SEQ ID NO: 2377570 - RNA, 21 nt, Bordetella pertussis
ggcgucgaugcgcgcgcggau

SEQ ID NO: 2377571 - RNA, 20 nt, Bordetella pertussis
ggcgucgauuucgucgagcu

SEQ ID NO: 2377572 - RNA, 18 nt, Bordetella pertussis
ggcgucgcccggggcggc

SEQ ID NO: 2377573 - RNA, 19 nt, Bordetella pertussis
ggcgucgcccggggcggcg

SEQ ID NO: 2377574 - RNA, 20 nt, Bordetella pertussis
ggcgucgcccggggcggcgu

SEQ ID NO: 2377575 - RNA, 15 nt, Bordetella pertussis
ggcgucgccgcgcac

SEQ ID NO: 2377576 - RNA, 17 nt, Bordetella pertussis
ggcgucgccgcgcacga

SEQ ID NO: 2377577 - RNA, 13 nt, Bordetella pertussis
ggcgucgccggcc

SEQ ID NO: 2377578 - RNA, 15 nt, Bordetella pertussis
ggcgucgcgaugcgc

SEQ ID NO: 2377579 - RNA, 18 nt, Bordetella pertussis
ggcgucgcucugcgcggc

SEQ ID NO: 2377580 - RNA, 17 nt, Bordetella pertussis
ggcgucgcuggcagccu

SEQ ID NO: 2377581 - RNA, 18 nt, Bordetella pertussis
ggcgucgcuggcagccuu

SEQ ID NO: 2377582 - RNA, 12 nt, Bordetella pertussis
ggcgucggccac

SEQ ID NO: 2377583 - RNA, 17 nt, Bordetella pertussis
ggcgucggccagcgcga

SEQ ID NO: 2377584 - RNA, 15 nt, Bordetella pertussis
ggcgucggccauggc

SEQ ID NO: 2377585 - RNA, 14 nt, Bordetella pertussis
ggcgucggccgccg

SEQ ID NO: 2377586 - RNA, 16 nt, Bordetella pertussis
ggcgucggccgcgccc

SEQ ID NO: 2377587 - RNA, 17 nt, Bordetella pertussis
ggcgucggccgcgccca

SEQ ID NO: 2377588 - RNA, 21 nt, Bordetella pertussis
ggcgucggccugguccgccgc

SEQ ID NO: 2377589 - RNA, 16 nt, Bordetella pertussis
ggcgucggcgcccggc

SEQ ID NO: 2377590 - RNA, 17 nt, Bordetella pertussis
ggcgucggcggcccaca

SEQ ID NO: 2377591 - RNA, 13 nt, Bordetella pertussis
ggcgucgggcagc

SEQ ID NO: 2377592 - RNA, 19 nt, Bordetella pertussis
ggcgucgggcagcaggcgc

SEQ ID NO: 2377593 - RNA, 14 nt, Bordetella pertussis
ggcgucgggcuugc

SEQ ID NO: 2377594 - RNA, 13 nt, Bordetella pertussis
ggcgucgggggcg

SEQ ID NO: 2377595 - RNA, 17 nt, Bordetella pertussis
ggcgucgggggcggccg

SEQ ID NO: 2377596 - RNA, 23 nt, Bordetella pertussis
ggcgucgggguucuccuugagca

SEQ ID NO: 2377597 - RNA, 20 nt, Bordetella pertussis
ggcgucguagcccucgccca

SEQ ID NO: 2377598 - RNA, 22 nt, Bordetella pertussis
ggcgucguccaucgacgcggcg

SEQ ID NO: 2377599 - RNA, 22 nt, Bordetella pertussis
ggcgucguccguggccggcgcg

SEQ ID NO: 2377600 - RNA, 23 nt, Bordetella pertussis
ggcgucguccguggccggcgcgg

SEQ ID NO: 2377601 - RNA, 14 nt, Bordetella pertussis
ggcgucgucgccgu

SEQ ID NO: 2377602 - RNA, 20 nt, Bordetella pertussis
ggcgucgucgcgguccagca

SEQ ID NO: 2377603 - RNA, 21 nt, Bordetella pertussis
ggcgucgucgggaccggcgcg

SEQ ID NO: 2377604 - RNA, 19 nt, Bordetella pertussis
ggcgucguggggcgcggcg

SEQ ID NO: 2377605 - RNA, 22 nt, Bordetella pertussis
ggcgucguggggcgcggcggcg

SEQ ID NO: 2377606 - RNA, 12 nt, Bordetella pertussis
ggcgucguuggc

SEQ ID NO: 2377607 - RNA, 17 nt, Bordetella pertussis
ggcgucguuggccgcgu

SEQ ID NO: 2377608 - RNA, 20 nt, Bordetella pertussis
ggcgucguuggccgcguagc

SEQ ID NO: 2377609 - RNA, 21 nt, Bordetella pertussis
ggcgucucggaaaacuggcgg

SEQ ID NO: 2377610 - RNA, 19 nt, Bordetella pertussis
ggcgucugcccgugcgugc

SEQ ID NO: 2377611 - RNA, 23 nt, Bordetella pertussis
ggcgucugcccgugcgugugccu

SEQ ID NO: 2377612 - RNA, 13 nt, Bordetella pertussis
ggcgucugcucgc

SEQ ID NO: 2377613 - RNA, 15 nt, Bordetella pertussis
ggcgucugcucgccg

SEQ ID NO: 2377614 - RNA, 21 nt, Bordetella pertussis
ggcgucuggaaacuguuggcg

SEQ ID NO: 2377615 - RNA, 18 nt, Bordetella pertussis
ggcgucugguacaacauc

SEQ ID NO: 2377616 - RNA, 16 nt, Bordetella pertussis
ggcgucuucgccgacc

SEQ ID NO: 2377617 - RNA, 16 nt, Bordetella pertussis
ggcgugaaaggccagc

SEQ ID NO: 2377618 - RNA, 19 nt, Bordetella pertussis
ggcgugaaaggccagcggc

SEQ ID NO: 2377619 - RNA, 20 nt, Bordetella pertussis
ggcgugaaaggccagcggcg

SEQ ID NO: 2377620 - RNA, 15 nt, Bordetella pertussis
ggcgugaacgccccg

SEQ ID NO: 2377621 - RNA, 17 nt, Bordetella pertussis
ggcgugaacgccccggc

SEQ ID NO: 2377622 - RNA, 18 nt, Bordetella pertussis
ggcgugaacucggggugg

SEQ ID NO: 2377623 - RNA, 20 nt, Bordetella pertussis
ggcgugaccagcugcaccag

SEQ ID NO: 2377624 - RNA, 15 nt, Bordetella pertussis
ggcgugaccgcgacg

SEQ ID NO: 2377625 - RNA, 22 nt, Bordetella pertussis
ggcgugaccgcgacgcgccugc

SEQ ID NO: 2377626 - RNA, 23 nt, Bordetella pertussis
ggcgugacgcgcggguccaggcc

SEQ ID NO: 2377627 - RNA, 15 nt, Bordetella pertussis
ggcgugacguggccc

SEQ ID NO: 2377628 - RNA, 14 nt, Bordetella pertussis
ggcgugagcgccac

SEQ ID NO: 2377629 - RNA, 17 nt, Bordetella pertussis
ggcgugaugccgaccag

SEQ ID NO: 2377630 - RNA, 22 nt, Bordetella pertussis
ggcgugaugccgaccaggcccg

SEQ ID NO: 2377631 - RNA, 20 nt, Bordetella pertussis
ggcgugcagcaagcccaccg

SEQ ID NO: 2377632 - RNA, 13 nt, Bordetella pertussis
ggcgugcagcagg

SEQ ID NO: 2377633 - RNA, 15 nt, Bordetella pertussis
ggcgugcaggccggc

SEQ ID NO: 2377634 - RNA, 16 nt, Bordetella pertussis
ggcgugcaggccggcg

SEQ ID NO: 2377635 - RNA, 19 nt, Bordetella pertussis
ggcgugcaggccggcggcg

SEQ ID NO: 2377636 - RNA, 14 nt, Bordetella pertussis
ggcgugcaggcugg

SEQ ID NO: 2377637 - RNA, 19 nt, Bordetella pertussis
ggcgugcagguacgccaug

SEQ ID NO: 2377638 - RNA, 20 nt, Bordetella pertussis
ggcgugcagguacgccaugc

SEQ ID NO: 2377639 - RNA, 19 nt, Bordetella pertussis
ggcgugcagguacugggcc

SEQ ID NO: 2377640 - RNA, 13 nt, Bordetella pertussis
ggcgugccaggug

SEQ ID NO: 2377641 - RNA, 12 nt, Bordetella pertussis
ggcgugcccagg

SEQ ID NO: 2377642 - RNA, 21 nt, Bordetella pertussis
ggcgugcccaguuucgcgacc

SEQ ID NO: 2377643 - RNA, 20 nt, Bordetella pertussis
ggcgugcccguugccgcgcg

SEQ ID NO: 2377644 - RNA, 14 nt, Bordetella pertussis
ggcuccgccauugc

SEQ ID NO: 2377645 - RNA, 13 nt, Bordetella pertussis
ggcuccggccgcu

SEQ ID NO: 2377646 - RNA, 13 nt, Bordetella pertussis
ggcuccucgccac

SEQ ID NO: 2377647 - RNA, 20 nt, Bordetella pertussis
ggcuccucgcccgaccugcu

SEQ ID NO: 2377648 - RNA, 21 nt, Bordetella pertussis
ggcuccucgcccgaccugcug

SEQ ID NO: 2377649 - RNA, 22 nt, Bordetella pertussis
ggcuccucgcccgaccugcugg

SEQ ID NO: 2377650 - RNA, 14 nt, Bordetella pertussis
ggcuccugcuggcg

SEQ ID NO: 2377651 - RNA, 16 nt, Bordetella pertussis
ggcuccugcuggcgcg

SEQ ID NO: 2377652 - RNA, 17 nt, Bordetella pertussis
ggcucgaacaggcuggc

SEQ ID NO: 2377653 - RNA, 14 nt, Bordetella pertussis
ggcucgaccgccgc

SEQ ID NO: 2377654 - RNA, 16 nt, Bordetella pertussis
ggcucgaccgccgcca

SEQ ID NO: 2377655 - RNA, 20 nt, Bordetella pertussis
ggcucgagcaagggccagac

SEQ ID NO: 2377656 - RNA, 13 nt, Bordetella pertussis
ggcucgagcggca

SEQ ID NO: 2377657 - RNA, 18 nt, Bordetella pertussis
ggcucgagcggcagcagc

SEQ ID NO: 2377658 - RNA, 17 nt, Bordetella pertussis
ggcucgagcuggcuggc

SEQ ID NO: 2377659 - RNA, 21 nt, Bordetella pertussis
ggcucgagcuggcuggccagc

SEQ ID NO: 2377660 - RNA, 22 nt, Bordetella pertussis
ggcucgagcuggcuggccagcg

SEQ ID NO: 2377661 - RNA, 19 nt, Bordetella pertussis
ggcucgaggaaccagccgu

SEQ ID NO: 2377662 - RNA, 15 nt, Bordetella pertussis
ggcucgaucgccgcc

SEQ ID NO: 2377663 - RNA, 21 nt, Bordetella pertussis
ggcucgaucgccgccggcacg

SEQ ID NO: 2377664 - RNA, 17 nt, Bordetella pertussis
ggcucgaugaccagcag

SEQ ID NO: 2377665 - RNA, 14 nt, Bordetella pertussis
ggcucgaugcgucc

SEQ ID NO: 2377666 - RNA, 13 nt, Bordetella pertussis
ggcucgccggccg

SEQ ID NO: 2377667 - RNA, 14 nt, Bordetella pertussis
ggcucgccucccca

SEQ ID NO: 2377668 - RNA, 20 nt, Bordetella pertussis
ggcucgccuccccaggccag

SEQ ID NO: 2377669 - RNA, 21 nt, Bordetella pertussis
ggcucgccuccccaggccagc

SEQ ID NO: 2377670 - RNA, 17 nt, Bordetella pertussis
ggcucgcgcgagcccau

SEQ ID NO: 2377671 - RNA, 21 nt, Bordetella pertussis
ggcucgcgcgcgcgggcgcgc

SEQ ID NO: 2377672 - RNA, 16 nt, Bordetella pertussis
ggcucgcgcucgcccg

SEQ ID NO: 2377673 - RNA, 17 nt, Bordetella pertussis
ggcucgcugaccggcgu

SEQ ID NO: 2377674 - RNA, 23 nt, Bordetella pertussis
ggcucgcugucgugccgcacggu

SEQ ID NO: 2377675 - RNA, 20 nt, Bordetella pertussis
ggcucggaccuggccagcgu

SEQ ID NO: 2377676 - RNA, 16 nt, Bordetella pertussis
ggcucggccaccaugc

SEQ ID NO: 2377677 - RNA, 17 nt, Bordetella pertussis
ggcucggccaccaugcg

SEQ ID NO: 2377678 - RNA, 22 nt, Bordetella pertussis
ggcucggccaggugcgccaugc

SEQ ID NO: 2377679 - RNA, 20 nt, Bordetella pertussis
ggcucggcccuagagcaugc

SEQ ID NO: 2377680 - RNA, 16 nt, Bordetella pertussis
ggcucggcgccggcgg

SEQ ID NO: 2377681 - RNA, 16 nt, Bordetella pertussis
ggcucggucucgccca

SEQ ID NO: 2377682 - RNA, 20 nt, Bordetella pertussis
ggcucggugaugauggccag

SEQ ID NO: 2377683 - RNA, 20 nt, Bordetella pertussis
ggcucguacggcgucgggca

SEQ ID NO: 2377684 - RNA, 19 nt, Bordetella pertussis
ggcucguagucgguggggu

SEQ ID NO: 2377685 - RNA, 13 nt, Bordetella pertussis
ggcucgucgaaca

SEQ ID NO: 2377686 - RNA, 15 nt, Bordetella pertussis
ggcucgucgaacagc

SEQ ID NO: 2377687 - RNA, 13 nt, Bordetella pertussis
ggcucgucgacgc

SEQ ID NO: 2377688 - RNA, 20 nt, Bordetella pertussis
ggcucgucgacgcggccgug

SEQ ID NO: 2377689 - RNA, 18 nt, Bordetella pertussis
ggcucgugcgccuaaaca

SEQ ID NO: 2377690 - RNA, 20 nt, Bordetella pertussis
ggcucguucgcucggcgucc

SEQ ID NO: 2377691 - RNA, 12 nt, Bordetella pertussis
ggcucugaucgc

SEQ ID NO: 2377692 - RNA, 16 nt, Bordetella pertussis
ggcucugaucgcgcug

SEQ ID NO: 2377693 - RNA, 18 nt, Bordetella pertussis
ggcucugaucgcgcugga

SEQ ID NO: 2377694 - RNA, 22 nt, Bordetella pertussis
ggcucuggaucgugcccagcug

SEQ ID NO: 2377695 - RNA, 17 nt, Bordetella pertussis
ggcucuggcugacgaug

SEQ ID NO: 2377696 - RNA, 14 nt, Bordetella pertussis
ggcucugggcggag

SEQ ID NO: 2377697 - RNA, 18 nt, Bordetella pertussis
ggcucuuuuucccggcgc

SEQ ID NO: 2377698 - RNA, 21 nt, Bordetella pertussis
ggcucuuuuucgagccgcaga

SEQ ID NO: 2377699 - RNA, 16 nt, Bordetella pertussis
ggcugaaaucccccgc

SEQ ID NO: 2377700 - RNA, 20 nt, Bordetella pertussis
ggcugaaaucccccgcgucg

SEQ ID NO: 2377701 - RNA, 20 nt, Bordetella pertussis
ggcugaagaagcccggcugc

SEQ ID NO: 2377702 - RNA, 15 nt, Bordetella pertussis
ggcugaaggggcucc

SEQ ID NO: 2377703 - RNA, 14 nt, Bordetella pertussis
ggcugaaugccgcc

SEQ ID NO: 2377704 - RNA, 21 nt, Bordetella pertussis
ggcugaauuggcgcccaucgc

SEQ ID NO: 2377705 - RNA, 22 nt, Bordetella pertussis
ggcugacaccguuuuggcaggc

SEQ ID NO: 2377706 - RNA, 13 nt, Bordetella pertussis
ggcugaccagcag

SEQ ID NO: 2377707 - RNA, 15 nt, Bordetella pertussis
ggcugaccagcgcgu

SEQ ID NO: 2377708 - RNA, 12 nt, Bordetella pertussis
ggcugacgcccg

SEQ ID NO: 2377709 - RNA, 17 nt, Bordetella pertussis
ggcugacgcccggcucg

SEQ ID NO: 2377710 - RNA, 17 nt, Bordetella pertussis
ggcugagcaggccgaua

SEQ ID NO: 2377711 - RNA, 20 nt, Bordetella pertussis
ggcugagcgacaugucgccg

SEQ ID NO: 2377712 - RNA, 18 nt, Bordetella pertussis
ggcugaucacccacagca

SEQ ID NO: 2377713 - RNA, 20 nt, Bordetella pertussis
ggcugaucacccacagcagc

SEQ ID NO: 2377714 - RNA, 21 nt, Bordetella pertussis
ggcugaucacccacagcagcg

SEQ ID NO: 2377715 - RNA, 18 nt, Bordetella pertussis
ggcugauccgcaccggcg

SEQ ID NO: 2377716 - RNA, 20 nt, Bordetella pertussis
ggcugauccgcaccggcgug

SEQ ID NO: 2377717 - RNA, 22 nt, Bordetella pertussis
ggcugauccgcaccggcgugcg

SEQ ID NO: 2377718 - RNA, 18 nt, Bordetella pertussis
ggcugcaagacgcccagg

SEQ ID NO: 2377719 - RNA, 19 nt, Bordetella pertussis
ggcugcaagacgcccaggc

SEQ ID NO: 2377720 - RNA, 21 nt, Bordetella pertussis
ggcugcaagacgcccaggccc

SEQ ID NO: 2377721 - RNA, 16 nt, Bordetella pertussis
ggcugcaaggcagccu

SEQ ID NO: 2377722 - RNA, 23 nt, Bordetella pertussis
ggcugcaagucuucuucagcaug

SEQ ID NO: 2377723 - RNA, 14 nt, Bordetella pertussis
ggcugcaccagcgc

SEQ ID NO: 2377724 - RNA, 15 nt, Bordetella pertussis
ggcugcaccagcgcg

SEQ ID NO: 2377725 - RNA, 22 nt, Bordetella pertussis
ggcugcaccagcgcgccgcgcg

SEQ ID NO: 2377726 - RNA, 16 nt, Bordetella pertussis
ggcugcaccaguuugc

SEQ ID NO: 2377727 - RNA, 13 nt, Bordetella pertussis
ggcugcaccugcc

SEQ ID NO: 2377728 - RNA, 15 nt, Bordetella pertussis
ggcugcaccugccug

SEQ ID NO: 2377729 - RNA, 21 nt, Bordetella pertussis
ggcugcacgauguugccgccg

SEQ ID NO: 2377730 - RNA, 22 nt, Bordetella pertussis
ggcugcacgauguugccgccgg

SEQ ID NO: 2377731 - RNA, 12 nt, Bordetella pertussis
ggcugcagccag

SEQ ID NO: 2377732 - RNA, 13 nt, Bordetella pertussis
ggcugcagccagu

SEQ ID NO: 2377733 - RNA, 22 nt, Bordetella pertussis
ggcugcagccaguugggccagg

SEQ ID NO: 2377734 - RNA, 18 nt, Bordetella pertussis
ggcugcagcuugcgcgcc

SEQ ID NO: 2377735 - RNA, 19 nt, Bordetella pertussis
ggcugcagcuugcgcgcca

SEQ ID NO: 2377736 - RNA, 21 nt, Bordetella pertussis
ggcugcagcuugcgcgccagu

SEQ ID NO: 2377737 - RNA, 14 nt, Bordetella pertussis
ggcugcaugcgcga

SEQ ID NO: 2377738 - RNA, 21 nt, Bordetella pertussis
ggcugcaugcgcgaacgcgcg

SEQ ID NO: 2377739 - RNA, 18 nt, Bordetella pertussis
ggcugccauuccagcucc

SEQ ID NO: 2377740 - RNA, 13 nt, Bordetella pertussis
ggcugcccaccuu

SEQ ID NO: 2377741 - RNA, 21 nt, Bordetella pertussis
ggcugcccaccuugcgcgcga

SEQ ID NO: 2377742 - RNA, 21 nt, Bordetella pertussis
ggcugcccgggcugcugcacg

SEQ ID NO: 2377743 - RNA, 15 nt, Bordetella pertussis
ggcugcccucgcccg

SEQ ID NO: 2377744 - RNA, 22 nt, Bordetella pertussis
ggcugcccucgcccgugcgcgg

SEQ ID NO: 2377745 - RNA, 20 nt, Bordetella pertussis
ggcugcccucggucagcgcc

SEQ ID NO: 2377746 - RNA, 23 nt, Bordetella pertussis
ggcugcccucggucagcgccagg

SEQ ID NO: 2377747 - RNA, 17 nt, Bordetella pertussis
ggcugcccuggcccagg

SEQ ID NO: 2377748 - RNA, 15 nt, Bordetella pertussis
ggcugcccuggcgcu

SEQ ID NO: 2377749 - RNA, 17 nt, Bordetella pertussis
ggcugcccuggcgcugu

SEQ ID NO: 2377750 - RNA, 11 nt, Bordetella pertussis
ggcugcccuug

SEQ ID NO: 2377751 - RNA, 14 nt, Bordetella pertussis
ggcugccgccggcg

SEQ ID NO: 2377752 - RNA, 15 nt, Bordetella pertussis
ggcugccggcagcag

SEQ ID NO: 2377753 - RNA, 20 nt, Bordetella pertussis
ggcugccggcguuggccggg

SEQ ID NO: 2377754 - RNA, 21 nt, Bordetella pertussis
ggcugccguagcccaggucca

SEQ ID NO: 2377755 - RNA, 15 nt, Bordetella pertussis
ggcugccgucggcca

SEQ ID NO: 2377756 - RNA, 16 nt, Bordetella pertussis
ggcugccgucggccag

SEQ ID NO: 2377757 - RNA, 18 nt, Bordetella pertussis
ggcuucgauggcggcggc

SEQ ID NO: 2377758 - RNA, 18 nt, Bordetella pertussis
ggcuucgcccgccaccac

SEQ ID NO: 2377759 - RNA, 13 nt, Bordetella pertussis
ggcuucgcgcaca

SEQ ID NO: 2377760 - RNA, 16 nt, Bordetella pertussis
ggcuucgcgcagcaag

SEQ ID NO: 2377761 - RNA, 21 nt, Bordetella pertussis
ggcuucggccgucagcagcag

SEQ ID NO: 2377762 - RNA, 14 nt, Bordetella pertussis
ggcuucggcgcugg

SEQ ID NO: 2377763 - RNA, 14 nt, Bordetella pertussis
ggcuucgucauggu

SEQ ID NO: 2377764 - RNA, 23 nt, Bordetella pertussis
ggcuucgucauggucgaccagca

SEQ ID NO: 2377765 - RNA, 17 nt, Bordetella pertussis
ggcuucgucgccggcgu

SEQ ID NO: 2377766 - RNA, 22 nt, Bordetella pertussis
ggcuucuccucuuuccccuccc

SEQ ID NO: 2377767 - RNA, 16 nt, Bordetella pertussis
ggcuucugggucagcu

SEQ ID NO: 2377768 - RNA, 19 nt, Bordetella pertussis
ggcuugaccacggccagca

SEQ ID NO: 2377769 - RNA, 13 nt, Bordetella pertussis
ggcuugacgcgcg

SEQ ID NO: 2377770 - RNA, 21 nt, Bordetella pertussis
ggcuugauaugggcgagcagg

SEQ ID NO: 2377771 - RNA, 16 nt, Bordetella pertussis
ggcuugauggccagcg

SEQ ID NO: 2377772 - RNA, 19 nt, Bordetella pertussis
ggcuugauggccagcgcgc

SEQ ID NO: 2377773 - RNA, 16 nt, Bordetella pertussis
ggcuugcacgccggcc

SEQ ID NO: 2377774 - RNA, 18 nt, Bordetella pertussis
ggcuugcacgccggccac

SEQ ID NO: 2377775 - RNA, 17 nt, Bordetella pertussis
ggcuugcagcggacggc

SEQ ID NO: 2377776 - RNA, 20 nt, Bordetella pertussis
ggcuugcagcuugcgcgccc

SEQ ID NO: 2377777 - RNA, 13 nt, Bordetella pertussis
ggcuugccgcgcg

SEQ ID NO: 2377778 - RNA, 16 nt, Bordetella pertussis
ggcuugccgcggcgcg

SEQ ID NO: 2377779 - RNA, 21 nt, Bordetella pertussis
ggcuugccgcggcgcggccuu

SEQ ID NO: 2377780 - RNA, 22 nt, Bordetella pertussis
ggcuugccgguuuuuuugcgcc

SEQ ID NO: 2377781 - RNA, 22 nt, Bordetella pertussis
ggcuugcgcaccccggugucgc

SEQ ID NO: 2377782 - RNA, 15 nt, Bordetella pertussis
ggcuugcgcauacgc

SEQ ID NO: 2377783 - RNA, 17 nt, Bordetella pertussis
ggcuugcgccacgcccg

SEQ ID NO: 2377784 - RNA, 17 nt, Bordetella pertussis
ggcuugcgccagccacg

SEQ ID NO: 2377785 - RNA, 16 nt, Bordetella pertussis
ggcuugcggcgcuggc

SEQ ID NO: 2377786 - RNA, 19 nt, Bordetella pertussis
ggcuugcggcgcuggcugg

SEQ ID NO: 2377787 - RNA, 12 nt, Bordetella pertussis
ggcuugcugccc

SEQ ID NO: 2377788 - RNA, 16 nt, Bordetella pertussis
ggcuuggccgaacaua

SEQ ID NO: 2377789 - RNA, 16 nt, Bordetella pertussis
ggcuuggccucggccg

SEQ ID NO: 2377790 - RNA, 20 nt, Bordetella pertussis
ggcuuggcgugcgcgagcug

SEQ ID NO: 2377791 - RNA, 17 nt, Bordetella pertussis
ggcuugguugucgcgca

SEQ ID NO: 2377792 - RNA, 19 nt, Bordetella pertussis
ggcuuguucgagcgcgcgc

SEQ ID NO: 2377793 - RNA, 22 nt, Bordetella pertussis
ggcuuucagcgccgagcgccag

SEQ ID NO: 2377794 - RNA, 18 nt, Bordetella pertussis
ggcuuucgccgcgggccu

SEQ ID NO: 2377795 - RNA, 20 nt, Bordetella pertussis
ggcuuucgccgcgggccugc

SEQ ID NO: 2377796 - RNA, 12 nt, Bordetella pertussis
ggcuuucugcuu

SEQ ID NO: 2377797 - RNA, 14 nt, Bordetella pertussis
ggcuuugccugcga

SEQ ID NO: 2377798 - RNA, 21 nt, Bordetella pertussis
ggcuuuggcguagccggugcg

SEQ ID NO: 2377799 - RNA, 19 nt, Bordetella pertussis
ggcuuuuuuucgccgggcg

SEQ ID NO: 2377800 - RNA, 18 nt, Bordetella pertussis
gggaaaacagcgcgggcg

SEQ ID NO: 2377801 - RNA, 13 nt, Bordetella pertussis
gggaaacaggccc

SEQ ID NO: 2377802 - RNA, 22 nt, Bordetella pertussis
gggaaacggccaagcagcgccu

SEQ ID NO: 2377803 - RNA, 23 nt, Bordetella pertussis
gggaaacucgcgcagcgugaccg

SEQ ID NO: 2377804 - RNA, 13 nt, Bordetella pertussis
gggaaagcggcga

SEQ ID NO: 2377805 - RNA, 14 nt, Bordetella pertussis
gggaaccgcaccgg

SEQ ID NO: 2377806 - RNA, 21 nt, Bordetella pertussis
gggaaccgcaccggaggcgcc

SEQ ID NO: 2377807 - RNA, 20 nt, Bordetella pertussis
gggaagauguggucggcgcc

SEQ ID NO: 2377808 - RNA, 22 nt, Bordetella pertussis
gggaagauguggucggcgccga

SEQ ID NO: 2377809 - RNA, 14 nt, Bordetella pertussis
gggaagccgccggc

SEQ ID NO: 2377810 - RNA, 13 nt, Bordetella pertussis
gggaagcugucgg

SEQ ID NO: 2377811 - RNA, 15 nt, Bordetella pertussis
gggaagcugucggcg

SEQ ID NO: 2377812 - RNA, 16 nt, Bordetella pertussis
gggaagcugucggcgc

SEQ ID NO: 2377813 - RNA, 20 nt, Bordetella pertussis
gggaaggccgcgccgcggca

SEQ ID NO: 2377814 - RNA, 17 nt, Bordetella pertussis
gggaaggggcggcuuca

SEQ ID NO: 2377815 - RNA, 21 nt, Bordetella pertussis
gggaauccgcugcgccgaggc

SEQ ID NO: 2377816 - RNA, 21 nt, Bordetella pertussis
gggaaucggcaccucggcgcc

SEQ ID NO: 2377817 - RNA, 20 nt, Bordetella pertussis
gggaaugucccacaggcgcg

SEQ ID NO: 2377818 - RNA, 21 nt, Bordetella pertussis
gggacaggcacaccgugccgc

SEQ ID NO: 2377819 - RNA, 15 nt, Bordetella pertussis
gggacaggcaccccc

SEQ ID NO: 2377820 - RNA, 22 nt, Bordetella pertussis
gggacaggcaccccgucaugcg

SEQ ID NO: 2377821 - RNA, 15 nt, Bordetella pertussis
gggacaggcaccccu

SEQ ID NO: 2377822 - RNA, 16 nt, Bordetella pertussis
gggacaggcacccgca

SEQ ID NO: 2377823 - RNA, 19 nt, Bordetella pertussis
gggacaggcacccgcacgg

SEQ ID NO: 2377824 - RNA, 15 nt, Bordetella pertussis
gggacaggcacccgg

SEQ ID NO: 2377825 - RNA, 20 nt, Bordetella pertussis
gggacaggcacccugucaua

SEQ ID NO: 2377826 - RNA, 16 nt, Bordetella pertussis
gggacaggcacgcgcc

SEQ ID NO: 2377827 - RNA, 12 nt, Bordetella pertussis
gggacaggcgcc

SEQ ID NO: 2377828 - RNA, 22 nt, Bordetella pertussis
gggaccgugccgccgaggauca

SEQ ID NO: 2377829 - RNA, 16 nt, Bordetella pertussis
gggacgcaggcccagc

SEQ ID NO: 2377830 - RNA, 13 nt, Bordetella pertussis
gggacgccagccc

SEQ ID NO: 2377831 - RNA, 23 nt, Bordetella pertussis
gggacgccagcccgccggcgcgc

SEQ ID NO: 2377832 - RNA, 15 nt, Bordetella pertussis
gggacgccggcgggc

SEQ ID NO: 2377833 - RNA, 12 nt, Bordetella pertussis
gggacgcgggcc

SEQ ID NO: 2377834 - RNA, 14 nt, Bordetella pertussis
gggacggccagggg

SEQ ID NO: 2377835 - RNA, 22 nt, Bordetella pertussis
gggacggccaggggcagcucgg

SEQ ID NO: 2377836 - RNA, 15 nt, Bordetella pertussis
gggacggcgcgggca

SEQ ID NO: 2377837 - RNA, 14 nt, Bordetella pertussis
gggacgggccagcc

SEQ ID NO: 2377838 - RNA, 16 nt, Bordetella pertussis
gggacuggcacccgca

SEQ ID NO: 2377839 - RNA, 17 nt, Bordetella pertussis
gggacuggcacccgcca

SEQ ID NO: 2377840 - RNA, 14 nt, Bordetella pertussis
gggacuggcaccgg

SEQ ID NO: 2377841 - RNA, 19 nt, Bordetella pertussis
gggacuggcucccaccggu

SEQ ID NO: 2377842 - RNA, 21 nt, Bordetella pertussis
gggagaucuguaccgccgggu

SEQ ID NO: 2377843 - RNA, 22 nt, Bordetella pertussis
gggagcccgcacauacaaggcg

SEQ ID NO: 2377844 - RNA, 15 nt, Bordetella pertussis
gggagccucuggaag

SEQ ID NO: 2377845 - RNA, 14 nt, Bordetella pertussis
gggagcggccagca

SEQ ID NO: 2377846 - RNA, 22 nt, Bordetella pertussis
gggagcggccagcaagcgcgcc

SEQ ID NO: 2377847 - RNA, 21 nt, Bordetella pertussis
gggaggccucgacgcuguaga

SEQ ID NO: 2377848 - RNA, 15 nt, Bordetella pertussis
gggagugcgaggacg

SEQ ID NO: 2377849 - RNA, 19 nt, Bordetella pertussis
gggaguucugguaggugug

SEQ ID NO: 2377850 - RNA, 16 nt, Bordetella pertussis
gggaucaccagcccgg

SEQ ID NO: 2377851 - RNA, 20 nt, Bordetella pertussis
gggauccacgccgccggcca

SEQ ID NO: 2377852 - RNA, 14 nt, Bordetella pertussis
gggauccggcagca

SEQ ID NO: 2377853 - RNA, 16 nt, Bordetella pertussis
gggauccgugcggcgc

SEQ ID NO: 2377854 - RNA, 16 nt, Bordetella pertussis
gggaucgcgccaggcg

SEQ ID NO: 2377855 - RNA, 13 nt, Bordetella pertussis
gggaucggccagg

SEQ ID NO: 2377856 - RNA, 17 nt, Bordetella pertussis
gggaucggccaggccgg

SEQ ID NO: 2377857 - RNA, 21 nt, Bordetella pertussis
gggaucguggcgccgcgggcc

SEQ ID NO: 2377858 - RNA, 14 nt, Bordetella pertussis
gggaugcaggucgg

SEQ ID NO: 2377859 - RNA, 19 nt, Bordetella pertussis
gggaugcaggucggggcgc

SEQ ID NO: 2377860 - RNA, 18 nt, Bordetella pertussis
gggaugccgguucgggcg

SEQ ID NO: 2377861 - RNA, 14 nt, Bordetella pertussis
gggaugcugcucgg

SEQ ID NO: 2377862 - RNA, 14 nt, Bordetella pertussis
gggauggaugccgu

SEQ ID NO: 2377863 - RNA, 19 nt, Bordetella pertussis
gggauguccgcgucggccg

SEQ ID NO: 2377864 - RNA, 21 nt, Bordetella pertussis
gggaugucggugaaggccacg

SEQ ID NO: 2377865 - RNA, 23 nt, Bordetella pertussis
gggauuagccucguuggucagca

SEQ ID NO: 2377866 - RNA, 16 nt, Bordetella pertussis
gggauuccugggugcu

SEQ ID NO: 2377867 - RNA, 22 nt, Bordetella pertussis
gggauugccgcgcgguggggcg

SEQ ID NO: 2377868 - RNA, 17 nt, Bordetella pertussis
gggauuggcgaaaggca

SEQ ID NO: 2377869 - RNA, 15 nt, Bordetella pertussis
gggauuucgcuggcc

SEQ ID NO: 2377870 - RNA, 15 nt, Bordetella pertussis
gggccagccagcgcc

SEQ ID NO: 2377871 - RNA, 17 nt, Bordetella pertussis
gggccagccccggcgcg

SEQ ID NO: 2377872 - RNA, 21 nt, Bordetella pertussis
gggccagccccggcgcgccgg

SEQ ID NO: 2377873 - RNA, 16 nt, Bordetella pertussis
gggccagccuggcgcc

SEQ ID NO: 2377874 - RNA, 17 nt, Bordetella pertussis
gggccagccuggcgcca

SEQ ID NO: 2377875 - RNA, 18 nt, Bordetella pertussis
gggccagcgccagcacga

SEQ ID NO: 2377876 - RNA, 19 nt, Bordetella pertussis
gggccagcgccagcacgau

SEQ ID NO: 2377877 - RNA, 13 nt, Bordetella pertussis
gggccagcgcgau

SEQ ID NO: 2377878 - RNA, 16 nt, Bordetella pertussis
gggccagcgcgaucuc

SEQ ID NO: 2377879 - RNA, 12 nt, Bordetella pertussis
gggccagcgcgg

SEQ ID NO: 2377880 - RNA, 23 nt, Bordetella pertussis
gggccagcgcggccaggucggcg

SEQ ID NO: 2377881 - RNA, 21 nt, Bordetella pertussis
gggccagcuugacguccagcc

SEQ ID NO: 2377882 - RNA, 23 nt, Bordetella pertussis
gggccagcuugacguccagccag

SEQ ID NO: 2377883 - RNA, 15 nt, Bordetella pertussis
gggccaggaccgagg

SEQ ID NO: 2377884 - RNA, 15 nt, Bordetella pertussis
gggccaggcccacgg

SEQ ID NO: 2377885 - RNA, 16 nt, Bordetella pertussis
gggccaggcccacggc

SEQ ID NO: 2377886 - RNA, 18 nt, Bordetella pertussis
gggccaggccgccgccgg

SEQ ID NO: 2377887 - RNA, 15 nt, Bordetella pertussis
gggccaggccggccc

SEQ ID NO: 2377888 - RNA, 22 nt, Bordetella pertussis
gggccaggccggcccaguccag

SEQ ID NO: 2377889 - RNA, 13 nt, Bordetella pertussis
gggccaggcgcag

SEQ ID NO: 2377890 - RNA, 21 nt, Bordetella pertussis
gggccagguauucggcgguga

SEQ ID NO: 2377891 - RNA, 19 nt, Bordetella pertussis
gggccaguagcgugugcag

SEQ ID NO: 2377892 - RNA, 21 nt, Bordetella pertussis
gggccaguagcgugugcagga

SEQ ID NO: 2377893 - RNA, 14 nt, Bordetella pertussis
gggccaguccgcag

SEQ ID NO: 2377894 - RNA, 15 nt, Bordetella pertussis
gggccaguccgcagc

SEQ ID NO: 2377895 - RNA, 16 nt, Bordetella pertussis
gggccaguccgcagcg

SEQ ID NO: 2377896 - RNA, 18 nt, Bordetella pertussis
gggccaguccgcagcgca

SEQ ID NO: 2377897 - RNA, 17 nt, Bordetella pertussis
gggccagucguucagcg

SEQ ID NO: 2377898 - RNA, 17 nt, Bordetella pertussis
gggccaguucggcuugc

SEQ ID NO: 2377899 - RNA, 21 nt, Bordetella pertussis
gggccaucagguuguccagcg

SEQ ID NO: 2377900 - RNA, 19 nt, Bordetella pertussis
gggccauccguccgccagg

SEQ ID NO: 2377901 - RNA, 20 nt, Bordetella pertussis
gggccauccguccgccagga

SEQ ID NO: 2377902 - RNA, 23 nt, Bordetella pertussis
gggccaugccguccugcugcggc

SEQ ID NO: 2377903 - RNA, 20 nt, Bordetella pertussis
gggccaugcgggucaggccg

SEQ ID NO: 2377904 - RNA, 21 nt, Bordetella pertussis
gggccaugcguaucggcagcg

SEQ ID NO: 2377905 - RNA, 16 nt, Bordetella pertussis
gggccauggcacaggc

SEQ ID NO: 2377906 - RNA, 19 nt, Bordetella pertussis
gggccauggcagggcgccg

SEQ ID NO: 2377907 - RNA, 18 nt, Bordetella pertussis
gggcccacaugccgugcc

SEQ ID NO: 2377908 - RNA, 16 nt, Bordetella pertussis
gggcccgcgcagacgg

SEQ ID NO: 2377909 - RNA, 17 nt, Bordetella pertussis
gggcccgcucggccagc

SEQ ID NO: 2377910 - RNA, 19 nt, Bordetella pertussis
gggcccggacgcggccggc

SEQ ID NO: 2377911 - RNA, 20 nt, Bordetella pertussis
gggcccggacgcggccggca

SEQ ID NO: 2377912 - RNA, 13 nt, Bordetella pertussis
gggcccggccacg

SEQ ID NO: 2377913 - RNA, 19 nt, Bordetella pertussis
gggcccggcguagcugcgc

SEQ ID NO: 2377914 - RNA, 13 nt, Bordetella pertussis
gggcccgggcgcg

SEQ ID NO: 2377915 - RNA, 22 nt, Bordetella pertussis
gggcccuggcguucgcgcgcgg

SEQ ID NO: 2377916 - RNA, 22 nt, Bordetella pertussis
gggcccuugugcguuggcgcgg

SEQ ID NO: 2377917 - RNA, 13 nt, Bordetella pertussis
gggccgaccaggc

SEQ ID NO: 2377918 - RNA, 20 nt, Bordetella pertussis
gggccgacggccucggccag

SEQ ID NO: 2377919 - RNA, 20 nt, Bordetella pertussis
gggccgagcccgcgucggcg

SEQ ID NO: 2377920 - RNA, 23 nt, Bordetella pertussis
gggccgagcccgcgucggcgcgg

SEQ ID NO: 2377921 - RNA, 17 nt, Bordetella pertussis
gggccgagcgcgccagc

SEQ ID NO: 2377922 - RNA, 18 nt, Bordetella pertussis
gggccgagcgcgccagca

SEQ ID NO: 2377923 - RNA, 12 nt, Bordetella pertussis
gggccgaggcgc

SEQ ID NO: 2377924 - RNA, 14 nt, Bordetella pertussis
gggccgaucccuug

SEQ ID NO: 2377925 - RNA, 23 nt, Bordetella pertussis
gggccgaucccuugugcgcgcca

SEQ ID NO: 2377926 - RNA, 17 nt, Bordetella pertussis
gggccgcagcauggcgc

SEQ ID NO: 2377927 - RNA, 19 nt, Bordetella pertussis
gggccgcagcauggcgcca

SEQ ID NO: 2377928 - RNA, 11 nt, Bordetella pertussis
gggccgcagcg

SEQ ID NO: 2377929 - RNA, 13 nt, Bordetella pertussis
gggccgcagcugg

SEQ ID NO: 2377930 - RNA, 14 nt, Bordetella pertussis
gggccgcagcugga

SEQ ID NO: 2377931 - RNA, 18 nt, Bordetella pertussis
gggccgccagcaccugcu

SEQ ID NO: 2377932 - RNA, 13 nt, Bordetella pertussis
gggccgccagggc

SEQ ID NO: 2377933 - RNA, 12 nt, Bordetella pertussis
gggccgccaugu

SEQ ID NO: 2377934 - RNA, 12 nt, Bordetella pertussis
gggccgcccagc

SEQ ID NO: 2377935 - RNA, 13 nt, Bordetella pertussis
gggccgcccagca

SEQ ID NO: 2377936 - RNA, 22 nt, Bordetella pertussis
gggccgccgcgcccagccgcgc

SEQ ID NO: 2377937 - RNA, 22 nt, Bordetella pertussis
gggccgccucggcggccagcgc

SEQ ID NO: 2377938 - RNA, 16 nt, Bordetella pertussis
gggccgccugcugggc

SEQ ID NO: 2377939 - RNA, 19 nt, Bordetella pertussis
gggccgcgagcaugcgcag

SEQ ID NO: 2377940 - RNA, 23 nt, Bordetella pertussis
gggccgcgagcaugcgcagcgcg

SEQ ID NO: 2377941 - RNA, 14 nt, Bordetella pertussis
gggccgcgccgcgg

SEQ ID NO: 2377942 - RNA, 17 nt, Bordetella pertussis
gggccgcgccgcggcac

SEQ ID NO: 2377943 - RNA, 19 nt, Bordetella pertussis
gggccgcgccgcggcacgg

SEQ ID NO: 2377944 - RNA, 12 nt, Bordetella pertussis
gggccgcgccgg

SEQ ID NO: 2377945 - RNA, 16 nt, Bordetella pertussis
gggccgcgccugcagg

SEQ ID NO: 2377946 - RNA, 16 nt, Bordetella pertussis
gggccgcgcgauccug

SEQ ID NO: 2377947 - RNA, 23 nt, Bordetella pertussis
gggccgcgcgaugcgcggcccgg

SEQ ID NO: 2377948 - RNA, 13 nt, Bordetella pertussis
gggccgcgcgcca

SEQ ID NO: 2377949 - RNA, 22 nt, Bordetella pertussis
gggccgcgcgccaaucagaugg

SEQ ID NO: 2377950 - RNA, 17 nt, Bordetella pertussis
gggccgcgcgcgggcgc

SEQ ID NO: 2377951 - RNA, 22 nt, Bordetella pertussis
gggccgcgcucgaauggcugcg

SEQ ID NO: 2377952 - RNA, 22 nt, Bordetella pertussis
gggccgcggacgaagccuaggc

SEQ ID NO: 2377953 - RNA, 16 nt, Bordetella pertussis
gggccgcggcgcgcgc

SEQ ID NO: 2377954 - RNA, 18 nt, Bordetella pertussis
gggccgcggcgcgcgcgg

SEQ ID NO: 2377955 - RNA, 12 nt, Bordetella pertussis
gggccgcugguc

SEQ ID NO: 2377956 - RNA, 18 nt, Bordetella pertussis
gggccgcuggucaccgcc

SEQ ID NO: 2377957 - RNA, 21 nt, Bordetella pertussis
gggccggaacagcguccagcc

SEQ ID NO: 2377958 - RNA, 16 nt, Bordetella pertussis
gggccggacuggcgcg

SEQ ID NO: 2377959 - RNA, 15 nt, Bordetella pertussis
gggccggccgcgcgc

SEQ ID NO: 2377960 - RNA, 23 nt, Bordetella pertussis
gggccggccgcgcgcgccaggcc

SEQ ID NO: 2377961 - RNA, 16 nt, Bordetella pertussis
gggccggccgggcgcg

SEQ ID NO: 2377962 - RNA, 17 nt, Bordetella pertussis
gggccggccgggcgcgg

SEQ ID NO: 2377963 - RNA, 15 nt, Bordetella pertussis
gggccggccugcguc

SEQ ID NO: 2377964 - RNA, 17 nt, Bordetella pertussis
gggccggccugcgucgc

SEQ ID NO: 2377965 - RNA, 23 nt, Bordetella pertussis
gggccggcgaugaagucgcggcc

SEQ ID NO: 2377966 - RNA, 14 nt, Bordetella pertussis
gggccggcgccagc

SEQ ID NO: 2377967 - RNA, 15 nt, Bordetella pertussis
gggccggcgccagca

SEQ ID NO: 2377968 - RNA, 13 nt, Bordetella pertussis
gggccggcgccgg

SEQ ID NO: 2377969 - RNA, 14 nt, Bordetella pertussis
gggccggcgcgccg

SEQ ID NO: 2377970 - RNA, 15 nt, Bordetella pertussis
gggccggcgcgccgc

SEQ ID NO: 2377971 - RNA, 14 nt, Bordetella pertussis
gggccggcgcgcgc

SEQ ID NO: 2377972 - RNA, 17 nt, Bordetella pertussis
gggccggcgcgcgcagg

SEQ ID NO: 2377973 - RNA, 18 nt, Bordetella pertussis
gggccggcgcgcgcaggc

SEQ ID NO: 2377974 - RNA, 12 nt, Bordetella pertussis
gggccggcggca

SEQ ID NO: 2377975 - RNA, 14 nt, Bordetella pertussis
gggccggcggcagc

SEQ ID NO: 2377976 - RNA, 14 nt, Bordetella pertussis
gggccggcgggcau

SEQ ID NO: 2377977 - RNA, 20 nt, Bordetella pertussis
gggccggcucauucggcgcg

SEQ ID NO: 2377978 - RNA, 21 nt, Bordetella pertussis
gggccggcucauucggcgcgc

SEQ ID NO: 2377979 - RNA, 13 nt, Bordetella pertussis
gggccggcugccg

SEQ ID NO: 2377980 - RNA, 15 nt, Bordetella pertussis
gggccggcugggcgg

SEQ ID NO: 2377981 - RNA, 19 nt, Bordetella pertussis
gggccggcuuuggacaggc

SEQ ID NO: 2377982 - RNA, 13 nt, Bordetella pertussis
gggccgggcaggc

SEQ ID NO: 2377983 - RNA, 22 nt, Bordetella pertussis
gggcgccugcagacgcagugga

SEQ ID NO: 2377984 - RNA, 18 nt, Bordetella pertussis
gggcgccugccccggcag

SEQ ID NO: 2377985 - RNA, 13 nt, Bordetella pertussis
gggcgccuggcug

SEQ ID NO: 2377986 - RNA, 20 nt, Bordetella pertussis
gggcgccuguccccgcagga

SEQ ID NO: 2377987 - RNA, 13 nt, Bordetella pertussis
gggcgcgaugggc

SEQ ID NO: 2377988 - RNA, 16 nt, Bordetella pertussis
gggcgcgaugggccug

SEQ ID NO: 2377989 - RNA, 19 nt, Bordetella pertussis
gggcgcgaugggccugccc

SEQ ID NO: 2377990 - RNA, 14 nt, Bordetella pertussis
gggcgcgcagcagg

SEQ ID NO: 2377991 - RNA, 21 nt, Bordetella pertussis
gggcgcgcagcaggcccaugc

SEQ ID NO: 2377992 - RNA, 23 nt, Bordetella pertussis
gggcgcgccagcacgaaccacag

SEQ ID NO: 2377993 - RNA, 23 nt, Bordetella pertussis
gggcgcgcccagccccgcggccg

SEQ ID NO: 2377994 - RNA, 14 nt, Bordetella pertussis
gggcgcgcccggcg

SEQ ID NO: 2377995 - RNA, 15 nt, Bordetella pertussis
gggcgcgccgcagcg

SEQ ID NO: 2377996 - RNA, 17 nt, Bordetella pertussis
gggcgcgccgcggcggg

SEQ ID NO: 2377997 - RNA, 18 nt, Bordetella pertussis
gggcgcgccgcugcagcg

SEQ ID NO: 2377998 - RNA, 16 nt, Bordetella pertussis
gggcgcgccggcgggc

SEQ ID NO: 2377999 - RNA, 17 nt, Bordetella pertussis
gggcgcgccggcgggcg

SEQ ID NO: 2378000 - RNA, 21 nt, Bordetella pertussis
gggcgcgcgcccaggccagcc

SEQ ID NO: 2378001 - RNA, 15 nt, Bordetella pertussis
gggcgcgcgccggcg

SEQ ID NO: 2378002 - RNA, 13 nt, Bordetella pertussis
gggcgcggcaggc

SEQ ID NO: 2378003 - RNA, 15 nt, Bordetella pertussis
gggcgcggcaggcgg

SEQ ID NO: 2378004 - RNA, 23 nt, Bordetella pertussis
gggcgcggcauggcgccgcgccg

SEQ ID NO: 2378005 - RNA, 13 nt, Bordetella pertussis
gggcgcggccagg

SEQ ID NO: 2378006 - RNA, 14 nt, Bordetella pertussis
gggcgcggccaggc

SEQ ID NO: 2378007 - RNA, 22 nt, Bordetella pertussis
gggcgcggccaggcgcucagcg

SEQ ID NO: 2378008 - RNA, 15 nt, Bordetella pertussis
gggcgcggccagggu

SEQ ID NO: 2378009 - RNA, 16 nt, Bordetella pertussis
gggcgcggcgcccgcc

SEQ ID NO: 2378010 - RNA, 12 nt, Bordetella pertussis
gggcgcggcgcg

SEQ ID NO: 2378011 - RNA, 17 nt, Bordetella pertussis
gggcgcggcgcgcgccg

SEQ ID NO: 2378012 - RNA, 22 nt, Bordetella pertussis
gggcgcggcggccugggcgggc

SEQ ID NO: 2378013 - RNA, 14 nt, Bordetella pertussis
gggcgcggcggcgu

SEQ ID NO: 2378014 - RNA, 12 nt, Bordetella pertussis
gggcgcggcggu

SEQ ID NO: 2378015 - RNA, 23 nt, Bordetella pertussis
gggcgcggcgucgauguccuucu

SEQ ID NO: 2378016 - RNA, 15 nt, Bordetella pertussis
gggcgcggugcgcac

SEQ ID NO: 2378017 - RNA, 20 nt, Bordetella pertussis
gggcgcggugcgcaccaggc

SEQ ID NO: 2378018 - RNA, 16 nt, Bordetella pertussis
gggcgcguccaagcag

SEQ ID NO: 2378019 - RNA, 13 nt, Bordetella pertussis
gggcgcguggccc

SEQ ID NO: 2378020 - RNA, 15 nt, Bordetella pertussis
gggcgcugcccagga

SEQ ID NO: 2378021 - RNA, 14 nt, Bordetella pertussis
gggcgcugcgccgg

SEQ ID NO: 2378022 - RNA, 18 nt, Bordetella pertussis
gggcgcuuggcccugcag

SEQ ID NO: 2378023 - RNA, 23 nt, Bordetella pertussis
gggcgcuuggcccugcagcggcc

SEQ ID NO: 2378024 - RNA, 22 nt, Bordetella pertussis
gggcggaucgccgaagucggcg

SEQ ID NO: 2378025 - RNA, 16 nt, Bordetella pertussis
gggcggaugagcaggc

SEQ ID NO: 2378026 - RNA, 18 nt, Bordetella pertussis
gggcggaugagcaggccg

SEQ ID NO: 2378027 - RNA, 14 nt, Bordetella pertussis
gggcggcaggugcg

SEQ ID NO: 2378028 - RNA, 18 nt, Bordetella pertussis
gggcggcaggugcgccag

SEQ ID NO: 2378029 - RNA, 21 nt, Bordetella pertussis
gggcggcaggugcgccagcac

SEQ ID NO: 2378030 - RNA, 14 nt, Bordetella pertussis
gggcggccacggcg

SEQ ID NO: 2378031 - RNA, 13 nt, Bordetella pertussis
gggcggccaggcc

SEQ ID NO: 2378032 - RNA, 16 nt, Bordetella pertussis
gggcggccaggccggu

SEQ ID NO: 2378033 - RNA, 14 nt, Bordetella pertussis
gggcggccaggcgg

SEQ ID NO: 2378034 - RNA, 12 nt, Bordetella pertussis
gggcggcccagc

SEQ ID NO: 2378035 - RNA, 20 nt, Bordetella pertussis
gggcggccccggccgccccc

SEQ ID NO: 2378036 - RNA, 12 nt, Bordetella pertussis
gggcggcccggc

SEQ ID NO: 2378037 - RNA, 13 nt, Bordetella pertussis
gggcggcccggcc

SEQ ID NO: 2378038 - RNA, 12 nt, Bordetella pertussis
gggcggccggca

SEQ ID NO: 2378039 - RNA, 22 nt, Bordetella pertussis
gggcggccggcgcgucgccggc

SEQ ID NO: 2378040 - RNA, 14 nt, Bordetella pertussis
gggcggccgggagc

SEQ ID NO: 2378041 - RNA, 14 nt, Bordetella pertussis
gggcggccucgacg

SEQ ID NO: 2378042 - RNA, 20 nt, Bordetella pertussis
gggcggccucggccagcugg

SEQ ID NO: 2378043 - RNA, 11 nt, Bordetella pertussis
gggcggccugg

SEQ ID NO: 2378044 - RNA, 21 nt, Bordetella pertussis
gggcggccugggaggcgcuga

SEQ ID NO: 2378045 - RNA, 22 nt, Bordetella pertussis
gggcggccuuggccgcagccgg

SEQ ID NO: 2378046 - RNA, 14 nt, Bordetella pertussis
gggcggcgagccga

SEQ ID NO: 2378047 - RNA, 13 nt, Bordetella pertussis
gggcggcgcagca

SEQ ID NO: 2378048 - RNA, 12 nt, Bordetella pertussis
gggcggcgccgg

SEQ ID NO: 2378049 - RNA, 12 nt, Bordetella pertussis
gggcggcggcga

SEQ ID NO: 2378050 - RNA, 21 nt, Bordetella pertussis
gggcggcggcgcccgcaugga

SEQ ID NO: 2378051 - RNA, 21 nt, Bordetella pertussis
gggcggcggcguggcggcggg

SEQ ID NO: 2378052 - RNA, 15 nt, Bordetella pertussis
gggcggcggguggcg

SEQ ID NO: 2378053 - RNA, 16 nt, Bordetella pertussis
gggcggcguagagcgc

SEQ ID NO: 2378054 - RNA, 18 nt, Bordetella pertussis
gggcggcguagagcgccg

SEQ ID NO: 2378055 - RNA, 14 nt, Bordetella pertussis
gggcggcgucgccg

SEQ ID NO: 2378056 - RNA, 12 nt, Bordetella pertussis
gggcggcguugu

SEQ ID NO: 2378057 - RNA, 15 nt, Bordetella pertussis
gggcggcuaggcgca

SEQ ID NO: 2378058 - RNA, 17 nt, Bordetella pertussis
gggcggcugccaguggu

SEQ ID NO: 2378059 - RNA, 14 nt, Bordetella pertussis
gggcggcugcccgg

SEQ ID NO: 2378060 - RNA, 16 nt, Bordetella pertussis
gggcggcugcccgggc

SEQ ID NO: 2378061 - RNA, 13 nt, Bordetella pertussis
gggcggcugcugg

SEQ ID NO: 2378062 - RNA, 18 nt, Bordetella pertussis
gggcggcuucaggcgcgc

SEQ ID NO: 2378063 - RNA, 13 nt, Bordetella pertussis
gggcgggcgcugc

SEQ ID NO: 2378064 - RNA, 13 nt, Bordetella pertussis
gggcgggcgggcg

SEQ ID NO: 2378065 - RNA, 16 nt, Bordetella pertussis
gggcgggcugguggug

SEQ ID NO: 2378066 - RNA, 17 nt, Bordetella pertussis
gggcggggcgugagcag

SEQ ID NO: 2378067 - RNA, 19 nt, Bordetella pertussis
gggcggggcgugagcaggc

SEQ ID NO: 2378068 - RNA, 17 nt, Bordetella pertussis
gggcgguacaggucgag

SEQ ID NO: 2378069 - RNA, 20 nt, Bordetella pertussis
gggcgguaccguccuggcag

SEQ ID NO: 2378070 - RNA, 20 nt, Bordetella pertussis
gggcggucaaugcggcggcg

SEQ ID NO: 2378071 - RNA, 21 nt, Bordetella pertussis
gggcgguccgguucgcccacc

SEQ ID NO: 2378072 - RNA, 22 nt, Bordetella pertussis
gggcgguccgguucgcccacca

SEQ ID NO: 2378073 - RNA, 13 nt, Bordetella pertussis
gggcggugggcag

SEQ ID NO: 2378074 - RNA, 16 nt, Bordetella pertussis
gggcggugggcagcgc

SEQ ID NO: 2378075 - RNA, 14 nt, Bordetella pertussis
gggcguagcucagc

SEQ ID NO: 2378076 - RNA, 17 nt, Bordetella pertussis
gggcguagcucagccug

SEQ ID NO: 2378077 - RNA, 18 nt, Bordetella pertussis
gggcguagcucagccugg

SEQ ID NO: 2378078 - RNA, 21 nt, Bordetella pertussis
gggcgucaucggcgcgcagca

SEQ ID NO: 2378079 - RNA, 13 nt, Bordetella pertussis
gggcgucccaggc

SEQ ID NO: 2378080 - RNA, 16 nt, Bordetella pertussis
gggcgucccaggccac

SEQ ID NO: 2378081 - RNA, 17 nt, Bordetella pertussis
gggcgucgcgaugcgcc

SEQ ID NO: 2378082 - RNA, 13 nt, Bordetella pertussis
gggcgucgcggcg

SEQ ID NO: 2378083 - RNA, 18 nt, Bordetella pertussis
gggcgucguccugcagca

SEQ ID NO: 2378084 - RNA, 16 nt, Bordetella pertussis
gggcgucgucgccguc

SEQ ID NO: 2378085 - RNA, 18 nt, Bordetella pertussis
gggcgucgucgcggucca

SEQ ID NO: 2378086 - RNA, 20 nt, Bordetella pertussis
gggcgucugcccgcggucca

SEQ ID NO: 2378087 - RNA, 23 nt, Bordetella pertussis
gggcgugaaaggccagcggcggu

SEQ ID NO: 2378088 - RNA, 23 nt, Bordetella pertussis
gggcgugaccagcugcaccaggc

SEQ ID NO: 2378089 - RNA, 22 nt, Bordetella pertussis
gggcgugagcaggcgccugccc

SEQ ID NO: 2378090 - RNA, 20 nt, Bordetella pertussis
gggcgugaugccgaccaggc

SEQ ID NO: 2378091 - RNA, 23 nt, Bordetella pertussis
gggcgugcccucgcugcgcguca

SEQ ID NO: 2378092 - RNA, 13 nt, Bordetella pertussis
gggcgugcccuug

SEQ ID NO: 2378093 - RNA, 20 nt, Bordetella pertussis
gggcgugcccuugagcgugg

SEQ ID NO: 2378094 - RNA, 13 nt, Bordetella pertussis
gggcgugccugcu

SEQ ID NO: 2378095 - RNA, 22 nt, Bordetella pertussis
gggcgugcggauggucgagcgc

SEQ ID NO: 2378096 - RNA, 17 nt, Bordetella pertussis
gggcguggccgcaguca

SEQ ID NO: 2378097 - RNA, 22 nt, Bordetella pertussis
ggggcgccccaacgcggccagc

SEQ ID NO: 2378098 - RNA, 13 nt, Bordetella pertussis
ggggcgcggccgg

SEQ ID NO: 2378099 - RNA, 14 nt, Bordetella pertussis
ggggcgcggccggu

SEQ ID NO: 2378100 - RNA, 14 nt, Bordetella pertussis
ggggcgcggcggcg

SEQ ID NO: 2378101 - RNA, 13 nt, Bordetella pertussis
ggggcgcuggucg

SEQ ID NO: 2378102 - RNA, 20 nt, Bordetella pertussis
ggggcggaugagcaggccgg

SEQ ID NO: 2378103 - RNA, 12 nt, Bordetella pertussis
ggggcggcaggu

SEQ ID NO: 2378104 - RNA, 14 nt, Bordetella pertussis
ggggcggcccagcg

SEQ ID NO: 2378105 - RNA, 13 nt, Bordetella pertussis
ggggcggccggga

SEQ ID NO: 2378106 - RNA, 14 nt, Bordetella pertussis
ggggcggcgcagca

SEQ ID NO: 2378107 - RNA, 16 nt, Bordetella pertussis
ggggcggcgcggcgcu

SEQ ID NO: 2378108 - RNA, 17 nt, Bordetella pertussis
ggggcggcggcgcccgc

SEQ ID NO: 2378109 - RNA, 19 nt, Bordetella pertussis
ggggcggcggguggcggcg

SEQ ID NO: 2378110 - RNA, 15 nt, Bordetella pertussis
ggggcggcucggccc

SEQ ID NO: 2378111 - RNA, 16 nt, Bordetella pertussis
ggggcgggcgcugcgc

SEQ ID NO: 2378112 - RNA, 20 nt, Bordetella pertussis
ggggcguagcucagccuggu

SEQ ID NO: 2378113 - RNA, 15 nt, Bordetella pertussis
ggggcguccaccgcc

SEQ ID NO: 2378114 - RNA, 22 nt, Bordetella pertussis
ggggcgucgucgcgguccagca

SEQ ID NO: 2378115 - RNA, 14 nt, Bordetella pertussis
ggggcguggccgca

SEQ ID NO: 2378116 - RNA, 22 nt, Bordetella pertussis
ggggcguggggagcgcggcccg

SEQ ID NO: 2378117 - RNA, 19 nt, Bordetella pertussis
ggggcguucgacgggcagg

SEQ ID NO: 2378118 - RNA, 20 nt, Bordetella pertussis
ggggcguucgacgggcaggc

SEQ ID NO: 2378119 - RNA, 14 nt, Bordetella pertussis
ggggcucguggugg

SEQ ID NO: 2378120 - RNA, 20 nt, Bordetella pertussis
ggggcucuucgacagcgcgc

SEQ ID NO: 2378121 - RNA, 14 nt, Bordetella pertussis
ggggcugcugggcc

SEQ ID NO: 2378122 - RNA, 11 nt, Bordetella pertussis
ggggcuggagg

SEQ ID NO: 2378123 - RNA, 14 nt, Bordetella pertussis
ggggcuggaggcgc

SEQ ID NO: 2378124 - RNA, 17 nt, Bordetella pertussis
ggggcuggccgccgcgg

SEQ ID NO: 2378125 - RNA, 19 nt, Bordetella pertussis
ggggcugucgcgcgcaucg

SEQ ID NO: 2378126 - RNA, 11 nt, Bordetella pertussis
gggggacuggc

SEQ ID NO: 2378127 - RNA, 17 nt, Bordetella pertussis
gggggacuggcacccgc

SEQ ID NO: 2378128 - RNA, 18 nt, Bordetella pertussis
gggggacuggcaccggca

SEQ ID NO: 2378129 - RNA, 16 nt, Bordetella pertussis
gggggcauggcgccgc

SEQ ID NO: 2378130 - RNA, 15 nt, Bordetella pertussis
gggggcgccccaacg

SEQ ID NO: 2378131 - RNA, 17 nt, Bordetella pertussis
gggggcgcggcggcggc

SEQ ID NO: 2378132 - RNA, 14 nt, Bordetella pertussis
gggggcgcgguauu

SEQ ID NO: 2378133 - RNA, 12 nt, Bordetella pertussis
gggggcgggccc

SEQ ID NO: 2378134 - RNA, 11 nt, Bordetella pertussis
gggggcguggc

SEQ ID NO: 2378135 - RNA, 17 nt, Bordetella pertussis
gggggcuggcgcuugcc

SEQ ID NO: 2378136 - RNA, 14 nt, Bordetella pertussis
gggggucaggccgu

SEQ ID NO: 2378137 - RNA, 12 nt, Bordetella pertussis
ggggguucgugg

SEQ ID NO: 2378138 - RNA, 15 nt, Bordetella pertussis
ggggguucgugggcg

SEQ ID NO: 2378139 - RNA, 18 nt, Bordetella pertussis
ggggguucgugggcgagc

SEQ ID NO: 2378140 - RNA, 21 nt, Bordetella pertussis
ggggguugccagauaaggcgg

SEQ ID NO: 2378141 - RNA, 23 nt, Bordetella pertussis
gggguagucggccaccaggccgu

SEQ ID NO: 2378142 - RNA, 12 nt, Bordetella pertussis
ggggucagcgcc

SEQ ID NO: 2378143 - RNA, 14 nt, Bordetella pertussis
ggggucagcgccga

SEQ ID NO: 2378144 - RNA, 13 nt, Bordetella pertussis
ggggucgccgggc

SEQ ID NO: 2378145 - RNA, 20 nt, Bordetella pertussis
ggggucgggccgcgcgcggg

SEQ ID NO: 2378146 - RNA, 17 nt, Bordetella pertussis
ggggucggggcaggccu

SEQ ID NO: 2378147 - RNA, 20 nt, Bordetella pertussis
ggggucgucggcgcugcagc

SEQ ID NO: 2378148 - RNA, 20 nt, Bordetella pertussis
ggggucugcaggugccuguc

SEQ ID NO: 2378149 - RNA, 14 nt, Bordetella pertussis
ggggucuugccgcg

SEQ ID NO: 2378150 - RNA, 17 nt, Bordetella pertussis
ggggugaucugcgccau

SEQ ID NO: 2378151 - RNA, 20 nt, Bordetella pertussis
ggggugccguucggccagcg

SEQ ID NO: 2378152 - RNA, 22 nt, Bordetella pertussis
ggggugccuguccccgcggagg

SEQ ID NO: 2378153 - RNA, 21 nt, Bordetella pertussis
ggggugccuguccccgcuggg

SEQ ID NO: 2378154 - RNA, 19 nt, Bordetella pertussis
ggggugcuccugccaggcg

SEQ ID NO: 2378155 - RNA, 18 nt, Bordetella pertussis
gggguggaaaugccggcg

SEQ ID NO: 2378156 - RNA, 22 nt, Bordetella pertussis
gggguggcacagccgcagccgu

SEQ ID NO: 2378157 - RNA, 13 nt, Bordetella pertussis
gggguggcugucc

SEQ ID NO: 2378158 - RNA, 22 nt, Bordetella pertussis
gggguggcuguccccgcgcggg

SEQ ID NO: 2378159 - RNA, 22 nt, Bordetella pertussis
gggguguucuccaacugggcca

SEQ ID NO: 2378160 - RNA, 22 nt, Bordetella pertussis
gggguuccugcccauggcaagc

SEQ ID NO: 2378161 - RNA, 15 nt, Bordetella pertussis
gggguucgugggcga

SEQ ID NO: 2378162 - RNA, 20 nt, Bordetella pertussis
gggguucuguccggcgcugg

SEQ ID NO: 2378163 - RNA, 16 nt, Bordetella pertussis
gggguugacguugucc

SEQ ID NO: 2378164 - RNA, 13 nt, Bordetella pertussis
gggguuggccgcc

SEQ ID NO: 2378165 - RNA, 14 nt, Bordetella pertussis
gggguuggccgcca

SEQ ID NO: 2378166 - RNA, 16 nt, Bordetella pertussis
ggguacagcgcgcccg

SEQ ID NO: 2378167 - RNA, 17 nt, Bordetella pertussis
ggguacgacggccgggg

SEQ ID NO: 2378168 - RNA, 13 nt, Bordetella pertussis
ggguacuggccga

SEQ ID NO: 2378169 - RNA, 22 nt, Bordetella pertussis
ggguagcugcugacugugcagc

SEQ ID NO: 2378170 - RNA, 14 nt, Bordetella pertussis
ggguagucggccac

SEQ ID NO: 2378171 - RNA, 21 nt, Bordetella pertussis
gggucacccgccgcaccagcc

SEQ ID NO: 2378172 - RNA, 12 nt, Bordetella pertussis
gggucagcgccg

SEQ ID NO: 2378173 - RNA, 13 nt, Bordetella pertussis
gggucagcgccgg

SEQ ID NO: 2378174 - RNA, 18 nt, Bordetella pertussis
gggucagcgccggcacgc

SEQ ID NO: 2378175 - RNA, 14 nt, Bordetella pertussis
gggucagcggccgg

SEQ ID NO: 2378176 - RNA, 16 nt, Bordetella pertussis
gggucagcggccggcc

SEQ ID NO: 2378177 - RNA, 12 nt, Bordetella pertussis
gggucaggccgu

SEQ ID NO: 2378178 - RNA, 14 nt, Bordetella pertussis
gggucaggccguug

SEQ ID NO: 2378179 - RNA, 18 nt, Bordetella pertussis
gggucaggcugcggcgga

SEQ ID NO: 2378180 - RNA, 13 nt, Bordetella pertussis
gggucaggggcag

SEQ ID NO: 2378181 - RNA, 17 nt, Bordetella pertussis
gggucaggggcaggugc

SEQ ID NO: 2378182 - RNA, 21 nt, Bordetella pertussis
gggucaggggcaggugcccca

SEQ ID NO: 2378183 - RNA, 21 nt, Bordetella pertussis
gggucaggucgcugcccagca

SEQ ID NO: 2378184 - RNA, 22 nt, Bordetella pertussis
gggucaucagcacgaucuggcg

SEQ ID NO: 2378185 - RNA, 20 nt, Bordetella pertussis
ggguccagcaaaugggccgc

SEQ ID NO: 2378186 - RNA, 14 nt, Bordetella pertussis
ggguccggccgcgc

SEQ ID NO: 2378187 - RNA, 21 nt, Bordetella pertussis
ggguccggccgcgcaaggcgg

SEQ ID NO: 2378188 - RNA, 16 nt, Bordetella pertussis
ggguccguggcggccg

SEQ ID NO: 2378189 - RNA, 20 nt, Bordetella pertussis
ggguccugaggccaggccgg

SEQ ID NO: 2378190 - RNA, 22 nt, Bordetella pertussis
ggguccugaggccaggccggau

SEQ ID NO: 2378191 - RNA, 19 nt, Bordetella pertussis
gggucgaguugcgcgccau

SEQ ID NO: 2378192 - RNA, 15 nt, Bordetella pertussis
gggucgaucauggcc

SEQ ID NO: 2378193 - RNA, 19 nt, Bordetella pertussis
gggucgaucauggccagcc

SEQ ID NO: 2378194 - RNA, 14 nt, Bordetella pertussis
gggucgaugccagu

SEQ ID NO: 2378195 - RNA, 21 nt, Bordetella pertussis
gggucgaugucgugaucgcca

SEQ ID NO: 2378196 - RNA, 16 nt, Bordetella pertussis
gggucgccgggcagcg

SEQ ID NO: 2378197 - RNA, 21 nt, Bordetella pertussis
gggucgcgcagcagggccugg

SEQ ID NO: 2378198 - RNA, 14 nt, Bordetella pertussis
gggucgcuguagcg

SEQ ID NO: 2378199 - RNA, 12 nt, Bordetella pertussis
gggucgcugugc

SEQ ID NO: 2378200 - RNA, 15 nt, Bordetella pertussis
gggucgcugugcgcg

SEQ ID NO: 2378201 - RNA, 17 nt, Bordetella pertussis
gggucgcugugcgcggc

SEQ ID NO: 2378202 - RNA, 18 nt, Bordetella pertussis
gggucggaugcgggugga

SEQ ID NO: 2378203 - RNA, 15 nt, Bordetella pertussis
gggucggcgccauga

SEQ ID NO: 2378204 - RNA, 15 nt, Bordetella pertussis
gggucgggccgcgcg

SEQ ID NO: 2378205 - RNA, 14 nt, Bordetella pertussis
gggucggggcaggc

SEQ ID NO: 2378206 - RNA, 18 nt, Bordetella pertussis
gggucggggcaggccugg

SEQ ID NO: 2378207 - RNA, 16 nt, Bordetella pertussis
gggucgucggcgcugc

SEQ ID NO: 2378208 - RNA, 20 nt, Bordetella pertussis
gggucgucggcgcugcagcg

SEQ ID NO: 2378209 - RNA, 13 nt, Bordetella pertussis
gggucgucgggcg

SEQ ID NO: 2378210 - RNA, 15 nt, Bordetella pertussis
gggucucggccacgg

SEQ ID NO: 2378211 - RNA, 17 nt, Bordetella pertussis
gguaucucagcgcgccg

SEQ ID NO: 2378212 - RNA, 17 nt, Bordetella pertussis
gguaucugucccggcgg

SEQ ID NO: 2378213 - RNA, 15 nt, Bordetella pertussis
gguaugaccggcgcg

SEQ ID NO: 2378214 - RNA, 15 nt, Bordetella pertussis
gguaugcacgaccag

SEQ ID NO: 2378215 - RNA, 22 nt, Bordetella pertussis
gguaugcggcgcccaggcccag

SEQ ID NO: 2378216 - RNA, 17 nt, Bordetella pertussis
gguauguauggcggucg

SEQ ID NO: 2378217 - RNA, 19 nt, Bordetella pertussis
gguauuccucgacgauggc

SEQ ID NO: 2378218 - RNA, 15 nt, Bordetella pertussis
gguauucguugccga

SEQ ID NO: 2378219 - RNA, 15 nt, Bordetella pertussis
ggucaacgccugcgg

SEQ ID NO: 2378220 - RNA, 15 nt, Bordetella pertussis
ggucaaggcgcggcc

SEQ ID NO: 2378221 - RNA, 21 nt, Bordetella pertussis
ggucaaggcggggcuccugug

SEQ ID NO: 2378222 - RNA, 14 nt, Bordetella pertussis
ggucaagggcggcc

SEQ ID NO: 2378223 - RNA, 18 nt, Bordetella pertussis
ggucaagggcggccaugc

SEQ ID NO: 2378224 - RNA, 18 nt, Bordetella pertussis
ggucaaguccggcgccgc

SEQ ID NO: 2378225 - RNA, 24 nt, Bordetella pertussis
ggucaauccgcccguugcggcgcc

SEQ ID NO: 2378226 - RNA, 15 nt, Bordetella pertussis
ggucaaugcggcggc

SEQ ID NO: 2378227 - RNA, 16 nt, Bordetella pertussis
ggucaaugcggcggcg

SEQ ID NO: 2378228 - RNA, 17 nt, Bordetella pertussis
ggucacacugggcggcg

SEQ ID NO: 2378229 - RNA, 22 nt, Bordetella pertussis
ggucacacugucgccacgggcg

SEQ ID NO: 2378230 - RNA, 23 nt, Bordetella pertussis
ggucaccaacgcgaucucagcca

SEQ ID NO: 2378231 - RNA, 20 nt, Bordetella pertussis
ggucaccacccgcacgccgg

SEQ ID NO: 2378232 - RNA, 23 nt, Bordetella pertussis
ggucaccacccgcacgccggccu

SEQ ID NO: 2378233 - RNA, 22 nt, Bordetella pertussis
ggucaccacgccuucgagcacc

SEQ ID NO: 2378234 - RNA, 20 nt, Bordetella pertussis
ggucacccggcgcaugcugg

SEQ ID NO: 2378235 - RNA, 19 nt, Bordetella pertussis
ggucaccgagcugagcacc

SEQ ID NO: 2378236 - RNA, 17 nt, Bordetella pertussis
ggucaccgccccgaccc

SEQ ID NO: 2378237 - RNA, 13 nt, Bordetella pertussis
ggucaccgcgccc

SEQ ID NO: 2378238 - RNA, 20 nt, Bordetella pertussis
ggucaccgcgcccagggugg

SEQ ID NO: 2378239 - RNA, 22 nt, Bordetella pertussis
ggucacgacgggugaggcgacg

SEQ ID NO: 2378240 - RNA, 20 nt, Bordetella pertussis
ggucacgccgaugaccaggg

SEQ ID NO: 2378241 - RNA, 14 nt, Bordetella pertussis
ggucacgcuggugg

SEQ ID NO: 2378242 - RNA, 16 nt, Bordetella pertussis
ggucacgcugguggcc

SEQ ID NO: 2378243 - RNA, 22 nt, Bordetella pertussis
ggucacggucuggcccacgcgc

SEQ ID NO: 2378244 - RNA, 16 nt, Bordetella pertussis
ggucacguucagcgcc

SEQ ID NO: 2378245 - RNA, 20 nt, Bordetella pertussis
ggucacguucagcgccggca

SEQ ID NO: 2378246 - RNA, 23 nt, Bordetella pertussis
ggucacguucagcgccggcauga

SEQ ID NO: 2378247 - RNA, 19 nt, Bordetella pertussis
ggucagaacgacgaucugg

SEQ ID NO: 2378248 - RNA, 19 nt, Bordetella pertussis
ggucagcaaccccagcagc

SEQ ID NO: 2378249 - RNA, 20 nt, Bordetella pertussis
ggucagcaaccccagcagcg

SEQ ID NO: 2378250 - RNA, 23 nt, Bordetella pertussis
ggucagcaaccccagcagcgccg

SEQ ID NO: 2378251 - RNA, 18 nt, Bordetella pertussis
ggucagcaccucggcgcc

SEQ ID NO: 2378252 - RNA, 21 nt, Bordetella pertussis
ggucagcacuugccggccgcc

SEQ ID NO: 2378253 - RNA, 15 nt, Bordetella pertussis
ggucagcagcaugcc

SEQ ID NO: 2378254 - RNA, 16 nt, Bordetella pertussis
ggucagcagggcgccg

SEQ ID NO: 2378255 - RNA, 21 nt, Bordetella pertussis
ggucagcaucagcagacccug

SEQ ID NO: 2378256 - RNA, 23 nt, Bordetella pertussis
ggucagcaugaagcugcccagca

SEQ ID NO: 2378257 - RNA, 13 nt, Bordetella pertussis
ggucagccagagc

SEQ ID NO: 2378258 - RNA, 12 nt, Bordetella pertussis
ggucagcccagg

SEQ ID NO: 2378259 - RNA, 20 nt, Bordetella pertussis
ggucagcccggcggccaucu

SEQ ID NO: 2378260 - RNA, 14 nt, Bordetella pertussis
ggucagccgugucg

SEQ ID NO: 2378261 - RNA, 20 nt, Bordetella pertussis
ggucagccugauucccaggc

SEQ ID NO: 2378262 - RNA, 21 nt, Bordetella pertussis
ggucagccuggggcaggcggc

SEQ ID NO: 2378263 - RNA, 13 nt, Bordetella pertussis
ggucagcgccagg

SEQ ID NO: 2378264 - RNA, 12 nt, Bordetella pertussis
ggucagcgccga

SEQ ID NO: 2378265 - RNA, 22 nt, Bordetella pertussis
ggucagcgccggcacgcugacc

SEQ ID NO: 2378266 - RNA, 12 nt, Bordetella pertussis
ggucagcgccuu

SEQ ID NO: 2378267 - RNA, 17 nt, Bordetella pertussis
ggucagcgccuugccgc

SEQ ID NO: 2378268 - RNA, 22 nt, Bordetella pertussis
ggucagcgccuugccgccgugc

SEQ ID NO: 2378269 - RNA, 18 nt, Bordetella pertussis
ggucagcgcggcgccggc

SEQ ID NO: 2378270 - RNA, 13 nt, Bordetella pertussis
ggucagcggccgg

SEQ ID NO: 2378271 - RNA, 20 nt, Bordetella pertussis
ggucagcggccggcccgugc

SEQ ID NO: 2378272 - RNA, 22 nt, Bordetella pertussis
ggucagcgugucgccgacccgg

SEQ ID NO: 2378273 - RNA, 16 nt, Bordetella pertussis
ggucagcucgucgccg

SEQ ID NO: 2378274 - RNA, 17 nt, Bordetella pertussis
ggucagcuggaacgcgc

SEQ ID NO: 2378275 - RNA, 15 nt, Bordetella pertussis
ggucagcuugccgcc

SEQ ID NO: 2378276 - RNA, 17 nt, Bordetella pertussis
ggucagcuugccgccca

SEQ ID NO: 2378277 - RNA, 15 nt, Bordetella pertussis
ggucaggaaguccug

SEQ ID NO: 2378278 - RNA, 12 nt, Bordetella pertussis
ggucaggaugcg

SEQ ID NO: 2378279 - RNA, 15 nt, Bordetella pertussis
ggucaggaugcgcgc

SEQ ID NO: 2378280 - RNA, 19 nt, Bordetella pertussis
ggucaggaugcgcgccagg

SEQ ID NO: 2378281 - RNA, 19 nt, Bordetella pertussis
ggucaggccguuggcgcgc

SEQ ID NO: 2378282 - RNA, 17 nt, Bordetella pertussis
ggucaggcugcggcgga

SEQ ID NO: 2378283 - RNA, 15 nt, Bordetella pertussis
ggucagggccgccca

SEQ ID NO: 2378284 - RNA, 19 nt, Bordetella pertussis
ggucagggcgaagcgcgcc

SEQ ID NO: 2378285 - RNA, 19 nt, Bordetella pertussis
ggucaggucgcugcccagc

SEQ ID NO: 2378286 - RNA, 14 nt, Bordetella pertussis
ggucagguugcgcc

SEQ ID NO: 2378287 - RNA, 17 nt, Bordetella pertussis
ggucagguugcgccggc

SEQ ID NO: 2378288 - RNA, 22 nt, Bordetella pertussis
ggucagguugcgccggcucagc

SEQ ID NO: 2378289 - RNA, 16 nt, Bordetella pertussis
ggucaguccgcccagc

SEQ ID NO: 2378290 - RNA, 17 nt, Bordetella pertussis
ggucaguccgcccagcc

SEQ ID NO: 2378291 - RNA, 18 nt, Bordetella pertussis
ggucaguccgcccagcca

SEQ ID NO: 2378292 - RNA, 22 nt, Bordetella pertussis
ggucaguccgcccagccaggcg

SEQ ID NO: 2378293 - RNA, 16 nt, Bordetella pertussis
acggggacgccggcgg

SEQ ID NO: 2378294 - RNA, 22 nt, Bordetella pertussis
acggggacuggcacgcgcugaa

SEQ ID NO: 2378295 - RNA, 22 nt, Bordetella pertussis
acggggcaucaauagcccgugc

SEQ ID NO: 2378296 - RNA, 17 nt, Bordetella pertussis
acggggccgccaacgcc

SEQ ID NO: 2378297 - RNA, 17 nt, Bordetella pertussis
acggggcugucgcgcgc

SEQ ID NO: 2378298 - RNA, 18 nt, Bordetella pertussis
acggggugccuguccccg

SEQ ID NO: 2378299 - RNA, 18 nt, Bordetella pertussis
acgggguggccggcgcgc

SEQ ID NO: 2378300 - RNA, 17 nt, Bordetella pertussis
acggguaugcgcagcga

SEQ ID NO: 2378301 - RNA, 16 nt, Bordetella pertussis
acgggucgcgcagcau

SEQ ID NO: 2378302 - RNA, 16 nt, Bordetella pertussis
acggguggguggacag

SEQ ID NO: 2378303 - RNA, 14 nt, Bordetella pertussis
acgguaucgcgucg

SEQ ID NO: 2378304 - RNA, 18 nt, Bordetella pertussis
acgguaucucagcgcgcc

SEQ ID NO: 2378305 - RNA, 14 nt, Bordetella pertussis
acggucaccgcgcc

SEQ ID NO: 2378306 - RNA, 15 nt, Bordetella pertussis
acgguccugcgcgcc

SEQ ID NO: 2378307 - RNA, 23 nt, Bordetella pertussis
acggucgacaccgugaaggugcc

SEQ ID NO: 2378308 - RNA, 15 nt, Bordetella pertussis
acggucgccggcaug

SEQ ID NO: 2378309 - RNA, 17 nt, Bordetella pertussis
acggucgcgagcugcgc

SEQ ID NO: 2378310 - RNA, 13 nt, Bordetella pertussis
acggucucguucc

SEQ ID NO: 2378311 - RNA, 18 nt, Bordetella pertussis
acggucucguuccagaug

SEQ ID NO: 2378312 - RNA, 17 nt, Bordetella pertussis
acggucugcacgccggg

SEQ ID NO: 2378313 - RNA, 22 nt, Bordetella pertussis
acggucugcacgccgggcgcgc

SEQ ID NO: 2378314 - RNA, 16 nt, Bordetella pertussis
acggucugccgcugau

SEQ ID NO: 2378315 - RNA, 20 nt, Bordetella pertussis
acggucuggcccacgcgcac

SEQ ID NO: 2378316 - RNA, 18 nt, Bordetella pertussis
acggugagccggccaccu

SEQ ID NO: 2378317 - RNA, 19 nt, Bordetella pertussis
acggugccagucccccugc

SEQ ID NO: 2378318 - RNA, 19 nt, Bordetella pertussis
acggugccgccgaucugcu

SEQ ID NO: 2378319 - RNA, 15 nt, Bordetella pertussis
acggugccgcgcgcu

SEQ ID NO: 2378320 - RNA, 15 nt, Bordetella pertussis
acggugccggccagc

SEQ ID NO: 2378321 - RNA, 16 nt, Bordetella pertussis
acggugccggccagcc

SEQ ID NO: 2378322 - RNA, 17 nt, Bordetella pertussis
acggugccggccagccu

SEQ ID NO: 2378323 - RNA, 19 nt, Bordetella pertussis
gguccagcaccagggcgcg

SEQ ID NO: 2378324 - RNA, 20 nt, Bordetella pertussis
gguccagcaccagggcgcgc

SEQ ID NO: 2378325 - RNA, 22 nt, Bordetella pertussis
gguccagcaccagggcgcgcag

SEQ ID NO: 2378326 - RNA, 23 nt, Bordetella pertussis
gguccagcaccagggcgcgcagc

SEQ ID NO: 2378327 - RNA, 13 nt, Bordetella pertussis
gguccagcagcgu

SEQ ID NO: 2378328 - RNA, 15 nt, Bordetella pertussis
gguccagcagcguga

SEQ ID NO: 2378329 - RNA, 23 nt, Bordetella pertussis
gguccagcaggauggcgaacaug

SEQ ID NO: 2378330 - RNA, 19 nt, Bordetella pertussis
gguccagccccacgccgac

SEQ ID NO: 2378331 - RNA, 20 nt, Bordetella pertussis
gguccagccccacgccgacc

SEQ ID NO: 2378332 - RNA, 21 nt, Bordetella pertussis
gguccagccccugcccgucua

SEQ ID NO: 2378333 - RNA, 15 nt, Bordetella pertussis
gguccagcgccacgg

SEQ ID NO: 2378334 - RNA, 15 nt, Bordetella pertussis
gguccagcugcgcgc

SEQ ID NO: 2378335 - RNA, 18 nt, Bordetella pertussis
gguccagcugcgcgcgag

SEQ ID NO: 2378336 - RNA, 22 nt, Bordetella pertussis
gguccagcugcgcgcgagcggc

SEQ ID NO: 2378337 - RNA, 15 nt, Bordetella pertussis
gguccaggcccggca

SEQ ID NO: 2378338 - RNA, 13 nt, Bordetella pertussis
gguccaggcgcgc

SEQ ID NO: 2378339 - RNA, 12 nt, Bordetella pertussis
gguccaggcggu

SEQ ID NO: 2378340 - RNA, 17 nt, Bordetella pertussis
gguccagguggcccgca

SEQ ID NO: 2378341 - RNA, 18 nt, Bordetella pertussis
gguccagguggcccgcac

SEQ ID NO: 2378342 - RNA, 19 nt, Bordetella pertussis
gguccagguggcccgcacc

SEQ ID NO: 2378343 - RNA, 20 nt, Bordetella pertussis
gguccaugaacgccgcgccc

SEQ ID NO: 2378344 - RNA, 22 nt, Bordetella pertussis
gguccaugaacgccgcgcccgc

SEQ ID NO: 2378345 - RNA, 20 nt, Bordetella pertussis
gguccaugcgaaagcggcca

SEQ ID NO: 2378346 - RNA, 17 nt, Bordetella pertussis
gguccgaaccgaccgcc

SEQ ID NO: 2378347 - RNA, 18 nt, Bordetella pertussis
gguccgccgccgcgugga

SEQ ID NO: 2378348 - RNA, 18 nt, Bordetella pertussis
gguccgccggcacgcgcg

SEQ ID NO: 2378349 - RNA, 15 nt, Bordetella pertussis
gguccgcucgaggcc

SEQ ID NO: 2378350 - RNA, 20 nt, Bordetella pertussis
gguccgcucgaggccaggcu

SEQ ID NO: 2378351 - RNA, 14 nt, Bordetella pertussis
gguccggcgugcca

SEQ ID NO: 2378352 - RNA, 13 nt, Bordetella pertussis
gguccggggcggg

SEQ ID NO: 2378353 - RNA, 15 nt, Bordetella pertussis
gguccggggcgggcg

SEQ ID NO: 2378354 - RNA, 21 nt, Bordetella pertussis
gguccggggcgggcgcgguau

SEQ ID NO: 2378355 - RNA, 20 nt, Bordetella pertussis
gguccggucgcgcgugcagg

SEQ ID NO: 2378356 - RNA, 17 nt, Bordetella pertussis
gguccgguucgcccacc

SEQ ID NO: 2378357 - RNA, 22 nt, Bordetella pertussis
gguccguguucgacgcggccga

SEQ ID NO: 2378358 - RNA, 17 nt, Bordetella pertussis
gguccuaaauugccgcg

SEQ ID NO: 2378359 - RNA, 17 nt, Bordetella pertussis
gguccugaggccaggcc

SEQ ID NO: 2378360 - RNA, 12 nt, Bordetella pertussis
gguccugcacgc

SEQ ID NO: 2378361 - RNA, 17 nt, Bordetella pertussis
gguccugcacgcgggcc

SEQ ID NO: 2378362 - RNA, 19 nt, Bordetella pertussis
gguccugcacgcgggccag

SEQ ID NO: 2378363 - RNA, 13 nt, Bordetella pertussis
gguccugcgcgcc

SEQ ID NO: 2378364 - RNA, 18 nt, Bordetella pertussis
gguccugcucggugcucu

SEQ ID NO: 2378365 - RNA, 18 nt, Bordetella pertussis
gguccuggcggccgccca

SEQ ID NO: 2378366 - RNA, 21 nt, Bordetella pertussis
gguccuggcggccgcccagca

SEQ ID NO: 2378367 - RNA, 12 nt, Bordetella pertussis
gguccugggccg

SEQ ID NO: 2378368 - RNA, 22 nt, Bordetella pertussis
gguccugguaucccucgcccag

SEQ ID NO: 2378369 - RNA, 17 nt, Bordetella pertussis
gguccuugagguaccac

SEQ ID NO: 2378370 - RNA, 16 nt, Bordetella pertussis
gguccuugccgggcuc

SEQ ID NO: 2378371 - RNA, 16 nt, Bordetella pertussis
ggucgaacaggcuggu

SEQ ID NO: 2378372 - RNA, 21 nt, Bordetella pertussis
ggucgaauuucccggguggcg

SEQ ID NO: 2378373 - RNA, 22 nt, Bordetella pertussis
ggucgacagguagcggucgccg

SEQ ID NO: 2378374 - RNA, 22 nt, Bordetella pertussis
ggucgacauacgcgaugccgau

SEQ ID NO: 2378375 - RNA, 17 nt, Bordetella pertussis
ggucgacauagacgcgc

SEQ ID NO: 2378376 - RNA, 20 nt, Bordetella pertussis
ggucgacauagacgcgcagc

SEQ ID NO: 2378377 - RNA, 13 nt, Bordetella pertussis
ggucgaccagcag

SEQ ID NO: 2378378 - RNA, 14 nt, Bordetella pertussis
ggucgaccagcagc

SEQ ID NO: 2378379 - RNA, 22 nt, Bordetella pertussis
ggucgacccacuugagcagcgc

SEQ ID NO: 2378380 - RNA, 22 nt, Bordetella pertussis
ggucgaccugcuugcccagcag

SEQ ID NO: 2378381 - RNA, 19 nt, Bordetella pertussis
ggucgacgaaauagccgac

SEQ ID NO: 2378382 - RNA, 15 nt, Bordetella pertussis
ggucgacgccggcga

SEQ ID NO: 2378383 - RNA, 23 nt, Bordetella pertussis
ggucgacguccgcccgguuggug

SEQ ID NO: 2378384 - RNA, 15 nt, Bordetella pertussis
ggucgagaccagcag

SEQ ID NO: 2378385 - RNA, 15 nt, Bordetella pertussis
ggucgagacgauggc

SEQ ID NO: 2378386 - RNA, 19 nt, Bordetella pertussis
ggucgagacgauggccgaa

SEQ ID NO: 2378387 - RNA, 14 nt, Bordetella pertussis
ggucgagagccugg

SEQ ID NO: 2378388 - RNA, 17 nt, Bordetella pertussis
ggucgagagccugggcg

SEQ ID NO: 2378389 - RNA, 23 nt, Bordetella pertussis
ggucgagagccugggcgcgcgcc

SEQ ID NO: 2378390 - RNA, 13 nt, Bordetella pertussis
ggucgagcgccga

SEQ ID NO: 2378391 - RNA, 13 nt, Bordetella pertussis
ggucgagcgccug

SEQ ID NO: 2378392 - RNA, 17 nt, Bordetella pertussis
ggucgagcgccugcgcc

SEQ ID NO: 2378393 - RNA, 19 nt, Bordetella pertussis
ggucgagcgccugcgccac

SEQ ID NO: 2378394 - RNA, 12 nt, Bordetella pertussis
ggucgagcgcuc

SEQ ID NO: 2378395 - RNA, 14 nt, Bordetella pertussis
ggucgagcgggcgc

SEQ ID NO: 2378396 - RNA, 17 nt, Bordetella pertussis
ggucgagcgggcgccag

SEQ ID NO: 2378397 - RNA, 22 nt, Bordetella pertussis
ggucgagguccugcucggugcu

SEQ ID NO: 2378398 - RNA, 16 nt, Bordetella pertussis
ggucgaguugguagcg

SEQ ID NO: 2378399 - RNA, 17 nt, Bordetella pertussis
ggucgaucagccccugc

SEQ ID NO: 2378400 - RNA, 18 nt, Bordetella pertussis
ggucgaucauggccagcc

SEQ ID NO: 2378401 - RNA, 19 nt, Bordetella pertussis
ggucgaucauggccagccg

SEQ ID NO: 2378402 - RNA, 18 nt, Bordetella pertussis
ggucgaucgcaucgcggc

SEQ ID NO: 2378403 - RNA, 23 nt, Bordetella pertussis
ggucgaucgcaucgcggcagccc

SEQ ID NO: 2378404 - RNA, 23 nt, Bordetella pertussis
ggucgaucgucuugaccagcagg

SEQ ID NO: 2378405 - RNA, 19 nt, Bordetella pertussis
ggucgaucuccacgaaggc

SEQ ID NO: 2378406 - RNA, 22 nt, Bordetella pertussis
ggucgaugaacaagguacccgc

SEQ ID NO: 2378407 - RNA, 11 nt, Bordetella pertussis
ggucgaugcca

SEQ ID NO: 2378408 - RNA, 13 nt, Bordetella pertussis
ggucgaugccagu

SEQ ID NO: 2378409 - RNA, 18 nt, Bordetella pertussis
ggucgauguccagcgcca

SEQ ID NO: 2378410 - RNA, 14 nt, Bordetella pertussis
ggucgauucgaaac

SEQ ID NO: 2378411 - RNA, 12 nt, Bordetella pertussis
ggucgccagcag

SEQ ID NO: 2378412 - RNA, 18 nt, Bordetella pertussis
ggucgccaucggccggcc

SEQ ID NO: 2378413 - RNA, 14 nt, Bordetella pertussis
ggucgccgcgggca

SEQ ID NO: 2378414 - RNA, 17 nt, Bordetella pertussis
ggucgccgggcagcggg

SEQ ID NO: 2378415 - RNA, 18 nt, Bordetella pertussis
ggucgccgucaggaucag

SEQ ID NO: 2378416 - RNA, 22 nt, Bordetella pertussis
ggucgccgucaggaucaggccg

SEQ ID NO: 2378417 - RNA, 23 nt, Bordetella pertussis
ggucgccgucaggaucaggccgg

SEQ ID NO: 2378418 - RNA, 24 nt, Bordetella pertussis
ggucgccgucaggaucaggccggc

SEQ ID NO: 2378419 - RNA, 13 nt, Bordetella pertussis
ggucgccguucug

SEQ ID NO: 2378420 - RNA, 22 nt, Bordetella pertussis
ggucgcgaccucggcggcgucg

SEQ ID NO: 2378421 - RNA, 19 nt, Bordetella pertussis
ggucgcgagcugcgcgacc

SEQ ID NO: 2378422 - RNA, 21 nt, Bordetella pertussis
ggucgcgaucgucgaccgcga

SEQ ID NO: 2378423 - RNA, 20 nt, Bordetella pertussis
ggucgcgaugcgucaggggc

SEQ ID NO: 2378424 - RNA, 22 nt, Bordetella pertussis
ggucgcgauugaguucgcgcgc

SEQ ID NO: 2378425 - RNA, 24 nt, Bordetella pertussis
ggucgcgauugaguucgcgcgccg

SEQ ID NO: 2378426 - RNA, 14 nt, Bordetella pertussis
ggucgcgcaccagg

SEQ ID NO: 2378427 - RNA, 15 nt, Bordetella pertussis
ggucgcgcacgcugg

SEQ ID NO: 2378428 - RNA, 16 nt, Bordetella pertussis
ggucgcgcagcagggc

SEQ ID NO: 2378429 - RNA, 23 nt, Bordetella pertussis
ggucgcgcagcauauccgcgugc

SEQ ID NO: 2378430 - RNA, 12 nt, Bordetella pertussis
ggucgcgcagcu

SEQ ID NO: 2378431 - RNA, 15 nt, Bordetella pertussis
ggucgcgcagcugcc

SEQ ID NO: 2378432 - RNA, 18 nt, Bordetella pertussis
ggucgcgcagcugccuga

SEQ ID NO: 2378433 - RNA, 16 nt, Bordetella pertussis
ggucgcgcgugcaggc

SEQ ID NO: 2378434 - RNA, 20 nt, Bordetella pertussis
ggucgcgcgugcaggccgcg

SEQ ID NO: 2378435 - RNA, 18 nt, Bordetella pertussis
ggugacuuccugguacac

SEQ ID NO: 2378436 - RNA, 13 nt, Bordetella pertussis
ggugagcaagcgc

SEQ ID NO: 2378437 - RNA, 17 nt, Bordetella pertussis
ggugagcaagcgcugga

SEQ ID NO: 2378438 - RNA, 14 nt, Bordetella pertussis
ggugagccggccac

SEQ ID NO: 2378439 - RNA, 15 nt, Bordetella pertussis
ggugaggggccagcc

SEQ ID NO: 2378440 - RNA, 17 nt, Bordetella pertussis
ggugaggggccagccug

SEQ ID NO: 2378441 - RNA, 13 nt, Bordetella pertussis
ggugagugcccau

SEQ ID NO: 2378442 - RNA, 19 nt, Bordetella pertussis
ggugauccacugcagcagu

SEQ ID NO: 2378443 - RNA, 22 nt, Bordetella pertussis
ggugaucgaguaggccggcacg

SEQ ID NO: 2378444 - RNA, 15 nt, Bordetella pertussis
ggugaucugcucgcc

SEQ ID NO: 2378445 - RNA, 15 nt, Bordetella pertussis
ggugaucugcugcgu

SEQ ID NO: 2378446 - RNA, 21 nt, Bordetella pertussis
ggugaucugguccacggcggc

SEQ ID NO: 2378447 - RNA, 17 nt, Bordetella pertussis
ggugaugauccugcugg

SEQ ID NO: 2378448 - RNA, 22 nt, Bordetella pertussis
ggugaugauccugcugguggcg

SEQ ID NO: 2378449 - RNA, 21 nt, Bordetella pertussis
ggugaugauggccagguccac

SEQ ID NO: 2378450 - RNA, 16 nt, Bordetella pertussis
ggugaugauggccgag

SEQ ID NO: 2378451 - RNA, 14 nt, Bordetella pertussis
ggugauguccugca

SEQ ID NO: 2378452 - RNA, 14 nt, Bordetella pertussis
ggugaugucgccgg

SEQ ID NO: 2378453 - RNA, 18 nt, Bordetella pertussis
ggugaugucgccggucac

SEQ ID NO: 2378454 - RNA, 14 nt, Bordetella pertussis
ggugauuucggcgc

SEQ ID NO: 2378455 - RNA, 19 nt, Bordetella pertussis
ggugauuucggcgcaucgg

SEQ ID NO: 2378456 - RNA, 20 nt, Bordetella pertussis
ggugcaacuccacgcccugc

SEQ ID NO: 2378457 - RNA, 15 nt, Bordetella pertussis
ggugcaagcggccgg

SEQ ID NO: 2378458 - RNA, 19 nt, Bordetella pertussis
ggugcacagcgucccagcc

SEQ ID NO: 2378459 - RNA, 20 nt, Bordetella pertussis
ggugcacagcgucccagcca

SEQ ID NO: 2378460 - RNA, 20 nt, Bordetella pertussis
ggugcaccaggccacccgcc

SEQ ID NO: 2378461 - RNA, 20 nt, Bordetella pertussis
ggugcaccaggugguuggcg

SEQ ID NO: 2378462 - RNA, 19 nt, Bordetella pertussis
ggugcacguggaugaugcg

SEQ ID NO: 2378463 - RNA, 20 nt, Bordetella pertussis
ggugcacgugggcacgccgg

SEQ ID NO: 2378464 - RNA, 18 nt, Bordetella pertussis
ggugcagcccagcaccac

SEQ ID NO: 2378465 - RNA, 13 nt, Bordetella pertussis
ggugcagccgccg

SEQ ID NO: 2378466 - RNA, 15 nt, Bordetella pertussis
ggugcagcggcagca

SEQ ID NO: 2378467 - RNA, 14 nt, Bordetella pertussis
ggugcagcggcucg

SEQ ID NO: 2378468 - RNA, 17 nt, Bordetella pertussis
ggugcagcggcucgacg

SEQ ID NO: 2378469 - RNA, 18 nt, Bordetella pertussis
ggugcagcguggcgcggg

SEQ ID NO: 2378470 - RNA, 20 nt, Bordetella pertussis
ggugcaggggccgcacgcgc

SEQ ID NO: 2378471 - RNA, 15 nt, Bordetella pertussis
ggugcaggguuggcg

SEQ ID NO: 2378472 - RNA, 20 nt, Bordetella pertussis
ggugcaggguuggcgcgccg

SEQ ID NO: 2378473 - RNA, 17 nt, Bordetella pertussis
ggugcaggucaucgcgc

SEQ ID NO: 2378474 - RNA, 21 nt, Bordetella pertussis
ggugcaggucaucgcgcuggc

SEQ ID NO: 2378475 - RNA, 23 nt, Bordetella pertussis
ggugcaucucggcaucggccacg

SEQ ID NO: 2378476 - RNA, 16 nt, Bordetella pertussis
ggugcauucguccagg

SEQ ID NO: 2378477 - RNA, 20 nt, Bordetella pertussis
ggugccaguccccaugcggc

SEQ ID NO: 2378478 - RNA, 23 nt, Bordetella pertussis
ggugccaguccccauguggggac

SEQ ID NO: 2378479 - RNA, 21 nt, Bordetella pertussis
ggugccagucccccgcgggga

SEQ ID NO: 2378480 - RNA, 23 nt, Bordetella pertussis
ggugccaguccccguucggggac

SEQ ID NO: 2378481 - RNA, 17 nt, Bordetella pertussis
ggugccagucuccaggc

SEQ ID NO: 2378482 - RNA, 23 nt, Bordetella pertussis
ggugcccagcgagcggggcuggu

SEQ ID NO: 2378483 - RNA, 20 nt, Bordetella pertussis
ggugcccaguucgcggccgg

SEQ ID NO: 2378484 - RNA, 16 nt, Bordetella pertussis
ggugccccacgccgau

SEQ ID NO: 2378485 - RNA, 21 nt, Bordetella pertussis
ggugcccgacgccgcgcgcga

SEQ ID NO: 2378486 - RNA, 14 nt, Bordetella pertussis
ggugcccgcgaagc

SEQ ID NO: 2378487 - RNA, 21 nt, Bordetella pertussis
ggugccgaagaugggggugga

SEQ ID NO: 2378488 - RNA, 20 nt, Bordetella pertussis
ggugccgcccuugggcauca

SEQ ID NO: 2378489 - RNA, 17 nt, Bordetella pertussis
ggugccgccuggccaga

SEQ ID NO: 2378490 - RNA, 19 nt, Bordetella pertussis
ggugccgcgcacccaggcc

SEQ ID NO: 2378491 - RNA, 18 nt, Bordetella pertussis
ggugccgcgcaggcccuu

SEQ ID NO: 2378492 - RNA, 14 nt, Bordetella pertussis
ggugccgcgcgcgg

SEQ ID NO: 2378493 - RNA, 13 nt, Bordetella pertussis
ggugccgcgcgcu

SEQ ID NO: 2378494 - RNA, 20 nt, Bordetella pertussis
ggugccgcguaugcggcagc

SEQ ID NO: 2378495 - RNA, 14 nt, Bordetella pertussis
ggugccgcuggcgg

SEQ ID NO: 2378496 - RNA, 19 nt, Bordetella pertussis
ggugccggaaaaugccgcg

SEQ ID NO: 2378497 - RNA, 16 nt, Bordetella pertussis
ggugccggacgccgac

SEQ ID NO: 2378498 - RNA, 20 nt, Bordetella pertussis
ggugccggccagccugcccg

SEQ ID NO: 2378499 - RNA, 17 nt, Bordetella pertussis
ggugccggugaccgcau

SEQ ID NO: 2378500 - RNA, 21 nt, Bordetella pertussis
ggugccgguggugcccaucgc

SEQ ID NO: 2378501 - RNA, 13 nt, Bordetella pertussis
ggugccguccagc

SEQ ID NO: 2378502 - RNA, 14 nt, Bordetella pertussis
ggugccguccagcg

SEQ ID NO: 2378503 - RNA, 15 nt, Bordetella pertussis
ggugccguccagcgc

SEQ ID NO: 2378504 - RNA, 18 nt, Bordetella pertussis
ggugccguccagcgcggc

SEQ ID NO: 2378505 - RNA, 19 nt, Bordetella pertussis
ggugccgugggcgaacugg

SEQ ID NO: 2378506 - RNA, 18 nt, Bordetella pertussis
ggugccguucggccagcg

SEQ ID NO: 2378507 - RNA, 18 nt, Bordetella pertussis
ggugccugccccugcggg

SEQ ID NO: 2378508 - RNA, 20 nt, Bordetella pertussis
ggugccugccccugcgggga

SEQ ID NO: 2378509 - RNA, 21 nt, Bordetella pertussis
ggugccuggcuccccgggcac

SEQ ID NO: 2378510 - RNA, 12 nt, Bordetella pertussis
ggugccuguccc

SEQ ID NO: 2378511 - RNA, 18 nt, Bordetella pertussis
ggugccuguccccaccgg

SEQ ID NO: 2378512 - RNA, 21 nt, Bordetella pertussis
ggugccuguccccaccgggac

SEQ ID NO: 2378513 - RNA, 15 nt, Bordetella pertussis
ggugccuguccccgc

SEQ ID NO: 2378514 - RNA, 21 nt, Bordetella pertussis
ggugccuguccccgccgggac

SEQ ID NO: 2378515 - RNA, 16 nt, Bordetella pertussis
ggugccuguccccgcu

SEQ ID NO: 2378516 - RNA, 19 nt, Bordetella pertussis
ggugccugucccggcuggg

SEQ ID NO: 2378517 - RNA, 21 nt, Bordetella pertussis
ggugccugucccugccgggac

SEQ ID NO: 2378518 - RNA, 22 nt, Bordetella pertussis
ggugccugucccugcgggggca

SEQ ID NO: 2378519 - RNA, 14 nt, Bordetella pertussis
ggugccugugcccg

SEQ ID NO: 2378520 - RNA, 16 nt, Bordetella pertussis
ggugccuguucccgcc

SEQ ID NO: 2378521 - RNA, 21 nt, Bordetella pertussis
ggugccuguucccgccgggcc

SEQ ID NO: 2378522 - RNA, 19 nt, Bordetella pertussis
ggugccuugcggcgccguu

SEQ ID NO: 2378523 - RNA, 20 nt, Bordetella pertussis
ggugcgacugcaggaugagg

SEQ ID NO: 2378524 - RNA, 21 nt, Bordetella pertussis
ggugcgacugcaggaugaggc

SEQ ID NO: 2378525 - RNA, 23 nt, Bordetella pertussis
ggugcgacugcaggaugaggcgc

SEQ ID NO: 2378526 - RNA, 17 nt, Bordetella pertussis
ggugcgauagcgccgcg

SEQ ID NO: 2378527 - RNA, 23 nt, Bordetella pertussis
ggugcgauagcgccgcgcaucga

SEQ ID NO: 2378528 - RNA, 17 nt, Bordetella pertussis
ggugcgcacaucgcccg

SEQ ID NO: 2378529 - RNA, 13 nt, Bordetella pertussis
ggugcgcaccagg

SEQ ID NO: 2378530 - RNA, 19 nt, Bordetella pertussis
ggugcgcaccuugcccacg

SEQ ID NO: 2378531 - RNA, 15 nt, Bordetella pertussis
ggugcgcacgauggg

SEQ ID NO: 2378532 - RNA, 13 nt, Bordetella pertussis
ggugcgcagcagg

SEQ ID NO: 2378533 - RNA, 16 nt, Bordetella pertussis
ggugcgcagcaggugg

SEQ ID NO: 2378534 - RNA, 13 nt, Bordetella pertussis
ggugcgcagccgg

SEQ ID NO: 2378535 - RNA, 14 nt, Bordetella pertussis
ggugcgcagccggg

SEQ ID NO: 2378536 - RNA, 16 nt, Bordetella pertussis
ggugcgcagccgggcu

SEQ ID NO: 2378537 - RNA, 14 nt, Bordetella pertussis
ggugcgcagcggca

SEQ ID NO: 2378538 - RNA, 16 nt, Bordetella pertussis
ggugcgcagcggcagg

SEQ ID NO: 2378539 - RNA, 19 nt, Bordetella pertussis
ggugcgcagcggcaggcgg

SEQ ID NO: 2378540 - RNA, 18 nt, Bordetella pertussis
ggugcgccaaucggcguu

SEQ ID NO: 2378541 - RNA, 21 nt, Bordetella pertussis
ggugcgccacgauguagccga

SEQ ID NO: 2378542 - RNA, 16 nt, Bordetella pertussis
ggugcgccagcacggc

SEQ ID NO: 2378543 - RNA, 18 nt, Bordetella pertussis
ggugcgccgccgccgcgg

SEQ ID NO: 2378544 - RNA, 23 nt, Bordetella pertussis
ggugcgccgccgccgcggccugg

SEQ ID NO: 2378545 - RNA, 15 nt, Bordetella pertussis
ggugcgccucgaaga

SEQ ID NO: 2378546 - RNA, 17 nt, Bordetella pertussis
ggugcgccugacccagu

SEQ ID NO: 2378547 - RNA, 13 nt, Bordetella pertussis
gguggucgcgccc

SEQ ID NO: 2378548 - RNA, 15 nt, Bordetella pertussis
gguggucugccaguc

SEQ ID NO: 2378549 - RNA, 17 nt, Bordetella pertussis
gguggucugccagucca

SEQ ID NO: 2378550 - RNA, 24 nt, Bordetella pertussis
gguggucugccaguccauccagcg

SEQ ID NO: 2378551 - RNA, 21 nt, Bordetella pertussis
gguggugaccacggcgcgccc

SEQ ID NO: 2378552 - RNA, 18 nt, Bordetella pertussis
gguggugcagcggcagca

SEQ ID NO: 2378553 - RNA, 18 nt, Bordetella pertussis
gguggugcccaucgcgcu

SEQ ID NO: 2378554 - RNA, 15 nt, Bordetella pertussis
gguggugccgcgcac

SEQ ID NO: 2378555 - RNA, 16 nt, Bordetella pertussis
gguggugccgcgcacg

SEQ ID NO: 2378556 - RNA, 19 nt, Bordetella pertussis
gguggugccugcuugcagg

SEQ ID NO: 2378557 - RNA, 22 nt, Bordetella pertussis
gguggugcugcucaacggccac

SEQ ID NO: 2378558 - RNA, 23 nt, Bordetella pertussis
gguggugcugcucaacggccacc

SEQ ID NO: 2378559 - RNA, 16 nt, Bordetella pertussis
gguggugcugggcggc

SEQ ID NO: 2378560 - RNA, 19 nt, Bordetella pertussis
gguggugcugggcggcggg

SEQ ID NO: 2378561 - RNA, 16 nt, Bordetella pertussis
gguggugucggcggcc

SEQ ID NO: 2378562 - RNA, 20 nt, Bordetella pertussis
gguggugucggcggccagca

SEQ ID NO: 2378563 - RNA, 21 nt, Bordetella pertussis
gguggugucggcggccagcag

SEQ ID NO: 2378564 - RNA, 17 nt, Bordetella pertussis
gguguagcugcccgcga

SEQ ID NO: 2378565 - RNA, 13 nt, Bordetella pertussis
gguguaggcgggc

SEQ ID NO: 2378566 - RNA, 17 nt, Bordetella pertussis
ggugucauagcgccagc

SEQ ID NO: 2378567 - RNA, 20 nt, Bordetella pertussis
ggugucccucggagccuguc

SEQ ID NO: 2378568 - RNA, 22 nt, Bordetella pertussis
gguguccggaugcacguagcgc

SEQ ID NO: 2378569 - RNA, 16 nt, Bordetella pertussis
gguguccuggucggcg

SEQ ID NO: 2378570 - RNA, 21 nt, Bordetella pertussis
gguguccuggucggcgcggca

SEQ ID NO: 2378571 - RNA, 17 nt, Bordetella pertussis
ggugucgccccccaugc

SEQ ID NO: 2378572 - RNA, 11 nt, Bordetella pertussis
ggugucgccgc

SEQ ID NO: 2378573 - RNA, 20 nt, Bordetella pertussis
ggugucggacaacugcgcga

SEQ ID NO: 2378574 - RNA, 13 nt, Bordetella pertussis
ggugucggccagg

SEQ ID NO: 2378575 - RNA, 13 nt, Bordetella pertussis
ggugucggcggcc

SEQ ID NO: 2378576 - RNA, 17 nt, Bordetella pertussis
ggugucggggccgggcc

SEQ ID NO: 2378577 - RNA, 21 nt, Bordetella pertussis
ggugugagcguaagcccacuc

SEQ ID NO: 2378578 - RNA, 22 nt, Bordetella pertussis
gguguggccaugcaccagcaca

SEQ ID NO: 2378579 - RNA, 15 nt, Bordetella pertussis
gguguugaccacgcc

SEQ ID NO: 2378580 - RNA, 22 nt, Bordetella pertussis
gguguugagauuggccgagcgc

SEQ ID NO: 2378581 - RNA, 16 nt, Bordetella pertussis
gguucagcgcgccagc

SEQ ID NO: 2378582 - RNA, 19 nt, Bordetella pertussis
gguucagcgcgccagcgcg

SEQ ID NO: 2378583 - RNA, 16 nt, Bordetella pertussis
gguucaggguggccgc

SEQ ID NO: 2378584 - RNA, 18 nt, Bordetella pertussis
gguucaggguggccgcga

SEQ ID NO: 2378585 - RNA, 16 nt, Bordetella pertussis
gguucagucgucgccg

SEQ ID NO: 2378586 - RNA, 20 nt, Bordetella pertussis
gguucaugcguucggccagc

SEQ ID NO: 2378587 - RNA, 19 nt, Bordetella pertussis
gguuccugcaaggccggcg

SEQ ID NO: 2378588 - RNA, 12 nt, Bordetella pertussis
gguuccugccca

SEQ ID NO: 2378589 - RNA, 20 nt, Bordetella pertussis
gguucgacgccggcagcgac

SEQ ID NO: 2378590 - RNA, 22 nt, Bordetella pertussis
gguucgcagggcgcaacgccgg

SEQ ID NO: 2378591 - RNA, 17 nt, Bordetella pertussis
gguucgcgccugcccgc

SEQ ID NO: 2378592 - RNA, 16 nt, Bordetella pertussis
gguucggccucgccca

SEQ ID NO: 2378593 - RNA, 13 nt, Bordetella pertussis
gguucggcgcggc

SEQ ID NO: 2378594 - RNA, 14 nt, Bordetella pertussis
gguucggcgcggcg

SEQ ID NO: 2378595 - RNA, 22 nt, Bordetella pertussis
gguucggcgguuccagccuggc

SEQ ID NO: 2378596 - RNA, 16 nt, Bordetella pertussis
gguucguagccgguau

SEQ ID NO: 2378597 - RNA, 20 nt, Bordetella pertussis
gguucgucagggccgcagca

SEQ ID NO: 2378598 - RNA, 21 nt, Bordetella pertussis
gguucgucagggccgcagcac

SEQ ID NO: 2378599 - RNA, 18 nt, Bordetella pertussis
gguucguccucgucggcc

SEQ ID NO: 2378600 - RNA, 18 nt, Bordetella pertussis
gguucgugccgggcagca

SEQ ID NO: 2378601 - RNA, 21 nt, Bordetella pertussis
gguucucgauguggcgcuggc

SEQ ID NO: 2378602 - RNA, 21 nt, Bordetella pertussis
gguucuguccggcgcuggcuu

SEQ ID NO: 2378603 - RNA, 15 nt, Bordetella pertussis
gguugaagccgacgg

SEQ ID NO: 2378604 - RNA, 13 nt, Bordetella pertussis
gguugaaggccgc

SEQ ID NO: 2378605 - RNA, 21 nt, Bordetella pertussis
gguugaaguugcucggcggca

SEQ ID NO: 2378606 - RNA, 16 nt, Bordetella pertussis
gguugcagcgcgccag

SEQ ID NO: 2378607 - RNA, 20 nt, Bordetella pertussis
gguugcagcgcgccaggcgc

SEQ ID NO: 2378608 - RNA, 14 nt, Bordetella pertussis
gguugcaggccagg

SEQ ID NO: 2378609 - RNA, 16 nt, Bordetella pertussis
gguugcaguccugugu

SEQ ID NO: 2378610 - RNA, 20 nt, Bordetella pertussis
gguugcaguucgccggcgcc

SEQ ID NO: 2378611 - RNA, 17 nt, Bordetella pertussis
gguugcccugcgcaucg

SEQ ID NO: 2378612 - RNA, 16 nt, Bordetella pertussis
gguugccgcugcaugg

SEQ ID NO: 2378613 - RNA, 18 nt, Bordetella pertussis
gguugccgcugcaugggc

SEQ ID NO: 2378614 - RNA, 23 nt, Bordetella pertussis
gguugcgcgccagcucgcgcagc

SEQ ID NO: 2378615 - RNA, 18 nt, Bordetella pertussis
gguugcgguaguucagca

SEQ ID NO: 2378616 - RNA, 21 nt, Bordetella pertussis
gguugcgguaguucagcagcg

SEQ ID NO: 2378617 - RNA, 13 nt, Bordetella pertussis
gguuggccacgaa

SEQ ID NO: 2378618 - RNA, 16 nt, Bordetella pertussis
gguuggccagcuccag

SEQ ID NO: 2378619 - RNA, 13 nt, Bordetella pertussis
gguuggccgccag

SEQ ID NO: 2378620 - RNA, 19 nt, Bordetella pertussis
gguuggccuugacggcgcg

SEQ ID NO: 2378621 - RNA, 21 nt, Bordetella pertussis
gguuggccuugacggcgcgga

SEQ ID NO: 2378622 - RNA, 15 nt, Bordetella pertussis
gguuggcgcgccgug

SEQ ID NO: 2378623 - RNA, 16 nt, Bordetella pertussis
gguuggcgugcccguu

SEQ ID NO: 2378624 - RNA, 15 nt, Bordetella pertussis
gguuggugucgcgca

SEQ ID NO: 2378625 - RNA, 18 nt, Bordetella pertussis
gguugguuugcggcgcga

SEQ ID NO: 2378626 - RNA, 22 nt, Bordetella pertussis
gguuguccaccacccaggccca

SEQ ID NO: 2378627 - RNA, 14 nt, Bordetella pertussis
gguugucgcgcacc

SEQ ID NO: 2378628 - RNA, 18 nt, Bordetella pertussis
gguugugccccuugccca

SEQ ID NO: 2378629 - RNA, 15 nt, Bordetella pertussis
gguugugcccgcccg

SEQ ID NO: 2378630 - RNA, 17 nt, Bordetella pertussis
gguuugcuggcgcagca

SEQ ID NO: 2378631 - RNA, 13 nt, Bordetella pertussis
gguuugguagcag

SEQ ID NO: 2378632 - RNA, 19 nt, Bordetella pertussis
gguuuuccuuuugcgcggc

SEQ ID NO: 2378633 - RNA, 18 nt, Bordetella pertussis
gguuuugcuuugcgggcg

SEQ ID NO: 2378634 - RNA, 20 nt, Bordetella pertussis
gguuuuuuuuggcguacggc

SEQ ID NO: 2378635 - RNA, 20 nt, Bordetella pertussis
guaaacaucgcgcauggcga

SEQ ID NO: 2378636 - RNA, 16 nt, Bordetella pertussis
guaaagcggugcuuga

SEQ ID NO: 2378637 - RNA, 19 nt, Bordetella pertussis
guaacccgaguccuugacg

SEQ ID NO: 2378638 - RNA, 21 nt, Bordetella pertussis
guaacucaugccuaucaaggg

SEQ ID NO: 2378639 - RNA, 16 nt, Bordetella pertussis
guaagcgcuggacgcc

SEQ ID NO: 2378640 - RNA, 24 nt, Bordetella pertussis
guaagcgcuggacgcccuggcgca

SEQ ID NO: 2378641 - RNA, 20 nt, Bordetella pertussis
guaagcguccgcgcgccgcu

SEQ ID NO: 2378642 - RNA, 15 nt, Bordetella pertussis
guaaggccgccggcc

SEQ ID NO: 2378643 - RNA, 22 nt, Bordetella pertussis
guaaggucggguaaagcggugc

SEQ ID NO: 2378644 - RNA, 14 nt, Bordetella pertussis
guaaguggcggcgg

SEQ ID NO: 2378645 - RNA, 17 nt, Bordetella pertussis
guaauaguggucgccgg

SEQ ID NO: 2378646 - RNA, 18 nt, Bordetella pertussis
guaaucgcccggcgccau

SEQ ID NO: 2378647 - RNA, 15 nt, Bordetella pertussis
guaaucgcgcgccac

SEQ ID NO: 2378648 - RNA, 19 nt, Bordetella pertussis
guaaucgcgcgccaccgcc

SEQ ID NO: 2378649 - RNA, 17 nt, Bordetella pertussis
guaauggcgcuccagcc

SEQ ID NO: 2378650 - RNA, 15 nt, Bordetella pertussis
guacaacgccgcguc

SEQ ID NO: 2378651 - RNA, 14 nt, Bordetella pertussis
guacaccggcgugc

SEQ ID NO: 2378652 - RNA, 15 nt, Bordetella pertussis
guacaccgucgcgcg

SEQ ID NO: 2378653 - RNA, 17 nt, Bordetella pertussis
guacacgcgcaacaugg

SEQ ID NO: 2378654 - RNA, 21 nt, Bordetella pertussis
guacacguuggggaaccgcac

SEQ ID NO: 2378655 - RNA, 13 nt, Bordetella pertussis
guacagcagcagc

SEQ ID NO: 2378656 - RNA, 13 nt, Bordetella pertussis
guacagccaggcc

SEQ ID NO: 2378657 - RNA, 16 nt, Bordetella pertussis
guacagccaggccagc

SEQ ID NO: 2378658 - RNA, 19 nt, Bordetella pertussis
guacagccaggccagcagc

SEQ ID NO: 2378659 - RNA, 23 nt, Bordetella pertussis
guacagccaggccagcagcucgg

SEQ ID NO: 2378660 - RNA, 21 nt, Bordetella pertussis
guagcaggcgcgcucaggccg

SEQ ID NO: 2378661 - RNA, 20 nt, Bordetella pertussis
guagcccagguccagcgcca

SEQ ID NO: 2378662 - RNA, 24 nt, Bordetella pertussis
guagcccauguugaacugcaggcc

SEQ ID NO: 2378663 - RNA, 15 nt, Bordetella pertussis
guagcccuggcgcug

SEQ ID NO: 2378664 - RNA, 17 nt, Bordetella pertussis
guagccgaauccggcca

SEQ ID NO: 2378665 - RNA, 22 nt, Bordetella pertussis
guagccgaauccggccagcacg

SEQ ID NO: 2378666 - RNA, 21 nt, Bordetella pertussis
guagccgaugaccggccaggc

SEQ ID NO: 2378667 - RNA, 23 nt, Bordetella pertussis
guagccgaugaccggccaggcgc

SEQ ID NO: 2378668 - RNA, 17 nt, Bordetella pertussis
guagccgccgacgauga

SEQ ID NO: 2378669 - RNA, 21 nt, Bordetella pertussis
guagccgccgacgaugaccau

SEQ ID NO: 2378670 - RNA, 23 nt, Bordetella pertussis
guagccgccgcugucggucagca

SEQ ID NO: 2378671 - RNA, 17 nt, Bordetella pertussis
guagccgcugcgcgcgg

SEQ ID NO: 2378672 - RNA, 23 nt, Bordetella pertussis
guagccggaaugcaccacggcca

SEQ ID NO: 2378673 - RNA, 15 nt, Bordetella pertussis
guagccgggucuggc

SEQ ID NO: 2378674 - RNA, 17 nt, Bordetella pertussis
guagccgggucuggccg

SEQ ID NO: 2378675 - RNA, 20 nt, Bordetella pertussis
guagccgggucuggccggcc

SEQ ID NO: 2378676 - RNA, 20 nt, Bordetella pertussis
guagccgguaucgcggcgca

SEQ ID NO: 2378677 - RNA, 19 nt, Bordetella pertussis
guagccguccucgcgggcc

SEQ ID NO: 2378678 - RNA, 18 nt, Bordetella pertussis
guagcgcagccccguuuc

SEQ ID NO: 2378679 - RNA, 10 nt, Bordetella pertussis
guagcgcagg

SEQ ID NO: 2378680 - RNA, 14 nt, Bordetella pertussis
guagcgcaggcgcu

SEQ ID NO: 2378681 - RNA, 23 nt, Bordetella pertussis
guagcgcaucgcgaugcgcagca

SEQ ID NO: 2378682 - RNA, 21 nt, Bordetella pertussis
guagcgccagcguucggccac

SEQ ID NO: 2378683 - RNA, 22 nt, Bordetella pertussis
guagcgccucgcaucggccugc

SEQ ID NO: 2378684 - RNA, 23 nt, Bordetella pertussis
guagcgccucgcaucggccugca

SEQ ID NO: 2378685 - RNA, 23 nt, Bordetella pertussis
guagcgcgcagcucccccacgcc

SEQ ID NO: 2378686 - RNA, 17 nt, Bordetella pertussis
guagcgcgccagccgcg

SEQ ID NO: 2378687 - RNA, 14 nt, Bordetella pertussis
guagcgcggccggg

SEQ ID NO: 2378688 - RNA, 19 nt, Bordetella pertussis
guagcgcucgacuucgucg

SEQ ID NO: 2378689 - RNA, 23 nt, Bordetella pertussis
guagcgcucguccaugccggcca

SEQ ID NO: 2378690 - RNA, 15 nt, Bordetella pertussis
guagcgcugcagcca

SEQ ID NO: 2378691 - RNA, 20 nt, Bordetella pertussis
guagcggaucgcggcgcggc

SEQ ID NO: 2378692 - RNA, 21 nt, Bordetella pertussis
guagcggaucgcggcgcggcu

SEQ ID NO: 2378693 - RNA, 22 nt, Bordetella pertussis
guagcggaucgcggcgcggcuu

SEQ ID NO: 2378694 - RNA, 11 nt, Bordetella pertussis
guagcggauga

SEQ ID NO: 2378695 - RNA, 14 nt, Bordetella pertussis
guagcggccgccca

SEQ ID NO: 2378696 - RNA, 15 nt, Bordetella pertussis
guagcgggcggcggc

SEQ ID NO: 2378697 - RNA, 16 nt, Bordetella pertussis
guagcgguagccggcg

SEQ ID NO: 2378698 - RNA, 19 nt, Bordetella pertussis
guagcgguagccggcgugg

SEQ ID NO: 2378699 - RNA, 21 nt, Bordetella pertussis
guagcgguagggcgauggcgc

SEQ ID NO: 2378700 - RNA, 14 nt, Bordetella pertussis
guagcgguccagcu

SEQ ID NO: 2378701 - RNA, 16 nt, Bordetella pertussis
guagcgguccagcugc

SEQ ID NO: 2378702 - RNA, 20 nt, Bordetella pertussis
guagcgguccggggcgggcg

SEQ ID NO: 2378703 - RNA, 19 nt, Bordetella pertussis
guagcguuggcggccggcc

SEQ ID NO: 2378704 - RNA, 12 nt, Bordetella pertussis
guagcucagccu

SEQ ID NO: 2378705 - RNA, 18 nt, Bordetella pertussis
guagcucgaccaucaugg

SEQ ID NO: 2378706 - RNA, 14 nt, Bordetella pertussis
guagcugcgccgca

SEQ ID NO: 2378707 - RNA, 17 nt, Bordetella pertussis
guaggacagccccagca

SEQ ID NO: 2378708 - RNA, 22 nt, Bordetella pertussis
guaggacagccccagcagcacg

SEQ ID NO: 2378709 - RNA, 23 nt, Bordetella pertussis
guaggccacgcgcgggcuggggu

SEQ ID NO: 2378710 - RNA, 22 nt, Bordetella pertussis
guaggccauugaaagcgcgagc

SEQ ID NO: 2378711 - RNA, 13 nt, Bordetella pertussis
guaggccggcacg

SEQ ID NO: 2378712 - RNA, 19 nt, Bordetella pertussis
guaggccggcacguccggc

SEQ ID NO: 2378713 - RNA, 16 nt, Bordetella pertussis
guaggccuggucgggg

SEQ ID NO: 2378714 - RNA, 19 nt, Bordetella pertussis
guaggccuggucggggucg

SEQ ID NO: 2378715 - RNA, 14 nt, Bordetella pertussis
guaggccuucaccu

SEQ ID NO: 2378716 - RNA, 23 nt, Bordetella pertussis
guaggccuucaccuugccgcugg

SEQ ID NO: 2378717 - RNA, 20 nt, Bordetella pertussis
guaggcgcccgacggcgcgc

SEQ ID NO: 2378718 - RNA, 23 nt, Bordetella pertussis
guaggcgcccgacggcgcgcccg

SEQ ID NO: 2378719 - RNA, 17 nt, Bordetella pertussis
guaggcgccgcgcccgu

SEQ ID NO: 2378720 - RNA, 15 nt, Bordetella pertussis
guaggcgcgcgcauc

SEQ ID NO: 2378721 - RNA, 21 nt, Bordetella pertussis
guaggcgcgcgcaucggccgg

SEQ ID NO: 2378722 - RNA, 15 nt, Bordetella pertussis
guaggcggccaggcc

SEQ ID NO: 2378723 - RNA, 16 nt, Bordetella pertussis
guaggcggccaggccg

SEQ ID NO: 2378724 - RNA, 16 nt, Bordetella pertussis
guaggcggcccaggcg

SEQ ID NO: 2378725 - RNA, 13 nt, Bordetella pertussis
guaggcggccggc

SEQ ID NO: 2378726 - RNA, 23 nt, Bordetella pertussis
guaggcggccggcugcaccagcg

SEQ ID NO: 2378727 - RNA, 20 nt, Bordetella pertussis
guaggcgggcagcggcgacg

SEQ ID NO: 2378728 - RNA, 21 nt, Bordetella pertussis
guagggaaucgucaugaacgu

SEQ ID NO: 2378729 - RNA, 16 nt, Bordetella pertussis
guagguaugguuggcc

SEQ ID NO: 2378730 - RNA, 18 nt, Bordetella pertussis
guaggucaggcccacgcc

SEQ ID NO: 2378731 - RNA, 20 nt, Bordetella pertussis
guaguacacauaaucggccc

SEQ ID NO: 2378732 - RNA, 14 nt, Bordetella pertussis
guaguacagcagca

SEQ ID NO: 2378733 - RNA, 17 nt, Bordetella pertussis
guaguacagcagcagca

SEQ ID NO: 2378734 - RNA, 13 nt, Bordetella pertussis
guaguagcccagg

SEQ ID NO: 2378735 - RNA, 15 nt, Bordetella pertussis
guagucgccgcugcc

SEQ ID NO: 2378736 - RNA, 23 nt, Bordetella pertussis
guagucgccggcuuccagcagca

SEQ ID NO: 2378737 - RNA, 18 nt, Bordetella pertussis
guagucggccaccaggcc

SEQ ID NO: 2378738 - RNA, 14 nt, Bordetella pertussis
guagucggcgccca

SEQ ID NO: 2378739 - RNA, 18 nt, Bordetella pertussis
guagucggcgcccagcuc

SEQ ID NO: 2378740 - RNA, 19 nt, Bordetella pertussis
guagucguugccggccagc

SEQ ID NO: 2378741 - RNA, 23 nt, Bordetella pertussis
guagucguugccggccagcacgg

SEQ ID NO: 2378742 - RNA, 19 nt, Bordetella pertussis
guagugcggcgccagcugg

SEQ ID NO: 2378743 - RNA, 14 nt, Bordetella pertussis
guagugcuccacca

SEQ ID NO: 2378744 - RNA, 21 nt, Bordetella pertussis
guagugguaugaccggcgcgg

SEQ ID NO: 2378745 - RNA, 15 nt, Bordetella pertussis
guagugguguagcca

SEQ ID NO: 2378746 - RNA, 18 nt, Bordetella pertussis
guagugguguagccagga

SEQ ID NO: 2378747 - RNA, 14 nt, Bordetella pertussis
guaguucggcgcgu

SEQ ID NO: 2378748 - RNA, 20 nt, Bordetella pertussis
guaguucggcgcgugcggau

SEQ ID NO: 2378749 - RNA, 22 nt, Bordetella pertussis
guaguucggcgcgugcggaugc

SEQ ID NO: 2378750 - RNA, 14 nt, Bordetella pertussis
guaguugggcgccu

SEQ ID NO: 2378751 - RNA, 18 nt, Bordetella pertussis
guaguugggcgccuugcc

SEQ ID NO: 2378752 - RNA, 14 nt, Bordetella pertussis
guauagaugcgcgg

SEQ ID NO: 2378753 - RNA, 20 nt, Bordetella pertussis
guauagcgguacucgcgcgg

SEQ ID NO: 2378754 - RNA, 18 nt, Bordetella pertussis
guaucaacuuccagcgcc

SEQ ID NO: 2378755 - RNA, 21 nt, Bordetella pertussis
guaucccaccugcagccagau

SEQ ID NO: 2378756 - RNA, 15 nt, Bordetella pertussis
guaucccggccaggc

SEQ ID NO: 2378757 - RNA, 18 nt, Bordetella pertussis
guaucccggccaggcgcc

SEQ ID NO: 2378758 - RNA, 13 nt, Bordetella pertussis
guauccuggcgcg

SEQ ID NO: 2378759 - RNA, 14 nt, Bordetella pertussis
guauccuggcgcgg

SEQ ID NO: 2378760 - RNA, 16 nt, Bordetella pertussis
guaucgacccaggccg

SEQ ID NO: 2378761 - RNA, 17 nt, Bordetella pertussis
guaucgacccaggccgg

SEQ ID NO: 2378762 - RNA, 19 nt, Bordetella pertussis
guaucgacccaggccggcg

SEQ ID NO: 2378763 - RNA, 19 nt, Bordetella pertussis
guaucgagguuuccgccau

SEQ ID NO: 2378764 - RNA, 15 nt, Bordetella pertussis
guaucgauagccgac

SEQ ID NO: 2378765 - RNA, 18 nt, Bordetella pertussis
guaucgcccgcgcgguau

SEQ ID NO: 2378766 - RNA, 22 nt, Bordetella pertussis
guaucgcggccgagcuccucga

SEQ ID NO: 2378767 - RNA, 21 nt, Bordetella pertussis
guaucggcccgcgccagcgcc

SEQ ID NO: 2378768 - RNA, 12 nt, Bordetella pertussis
guaucggccucg

SEQ ID NO: 2378769 - RNA, 22 nt, Bordetella pertussis
guaucucggcgcccgcggccug

SEQ ID NO: 2378770 - RNA, 17 nt, Bordetella pertussis
guaucuguccccgcggg

SEQ ID NO: 2378771 - RNA, 23 nt, Bordetella pertussis
guaucuguccccgcggggacagg

SEQ ID NO: 2378772 - RNA, 23 nt, Bordetella pertussis
gucagcuuccagaucgaccagga

SEQ ID NO: 2378773 - RNA, 17 nt, Bordetella pertussis
gucagcuugccgcccag

SEQ ID NO: 2378774 - RNA, 23 nt, Bordetella pertussis
gucaggaugcccuggguggcggg

SEQ ID NO: 2378775 - RNA, 13 nt, Bordetella pertussis
gucaggaugcgcg

SEQ ID NO: 2378776 - RNA, 16 nt, Bordetella pertussis
gucaggaugcgcgcca

SEQ ID NO: 2378777 - RNA, 22 nt, Bordetella pertussis
gucaggaugcgcgccaggcugu

SEQ ID NO: 2378778 - RNA, 17 nt, Bordetella pertussis
gucaggcaggcgcgccg

SEQ ID NO: 2378779 - RNA, 17 nt, Bordetella pertussis
gucaggcccacgccgcc

SEQ ID NO: 2378780 - RNA, 18 nt, Bordetella pertussis
gucaggcccacgccgccg

SEQ ID NO: 2378781 - RNA, 19 nt, Bordetella pertussis
gucaggccgucgagccggg

SEQ ID NO: 2378782 - RNA, 20 nt, Bordetella pertussis
gucaggccgucgagccgggc

SEQ ID NO: 2378783 - RNA, 18 nt, Bordetella pertussis
gucaggccguuggcgcgc

SEQ ID NO: 2378784 - RNA, 20 nt, Bordetella pertussis
gucaggccguuggcgcgccu

SEQ ID NO: 2378785 - RNA, 13 nt, Bordetella pertussis
gucaggcggaugc

SEQ ID NO: 2378786 - RNA, 14 nt, Bordetella pertussis
gucaggcggucgac

SEQ ID NO: 2378787 - RNA, 16 nt, Bordetella pertussis
gucaggcguggcgaca

SEQ ID NO: 2378788 - RNA, 21 nt, Bordetella pertussis
gucaggcugggagagccggcc

SEQ ID NO: 2378789 - RNA, 15 nt, Bordetella pertussis
gucagggccgcccag

SEQ ID NO: 2378790 - RNA, 16 nt, Bordetella pertussis
gucagggccgcccagu

SEQ ID NO: 2378791 - RNA, 16 nt, Bordetella pertussis
gucagggcugcagauu

SEQ ID NO: 2378792 - RNA, 13 nt, Bordetella pertussis
gucaggggcaggc

SEQ ID NO: 2378793 - RNA, 16 nt, Bordetella pertussis
gucaggguacgcucga

SEQ ID NO: 2378794 - RNA, 14 nt, Bordetella pertussis
gucaggucgcugcc

SEQ ID NO: 2378795 - RNA, 16 nt, Bordetella pertussis
gucagguugcgccggc

SEQ ID NO: 2378796 - RNA, 17 nt, Bordetella pertussis
gucaguccguggcgcgg

SEQ ID NO: 2378797 - RNA, 20 nt, Bordetella pertussis
gucaguccguggcgcggcca

SEQ ID NO: 2378798 - RNA, 16 nt, Bordetella pertussis
gucaguccucaugcgg

SEQ ID NO: 2378799 - RNA, 21 nt, Bordetella pertussis
gucaguccucaugcgggacag

SEQ ID NO: 2378800 - RNA, 19 nt, Bordetella pertussis
gucagucgggacggcgcgg

SEQ ID NO: 2378801 - RNA, 22 nt, Bordetella pertussis
gucagucgggacggcgcgggca

SEQ ID NO: 2378802 - RNA, 14 nt, Bordetella pertussis
gucaguugaagacg

SEQ ID NO: 2378803 - RNA, 21 nt, Bordetella pertussis
gucaguuuccaucggggggca

SEQ ID NO: 2378804 - RNA, 14 nt, Bordetella pertussis
gucauagcgccagc

SEQ ID NO: 2378805 - RNA, 20 nt, Bordetella pertussis
gucauaggcuucgcccgcca

SEQ ID NO: 2378806 - RNA, 21 nt, Bordetella pertussis
gucaucaccaagggcgccggg

SEQ ID NO: 2378807 - RNA, 16 nt, Bordetella pertussis
gucaucaccagggugg

SEQ ID NO: 2378808 - RNA, 21 nt, Bordetella pertussis
gucaucaccaggguggcgggc

SEQ ID NO: 2378809 - RNA, 12 nt, Bordetella pertussis
gucaucacgcgg

SEQ ID NO: 2378810 - RNA, 23 nt, Bordetella pertussis
gucaucacgcggucgaugcgcac

SEQ ID NO: 2378811 - RNA, 13 nt, Bordetella pertussis
gucaucagcacga

SEQ ID NO: 2378812 - RNA, 18 nt, Bordetella pertussis
gucaucgagguggcgggc

SEQ ID NO: 2378813 - RNA, 14 nt, Bordetella pertussis
gucaucgaugcgcc

SEQ ID NO: 2378814 - RNA, 15 nt, Bordetella pertussis
gucaucgaugcgccg

SEQ ID NO: 2378815 - RNA, 15 nt, Bordetella pertussis
gucaucgauggccag

SEQ ID NO: 2378816 - RNA, 20 nt, Bordetella pertussis
gucaucgccaugcugccaac

SEQ ID NO: 2378817 - RNA, 14 nt, Bordetella pertussis
gucaucgccgcggc

SEQ ID NO: 2378818 - RNA, 14 nt, Bordetella pertussis
gucaucgcgcuggc

SEQ ID NO: 2378819 - RNA, 15 nt, Bordetella pertussis
gucaucgcgcuggcg

SEQ ID NO: 2378820 - RNA, 19 nt, Bordetella pertussis
gucaucgggugcggcgccu

SEQ ID NO: 2378821 - RNA, 17 nt, Bordetella pertussis
gucaucggugcggccgg

SEQ ID NO: 2378822 - RNA, 23 nt, Bordetella pertussis
gucaucggugcggccgguggcga

SEQ ID NO: 2378823 - RNA, 17 nt, Bordetella pertussis
gucaucguggccgcgca

SEQ ID NO: 2378824 - RNA, 24 nt, Bordetella pertussis
gucaugaacgucaccccgcccugc

SEQ ID NO: 2378825 - RNA, 18 nt, Bordetella pertussis
gucaugaggccccugucc

SEQ ID NO: 2378826 - RNA, 19 nt, Bordetella pertussis
gucaugaggccccuguccu

SEQ ID NO: 2378827 - RNA, 17 nt, Bordetella pertussis
gucaugaucccgcgccu

SEQ ID NO: 2378828 - RNA, 22 nt, Bordetella pertussis
gucaugauguagcccauguucu

SEQ ID NO: 2378829 - RNA, 22 nt, Bordetella pertussis
gucaugcagaacagggugccgc

SEQ ID NO: 2378830 - RNA, 16 nt, Bordetella pertussis
gucaugcccaugccgc

SEQ ID NO: 2378831 - RNA, 22 nt, Bordetella pertussis
gucaugcccaugccgccaugca

SEQ ID NO: 2378832 - RNA, 17 nt, Bordetella pertussis
gucaugcccuccucggc

SEQ ID NO: 2378833 - RNA, 20 nt, Bordetella pertussis
gucaugcccuccucggccag

SEQ ID NO: 2378834 - RNA, 21 nt, Bordetella pertussis
gucaugcccuccucggccagg

SEQ ID NO: 2378835 - RNA, 12 nt, Bordetella pertussis
gucaugccgaac

SEQ ID NO: 2378836 - RNA, 16 nt, Bordetella pertussis
gucaugcgcaccuugu

SEQ ID NO: 2378837 - RNA, 18 nt, Bordetella pertussis
gucaugcgccaugaacgc

SEQ ID NO: 2378838 - RNA, 17 nt, Bordetella pertussis
gucaugcgugaacuggu

SEQ ID NO: 2378839 - RNA, 16 nt, Bordetella pertussis
gucaugcugucgcuca

SEQ ID NO: 2378840 - RNA, 18 nt, Bordetella pertussis
gucaugcugucgcucaug

SEQ ID NO: 2378841 - RNA, 15 nt, Bordetella pertussis
gucauggccuggccc

SEQ ID NO: 2378842 - RNA, 16 nt, Bordetella pertussis
gucauggccuggccca

SEQ ID NO: 2378843 - RNA, 17 nt, Bordetella pertussis
gucauggccuggcccag

SEQ ID NO: 2378844 - RNA, 22 nt, Bordetella pertussis
gucauggcgccgugaaugcgcc

SEQ ID NO: 2378845 - RNA, 19 nt, Bordetella pertussis
gucauggcggcaggcgcga

SEQ ID NO: 2378846 - RNA, 15 nt, Bordetella pertussis
gucauggcgugcgcg

SEQ ID NO: 2378847 - RNA, 13 nt, Bordetella pertussis
gucaugggcgggg

SEQ ID NO: 2378848 - RNA, 17 nt, Bordetella pertussis
gucauggucgaccagca

SEQ ID NO: 2378849 - RNA, 22 nt, Bordetella pertussis
gucauggucgaccagcagccgg

SEQ ID NO: 2378850 - RNA, 14 nt, Bordetella pertussis
gucauguccagcgc

SEQ ID NO: 2378851 - RNA, 20 nt, Bordetella pertussis
gucauugcaucgcagcagaa

SEQ ID NO: 2378852 - RNA, 18 nt, Bordetella pertussis
guccaaaacagacaggcc

SEQ ID NO: 2378853 - RNA, 19 nt, Bordetella pertussis
guccaagcagacccgcgcc

SEQ ID NO: 2378854 - RNA, 19 nt, Bordetella pertussis
guccaaggaaagcccggcc

SEQ ID NO: 2378855 - RNA, 20 nt, Bordetella pertussis
guccaaggaaagcccggccc

SEQ ID NO: 2378856 - RNA, 15 nt, Bordetella pertussis
guccaauucgagcag

SEQ ID NO: 2378857 - RNA, 18 nt, Bordetella pertussis
guccaauucgagcaggcg

SEQ ID NO: 2378858 - RNA, 21 nt, Bordetella pertussis
guccaauucgagcaggcgcag

SEQ ID NO: 2378859 - RNA, 22 nt, Bordetella pertussis
guccaauucgagcaggcgcagg

SEQ ID NO: 2378860 - RNA, 16 nt, Bordetella pertussis
guccacauccgcgcug

SEQ ID NO: 2378861 - RNA, 17 nt, Bordetella pertussis
guccacauccgcgcugc

SEQ ID NO: 2378862 - RNA, 21 nt, Bordetella pertussis
guccacauccgcgcugcugcc

SEQ ID NO: 2378863 - RNA, 16 nt, Bordetella pertussis
guccaccaccaggccg

SEQ ID NO: 2378864 - RNA, 17 nt, Bordetella pertussis
guccaccacccaggccc

SEQ ID NO: 2378865 - RNA, 14 nt, Bordetella pertussis
guccaccaccuuca

SEQ ID NO: 2378866 - RNA, 22 nt, Bordetella pertussis
guccaccaccuucagggcgccg

SEQ ID NO: 2378867 - RNA, 13 nt, Bordetella pertussis
guccaccagccgg

SEQ ID NO: 2378868 - RNA, 16 nt, Bordetella pertussis
guccaccagccggccg

SEQ ID NO: 2378869 - RNA, 17 nt, Bordetella pertussis
guccaccagccggccgc

SEQ ID NO: 2378870 - RNA, 20 nt, Bordetella pertussis
guccaccagccggccgccga

SEQ ID NO: 2378871 - RNA, 20 nt, Bordetella pertussis
guccacccccgucagcacgg

SEQ ID NO: 2378872 - RNA, 13 nt, Bordetella pertussis
guccaccgccacg

SEQ ID NO: 2378873 - RNA, 19 nt, Bordetella pertussis
guccaccucgucguccagc

SEQ ID NO: 2378874 - RNA, 16 nt, Bordetella pertussis
guccaccuugacgcgc

SEQ ID NO: 2378875 - RNA, 16 nt, Bordetella pertussis
guccacgaaggcagca

SEQ ID NO: 2378876 - RNA, 17 nt, Bordetella pertussis
guccacgaaggcagcac

SEQ ID NO: 2378877 - RNA, 14 nt, Bordetella pertussis
guccacgaaggcgc

SEQ ID NO: 2378878 - RNA, 17 nt, Bordetella pertussis
guccacgaaggcgccga

SEQ ID NO: 2378879 - RNA, 19 nt, Bordetella pertussis
guccacgaaggcgccgaaa

SEQ ID NO: 2378880 - RNA, 23 nt, Bordetella pertussis
guccacgaaggcgccgaaauugg

SEQ ID NO: 2378881 - RNA, 23 nt, Bordetella pertussis
guccacgauauugguguugccgg

SEQ ID NO: 2378882 - RNA, 21 nt, Bordetella pertussis
guccacgaugucguccagcuc

SEQ ID NO: 2378883 - RNA, 23 nt, Bordetella pertussis
guccacgcagaaauggaugcgcg

SEQ ID NO: 2378884 - RNA, 14 nt, Bordetella pertussis
gucccagucgccgc

SEQ ID NO: 2378885 - RNA, 20 nt, Bordetella pertussis
gucccagucgccgcgcccgc

SEQ ID NO: 2378886 - RNA, 21 nt, Bordetella pertussis
guccccacagggggacuggca

SEQ ID NO: 2378887 - RNA, 21 nt, Bordetella pertussis
guccccacauggggacuggca

SEQ ID NO: 2378888 - RNA, 21 nt, Bordetella pertussis
guccccaccgggacaggcacc

SEQ ID NO: 2378889 - RNA, 19 nt, Bordetella pertussis
guccccacggggacaggca

SEQ ID NO: 2378890 - RNA, 21 nt, Bordetella pertussis
guccccacggggacaggcacc

SEQ ID NO: 2378891 - RNA, 22 nt, Bordetella pertussis
guccccacguggacaggcaccu

SEQ ID NO: 2378892 - RNA, 15 nt, Bordetella pertussis
guccccagauccgca

SEQ ID NO: 2378893 - RNA, 21 nt, Bordetella pertussis
guccccauguggggacaggca

SEQ ID NO: 2378894 - RNA, 15 nt, Bordetella pertussis
gucccccgcggggac

SEQ ID NO: 2378895 - RNA, 17 nt, Bordetella pertussis
gucccccuacugcccuc

SEQ ID NO: 2378896 - RNA, 21 nt, Bordetella pertussis
gucccccugcggggacaggca

SEQ ID NO: 2378897 - RNA, 21 nt, Bordetella pertussis
guccccgaacggggacuggca

SEQ ID NO: 2378898 - RNA, 22 nt, Bordetella pertussis
guccccgcaagggggacuggca

SEQ ID NO: 2378899 - RNA, 20 nt, Bordetella pertussis
guccccgcaggagcaugccc

SEQ ID NO: 2378900 - RNA, 21 nt, Bordetella pertussis
guccccgcaggagcaugcccu

SEQ ID NO: 2378901 - RNA, 23 nt, Bordetella pertussis
guccccgcaggagcaugcccuuu

SEQ ID NO: 2378902 - RNA, 19 nt, Bordetella pertussis
guccccgcagggacaggca

SEQ ID NO: 2378903 - RNA, 20 nt, Bordetella pertussis
guccccgcagggacaggcac

SEQ ID NO: 2378904 - RNA, 21 nt, Bordetella pertussis
guccccgcagggacaggcucc

SEQ ID NO: 2378905 - RNA, 21 nt, Bordetella pertussis
guccccgcauggagaccggcg

SEQ ID NO: 2378906 - RNA, 20 nt, Bordetella pertussis
guccccgcaugggggcuggc

SEQ ID NO: 2378907 - RNA, 21 nt, Bordetella pertussis
guccccgcaugggggcuggcg

SEQ ID NO: 2378908 - RNA, 22 nt, Bordetella pertussis
guccccgcaugggggcuggcgc

SEQ ID NO: 2378909 - RNA, 23 nt, Bordetella pertussis
guccccgcaugggggcuggcgcu

SEQ ID NO: 2378910 - RNA, 13 nt, Bordetella pertussis
guccccgccgggg

SEQ ID NO: 2378911 - RNA, 19 nt, Bordetella pertussis
guccccgcggggacaggca

SEQ ID NO: 2378912 - RNA, 20 nt, Bordetella pertussis
guccccgcggggacaggcac

SEQ ID NO: 2378913 - RNA, 21 nt, Bordetella pertussis
guccccgcggggacaggcacc

SEQ ID NO: 2378914 - RNA, 23 nt, Bordetella pertussis
guccccgcggggacaggcacccu

SEQ ID NO: 2378915 - RNA, 21 nt, Bordetella pertussis
guccccgcggggacaggcucc

SEQ ID NO: 2378916 - RNA, 20 nt, Bordetella pertussis
guccccgcugggacaggcac

SEQ ID NO: 2378917 - RNA, 21 nt, Bordetella pertussis
guccccguggggacaggcacc

SEQ ID NO: 2378918 - RNA, 16 nt, Bordetella pertussis
guccccguucggggac

SEQ ID NO: 2378919 - RNA, 21 nt, Bordetella pertussis
guccccguucggggacaggca

SEQ ID NO: 2378920 - RNA, 15 nt, Bordetella pertussis
guccccugcggggac

SEQ ID NO: 2378921 - RNA, 20 nt, Bordetella pertussis
guccccugcggggacaggca

SEQ ID NO: 2378922 - RNA, 15 nt, Bordetella pertussis
gucccgacggggaca

SEQ ID NO: 2378923 - RNA, 19 nt, Bordetella pertussis
gucccgcaccgaccagcgc

SEQ ID NO: 2378924 - RNA, 21 nt, Bordetella pertussis
gucccgcaccgaccagcgcgc

SEQ ID NO: 2378925 - RNA, 13 nt, Bordetella pertussis
gucccgcaccggg

SEQ ID NO: 2378926 - RNA, 16 nt, Bordetella pertussis
gucccgcaccgggcaa

SEQ ID NO: 2378927 - RNA, 17 nt, Bordetella pertussis
gucccgcacgcagcccu

SEQ ID NO: 2378928 - RNA, 22 nt, Bordetella pertussis
gucccgcaguacccggugcagc

SEQ ID NO: 2378929 - RNA, 17 nt, Bordetella pertussis
gucccgcaugaccugca

SEQ ID NO: 2378930 - RNA, 14 nt, Bordetella pertussis
gucccggcggggac

SEQ ID NO: 2378931 - RNA, 19 nt, Bordetella pertussis
gucccggcggggacaggcg

SEQ ID NO: 2378932 - RNA, 19 nt, Bordetella pertussis
gucccggcggggcaggcgc

SEQ ID NO: 2378933 - RNA, 15 nt, Bordetella pertussis
gucccggcugggaca

SEQ ID NO: 2378934 - RNA, 19 nt, Bordetella pertussis
gucccggcugggacaggca

SEQ ID NO: 2378935 - RNA, 20 nt, Bordetella pertussis
gucccggcugggacaggcac

SEQ ID NO: 2378936 - RNA, 20 nt, Bordetella pertussis
gucccggugaucguccugaa

SEQ ID NO: 2378937 - RNA, 15 nt, Bordetella pertussis
gucccgugccggccg

SEQ ID NO: 2378938 - RNA, 18 nt, Bordetella pertussis
gucccgugccggccggac

SEQ ID NO: 2378939 - RNA, 20 nt, Bordetella pertussis
gucccugaacguggcgucca

SEQ ID NO: 2378940 - RNA, 14 nt, Bordetella pertussis
gucccugccgggac

SEQ ID NO: 2378941 - RNA, 14 nt, Bordetella pertussis
gucccugcggggac

SEQ ID NO: 2378942 - RNA, 19 nt, Bordetella pertussis
gucccugcggggacuggcu

SEQ ID NO: 2378943 - RNA, 21 nt, Bordetella pertussis
gucccugcggggacuggcucc

SEQ ID NO: 2378944 - RNA, 20 nt, Bordetella pertussis
gucccugcgggggcaggcac

SEQ ID NO: 2378945 - RNA, 21 nt, Bordetella pertussis
gucccugcgggggcaggcacg

SEQ ID NO: 2378946 - RNA, 23 nt, Bordetella pertussis
gucccuggccauuccuuccgggc

SEQ ID NO: 2378947 - RNA, 20 nt, Bordetella pertussis
gucccuggcccuggcgggcc

SEQ ID NO: 2378948 - RNA, 15 nt, Bordetella pertussis
gucccugguccagca

SEQ ID NO: 2378949 - RNA, 17 nt, Bordetella pertussis
gucccugguccagcagc

SEQ ID NO: 2378950 - RNA, 13 nt, Bordetella pertussis
guccgaaccaccc

SEQ ID NO: 2378951 - RNA, 18 nt, Bordetella pertussis
guccgaaccacccggcca

SEQ ID NO: 2378952 - RNA, 19 nt, Bordetella pertussis
guccgaaccacccggccau

SEQ ID NO: 2378953 - RNA, 19 nt, Bordetella pertussis
guccgaaccgaccgccacg

SEQ ID NO: 2378954 - RNA, 17 nt, Bordetella pertussis
guccgacaggcagacga

SEQ ID NO: 2378955 - RNA, 15 nt, Bordetella pertussis
guccgagcccgggcg

SEQ ID NO: 2378956 - RNA, 17 nt, Bordetella pertussis
guccgagcccgggcgug

SEQ ID NO: 2378957 - RNA, 15 nt, Bordetella pertussis
guccgaugucgagga

SEQ ID NO: 2378958 - RNA, 13 nt, Bordetella pertussis
guccgcagcgcag

SEQ ID NO: 2378959 - RNA, 15 nt, Bordetella pertussis
guccgcagcgcagcg

SEQ ID NO: 2378960 - RNA, 16 nt, Bordetella pertussis
guccgcaucgcgcaag

SEQ ID NO: 2378961 - RNA, 17 nt, Bordetella pertussis
guccgccacgccggcca

SEQ ID NO: 2378962 - RNA, 15 nt, Bordetella pertussis
guccgccaggacggg

SEQ ID NO: 2378963 - RNA, 11 nt, Bordetella pertussis
guccgccaugc

SEQ ID NO: 2378964 - RNA, 14 nt, Bordetella pertussis
guccgcccagccag

SEQ ID NO: 2378965 - RNA, 17 nt, Bordetella pertussis
guccgcccagccaggcg

SEQ ID NO: 2378966 - RNA, 20 nt, Bordetella pertussis
guccgcccagccaggcgcca

SEQ ID NO: 2378967 - RNA, 21 nt, Bordetella pertussis
guccgcccagccaggcgccag

SEQ ID NO: 2378968 - RNA, 22 nt, Bordetella pertussis
guccgccccauccacggcgcca

SEQ ID NO: 2378969 - RNA, 14 nt, Bordetella pertussis
guccgccgcgacca

SEQ ID NO: 2378970 - RNA, 22 nt, Bordetella pertussis
guccgccgcgaccaccagcacc

SEQ ID NO: 2378971 - RNA, 16 nt, Bordetella pertussis
guccgccguagcgcgc

SEQ ID NO: 2378972 - RNA, 17 nt, Bordetella pertussis
guccgccguagcgcgcc

SEQ ID NO: 2378973 - RNA, 21 nt, Bordetella pertussis
guccgccguagcgcgccagcc

SEQ ID NO: 2378974 - RNA, 15 nt, Bordetella pertussis
guccgccgugcaggc

SEQ ID NO: 2378975 - RNA, 18 nt, Bordetella pertussis
guccgccgugcaggcccg

SEQ ID NO: 2378976 - RNA, 22 nt, Bordetella pertussis
guccgccgugcaggcccgggcg

SEQ ID NO: 2378977 - RNA, 15 nt, Bordetella pertussis
guccgccugcggacg

SEQ ID NO: 2378978 - RNA, 17 nt, Bordetella pertussis
guccgccugcggacggc

SEQ ID NO: 2378979 - RNA, 20 nt, Bordetella pertussis
guccgccugcggacggcggg

SEQ ID NO: 2378980 - RNA, 21 nt, Bordetella pertussis
guccgccugcggacggcgggc

SEQ ID NO: 2378981 - RNA, 14 nt, Bordetella pertussis
guccgcgacggucc

SEQ ID NO: 2378982 - RNA, 13 nt, Bordetella pertussis
guccgcgccggga

SEQ ID NO: 2378983 - RNA, 14 nt, Bordetella pertussis
guccgcgcgcagcg

SEQ ID NO: 2378984 - RNA, 19 nt, Bordetella pertussis
guccgcgcgcagcgcgccg

SEQ ID NO: 2378985 - RNA, 19 nt, Bordetella pertussis
guccgcgcucgcccagccg

SEQ ID NO: 2378986 - RNA, 14 nt, Bordetella pertussis
guccgcgucggccg

SEQ ID NO: 2378987 - RNA, 17 nt, Bordetella pertussis
guccgcgugggcauggu

SEQ ID NO: 2378988 - RNA, 16 nt, Bordetella pertussis
guccgcucgaggccag

SEQ ID NO: 2378989 - RNA, 19 nt, Bordetella pertussis
guccgcucgaggccaggcu

SEQ ID NO: 2378990 - RNA, 19 nt, Bordetella pertussis
guccgcuucgucgggcagc

SEQ ID NO: 2378991 - RNA, 23 nt, Bordetella pertussis
guccgcuucgucgggcagcgcgg

SEQ ID NO: 2378992 - RNA, 17 nt, Bordetella pertussis
guccggaucccaggccg

SEQ ID NO: 2378993 - RNA, 23 nt, Bordetella pertussis
guccggaucuuccuugaagccgu

SEQ ID NO: 2378994 - RNA, 22 nt, Bordetella pertussis
guccggaugcacguagcgcagc

SEQ ID NO: 2378995 - RNA, 14 nt, Bordetella pertussis
gucgaacagcugca

SEQ ID NO: 2378996 - RNA, 23 nt, Bordetella pertussis
gucgaacaggcgcuugcgcucgg

SEQ ID NO: 2378997 - RNA, 13 nt, Bordetella pertussis
gucgaaccagccg

SEQ ID NO: 2378998 - RNA, 13 nt, Bordetella pertussis
gucgaacggccgg

SEQ ID NO: 2378999 - RNA, 14 nt, Bordetella pertussis
gucgaacggccggg

SEQ ID NO: 2379000 - RNA, 15 nt, Bordetella pertussis
gucgaacggccgggc

SEQ ID NO: 2379001 - RNA, 16 nt, Bordetella pertussis
gucgaacguggcggcg

SEQ ID NO: 2379002 - RNA, 17 nt, Bordetella pertussis
gucgaacguggcggcga

SEQ ID NO: 2379003 - RNA, 16 nt, Bordetella pertussis
gucgaacuccucgacg

SEQ ID NO: 2379004 - RNA, 19 nt, Bordetella pertussis
gucgaagaaggccuuggcc

SEQ ID NO: 2379005 - RNA, 17 nt, Bordetella pertussis
gucgaagaucagggugg

SEQ ID NO: 2379006 - RNA, 13 nt, Bordetella pertussis
gucgaagcaggcg

SEQ ID NO: 2379007 - RNA, 23 nt, Bordetella pertussis
gucgaagcaggcgguacagcgga

SEQ ID NO: 2379008 - RNA, 13 nt, Bordetella pertussis
gucgaagccggcg

SEQ ID NO: 2379009 - RNA, 16 nt, Bordetella pertussis
gucgaagccggugaug

SEQ ID NO: 2379010 - RNA, 16 nt, Bordetella pertussis
gucgaaggccgccgga

SEQ ID NO: 2379011 - RNA, 16 nt, Bordetella pertussis
gucgaaggcggccggc

SEQ ID NO: 2379012 - RNA, 19 nt, Bordetella pertussis
gucgaaguagaacgccggc

SEQ ID NO: 2379013 - RNA, 20 nt, Bordetella pertussis
gucgaaguagaacgccggcu

SEQ ID NO: 2379014 - RNA, 16 nt, Bordetella pertussis
gucgaaugcacgggcg

SEQ ID NO: 2379015 - RNA, 16 nt, Bordetella pertussis
gucgaauuccgggacg

SEQ ID NO: 2379016 - RNA, 18 nt, Bordetella pertussis
gucgaauuucccgggugg

SEQ ID NO: 2379017 - RNA, 20 nt, Bordetella pertussis
gucgaauuucccggguggcg

SEQ ID NO: 2379018 - RNA, 21 nt, Bordetella pertussis
gucgacagguagcggucgccg

SEQ ID NO: 2379019 - RNA, 16 nt, Bordetella pertussis
gucgacauagacgcgc

SEQ ID NO: 2379020 - RNA, 20 nt, Bordetella pertussis
gucgacauagacgcgcagcg

SEQ ID NO: 2379021 - RNA, 13 nt, Bordetella pertussis
gucgaccaccagc

SEQ ID NO: 2379022 - RNA, 14 nt, Bordetella pertussis
gucgaccaccagca

SEQ ID NO: 2379023 - RNA, 16 nt, Bordetella pertussis
gucgaccaccagcauc

SEQ ID NO: 2379024 - RNA, 15 nt, Bordetella pertussis
gucgaccacgccggc

SEQ ID NO: 2379025 - RNA, 18 nt, Bordetella pertussis
gucgaccacgccggcggc

SEQ ID NO: 2379026 - RNA, 22 nt, Bordetella pertussis
gucgaccacgccggcggccaug

SEQ ID NO: 2379027 - RNA, 23 nt, Bordetella pertussis
gucgaccacgccggcggccauga

SEQ ID NO: 2379028 - RNA, 14 nt, Bordetella pertussis
gucgaccagcagcc

SEQ ID NO: 2379029 - RNA, 20 nt, Bordetella pertussis
gucgaccagcagccgguugg

SEQ ID NO: 2379030 - RNA, 15 nt, Bordetella pertussis
gucgaccaggccggu

SEQ ID NO: 2379031 - RNA, 20 nt, Bordetella pertussis
gucgaccaggccggugcgca

SEQ ID NO: 2379032 - RNA, 18 nt, Bordetella pertussis
gucgaccaguucggccag

SEQ ID NO: 2379033 - RNA, 21 nt, Bordetella pertussis
gucgaccccgucgaccgcggc

SEQ ID NO: 2379034 - RNA, 21 nt, Bordetella pertussis
gucgaccgacagcacauggcg

SEQ ID NO: 2379035 - RNA, 15 nt, Bordetella pertussis
gucgaccgcgaagcc

SEQ ID NO: 2379036 - RNA, 16 nt, Bordetella pertussis
gucgaccgcgaagccg

SEQ ID NO: 2379037 - RNA, 19 nt, Bordetella pertussis
gucgaccgcgaagcgcgcc

SEQ ID NO: 2379038 - RNA, 15 nt, Bordetella pertussis
gucgaccgcgggcgc

SEQ ID NO: 2379039 - RNA, 20 nt, Bordetella pertussis
gucgaccgcgggcgcgcgcc

SEQ ID NO: 2379040 - RNA, 21 nt, Bordetella pertussis
gucgaccggaaucaccgccgc

SEQ ID NO: 2379041 - RNA, 15 nt, Bordetella pertussis
gucgaccggcccgca

SEQ ID NO: 2379042 - RNA, 17 nt, Bordetella pertussis
gucgaccucgagcaccu

SEQ ID NO: 2379043 - RNA, 20 nt, Bordetella pertussis
gucgaccugcuugcccagca

SEQ ID NO: 2379044 - RNA, 14 nt, Bordetella pertussis
gucgacgacggcaa

SEQ ID NO: 2379045 - RNA, 21 nt, Bordetella pertussis
gucgacgaggggguguucucc

SEQ ID NO: 2379046 - RNA, 15 nt, Bordetella pertussis
gucgacgaucaggcc

SEQ ID NO: 2379047 - RNA, 22 nt, Bordetella pertussis
gucgacgaucaggcccuggggc

SEQ ID NO: 2379048 - RNA, 17 nt, Bordetella pertussis
gucgacgcagcagccgc

SEQ ID NO: 2379049 - RNA, 22 nt, Bordetella pertussis
gucgacgcagcagccgcuaggu

SEQ ID NO: 2379050 - RNA, 15 nt, Bordetella pertussis
gucgacgccgaaggu

SEQ ID NO: 2379051 - RNA, 13 nt, Bordetella pertussis
gucgacgccggcg

SEQ ID NO: 2379052 - RNA, 15 nt, Bordetella pertussis
gucgacgccggcgac

SEQ ID NO: 2379053 - RNA, 13 nt, Bordetella pertussis
gucgacgcggccg

SEQ ID NO: 2379054 - RNA, 16 nt, Bordetella pertussis
gucgacgcugaucggc

SEQ ID NO: 2379055 - RNA, 14 nt, Bordetella pertussis
gucgacggugcgcg

SEQ ID NO: 2379056 - RNA, 15 nt, Bordetella pertussis
gucgacggugcgcgc

SEQ ID NO: 2379057 - RNA, 16 nt, Bordetella pertussis
gucgacguccuggugg

SEQ ID NO: 2379058 - RNA, 22 nt, Bordetella pertussis
gucgacguuaugcucgcgcaug

SEQ ID NO: 2379059 - RNA, 14 nt, Bordetella pertussis
gucgagaccagcag

SEQ ID NO: 2379060 - RNA, 14 nt, Bordetella pertussis
gucgagagccuggg

SEQ ID NO: 2379061 - RNA, 13 nt, Bordetella pertussis
gucgagcaccgcg

SEQ ID NO: 2379062 - RNA, 19 nt, Bordetella pertussis
gucgagcacgcggcgcggc

SEQ ID NO: 2379063 - RNA, 16 nt, Bordetella pertussis
gucgagcagcgcaucg

SEQ ID NO: 2379064 - RNA, 12 nt, Bordetella pertussis
gucgagcaggcc

SEQ ID NO: 2379065 - RNA, 15 nt, Bordetella pertussis
gucgagcaggccggc

SEQ ID NO: 2379066 - RNA, 17 nt, Bordetella pertussis
gucgagcaggccggcgu

SEQ ID NO: 2379067 - RNA, 19 nt, Bordetella pertussis
gucgagcaucccggcgcuc

SEQ ID NO: 2379068 - RNA, 13 nt, Bordetella pertussis
gucgagccaggug

SEQ ID NO: 2379069 - RNA, 14 nt, Bordetella pertussis
gucgagccaggugg

SEQ ID NO: 2379070 - RNA, 12 nt, Bordetella pertussis
gucgagccgggc

SEQ ID NO: 2379071 - RNA, 22 nt, Bordetella pertussis
gucgagccgggccacgcgcaca

SEQ ID NO: 2379072 - RNA, 12 nt, Bordetella pertussis
gucgagcgccga

SEQ ID NO: 2379073 - RNA, 15 nt, Bordetella pertussis
gucgagcgccgaagu

SEQ ID NO: 2379074 - RNA, 15 nt, Bordetella pertussis
gucgagcgccugcgc

SEQ ID NO: 2379075 - RNA, 16 nt, Bordetella pertussis
gucgagcgccugcgcc

SEQ ID NO: 2379076 - RNA, 16 nt, Bordetella pertussis
gucgagcgcgacgcgc

SEQ ID NO: 2379077 - RNA, 18 nt, Bordetella pertussis
gucgagcgcgacgcgcuc

SEQ ID NO: 2379078 - RNA, 20 nt, Bordetella pertussis
gucgagcgcgacgcgcucgu

SEQ ID NO: 2379079 - RNA, 14 nt, Bordetella pertussis
gucgagcgcggcca

SEQ ID NO: 2379080 - RNA, 15 nt, Bordetella pertussis
gucgagcgcggccag

SEQ ID NO: 2379081 - RNA, 16 nt, Bordetella pertussis
gucgagcgcggccagg

SEQ ID NO: 2379082 - RNA, 15 nt, Bordetella pertussis
gucgagcgcucgcuc

SEQ ID NO: 2379083 - RNA, 12 nt, Bordetella pertussis
gucgagcgggcg

SEQ ID NO: 2379084 - RNA, 14 nt, Bordetella pertussis
gucgagcgggcgcc

SEQ ID NO: 2379085 - RNA, 15 nt, Bordetella pertussis
gucgagcgggcgcca

SEQ ID NO: 2379086 - RNA, 16 nt, Bordetella pertussis
gucgagcucgauggcu

SEQ ID NO: 2379087 - RNA, 19 nt, Bordetella pertussis
gucgagcugcucgagcaug

SEQ ID NO: 2379088 - RNA, 19 nt, Bordetella pertussis
gucgaggaucaaggcccgg

SEQ ID NO: 2379089 - RNA, 23 nt, Bordetella pertussis
gucgaggaucaugucguccucgg

SEQ ID NO: 2379090 - RNA, 16 nt, Bordetella pertussis
gucgaguucggcgcgc

SEQ ID NO: 2379091 - RNA, 20 nt, Bordetella pertussis
gucgaguucggcgcgcccgc

SEQ ID NO: 2379092 - RNA, 21 nt, Bordetella pertussis
gucgaguucgucgucgccacc

SEQ ID NO: 2379093 - RNA, 17 nt, Bordetella pertussis
gucgaguugcgcgccau

SEQ ID NO: 2379094 - RNA, 15 nt, Bordetella pertussis
gucgauaucgccauc

SEQ ID NO: 2379095 - RNA, 19 nt, Bordetella pertussis
gucgauaucgccauccagg

SEQ ID NO: 2379096 - RNA, 15 nt, Bordetella pertussis
gucgaucagccacgu

SEQ ID NO: 2379097 - RNA, 21 nt, Bordetella pertussis
gucgaucagccccugccaugc

SEQ ID NO: 2379098 - RNA, 16 nt, Bordetella pertussis
gucgaucagcgcgggc

SEQ ID NO: 2379099 - RNA, 15 nt, Bordetella pertussis
gucgaucagggcgcg

SEQ ID NO: 2379100 - RNA, 17 nt, Bordetella pertussis
gucgaucauggccagcc

SEQ ID NO: 2379101 - RNA, 20 nt, Bordetella pertussis
gucgaucauggcgccgaugg

SEQ ID NO: 2379102 - RNA, 14 nt, Bordetella pertussis
gucgaucgccacca

SEQ ID NO: 2379103 - RNA, 17 nt, Bordetella pertussis
gucgaucgccaccagcg

SEQ ID NO: 2379104 - RNA, 19 nt, Bordetella pertussis
gucgaucgccaccagcguc

SEQ ID NO: 2379105 - RNA, 21 nt, Bordetella pertussis
gucgaugaacaagguacccgc

SEQ ID NO: 2379106 - RNA, 17 nt, Bordetella pertussis
gucgaugaaggcgccga

SEQ ID NO: 2379107 - RNA, 18 nt, Bordetella pertussis
gucgaugaaggcgccgac

SEQ ID NO: 2379108 - RNA, 12 nt, Bordetella pertussis
gucgaugaaguu

SEQ ID NO: 2379109 - RNA, 20 nt, Bordetella pertussis
gucgcgaugcgucaggggca

SEQ ID NO: 2379110 - RNA, 16 nt, Bordetella pertussis
gucgcgcaacgccggg

SEQ ID NO: 2379111 - RNA, 18 nt, Bordetella pertussis
gucgcgcaacgccggguc

SEQ ID NO: 2379112 - RNA, 20 nt, Bordetella pertussis
gucgcgcaacgccgggucga

SEQ ID NO: 2379113 - RNA, 22 nt, Bordetella pertussis
gucgcgcaauacgccgccggcg

SEQ ID NO: 2379114 - RNA, 13 nt, Bordetella pertussis
gucgcgcaccagg

SEQ ID NO: 2379115 - RNA, 21 nt, Bordetella pertussis
gucgcgcaccuguucggcggc

SEQ ID NO: 2379116 - RNA, 22 nt, Bordetella pertussis
gucgcgcaccuguucggcggcg

SEQ ID NO: 2379117 - RNA, 13 nt, Bordetella pertussis
gucgcgcacgcug

SEQ ID NO: 2379118 - RNA, 14 nt, Bordetella pertussis
gucgcgcacgcugg

SEQ ID NO: 2379119 - RNA, 15 nt, Bordetella pertussis
gucgcgcacgcuggc

SEQ ID NO: 2379120 - RNA, 16 nt, Bordetella pertussis
gucgcgcacgcuggca

SEQ ID NO: 2379121 - RNA, 22 nt, Bordetella pertussis
gucgcgcagcacgauggggcca

SEQ ID NO: 2379122 - RNA, 13 nt, Bordetella pertussis
gucgcgcagcagg

SEQ ID NO: 2379123 - RNA, 14 nt, Bordetella pertussis
gucgcgcagcaggg

SEQ ID NO: 2379124 - RNA, 21 nt, Bordetella pertussis
gucgcgcagcugccugagcac

SEQ ID NO: 2379125 - RNA, 23 nt, Bordetella pertussis
gucgcgcagcugccugagcaccg

SEQ ID NO: 2379126 - RNA, 15 nt, Bordetella pertussis
gucgcgccagcggcc

SEQ ID NO: 2379127 - RNA, 19 nt, Bordetella pertussis
gucgcgccagcggccgucg

SEQ ID NO: 2379128 - RNA, 13 nt, Bordetella pertussis
gucgcgccaggcc

SEQ ID NO: 2379129 - RNA, 20 nt, Bordetella pertussis
gucgcgccaggccggcggcg

SEQ ID NO: 2379130 - RNA, 21 nt, Bordetella pertussis
gucgcgccaggccggcggcga

SEQ ID NO: 2379131 - RNA, 16 nt, Bordetella pertussis
gucgcgcccgccgugg

SEQ ID NO: 2379132 - RNA, 17 nt, Bordetella pertussis
gucgcgcccgccguggc

SEQ ID NO: 2379133 - RNA, 19 nt, Bordetella pertussis
gucgcgcccgccguggcca

SEQ ID NO: 2379134 - RNA, 12 nt, Bordetella pertussis
gucgcgccgcga

SEQ ID NO: 2379135 - RNA, 22 nt, Bordetella pertussis
gucgcgcgacuggcccaggcgg

SEQ ID NO: 2379136 - RNA, 17 nt, Bordetella pertussis
gucgcgcgcacgcgcuc

SEQ ID NO: 2379137 - RNA, 20 nt, Bordetella pertussis
gucgcgcgcaucgccgaaca

SEQ ID NO: 2379138 - RNA, 15 nt, Bordetella pertussis
gucgcgcgcgcggau

SEQ ID NO: 2379139 - RNA, 12 nt, Bordetella pertussis
gucgcgcgugca

SEQ ID NO: 2379140 - RNA, 14 nt, Bordetella pertussis
gucgcgcgugcagg

SEQ ID NO: 2379141 - RNA, 17 nt, Bordetella pertussis
gucgcgcgugcaggccg

SEQ ID NO: 2379142 - RNA, 14 nt, Bordetella pertussis
gucgcgcucgagca

SEQ ID NO: 2379143 - RNA, 22 nt, Bordetella pertussis
gucgcgcucgagcaucuggcgc

SEQ ID NO: 2379144 - RNA, 13 nt, Bordetella pertussis
gucgcgcugcaau

SEQ ID NO: 2379145 - RNA, 14 nt, Bordetella pertussis
gucgcgcuggcccc

SEQ ID NO: 2379146 - RNA, 20 nt, Bordetella pertussis
gucgcgcuggcccgcgcgag

SEQ ID NO: 2379147 - RNA, 22 nt, Bordetella pertussis
gucgcgcuggcccgcgcgagcg

SEQ ID NO: 2379148 - RNA, 20 nt, Bordetella pertussis
gucgcggaccuccugguccg

SEQ ID NO: 2379149 - RNA, 16 nt, Bordetella pertussis
gucgcggcccacggcc

SEQ ID NO: 2379150 - RNA, 14 nt, Bordetella pertussis
gucgcggcccgcca

SEQ ID NO: 2379151 - RNA, 20 nt, Bordetella pertussis
gucgcggcccgccagggcgu

SEQ ID NO: 2379152 - RNA, 18 nt, Bordetella pertussis
gucgcggccgaggccagc

SEQ ID NO: 2379153 - RNA, 23 nt, Bordetella pertussis
gucgcggccguuggcgauggcgc

SEQ ID NO: 2379154 - RNA, 13 nt, Bordetella pertussis
gucgcggcguugu

SEQ ID NO: 2379155 - RNA, 16 nt, Bordetella pertussis
gucgcggcugggcaau

SEQ ID NO: 2379156 - RNA, 22 nt, Bordetella pertussis
gucgcgggagaucuguaccgcc

SEQ ID NO: 2379157 - RNA, 21 nt, Bordetella pertussis
gucgcgggcagugcgccggac

SEQ ID NO: 2379158 - RNA, 14 nt, Bordetella pertussis
gucgcgggccaggc

SEQ ID NO: 2379159 - RNA, 17 nt, Bordetella pertussis
gucgcgggccaggccgg

SEQ ID NO: 2379160 - RNA, 18 nt, Bordetella pertussis
gucgcgggccaggccggc

SEQ ID NO: 2379161 - RNA, 19 nt, Bordetella pertussis
gucgcgggccaggccggcc

SEQ ID NO: 2379162 - RNA, 22 nt, Bordetella pertussis
gucgcgggcccgcucggccagc

SEQ ID NO: 2379163 - RNA, 23 nt, Bordetella pertussis
gucgcgggugcgggcaaacggcg

SEQ ID NO: 2379164 - RNA, 14 nt, Bordetella pertussis
gucgcggguggugg

SEQ ID NO: 2379165 - RNA, 16 nt, Bordetella pertussis
gucgcgguccagcacc

SEQ ID NO: 2379166 - RNA, 16 nt, Bordetella pertussis
gucgcguagcgcggcc

SEQ ID NO: 2379167 - RNA, 22 nt, Bordetella pertussis
gucgcguagcgcggccgggucg

SEQ ID NO: 2379168 - RNA, 19 nt, Bordetella pertussis
gucgcguccuucgucggcg

SEQ ID NO: 2379169 - RNA, 18 nt, Bordetella pertussis
gucgcucauggaggggcg

SEQ ID NO: 2379170 - RNA, 21 nt, Bordetella pertussis
gucgcucauggaggggcgcag

SEQ ID NO: 2379171 - RNA, 22 nt, Bordetella pertussis
gucgcucccccaugcggggaca

SEQ ID NO: 2379172 - RNA, 17 nt, Bordetella pertussis
gucgcucugcgcggcau

SEQ ID NO: 2379173 - RNA, 15 nt, Bordetella pertussis
gucgcugaucugcuu

SEQ ID NO: 2379174 - RNA, 14 nt, Bordetella pertussis
gucgcugccaguug

SEQ ID NO: 2379175 - RNA, 14 nt, Bordetella pertussis
gucgcugcccagca

SEQ ID NO: 2379176 - RNA, 13 nt, Bordetella pertussis
gucgcugcggccg

SEQ ID NO: 2379177 - RNA, 17 nt, Bordetella pertussis
gucgcugcucgacagca

SEQ ID NO: 2379178 - RNA, 13 nt, Bordetella pertussis
gucgcugcuggcg

SEQ ID NO: 2379179 - RNA, 15 nt, Bordetella pertussis
gucgcugcuggcggc

SEQ ID NO: 2379180 - RNA, 16 nt, Bordetella pertussis
gucgcugcuggcggcg

SEQ ID NO: 2379181 - RNA, 17 nt, Bordetella pertussis
gucgcugcuggcggcgc

SEQ ID NO: 2379182 - RNA, 18 nt, Bordetella pertussis
gucgcuggccggacgcaa

SEQ ID NO: 2379183 - RNA, 12 nt, Bordetella pertussis
gucgcuggcgcc

SEQ ID NO: 2379184 - RNA, 18 nt, Bordetella pertussis
gucgcuggcgccggugca

SEQ ID NO: 2379185 - RNA, 19 nt, Bordetella pertussis
gucgcuggcgccggugcag

SEQ ID NO: 2379186 - RNA, 13 nt, Bordetella pertussis
gucgcuggggcgc

SEQ ID NO: 2379187 - RNA, 15 nt, Bordetella pertussis
gucgcuguagcgcag

SEQ ID NO: 2379188 - RNA, 16 nt, Bordetella pertussis
gucgcugucggcgaug

SEQ ID NO: 2379189 - RNA, 15 nt, Bordetella pertussis
gucgcugugcgcggc

SEQ ID NO: 2379190 - RNA, 13 nt, Bordetella pertussis
gucgcuuccagcg

SEQ ID NO: 2379191 - RNA, 17 nt, Bordetella pertussis
gucgcuucgguggcgcg

SEQ ID NO: 2379192 - RNA, 19 nt, Bordetella pertussis
gucggaaacacguccagcg

SEQ ID NO: 2379193 - RNA, 13 nt, Bordetella pertussis
gucggacaacgcc

SEQ ID NO: 2379194 - RNA, 14 nt, Bordetella pertussis
gucggacagggccc

SEQ ID NO: 2379195 - RNA, 15 nt, Bordetella pertussis
gucggacagggcccc

SEQ ID NO: 2379196 - RNA, 18 nt, Bordetella pertussis
gucggacagggccccggc

SEQ ID NO: 2379197 - RNA, 17 nt, Bordetella pertussis
gucggacgcgccgggcg

SEQ ID NO: 2379198 - RNA, 22 nt, Bordetella pertussis
gucggacgcgccgggcgaaccg

SEQ ID NO: 2379199 - RNA, 17 nt, Bordetella pertussis
gucggacgcgcgccgca

SEQ ID NO: 2379200 - RNA, 17 nt, Bordetella pertussis
gucggagucggcgccgc

SEQ ID NO: 2379201 - RNA, 19 nt, Bordetella pertussis
gucggcaaccgucgccagc

SEQ ID NO: 2379202 - RNA, 21 nt, Bordetella pertussis
gucggcaaccgucgccagcgc

SEQ ID NO: 2379203 - RNA, 18 nt, Bordetella pertussis
gucggcaccuucgcgcag

SEQ ID NO: 2379204 - RNA, 20 nt, Bordetella pertussis
gucggcaccuucgcgcagcg

SEQ ID NO: 2379205 - RNA, 14 nt, Bordetella pertussis
gucggcacgacgcu

SEQ ID NO: 2379206 - RNA, 13 nt, Bordetella pertussis
gucggcaggugca

SEQ ID NO: 2379207 - RNA, 23 nt, Bordetella pertussis
gucggcauggccaggaagaacga

SEQ ID NO: 2379208 - RNA, 18 nt, Bordetella pertussis
gucggcauggccaucgcg

SEQ ID NO: 2379209 - RNA, 20 nt, Bordetella pertussis
gucggcauggccaucgcggu

SEQ ID NO: 2379210 - RNA, 22 nt, Bordetella pertussis
gucggcaugucgaugccguaca

SEQ ID NO: 2379211 - RNA, 16 nt, Bordetella pertussis
gucggccaaggccggc

SEQ ID NO: 2379212 - RNA, 21 nt, Bordetella pertussis
gucggccaccaccagguacac

SEQ ID NO: 2379213 - RNA, 13 nt, Bordetella pertussis
gucggccaccagg

SEQ ID NO: 2379214 - RNA, 15 nt, Bordetella pertussis
gucggccaccaggcc

SEQ ID NO: 2379215 - RNA, 16 nt, Bordetella pertussis
gucggccaccaggccg

SEQ ID NO: 2379216 - RNA, 19 nt, Bordetella pertussis
gucggccaccaggccgucg

SEQ ID NO: 2379217 - RNA, 14 nt, Bordetella pertussis
gucggccagccggc

SEQ ID NO: 2379218 - RNA, 16 nt, Bordetella pertussis
gucggccagccggccg

SEQ ID NO: 2379219 - RNA, 14 nt, Bordetella pertussis
gucggccagcgccg

SEQ ID NO: 2379220 - RNA, 13 nt, Bordetella pertussis
gucggccagcgcg

SEQ ID NO: 2379221 - RNA, 23 nt, Bordetella pertussis
gucggccagcgcgaaguaccagc

SEQ ID NO: 2379222 - RNA, 21 nt, Bordetella pertussis
gucgggcugcugcccgaagcg

SEQ ID NO: 2379223 - RNA, 17 nt, Bordetella pertussis
gucgggcuugccguuca

SEQ ID NO: 2379224 - RNA, 22 nt, Bordetella pertussis
gucgggcuugccguucaugccg

SEQ ID NO: 2379225 - RNA, 14 nt, Bordetella pertussis
gucggggcaggccu

SEQ ID NO: 2379226 - RNA, 17 nt, Bordetella pertussis
gucggggccgggccggc

SEQ ID NO: 2379227 - RNA, 14 nt, Bordetella pertussis
gucggggcgcucga

SEQ ID NO: 2379228 - RNA, 14 nt, Bordetella pertussis
gucgggggcggccg

SEQ ID NO: 2379229 - RNA, 15 nt, Bordetella pertussis
gucggggucggccac

SEQ ID NO: 2379230 - RNA, 23 nt, Bordetella pertussis
gucgggguggucuuccaggcgca

SEQ ID NO: 2379231 - RNA, 15 nt, Bordetella pertussis
gucggguagcugcug

SEQ ID NO: 2379232 - RNA, 16 nt, Bordetella pertussis
gucggguccagcacgc

SEQ ID NO: 2379233 - RNA, 21 nt, Bordetella pertussis
gucggguccagcacgccuugc

SEQ ID NO: 2379234 - RNA, 21 nt, Bordetella pertussis
gucggguugcccugcgcaucg

SEQ ID NO: 2379235 - RNA, 16 nt, Bordetella pertussis
gucggguugccgcugc

SEQ ID NO: 2379236 - RNA, 14 nt, Bordetella pertussis
gucggucagccuga

SEQ ID NO: 2379237 - RNA, 15 nt, Bordetella pertussis
gucggucaucacgcg

SEQ ID NO: 2379238 - RNA, 19 nt, Bordetella pertussis
gucggucaugcccaugccg

SEQ ID NO: 2379239 - RNA, 15 nt, Bordetella pertussis
gucggucgccuguau

SEQ ID NO: 2379240 - RNA, 22 nt, Bordetella pertussis
gucggucgccuguaucagcgcc

SEQ ID NO: 2379241 - RNA, 19 nt, Bordetella pertussis
gucggucgcuuccagcgca

SEQ ID NO: 2379242 - RNA, 17 nt, Bordetella pertussis
gucggugaaggccacgc

SEQ ID NO: 2379243 - RNA, 15 nt, Bordetella pertussis
gucggugcacacgcc

SEQ ID NO: 2379244 - RNA, 19 nt, Bordetella pertussis
gucggugcacacgccuucg

SEQ ID NO: 2379245 - RNA, 14 nt, Bordetella pertussis
gucggugccgccga

SEQ ID NO: 2379246 - RNA, 16 nt, Bordetella pertussis
gucggugccgccgagc

SEQ ID NO: 2379247 - RNA, 14 nt, Bordetella pertussis
gucgguggugacca

SEQ ID NO: 2379248 - RNA, 15 nt, Bordetella pertussis
gucgguugcaguccu

SEQ ID NO: 2379249 - RNA, 13 nt, Bordetella pertussis
gucguacagcgcc

SEQ ID NO: 2379250 - RNA, 17 nt, Bordetella pertussis
gucguagaacacgucga

SEQ ID NO: 2379251 - RNA, 20 nt, Bordetella pertussis
gucguagaacacgucgauca

SEQ ID NO: 2379252 - RNA, 17 nt, Bordetella pertussis
gucguagcccucgccca

SEQ ID NO: 2379253 - RNA, 19 nt, Bordetella pertussis
gucguagcccucgcccagg

SEQ ID NO: 2379254 - RNA, 15 nt, Bordetella pertussis
gucguagcgccagcg

SEQ ID NO: 2379255 - RNA, 19 nt, Bordetella pertussis
gucguagcggaugaagggc

SEQ ID NO: 2379256 - RNA, 16 nt, Bordetella pertussis
gucguagugcgcgccg

SEQ ID NO: 2379257 - RNA, 18 nt, Bordetella pertussis
gucgucagcgccgcgaug

SEQ ID NO: 2379258 - RNA, 15 nt, Bordetella pertussis
gucgucaucgccauc

SEQ ID NO: 2379259 - RNA, 20 nt, Bordetella pertussis
gucgucaugauguagcccau

SEQ ID NO: 2379260 - RNA, 17 nt, Bordetella pertussis
gucguccaauucgagca

SEQ ID NO: 2379261 - RNA, 19 nt, Bordetella pertussis
gucguccaauucgagcagg

SEQ ID NO: 2379262 - RNA, 21 nt, Bordetella pertussis
gucguccaauucgagcaggcg

SEQ ID NO: 2379263 - RNA, 19 nt, Bordetella pertussis
gucguccacgcccggugcc

SEQ ID NO: 2379264 - RNA, 17 nt, Bordetella pertussis
gucguccagcgucaugc

SEQ ID NO: 2379265 - RNA, 21 nt, Bordetella pertussis
gucguccagcgucaugcgcac

SEQ ID NO: 2379266 - RNA, 13 nt, Bordetella pertussis
gucguccagcuug

SEQ ID NO: 2379267 - RNA, 14 nt, Bordetella pertussis
gucgucccagcgca

SEQ ID NO: 2379268 - RNA, 15 nt, Bordetella pertussis
gucguccguccuggc

SEQ ID NO: 2379269 - RNA, 16 nt, Bordetella pertussis
gucguccguggccggc

SEQ ID NO: 2379270 - RNA, 16 nt, Bordetella pertussis
gucguccucgaugacg

SEQ ID NO: 2379271 - RNA, 20 nt, Bordetella pertussis
gucguccucggcacggccag

SEQ ID NO: 2379272 - RNA, 17 nt, Bordetella pertussis
gucguccucggccacgu

SEQ ID NO: 2379273 - RNA, 20 nt, Bordetella pertussis
gucguccucggccacgucgg

SEQ ID NO: 2379274 - RNA, 23 nt, Bordetella pertussis
gucguccucggccacgucggcgg

SEQ ID NO: 2379275 - RNA, 16 nt, Bordetella pertussis
gucgucgaaggcgcgc

SEQ ID NO: 2379276 - RNA, 13 nt, Bordetella pertussis
gucgucgaugccg

SEQ ID NO: 2379277 - RNA, 20 nt, Bordetella pertussis
gucgucgaugccgaccaggc

SEQ ID NO: 2379278 - RNA, 21 nt, Bordetella pertussis
gucgucgaugccgaccaggcu

SEQ ID NO: 2379279 - RNA, 17 nt, Bordetella pertussis
gucgucgauggcccgca

SEQ ID NO: 2379280 - RNA, 21 nt, Bordetella pertussis
gucgucgcgcgagaauggcgc

SEQ ID NO: 2379281 - RNA, 11 nt, Bordetella pertussis
gucgucgcgcu

SEQ ID NO: 2379282 - RNA, 14 nt, Bordetella pertussis
gucgucgcgcuggc

SEQ ID NO: 2379283 - RNA, 18 nt, Bordetella pertussis
gucgucgcgcuggcccca

SEQ ID NO: 2379284 - RNA, 16 nt, Bordetella pertussis
gucgucgcgguccagc

SEQ ID NO: 2379285 - RNA, 17 nt, Bordetella pertussis
gucgucgcgguccagca

SEQ ID NO: 2379286 - RNA, 14 nt, Bordetella pertussis
gucgucgcuggccc

SEQ ID NO: 2379287 - RNA, 23 nt, Bordetella pertussis
gucgucggcaccuucgcgcagcg

SEQ ID NO: 2379288 - RNA, 15 nt, Bordetella pertussis
gucgucggccacgcc

SEQ ID NO: 2379289 - RNA, 20 nt, Bordetella pertussis
gucgucggcgcugcagcgca

SEQ ID NO: 2379290 - RNA, 15 nt, Bordetella pertussis
gucgucgggaccggc

SEQ ID NO: 2379291 - RNA, 16 nt, Bordetella pertussis
gucgucgggaccggcg

SEQ ID NO: 2379292 - RNA, 21 nt, Bordetella pertussis
gucgucgggcggcgcgaacgg

SEQ ID NO: 2379293 - RNA, 17 nt, Bordetella pertussis
gucgucguccacgcccg

SEQ ID NO: 2379294 - RNA, 15 nt, Bordetella pertussis
gucgugaucgccagc

SEQ ID NO: 2379295 - RNA, 16 nt, Bordetella pertussis
gucgugaucgccagcg

SEQ ID NO: 2379296 - RNA, 20 nt, Bordetella pertussis
gucgugaucgccagcgccgg

SEQ ID NO: 2379297 - RNA, 14 nt, Bordetella pertussis
gucgugcagcgugg

SEQ ID NO: 2379298 - RNA, 15 nt, Bordetella pertussis
gucgugcccgccacc

SEQ ID NO: 2379299 - RNA, 17 nt, Bordetella pertussis
gucgugcccgccaccca

SEQ ID NO: 2379300 - RNA, 19 nt, Bordetella pertussis
gucgugcccucgggaaaca

SEQ ID NO: 2379301 - RNA, 13 nt, Bordetella pertussis
gucgugcggcacg

SEQ ID NO: 2379302 - RNA, 18 nt, Bordetella pertussis
gucgugcggcacgcacag

SEQ ID NO: 2379303 - RNA, 13 nt, Bordetella pertussis
gucgugcuggcgc

SEQ ID NO: 2379304 - RNA, 14 nt, Bordetella pertussis
gucgugcuggcgcg

SEQ ID NO: 2379305 - RNA, 14 nt, Bordetella pertussis
gucgugcuggcuga

SEQ ID NO: 2379306 - RNA, 16 nt, Bordetella pertussis
gucguggcccagccgg

SEQ ID NO: 2379307 - RNA, 16 nt, Bordetella pertussis
gucguggggcgcggcg

SEQ ID NO: 2379308 - RNA, 22 nt, Bordetella pertussis
gucguggucgacauagacgcgc

SEQ ID NO: 2379309 - RNA, 20 nt, Bordetella pertussis
gucguucgaacugguacagc

SEQ ID NO: 2379310 - RNA, 20 nt, Bordetella pertussis
gucguucugcguggcggcgu

SEQ ID NO: 2379311 - RNA, 18 nt, Bordetella pertussis
gucguucugggagcgcgg

SEQ ID NO: 2379312 - RNA, 20 nt, Bordetella pertussis
gucguucugggagcgcgggc

SEQ ID NO: 2379313 - RNA, 14 nt, Bordetella pertussis
gucguugacgggga

SEQ ID NO: 2379314 - RNA, 19 nt, Bordetella pertussis
gucguugauggggccgcgc

SEQ ID NO: 2379315 - RNA, 16 nt, Bordetella pertussis
gucguugccggccagc

SEQ ID NO: 2379316 - RNA, 20 nt, Bordetella pertussis
gucguuguggcaggcgucgg

SEQ ID NO: 2379317 - RNA, 12 nt, Bordetella pertussis
gucguuucccag

SEQ ID NO: 2379318 - RNA, 20 nt, Bordetella pertussis
gucuacaggcccagcgccag

SEQ ID NO: 2379319 - RNA, 23 nt, Bordetella pertussis
gucuacaggcccagcgccagcag

SEQ ID NO: 2379320 - RNA, 16 nt, Bordetella pertussis
gucuauggccugcagg

SEQ ID NO: 2379321 - RNA, 17 nt, Bordetella pertussis
gucuauggccugcagga

SEQ ID NO: 2379322 - RNA, 17 nt, Bordetella pertussis
gucuauuuccgacgaga

SEQ ID NO: 2379323 - RNA, 14 nt, Bordetella pertussis
gucuccacgccgcc

SEQ ID NO: 2379324 - RNA, 12 nt, Bordetella pertussis
gucuccagcgcg

SEQ ID NO: 2379325 - RNA, 18 nt, Bordetella pertussis
gucuccagcgcggcggac

SEQ ID NO: 2379326 - RNA, 18 nt, Bordetella pertussis
gucuccagcgcgucggcc

SEQ ID NO: 2379327 - RNA, 21 nt, Bordetella pertussis
gucuccagcgcgucggccagg

SEQ ID NO: 2379328 - RNA, 22 nt, Bordetella pertussis
gucuccagcgcgucggccaggc

SEQ ID NO: 2379329 - RNA, 15 nt, Bordetella pertussis
gucucccccucggcc

SEQ ID NO: 2379330 - RNA, 16 nt, Bordetella pertussis
gucucccccucggccu

SEQ ID NO: 2379331 - RNA, 22 nt, Bordetella pertussis
gucucccccucggccugcgcga

SEQ ID NO: 2379332 - RNA, 19 nt, Bordetella pertussis
gucucgaacgccgcgucgc

SEQ ID NO: 2379333 - RNA, 21 nt, Bordetella pertussis
gucucgcccacccccggcacc

SEQ ID NO: 2379334 - RNA, 21 nt, Bordetella pertussis
gucucgcccaggcccagcauc

SEQ ID NO: 2379335 - RNA, 11 nt, Bordetella pertussis
gugagcgccac

SEQ ID NO: 2379336 - RNA, 12 nt, Bordetella pertussis
gugagcgccacc

SEQ ID NO: 2379337 - RNA, 17 nt, Bordetella pertussis
gugaggcccagccgcuc

SEQ ID NO: 2379338 - RNA, 16 nt, Bordetella pertussis
gugaggggccagccug

SEQ ID NO: 2379339 - RNA, 15 nt, Bordetella pertussis
gugauagacauugcc

SEQ ID NO: 2379340 - RNA, 22 nt, Bordetella pertussis
gugauagacauugcccagcacc

SEQ ID NO: 2379341 - RNA, 20 nt, Bordetella pertussis
gugauagcacugcaccugcu

SEQ ID NO: 2379342 - RNA, 23 nt, Bordetella pertussis
gugauagcacugcaccugcucca

SEQ ID NO: 2379343 - RNA, 19 nt, Bordetella pertussis
gugauauagaccagcagcu

SEQ ID NO: 2379344 - RNA, 17 nt, Bordetella pertussis
gugauaugcgccaggcc

SEQ ID NO: 2379345 - RNA, 18 nt, Bordetella pertussis
gugaucaccgccauggcg

SEQ ID NO: 2379346 - RNA, 16 nt, Bordetella pertussis
gugaucaucgugccgg

SEQ ID NO: 2379347 - RNA, 16 nt, Bordetella pertussis
gugaucaugccgcuga

SEQ ID NO: 2379348 - RNA, 16 nt, Bordetella pertussis
gugauccacugcagca

SEQ ID NO: 2379349 - RNA, 17 nt, Bordetella pertussis
gugaucgacaacaagcc

SEQ ID NO: 2379350 - RNA, 21 nt, Bordetella pertussis
gugaucgacaacaagccgggc

SEQ ID NO: 2379351 - RNA, 22 nt, Bordetella pertussis
gugaucgacaacaagccgggcg

SEQ ID NO: 2379352 - RNA, 18 nt, Bordetella pertussis
gugaucgaccgccagcag

SEQ ID NO: 2379353 - RNA, 15 nt, Bordetella pertussis
gugaucgccagcgcc

SEQ ID NO: 2379354 - RNA, 18 nt, Bordetella pertussis
gugaucgccagcgccggg

SEQ ID NO: 2379355 - RNA, 20 nt, Bordetella pertussis
gugaucgccagcgccggggu

SEQ ID NO: 2379356 - RNA, 20 nt, Bordetella pertussis
gugaucgguaaugagcccga

SEQ ID NO: 2379357 - RNA, 22 nt, Bordetella pertussis
gugaucugcucgccgcgcgaca

SEQ ID NO: 2379358 - RNA, 17 nt, Bordetella pertussis
gugaucugguccacggc

SEQ ID NO: 2379359 - RNA, 22 nt, Bordetella pertussis
gugaucugguccacggcggcgg

SEQ ID NO: 2379360 - RNA, 19 nt, Bordetella pertussis
gugaucuugaugccgccca

SEQ ID NO: 2379361 - RNA, 23 nt, Bordetella pertussis
gugaucuugccgaugcggcgcau

SEQ ID NO: 2379362 - RNA, 16 nt, Bordetella pertussis
gugaugauccugcugg

SEQ ID NO: 2379363 - RNA, 22 nt, Bordetella pertussis
gugaugcaggcggucgaggcgc

SEQ ID NO: 2379364 - RNA, 16 nt, Bordetella pertussis
gugaugcccaggcccu

SEQ ID NO: 2379365 - RNA, 23 nt, Bordetella pertussis
gugaugcccaggcccuggcuggc

SEQ ID NO: 2379366 - RNA, 17 nt, Bordetella pertussis
gugaugccccagguccg

SEQ ID NO: 2379367 - RNA, 21 nt, Bordetella pertussis
gugaugccccagguccgccgg

SEQ ID NO: 2379368 - RNA, 19 nt, Bordetella pertussis
gugaugcccgaggcggcgc

SEQ ID NO: 2379369 - RNA, 13 nt, Bordetella pertussis
gugaugccgacca

SEQ ID NO: 2379370 - RNA, 17 nt, Bordetella pertussis
gugaugccgucgagcgc

SEQ ID NO: 2379371 - RNA, 21 nt, Bordetella pertussis
gugaugccgucgagcgcggcc

SEQ ID NO: 2379372 - RNA, 13 nt, Bordetella pertussis
gugaugcgcgcgg

SEQ ID NO: 2379373 - RNA, 14 nt, Bordetella pertussis
gugaugcggcgcgc

SEQ ID NO: 2379374 - RNA, 16 nt, Bordetella pertussis
gugaugcggcgcgccg

SEQ ID NO: 2379375 - RNA, 15 nt, Bordetella pertussis
gugaugcugcagcgc

SEQ ID NO: 2379376 - RNA, 14 nt, Bordetella pertussis
gugauggcguagcc

SEQ ID NO: 2379377 - RNA, 16 nt, Bordetella pertussis
gugauguccugcaggc

SEQ ID NO: 2379378 - RNA, 17 nt, Bordetella pertussis
gugauguccugcaggcc

SEQ ID NO: 2379379 - RNA, 22 nt, Bordetella pertussis
gugauuguccugcacgaagcgg

SEQ ID NO: 2379380 - RNA, 16 nt, Bordetella pertussis
gugcaagcggccggcc

SEQ ID NO: 2379381 - RNA, 19 nt, Bordetella pertussis
gugcaagcggccggccugc

SEQ ID NO: 2379382 - RNA, 12 nt, Bordetella pertussis
gugcaccagccc

SEQ ID NO: 2379383 - RNA, 13 nt, Bordetella pertussis
gugcaccagcccg

SEQ ID NO: 2379384 - RNA, 14 nt, Bordetella pertussis
gugcaccaggccac

SEQ ID NO: 2379385 - RNA, 13 nt, Bordetella pertussis
gugcaccaggugg

SEQ ID NO: 2379386 - RNA, 13 nt, Bordetella pertussis
gugcacgaugccc

SEQ ID NO: 2379387 - RNA, 20 nt, Bordetella pertussis
gugcacgcccgcggcgccca

SEQ ID NO: 2379388 - RNA, 22 nt, Bordetella pertussis
gugcacgcccgcggcgcccagc

SEQ ID NO: 2379389 - RNA, 23 nt, Bordetella pertussis
gugcacgguggauucggacgccu

SEQ ID NO: 2379390 - RNA, 22 nt, Bordetella pertussis
gugcacgugggcacgccggccu

SEQ ID NO: 2379391 - RNA, 16 nt, Bordetella pertussis
gugcagacggcggcug

SEQ ID NO: 2379392 - RNA, 17 nt, Bordetella pertussis
gugcagacggcggcugg

SEQ ID NO: 2379393 - RNA, 18 nt, Bordetella pertussis
gugcagacggcggcugga

SEQ ID NO: 2379394 - RNA, 16 nt, Bordetella pertussis
gugcagcaagcccacc

SEQ ID NO: 2379395 - RNA, 17 nt, Bordetella pertussis
gugcagcaggggcugcc

SEQ ID NO: 2379396 - RNA, 17 nt, Bordetella pertussis
gugcagccagcggccga

SEQ ID NO: 2379397 - RNA, 20 nt, Bordetella pertussis
gugcagccauucggccaggu

SEQ ID NO: 2379398 - RNA, 22 nt, Bordetella pertussis
gugcagcccagcaccacggcau

SEQ ID NO: 2379399 - RNA, 17 nt, Bordetella pertussis
gugcagccgccgcaggc

SEQ ID NO: 2379400 - RNA, 13 nt, Bordetella pertussis
gugcagcgcacgg

SEQ ID NO: 2379401 - RNA, 20 nt, Bordetella pertussis
gugcagcgcacgguccaggc

SEQ ID NO: 2379402 - RNA, 13 nt, Bordetella pertussis
gugcagcgccgcg

SEQ ID NO: 2379403 - RNA, 18 nt, Bordetella pertussis
gugcagcgccgcgcgcuc

SEQ ID NO: 2379404 - RNA, 13 nt, Bordetella pertussis
gugcagcgcgugg

SEQ ID NO: 2379405 - RNA, 19 nt, Bordetella pertussis
gugcagcgcgugggccagu

SEQ ID NO: 2379406 - RNA, 12 nt, Bordetella pertussis
gugcagcggcag

SEQ ID NO: 2379407 - RNA, 13 nt, Bordetella pertussis
gugcagcggcagc

SEQ ID NO: 2379408 - RNA, 13 nt, Bordetella pertussis
gugcagcggcucg

SEQ ID NO: 2379409 - RNA, 21 nt, Bordetella pertussis
gugcaggaccuuguugugcuu

SEQ ID NO: 2379410 - RNA, 16 nt, Bordetella pertussis
gugcaggacgaacagg

SEQ ID NO: 2379411 - RNA, 18 nt, Bordetella pertussis
gugcaggacgaacaggcc

SEQ ID NO: 2379412 - RNA, 22 nt, Bordetella pertussis
gugcaggccaccgacggcgcgg

SEQ ID NO: 2379413 - RNA, 19 nt, Bordetella pertussis
gugcaggcccgggcgccug

SEQ ID NO: 2379414 - RNA, 14 nt, Bordetella pertussis
gugcaggccgagga

SEQ ID NO: 2379415 - RNA, 19 nt, Bordetella pertussis
gugcaggccgcgcagcacg

SEQ ID NO: 2379416 - RNA, 22 nt, Bordetella pertussis
gugcaggccgcgcagcacgccc

SEQ ID NO: 2379417 - RNA, 16 nt, Bordetella pertussis
gugcaggggccgcacg

SEQ ID NO: 2379418 - RNA, 20 nt, Bordetella pertussis
gugcaggggguggcggccgu

SEQ ID NO: 2379419 - RNA, 23 nt, Bordetella pertussis
gugcaggggguggcggccgucgg

SEQ ID NO: 2379420 - RNA, 14 nt, Bordetella pertussis
gugcaggguuggcg

SEQ ID NO: 2379421 - RNA, 20 nt, Bordetella pertussis
gugcaucaucugggcgucga

SEQ ID NO: 2379422 - RNA, 20 nt, Bordetella pertussis
gugcaucccaauuggccgcc

SEQ ID NO: 2379423 - RNA, 21 nt, Bordetella pertussis
gugcaucccaauuggccgccc

SEQ ID NO: 2379424 - RNA, 13 nt, Bordetella pertussis
gugcaucgugaca

SEQ ID NO: 2379425 - RNA, 13 nt, Bordetella pertussis
gugcaugcgcgcc

SEQ ID NO: 2379426 - RNA, 14 nt, Bordetella pertussis
gugcaugcgcgcca

SEQ ID NO: 2379427 - RNA, 15 nt, Bordetella pertussis
gugccaccgcccagg

SEQ ID NO: 2379428 - RNA, 16 nt, Bordetella pertussis
gugccaccgcccaggc

SEQ ID NO: 2379429 - RNA, 19 nt, Bordetella pertussis
gugccaccgcccaggcgca

SEQ ID NO: 2379430 - RNA, 21 nt, Bordetella pertussis
gugccagauauccuugaggau

SEQ ID NO: 2379431 - RNA, 13 nt, Bordetella pertussis
gugccagcccccu

SEQ ID NO: 2379432 - RNA, 16 nt, Bordetella pertussis
gugccagcccccugcg

SEQ ID NO: 2379433 - RNA, 14 nt, Bordetella pertussis
gugccagccgcugg

SEQ ID NO: 2379434 - RNA, 12 nt, Bordetella pertussis
gugccagcuggc

SEQ ID NO: 2379435 - RNA, 16 nt, Bordetella pertussis
gugccagcuggcccag

SEQ ID NO: 2379436 - RNA, 22 nt, Bordetella pertussis
gugccaguccccauguggggac

SEQ ID NO: 2379437 - RNA, 17 nt, Bordetella pertussis
gugccagucccccgcgg

SEQ ID NO: 2379438 - RNA, 21 nt, Bordetella pertussis
gugccagucccccgcggggac

SEQ ID NO: 2379439 - RNA, 23 nt, Bordetella pertussis
gugccagucccccgcggggacag

SEQ ID NO: 2379440 - RNA, 21 nt, Bordetella pertussis
gugccaguccccugcggggac

SEQ ID NO: 2379441 - RNA, 23 nt, Bordetella pertussis
gugccaguccccugcggggacag

SEQ ID NO: 2379442 - RNA, 24 nt, Bordetella pertussis
gugccauacagcaaggacaaggcg

SEQ ID NO: 2379443 - RNA, 20 nt, Bordetella pertussis
gugccaucgauaugggcggc

SEQ ID NO: 2379444 - RNA, 15 nt, Bordetella pertussis
gugccauggacgccg

SEQ ID NO: 2379445 - RNA, 16 nt, Bordetella pertussis
gugcccagcaccaggc

SEQ ID NO: 2379446 - RNA, 18 nt, Bordetella pertussis
gugcccagcaccaggccg

SEQ ID NO: 2379447 - RNA, 22 nt, Bordetella pertussis
gugcccagcaccaggccgaacu

SEQ ID NO: 2379448 - RNA, 16 nt, Bordetella pertussis
gugccuguucccgccg

SEQ ID NO: 2379449 - RNA, 13 nt, Bordetella pertussis
gugccuugcggcg

SEQ ID NO: 2379450 - RNA, 17 nt, Bordetella pertussis
gugcgacggaugggcgc

SEQ ID NO: 2379451 - RNA, 19 nt, Bordetella pertussis
gugcgacggaugggcgccg

SEQ ID NO: 2379452 - RNA, 22 nt, Bordetella pertussis
gugcgagcagaugcaccggcca

SEQ ID NO: 2379453 - RNA, 14 nt, Bordetella pertussis
gugcgaggccacgg

SEQ ID NO: 2379454 - RNA, 16 nt, Bordetella pertussis
gugcgaggccacggca

SEQ ID NO: 2379455 - RNA, 17 nt, Bordetella pertussis
gugcgaggccacggcaa

SEQ ID NO: 2379456 - RNA, 20 nt, Bordetella pertussis
gugcgaggcgaacaggcaca

SEQ ID NO: 2379457 - RNA, 21 nt, Bordetella pertussis
gugcgaggcgaacaggcacag

SEQ ID NO: 2379458 - RNA, 18 nt, Bordetella pertussis
gugcgagggcucgaccgc

SEQ ID NO: 2379459 - RNA, 22 nt, Bordetella pertussis
gugcgagggcucgaccgccgcc

SEQ ID NO: 2379460 - RNA, 15 nt, Bordetella pertussis
gugcgauagcgccgc

SEQ ID NO: 2379461 - RNA, 13 nt, Bordetella pertussis
gugcgauggaacu

SEQ ID NO: 2379462 - RNA, 15 nt, Bordetella pertussis
gugcgauggcacggc

SEQ ID NO: 2379463 - RNA, 16 nt, Bordetella pertussis
gugcgauggcacggca

SEQ ID NO: 2379464 - RNA, 15 nt, Bordetella pertussis
gugcgcacaucgccc

SEQ ID NO: 2379465 - RNA, 12 nt, Bordetella pertussis
gugcgcaccagg

SEQ ID NO: 2379466 - RNA, 15 nt, Bordetella pertussis
gugcgcaccaggccc

SEQ ID NO: 2379467 - RNA, 16 nt, Bordetella pertussis
gugcgcaccaggccca

SEQ ID NO: 2379468 - RNA, 16 nt, Bordetella pertussis
gugcgcacgauggggc

SEQ ID NO: 2379469 - RNA, 22 nt, Bordetella pertussis
gugcgcacgcguucgggcggca

SEQ ID NO: 2379470 - RNA, 23 nt, Bordetella pertussis
gugcgcagcagguggaucgacga

SEQ ID NO: 2379471 - RNA, 14 nt, Bordetella pertussis
gugcgcagccgggc

SEQ ID NO: 2379472 - RNA, 21 nt, Bordetella pertussis
gugcgcagccgggcugccggc

SEQ ID NO: 2379473 - RNA, 16 nt, Bordetella pertussis
gugcgcagcggcaggc

SEQ ID NO: 2379474 - RNA, 24 nt, Bordetella pertussis
gugcgcagcggcaggcggcugacg

SEQ ID NO: 2379475 - RNA, 15 nt, Bordetella pertussis
gugcgcaucagcgca

SEQ ID NO: 2379476 - RNA, 16 nt, Bordetella pertussis
gugcgcaucagcgcau

SEQ ID NO: 2379477 - RNA, 16 nt, Bordetella pertussis
gugcgccacuucgccu

SEQ ID NO: 2379478 - RNA, 13 nt, Bordetella pertussis
gugcgccagcgcg

SEQ ID NO: 2379479 - RNA, 19 nt, Bordetella pertussis
gugcgccgcaugcggcggc

SEQ ID NO: 2379480 - RNA, 20 nt, Bordetella pertussis
gugcgccgccgccgcggccu

SEQ ID NO: 2379481 - RNA, 17 nt, Bordetella pertussis
gugcgccgccggccugc

SEQ ID NO: 2379482 - RNA, 15 nt, Bordetella pertussis
gugcgccgugcccgg

SEQ ID NO: 2379483 - RNA, 17 nt, Bordetella pertussis
gugcgccgugcccggcg

SEQ ID NO: 2379484 - RNA, 21 nt, Bordetella pertussis
gugcgccgugcccggcgggcc

SEQ ID NO: 2379485 - RNA, 22 nt, Bordetella pertussis
gugcgccgugcccggcgggccg

SEQ ID NO: 2379486 - RNA, 20 nt, Bordetella pertussis
gugcgccugacccagucgca

SEQ ID NO: 2379487 - RNA, 14 nt, Bordetella pertussis
gugcgccugcagcg

SEQ ID NO: 2379488 - RNA, 18 nt, Bordetella pertussis
gugcgccugcagcgccgc

SEQ ID NO: 2379489 - RNA, 15 nt, Bordetella pertussis
gugcgccuguccccg

SEQ ID NO: 2379490 - RNA, 17 nt, Bordetella pertussis
gugcgcgaccuccggca

SEQ ID NO: 2379491 - RNA, 20 nt, Bordetella pertussis
gugcgcgcagggcggccggc

SEQ ID NO: 2379492 - RNA, 22 nt, Bordetella pertussis
gugcgcgcagggcggccggcac

SEQ ID NO: 2379493 - RNA, 14 nt, Bordetella pertussis
gugcgcgccaaaag

SEQ ID NO: 2379494 - RNA, 22 nt, Bordetella pertussis
gugcgcgccaaaaggcagcagg

SEQ ID NO: 2379495 - RNA, 18 nt, Bordetella pertussis
gugcgcgccacggcgucg

SEQ ID NO: 2379496 - RNA, 15 nt, Bordetella pertussis
gugcgcgcgccccca

SEQ ID NO: 2379497 - RNA, 22 nt, Bordetella pertussis
gugcgcgcgcccccagcgccgu

SEQ ID NO: 2379498 - RNA, 13 nt, Bordetella pertussis
gugcgcgcggccg

SEQ ID NO: 2379499 - RNA, 13 nt, Bordetella pertussis
gugcgcggcgcgc

SEQ ID NO: 2379500 - RNA, 13 nt, Bordetella pertussis
gugcgcgggcgcg

SEQ ID NO: 2379501 - RNA, 21 nt, Bordetella pertussis
gugcgcgugggcacccggccg

SEQ ID NO: 2379502 - RNA, 20 nt, Bordetella pertussis
gugcgcguuccggccgcgcc

SEQ ID NO: 2379503 - RNA, 15 nt, Bordetella pertussis
gugcgcuggcugggc

SEQ ID NO: 2379504 - RNA, 16 nt, Bordetella pertussis
gugcgcuggcugggcc

SEQ ID NO: 2379505 - RNA, 16 nt, Bordetella pertussis
gugcggaugcagcagc

SEQ ID NO: 2379506 - RNA, 20 nt, Bordetella pertussis
gugcggcagggccuccugca

SEQ ID NO: 2379507 - RNA, 21 nt, Bordetella pertussis
gugcggcccagccgcucggcc

SEQ ID NO: 2379508 - RNA, 14 nt, Bordetella pertussis
gugcggccgcagca

SEQ ID NO: 2379509 - RNA, 16 nt, Bordetella pertussis
gugcggccgcagcagu

SEQ ID NO: 2379510 - RNA, 15 nt, Bordetella pertussis
gugcggccgcagcgg

SEQ ID NO: 2379511 - RNA, 18 nt, Bordetella pertussis
gugcggccgcagcggacg

SEQ ID NO: 2379512 - RNA, 12 nt, Bordetella pertussis
gugcggcgccac

SEQ ID NO: 2379513 - RNA, 22 nt, Bordetella pertussis
gugcggcgccacugccaggcgc

SEQ ID NO: 2379514 - RNA, 23 nt, Bordetella pertussis
gugcggcgccacugccaggcgcc

SEQ ID NO: 2379515 - RNA, 12 nt, Bordetella pertussis
gugcggcgccug

SEQ ID NO: 2379516 - RNA, 21 nt, Bordetella pertussis
gugcggcgccugcgucguugc

SEQ ID NO: 2379517 - RNA, 13 nt, Bordetella pertussis
gugcggcggcgac

SEQ ID NO: 2379518 - RNA, 14 nt, Bordetella pertussis
gugcggcggcgacu

SEQ ID NO: 2379519 - RNA, 15 nt, Bordetella pertussis
gugcggcguggcggg

SEQ ID NO: 2379520 - RNA, 17 nt, Bordetella pertussis
gugcggcguggcggggc

SEQ ID NO: 2379521 - RNA, 18 nt, Bordetella pertussis
gugcggcuguugggcaag

SEQ ID NO: 2379522 - RNA, 17 nt, Bordetella pertussis
gugcgggacggccaggg

SEQ ID NO: 2379523 - RNA, 20 nt, Bordetella pertussis
gugcgggacggccaggggca

SEQ ID NO: 2379524 - RNA, 16 nt, Bordetella pertussis
gugcgggagccggcaa

SEQ ID NO: 2379525 - RNA, 20 nt, Bordetella pertussis
gugcgggcaaacggcggcag

SEQ ID NO: 2379526 - RNA, 12 nt, Bordetella pertussis
gugcgggccugc

SEQ ID NO: 2379527 - RNA, 15 nt, Bordetella pertussis
gugcgggccugcagu

SEQ ID NO: 2379528 - RNA, 17 nt, Bordetella pertussis
gugcggggaccggcacc

SEQ ID NO: 2379529 - RNA, 13 nt, Bordetella pertussis
gugcggggcggca

SEQ ID NO: 2379530 - RNA, 14 nt, Bordetella pertussis
gugcguaccagccc

SEQ ID NO: 2379531 - RNA, 15 nt, Bordetella pertussis
gugcguaccagccca

SEQ ID NO: 2379532 - RNA, 22 nt, Bordetella pertussis
gugcgucacgcacagcaccugg

SEQ ID NO: 2379533 - RNA, 15 nt, Bordetella pertussis
gugcguccaggacgc

SEQ ID NO: 2379534 - RNA, 16 nt, Bordetella pertussis
gugcguccaggacgcg

SEQ ID NO: 2379535 - RNA, 13 nt, Bordetella pertussis
gugcgugcgccug

SEQ ID NO: 2379536 - RNA, 15 nt, Bordetella pertussis
gugcgugcgccuguc

SEQ ID NO: 2379537 - RNA, 23 nt, Bordetella pertussis
gugcguggucgcgggugguggcc

SEQ ID NO: 2379538 - RNA, 13 nt, Bordetella pertussis
gugcgugugccug

SEQ ID NO: 2379539 - RNA, 22 nt, Bordetella pertussis
gugcguuccaugacguccagcg

SEQ ID NO: 2379540 - RNA, 16 nt, Bordetella pertussis
gugcguugccagccca

SEQ ID NO: 2379541 - RNA, 18 nt, Bordetella pertussis
gugcguuggcgcggcgca

SEQ ID NO: 2379542 - RNA, 22 nt, Bordetella pertussis
gugcuauagucucgcuucuucg

SEQ ID NO: 2379543 - RNA, 20 nt, Bordetella pertussis
gugcucaaccucgacgcgca

SEQ ID NO: 2379544 - RNA, 14 nt, Bordetella pertussis
gugcucaucggcag

SEQ ID NO: 2379545 - RNA, 20 nt, Bordetella pertussis
gugcucaucggcaggccggc

SEQ ID NO: 2379546 - RNA, 14 nt, Bordetella pertussis
gugcuccaccacca

SEQ ID NO: 2379547 - RNA, 16 nt, Bordetella pertussis
gugcuccugccaggcg

SEQ ID NO: 2379548 - RNA, 18 nt, Bordetella pertussis
gugcucgaggugcacgug

SEQ ID NO: 2379549 - RNA, 13 nt, Bordetella pertussis
gugcucgugcugg

SEQ ID NO: 2379550 - RNA, 14 nt, Bordetella pertussis
gugcucgugcuggg

SEQ ID NO: 2379551 - RNA, 22 nt, Bordetella pertussis
gugcugaacgccucgggcuuga

SEQ ID NO: 2379552 - RNA, 20 nt, Bordetella pertussis
gugcugacggugccggccag

SEQ ID NO: 2379553 - RNA, 21 nt, Bordetella pertussis
gugcugaucgaucgcccgcuc

SEQ ID NO: 2379554 - RNA, 13 nt, Bordetella pertussis
gugcugcagcgca

SEQ ID NO: 2379555 - RNA, 16 nt, Bordetella pertussis
gugcugcagcgcacca

SEQ ID NO: 2379556 - RNA, 21 nt, Bordetella pertussis
gugcugccaugccgcgcgccu

SEQ ID NO: 2379557 - RNA, 16 nt, Bordetella pertussis
gugcugccgccgaugu

SEQ ID NO: 2379558 - RNA, 12 nt, Bordetella pertussis
gugcugccgcug

SEQ ID NO: 2379559 - RNA, 13 nt, Bordetella pertussis
gugcugcgccgcc

SEQ ID NO: 2379560 - RNA, 22 nt, Bordetella pertussis
gugcugcgccgccucgaccggc

SEQ ID NO: 2379561 - RNA, 22 nt, Bordetella pertussis
guggccgugcgaggcgaacagg

SEQ ID NO: 2379562 - RNA, 15 nt, Bordetella pertussis
guggccgugcugguc

SEQ ID NO: 2379563 - RNA, 22 nt, Bordetella pertussis
guggccguucggugcgcagcgg

SEQ ID NO: 2379564 - RNA, 20 nt, Bordetella pertussis
guggccucguaucgccugac

SEQ ID NO: 2379565 - RNA, 13 nt, Bordetella pertussis
guggccucgucca

SEQ ID NO: 2379566 - RNA, 21 nt, Bordetella pertussis
guggccugcccgucgggcagg

SEQ ID NO: 2379567 - RNA, 20 nt, Bordetella pertussis
guggcgaaauggugcggcca

SEQ ID NO: 2379568 - RNA, 24 nt, Bordetella pertussis
guggcgaaauggugcggccaugau

SEQ ID NO: 2379569 - RNA, 23 nt, Bordetella pertussis
guggcgaaggccgccgcgcccag

SEQ ID NO: 2379570 - RNA, 20 nt, Bordetella pertussis
guggcgauagcgcuccagcg

SEQ ID NO: 2379571 - RNA, 23 nt, Bordetella pertussis
guggcgauagcgcuccagcguca

SEQ ID NO: 2379572 - RNA, 16 nt, Bordetella pertussis
guggcgaugccgggca

SEQ ID NO: 2379573 - RNA, 21 nt, Bordetella pertussis
guggcgauggcaucgggcagg

SEQ ID NO: 2379574 - RNA, 16 nt, Bordetella pertussis
guggcgcacccugcag

SEQ ID NO: 2379575 - RNA, 21 nt, Bordetella pertussis
guggcgcacccugcaggccgg

SEQ ID NO: 2379576 - RNA, 14 nt, Bordetella pertussis
guggcgcagauggg

SEQ ID NO: 2379577 - RNA, 14 nt, Bordetella pertussis
guggcgcagcuccg

SEQ ID NO: 2379578 - RNA, 18 nt, Bordetella pertussis
guggcgcagucgagcacc

SEQ ID NO: 2379579 - RNA, 19 nt, Bordetella pertussis
guggcgcagucgagcaccg

SEQ ID NO: 2379580 - RNA, 16 nt, Bordetella pertussis
guggcgcagugggcca

SEQ ID NO: 2379581 - RNA, 12 nt, Bordetella pertussis
guggcgcccagc

SEQ ID NO: 2379582 - RNA, 13 nt, Bordetella pertussis
guggcgcccggcg

SEQ ID NO: 2379583 - RNA, 16 nt, Bordetella pertussis
guggcgcccggcggcg

SEQ ID NO: 2379584 - RNA, 17 nt, Bordetella pertussis
guggcgcccggcggcgc

SEQ ID NO: 2379585 - RNA, 22 nt, Bordetella pertussis
guggcgcccggcggcgcggcga

SEQ ID NO: 2379586 - RNA, 15 nt, Bordetella pertussis
guggcgccgaaggcg

SEQ ID NO: 2379587 - RNA, 22 nt, Bordetella pertussis
guggcgccgacccugcccggca

SEQ ID NO: 2379588 - RNA, 16 nt, Bordetella pertussis
guggcgccgcgggccu

SEQ ID NO: 2379589 - RNA, 13 nt, Bordetella pertussis
guggcgccggcca

SEQ ID NO: 2379590 - RNA, 18 nt, Bordetella pertussis
guggcgccgucgcgcugu

SEQ ID NO: 2379591 - RNA, 16 nt, Bordetella pertussis
guggcgcgccagcgcc

SEQ ID NO: 2379592 - RNA, 17 nt, Bordetella pertussis
guggcgcgccagcgcca

SEQ ID NO: 2379593 - RNA, 16 nt, Bordetella pertussis
guggcgcgccuccagc

SEQ ID NO: 2379594 - RNA, 13 nt, Bordetella pertussis
guggcgcgcgccg

SEQ ID NO: 2379595 - RNA, 18 nt, Bordetella pertussis
guggcgcgcgugcugggc

SEQ ID NO: 2379596 - RNA, 20 nt, Bordetella pertussis
guggcgcgcgugcugggcca

SEQ ID NO: 2379597 - RNA, 14 nt, Bordetella pertussis
guggcgcggguggc

SEQ ID NO: 2379598 - RNA, 16 nt, Bordetella pertussis
guggcgcuggcggcug

SEQ ID NO: 2379599 - RNA, 17 nt, Bordetella pertussis
guggcgcuggcggcugc

SEQ ID NO: 2379600 - RNA, 15 nt, Bordetella pertussis
guggcgcuguccggc

SEQ ID NO: 2379601 - RNA, 13 nt, Bordetella pertussis
guggcggccaggc

SEQ ID NO: 2379602 - RNA, 15 nt, Bordetella pertussis
guggcggccaggccg

SEQ ID NO: 2379603 - RNA, 16 nt, Bordetella pertussis
guggcggccgcgggca

SEQ ID NO: 2379604 - RNA, 23 nt, Bordetella pertussis
guggcggccgucggggccgaugg

SEQ ID NO: 2379605 - RNA, 18 nt, Bordetella pertussis
guggcggccugcgccggc

SEQ ID NO: 2379606 - RNA, 22 nt, Bordetella pertussis
guggcggccugcgccggcaugg

SEQ ID NO: 2379607 - RNA, 15 nt, Bordetella pertussis
guggcggcgacggcg

SEQ ID NO: 2379608 - RNA, 18 nt, Bordetella pertussis
guggcggcgcagcgccca

SEQ ID NO: 2379609 - RNA, 12 nt, Bordetella pertussis
guggcggcggca

SEQ ID NO: 2379610 - RNA, 14 nt, Bordetella pertussis
guggcgggccagcu

SEQ ID NO: 2379611 - RNA, 15 nt, Bordetella pertussis
guggcggggauggcu

SEQ ID NO: 2379612 - RNA, 14 nt, Bordetella pertussis
guggcggggcgcau

SEQ ID NO: 2379613 - RNA, 16 nt, Bordetella pertussis
guggcggggcguucga

SEQ ID NO: 2379614 - RNA, 14 nt, Bordetella pertussis
guggcggguccacg

SEQ ID NO: 2379615 - RNA, 19 nt, Bordetella pertussis
guggcgguguuggcgucca

SEQ ID NO: 2379616 - RNA, 21 nt, Bordetella pertussis
guggcgguuggugucgcgcag

SEQ ID NO: 2379617 - RNA, 22 nt, Bordetella pertussis
guggcguaggauucgcggugca

SEQ ID NO: 2379618 - RNA, 21 nt, Bordetella pertussis
guggcguaguagcccaggccc

SEQ ID NO: 2379619 - RNA, 23 nt, Bordetella pertussis
guggcguaguagcccaggcccac

SEQ ID NO: 2379620 - RNA, 13 nt, Bordetella pertussis
guggcguccacgc

SEQ ID NO: 2379621 - RNA, 20 nt, Bordetella pertussis
guggcguccacgcggguggu

SEQ ID NO: 2379622 - RNA, 21 nt, Bordetella pertussis
guggcgucgaguucgagcacg

SEQ ID NO: 2379623 - RNA, 23 nt, Bordetella pertussis
guggcgucgaguucgagcacggu

SEQ ID NO: 2379624 - RNA, 23 nt, Bordetella pertussis
guggcgucgggggcggccggggc

SEQ ID NO: 2379625 - RNA, 15 nt, Bordetella pertussis
guggcgucguggggc

SEQ ID NO: 2379626 - RNA, 16 nt, Bordetella pertussis
guggcgugcaggccgg

SEQ ID NO: 2379627 - RNA, 19 nt, Bordetella pertussis
guggcguuggccugccauc

SEQ ID NO: 2379628 - RNA, 24 nt, Bordetella pertussis
guggcguuggccugccauccggcc

SEQ ID NO: 2379629 - RNA, 21 nt, Bordetella pertussis
guggcucugguaacucaugcc

SEQ ID NO: 2379630 - RNA, 23 nt, Bordetella pertussis
guggcugagccauuccggcuggu

SEQ ID NO: 2379631 - RNA, 15 nt, Bordetella pertussis
guggcugcgcagguc

SEQ ID NO: 2379632 - RNA, 21 nt, Bordetella pertussis
guggcugcgcaggucggccag

SEQ ID NO: 2379633 - RNA, 15 nt, Bordetella pertussis
guggcuggggcuggc

SEQ ID NO: 2379634 - RNA, 16 nt, Bordetella pertussis
guggcuucagggcuga

SEQ ID NO: 2379635 - RNA, 12 nt, Bordetella pertussis
gugggacaggca

SEQ ID NO: 2379636 - RNA, 15 nt, Bordetella pertussis
gugggacaggcacuc

SEQ ID NO: 2379637 - RNA, 22 nt, Bordetella pertussis
gugggcaccgugaugcgcgccg

SEQ ID NO: 2379638 - RNA, 14 nt, Bordetella pertussis
gugggcacgccggc

SEQ ID NO: 2379639 - RNA, 15 nt, Bordetella pertussis
gugggcacgccggcc

SEQ ID NO: 2379640 - RNA, 16 nt, Bordetella pertussis
gugggcacgccggccu

SEQ ID NO: 2379641 - RNA, 14 nt, Bordetella pertussis
gugggcacgcgcgc

SEQ ID NO: 2379642 - RNA, 18 nt, Bordetella pertussis
gugggcacgcgcgcggcg

SEQ ID NO: 2379643 - RNA, 21 nt, Bordetella pertussis
gugggcagaacggaaacgccc

SEQ ID NO: 2379644 - RNA, 13 nt, Bordetella pertussis
gugggcagcagca

SEQ ID NO: 2379645 - RNA, 18 nt, Bordetella pertussis
gugggcagcggcaucacg

SEQ ID NO: 2379646 - RNA, 20 nt, Bordetella pertussis
gugggcauagcguuuuguac

SEQ ID NO: 2379647 - RNA, 17 nt, Bordetella pertussis
gugggcauccagcggca

SEQ ID NO: 2379648 - RNA, 20 nt, Bordetella pertussis
gugggccacucgaugggcgc

SEQ ID NO: 2379649 - RNA, 13 nt, Bordetella pertussis
gugggccagcaac

SEQ ID NO: 2379650 - RNA, 20 nt, Bordetella pertussis
gugggccagcaacuggugcc

SEQ ID NO: 2379651 - RNA, 20 nt, Bordetella pertussis
gugggccaguccgcagcgca

SEQ ID NO: 2379652 - RNA, 23 nt, Bordetella pertussis
gugggccaguccgcagcgcagcg

SEQ ID NO: 2379653 - RNA, 23 nt, Bordetella pertussis
gugggccaguucgcggcgcagcg

SEQ ID NO: 2379654 - RNA, 14 nt, Bordetella pertussis
gugggccggcuucu

SEQ ID NO: 2379655 - RNA, 20 nt, Bordetella pertussis
gugggcgaaccgcggcgcag

SEQ ID NO: 2379656 - RNA, 16 nt, Bordetella pertussis
gugggcgaacuggucg

SEQ ID NO: 2379657 - RNA, 16 nt, Bordetella pertussis
gugggcgacgcggcgu

SEQ ID NO: 2379658 - RNA, 22 nt, Bordetella pertussis
gugggcgaugcauucggcggcc

SEQ ID NO: 2379659 - RNA, 12 nt, Bordetella pertussis
gugggcgcgccg

SEQ ID NO: 2379660 - RNA, 12 nt, Bordetella pertussis
gugggcgcgcuc

SEQ ID NO: 2379661 - RNA, 15 nt, Bordetella pertussis
gugggcggcagcagg

SEQ ID NO: 2379662 - RNA, 21 nt, Bordetella pertussis
gugggcggccuugccggccac

SEQ ID NO: 2379663 - RNA, 23 nt, Bordetella pertussis
gugggcggugaccaugcgcaccg

SEQ ID NO: 2379664 - RNA, 14 nt, Bordetella pertussis
guggggacaggcac

SEQ ID NO: 2379665 - RNA, 19 nt, Bordetella pertussis
guggggacaggcacccgag

SEQ ID NO: 2379666 - RNA, 18 nt, Bordetella pertussis
guggggcagcaggccggc

SEQ ID NO: 2379667 - RNA, 13 nt, Bordetella pertussis
guggggcaggucg

SEQ ID NO: 2379668 - RNA, 22 nt, Bordetella pertussis
guggggccggccgcgcgcgcca

SEQ ID NO: 2379669 - RNA, 13 nt, Bordetella pertussis
guggggcgcggcg

SEQ ID NO: 2379670 - RNA, 22 nt, Bordetella pertussis
guggggcuggccgccgcggccu

SEQ ID NO: 2379671 - RNA, 13 nt, Bordetella pertussis
gugggggacaggc

SEQ ID NO: 2379672 - RNA, 17 nt, Bordetella pertussis
gugggggcgcggcggcg

SEQ ID NO: 2379673 - RNA, 17 nt, Bordetella pertussis
guggggggucaggccgu

SEQ ID NO: 2379674 - RNA, 19 nt, Bordetella pertussis
guucaugucgcgggugcgg

SEQ ID NO: 2379675 - RNA, 14 nt, Bordetella pertussis
guuccacagcgccg

SEQ ID NO: 2379676 - RNA, 15 nt, Bordetella pertussis
guuccacagcgccga

SEQ ID NO: 2379677 - RNA, 14 nt, Bordetella pertussis
guuccacgcggccg

SEQ ID NO: 2379678 - RNA, 19 nt, Bordetella pertussis
guuccacgcggccguggcg

SEQ ID NO: 2379679 - RNA, 23 nt, Bordetella pertussis
guuccagacgauggugccggccg

SEQ ID NO: 2379680 - RNA, 21 nt, Bordetella pertussis
guuccagauuuccggaccggu

SEQ ID NO: 2379681 - RNA, 23 nt, Bordetella pertussis
guuccagcacgacgacggccggc

SEQ ID NO: 2379682 - RNA, 11 nt, Bordetella pertussis
guuccagcaga

SEQ ID NO: 2379683 - RNA, 19 nt, Bordetella pertussis
guuccagccaguacaggcu

SEQ ID NO: 2379684 - RNA, 22 nt, Bordetella pertussis
guuccagccaguacaggcugcc

SEQ ID NO: 2379685 - RNA, 20 nt, Bordetella pertussis
guuccagcgccuggcgggcc

SEQ ID NO: 2379686 - RNA, 13 nt, Bordetella pertussis
guuccaggcggau

SEQ ID NO: 2379687 - RNA, 21 nt, Bordetella pertussis
guuccaguccagcgucggcgu

SEQ ID NO: 2379688 - RNA, 20 nt, Bordetella pertussis
guuccaugacguccagcgcc

SEQ ID NO: 2379689 - RNA, 21 nt, Bordetella pertussis
guuccaugacguccagcgcca

SEQ ID NO: 2379690 - RNA, 14 nt, Bordetella pertussis
guucccagcgcgcg

SEQ ID NO: 2379691 - RNA, 12 nt, Bordetella pertussis
guucccggugcc

SEQ ID NO: 2379692 - RNA, 16 nt, Bordetella pertussis
guuccgcgucuaccug

SEQ ID NO: 2379693 - RNA, 13 nt, Bordetella pertussis
guuccgugcgcgc

SEQ ID NO: 2379694 - RNA, 18 nt, Bordetella pertussis
guuccugcaaggccggcg

SEQ ID NO: 2379695 - RNA, 14 nt, Bordetella pertussis
guuccuggcgcugu

SEQ ID NO: 2379696 - RNA, 16 nt, Bordetella pertussis
guucgaaagccagcgc

SEQ ID NO: 2379697 - RNA, 17 nt, Bordetella pertussis
guucgaaagccagcgcc

SEQ ID NO: 2379698 - RNA, 19 nt, Bordetella pertussis
guucgaaguccgcgcgcag

SEQ ID NO: 2379699 - RNA, 23 nt, Bordetella pertussis
guucgaccugaagguggcguuca

SEQ ID NO: 2379700 - RNA, 14 nt, Bordetella pertussis
guucgacgcccaug

SEQ ID NO: 2379701 - RNA, 16 nt, Bordetella pertussis
guucgacgcggccgac

SEQ ID NO: 2379702 - RNA, 14 nt, Bordetella pertussis
guucgacgggcagg

SEQ ID NO: 2379703 - RNA, 20 nt, Bordetella pertussis
guucgacuucguccggcgcg

SEQ ID NO: 2379704 - RNA, 13 nt, Bordetella pertussis
guucgagcaggcg

SEQ ID NO: 2379705 - RNA, 15 nt, Bordetella pertussis
guucgagcaggcgcg

SEQ ID NO: 2379706 - RNA, 18 nt, Bordetella pertussis
guucgagcaggcgcgcgg

SEQ ID NO: 2379707 - RNA, 15 nt, Bordetella pertussis
guucgauggcggcca

SEQ ID NO: 2379708 - RNA, 17 nt, Bordetella pertussis
guucgauggcggccagg

SEQ ID NO: 2379709 - RNA, 19 nt, Bordetella pertussis
guucgauggcggccagggc

SEQ ID NO: 2379710 - RNA, 16 nt, Bordetella pertussis
guucgcccaccaccag

SEQ ID NO: 2379711 - RNA, 18 nt, Bordetella pertussis
guucgcccaccaccagcg

SEQ ID NO: 2379712 - RNA, 18 nt, Bordetella pertussis
guucgcccggcuccaggc

SEQ ID NO: 2379713 - RNA, 15 nt, Bordetella pertussis
guucgcccggugcgu

SEQ ID NO: 2379714 - RNA, 15 nt, Bordetella pertussis
guucgccgcaccagg

SEQ ID NO: 2379715 - RNA, 16 nt, Bordetella pertussis
guucgccgcaccaggc

SEQ ID NO: 2379716 - RNA, 15 nt, Bordetella pertussis
guucgccgcugucgc

SEQ ID NO: 2379717 - RNA, 14 nt, Bordetella pertussis
guucgccggcgccg

SEQ ID NO: 2379718 - RNA, 15 nt, Bordetella pertussis
guucgccgugcaggg

SEQ ID NO: 2379719 - RNA, 16 nt, Bordetella pertussis
guucgccgugcagggc

SEQ ID NO: 2379720 - RNA, 17 nt, Bordetella pertussis
guucgccgugcagggcc

SEQ ID NO: 2379721 - RNA, 21 nt, Bordetella pertussis
guucgccgugcagggccaggu

SEQ ID NO: 2379722 - RNA, 18 nt, Bordetella pertussis
guucgcgcaacucggcca

SEQ ID NO: 2379723 - RNA, 20 nt, Bordetella pertussis
guucgcgcaacucggccacc

SEQ ID NO: 2379724 - RNA, 13 nt, Bordetella pertussis
guucgcgcagcag

SEQ ID NO: 2379725 - RNA, 14 nt, Bordetella pertussis
guucgcgcagcagg

SEQ ID NO: 2379726 - RNA, 12 nt, Bordetella pertussis
guucgcgccgcg

SEQ ID NO: 2379727 - RNA, 13 nt, Bordetella pertussis
guucgcggccgga

SEQ ID NO: 2379728 - RNA, 13 nt, Bordetella pertussis
guucgcggccggc

SEQ ID NO: 2379729 - RNA, 13 nt, Bordetella pertussis
guucgcggcgcag

SEQ ID NO: 2379730 - RNA, 16 nt, Bordetella pertussis
guucgcuuuccagggu

SEQ ID NO: 2379731 - RNA, 14 nt, Bordetella pertussis
guucggccacggcu

SEQ ID NO: 2379732 - RNA, 13 nt, Bordetella pertussis
guucggccagcgc

SEQ ID NO: 2379733 - RNA, 15 nt, Bordetella pertussis
guucggccagcgcgc

SEQ ID NO: 2379734 - RNA, 20 nt, Bordetella pertussis
guucggccagcggcaggccc

SEQ ID NO: 2379735 - RNA, 15 nt, Bordetella pertussis
guucggccgccaggu

SEQ ID NO: 2379736 - RNA, 14 nt, Bordetella pertussis
guucggccggcggc

SEQ ID NO: 2379737 - RNA, 15 nt, Bordetella pertussis
guucggccucgccca

SEQ ID NO: 2379738 - RNA, 18 nt, Bordetella pertussis
guucggccuugccauugg

SEQ ID NO: 2379739 - RNA, 17 nt, Bordetella pertussis
guucggcgaccgccggc

SEQ ID NO: 2379740 - RNA, 21 nt, Bordetella pertussis
guucggcgaccgccggccggu

SEQ ID NO: 2379741 - RNA, 16 nt, Bordetella pertussis
guucggcgaugcgggc

SEQ ID NO: 2379742 - RNA, 18 nt, Bordetella pertussis
guucggcgaugcgggcgg

SEQ ID NO: 2379743 - RNA, 14 nt, Bordetella pertussis
guucggcgccgggc

SEQ ID NO: 2379744 - RNA, 15 nt, Bordetella pertussis
guucggcgccgggcg

SEQ ID NO: 2379745 - RNA, 11 nt, Bordetella pertussis
guucggcgcgc

SEQ ID NO: 2379746 - RNA, 15 nt, Bordetella pertussis
guucggcggcgccca

SEQ ID NO: 2379747 - RNA, 20 nt, Bordetella pertussis
guucggcgguuccagccugg

SEQ ID NO: 2379748 - RNA, 23 nt, Bordetella pertussis
guucggcuugcacgccggccacg

SEQ ID NO: 2379749 - RNA, 18 nt, Bordetella pertussis
guucgggacgcaggaguc

SEQ ID NO: 2379750 - RNA, 20 nt, Bordetella pertussis
guucgggcaugucgcggccc

SEQ ID NO: 2379751 - RNA, 17 nt, Bordetella pertussis
guucgggcgcggugcgc

SEQ ID NO: 2379752 - RNA, 19 nt, Bordetella pertussis
guucggucagcgcggcgca

SEQ ID NO: 2379753 - RNA, 16 nt, Bordetella pertussis
guucguagucgagcca

SEQ ID NO: 2379754 - RNA, 18 nt, Bordetella pertussis
guucguagucgagccagg

SEQ ID NO: 2379755 - RNA, 18 nt, Bordetella pertussis
guucguccucgucggcca

SEQ ID NO: 2379756 - RNA, 19 nt, Bordetella pertussis
guucgucgucgccaccgcc

SEQ ID NO: 2379757 - RNA, 13 nt, Bordetella pertussis
guucgugauccug

SEQ ID NO: 2379758 - RNA, 23 nt, Bordetella pertussis
guucgugcaccagcccgaugcgc

SEQ ID NO: 2379759 - RNA, 22 nt, Bordetella pertussis
guucucaggccgaggcugcgcg

SEQ ID NO: 2379760 - RNA, 16 nt, Bordetella pertussis
guucuccaacugggcc

SEQ ID NO: 2379761 - RNA, 13 nt, Bordetella pertussis
guucuccagcgcc

SEQ ID NO: 2379762 - RNA, 14 nt, Bordetella pertussis
guucuccagcgccg

SEQ ID NO: 2379763 - RNA, 15 nt, Bordetella pertussis
guucuccagcgccgu

SEQ ID NO: 2379764 - RNA, 19 nt, Bordetella pertussis
guucucgauguggcgcugg

SEQ ID NO: 2379765 - RNA, 20 nt, Bordetella pertussis
guucucgauguggcgcuggc

SEQ ID NO: 2379766 - RNA, 24 nt, Bordetella pertussis
guucugcagcgcggugcgggugac

SEQ ID NO: 2379767 - RNA, 15 nt, Bordetella pertussis
guucugcgcguccug

SEQ ID NO: 2379768 - RNA, 19 nt, Bordetella pertussis
guucugcgcguccuggcgc

SEQ ID NO: 2379769 - RNA, 13 nt, Bordetella pertussis
guucugcggcgcg

SEQ ID NO: 2379770 - RNA, 19 nt, Bordetella pertussis
guucugcguggcggcgucg

SEQ ID NO: 2379771 - RNA, 20 nt, Bordetella pertussis
guucugcguggcggcgucgg

SEQ ID NO: 2379772 - RNA, 24 nt, Bordetella pertussis
guucuggaucgcgcccagcgagcu

SEQ ID NO: 2379773 - RNA, 20 nt, Bordetella pertussis
guucuggcagugcgccuggc

SEQ ID NO: 2379774 - RNA, 16 nt, Bordetella pertussis
guucuggcugcgcgcc

SEQ ID NO: 2379775 - RNA, 22 nt, Bordetella pertussis
guucuggcugcgcgccuggcac

SEQ ID NO: 2379776 - RNA, 17 nt, Bordetella pertussis
guucuggucgaacuggc

SEQ ID NO: 2379777 - RNA, 13 nt, Bordetella pertussis
guucuucaggcuc

SEQ ID NO: 2379778 - RNA, 19 nt, Bordetella pertussis
guucuugcccuugaauucc

SEQ ID NO: 2379779 - RNA, 18 nt, Bordetella pertussis
guucuuggagaacugcuc

SEQ ID NO: 2379780 - RNA, 13 nt, Bordetella pertussis
guugaacugcagg

SEQ ID NO: 2379781 - RNA, 17 nt, Bordetella pertussis
guugaacugcaggccgc

SEQ ID NO: 2379782 - RNA, 16 nt, Bordetella pertussis
guugaagacgccgguc

SEQ ID NO: 2379783 - RNA, 13 nt, Bordetella pertussis
guugaaguccgga

SEQ ID NO: 2379784 - RNA, 15 nt, Bordetella pertussis
guugaaucggcgcga

SEQ ID NO: 2379785 - RNA, 21 nt, Bordetella pertussis
guugaccacgcccuggaucag

SEQ ID NO: 2379786 - RNA, 20 nt, Bordetella pertussis
guugaccaugaccaugccgg

SEQ ID NO: 2379787 - RNA, 14 nt, Bordetella pertussis
guugaccggcuggc

SEQ ID NO: 2379788 - RNA, 15 nt, Bordetella pertussis
guuucgcugcgcacg

SEQ ID NO: 2379789 - RNA, 16 nt, Bordetella pertussis
guuucggccugcaggc

SEQ ID NO: 2379790 - RNA, 23 nt, Bordetella pertussis
guuucggccugcaggcccagcac

SEQ ID NO: 2379791 - RNA, 16 nt, Bordetella pertussis
guuucggccugcucgc

SEQ ID NO: 2379792 - RNA, 22 nt, Bordetella pertussis
guuucggcggguuucucggccu

SEQ ID NO: 2379793 - RNA, 12 nt, Bordetella pertussis
guuucggugcgg

SEQ ID NO: 2379794 - RNA, 20 nt, Bordetella pertussis
guuucucaacccgccggcca

SEQ ID NO: 2379795 - RNA, 21 nt, Bordetella pertussis
guuucucggccuugggcgcgg

SEQ ID NO: 2379796 - RNA, 18 nt, Bordetella pertussis
guuugaguacgacgccgu

SEQ ID NO: 2379797 - RNA, 17 nt, Bordetella pertussis
guuugcgcaguggcgag

SEQ ID NO: 2379798 - RNA, 13 nt, Bordetella pertussis
guuugcggcgcga

SEQ ID NO: 2379799 - RNA, 12 nt, Bordetella pertussis
guuugcuggcgc

SEQ ID NO: 2379800 - RNA, 21 nt, Bordetella pertussis
guuuggcgaaggcgucggcca

SEQ ID NO: 2379801 - RNA, 18 nt, Bordetella pertussis
guuugguagcaggcgcgc

SEQ ID NO: 2379802 - RNA, 18 nt, Bordetella pertussis
guuuuccacagccaggcc

SEQ ID NO: 2379803 - RNA, 21 nt, Bordetella pertussis
guuuucgcccgcccacauggc

SEQ ID NO: 2379804 - RNA, 19 nt, Bordetella pertussis
guuuucuggccuuccugcu

SEQ ID NO: 2379805 - RNA, 21 nt, Bordetella pertussis
guuuucuggccuuccugcuga

SEQ ID NO: 2379806 - RNA, 16 nt, Bordetella pertussis
guuuuuuugcgccgcu

SEQ ID NO: 2379807 - RNA, 22 nt, Bordetella pertussis
guuuuuuuuugggaaggccgcg

SEQ ID NO: 2379808 - RNA, 20 nt, Bordetella pertussis
guuuuuuuuuggugccuguc

SEQ ID NO: 2379809 - RNA, 13 nt, Bordetella pertussis
uaaagaugcgcgc

SEQ ID NO: 2379810 - RNA, 20 nt, Bordetella pertussis
uaacagaggaacgccgcgcu

SEQ ID NO: 2379811 - RNA, 15 nt, Bordetella pertussis
uaaccggccaguccc

SEQ ID NO: 2379812 - RNA, 19 nt, Bordetella pertussis
uaacgaaucgcugccuucg

SEQ ID NO: 2379813 - RNA, 22 nt, Bordetella pertussis
uaacgccacuugcaggccgcga

SEQ ID NO: 2379814 - RNA, 23 nt, Bordetella pertussis
uaagacagauguccgugcuggcc

SEQ ID NO: 2379815 - RNA, 18 nt, Bordetella pertussis
uaagcaggucugcacgag

SEQ ID NO: 2379816 - RNA, 18 nt, Bordetella pertussis
uaagcuggcgcuuggcca

SEQ ID NO: 2379817 - RNA, 18 nt, Bordetella pertussis
uaaggagaauccgcaggc

SEQ ID NO: 2379818 - RNA, 20 nt, Bordetella pertussis
uaaggcgcuugcgcagggcg

SEQ ID NO: 2379819 - RNA, 22 nt, Bordetella pertussis
uaaucgagcuggcccacgccca

SEQ ID NO: 2379820 - RNA, 14 nt, Bordetella pertussis
uaaucgucggcaac

SEQ ID NO: 2379821 - RNA, 22 nt, Bordetella pertussis
uaauuaaugaaacugcaaaauu

SEQ ID NO: 2379822 - RNA, 21 nt, Bordetella pertussis
uacaacaucaaugacauggcc

SEQ ID NO: 2379823 - RNA, 13 nt, Bordetella pertussis
uacaaggcgcggc

SEQ ID NO: 2379824 - RNA, 15 nt, Bordetella pertussis
uacacaugcuugcca

SEQ ID NO: 2379825 - RNA, 22 nt, Bordetella pertussis
uacaccgugcuggccgacgcgc

SEQ ID NO: 2379826 - RNA, 18 nt, Bordetella pertussis
uacaccuuguuggcgccg

SEQ ID NO: 2379827 - RNA, 14 nt, Bordetella pertussis
uacacggccagcac

SEQ ID NO: 2379828 - RNA, 17 nt, Bordetella pertussis
uacacggugggcgacgc

SEQ ID NO: 2379829 - RNA, 16 nt, Bordetella pertussis
uacagaucgccgccgc

SEQ ID NO: 2379830 - RNA, 22 nt, Bordetella pertussis
uacagaucgccgccgcccgccc

SEQ ID NO: 2379831 - RNA, 12 nt, Bordetella pertussis
uacagcaaggac

SEQ ID NO: 2379832 - RNA, 17 nt, Bordetella pertussis
uacagcagcagcacggc

SEQ ID NO: 2379833 - RNA, 15 nt, Bordetella pertussis
uacagccaggccagc

SEQ ID NO: 2379834 - RNA, 17 nt, Bordetella pertussis
uacagccaggccagcag

SEQ ID NO: 2379835 - RNA, 17 nt, Bordetella pertussis
uacagccccagcgccag

SEQ ID NO: 2379836 - RNA, 14 nt, Bordetella pertussis
uacagccgccuggc

SEQ ID NO: 2379837 - RNA, 23 nt, Bordetella pertussis
uacagccugcccugguggcagag

SEQ ID NO: 2379838 - RNA, 14 nt, Bordetella pertussis
uacagcgccugcgc

SEQ ID NO: 2379839 - RNA, 17 nt, Bordetella pertussis
uacagcgccugcgcggc

SEQ ID NO: 2379840 - RNA, 13 nt, Bordetella pertussis
uacagcgcgcccg

SEQ ID NO: 2379841 - RNA, 14 nt, Bordetella pertussis
uacagcggagccgc

SEQ ID NO: 2379842 - RNA, 14 nt, Bordetella pertussis
uacagcgucacggc

SEQ ID NO: 2379843 - RNA, 14 nt, Bordetella pertussis
uacagcucgccggc

SEQ ID NO: 2379844 - RNA, 15 nt, Bordetella pertussis
uacagcuugagagug

SEQ ID NO: 2379845 - RNA, 15 nt, Bordetella pertussis
uacagcuuggcgcgc

SEQ ID NO: 2379846 - RNA, 14 nt, Bordetella pertussis
uacaggcagcggcc

SEQ ID NO: 2379847 - RNA, 15 nt, Bordetella pertussis
uacaggcagcggccg

SEQ ID NO: 2379848 - RNA, 16 nt, Bordetella pertussis
uacaggcagcggccgc

SEQ ID NO: 2379849 - RNA, 14 nt, Bordetella pertussis
uacaggccgccggu

SEQ ID NO: 2379850 - RNA, 23 nt, Bordetella pertussis
uacaggccggcggcgagcgcggc

SEQ ID NO: 2379851 - RNA, 19 nt, Bordetella pertussis
uacaggcuguggccgcggc

SEQ ID NO: 2379852 - RNA, 16 nt, Bordetella pertussis
uacagggugccgcgcc

SEQ ID NO: 2379853 - RNA, 22 nt, Bordetella pertussis
uacaggugcugggucaucagca

SEQ ID NO: 2379854 - RNA, 22 nt, Bordetella pertussis
uacagugguucaucgggccggc

SEQ ID NO: 2379855 - RNA, 19 nt, Bordetella pertussis
uacaugaguucuggcauca

SEQ ID NO: 2379856 - RNA, 20 nt, Bordetella pertussis
uacaugaguucuggcaucag

SEQ ID NO: 2379857 - RNA, 23 nt, Bordetella pertussis
uaccaauacaggaagcgcuggcc

SEQ ID NO: 2379858 - RNA, 18 nt, Bordetella pertussis
uaccacaguucggccagc

SEQ ID NO: 2379859 - RNA, 13 nt, Bordetella pertussis
uaccacgcgcggc

SEQ ID NO: 2379860 - RNA, 15 nt, Bordetella pertussis
uaccacguggucugg

SEQ ID NO: 2379861 - RNA, 14 nt, Bordetella pertussis
uaccagcccggcgc

SEQ ID NO: 2379862 - RNA, 15 nt, Bordetella pertussis
uaccaggcagccggc

SEQ ID NO: 2379863 - RNA, 12 nt, Bordetella pertussis
uaccaggcgcgc

SEQ ID NO: 2379864 - RNA, 22 nt, Bordetella pertussis
uaccaggcggcgacgaugccgc

SEQ ID NO: 2379865 - RNA, 15 nt, Bordetella pertussis
uaccaggcguaucga

SEQ ID NO: 2379866 - RNA, 16 nt, Bordetella pertussis
uaccaggugggcgcgc

SEQ ID NO: 2379867 - RNA, 19 nt, Bordetella pertussis
uaccaguacaccggcgugc

SEQ ID NO: 2379868 - RNA, 14 nt, Bordetella pertussis
uacccaugcggggc

SEQ ID NO: 2379869 - RNA, 17 nt, Bordetella pertussis
uacccaugcggggcggc

SEQ ID NO: 2379870 - RNA, 23 nt, Bordetella pertussis
uaccccguagaacuucacgccga

SEQ ID NO: 2379871 - RNA, 14 nt, Bordetella pertussis
uacccgccgggcgg

SEQ ID NO: 2379872 - RNA, 12 nt, Bordetella pertussis
uacccgcgccgg

SEQ ID NO: 2379873 - RNA, 19 nt, Bordetella pertussis
uacccgcgccggcggcaag

SEQ ID NO: 2379874 - RNA, 21 nt, Bordetella pertussis
uacccgcgccgucgaacuccu

SEQ ID NO: 2379875 - RNA, 23 nt, Bordetella pertussis
uacccggucgaucagggcgcgga

SEQ ID NO: 2379876 - RNA, 21 nt, Bordetella pertussis
uaccgaagccgaguggcgggc

SEQ ID NO: 2379877 - RNA, 19 nt, Bordetella pertussis
uaccgaaucgaacuuggcg

SEQ ID NO: 2379878 - RNA, 15 nt, Bordetella pertussis
uaccgaucuacgacg

SEQ ID NO: 2379879 - RNA, 19 nt, Bordetella pertussis
uaccgaucuacgacgccug

SEQ ID NO: 2379880 - RNA, 13 nt, Bordetella pertussis
uaccgccagcucg

SEQ ID NO: 2379881 - RNA, 15 nt, Bordetella pertussis
uaccgccgccugcgc

SEQ ID NO: 2379882 - RNA, 20 nt, Bordetella pertussis
uaccgccuugccuugcgcgg

SEQ ID NO: 2379883 - RNA, 23 nt, Bordetella pertussis
uaccgccuugccuugcgcggcca

SEQ ID NO: 2379884 - RNA, 18 nt, Bordetella pertussis
uaccgcuucccuggcaag

SEQ ID NO: 2379885 - RNA, 13 nt, Bordetella pertussis
uaccggagcggcu

SEQ ID NO: 2379886 - RNA, 18 nt, Bordetella pertussis
uaccgggcuggucagccu

SEQ ID NO: 2379887 - RNA, 13 nt, Bordetella pertussis
uaccgguccagau

SEQ ID NO: 2379888 - RNA, 20 nt, Bordetella pertussis
uaccgucguccucggcacgg

SEQ ID NO: 2379889 - RNA, 21 nt, Bordetella pertussis
uaccgucguccucggcacggc

SEQ ID NO: 2379890 - RNA, 22 nt, Bordetella pertussis
uaccgucguccucggcacggcc

SEQ ID NO: 2379891 - RNA, 14 nt, Bordetella pertussis
uaccgucuuggccg

SEQ ID NO: 2379892 - RNA, 17 nt, Bordetella pertussis
uaccucggugaggauuu

SEQ ID NO: 2379893 - RNA, 17 nt, Bordetella pertussis
uaccugcagcaggcgca

SEQ ID NO: 2379894 - RNA, 16 nt, Bordetella pertussis
uaccuucagcccggcg

SEQ ID NO: 2379895 - RNA, 16 nt, Bordetella pertussis
uacgaaaaccaggcug

SEQ ID NO: 2379896 - RNA, 17 nt, Bordetella pertussis
uacgaaaccaggccggg

SEQ ID NO: 2379897 - RNA, 18 nt, Bordetella pertussis
uacgaaacucccacgcuc

SEQ ID NO: 2379898 - RNA, 16 nt, Bordetella pertussis
uacgacgagcgcacca

SEQ ID NO: 2379899 - RNA, 19 nt, Bordetella pertussis
uacgacgccgugcugaucg

SEQ ID NO: 2379900 - RNA, 12 nt, Bordetella pertussis
uacgacggccgg

SEQ ID NO: 2379901 - RNA, 19 nt, Bordetella pertussis
ucaaccggcguucuggcgc

SEQ ID NO: 2379902 - RNA, 17 nt, Bordetella pertussis
ucaaccguucauggcgu

SEQ ID NO: 2379903 - RNA, 15 nt, Bordetella pertussis
ucaaccucgacgcgc

SEQ ID NO: 2379904 - RNA, 18 nt, Bordetella pertussis
ucaaccucgacgcgcauu

SEQ ID NO: 2379905 - RNA, 22 nt, Bordetella pertussis
ucaaccugaucguucccuaccc

SEQ ID NO: 2379906 - RNA, 19 nt, Bordetella pertussis
ucaacgugcgccaggcaaa

SEQ ID NO: 2379907 - RNA, 14 nt, Bordetella pertussis
ucaacucgcccgau

SEQ ID NO: 2379908 - RNA, 20 nt, Bordetella pertussis
ucaacuggccggccuggcgc

SEQ ID NO: 2379909 - RNA, 22 nt, Bordetella pertussis
ucaacuggccggccuggcgcgc

SEQ ID NO: 2379910 - RNA, 16 nt, Bordetella pertussis
ucaacuuccagcgccc

SEQ ID NO: 2379911 - RNA, 13 nt, Bordetella pertussis
ucaagcagcgccg

SEQ ID NO: 2379912 - RNA, 15 nt, Bordetella pertussis
ucaagcagcgccggc

SEQ ID NO: 2379913 - RNA, 17 nt, Bordetella pertussis
ucaagcggcccgcgccc

SEQ ID NO: 2379914 - RNA, 18 nt, Bordetella pertussis
ucaagcggcccgcgcccu

SEQ ID NO: 2379915 - RNA, 17 nt, Bordetella pertussis
ucaagcggcugcccuug

SEQ ID NO: 2379916 - RNA, 23 nt, Bordetella pertussis
ucaagcgucgauggcguacagca

SEQ ID NO: 2379917 - RNA, 17 nt, Bordetella pertussis
ucaagcguucauggcgu

SEQ ID NO: 2379918 - RNA, 20 nt, Bordetella pertussis
ucaaggaaaucgucgacacc

SEQ ID NO: 2379919 - RNA, 19 nt, Bordetella pertussis
ucaaggccaugaucaggcc

SEQ ID NO: 2379920 - RNA, 21 nt, Bordetella pertussis
ucaaggcccggauauggccgg

SEQ ID NO: 2379921 - RNA, 21 nt, Bordetella pertussis
ucaaggccgaauugccgccgc

SEQ ID NO: 2379922 - RNA, 15 nt, Bordetella pertussis
ucaaggcgcggccgu

SEQ ID NO: 2379923 - RNA, 16 nt, Bordetella pertussis
ucaaggcgcggccguc

SEQ ID NO: 2379924 - RNA, 23 nt, Bordetella pertussis
ucaagggccuuuuucuuuugcgg

SEQ ID NO: 2379925 - RNA, 15 nt, Bordetella pertussis
ucaaggggcuguacc

SEQ ID NO: 2379926 - RNA, 20 nt, Bordetella pertussis
ucaaguccggcgccgccggg

SEQ ID NO: 2379927 - RNA, 19 nt, Bordetella pertussis
ucaaucugaucaucuucgu

SEQ ID NO: 2379928 - RNA, 15 nt, Bordetella pertussis
ucaaugaagggcugc

SEQ ID NO: 2379929 - RNA, 23 nt, Bordetella pertussis
ucaaugcggcggcgcuggccugc

SEQ ID NO: 2379930 - RNA, 14 nt, Bordetella pertussis
ucacaccccaccac

SEQ ID NO: 2379931 - RNA, 19 nt, Bordetella pertussis
ucacagacgaucacggugg

SEQ ID NO: 2379932 - RNA, 23 nt, Bordetella pertussis
ucacaggcccgcgcggccagcgc

SEQ ID NO: 2379933 - RNA, 21 nt, Bordetella pertussis
ucacagggucaaggcgcggcc

SEQ ID NO: 2379934 - RNA, 13 nt, Bordetella pertussis
ucacauaggccgg

SEQ ID NO: 2379935 - RNA, 18 nt, Bordetella pertussis
ucacaucgcuaugcagcu

SEQ ID NO: 2379936 - RNA, 17 nt, Bordetella pertussis
ucaccaagggcgccggg

SEQ ID NO: 2379937 - RNA, 20 nt, Bordetella pertussis
ucaccaagggcgccgggcgg

SEQ ID NO: 2379938 - RNA, 14 nt, Bordetella pertussis
ucaccacgcccgcg

SEQ ID NO: 2379939 - RNA, 22 nt, Bordetella pertussis
ucaccacgccuucgagcaccau

SEQ ID NO: 2379940 - RNA, 23 nt, Bordetella pertussis
ucaccacgggcacgauggccgcg

SEQ ID NO: 2379941 - RNA, 18 nt, Bordetella pertussis
ucaccagcagguggcgcu

SEQ ID NO: 2379942 - RNA, 22 nt, Bordetella pertussis
ucaccagcccggcggugaccug

SEQ ID NO: 2379943 - RNA, 17 nt, Bordetella pertussis
ucaccaggaagcgcgcc

SEQ ID NO: 2379944 - RNA, 21 nt, Bordetella pertussis
ucaccaggaagcgcgccugcg

SEQ ID NO: 2379945 - RNA, 20 nt, Bordetella pertussis
ucaccaggguggcgggcgcc

SEQ ID NO: 2379946 - RNA, 22 nt, Bordetella pertussis
ucaccaggguggcgggcgccug

SEQ ID NO: 2379947 - RNA, 17 nt, Bordetella pertussis
ucaccauggccgacagc

SEQ ID NO: 2379948 - RNA, 13 nt, Bordetella pertussis
ucacccagcggcu

SEQ ID NO: 2379949 - RNA, 16 nt, Bordetella pertussis
ucacccagcggcuggc

SEQ ID NO: 2379950 - RNA, 13 nt, Bordetella pertussis
ucacccagggugu

SEQ ID NO: 2379951 - RNA, 17 nt, Bordetella pertussis
ucaccccgccaccgccc

SEQ ID NO: 2379952 - RNA, 21 nt, Bordetella pertussis
ucaccccgcccggcggcgcgc

SEQ ID NO: 2379953 - RNA, 15 nt, Bordetella pertussis
ucaccccgcccugcc

SEQ ID NO: 2379954 - RNA, 20 nt, Bordetella pertussis
ucaccccgcccugcccggcg

SEQ ID NO: 2379955 - RNA, 23 nt, Bordetella pertussis
ucaccccgcccugcccggcgagc

SEQ ID NO: 2379956 - RNA, 23 nt, Bordetella pertussis
ucacccgauacgacacgccgcgc

SEQ ID NO: 2379957 - RNA, 15 nt, Bordetella pertussis
ucaccgacagcgcca

SEQ ID NO: 2379958 - RNA, 20 nt, Bordetella pertussis
ucaccgacaggaugggcgcu

SEQ ID NO: 2379959 - RNA, 20 nt, Bordetella pertussis
ucaccgagcugagcaccagc

SEQ ID NO: 2379960 - RNA, 18 nt, Bordetella pertussis
ucaccgccauggcggccg

SEQ ID NO: 2379961 - RNA, 14 nt, Bordetella pertussis
ucaccgccgcccgc

SEQ ID NO: 2379962 - RNA, 16 nt, Bordetella pertussis
ucaccgccgcccgcag

SEQ ID NO: 2379963 - RNA, 19 nt, Bordetella pertussis
ucaccgccgcccgcaggca

SEQ ID NO: 2379964 - RNA, 17 nt, Bordetella pertussis
ucaccgccgccgccacc

SEQ ID NO: 2379965 - RNA, 18 nt, Bordetella pertussis
ucaccgccgccgccacca

SEQ ID NO: 2379966 - RNA, 15 nt, Bordetella pertussis
ucaccgccgccgcgc

SEQ ID NO: 2379967 - RNA, 15 nt, Bordetella pertussis
ucaccgccgcgaccg

SEQ ID NO: 2379968 - RNA, 13 nt, Bordetella pertussis
ucaccgccgcggc

SEQ ID NO: 2379969 - RNA, 14 nt, Bordetella pertussis
ucaccgccgcggcg

SEQ ID NO: 2379970 - RNA, 16 nt, Bordetella pertussis
ucaccgccggcggcgu

SEQ ID NO: 2379971 - RNA, 16 nt, Bordetella pertussis
ucaccggcgagccgau

SEQ ID NO: 2379972 - RNA, 21 nt, Bordetella pertussis
ucaccgugaugggcgcaucca

SEQ ID NO: 2379973 - RNA, 20 nt, Bordetella pertussis
ucaccuucaacaucgcccug

SEQ ID NO: 2379974 - RNA, 15 nt, Bordetella pertussis
ucacgaaagcgccca

SEQ ID NO: 2379975 - RNA, 19 nt, Bordetella pertussis
ucacgaacagcgccaggcu

SEQ ID NO: 2379976 - RNA, 22 nt, Bordetella pertussis
ucacgaaccgcagaagcagccg

SEQ ID NO: 2379977 - RNA, 17 nt, Bordetella pertussis
ucacgacacgcccagca

SEQ ID NO: 2379978 - RNA, 23 nt, Bordetella pertussis
ucacgaucuggccgauggccucg

SEQ ID NO: 2379979 - RNA, 14 nt, Bordetella pertussis
ucacgcaaggccga

SEQ ID NO: 2379980 - RNA, 12 nt, Bordetella pertussis
ucacgcacagca

SEQ ID NO: 2379981 - RNA, 15 nt, Bordetella pertussis
ucacgcacagcaccu

SEQ ID NO: 2379982 - RNA, 16 nt, Bordetella pertussis
ucacgcacagcaccug

SEQ ID NO: 2379983 - RNA, 12 nt, Bordetella pertussis
ucacgcccagga

SEQ ID NO: 2379984 - RNA, 13 nt, Bordetella pertussis
ucacgcccaggaa

SEQ ID NO: 2379985 - RNA, 17 nt, Bordetella pertussis
ucacgcccaggcgcugg

SEQ ID NO: 2379986 - RNA, 16 nt, Bordetella pertussis
ucacgcccgugucgcc

SEQ ID NO: 2379987 - RNA, 19 nt, Bordetella pertussis
ucacgcccgugucgccguc

SEQ ID NO: 2379988 - RNA, 14 nt, Bordetella pertussis
ucacgccggcgcgc

SEQ ID NO: 2379989 - RNA, 15 nt, Bordetella pertussis
ucacgccggcgcgcc

SEQ ID NO: 2379990 - RNA, 18 nt, Bordetella pertussis
ucacgccggcgcgccggg

SEQ ID NO: 2379991 - RNA, 22 nt, Bordetella pertussis
ucacgccggcgcgccgggccag

SEQ ID NO: 2379992 - RNA, 16 nt, Bordetella pertussis
ucacgcgcaaggcggg

SEQ ID NO: 2379993 - RNA, 14 nt, Bordetella pertussis
ucacgcgcagcguc

SEQ ID NO: 2379994 - RNA, 23 nt, Bordetella pertussis
ucacgcgcuccggcugcgcgcgc

SEQ ID NO: 2379995 - RNA, 21 nt, Bordetella pertussis
ucacgcgugaauaccgcgcac

SEQ ID NO: 2379996 - RNA, 21 nt, Bordetella pertussis
ucacgcugguggccaccagcc

SEQ ID NO: 2379997 - RNA, 22 nt, Bordetella pertussis
ucacgcugguggccaccagccc

SEQ ID NO: 2379998 - RNA, 15 nt, Bordetella pertussis
ucacgcuuccccgaa

SEQ ID NO: 2379999 - RNA, 18 nt, Bordetella pertussis
ucacggcaagacggcgcu

SEQ ID NO: 2380000 - RNA, 23 nt, Bordetella pertussis
ucacggccaacccucgcacggcc

SEQ ID NO: 2380001 - RNA, 22 nt, Bordetella pertussis
ucacggccgucaauaucacgcg

SEQ ID NO: 2380002 - RNA, 14 nt, Bordetella pertussis
ucacggcgcgcgcc

SEQ ID NO: 2380003 - RNA, 16 nt, Bordetella pertussis
ucacggcgcgcgccug

SEQ ID NO: 2380004 - RNA, 17 nt, Bordetella pertussis
ucacgggcgaagcggac

SEQ ID NO: 2380005 - RNA, 16 nt, Bordetella pertussis
ucacgggcgccagcag

SEQ ID NO: 2380006 - RNA, 20 nt, Bordetella pertussis
ucacgggcgccagcagcggg

SEQ ID NO: 2380007 - RNA, 21 nt, Bordetella pertussis
ucacggggcugucgcgcgcau

SEQ ID NO: 2380008 - RNA, 18 nt, Bordetella pertussis
ucacguagccggccaggu

SEQ ID NO: 2380009 - RNA, 20 nt, Bordetella pertussis
ucacguccaguccuucgcgu

SEQ ID NO: 2380010 - RNA, 15 nt, Bordetella pertussis
ucacguucagcgccg

SEQ ID NO: 2380011 - RNA, 19 nt, Bordetella pertussis
ucacguucagcgccggcau

SEQ ID NO: 2380012 - RNA, 14 nt, Bordetella pertussis
ucacguucgaccug

SEQ ID NO: 2380013 - RNA, 20 nt, Bordetella pertussis
acugcuggaacaccaugccc

SEQ ID NO: 2380014 - RNA, 18 nt, Bordetella pertussis
acugcuguacgacagcaa

SEQ ID NO: 2380015 - RNA, 15 nt, Bordetella pertussis
acuggacggcgcugg

SEQ ID NO: 2380016 - RNA, 23 nt, Bordetella pertussis
acuggacggcgcuggggaagcgc

SEQ ID NO: 2380017 - RNA, 16 nt, Bordetella pertussis
acuggauauggcgccg

SEQ ID NO: 2380018 - RNA, 18 nt, Bordetella pertussis
acuggauauggcgccgca

SEQ ID NO: 2380019 - RNA, 20 nt, Bordetella pertussis
acuggaucuuggccuguucg

SEQ ID NO: 2380020 - RNA, 21 nt, Bordetella pertussis
acuggaugaagcguucggccu

SEQ ID NO: 2380021 - RNA, 20 nt, Bordetella pertussis
acuggcacccgcaagauuuc

SEQ ID NO: 2380022 - RNA, 20 nt, Bordetella pertussis
acuggcagaccgagcgcgcc

SEQ ID NO: 2380023 - RNA, 13 nt, Bordetella pertussis
acuggcccaggcg

SEQ ID NO: 2380024 - RNA, 21 nt, Bordetella pertussis
acuggcccaggcgggccaggu

SEQ ID NO: 2380025 - RNA, 14 nt, Bordetella pertussis
acuggccgaugguc

SEQ ID NO: 2380026 - RNA, 24 nt, Bordetella pertussis
acuggccgauggucagcaugucga

SEQ ID NO: 2380027 - RNA, 12 nt, Bordetella pertussis
acuggccgcgcc

SEQ ID NO: 2380028 - RNA, 15 nt, Bordetella pertussis
acuggccgcgccgcu

SEQ ID NO: 2380029 - RNA, 12 nt, Bordetella pertussis
acuggccgcgcu

SEQ ID NO: 2380030 - RNA, 18 nt, Bordetella pertussis
acuggccgcgcucaggcc

SEQ ID NO: 2380031 - RNA, 22 nt, Bordetella pertussis
acuggcgcgcgcaagccgccgc

SEQ ID NO: 2380032 - RNA, 18 nt, Bordetella pertussis
acuggcggcugcgggcgc

SEQ ID NO: 2380033 - RNA, 14 nt, Bordetella pertussis
acuggcuaaaagga

SEQ ID NO: 2380034 - RNA, 12 nt, Bordetella pertussis
acuggcucccga

SEQ ID NO: 2380035 - RNA, 19 nt, Bordetella pertussis
acuggcuggucuucgagcg

SEQ ID NO: 2380036 - RNA, 20 nt, Bordetella pertussis
acuggcuggucuucgagcgc

SEQ ID NO: 2380037 - RNA, 18 nt, Bordetella pertussis
acugggacaggcccagcc

SEQ ID NO: 2380038 - RNA, 19 nt, Bordetella pertussis
acugggacaggcccagccc

SEQ ID NO: 2380039 - RNA, 16 nt, Bordetella pertussis
acugggcaccacgaug

SEQ ID NO: 2380040 - RNA, 12 nt, Bordetella pertussis
acugggcggcga

SEQ ID NO: 2380041 - RNA, 12 nt, Bordetella pertussis
acugggcgucgc

SEQ ID NO: 2380042 - RNA, 13 nt, Bordetella pertussis
acugggcuugccg

SEQ ID NO: 2380043 - RNA, 15 nt, Bordetella pertussis
acugggggacuggca

SEQ ID NO: 2380044 - RNA, 17 nt, Bordetella pertussis
acugggugcuggccaac

SEQ ID NO: 2380045 - RNA, 19 nt, Bordetella pertussis
ucagcagcgcggcgccggc

SEQ ID NO: 2380046 - RNA, 19 nt, Bordetella pertussis
ucagcagcucguugaccug

SEQ ID NO: 2380047 - RNA, 15 nt, Bordetella pertussis
ucagcaggcccacca

SEQ ID NO: 2380048 - RNA, 19 nt, Bordetella pertussis
ucagcaggcccaccaggga

SEQ ID NO: 2380049 - RNA, 13 nt, Bordetella pertussis
ucagcagggcgcc

SEQ ID NO: 2380050 - RNA, 19 nt, Bordetella pertussis
ucagcagggcgccgacgau

SEQ ID NO: 2380051 - RNA, 20 nt, Bordetella pertussis
ucagcagggucgagaccagc

SEQ ID NO: 2380052 - RNA, 18 nt, Bordetella pertussis
ucagcaggucggcgcggc

SEQ ID NO: 2380053 - RNA, 19 nt, Bordetella pertussis
ucagcaggucggcgcggcc

SEQ ID NO: 2380054 - RNA, 18 nt, Bordetella pertussis
ucagcauaucgucgcugc

SEQ ID NO: 2380055 - RNA, 14 nt, Bordetella pertussis
ucagcaucagcaga

SEQ ID NO: 2380056 - RNA, 21 nt, Bordetella pertussis
ucagcaugaagcugcccagca

SEQ ID NO: 2380057 - RNA, 16 nt, Bordetella pertussis
ucagcauggagcuggg

SEQ ID NO: 2380058 - RNA, 21 nt, Bordetella pertussis
ucagcauggagcuggggccgc

SEQ ID NO: 2380059 - RNA, 12 nt, Bordetella pertussis
ucagcauggcgu

SEQ ID NO: 2380060 - RNA, 19 nt, Bordetella pertussis
ucagccacacgaucagcgc

SEQ ID NO: 2380061 - RNA, 20 nt, Bordetella pertussis
ucagccacacgaucagcgcc

SEQ ID NO: 2380062 - RNA, 22 nt, Bordetella pertussis
ucagccacacgaucagcgccca

SEQ ID NO: 2380063 - RNA, 12 nt, Bordetella pertussis
ucagccaccggu

SEQ ID NO: 2380064 - RNA, 20 nt, Bordetella pertussis
ucagccaccgguugcagcgc

SEQ ID NO: 2380065 - RNA, 17 nt, Bordetella pertussis
ucagccacgugaagcgc

SEQ ID NO: 2380066 - RNA, 22 nt, Bordetella pertussis
ucagccacgugaagcgccgcgc

SEQ ID NO: 2380067 - RNA, 19 nt, Bordetella pertussis
ucagccagccggcggccag

SEQ ID NO: 2380068 - RNA, 15 nt, Bordetella pertussis
ucagccaucaucauc

SEQ ID NO: 2380069 - RNA, 16 nt, Bordetella pertussis
ucagccaucaucaucg

SEQ ID NO: 2380070 - RNA, 15 nt, Bordetella pertussis
ucagcccaggcgggc

SEQ ID NO: 2380071 - RNA, 14 nt, Bordetella pertussis
ucagccccaggcgc

SEQ ID NO: 2380072 - RNA, 15 nt, Bordetella pertussis
ucagccccaggcgcg

SEQ ID NO: 2380073 - RNA, 22 nt, Bordetella pertussis
ucagccccugccaugccccauc

SEQ ID NO: 2380074 - RNA, 18 nt, Bordetella pertussis
ucagcccgcaccgcccgc

SEQ ID NO: 2380075 - RNA, 19 nt, Bordetella pertussis
ucagcccgccaucgcgcau

SEQ ID NO: 2380076 - RNA, 18 nt, Bordetella pertussis
ucagcccgccuggcgccg

SEQ ID NO: 2380077 - RNA, 22 nt, Bordetella pertussis
ucagcccgcguucaggcgcggc

SEQ ID NO: 2380078 - RNA, 23 nt, Bordetella pertussis
ucagcccggcgacguugcauacc

SEQ ID NO: 2380079 - RNA, 23 nt, Bordetella pertussis
ucagcccggcgagguugcaggcc

SEQ ID NO: 2380080 - RNA, 14 nt, Bordetella pertussis
ucagcccggcgcgc

SEQ ID NO: 2380081 - RNA, 15 nt, Bordetella pertussis
ucagcccggcgcgcc

SEQ ID NO: 2380082 - RNA, 13 nt, Bordetella pertussis
ucagcccggcggc

SEQ ID NO: 2380083 - RNA, 14 nt, Bordetella pertussis
ucagcccggcggcc

SEQ ID NO: 2380084 - RNA, 17 nt, Bordetella pertussis
ucagcccggcggccauc

SEQ ID NO: 2380085 - RNA, 21 nt, Bordetella pertussis
ucagccgcaagcuggcggcgc

SEQ ID NO: 2380086 - RNA, 23 nt, Bordetella pertussis
ucagccgcaagcuggcggcgcgc

SEQ ID NO: 2380087 - RNA, 21 nt, Bordetella pertussis
ucagccgcccgccgggccguc

SEQ ID NO: 2380088 - RNA, 16 nt, Bordetella pertussis
ucagccggccauggcc

SEQ ID NO: 2380089 - RNA, 20 nt, Bordetella pertussis
ucagccugauucccaggccc

SEQ ID NO: 2380090 - RNA, 17 nt, Bordetella pertussis
ucagccugcuggugcug

SEQ ID NO: 2380091 - RNA, 14 nt, Bordetella pertussis
ucagccugggcgcc

SEQ ID NO: 2380092 - RNA, 18 nt, Bordetella pertussis
ucagccuugcuccggcgu

SEQ ID NO: 2380093 - RNA, 15 nt, Bordetella pertussis
ucagcgccaucaucg

SEQ ID NO: 2380094 - RNA, 13 nt, Bordetella pertussis
ucagcgcccaggu

SEQ ID NO: 2380095 - RNA, 19 nt, Bordetella pertussis
ucagcgccgacucgaagaa

SEQ ID NO: 2380096 - RNA, 15 nt, Bordetella pertussis
ucagcgccugcaggu

SEQ ID NO: 2380097 - RNA, 19 nt, Bordetella pertussis
ucagcgccugcaggucuuc

SEQ ID NO: 2380098 - RNA, 16 nt, Bordetella pertussis
ucagcgccuggcuucc

SEQ ID NO: 2380099 - RNA, 21 nt, Bordetella pertussis
ucagcgcgacgaagccggaac

SEQ ID NO: 2380100 - RNA, 17 nt, Bordetella pertussis
ucagcgcgccagcgcgc

SEQ ID NO: 2380101 - RNA, 22 nt, Bordetella pertussis
ucagcgcgcccgcuuccuuggg

SEQ ID NO: 2380102 - RNA, 16 nt, Bordetella pertussis
ucagcgcgccgcgccg

SEQ ID NO: 2380103 - RNA, 12 nt, Bordetella pertussis
ucagcgcgcgcg

SEQ ID NO: 2380104 - RNA, 14 nt, Bordetella pertussis
ucagcgcggcgcac

SEQ ID NO: 2380105 - RNA, 16 nt, Bordetella pertussis
ucagcgcggcgcacag

SEQ ID NO: 2380106 - RNA, 24 nt, Bordetella pertussis
ucagcgcggcgcacagggcgucgc

SEQ ID NO: 2380107 - RNA, 13 nt, Bordetella pertussis
ucagcgcggcgcc

SEQ ID NO: 2380108 - RNA, 16 nt, Bordetella pertussis
ucagcgcggcgccggc

SEQ ID NO: 2380109 - RNA, 19 nt, Bordetella pertussis
ucagcgcggcgccggccuc

SEQ ID NO: 2380110 - RNA, 14 nt, Bordetella pertussis
ucagcgcggcgcgg

SEQ ID NO: 2380111 - RNA, 15 nt, Bordetella pertussis
ucagcgcggcgcggc

SEQ ID NO: 2380112 - RNA, 19 nt, Bordetella pertussis
ucagcgcggcgcggccagc

SEQ ID NO: 2380113 - RNA, 22 nt, Bordetella pertussis
ucagcgcggcgcggccagcagc

SEQ ID NO: 2380114 - RNA, 22 nt, Bordetella pertussis
ucagcggauugaccagcgcggc

SEQ ID NO: 2380115 - RNA, 12 nt, Bordetella pertussis
ucagcggcagca

SEQ ID NO: 2380116 - RNA, 15 nt, Bordetella pertussis
ucagcggcagcacga

SEQ ID NO: 2380117 - RNA, 16 nt, Bordetella pertussis
ucagcggcagcacgau

SEQ ID NO: 2380118 - RNA, 14 nt, Bordetella pertussis
ucagcggccgcugc

SEQ ID NO: 2380119 - RNA, 22 nt, Bordetella pertussis
ucagcggccgcugccgcgcgcc

SEQ ID NO: 2380120 - RNA, 12 nt, Bordetella pertussis
ucagcggccggc

SEQ ID NO: 2380121 - RNA, 13 nt, Bordetella pertussis
ucagcggccggcc

SEQ ID NO: 2380122 - RNA, 21 nt, Bordetella pertussis
ucagcggccggcccgugcgca

SEQ ID NO: 2380123 - RNA, 11 nt, Bordetella pertussis
ucagcggcgcg

SEQ ID NO: 2380124 - RNA, 14 nt, Bordetella pertussis
ucagcggcgcgccc

SEQ ID NO: 2380125 - RNA, 19 nt, Bordetella pertussis
ucagcggcggcacgcgcgc

SEQ ID NO: 2380126 - RNA, 17 nt, Bordetella pertussis
ucauccuggucgacgcg

SEQ ID NO: 2380127 - RNA, 17 nt, Bordetella pertussis
ucaucgaccaccagcgg

SEQ ID NO: 2380128 - RNA, 14 nt, Bordetella pertussis
ucaucgagcaccgc

SEQ ID NO: 2380129 - RNA, 19 nt, Bordetella pertussis
ucaucgagcauugccgcgg

SEQ ID NO: 2380130 - RNA, 18 nt, Bordetella pertussis
ucaucgaugcgccgcacc

SEQ ID NO: 2380131 - RNA, 14 nt, Bordetella pertussis
ucaucgccgacgcg

SEQ ID NO: 2380132 - RNA, 17 nt, Bordetella pertussis
ucaucgcgcuggcgcgc

SEQ ID NO: 2380133 - RNA, 17 nt, Bordetella pertussis
ucaucggcaggccggcg

SEQ ID NO: 2380134 - RNA, 12 nt, Bordetella pertussis
ucaucggcccga

SEQ ID NO: 2380135 - RNA, 13 nt, Bordetella pertussis
ucaucggcgcgca

SEQ ID NO: 2380136 - RNA, 14 nt, Bordetella pertussis
ucaucgggccggcg

SEQ ID NO: 2380137 - RNA, 17 nt, Bordetella pertussis
ucaucgggugcggcgcc

SEQ ID NO: 2380138 - RNA, 10 nt, Bordetella pertussis
ucaucgucau

SEQ ID NO: 2380139 - RNA, 13 nt, Bordetella pertussis
ucaucgugcucgu

SEQ ID NO: 2380140 - RNA, 15 nt, Bordetella pertussis
ucaugaacgucaccc

SEQ ID NO: 2380141 - RNA, 15 nt, Bordetella pertussis
ucaugaccaucgcgc

SEQ ID NO: 2380142 - RNA, 14 nt, Bordetella pertussis
ucaugacgggcggc

SEQ ID NO: 2380143 - RNA, 20 nt, Bordetella pertussis
ucaugaucuggccgaccagc

SEQ ID NO: 2380144 - RNA, 18 nt, Bordetella pertussis
ucaugaugcgcugggcca

SEQ ID NO: 2380145 - RNA, 21 nt, Bordetella pertussis
ucaugaugcgcugggccaggc

SEQ ID NO: 2380146 - RNA, 11 nt, Bordetella pertussis
ucaugcagaac

SEQ ID NO: 2380147 - RNA, 23 nt, Bordetella pertussis
ucaugcccaugccgccaugcagc

SEQ ID NO: 2380148 - RNA, 17 nt, Bordetella pertussis
ucaugcccgccacgguc

SEQ ID NO: 2380149 - RNA, 15 nt, Bordetella pertussis
ucaugccgaacagca

SEQ ID NO: 2380150 - RNA, 16 nt, Bordetella pertussis
ucaugccgaccacggc

SEQ ID NO: 2380151 - RNA, 14 nt, Bordetella pertussis
ucaugccggcaagc

SEQ ID NO: 2380152 - RNA, 19 nt, Bordetella pertussis
ucaugccggcaagcacgaa

SEQ ID NO: 2380153 - RNA, 13 nt, Bordetella pertussis
ucaugccggcguu

SEQ ID NO: 2380154 - RNA, 17 nt, Bordetella pertussis
ucaugcgaaaucuucug

SEQ ID NO: 2380155 - RNA, 21 nt, Bordetella pertussis
ucaugcgccguccucaggccc

SEQ ID NO: 2380156 - RNA, 18 nt, Bordetella pertussis
ucauggcacagcgcggcg

SEQ ID NO: 2380157 - RNA, 21 nt, Bordetella pertussis
ucauggccagccgcuugaagu

SEQ ID NO: 2380158 - RNA, 13 nt, Bordetella pertussis
ucauggccagggc

SEQ ID NO: 2380159 - RNA, 20 nt, Bordetella pertussis
ucauggccuggcccagcucc

SEQ ID NO: 2380160 - RNA, 21 nt, Bordetella pertussis
ucauggcgccgauggcgccgc

SEQ ID NO: 2380161 - RNA, 14 nt, Bordetella pertussis
ucauggcggcaggc

SEQ ID NO: 2380162 - RNA, 18 nt, Bordetella pertussis
ucauggcggcaggcgcga

SEQ ID NO: 2380163 - RNA, 16 nt, Bordetella pertussis
ucauggcgucggccac

SEQ ID NO: 2380164 - RNA, 13 nt, Bordetella pertussis
ucaugggccuggg

SEQ ID NO: 2380165 - RNA, 13 nt, Bordetella pertussis
ucaugggcggcga

SEQ ID NO: 2380166 - RNA, 15 nt, Bordetella pertussis
ucaugggcggcgagc

SEQ ID NO: 2380167 - RNA, 19 nt, Bordetella pertussis
ucauggucgaccagcagcc

SEQ ID NO: 2380168 - RNA, 22 nt, Bordetella pertussis
ucaugguuucgucaccgaacug

SEQ ID NO: 2380169 - RNA, 14 nt, Bordetella pertussis
ucauguagcggccg

SEQ ID NO: 2380170 - RNA, 14 nt, Bordetella pertussis
ucauucggcgcgcu

SEQ ID NO: 2380171 - RNA, 21 nt, Bordetella pertussis
ucauuucggcgccgcgcugau

SEQ ID NO: 2380172 - RNA, 18 nt, Bordetella pertussis
uccaaaacagacaggccg

SEQ ID NO: 2380173 - RNA, 19 nt, Bordetella pertussis
uccaaaacagacaggccgg

SEQ ID NO: 2380174 - RNA, 18 nt, Bordetella pertussis
uccaagcgcguggccauc

SEQ ID NO: 2380175 - RNA, 13 nt, Bordetella pertussis
uccacagccaggc

SEQ ID NO: 2380176 - RNA, 14 nt, Bordetella pertussis
uccacagcccggcc

SEQ ID NO: 2380177 - RNA, 23 nt, Bordetella pertussis
uccacagcccggcccccagccca

SEQ ID NO: 2380178 - RNA, 12 nt, Bordetella pertussis
uccacagcgccg

SEQ ID NO: 2380179 - RNA, 20 nt, Bordetella pertussis
uccacauccgcgcugcugcc

SEQ ID NO: 2380180 - RNA, 23 nt, Bordetella pertussis
uccacauccgcgcugcugccguc

SEQ ID NO: 2380181 - RNA, 13 nt, Bordetella pertussis
uccaccaccaggc

SEQ ID NO: 2380182 - RNA, 12 nt, Bordetella pertussis
uccaccaccauc

SEQ ID NO: 2380183 - RNA, 15 nt, Bordetella pertussis
uccaccacccaggcc

SEQ ID NO: 2380184 - RNA, 15 nt, Bordetella pertussis
uccaccagcaccggc

SEQ ID NO: 2380185 - RNA, 14 nt, Bordetella pertussis
uccaccagccggcc

SEQ ID NO: 2380186 - RNA, 16 nt, Bordetella pertussis
uccaccagccggccgc

SEQ ID NO: 2380187 - RNA, 21 nt, Bordetella pertussis
uccaccccgguguaggcgggc

SEQ ID NO: 2380188 - RNA, 13 nt, Bordetella pertussis
uccaccgccagcc

SEQ ID NO: 2380189 - RNA, 15 nt, Bordetella pertussis
uccaccgccagcccg

SEQ ID NO: 2380190 - RNA, 19 nt, Bordetella pertussis
uccaccgccgaugccgcca

SEQ ID NO: 2380191 - RNA, 13 nt, Bordetella pertussis
uccaccggcgcgc

SEQ ID NO: 2380192 - RNA, 14 nt, Bordetella pertussis
uccaccggcgcgcg

SEQ ID NO: 2380193 - RNA, 14 nt, Bordetella pertussis
uccaccucgucguc

SEQ ID NO: 2380194 - RNA, 22 nt, Bordetella pertussis
uccaccucgucguccagcguca

SEQ ID NO: 2380195 - RNA, 20 nt, Bordetella pertussis
uccaccuugacgcgcaggcc

SEQ ID NO: 2380196 - RNA, 17 nt, Bordetella pertussis
uccacgaugucguccag

SEQ ID NO: 2380197 - RNA, 22 nt, Bordetella pertussis
uccacgaugucguccagcucca

SEQ ID NO: 2380198 - RNA, 19 nt, Bordetella pertussis
uccacgcacaccgcccgaa

SEQ ID NO: 2380199 - RNA, 23 nt, Bordetella pertussis
uccacgcagaaauggaugcgcgc

SEQ ID NO: 2380200 - RNA, 17 nt, Bordetella pertussis
uccacgccacuggccuu

SEQ ID NO: 2380201 - RNA, 16 nt, Bordetella pertussis
uccacgcccagcgccg

SEQ ID NO: 2380202 - RNA, 15 nt, Bordetella pertussis
uccacgcccgcgccg

SEQ ID NO: 2380203 - RNA, 14 nt, Bordetella pertussis
uccacgccgccgac

SEQ ID NO: 2380204 - RNA, 18 nt, Bordetella pertussis
uccacgccgccggccagc

SEQ ID NO: 2380205 - RNA, 13 nt, Bordetella pertussis
uccacgccgcgcg

SEQ ID NO: 2380206 - RNA, 14 nt, Bordetella pertussis
uccacgccgcgcgc

SEQ ID NO: 2380207 - RNA, 14 nt, Bordetella pertussis
uccacgccguggcg

SEQ ID NO: 2380208 - RNA, 23 nt, Bordetella pertussis
uccacgcggccguggcggccugc

SEQ ID NO: 2380209 - RNA, 13 nt, Bordetella pertussis
uccacgcgggcau

SEQ ID NO: 2380210 - RNA, 17 nt, Bordetella pertussis
uccacggcauggccagc

SEQ ID NO: 2380211 - RNA, 14 nt, Bordetella pertussis
uccacggccggcgc

SEQ ID NO: 2380212 - RNA, 16 nt, Bordetella pertussis
uccacggccggcgcac

SEQ ID NO: 2380213 - RNA, 21 nt, Bordetella pertussis
uccacggccggcgcacgccgg

SEQ ID NO: 2380214 - RNA, 13 nt, Bordetella pertussis
uccacggccugcg

SEQ ID NO: 2380215 - RNA, 16 nt, Bordetella pertussis
uccacggucgccggca

SEQ ID NO: 2380216 - RNA, 17 nt, Bordetella pertussis
uccacggucgccggcau

SEQ ID NO: 2380217 - RNA, 20 nt, Bordetella pertussis
uccacgucaguccguggcgc

SEQ ID NO: 2380218 - RNA, 22 nt, Bordetella pertussis
uccacgucaguccguggcgcgg

SEQ ID NO: 2380219 - RNA, 12 nt, Bordetella pertussis
uccacguggcga

SEQ ID NO: 2380220 - RNA, 14 nt, Bordetella pertussis
uccacucggccagc

SEQ ID NO: 2380221 - RNA, 17 nt, Bordetella pertussis
uccacugaaagaaccgc

SEQ ID NO: 2380222 - RNA, 22 nt, Bordetella pertussis
uccacuucaccgcugaucaggu

SEQ ID NO: 2380223 - RNA, 21 nt, Bordetella pertussis
uccacuugcggguccagcagg

SEQ ID NO: 2380224 - RNA, 16 nt, Bordetella pertussis
uccagaacggcgcggg

SEQ ID NO: 2380225 - RNA, 23 nt, Bordetella pertussis
uccagacgauggugccggccguc

SEQ ID NO: 2380226 - RNA, 16 nt, Bordetella pertussis
uccagagucugccugg

SEQ ID NO: 2380227 - RNA, 19 nt, Bordetella pertussis
uccagagucugccuggcga

SEQ ID NO: 2380228 - RNA, 22 nt, Bordetella pertussis
uccagauaugccccuccggguc

SEQ ID NO: 2380229 - RNA, 15 nt, Bordetella pertussis
uccagaugcgcagca

SEQ ID NO: 2380230 - RNA, 19 nt, Bordetella pertussis
uccagaugcgcagcaggcg

SEQ ID NO: 2380231 - RNA, 20 nt, Bordetella pertussis
uccagcacgacgacggccgg

SEQ ID NO: 2380232 - RNA, 17 nt, Bordetella pertussis
uccagcacggccgcggc

SEQ ID NO: 2380233 - RNA, 14 nt, Bordetella pertussis
uccagcacggcgag

SEQ ID NO: 2380234 - RNA, 16 nt, Bordetella pertussis
uccagcacggcgagga

SEQ ID NO: 2380235 - RNA, 19 nt, Bordetella pertussis
uccagcacggcgaggaugc

SEQ ID NO: 2380236 - RNA, 17 nt, Bordetella pertussis
uccagcagaucgcggcg

SEQ ID NO: 2380237 - RNA, 21 nt, Bordetella pertussis
uccagcagauucaugggcggc

SEQ ID NO: 2380238 - RNA, 11 nt, Bordetella pertussis
uccagcagcag

SEQ ID NO: 2380239 - RNA, 15 nt, Bordetella pertussis
uccagcagcagcgcc

SEQ ID NO: 2380240 - RNA, 23 nt, Bordetella pertussis
uccaguugagaaugcccaggaug

SEQ ID NO: 2380241 - RNA, 20 nt, Bordetella pertussis
uccaguugcgcgccgucggc

SEQ ID NO: 2380242 - RNA, 22 nt, Bordetella pertussis
uccauauauauagggccauggc

SEQ ID NO: 2380243 - RNA, 19 nt, Bordetella pertussis
uccaucgccugcacgaccu

SEQ ID NO: 2380244 - RNA, 20 nt, Bordetella pertussis
uccaucgccugcacgaccug

SEQ ID NO: 2380245 - RNA, 17 nt, Bordetella pertussis
uccaucgcgugcagcga

SEQ ID NO: 2380246 - RNA, 13 nt, Bordetella pertussis
uccaucggcgcgc

SEQ ID NO: 2380247 - RNA, 16 nt, Bordetella pertussis
uccaucggggggcagg

SEQ ID NO: 2380248 - RNA, 21 nt, Bordetella pertussis
uccaucggggggcaggcugga

SEQ ID NO: 2380249 - RNA, 17 nt, Bordetella pertussis
uccaucuacgugcugga

SEQ ID NO: 2380250 - RNA, 14 nt, Bordetella pertussis
uccaucuggaccgc

SEQ ID NO: 2380251 - RNA, 18 nt, Bordetella pertussis
uccaucuggaccgcgcgc

SEQ ID NO: 2380252 - RNA, 14 nt, Bordetella pertussis
uccaucuggcccgu

SEQ ID NO: 2380253 - RNA, 17 nt, Bordetella pertussis
uccaucuggcccgucau

SEQ ID NO: 2380254 - RNA, 19 nt, Bordetella pertussis
uccaucugguggugccguu

SEQ ID NO: 2380255 - RNA, 18 nt, Bordetella pertussis
uccaucuugccggccugu

SEQ ID NO: 2380256 - RNA, 23 nt, Bordetella pertussis
uccaucuugccggccuguucuuu

SEQ ID NO: 2380257 - RNA, 16 nt, Bordetella pertussis
uccaugaacgccgcgc

SEQ ID NO: 2380258 - RNA, 22 nt, Bordetella pertussis
uccaugaacgccgcgcccgccc

SEQ ID NO: 2380259 - RNA, 17 nt, Bordetella pertussis
uccaugacggugccgag

SEQ ID NO: 2380260 - RNA, 19 nt, Bordetella pertussis
uccaugacguccagcgcca

SEQ ID NO: 2380261 - RNA, 18 nt, Bordetella pertussis
uccaugaggaacggcacc

SEQ ID NO: 2380262 - RNA, 19 nt, Bordetella pertussis
uccaugaggaacggcacca

SEQ ID NO: 2380263 - RNA, 16 nt, Bordetella pertussis
uccaugcggaggcuuu

SEQ ID NO: 2380264 - RNA, 13 nt, Bordetella pertussis
uccauggccaguc

SEQ ID NO: 2380265 - RNA, 20 nt, Bordetella pertussis
uccauggcgccggcggccuc

SEQ ID NO: 2380266 - RNA, 10 nt, Bordetella pertussis
uccaugguga

SEQ ID NO: 2380267 - RNA, 16 nt, Bordetella pertussis
uccauguaaaaacccg

SEQ ID NO: 2380268 - RNA, 23 nt, Bordetella pertussis
uccauguaaaaacccggccugcg

SEQ ID NO: 2380269 - RNA, 22 nt, Bordetella pertussis
ucccaaaaaaaaaccccgccag

SEQ ID NO: 2380270 - RNA, 18 nt, Bordetella pertussis
ucccaaccagggccgcca

SEQ ID NO: 2380271 - RNA, 18 nt, Bordetella pertussis
ucccaaccgggacaggca

SEQ ID NO: 2380272 - RNA, 19 nt, Bordetella pertussis
ucccaaccgggacaggcac

SEQ ID NO: 2380273 - RNA, 14 nt, Bordetella pertussis
ucccacaggcgcgc

SEQ ID NO: 2380274 - RNA, 20 nt, Bordetella pertussis
ucccacaggcgcgcggcguu

SEQ ID NO: 2380275 - RNA, 14 nt, Bordetella pertussis
ucccagaccugcgc

SEQ ID NO: 2380276 - RNA, 18 nt, Bordetella pertussis
ucccagcaagccgaucaa

SEQ ID NO: 2380277 - RNA, 14 nt, Bordetella pertussis
ucccagccggcccc

SEQ ID NO: 2380278 - RNA, 17 nt, Bordetella pertussis
ucccagcggggacaggc

SEQ ID NO: 2380279 - RNA, 19 nt, Bordetella pertussis
acuggguuuuuccggcucu

SEQ ID NO: 2380280 - RNA, 12 nt, Bordetella pertussis
acugguacagcg

SEQ ID NO: 2380281 - RNA, 20 nt, Bordetella pertussis
acugguagugcggcgccagc

SEQ ID NO: 2380282 - RNA, 19 nt, Bordetella pertussis
acugguccuaaauugccgc

SEQ ID NO: 2380283 - RNA, 22 nt, Bordetella pertussis
acugucggcguuccuggcgcug

SEQ ID NO: 2380284 - RNA, 18 nt, Bordetella pertussis
acuucacgccgaggugga

SEQ ID NO: 2380285 - RNA, 13 nt, Bordetella pertussis
acuuccagcgccc

SEQ ID NO: 2380286 - RNA, 16 nt, Bordetella pertussis
acuuccgcuuccggcc

SEQ ID NO: 2380287 - RNA, 17 nt, Bordetella pertussis
acuuccucgaccagccc

SEQ ID NO: 2380288 - RNA, 19 nt, Bordetella pertussis
acuuccucgaccagcccgg

SEQ ID NO: 2380289 - RNA, 14 nt, Bordetella pertussis
acuuccucgacccg

SEQ ID NO: 2380290 - RNA, 18 nt, Bordetella pertussis
acuuccucggcgcgcgcg

SEQ ID NO: 2380291 - RNA, 19 nt, Bordetella pertussis
acuucgaaaaugacggcga

SEQ ID NO: 2380292 - RNA, 14 nt, Bordetella pertussis
acuucgacccggac

SEQ ID NO: 2380293 - RNA, 21 nt, Bordetella pertussis
acuucgagcgacggcaaugcc

SEQ ID NO: 2380294 - RNA, 18 nt, Bordetella pertussis
acuucgccgaucgagcag

SEQ ID NO: 2380295 - RNA, 21 nt, Bordetella pertussis
acuucgccgaucgagcaggcc

SEQ ID NO: 2380296 - RNA, 17 nt, Bordetella pertussis
acuucgccgucgacguc

SEQ ID NO: 2380297 - RNA, 13 nt, Bordetella pertussis
acuucggcggcca

SEQ ID NO: 2380298 - RNA, 17 nt, Bordetella pertussis
acuucuggggugccugu

SEQ ID NO: 2380299 - RNA, 20 nt, Bordetella pertussis
acuucuugcgcaucggcggc

SEQ ID NO: 2380300 - RNA, 18 nt, Bordetella pertussis
acuugaucagggccacgg

SEQ ID NO: 2380301 - RNA, 18 nt, Bordetella pertussis
acuugccggcgcucagcg

SEQ ID NO: 2380302 - RNA, 21 nt, Bordetella pertussis
acuugccggcgcucagcgacg

SEQ ID NO: 2380303 - RNA, 16 nt, Bordetella pertussis
acuugcgcagcgcggc

SEQ ID NO: 2380304 - RNA, 14 nt, Bordetella pertussis
acuugcggcacgug

SEQ ID NO: 2380305 - RNA, 14 nt, Bordetella pertussis
acuugcggguccag

SEQ ID NO: 2380306 - RNA, 20 nt, Bordetella pertussis
acuugcggguccagcaggau

SEQ ID NO: 2380307 - RNA, 16 nt, Bordetella pertussis
acuugcuccgguacgc

SEQ ID NO: 2380308 - RNA, 19 nt, Bordetella pertussis
acuugcuccgguacgccug

SEQ ID NO: 2380309 - RNA, 19 nt, Bordetella pertussis
acuuggccggcgauugcgc

SEQ ID NO: 2380310 - RNA, 13 nt, Bordetella pertussis
acuugucgcgccc

SEQ ID NO: 2380311 - RNA, 16 nt, Bordetella pertussis
acuugucgcgcccgaa

SEQ ID NO: 2380312 - RNA, 20 nt, Bordetella pertussis
acuuucgcgcgcgccugccc

SEQ ID NO: 2380313 - RNA, 20 nt, Bordetella pertussis
agaaaaaaagcaagacagca

SEQ ID NO: 2380314 - RNA, 15 nt, Bordetella pertussis
agaaaccccagggga

SEQ ID NO: 2380315 - RNA, 17 nt, Bordetella pertussis
agaaaccugaccucgcg

SEQ ID NO: 2380316 - RNA, 13 nt, Bordetella pertussis
agaacaccgccgc

SEQ ID NO: 2380317 - RNA, 15 nt, Bordetella pertussis
agaacaccgccgcgc

SEQ ID NO: 2380318 - RNA, 23 nt, Bordetella pertussis
agaacagcagauggcccuugccc

SEQ ID NO: 2380319 - RNA, 15 nt, Bordetella pertussis
agaacccggccggcg

SEQ ID NO: 2380320 - RNA, 11 nt, Bordetella pertussis
agaaccgccgc

SEQ ID NO: 2380321 - RNA, 20 nt, Bordetella pertussis
agaacgagccggccgcgccc

SEQ ID NO: 2380322 - RNA, 13 nt, Bordetella pertussis
agaacgccagggu

SEQ ID NO: 2380323 - RNA, 14 nt, Bordetella pertussis
agaacucggccgca

SEQ ID NO: 2380324 - RNA, 17 nt, Bordetella pertussis
agaacucgguggcgguc

SEQ ID NO: 2380325 - RNA, 21 nt, Bordetella pertussis
agaacugcucgaccgcuucgg

SEQ ID NO: 2380326 - RNA, 14 nt, Bordetella pertussis
agaagaagccgggc

SEQ ID NO: 2380327 - RNA, 15 nt, Bordetella pertussis
agaagaagccgggcu

SEQ ID NO: 2380328 - RNA, 23 nt, Bordetella pertussis
agaagaucgucgacguccuggug

SEQ ID NO: 2380329 - RNA, 15 nt, Bordetella pertussis
agaagcagccgcgcg

SEQ ID NO: 2380330 - RNA, 19 nt, Bordetella pertussis
agaagccgggcucgcugac

SEQ ID NO: 2380331 - RNA, 14 nt, Bordetella pertussis
agaagcgccgcgcc

SEQ ID NO: 2380332 - RNA, 14 nt, Bordetella pertussis
agaagcugcgugcg

SEQ ID NO: 2380333 - RNA, 14 nt, Bordetella pertussis
agaaggccuuggcc

SEQ ID NO: 2380334 - RNA, 22 nt, Bordetella pertussis
agaaucggggcguagcucagcc

SEQ ID NO: 2380335 - RNA, 12 nt, Bordetella pertussis
agaauggcgcgg

SEQ ID NO: 2380336 - RNA, 13 nt, Bordetella pertussis
agacaggcgcgcc

SEQ ID NO: 2380337 - RNA, 17 nt, Bordetella pertussis
agacaggcgcgccaucc

SEQ ID NO: 2380338 - RNA, 21 nt, Bordetella pertussis
agacaugcucgaugccggccu

SEQ ID NO: 2380339 - RNA, 22 nt, Bordetella pertussis
agacaugcucgaugccggccuc

SEQ ID NO: 2380340 - RNA, 23 nt, Bordetella pertussis
agacaugcucgaugccggccucg

SEQ ID NO: 2380341 - RNA, 13 nt, Bordetella pertussis
agacauggcgcgc

SEQ ID NO: 2380342 - RNA, 16 nt, Bordetella pertussis
agacauggcgcgcgcc

SEQ ID NO: 2380343 - RNA, 19 nt, Bordetella pertussis
agacauugcccagcaccac

SEQ ID NO: 2380344 - RNA, 20 nt, Bordetella pertussis
agacauugucaagcagcgcc

SEQ ID NO: 2380345 - RNA, 13 nt, Bordetella pertussis
agaccaagcugcg

SEQ ID NO: 2380346 - RNA, 20 nt, Bordetella pertussis
agaccaagcugcgcgaggac

SEQ ID NO: 2380347 - RNA, 13 nt, Bordetella pertussis
agaccaccagcag

SEQ ID NO: 2380348 - RNA, 20 nt, Bordetella pertussis
agaccacgauggccggcgcg

SEQ ID NO: 2380349 - RNA, 18 nt, Bordetella pertussis
agaccacgccggcgguca

SEQ ID NO: 2380350 - RNA, 19 nt, Bordetella pertussis
agaccacgcgcugcgcgcc

SEQ ID NO: 2380351 - RNA, 17 nt, Bordetella pertussis
agaccagcaccggcacg

SEQ ID NO: 2380352 - RNA, 22 nt, Bordetella pertussis
agaccagcagcggguugcgcgc

SEQ ID NO: 2380353 - RNA, 19 nt, Bordetella pertussis
uccccgccgggacaggcac

SEQ ID NO: 2380354 - RNA, 15 nt, Bordetella pertussis
uccccgcggggacag

SEQ ID NO: 2380355 - RNA, 16 nt, Bordetella pertussis
uccccgcggggacaga

SEQ ID NO: 2380356 - RNA, 16 nt, Bordetella pertussis
uccccgcggggacagg

SEQ ID NO: 2380357 - RNA, 17 nt, Bordetella pertussis
uccccgcggggacaggc

SEQ ID NO: 2380358 - RNA, 18 nt, Bordetella pertussis
uccccgcggggacaggca

SEQ ID NO: 2380359 - RNA, 21 nt, Bordetella pertussis
uccccgcggggacaggcaccc

SEQ ID NO: 2380360 - RNA, 23 nt, Bordetella pertussis
uccccgcggggacaggcaccgcc

SEQ ID NO: 2380361 - RNA, 16 nt, Bordetella pertussis
uccccgcggggacugg

SEQ ID NO: 2380362 - RNA, 17 nt, Bordetella pertussis
uccccgcgugccugucc

SEQ ID NO: 2380363 - RNA, 14 nt, Bordetella pertussis
uccccgcugaccug

SEQ ID NO: 2380364 - RNA, 14 nt, Bordetella pertussis
uccccgcugcggca

SEQ ID NO: 2380365 - RNA, 16 nt, Bordetella pertussis
uccccgcugcggcaag

SEQ ID NO: 2380366 - RNA, 19 nt, Bordetella pertussis
uccccgcugggacaggcac

SEQ ID NO: 2380367 - RNA, 14 nt, Bordetella pertussis
uccccgggcaccau

SEQ ID NO: 2380368 - RNA, 22 nt, Bordetella pertussis
uccccgggcgugaccagcugca

SEQ ID NO: 2380369 - RNA, 17 nt, Bordetella pertussis
uccccgucggcggcaag

SEQ ID NO: 2380370 - RNA, 17 nt, Bordetella pertussis
uccccgucgggacaggc

SEQ ID NO: 2380371 - RNA, 16 nt, Bordetella pertussis
uccccguggggacaga

SEQ ID NO: 2380372 - RNA, 17 nt, Bordetella pertussis
uccccguggggacaggc

SEQ ID NO: 2380373 - RNA, 18 nt, Bordetella pertussis
uccccguggggacaggca

SEQ ID NO: 2380374 - RNA, 19 nt, Bordetella pertussis
uccccguggggacaggcac

SEQ ID NO: 2380375 - RNA, 20 nt, Bordetella pertussis
uccccguggggacaggcacc

SEQ ID NO: 2380376 - RNA, 16 nt, Bordetella pertussis
uccccguucggggaca

SEQ ID NO: 2380377 - RNA, 19 nt, Bordetella pertussis
uccccguucggggacaggc

SEQ ID NO: 2380378 - RNA, 20 nt, Bordetella pertussis
uccccguucggggacaggca

SEQ ID NO: 2380379 - RNA, 22 nt, Bordetella pertussis
uccccguucggggacaggcacc

SEQ ID NO: 2380380 - RNA, 18 nt, Bordetella pertussis
uccccugcggggacaggc

SEQ ID NO: 2380381 - RNA, 22 nt, Bordetella pertussis
uccccugcggggacaggcaccc

SEQ ID NO: 2380382 - RNA, 17 nt, Bordetella pertussis
uccccuucucggccguc

SEQ ID NO: 2380383 - RNA, 14 nt, Bordetella pertussis
ucccgacgaggccg

SEQ ID NO: 2380384 - RNA, 19 nt, Bordetella pertussis
ucccgacggggacaggcuc

SEQ ID NO: 2380385 - RNA, 17 nt, Bordetella pertussis
ucccgauuucggagcgg

SEQ ID NO: 2380386 - RNA, 20 nt, Bordetella pertussis
ucccgcaccgaccagcgcgc

SEQ ID NO: 2380387 - RNA, 12 nt, Bordetella pertussis
ucccgcaccggg

SEQ ID NO: 2380388 - RNA, 14 nt, Bordetella pertussis
ucccgcaccgggca

SEQ ID NO: 2380389 - RNA, 16 nt, Bordetella pertussis
ucccgcaggcccacaa

SEQ ID NO: 2380390 - RNA, 18 nt, Bordetella pertussis
ucccgcaugaccugcagg

SEQ ID NO: 2380391 - RNA, 17 nt, Bordetella pertussis
ucccgcccugacgccug

SEQ ID NO: 2380392 - RNA, 16 nt, Bordetella pertussis
ucccgccgcccggccg

SEQ ID NO: 2380393 - RNA, 18 nt, Bordetella pertussis
ucccgccgcccggccggc

SEQ ID NO: 2380394 - RNA, 22 nt, Bordetella pertussis
ucccgccgggccaaggugccug

SEQ ID NO: 2380395 - RNA, 20 nt, Bordetella pertussis
ucccgccgggcuccucgccc

SEQ ID NO: 2380396 - RNA, 16 nt, Bordetella pertussis
ucccgcgcacgcgcuu

SEQ ID NO: 2380397 - RNA, 17 nt, Bordetella pertussis
ucccgcgccuaucaggc

SEQ ID NO: 2380398 - RNA, 13 nt, Bordetella pertussis
ucccgcgcugccg

SEQ ID NO: 2380399 - RNA, 14 nt, Bordetella pertussis
ucccgcuggcggca

SEQ ID NO: 2380400 - RNA, 15 nt, Bordetella pertussis
ucccggaccgcgcug

SEQ ID NO: 2380401 - RNA, 19 nt, Bordetella pertussis
ucccggaugcgauaucccg

SEQ ID NO: 2380402 - RNA, 18 nt, Bordetella pertussis
ucccggccaggcgccggc

SEQ ID NO: 2380403 - RNA, 20 nt, Bordetella pertussis
ucccggccaggcgccggcgg

SEQ ID NO: 2380404 - RNA, 22 nt, Bordetella pertussis
ucccggccgaaaccgccgcggc

SEQ ID NO: 2380405 - RNA, 12 nt, Bordetella pertussis
ucccggcgccag

SEQ ID NO: 2380406 - RNA, 12 nt, Bordetella pertussis
ucccggcgcgga

SEQ ID NO: 2380407 - RNA, 18 nt, Bordetella pertussis
ucccggcgcuggccgcca

SEQ ID NO: 2380408 - RNA, 17 nt, Bordetella pertussis
ucccggcggggacaggc

SEQ ID NO: 2380409 - RNA, 18 nt, Bordetella pertussis
ucccggcggggacaggcg

SEQ ID NO: 2380410 - RNA, 19 nt, Bordetella pertussis
ucccggcggggacaggcgc

SEQ ID NO: 2380411 - RNA, 17 nt, Bordetella pertussis
ucccggcggggcaggcg

SEQ ID NO: 2380412 - RNA, 19 nt, Bordetella pertussis
ucccggcggggcaggcgcc

SEQ ID NO: 2380413 - RNA, 15 nt, Bordetella pertussis
ucccggguggcgcca

SEQ ID NO: 2380414 - RNA, 16 nt, Bordetella pertussis
ucccggguggcgccau

SEQ ID NO: 2380415 - RNA, 15 nt, Bordetella pertussis
ucccgucauggcggc

SEQ ID NO: 2380416 - RNA, 19 nt, Bordetella pertussis
ucccgucauggcggcaggc

SEQ ID NO: 2380417 - RNA, 22 nt, Bordetella pertussis
ucccuacccgccgggcggcgcc

SEQ ID NO: 2380418 - RNA, 22 nt, Bordetella pertussis
ucccucgcccagcgagccggcc

SEQ ID NO: 2380419 - RNA, 16 nt, Bordetella pertussis
ucccucggugcugcug

SEQ ID NO: 2380420 - RNA, 18 nt, Bordetella pertussis
ucccucggugcugcuguu

SEQ ID NO: 2380421 - RNA, 23 nt, Bordetella pertussis
ucccugaacguggcguccacgcg

SEQ ID NO: 2380422 - RNA, 20 nt, Bordetella pertussis
ucccugccgggacaggcacc

SEQ ID NO: 2380423 - RNA, 18 nt, Bordetella pertussis
ucccugcggggacuggcu

SEQ ID NO: 2380424 - RNA, 17 nt, Bordetella pertussis
ucccugcgggggcaggc

SEQ ID NO: 2380425 - RNA, 17 nt, Bordetella pertussis
ucccugcuugcgcggac

SEQ ID NO: 2380426 - RNA, 16 nt, Bordetella pertussis
ucccuggcgcgccagc

SEQ ID NO: 2380427 - RNA, 13 nt, Bordetella pertussis
ucccugguccagc

SEQ ID NO: 2380428 - RNA, 15 nt, Bordetella pertussis
ucccugguccagcag

SEQ ID NO: 2380429 - RNA, 17 nt, Bordetella pertussis
ucccugguccagcagcg

SEQ ID NO: 2380430 - RNA, 15 nt, Bordetella pertussis
ucccugugggggaca

SEQ ID NO: 2380431 - RNA, 19 nt, Bordetella pertussis
ucccuugagcguggcgucc

SEQ ID NO: 2380432 - RNA, 21 nt, Bordetella pertussis
ucccuuggucgguaugccguc

SEQ ID NO: 2380433 - RNA, 19 nt, Bordetella pertussis
uccgaaccacccggccauc

SEQ ID NO: 2380434 - RNA, 18 nt, Bordetella pertussis
uccgaacgcgacagcgcu

SEQ ID NO: 2380435 - RNA, 19 nt, Bordetella pertussis
uccgaacgcgacagcgcug

SEQ ID NO: 2380436 - RNA, 20 nt, Bordetella pertussis
uccgacaccgucaggaagcc

SEQ ID NO: 2380437 - RNA, 15 nt, Bordetella pertussis
uccgacagauggcgc

SEQ ID NO: 2380438 - RNA, 13 nt, Bordetella pertussis
uccgacaggcgcc

SEQ ID NO: 2380439 - RNA, 16 nt, Bordetella pertussis
uccgacaggcgccgca

SEQ ID NO: 2380440 - RNA, 19 nt, Bordetella pertussis
uccgagauggccuuuucca

SEQ ID NO: 2380441 - RNA, 14 nt, Bordetella pertussis
uccgagcccgacgc

SEQ ID NO: 2380442 - RNA, 18 nt, Bordetella pertussis
uccgagcgggcccgacag

SEQ ID NO: 2380443 - RNA, 22 nt, Bordetella pertussis
uccgagggacaccgcaggugcc

SEQ ID NO: 2380444 - RNA, 15 nt, Bordetella pertussis
uccgaucagcacgau

SEQ ID NO: 2380445 - RNA, 17 nt, Bordetella pertussis
uccgaucagcugcggcc

SEQ ID NO: 2380446 - RNA, 17 nt, Bordetella pertussis
uccgaugaugcccagga

SEQ ID NO: 2380447 - RNA, 16 nt, Bordetella pertussis
uccgaugcugguguga

SEQ ID NO: 2380448 - RNA, 22 nt, Bordetella pertussis
uccgaugcuggugugaaugaac

SEQ ID NO: 2380449 - RNA, 23 nt, Bordetella pertussis
uccgauggcgauguaggccaggu

SEQ ID NO: 2380450 - RNA, 18 nt, Bordetella pertussis
uccgcaacccagcagcgg

SEQ ID NO: 2380451 - RNA, 22 nt, Bordetella pertussis
uccgcacccgguauccgcgcau

SEQ ID NO: 2380452 - RNA, 11 nt, Bordetella pertussis
uccgcaccggc

SEQ ID NO: 2380453 - RNA, 22 nt, Bordetella pertussis
uccgcaccggugggagccaguc

SEQ ID NO: 2380454 - RNA, 17 nt, Bordetella pertussis
uccgcagcgcagcgcca

SEQ ID NO: 2380455 - RNA, 22 nt, Bordetella pertussis
uccgcagcgcagcgccacgcug

SEQ ID NO: 2380456 - RNA, 12 nt, Bordetella pertussis
uccgcagguagu

SEQ ID NO: 2380457 - RNA, 19 nt, Bordetella pertussis
uccgcaucgcgcaagggcc

SEQ ID NO: 2380458 - RNA, 16 nt, Bordetella pertussis
uccgccacccuggcac

SEQ ID NO: 2380459 - RNA, 19 nt, Bordetella pertussis
uccgccacccuggcacgcu

SEQ ID NO: 2380460 - RNA, 14 nt, Bordetella pertussis
uccgccaccgcgcc

SEQ ID NO: 2380461 - RNA, 16 nt, Bordetella pertussis
uccgccauaugcgcga

SEQ ID NO: 2380462 - RNA, 18 nt, Bordetella pertussis
uccgccauaugcgcgaag

SEQ ID NO: 2380463 - RNA, 23 nt, Bordetella pertussis
uccgccauaugcgcgaaguggcc

SEQ ID NO: 2380464 - RNA, 17 nt, Bordetella pertussis
uccgccaugcggcgcca

SEQ ID NO: 2380465 - RNA, 18 nt, Bordetella pertussis
uccgccauggaggcgcag

SEQ ID NO: 2380466 - RNA, 20 nt, Bordetella pertussis
uccgucgggcaagcggcgua

SEQ ID NO: 2380467 - RNA, 17 nt, Bordetella pertussis
uccgugagugcagcgcu

SEQ ID NO: 2380468 - RNA, 13 nt, Bordetella pertussis
uccgugcaucggc

SEQ ID NO: 2380469 - RNA, 18 nt, Bordetella pertussis
uccgugcaucggcacggg

SEQ ID NO: 2380470 - RNA, 14 nt, Bordetella pertussis
uccgugcggcgcgc

SEQ ID NO: 2380471 - RNA, 20 nt, Bordetella pertussis
uccguggcggccgcgggcag

SEQ ID NO: 2380472 - RNA, 15 nt, Bordetella pertussis
uccuaucuuucgggc

SEQ ID NO: 2380473 - RNA, 20 nt, Bordetella pertussis
uccuaucuuucgggcgcggg

SEQ ID NO: 2380474 - RNA, 18 nt, Bordetella pertussis
uccucaugcgggacaggc

SEQ ID NO: 2380475 - RNA, 20 nt, Bordetella pertussis
uccucccagaccugcgcgcc

SEQ ID NO: 2380476 - RNA, 18 nt, Bordetella pertussis
uccuccccaacggggacg

SEQ ID NO: 2380477 - RNA, 16 nt, Bordetella pertussis
uccuccgacaggcgcc

SEQ ID NO: 2380478 - RNA, 14 nt, Bordetella pertussis
uccuccugccggcg

SEQ ID NO: 2380479 - RNA, 17 nt, Bordetella pertussis
uccucgaacaggccauc

SEQ ID NO: 2380480 - RNA, 18 nt, Bordetella pertussis
uccucgaccagcccggcc

SEQ ID NO: 2380481 - RNA, 23 nt, Bordetella pertussis
uccucgaccagcccggccgccag

SEQ ID NO: 2380482 - RNA, 15 nt, Bordetella pertussis
uccucgaccaggucc

SEQ ID NO: 2380483 - RNA, 15 nt, Bordetella pertussis
uccucgacccgaagg

SEQ ID NO: 2380484 - RNA, 22 nt, Bordetella pertussis
uccucgacccgcgccucggcau

SEQ ID NO: 2380485 - RNA, 23 nt, Bordetella pertussis
uccucgacguaagugcccaggcc

SEQ ID NO: 2380486 - RNA, 12 nt, Bordetella pertussis
uccucgcaggaa

SEQ ID NO: 2380487 - RNA, 13 nt, Bordetella pertussis
uccucgccagcgg

SEQ ID NO: 2380488 - RNA, 17 nt, Bordetella pertussis
uccucgccagcggcagc

SEQ ID NO: 2380489 - RNA, 21 nt, Bordetella pertussis
uccucgcccgaccugcuggcg

SEQ ID NO: 2380490 - RNA, 22 nt, Bordetella pertussis
uccucgccgacgaaagcggcaa

SEQ ID NO: 2380491 - RNA, 14 nt, Bordetella pertussis
uccucgccgcccag

SEQ ID NO: 2380492 - RNA, 20 nt, Bordetella pertussis
uccucgccgcccagccggcc

SEQ ID NO: 2380493 - RNA, 11 nt, Bordetella pertussis
uccucgcugcc

SEQ ID NO: 2380494 - RNA, 19 nt, Bordetella pertussis
uccucgcuuuaccagcugu

SEQ ID NO: 2380495 - RNA, 19 nt, Bordetella pertussis
uccucggcacggccagcau

SEQ ID NO: 2380496 - RNA, 14 nt, Bordetella pertussis
uccucggccacguc

SEQ ID NO: 2380497 - RNA, 18 nt, Bordetella pertussis
uccucggccacgucggcg

SEQ ID NO: 2380498 - RNA, 13 nt, Bordetella pertussis
uccucggccagcc

SEQ ID NO: 2380499 - RNA, 14 nt, Bordetella pertussis
uccucggccagguc

SEQ ID NO: 2380500 - RNA, 19 nt, Bordetella pertussis
uccucggccaggucgcgca

SEQ ID NO: 2380501 - RNA, 14 nt, Bordetella pertussis
uccucggccuggcc

SEQ ID NO: 2380502 - RNA, 15 nt, Bordetella pertussis
uccucggccuggccc

SEQ ID NO: 2380503 - RNA, 16 nt, Bordetella pertussis
uccucggccuggcccc

SEQ ID NO: 2380504 - RNA, 13 nt, Bordetella pertussis
uccucggcgcgcg

SEQ ID NO: 2380505 - RNA, 13 nt, Bordetella pertussis
uccucgucggcca

SEQ ID NO: 2380506 - RNA, 14 nt, Bordetella pertussis
uccucguugcccgc

SEQ ID NO: 2380507 - RNA, 21 nt, Bordetella pertussis
uccugaacgacgguacaccug

SEQ ID NO: 2380508 - RNA, 14 nt, Bordetella pertussis
uccugaacgccgcg

SEQ ID NO: 2380509 - RNA, 15 nt, Bordetella pertussis
uccugaacgccgggc

SEQ ID NO: 2380510 - RNA, 14 nt, Bordetella pertussis
uccugaggccaggc

SEQ ID NO: 2380511 - RNA, 15 nt, Bordetella pertussis
uccugcaaccagcuc

SEQ ID NO: 2380512 - RNA, 17 nt, Bordetella pertussis
uccugcaacuggugcac

SEQ ID NO: 2380513 - RNA, 19 nt, Bordetella pertussis
uccugcaacuggugcacga

SEQ ID NO: 2380514 - RNA, 16 nt, Bordetella pertussis
uccugcaaggccggcg

SEQ ID NO: 2380515 - RNA, 22 nt, Bordetella pertussis
uccugcaaggccggcggcacgc

SEQ ID NO: 2380516 - RNA, 19 nt, Bordetella pertussis
uccugcaccucaggaugcc

SEQ ID NO: 2380517 - RNA, 15 nt, Bordetella pertussis
uccugcacgcgggcc

SEQ ID NO: 2380518 - RNA, 20 nt, Bordetella pertussis
uccugcagcacgcuggccuu

SEQ ID NO: 2380519 - RNA, 18 nt, Bordetella pertussis
uccugcagguccugguag

SEQ ID NO: 2380520 - RNA, 20 nt, Bordetella pertussis
uccugcaucgccaugccggc

SEQ ID NO: 2380521 - RNA, 16 nt, Bordetella pertussis
uccugccaggcgccgc

SEQ ID NO: 2380522 - RNA, 15 nt, Bordetella pertussis
uccugccaguugccg

SEQ ID NO: 2380523 - RNA, 17 nt, Bordetella pertussis
uccugccauugcgcggc

SEQ ID NO: 2380524 - RNA, 21 nt, Bordetella pertussis
uccugccauugcgcggccugc

SEQ ID NO: 2380525 - RNA, 18 nt, Bordetella pertussis
uccugccgcacuucgggc

SEQ ID NO: 2380526 - RNA, 14 nt, Bordetella pertussis
uccugccgcgaccc

SEQ ID NO: 2380527 - RNA, 24 nt, Bordetella pertussis
uccugccggggcacccaggcgggc

SEQ ID NO: 2380528 - RNA, 17 nt, Bordetella pertussis
uccugcgaggacagggg

SEQ ID NO: 2380529 - RNA, 14 nt, Bordetella pertussis
uccugcggcgcggu

SEQ ID NO: 2380530 - RNA, 19 nt, Bordetella pertussis
uccugcucggugcucuggc

SEQ ID NO: 2380531 - RNA, 14 nt, Bordetella pertussis
uccugcugacaggc

SEQ ID NO: 2380532 - RNA, 16 nt, Bordetella pertussis
uccugcugcgccuggc

SEQ ID NO: 2380533 - RNA, 17 nt, Bordetella pertussis
uccugcugcgccuggcg

SEQ ID NO: 2380534 - RNA, 19 nt, Bordetella pertussis
uccugcuggaccugcuguu

SEQ ID NO: 2380535 - RNA, 12 nt, Bordetella pertussis
uccugcuggcgc

SEQ ID NO: 2380536 - RNA, 15 nt, Bordetella pertussis
uccugcuggcgcguc

SEQ ID NO: 2380537 - RNA, 23 nt, Bordetella pertussis
uccugcuggcgcgucggcgcgcg

SEQ ID NO: 2380538 - RNA, 13 nt, Bordetella pertussis
uccuggacagugc

SEQ ID NO: 2380539 - RNA, 16 nt, Bordetella pertussis
uccuggagacguagcc

SEQ ID NO: 2380540 - RNA, 13 nt, Bordetella pertussis
uccuggcagucag

SEQ ID NO: 2380541 - RNA, 15 nt, Bordetella pertussis
uccuggcagucagcc

SEQ ID NO: 2380542 - RNA, 12 nt, Bordetella pertussis
uccuggcgaccg

SEQ ID NO: 2380543 - RNA, 18 nt, Bordetella pertussis
uccuggcgacggccugcc

SEQ ID NO: 2380544 - RNA, 22 nt, Bordetella pertussis
uccuggcucugaucgcgcugga

SEQ ID NO: 2380545 - RNA, 17 nt, Bordetella pertussis
uccugguaagaaaccug

SEQ ID NO: 2380546 - RNA, 15 nt, Bordetella pertussis
uccugguagccggcg

SEQ ID NO: 2380547 - RNA, 21 nt, Bordetella pertussis
uccugguagccggcgacgugg

SEQ ID NO: 2380548 - RNA, 14 nt, Bordetella pertussis
uccuggucgacgcg

SEQ ID NO: 2380549 - RNA, 18 nt, Bordetella pertussis
uccuggucggcgcggcag

SEQ ID NO: 2380550 - RNA, 21 nt, Bordetella pertussis
uccuggugccaguccccgcau

SEQ ID NO: 2380551 - RNA, 23 nt, Bordetella pertussis
uccugguucaggcgagcggcguc

SEQ ID NO: 2380552 - RNA, 16 nt, Bordetella pertussis
uccugguugccgaagg

SEQ ID NO: 2380553 - RNA, 20 nt, Bordetella pertussis
uccuguucggccacggcugg

SEQ ID NO: 2380554 - RNA, 13 nt, Bordetella pertussis
uccuucagcuuga

SEQ ID NO: 2380555 - RNA, 15 nt, Bordetella pertussis
uccuuccaugaggaa

SEQ ID NO: 2380556 - RNA, 12 nt, Bordetella pertussis
uccuucguggug

SEQ ID NO: 2380557 - RNA, 21 nt, Bordetella pertussis
uccuucugggucggcaugucg

SEQ ID NO: 2380558 - RNA, 14 nt, Bordetella pertussis
uccuugaacgccuu

SEQ ID NO: 2380559 - RNA, 15 nt, Bordetella pertussis
uccuugacgccgccg

SEQ ID NO: 2380560 - RNA, 16 nt, Bordetella pertussis
uccuugacgccgccga

SEQ ID NO: 2380561 - RNA, 20 nt, Bordetella pertussis
uccuugacgccgccgaacgg

SEQ ID NO: 2380562 - RNA, 14 nt, Bordetella pertussis
uccuugagcgccag

SEQ ID NO: 2380563 - RNA, 18 nt, Bordetella pertussis
uccuugccauccagccag

SEQ ID NO: 2380564 - RNA, 21 nt, Bordetella pertussis
uccuugcgcucgcccagcacc

SEQ ID NO: 2380565 - RNA, 16 nt, Bordetella pertussis
uccuuuugcgcggccg

SEQ ID NO: 2380566 - RNA, 13 nt, Bordetella pertussis
ucgaaaccggcgc

SEQ ID NO: 2380567 - RNA, 16 nt, Bordetella pertussis
ucgaacaacagcgccu

SEQ ID NO: 2380568 - RNA, 14 nt, Bordetella pertussis
ucgaacaaggcggu

SEQ ID NO: 2380569 - RNA, 23 nt, Bordetella pertussis
ucgaacaaggcgguggccagcgu

SEQ ID NO: 2380570 - RNA, 15 nt, Bordetella pertussis
ucgaacacgccgacc

SEQ ID NO: 2380571 - RNA, 11 nt, Bordetella pertussis
ucgaacaggcu

SEQ ID NO: 2380572 - RNA, 17 nt, Bordetella pertussis
ucgaacaggcuggcaug

SEQ ID NO: 2380573 - RNA, 18 nt, Bordetella pertussis
ucgaaccacacgaccgag

SEQ ID NO: 2380574 - RNA, 14 nt, Bordetella pertussis
ucgaacccaugcag

SEQ ID NO: 2380575 - RNA, 15 nt, Bordetella pertussis
ucgaacccaugcagu

SEQ ID NO: 2380576 - RNA, 16 nt, Bordetella pertussis
ucgaacgcggccagac

SEQ ID NO: 2380577 - RNA, 23 nt, Bordetella pertussis
ucgaacgcguucaagucgcccug

SEQ ID NO: 2380578 - RNA, 22 nt, Bordetella pertussis
ucgaacgcuuccugggccugcg

SEQ ID NO: 2380579 - RNA, 17 nt, Bordetella pertussis
ucgaacggccgggcgcc

SEQ ID NO: 2380580 - RNA, 22 nt, Bordetella pertussis
ucgagagccugggcgcgcgccc

SEQ ID NO: 2380581 - RNA, 15 nt, Bordetella pertussis
ucgagauccgccggc

SEQ ID NO: 2380582 - RNA, 18 nt, Bordetella pertussis
ucgagauccgccggcgau

SEQ ID NO: 2380583 - RNA, 21 nt, Bordetella pertussis
ucgagcaccaugccggggaac

SEQ ID NO: 2380584 - RNA, 13 nt, Bordetella pertussis
ucgagcaccgccu

SEQ ID NO: 2380585 - RNA, 15 nt, Bordetella pertussis
ucgagcaccuugacg

SEQ ID NO: 2380586 - RNA, 17 nt, Bordetella pertussis
ucgagcacgcggcgcgg

SEQ ID NO: 2380587 - RNA, 17 nt, Bordetella pertussis
ucgagcacggggcuguc

SEQ ID NO: 2380588 - RNA, 17 nt, Bordetella pertussis
ucgagcagcgcaucgau

SEQ ID NO: 2380589 - RNA, 17 nt, Bordetella pertussis
ucgagcaggccgccggg

SEQ ID NO: 2380590 - RNA, 13 nt, Bordetella pertussis
ucgagcaggccgg

SEQ ID NO: 2380591 - RNA, 14 nt, Bordetella pertussis
ucgagcaggccggc

SEQ ID NO: 2380592 - RNA, 14 nt, Bordetella pertussis
ucgagcaggcgcag

SEQ ID NO: 2380593 - RNA, 21 nt, Bordetella pertussis
ucgagcaggcgcaggccgcgc

SEQ ID NO: 2380594 - RNA, 24 nt, Bordetella pertussis
ucgagcaucuggcgcauggccggc

SEQ ID NO: 2380595 - RNA, 16 nt, Bordetella pertussis
ucgagcaugcgggcca

SEQ ID NO: 2380596 - RNA, 17 nt, Bordetella pertussis
ucgagcauugccgcggc

SEQ ID NO: 2380597 - RNA, 19 nt, Bordetella pertussis
ucgagccgcagaacagcag

SEQ ID NO: 2380598 - RNA, 18 nt, Bordetella pertussis
ucgagccggcuccagucc

SEQ ID NO: 2380599 - RNA, 13 nt, Bordetella pertussis
ucgagccgggcca

SEQ ID NO: 2380600 - RNA, 19 nt, Bordetella pertussis
ucgagccgggccacgcgca

SEQ ID NO: 2380601 - RNA, 20 nt, Bordetella pertussis
ucgagccgggccacgcgcac

SEQ ID NO: 2380602 - RNA, 16 nt, Bordetella pertussis
ucgagcgccugcgcca

SEQ ID NO: 2380603 - RNA, 21 nt, Bordetella pertussis
ucgagcgccugggcggccacg

SEQ ID NO: 2380604 - RNA, 22 nt, Bordetella pertussis
ucgagcgcgaaauccagcgcgc

SEQ ID NO: 2380605 - RNA, 16 nt, Bordetella pertussis
ucgagcgcggcgcgcg

SEQ ID NO: 2380606 - RNA, 18 nt, Bordetella pertussis
ucgagcgcggcgcgcgau

SEQ ID NO: 2380607 - RNA, 17 nt, Bordetella pertussis
ucgagcgcggcgcgcgc

SEQ ID NO: 2380608 - RNA, 13 nt, Bordetella pertussis
ucgagcggcagca

SEQ ID NO: 2380609 - RNA, 19 nt, Bordetella pertussis
ucgagcuccugcucgaucc

SEQ ID NO: 2380610 - RNA, 12 nt, Bordetella pertussis
ucgagcuggcug

SEQ ID NO: 2380611 - RNA, 15 nt, Bordetella pertussis
ucgagcuggcuggcc

SEQ ID NO: 2380612 - RNA, 18 nt, Bordetella pertussis
ucgagcuggcuggccagc

SEQ ID NO: 2380613 - RNA, 20 nt, Bordetella pertussis
ucgaggaaccagccgucggc

SEQ ID NO: 2380614 - RNA, 17 nt, Bordetella pertussis
ucgaggaaggcccgcgu

SEQ ID NO: 2380615 - RNA, 17 nt, Bordetella pertussis
ucgaggccaggcugacc

SEQ ID NO: 2380616 - RNA, 23 nt, Bordetella pertussis
ucgaggcgcaguccagcguggag

SEQ ID NO: 2380617 - RNA, 14 nt, Bordetella pertussis
ucgaggcggcgcag

SEQ ID NO: 2380618 - RNA, 17 nt, Bordetella pertussis
ucgaggcguucggccac

SEQ ID NO: 2380619 - RNA, 18 nt, Bordetella pertussis
ucgagguauucgcgcgau

SEQ ID NO: 2380620 - RNA, 19 nt, Bordetella pertussis
ucgaggucgaucucgggau

SEQ ID NO: 2380621 - RNA, 15 nt, Bordetella pertussis
ucgaguggugcgcgg

SEQ ID NO: 2380622 - RNA, 16 nt, Bordetella pertussis
ucgaguuccgcgacgc

SEQ ID NO: 2380623 - RNA, 14 nt, Bordetella pertussis
ucgauacgccgggc

SEQ ID NO: 2380624 - RNA, 23 nt, Bordetella pertussis
ucgauacgccgggcgcguggccc

SEQ ID NO: 2380625 - RNA, 19 nt, Bordetella pertussis
ucgaucaagggguggcugu

SEQ ID NO: 2380626 - RNA, 16 nt, Bordetella pertussis
ucgaucaccaccggca

SEQ ID NO: 2380627 - RNA, 14 nt, Bordetella pertussis
ucgaucacgaagcc

SEQ ID NO: 2380628 - RNA, 17 nt, Bordetella pertussis
ucgaucacgaagcccag

SEQ ID NO: 2380629 - RNA, 21 nt, Bordetella pertussis
ucgaucacgaagcccaguucg

SEQ ID NO: 2380630 - RNA, 15 nt, Bordetella pertussis
ucgaucacggcgcgc

SEQ ID NO: 2380631 - RNA, 21 nt, Bordetella pertussis
ucgaucagccagccggcggcc

SEQ ID NO: 2380632 - RNA, 21 nt, Bordetella pertussis
ucgaucagcgaaugcgacagc

SEQ ID NO: 2380633 - RNA, 15 nt, Bordetella pertussis
ucgaucaggcgcucc

SEQ ID NO: 2380634 - RNA, 15 nt, Bordetella pertussis
ucgaucaggcugucg

SEQ ID NO: 2380635 - RNA, 15 nt, Bordetella pertussis
ucgaucagggcgcgg

SEQ ID NO: 2380636 - RNA, 21 nt, Bordetella pertussis
ucgaucaguaucucggcgccc

SEQ ID NO: 2380637 - RNA, 14 nt, Bordetella pertussis
ucgaucauggccag

SEQ ID NO: 2380638 - RNA, 15 nt, Bordetella pertussis
ucgaucauggccagc

SEQ ID NO: 2380639 - RNA, 22 nt, Bordetella pertussis
ucgaucauggcgccgauggcgc

SEQ ID NO: 2380640 - RNA, 14 nt, Bordetella pertussis
ucgauccagaagau

SEQ ID NO: 2380641 - RNA, 12 nt, Bordetella pertussis
ucgauccggcag

SEQ ID NO: 2380642 - RNA, 18 nt, Bordetella pertussis
ucgauccggcagcagcag

SEQ ID NO: 2380643 - RNA, 23 nt, Bordetella pertussis
ucgauccgggcaccuucgaggaa

SEQ ID NO: 2380644 - RNA, 16 nt, Bordetella pertussis
ucgauccgggccuggc

SEQ ID NO: 2380645 - RNA, 16 nt, Bordetella pertussis
ucgaucgccaccagcg

SEQ ID NO: 2380646 - RNA, 13 nt, Bordetella pertussis
ucgaucgccaggu

SEQ ID NO: 2380647 - RNA, 15 nt, Bordetella pertussis
ucgaucgccgccggc

SEQ ID NO: 2380648 - RNA, 22 nt, Bordetella pertussis
ucgaucgucuugaccagcaggc

SEQ ID NO: 2380649 - RNA, 17 nt, Bordetella pertussis
ucgaucugguuggccac

SEQ ID NO: 2380650 - RNA, 19 nt, Bordetella pertussis
ucgaucuucucgccgcgcg

SEQ ID NO: 2380651 - RNA, 23 nt, Bordetella pertussis
ucgaugaaauauugggcuggucg

SEQ ID NO: 2380652 - RNA, 15 nt, Bordetella pertussis
ucgaugaaggcgccg

SEQ ID NO: 2380653 - RNA, 19 nt, Bordetella pertussis
ucgaugaauuccagccagg

SEQ ID NO: 2380654 - RNA, 13 nt, Bordetella pertussis
ucgaugaccagca

SEQ ID NO: 2380655 - RNA, 21 nt, Bordetella pertussis
ucgaugaucacgcgcuccggc

SEQ ID NO: 2380656 - RNA, 14 nt, Bordetella pertussis
ucgaugaugagcgc

SEQ ID NO: 2380657 - RNA, 19 nt, Bordetella pertussis
ucgaugaugcgguugauca

SEQ ID NO: 2380658 - RNA, 17 nt, Bordetella pertussis
ucgaugcccagcaccgc

SEQ ID NO: 2380659 - RNA, 13 nt, Bordetella pertussis
ucgaugccggccu

SEQ ID NO: 2380660 - RNA, 19 nt, Bordetella pertussis
ucgaugccguacacguugg

SEQ ID NO: 2380661 - RNA, 22 nt, Bordetella pertussis
ucgaugcgcaccaugcgcagca

SEQ ID NO: 2380662 - RNA, 12 nt, Bordetella pertussis
ucgaugcgcgaa

SEQ ID NO: 2380663 - RNA, 15 nt, Bordetella pertussis
ucgaugcgcgaacgg

SEQ ID NO: 2380664 - RNA, 18 nt, Bordetella pertussis
ucgaugcgcgaacgggca

SEQ ID NO: 2380665 - RNA, 21 nt, Bordetella pertussis
ucgaugcgcgcgcggaucgac

SEQ ID NO: 2380666 - RNA, 20 nt, Bordetella pertussis
ucgaugcggucggccgcgcc

SEQ ID NO: 2380667 - RNA, 14 nt, Bordetella pertussis
ucgaugcguccguc

SEQ ID NO: 2380668 - RNA, 16 nt, Bordetella pertussis
ucgaugcuggcgcgga

SEQ ID NO: 2380669 - RNA, 13 nt, Bordetella pertussis
ucgaugcuggcgg

SEQ ID NO: 2380670 - RNA, 17 nt, Bordetella pertussis
ucgaugcuggcggcauc

SEQ ID NO: 2380671 - RNA, 15 nt, Bordetella pertussis
ucgauggcggccagg

SEQ ID NO: 2380672 - RNA, 19 nt, Bordetella pertussis
ucgauggcggccagggcaa

SEQ ID NO: 2380673 - RNA, 21 nt, Bordetella pertussis
ucgauggcuucgcgcacaucc

SEQ ID NO: 2380674 - RNA, 22 nt, Bordetella pertussis
ucgaugggcccgggcaggcuca

SEQ ID NO: 2380675 - RNA, 15 nt, Bordetella pertussis
ucgaugggcgcgcgc

SEQ ID NO: 2380676 - RNA, 21 nt, Bordetella pertussis
ucgauggggucgggccgcgcg

SEQ ID NO: 2380677 - RNA, 22 nt, Bordetella pertussis
ucgauguagagggucuggccgg

SEQ ID NO: 2380678 - RNA, 14 nt, Bordetella pertussis
ucgaugucaucgcc

SEQ ID NO: 2380679 - RNA, 16 nt, Bordetella pertussis
ucgauguccagcgcca

SEQ ID NO: 2380680 - RNA, 17 nt, Bordetella pertussis
ucgauguccagcgccag

SEQ ID NO: 2380681 - RNA, 19 nt, Bordetella pertussis
ucgauguccagcgccagca

SEQ ID NO: 2380682 - RNA, 19 nt, Bordetella pertussis
ucgaugugcaugccgucgc

SEQ ID NO: 2380683 - RNA, 18 nt, Bordetella pertussis
ucgauguggcgcuggcgg

SEQ ID NO: 2380684 - RNA, 18 nt, Bordetella pertussis
ucgauugaccagcaccag

SEQ ID NO: 2380685 - RNA, 15 nt, Bordetella pertussis
ucgauugccuggucg

SEQ ID NO: 2380686 - RNA, 15 nt, Bordetella pertussis
ucgauuucggcggcc

SEQ ID NO: 2380687 - RNA, 18 nt, Bordetella pertussis
ucgauuucggcggccagg

SEQ ID NO: 2380688 - RNA, 19 nt, Bordetella pertussis
ucgauuucggcggccaggc

SEQ ID NO: 2380689 - RNA, 17 nt, Bordetella pertussis
ucgauuucggggcgcga

SEQ ID NO: 2380690 - RNA, 23 nt, Bordetella pertussis
ucgcaacaacggggucaucgcga

SEQ ID NO: 2380691 - RNA, 22 nt, Bordetella pertussis
ucgcaagcggccaugcgccgcu

SEQ ID NO: 2380692 - RNA, 15 nt, Bordetella pertussis
ucgcaagugcuggcc

SEQ ID NO: 2380693 - RNA, 15 nt, Bordetella pertussis
ucgccgcccagccgg

SEQ ID NO: 2380694 - RNA, 13 nt, Bordetella pertussis
ucgccgcccaugc

SEQ ID NO: 2380695 - RNA, 15 nt, Bordetella pertussis
ucgccgcccugcugc

SEQ ID NO: 2380696 - RNA, 17 nt, Bordetella pertussis
ucgccgcccugcugccc

SEQ ID NO: 2380697 - RNA, 19 nt, Bordetella pertussis
ucgccgcccugcugcccgc

SEQ ID NO: 2380698 - RNA, 22 nt, Bordetella pertussis
ucgccgcccugcugcccgccgc

SEQ ID NO: 2380699 - RNA, 17 nt, Bordetella pertussis
ucgccgccgcccgcccg

SEQ ID NO: 2380700 - RNA, 12 nt, Bordetella pertussis
ucgccgccggca

SEQ ID NO: 2380701 - RNA, 20 nt, Bordetella pertussis
ucgccgccguuuucgcccgc

SEQ ID NO: 2380702 - RNA, 17 nt, Bordetella pertussis
ucgccgccugcggcgcg

SEQ ID NO: 2380703 - RNA, 18 nt, Bordetella pertussis
ucgccgcgcacagcccga

SEQ ID NO: 2380704 - RNA, 19 nt, Bordetella pertussis
ucgccgcgcacagcccgau

SEQ ID NO: 2380705 - RNA, 16 nt, Bordetella pertussis
ucgccgcgcacgaugg

SEQ ID NO: 2380706 - RNA, 15 nt, Bordetella pertussis
ucgccgcgcacgggc

SEQ ID NO: 2380707 - RNA, 16 nt, Bordetella pertussis
ucgccgcgcacgggcg

SEQ ID NO: 2380708 - RNA, 23 nt, Bordetella pertussis
ucgccgcgcacgggcgccugucc

SEQ ID NO: 2380709 - RNA, 10 nt, Bordetella pertussis
ucgccgcgcc

SEQ ID NO: 2380710 - RNA, 20 nt, Bordetella pertussis
ucgccgcgccagcugcgcag

SEQ ID NO: 2380711 - RNA, 21 nt, Bordetella pertussis
ucgccgcgcgacagccgcgcc

SEQ ID NO: 2380712 - RNA, 12 nt, Bordetella pertussis
ucgccgcgcgcu

SEQ ID NO: 2380713 - RNA, 19 nt, Bordetella pertussis
ucgccgcgcggcgaggcgu

SEQ ID NO: 2380714 - RNA, 23 nt, Bordetella pertussis
ucgccgcgcggcgaggcguccag

SEQ ID NO: 2380715 - RNA, 13 nt, Bordetella pertussis
ucgccgcggccgg

SEQ ID NO: 2380716 - RNA, 14 nt, Bordetella pertussis
ucgccgcggccggc

SEQ ID NO: 2380717 - RNA, 14 nt, Bordetella pertussis
ucgccgcggcgggc

SEQ ID NO: 2380718 - RNA, 16 nt, Bordetella pertussis
ucgccgcggcgggcga

SEQ ID NO: 2380719 - RNA, 15 nt, Bordetella pertussis
ucgccgcgggccugc

SEQ ID NO: 2380720 - RNA, 16 nt, Bordetella pertussis
ucgccgcuccggcaug

SEQ ID NO: 2380721 - RNA, 18 nt, Bordetella pertussis
ucgccgcugccgggcucg

SEQ ID NO: 2380722 - RNA, 16 nt, Bordetella pertussis
ucgccgcugcgcagca

SEQ ID NO: 2380723 - RNA, 14 nt, Bordetella pertussis
ucgccgcuggccag

SEQ ID NO: 2380724 - RNA, 14 nt, Bordetella pertussis
ucgccgcugucgca

SEQ ID NO: 2380725 - RNA, 15 nt, Bordetella pertussis
ucgccggaggcgcgc

SEQ ID NO: 2380726 - RNA, 16 nt, Bordetella pertussis
ucgccggccagcgcgg

SEQ ID NO: 2380727 - RNA, 17 nt, Bordetella pertussis
ucgccggccagcgcggu

SEQ ID NO: 2380728 - RNA, 13 nt, Bordetella pertussis
ucgccggccaggc

SEQ ID NO: 2380729 - RNA, 20 nt, Bordetella pertussis
ucgccggccaguggcgcggc

SEQ ID NO: 2380730 - RNA, 13 nt, Bordetella pertussis
ucgccggccuggc

SEQ ID NO: 2380731 - RNA, 15 nt, Bordetella pertussis
ucgccggccuggcgc

SEQ ID NO: 2380732 - RNA, 16 nt, Bordetella pertussis
ucgccggccuggcgcg

SEQ ID NO: 2380733 - RNA, 23 nt, Bordetella pertussis
ucgccggccuggcgcgcggccug

SEQ ID NO: 2380734 - RNA, 17 nt, Bordetella pertussis
ucgccggcgaugacggc

SEQ ID NO: 2380735 - RNA, 18 nt, Bordetella pertussis
ucgccggcgcccccagca

SEQ ID NO: 2380736 - RNA, 12 nt, Bordetella pertussis
ucgccggcgccg

SEQ ID NO: 2380737 - RNA, 12 nt, Bordetella pertussis
ucgccggcgcgc

SEQ ID NO: 2380738 - RNA, 14 nt, Bordetella pertussis
ucgccggcgcgcag

SEQ ID NO: 2380739 - RNA, 12 nt, Bordetella pertussis
ucgccggcgcug

SEQ ID NO: 2380740 - RNA, 14 nt, Bordetella pertussis
ucgccggcgcugcg

SEQ ID NO: 2380741 - RNA, 15 nt, Bordetella pertussis
ucgccggcggcgugg

SEQ ID NO: 2380742 - RNA, 16 nt, Bordetella pertussis
ucgccggcuacggcaa

SEQ ID NO: 2380743 - RNA, 18 nt, Bordetella pertussis
ucgccgggcagcgggccg

SEQ ID NO: 2380744 - RNA, 15 nt, Bordetella pertussis
ucgccgggcggcgcg

SEQ ID NO: 2380745 - RNA, 17 nt, Bordetella pertussis
ucgccgggcggcgcggg

SEQ ID NO: 2380746 - RNA, 12 nt, Bordetella pertussis
ucgccggggcgc

SEQ ID NO: 2380747 - RNA, 15 nt, Bordetella pertussis
ucgccggggcgcacc

SEQ ID NO: 2380748 - RNA, 21 nt, Bordetella pertussis
ucgccggggcgcaccggcacg

SEQ ID NO: 2380749 - RNA, 14 nt, Bordetella pertussis
ucgccgguagcgcu

SEQ ID NO: 2380750 - RNA, 21 nt, Bordetella pertussis
ucgccgguagcgcugggcgcc

SEQ ID NO: 2380751 - RNA, 23 nt, Bordetella pertussis
ucgccgguagcgcugggcgccag

SEQ ID NO: 2380752 - RNA, 23 nt, Bordetella pertussis
ucgccggugggauaaggcgugcc

SEQ ID NO: 2380753 - RNA, 22 nt, Bordetella pertussis
ucgccgucaggaucaggccggc

SEQ ID NO: 2380754 - RNA, 15 nt, Bordetella pertussis
ucgccguccaggcgc

SEQ ID NO: 2380755 - RNA, 19 nt, Bordetella pertussis
ucgccgucgacgccgaagg

SEQ ID NO: 2380756 - RNA, 19 nt, Bordetella pertussis
ucgccgucgacgucgguga

SEQ ID NO: 2380757 - RNA, 15 nt, Bordetella pertussis
ucgccgucgcccugg

SEQ ID NO: 2380758 - RNA, 16 nt, Bordetella pertussis
ucgccgucggcauagc

SEQ ID NO: 2380759 - RNA, 14 nt, Bordetella pertussis
ucgccgugcagggc

SEQ ID NO: 2380760 - RNA, 22 nt, Bordetella pertussis
ucgccgugcugggcggccaggc

SEQ ID NO: 2380761 - RNA, 20 nt, Bordetella pertussis
ucgccguucuggcugcgcgc

SEQ ID NO: 2380762 - RNA, 18 nt, Bordetella pertussis
ucgccguucuucgaucgc

SEQ ID NO: 2380763 - RNA, 22 nt, Bordetella pertussis
ucgccuauuuccagggcgucgc

SEQ ID NO: 2380764 - RNA, 14 nt, Bordetella pertussis
ucgccucccauugc

SEQ ID NO: 2380765 - RNA, 15 nt, Bordetella pertussis
ucgccuccccaggcc

SEQ ID NO: 2380766 - RNA, 16 nt, Bordetella pertussis
ucgccuccccaggcca

SEQ ID NO: 2380767 - RNA, 15 nt, Bordetella pertussis
ucgccucgaugaagg

SEQ ID NO: 2380768 - RNA, 19 nt, Bordetella pertussis
ucgccucggcgguugcccg

SEQ ID NO: 2380769 - RNA, 22 nt, Bordetella pertussis
ucgccucggcgguugcccgccc

SEQ ID NO: 2380770 - RNA, 18 nt, Bordetella pertussis
ucgccucggucugcuuca

SEQ ID NO: 2380771 - RNA, 19 nt, Bordetella pertussis
ucgccucguauucgcccgg

SEQ ID NO: 2380772 - RNA, 13 nt, Bordetella pertussis
ucgccuggccggc

SEQ ID NO: 2380773 - RNA, 19 nt, Bordetella pertussis
ucgccuggccggcuugcau

SEQ ID NO: 2380774 - RNA, 23 nt, Bordetella pertussis
ucgccuggggcaguuuccagggc

SEQ ID NO: 2380775 - RNA, 19 nt, Bordetella pertussis
ucgccuggggcgggcgcug

SEQ ID NO: 2380776 - RNA, 20 nt, Bordetella pertussis
ucgccuggggggucaaccag

SEQ ID NO: 2380777 - RNA, 18 nt, Bordetella pertussis
ucgccuguaucagcgccu

SEQ ID NO: 2380778 - RNA, 21 nt, Bordetella pertussis
ucgccuguaucugcgccguga

SEQ ID NO: 2380779 - RNA, 15 nt, Bordetella pertussis
ucgccuugucgggga

SEQ ID NO: 2380780 - RNA, 13 nt, Bordetella pertussis
ucgcgaaagcggc

SEQ ID NO: 2380781 - RNA, 21 nt, Bordetella pertussis
ucgcgaagguguccggaugca

SEQ ID NO: 2380782 - RNA, 13 nt, Bordetella pertussis
ucgcgaccgccgc

SEQ ID NO: 2380783 - RNA, 16 nt, Bordetella pertussis
ucgcgaccgccgccuu

SEQ ID NO: 2380784 - RNA, 17 nt, Bordetella pertussis
ucgcgaccugcgggcgc

SEQ ID NO: 2380785 - RNA, 22 nt, Bordetella pertussis
ucgcgaccugcgggcgcagcgc

SEQ ID NO: 2380786 - RNA, 20 nt, Bordetella pertussis
ucgcgacggccucccgccgc

SEQ ID NO: 2380787 - RNA, 15 nt, Bordetella pertussis
ucgcgauccagcagc

SEQ ID NO: 2380788 - RNA, 15 nt, Bordetella pertussis
ucgcgaugcgcagca

SEQ ID NO: 2380789 - RNA, 13 nt, Bordetella pertussis
ucgcgaugcgcca

SEQ ID NO: 2380790 - RNA, 20 nt, Bordetella pertussis
ucgcgaugcgccaggcgcuc

SEQ ID NO: 2380791 - RNA, 23 nt, Bordetella pertussis
ucgcgaugcgccaggcgcucggc

SEQ ID NO: 2380792 - RNA, 21 nt, Bordetella pertussis
ucgcgauugaguucgcgcgcc

SEQ ID NO: 2380793 - RNA, 15 nt, Bordetella pertussis
ucgcgauuuccauga

SEQ ID NO: 2380794 - RNA, 16 nt, Bordetella pertussis
ucgcgcaagggccagu

SEQ ID NO: 2380795 - RNA, 20 nt, Bordetella pertussis
ucgcgcaauacgccgccggc

SEQ ID NO: 2380796 - RNA, 12 nt, Bordetella pertussis
ucgcgcacagca

SEQ ID NO: 2380797 - RNA, 21 nt, Bordetella pertussis
ucgcgcacauccagccgaugc

SEQ ID NO: 2380798 - RNA, 15 nt, Bordetella pertussis
ucgcgcaccaccugg

SEQ ID NO: 2380799 - RNA, 16 nt, Bordetella pertussis
ucgcgcaccaccuggc

SEQ ID NO: 2380800 - RNA, 17 nt, Bordetella pertussis
ucgcgcaccgaggugcc

SEQ ID NO: 2380801 - RNA, 20 nt, Bordetella pertussis
ucgcgcaccgaggugccggc

SEQ ID NO: 2380802 - RNA, 22 nt, Bordetella pertussis
ucgcgcaccgaggugccggcgg

SEQ ID NO: 2380803 - RNA, 17 nt, Bordetella pertussis
ucgcgcaccgcaugggc

SEQ ID NO: 2380804 - RNA, 21 nt, Bordetella pertussis
ucgcgcaccgcaugggccagg

SEQ ID NO: 2380805 - RNA, 15 nt, Bordetella pertussis
ucgcgcaccgccugc

SEQ ID NO: 2380806 - RNA, 21 nt, Bordetella pertussis
ucgcggcagcccggcacgucg

SEQ ID NO: 2380807 - RNA, 13 nt, Bordetella pertussis
ucgcggccagcgg

SEQ ID NO: 2380808 - RNA, 16 nt, Bordetella pertussis
ucgcggcccugggcca

SEQ ID NO: 2380809 - RNA, 20 nt, Bordetella pertussis
ucgcggcccugggcgcggcg

SEQ ID NO: 2380810 - RNA, 20 nt, Bordetella pertussis
ucgcggccgagcuccucgag

SEQ ID NO: 2380811 - RNA, 13 nt, Bordetella pertussis
ucgcggccgaggc

SEQ ID NO: 2380812 - RNA, 17 nt, Bordetella pertussis
ucgcggccgaggccagc

SEQ ID NO: 2380813 - RNA, 21 nt, Bordetella pertussis
ucgcggccgaggccagcgugc

SEQ ID NO: 2380814 - RNA, 19 nt, Bordetella pertussis
ucgcggccggacagggccg

SEQ ID NO: 2380815 - RNA, 13 nt, Bordetella pertussis
ucgcggccggccg

SEQ ID NO: 2380816 - RNA, 15 nt, Bordetella pertussis
ucgcggccggccugc

SEQ ID NO: 2380817 - RNA, 14 nt, Bordetella pertussis
ucgcggccgucggc

SEQ ID NO: 2380818 - RNA, 13 nt, Bordetella pertussis
ucgcggcgcagcg

SEQ ID NO: 2380819 - RNA, 14 nt, Bordetella pertussis
ucgcggcgcagcgc

SEQ ID NO: 2380820 - RNA, 13 nt, Bordetella pertussis
ucgcggcgcaggc

SEQ ID NO: 2380821 - RNA, 16 nt, Bordetella pertussis
ucgcggcgcggcgcag

SEQ ID NO: 2380822 - RNA, 18 nt, Bordetella pertussis
ucgcggcgcggcgcaggc

SEQ ID NO: 2380823 - RNA, 19 nt, Bordetella pertussis
ucgcggcgcggcgcaggcc

SEQ ID NO: 2380824 - RNA, 13 nt, Bordetella pertussis
ucgcggcgcguau

SEQ ID NO: 2380825 - RNA, 19 nt, Bordetella pertussis
ucgcggcggguggccucgc

SEQ ID NO: 2380826 - RNA, 21 nt, Bordetella pertussis
ucgcggcggguucgcagggcg

SEQ ID NO: 2380827 - RNA, 20 nt, Bordetella pertussis
ucgcggcgucgaccgcgggc

SEQ ID NO: 2380828 - RNA, 15 nt, Bordetella pertussis
ucgcggcuccagcuc

SEQ ID NO: 2380829 - RNA, 14 nt, Bordetella pertussis
ucgcggcugggcaa

SEQ ID NO: 2380830 - RNA, 15 nt, Bordetella pertussis
ucgcggcugggcaau

SEQ ID NO: 2380831 - RNA, 18 nt, Bordetella pertussis
ucgcggcuggucgccguc

SEQ ID NO: 2380832 - RNA, 13 nt, Bordetella pertussis
ucgcgggcagugc

SEQ ID NO: 2380833 - RNA, 15 nt, Bordetella pertussis
ucgcgggccaggccg

SEQ ID NO: 2380834 - RNA, 15 nt, Bordetella pertussis
ucgcgggccuggcgg

SEQ ID NO: 2380835 - RNA, 20 nt, Bordetella pertussis
ucgcgggccuuggccagcag

SEQ ID NO: 2380836 - RNA, 21 nt, Bordetella pertussis
ucgcgggccuuggccagcagc

SEQ ID NO: 2380837 - RNA, 17 nt, Bordetella pertussis
ucgcgguaaccggcgau

SEQ ID NO: 2380838 - RNA, 15 nt, Bordetella pertussis
ucgcgguacaggcug

SEQ ID NO: 2380839 - RNA, 17 nt, Bordetella pertussis
ucgcgguauucggcgac

SEQ ID NO: 2380840 - RNA, 20 nt, Bordetella pertussis
ucgcgguccagcaccagggc

SEQ ID NO: 2380841 - RNA, 20 nt, Bordetella pertussis
ucgcgguccugaccggcggc

SEQ ID NO: 2380842 - RNA, 20 nt, Bordetella pertussis
ucgcggugggcagcggcauc

SEQ ID NO: 2380843 - RNA, 20 nt, Bordetella pertussis
ucgcgguucaggguggccgc

SEQ ID NO: 2380844 - RNA, 16 nt, Bordetella pertussis
ucgcguagcgcggccg

SEQ ID NO: 2380845 - RNA, 17 nt, Bordetella pertussis
ucgcguccaggcccagc

SEQ ID NO: 2380846 - RNA, 20 nt, Bordetella pertussis
ucgcguccgcucaugccggc

SEQ ID NO: 2380847 - RNA, 20 nt, Bordetella pertussis
ucgcgucgacggugcgcgcc

SEQ ID NO: 2380848 - RNA, 16 nt, Bordetella pertussis
ucgcgucggccaaggc

SEQ ID NO: 2380849 - RNA, 17 nt, Bordetella pertussis
ucgcgucggccaaggcc

SEQ ID NO: 2380850 - RNA, 17 nt, Bordetella pertussis
ucgcgucguugcgccga

SEQ ID NO: 2380851 - RNA, 21 nt, Bordetella pertussis
ucgcgucguugcgccgaucgc

SEQ ID NO: 2380852 - RNA, 15 nt, Bordetella pertussis
ucgcuaugcagcugc

SEQ ID NO: 2380853 - RNA, 20 nt, Bordetella pertussis
ucgcuaugcagcugcgccag

SEQ ID NO: 2380854 - RNA, 19 nt, Bordetella pertussis
ucgcucagaagcuguagcg

SEQ ID NO: 2380855 - RNA, 23 nt, Bordetella pertussis
ucgcucauggaggggcgcaggca

SEQ ID NO: 2380856 - RNA, 14 nt, Bordetella pertussis
ucgcuccccgugcg

SEQ ID NO: 2380857 - RNA, 17 nt, Bordetella pertussis
ucgcuccuccccaacgg

SEQ ID NO: 2380858 - RNA, 18 nt, Bordetella pertussis
ucgcucugcgcggcauac

SEQ ID NO: 2380859 - RNA, 12 nt, Bordetella pertussis
ucgcugaccggc

SEQ ID NO: 2380860 - RNA, 22 nt, Bordetella pertussis
ucgcugaccggcguauggcccg

SEQ ID NO: 2380861 - RNA, 15 nt, Bordetella pertussis
ucgcugaucugcuug

SEQ ID NO: 2380862 - RNA, 12 nt, Bordetella pertussis
ucgcugccggcg

SEQ ID NO: 2380863 - RNA, 20 nt, Bordetella pertussis
ucgcugccggcgcccuugau

SEQ ID NO: 2380864 - RNA, 14 nt, Bordetella pertussis
ucgcugccggcguc

SEQ ID NO: 2380865 - RNA, 19 nt, Bordetella pertussis
ucgcugcgcacgcuggcgc

SEQ ID NO: 2380866 - RNA, 21 nt, Bordetella pertussis
ucgcugcgcacgcuggcgccc

SEQ ID NO: 2380867 - RNA, 13 nt, Bordetella pertussis
ucgcugcgcggaa

SEQ ID NO: 2380868 - RNA, 14 nt, Bordetella pertussis
ucgcugcgcggaaa

SEQ ID NO: 2380869 - RNA, 21 nt, Bordetella pertussis
ucgcugcgcgucaaggggcug

SEQ ID NO: 2380870 - RNA, 16 nt, Bordetella pertussis
ucgcugcucgacagca

SEQ ID NO: 2380871 - RNA, 19 nt, Bordetella pertussis
ucgcugcucgacagcagcc

SEQ ID NO: 2380872 - RNA, 21 nt, Bordetella pertussis
ucgcugcucgacagcagcccg

SEQ ID NO: 2380873 - RNA, 17 nt, Bordetella pertussis
ucgcugcugaccgacgg

SEQ ID NO: 2380874 - RNA, 18 nt, Bordetella pertussis
ucgcugcugaccgacggc

SEQ ID NO: 2380875 - RNA, 12 nt, Bordetella pertussis
ucgcugcuggcc

SEQ ID NO: 2380876 - RNA, 15 nt, Bordetella pertussis
ucgcugcuggccgcg

SEQ ID NO: 2380877 - RNA, 12 nt, Bordetella pertussis
ucgcugcuggcg

SEQ ID NO: 2380878 - RNA, 13 nt, Bordetella pertussis
ucgcuggagaccg

SEQ ID NO: 2380879 - RNA, 23 nt, Bordetella pertussis
ucgcuggagaccggcauggugua

SEQ ID NO: 2380880 - RNA, 13 nt, Bordetella pertussis
ucgcuggcagccu

SEQ ID NO: 2380881 - RNA, 23 nt, Bordetella pertussis
ucgcuggcccacucggugcgcgc

SEQ ID NO: 2380882 - RNA, 12 nt, Bordetella pertussis
ucgcuggcgccg

SEQ ID NO: 2380883 - RNA, 18 nt, Bordetella pertussis
ucgcuggcggaccgaacg

SEQ ID NO: 2380884 - RNA, 24 nt, Bordetella pertussis
ucgcugggauggguacgccggccu

SEQ ID NO: 2380885 - RNA, 19 nt, Bordetella pertussis
ucgcugucgugccgcacgg

SEQ ID NO: 2380886 - RNA, 14 nt, Bordetella pertussis
ucgcuuucgguggc

SEQ ID NO: 2380887 - RNA, 16 nt, Bordetella pertussis
ucggaagacauggcgc

SEQ ID NO: 2380888 - RNA, 21 nt, Bordetella pertussis
ucggaagacauggcgcgcgcc

SEQ ID NO: 2380889 - RNA, 22 nt, Bordetella pertussis
ucggaagacauggcgcgcgcca

SEQ ID NO: 2380890 - RNA, 19 nt, Bordetella pertussis
ucggacgagacaggcgcgc

SEQ ID NO: 2380891 - RNA, 20 nt, Bordetella pertussis
ucggacgagacaggcgcgcc

SEQ ID NO: 2380892 - RNA, 21 nt, Bordetella pertussis
ucggacgagacaggcgcgcca

SEQ ID NO: 2380893 - RNA, 22 nt, Bordetella pertussis
ucggacgcaccuuucugcugcu

SEQ ID NO: 2380894 - RNA, 13 nt, Bordetella pertussis
ucggacgccgcgc

SEQ ID NO: 2380895 - RNA, 14 nt, Bordetella pertussis
ucggacgccuggcg

SEQ ID NO: 2380896 - RNA, 13 nt, Bordetella pertussis
ucggacgcgcgcc

SEQ ID NO: 2380897 - RNA, 13 nt, Bordetella pertussis
ucggacgggccga

SEQ ID NO: 2380898 - RNA, 21 nt, Bordetella pertussis
ucggacgggccgaugaagacg

SEQ ID NO: 2380899 - RNA, 23 nt, Bordetella pertussis
ucggacugggucagaacgacgau

SEQ ID NO: 2380900 - RNA, 22 nt, Bordetella pertussis
ucggagaaaucgccgccggcgg

SEQ ID NO: 2380901 - RNA, 15 nt, Bordetella pertussis
ucggagcacggaaga

SEQ ID NO: 2380902 - RNA, 18 nt, Bordetella pertussis
ucggagucggcgccgcgc

SEQ ID NO: 2380903 - RNA, 23 nt, Bordetella pertussis
ucggaguugcccgaaggcagcgg

SEQ ID NO: 2380904 - RNA, 15 nt, Bordetella pertussis
ucggauugcggugcc

SEQ ID NO: 2380905 - RNA, 13 nt, Bordetella pertussis
ucggcaaccgcgc

SEQ ID NO: 2380906 - RNA, 16 nt, Bordetella pertussis
ucggcaaccgucgcca

SEQ ID NO: 2380907 - RNA, 16 nt, Bordetella pertussis
ucggcaaccugcacgc

SEQ ID NO: 2380908 - RNA, 23 nt, Bordetella pertussis
ucggcaaccugcacgcgggcgcu

SEQ ID NO: 2380909 - RNA, 15 nt, Bordetella pertussis
ucggcaaggcgcaca

SEQ ID NO: 2380910 - RNA, 17 nt, Bordetella pertussis
ucggcaccaucguugcc

SEQ ID NO: 2380911 - RNA, 21 nt, Bordetella pertussis
ucggcaccaucguugccuggg

SEQ ID NO: 2380912 - RNA, 14 nt, Bordetella pertussis
ucggcacccagccg

SEQ ID NO: 2380913 - RNA, 16 nt, Bordetella pertussis
ucggcaccgaggccga

SEQ ID NO: 2380914 - RNA, 12 nt, Bordetella pertussis
ucggcaccggca

SEQ ID NO: 2380915 - RNA, 23 nt, Bordetella pertussis
ucggcacgacgcugaugcccagc

SEQ ID NO: 2380916 - RNA, 17 nt, Bordetella pertussis
ucggcagcgaggcgcag

SEQ ID NO: 2380917 - RNA, 20 nt, Bordetella pertussis
ucggcaggagccuguccccg

SEQ ID NO: 2380918 - RNA, 13 nt, Bordetella pertussis
ucggcaggccggc

SEQ ID NO: 2380919 - RNA, 20 nt, Bordetella pertussis
ucggcgacuucggcggccug

SEQ ID NO: 2380920 - RNA, 21 nt, Bordetella pertussis
ucggcgagccgggcaccgagc

SEQ ID NO: 2380921 - RNA, 18 nt, Bordetella pertussis
ucggcgaucugcgcggcg

SEQ ID NO: 2380922 - RNA, 20 nt, Bordetella pertussis
ucggcgaucugggccucggc

SEQ ID NO: 2380923 - RNA, 20 nt, Bordetella pertussis
ucggcgaucuuguaggcgau

SEQ ID NO: 2380924 - RNA, 14 nt, Bordetella pertussis
ucggcgaugaacag

SEQ ID NO: 2380925 - RNA, 22 nt, Bordetella pertussis
ucggcgaugccguacuuggcga

SEQ ID NO: 2380926 - RNA, 13 nt, Bordetella pertussis
ucggcgaugcgcc

SEQ ID NO: 2380927 - RNA, 14 nt, Bordetella pertussis
ucggcgaugcgcga

SEQ ID NO: 2380928 - RNA, 20 nt, Bordetella pertussis
ucggcgaugcgggcggcggu

SEQ ID NO: 2380929 - RNA, 16 nt, Bordetella pertussis
ucggcgauggcgcgcg

SEQ ID NO: 2380930 - RNA, 18 nt, Bordetella pertussis
ucggcgauggcgcgcgcc

SEQ ID NO: 2380931 - RNA, 17 nt, Bordetella pertussis
ucggcgcaaccggcccg

SEQ ID NO: 2380932 - RNA, 20 nt, Bordetella pertussis
ucggcgcaaccggcccgaag

SEQ ID NO: 2380933 - RNA, 15 nt, Bordetella pertussis
ucggcgcaucggcgc

SEQ ID NO: 2380934 - RNA, 20 nt, Bordetella pertussis
ucggcgccaagcggcaggcg

SEQ ID NO: 2380935 - RNA, 22 nt, Bordetella pertussis
ucggcgccacaggugcgcggcg

SEQ ID NO: 2380936 - RNA, 13 nt, Bordetella pertussis
ucggcgccaugau

SEQ ID NO: 2380937 - RNA, 20 nt, Bordetella pertussis
ucggcgccaugaucgccggc

SEQ ID NO: 2380938 - RNA, 13 nt, Bordetella pertussis
ucggcgcccacgc

SEQ ID NO: 2380939 - RNA, 14 nt, Bordetella pertussis
ucggcgcccagcuc

SEQ ID NO: 2380940 - RNA, 15 nt, Bordetella pertussis
ucggcgcccagcugc

SEQ ID NO: 2380941 - RNA, 14 nt, Bordetella pertussis
ucggcgcccgcggc

SEQ ID NO: 2380942 - RNA, 16 nt, Bordetella pertussis
ucggcgcccgcggccu

SEQ ID NO: 2380943 - RNA, 16 nt, Bordetella pertussis
ucggcgcccggcgccg

SEQ ID NO: 2380944 - RNA, 19 nt, Bordetella pertussis
ucggcgcccggcgccgcgc

SEQ ID NO: 2380945 - RNA, 13 nt, Bordetella pertussis
ucggcgccgagca

SEQ ID NO: 2380946 - RNA, 14 nt, Bordetella pertussis
ucggcgccgccggc

SEQ ID NO: 2380947 - RNA, 14 nt, Bordetella pertussis
ucggcgccgcgcag

SEQ ID NO: 2380948 - RNA, 19 nt, Bordetella pertussis
ucggcgccgcgcgcggccc

SEQ ID NO: 2380949 - RNA, 18 nt, Bordetella pertussis
ucggcgccgcgcugaucc

SEQ ID NO: 2380950 - RNA, 22 nt, Bordetella pertussis
ucggcgccgcgcugauccuggc

SEQ ID NO: 2380951 - RNA, 12 nt, Bordetella pertussis
ucggcgccggcg

SEQ ID NO: 2380952 - RNA, 18 nt, Bordetella pertussis
ucggcgccggcggcgcgg

SEQ ID NO: 2380953 - RNA, 20 nt, Bordetella pertussis
ucggcgccggcggcgcggau

SEQ ID NO: 2380954 - RNA, 13 nt, Bordetella pertussis
ucggcgccggcgu

SEQ ID NO: 2380955 - RNA, 16 nt, Bordetella pertussis
ucggcgccggcgucca

SEQ ID NO: 2380956 - RNA, 14 nt, Bordetella pertussis
ucggcgccgggcga

SEQ ID NO: 2380957 - RNA, 15 nt, Bordetella pertussis
ucggcgccgggcgac

SEQ ID NO: 2380958 - RNA, 20 nt, Bordetella pertussis
ucggcgccgggcgacggcgu

SEQ ID NO: 2380959 - RNA, 14 nt, Bordetella pertussis
ucggcgccgggcug

SEQ ID NO: 2380960 - RNA, 14 nt, Bordetella pertussis
ucggcgccuggccg

SEQ ID NO: 2380961 - RNA, 16 nt, Bordetella pertussis
ucggcgccuggccgcc

SEQ ID NO: 2380962 - RNA, 19 nt, Bordetella pertussis
ucggcgccuggccgcccag

SEQ ID NO: 2380963 - RNA, 18 nt, Bordetella pertussis
ucggcgcgcagcagacgc

SEQ ID NO: 2380964 - RNA, 16 nt, Bordetella pertussis
ucggcgcgcccgccac

SEQ ID NO: 2380965 - RNA, 19 nt, Bordetella pertussis
ucggcgcgcccgccacguc

SEQ ID NO: 2380966 - RNA, 23 nt, Bordetella pertussis
ucggcgcgcgcgacuccaccggc

SEQ ID NO: 2380967 - RNA, 14 nt, Bordetella pertussis
ucggcgcgcgcugc

SEQ ID NO: 2380968 - RNA, 19 nt, Bordetella pertussis
ucggcgcgcgcugcacggc

SEQ ID NO: 2380969 - RNA, 20 nt, Bordetella pertussis
ucggcgcgcgcugcacggcc

SEQ ID NO: 2380970 - RNA, 14 nt, Bordetella pertussis
ucggcgcgcgugcc

SEQ ID NO: 2380971 - RNA, 18 nt, Bordetella pertussis
ucggcgcgcgugccgcgc

SEQ ID NO: 2380972 - RNA, 20 nt, Bordetella pertussis
ucggcgcgcgugccgcgcag

SEQ ID NO: 2380973 - RNA, 13 nt, Bordetella pertussis
ucggcgcggcgcc

SEQ ID NO: 2380974 - RNA, 18 nt, Bordetella pertussis
ucggcgcggcgccgucca

SEQ ID NO: 2380975 - RNA, 22 nt, Bordetella pertussis
ucggcgcggcgccguccagcgc

SEQ ID NO: 2380976 - RNA, 14 nt, Bordetella pertussis
ucggcgcucaggaa

SEQ ID NO: 2380977 - RNA, 19 nt, Bordetella pertussis
ucggcgcuggccuggccgc

SEQ ID NO: 2380978 - RNA, 15 nt, Bordetella pertussis
ucggcggcaagcagc

SEQ ID NO: 2380979 - RNA, 12 nt, Bordetella pertussis
ucggcggccagc

SEQ ID NO: 2380980 - RNA, 18 nt, Bordetella pertussis
ucggcggccagccggcgc

SEQ ID NO: 2380981 - RNA, 21 nt, Bordetella pertussis
ucggcggccagccggcgcgcc

SEQ ID NO: 2380982 - RNA, 14 nt, Bordetella pertussis
ucggcggccagcgc

SEQ ID NO: 2380983 - RNA, 17 nt, Bordetella pertussis
ucggcggccagcgcgcc

SEQ ID NO: 2380984 - RNA, 19 nt, Bordetella pertussis
ucggcggccagcgcgcccu

SEQ ID NO: 2380985 - RNA, 14 nt, Bordetella pertussis
ucggcggccaggcc

SEQ ID NO: 2380986 - RNA, 14 nt, Bordetella pertussis
ucggcggcccacag

SEQ ID NO: 2380987 - RNA, 19 nt, Bordetella pertussis
ucggcggcccacagcgccc

SEQ ID NO: 2380988 - RNA, 15 nt, Bordetella pertussis
ucggcggccgccugc

SEQ ID NO: 2380989 - RNA, 14 nt, Bordetella pertussis
ucggcggccgccuu

SEQ ID NO: 2380990 - RNA, 21 nt, Bordetella pertussis
ucggcggccugcuuggcagcc

SEQ ID NO: 2380991 - RNA, 22 nt, Bordetella pertussis
ucggcggccugcuuggcagccu

SEQ ID NO: 2380992 - RNA, 23 nt, Bordetella pertussis
ucggcggccugcuuggcagccuu

SEQ ID NO: 2380993 - RNA, 24 nt, Bordetella pertussis
ucggcggccugcuuggcagccuug

SEQ ID NO: 2380994 - RNA, 13 nt, Bordetella pertussis
ucggcggccuggg

SEQ ID NO: 2380995 - RNA, 17 nt, Bordetella pertussis
ucggcggcgagcuggcc

SEQ ID NO: 2380996 - RNA, 23 nt, Bordetella pertussis
ucggcggcgagcuggcccugggc

SEQ ID NO: 2380997 - RNA, 22 nt, Bordetella pertussis
ucggcggcgucgcuggcagccu

SEQ ID NO: 2380998 - RNA, 17 nt, Bordetella pertussis
ucggcgggcggcgccag

SEQ ID NO: 2380999 - RNA, 20 nt, Bordetella pertussis
ucggcggguuucucggccuu

SEQ ID NO: 2381000 - RNA, 14 nt, Bordetella pertussis
ucggcggucagcgc

SEQ ID NO: 2381001 - RNA, 17 nt, Bordetella pertussis
ucggcggucagcgcggc

SEQ ID NO: 2381002 - RNA, 22 nt, Bordetella pertussis
ucggcguaaggccgccggccac

SEQ ID NO: 2381003 - RNA, 21 nt, Bordetella pertussis
ucggcguaccaggcagccggc

SEQ ID NO: 2381004 - RNA, 16 nt, Bordetella pertussis
ucggcguacugcugca

SEQ ID NO: 2381005 - RNA, 19 nt, Bordetella pertussis
ucggcguauugcuccacag

SEQ ID NO: 2381006 - RNA, 22 nt, Bordetella pertussis
ucggcgucgaaugcacgggcgc

SEQ ID NO: 2381007 - RNA, 19 nt, Bordetella pertussis
ucggcgugacguugccgcg

SEQ ID NO: 2381008 - RNA, 20 nt, Bordetella pertussis
ucggcgugacguugccgcgc

SEQ ID NO: 2381009 - RNA, 17 nt, Bordetella pertussis
ucggcguuccuggcgcu

SEQ ID NO: 2381010 - RNA, 13 nt, Bordetella pertussis
ucggcguugaccg

SEQ ID NO: 2381011 - RNA, 16 nt, Bordetella pertussis
ucggcguugugccggc

SEQ ID NO: 2381012 - RNA, 23 nt, Bordetella pertussis
ucggcguugugccggcgcaggaa

SEQ ID NO: 2381013 - RNA, 17 nt, Bordetella pertussis
ucggcucgagcaagggc

SEQ ID NO: 2381014 - RNA, 18 nt, Bordetella pertussis
ucggcucgagcaagggcc

SEQ ID NO: 2381015 - RNA, 20 nt, Bordetella pertussis
ucggcucggugaugauggcc

SEQ ID NO: 2381016 - RNA, 22 nt, Bordetella pertussis
ucgggaaacaggcccacggcau

SEQ ID NO: 2381017 - RNA, 19 nt, Bordetella pertussis
ucgggaaugaugcagcugu

SEQ ID NO: 2381018 - RNA, 14 nt, Bordetella pertussis
ucgggacggcgcgg

SEQ ID NO: 2381019 - RNA, 17 nt, Bordetella pertussis
ucgggagccaguccccg

SEQ ID NO: 2381020 - RNA, 20 nt, Bordetella pertussis
ucgggauaccgcuggccagg

SEQ ID NO: 2381021 - RNA, 21 nt, Bordetella pertussis
ucgggauaccgcuggccaggc

SEQ ID NO: 2381022 - RNA, 18 nt, Bordetella pertussis
ucgggauaguccagcacc

SEQ ID NO: 2381023 - RNA, 16 nt, Bordetella pertussis
ucgggaugccccgccc

SEQ ID NO: 2381024 - RNA, 18 nt, Bordetella pertussis
ucgggaugccccgcccgc

SEQ ID NO: 2381025 - RNA, 19 nt, Bordetella pertussis
ucgggcacgaucaccgccg

SEQ ID NO: 2381026 - RNA, 20 nt, Bordetella pertussis
ucgggcacgaucaccgccgc

SEQ ID NO: 2381027 - RNA, 15 nt, Bordetella pertussis
ucgggcacggccagc

SEQ ID NO: 2381028 - RNA, 16 nt, Bordetella pertussis
ucgggcacguccggau

SEQ ID NO: 2381029 - RNA, 17 nt, Bordetella pertussis
ucgggcacguccggauc

SEQ ID NO: 2381030 - RNA, 20 nt, Bordetella pertussis
ucgggcagcacgcgcaccag

SEQ ID NO: 2381031 - RNA, 14 nt, Bordetella pertussis
ucgggcagcaggcg

SEQ ID NO: 2381032 - RNA, 17 nt, Bordetella pertussis
ucgucgaggaugcgagc

SEQ ID NO: 2381033 - RNA, 18 nt, Bordetella pertussis
ucgucgaggucagcggcu

SEQ ID NO: 2381034 - RNA, 15 nt, Bordetella pertussis
ucgucgaucauggcg

SEQ ID NO: 2381035 - RNA, 15 nt, Bordetella pertussis
ucgucgaugaugacg

SEQ ID NO: 2381036 - RNA, 16 nt, Bordetella pertussis
ucgucgaugccgacca

SEQ ID NO: 2381037 - RNA, 17 nt, Bordetella pertussis
ucgucgccaccgcccag

SEQ ID NO: 2381038 - RNA, 19 nt, Bordetella pertussis
ucgucgccaccgcccagaa

SEQ ID NO: 2381039 - RNA, 15 nt, Bordetella pertussis
ucgucgccaugcggc

SEQ ID NO: 2381040 - RNA, 20 nt, Bordetella pertussis
ucgucgccaugcggcuggcc

SEQ ID NO: 2381041 - RNA, 23 nt, Bordetella pertussis
ucgucgccaugcggcuggccgau

SEQ ID NO: 2381042 - RNA, 18 nt, Bordetella pertussis
ucgucgccucccauugcg

SEQ ID NO: 2381043 - RNA, 17 nt, Bordetella pertussis
ucgucgcgcacccgcag

SEQ ID NO: 2381044 - RNA, 20 nt, Bordetella pertussis
ucgucgcgcuggccccagau

SEQ ID NO: 2381045 - RNA, 13 nt, Bordetella pertussis
ucgucgcggaagc

SEQ ID NO: 2381046 - RNA, 14 nt, Bordetella pertussis
ucgucgcggccguu

SEQ ID NO: 2381047 - RNA, 18 nt, Bordetella pertussis
ucgucgcgguccagcacc

SEQ ID NO: 2381048 - RNA, 23 nt, Bordetella pertussis
ucgucgcgguccagcaccagggc

SEQ ID NO: 2381049 - RNA, 15 nt, Bordetella pertussis
ucgucgcugccgcgc

SEQ ID NO: 2381050 - RNA, 16 nt, Bordetella pertussis
ucgucgcugccgcgcg

SEQ ID NO: 2381051 - RNA, 18 nt, Bordetella pertussis
ucgucgcugccgcgcgau

SEQ ID NO: 2381052 - RNA, 15 nt, Bordetella pertussis
ucgucgcuggcccac

SEQ ID NO: 2381053 - RNA, 23 nt, Bordetella pertussis
ucgucggcaaccgucgccagcgc

SEQ ID NO: 2381054 - RNA, 21 nt, Bordetella pertussis
ucgucggcaccuucgcgcagc

SEQ ID NO: 2381055 - RNA, 23 nt, Bordetella pertussis
ucgucggccaugcgcgccagcau

SEQ ID NO: 2381056 - RNA, 12 nt, Bordetella pertussis
ucgucggccgcc

SEQ ID NO: 2381057 - RNA, 14 nt, Bordetella pertussis
ucgucggccgccgc

SEQ ID NO: 2381058 - RNA, 14 nt, Bordetella pertussis
ucgucggcgcgcgc

SEQ ID NO: 2381059 - RNA, 19 nt, Bordetella pertussis
ucgucggcgcgcgccaggc

SEQ ID NO: 2381060 - RNA, 20 nt, Bordetella pertussis
ucgucggcgcgcgccaggcc

SEQ ID NO: 2381061 - RNA, 19 nt, Bordetella pertussis
ucgucggcgcugcagcgca

SEQ ID NO: 2381062 - RNA, 13 nt, Bordetella pertussis
ucgucgggaccgg

SEQ ID NO: 2381063 - RNA, 19 nt, Bordetella pertussis
ucgucgggaccggcgcguu

SEQ ID NO: 2381064 - RNA, 21 nt, Bordetella pertussis
ucgucggggucgucggcgcug

SEQ ID NO: 2381065 - RNA, 13 nt, Bordetella pertussis
ucgucggucagcu

SEQ ID NO: 2381066 - RNA, 14 nt, Bordetella pertussis
ucgucguagcgcca

SEQ ID NO: 2381067 - RNA, 14 nt, Bordetella pertussis
ucgucguccaggcg

SEQ ID NO: 2381068 - RNA, 16 nt, Bordetella pertussis
ucgucgucggcaccuu

SEQ ID NO: 2381069 - RNA, 20 nt, Bordetella pertussis
ucgucuugaccagcaggccg

SEQ ID NO: 2381070 - RNA, 20 nt, Bordetella pertussis
ucgugaucgaccgccagcag

SEQ ID NO: 2381071 - RNA, 13 nt, Bordetella pertussis
ucgugcaccagcc

SEQ ID NO: 2381072 - RNA, 15 nt, Bordetella pertussis
ucgugcagcaggggc

SEQ ID NO: 2381073 - RNA, 15 nt, Bordetella pertussis
ucgugcaucgugaca

SEQ ID NO: 2381074 - RNA, 17 nt, Bordetella pertussis
ucgugcccagcuggcac

SEQ ID NO: 2381075 - RNA, 22 nt, Bordetella pertussis
ucgugccccgcaugcgcagacu

SEQ ID NO: 2381076 - RNA, 15 nt, Bordetella pertussis
ucgugccgcacggug

SEQ ID NO: 2381077 - RNA, 16 nt, Bordetella pertussis
ucgugccgcacggugg

SEQ ID NO: 2381078 - RNA, 15 nt, Bordetella pertussis
ucgugcgccuggcgg

SEQ ID NO: 2381079 - RNA, 13 nt, Bordetella pertussis
ucgugcggcacgc

SEQ ID NO: 2381080 - RNA, 19 nt, Bordetella pertussis
ucgugcggcacgcacagca

SEQ ID NO: 2381081 - RNA, 21 nt, Bordetella pertussis
ucgugcgugaccacgaucaug

SEQ ID NO: 2381082 - RNA, 20 nt, Bordetella pertussis
ucgugcugcugcaggcgcgg

SEQ ID NO: 2381083 - RNA, 13 nt, Bordetella pertussis
ucgugcuggccau

SEQ ID NO: 2381084 - RNA, 14 nt, Bordetella pertussis
ucgugcuggccauc

SEQ ID NO: 2381085 - RNA, 20 nt, Bordetella pertussis
ucguggaagaucacauaggc

SEQ ID NO: 2381086 - RNA, 12 nt, Bordetella pertussis
ucguggcccagc

SEQ ID NO: 2381087 - RNA, 17 nt, Bordetella pertussis
ucguggcccagcaccgc

SEQ ID NO: 2381088 - RNA, 23 nt, Bordetella pertussis
ucguggccgcuucggcggccaug

SEQ ID NO: 2381089 - RNA, 16 nt, Bordetella pertussis
ucguggcuggcgagga

SEQ ID NO: 2381090 - RNA, 20 nt, Bordetella pertussis
ucguggggcgcggcggcguu

SEQ ID NO: 2381091 - RNA, 22 nt, Bordetella pertussis
ucguggucgacauagacgcgca

SEQ ID NO: 2381092 - RNA, 14 nt, Bordetella pertussis
ucguguagggccug

SEQ ID NO: 2381093 - RNA, 12 nt, Bordetella pertussis
ucguguuauagu

SEQ ID NO: 2381094 - RNA, 15 nt, Bordetella pertussis
ucguguucgcggccg

SEQ ID NO: 2381095 - RNA, 16 nt, Bordetella pertussis
ucguucaagcguugcc

SEQ ID NO: 2381096 - RNA, 13 nt, Bordetella pertussis
ucguucacgcccg

SEQ ID NO: 2381097 - RNA, 13 nt, Bordetella pertussis
ucguuccagaugc

SEQ ID NO: 2381098 - RNA, 12 nt, Bordetella pertussis
ucguucgaaguc

SEQ ID NO: 2381099 - RNA, 18 nt, Bordetella pertussis
ucguucgaaguccgcgcg

SEQ ID NO: 2381100 - RNA, 13 nt, Bordetella pertussis
ucguucgcgcgcg

SEQ ID NO: 2381101 - RNA, 20 nt, Bordetella pertussis
ucguucguauugcugcugcu

SEQ ID NO: 2381102 - RNA, 14 nt, Bordetella pertussis
ucguucugcgcgcc

SEQ ID NO: 2381103 - RNA, 18 nt, Bordetella pertussis
ucguucuugagaauggcg

SEQ ID NO: 2381104 - RNA, 16 nt, Bordetella pertussis
ucguugacgccgacga

SEQ ID NO: 2381105 - RNA, 15 nt, Bordetella pertussis
ucguugacggggacg

SEQ ID NO: 2381106 - RNA, 18 nt, Bordetella pertussis
ucguugaucucgcccagc

SEQ ID NO: 2381107 - RNA, 16 nt, Bordetella pertussis
ucguugaucuggccgu

SEQ ID NO: 2381108 - RNA, 12 nt, Bordetella pertussis
ucguugccggcc

SEQ ID NO: 2381109 - RNA, 15 nt, Bordetella pertussis
ucguugccggccagc

SEQ ID NO: 2381110 - RNA, 15 nt, Bordetella pertussis
ucguugccugggugc

SEQ ID NO: 2381111 - RNA, 20 nt, Bordetella pertussis
ucguugcgccgaucgcggcu

SEQ ID NO: 2381112 - RNA, 19 nt, Bordetella pertussis
ucguugcgcgaagcggaaa

SEQ ID NO: 2381113 - RNA, 18 nt, Bordetella pertussis
ucguuggccagcgcgccu

SEQ ID NO: 2381114 - RNA, 15 nt, Bordetella pertussis
ucguuggccgcguag

SEQ ID NO: 2381115 - RNA, 22 nt, Bordetella pertussis
ucguuggccgcguagcccaugu

SEQ ID NO: 2381116 - RNA, 22 nt, Bordetella pertussis
ucguuggucggguugcccugcg

SEQ ID NO: 2381117 - RNA, 15 nt, Bordetella pertussis
ucguuggugcccagc

SEQ ID NO: 2381118 - RNA, 12 nt, Bordetella pertussis
ucguuucccagc

SEQ ID NO: 2381119 - RNA, 15 nt, Bordetella pertussis
ucguuucccagcaag

SEQ ID NO: 2381120 - RNA, 16 nt, Bordetella pertussis
ucuacccgcgcgagcu

SEQ ID NO: 2381121 - RNA, 20 nt, Bordetella pertussis
ucuacgccgaauugcuggag

SEQ ID NO: 2381122 - RNA, 18 nt, Bordetella pertussis
ucuacgcgcgcgccggca

SEQ ID NO: 2381123 - RNA, 19 nt, Bordetella pertussis
ucuacgcgcgcgccggcau

SEQ ID NO: 2381124 - RNA, 18 nt, Bordetella pertussis
ucuacugggugcuggcca

SEQ ID NO: 2381125 - RNA, 12 nt, Bordetella pertussis
ucuaucaucagg

SEQ ID NO: 2381126 - RNA, 16 nt, Bordetella pertussis
ucuaugcgguguugcu

SEQ ID NO: 2381127 - RNA, 14 nt, Bordetella pertussis
ucuauggccugcag

SEQ ID NO: 2381128 - RNA, 15 nt, Bordetella pertussis
ucuaugucgccggcc

SEQ ID NO: 2381129 - RNA, 20 nt, Bordetella pertussis
ucucagccgcccgccgggcc

SEQ ID NO: 2381130 - RNA, 18 nt, Bordetella pertussis
ucucagcgcgccgcgccg

SEQ ID NO: 2381131 - RNA, 22 nt, Bordetella pertussis
ucucaggccgaggcugcgcgcg

SEQ ID NO: 2381132 - RNA, 14 nt, Bordetella pertussis
ucuccacccccggg

SEQ ID NO: 2381133 - RNA, 13 nt, Bordetella pertussis
ucuccacuggccu

SEQ ID NO: 2381134 - RNA, 19 nt, Bordetella pertussis
ucuccagcgccggcagccc

SEQ ID NO: 2381135 - RNA, 13 nt, Bordetella pertussis
ucuccagcgcggc

SEQ ID NO: 2381136 - RNA, 21 nt, Bordetella pertussis
ucuccagcgcgucggccaggc

SEQ ID NO: 2381137 - RNA, 22 nt, Bordetella pertussis
ucuccagcgcgucggccaggcg

SEQ ID NO: 2381138 - RNA, 16 nt, Bordetella pertussis
ucuccaggaugcgcga

SEQ ID NO: 2381139 - RNA, 19 nt, Bordetella pertussis
ucuccaggcucaggcggcc

SEQ ID NO: 2381140 - RNA, 23 nt, Bordetella pertussis
ucuccaggcucaggcggccaggg

SEQ ID NO: 2381141 - RNA, 23 nt, Bordetella pertussis
ucuccaugcugaaaaccaacggg

SEQ ID NO: 2381142 - RNA, 17 nt, Bordetella pertussis
ucuccggcgccuggccg

SEQ ID NO: 2381143 - RNA, 18 nt, Bordetella pertussis
ucuccgguucggcgcggc

SEQ ID NO: 2381144 - RNA, 19 nt, Bordetella pertussis
ucuccgugcaucggcacgg

SEQ ID NO: 2381145 - RNA, 15 nt, Bordetella pertussis
ucuccuugagcacgu

SEQ ID NO: 2381146 - RNA, 14 nt, Bordetella pertussis
ucuucgccuggccg

SEQ ID NO: 2381147 - RNA, 21 nt, Bordetella pertussis
ucuucgggauuucgcuggcca

SEQ ID NO: 2381148 - RNA, 17 nt, Bordetella pertussis
ucuucgugcuggccauc

SEQ ID NO: 2381149 - RNA, 15 nt, Bordetella pertussis
ucuucguugucgcgc

SEQ ID NO: 2381150 - RNA, 15 nt, Bordetella pertussis
ucuucuggacgcuga

SEQ ID NO: 2381151 - RNA, 14 nt, Bordetella pertussis
ucuucuuggccaga

SEQ ID NO: 2381152 - RNA, 14 nt, Bordetella pertussis
ucuucuuugcccug

SEQ ID NO: 2381153 - RNA, 18 nt, Bordetella pertussis
ucuucuuugcccuggcca

SEQ ID NO: 2381154 - RNA, 19 nt, Bordetella pertussis
ucuugaacucggccagcag

SEQ ID NO: 2381155 - RNA, 15 nt, Bordetella pertussis
ucuugaccagcaggc

SEQ ID NO: 2381156 - RNA, 19 nt, Bordetella pertussis
ucuugaccugggccagcag

SEQ ID NO: 2381157 - RNA, 15 nt, Bordetella pertussis
ucuugagcgcggccu

SEQ ID NO: 2381158 - RNA, 18 nt, Bordetella pertussis
ucuugaugccgcccagca

SEQ ID NO: 2381159 - RNA, 19 nt, Bordetella pertussis
ucuugaugccgcccagcau

SEQ ID NO: 2381160 - RNA, 12 nt, Bordetella pertussis
ucuugaugcggc

SEQ ID NO: 2381161 - RNA, 15 nt, Bordetella pertussis
ucuugcaggcgccag

SEQ ID NO: 2381162 - RNA, 19 nt, Bordetella pertussis
ucuugcaggcgccaguccc

SEQ ID NO: 2381163 - RNA, 13 nt, Bordetella pertussis
ucuugcccgccag

SEQ ID NO: 2381164 - RNA, 16 nt, Bordetella pertussis
ucuugcccgccagcgc

SEQ ID NO: 2381165 - RNA, 19 nt, Bordetella pertussis
ucuugcccgccagcgcggc

SEQ ID NO: 2381166 - RNA, 15 nt, Bordetella pertussis
ucuugccgaugcggc

SEQ ID NO: 2381167 - RNA, 12 nt, Bordetella pertussis
ucuugccgccgu

SEQ ID NO: 2381168 - RNA, 13 nt, Bordetella pertussis
ucuugcugccguc

SEQ ID NO: 2381169 - RNA, 21 nt, Bordetella pertussis
ucuuggcaaccucgccgcgcc

SEQ ID NO: 2381170 - RNA, 14 nt, Bordetella pertussis
ucuugguagcuccg

SEQ ID NO: 2381171 - RNA, 19 nt, Bordetella pertussis
ucuuguaggcgauccaggc

SEQ ID NO: 2381172 - RNA, 20 nt, Bordetella pertussis
ucuuguaggcgauccaggcc

SEQ ID NO: 2381173 - RNA, 14 nt, Bordetella pertussis
ucuugucgcuggag

SEQ ID NO: 2381174 - RNA, 14 nt, Bordetella pertussis
ucuuucgccgcgcg

SEQ ID NO: 2381175 - RNA, 13 nt, Bordetella pertussis
ucuuugcccuggc

SEQ ID NO: 2381176 - RNA, 13 nt, Bordetella pertussis
ucuuuggccgcgc

SEQ ID NO: 2381177 - RNA, 21 nt, Bordetella pertussis
ucuuuucguccucgaccagga

SEQ ID NO: 2381178 - RNA, 17 nt, Bordetella pertussis
ugaaacagcaucagcgg

SEQ ID NO: 2381179 - RNA, 23 nt, Bordetella pertussis
ugaaacagcaucagcggcagcac

SEQ ID NO: 2381180 - RNA, 14 nt, Bordetella pertussis
ugaaaccgcaggca

SEQ ID NO: 2381181 - RNA, 14 nt, Bordetella pertussis
ugaaaccucgauga

SEQ ID NO: 2381182 - RNA, 16 nt, Bordetella pertussis
ugaaagcgaacagggc

SEQ ID NO: 2381183 - RNA, 15 nt, Bordetella pertussis
ugaaaggccagcggc

SEQ ID NO: 2381184 - RNA, 18 nt, Bordetella pertussis
ugaaauagccaugcggac

SEQ ID NO: 2381185 - RNA, 18 nt, Bordetella pertussis
ugaaaucgacguggcugg

SEQ ID NO: 2381186 - RNA, 19 nt, Bordetella pertussis
ugaaaugcguggcgugccg

SEQ ID NO: 2381187 - RNA, 17 nt, Bordetella pertussis
ugaacaagguacccgcg

SEQ ID NO: 2381188 - RNA, 12 nt, Bordetella pertussis
ugaacagccgcc

SEQ ID NO: 2381189 - RNA, 12 nt, Bordetella pertussis
ugaacagcgaga

SEQ ID NO: 2381190 - RNA, 18 nt, Bordetella pertussis
ugaacagcgagaagcaac

SEQ ID NO: 2381191 - RNA, 21 nt, Bordetella pertussis
ugaacaguucgcccauuuccg

SEQ ID NO: 2381192 - RNA, 17 nt, Bordetella pertussis
ugaacauccugaccggc

SEQ ID NO: 2381193 - RNA, 19 nt, Bordetella pertussis
ugaaccaggccgccagggc

SEQ ID NO: 2381194 - RNA, 16 nt, Bordetella pertussis
ugaaccgcaacgccag

SEQ ID NO: 2381195 - RNA, 16 nt, Bordetella pertussis
ugaaccugcuggccgc

SEQ ID NO: 2381196 - RNA, 21 nt, Bordetella pertussis
ugaaccugcuggccgccggcg

SEQ ID NO: 2381197 - RNA, 15 nt, Bordetella pertussis
ugaacgacagcgaca

SEQ ID NO: 2381198 - RNA, 14 nt, Bordetella pertussis
ugaacgaccagcac

SEQ ID NO: 2381199 - RNA, 18 nt, Bordetella pertussis
ugaacgccaccaggccga

SEQ ID NO: 2381200 - RNA, 15 nt, Bordetella pertussis
ugaacgccgcgcccg

SEQ ID NO: 2381201 - RNA, 14 nt, Bordetella pertussis
ugaacgccgggccg

SEQ ID NO: 2381202 - RNA, 20 nt, Bordetella pertussis
ugaacgcgcauucgucgcug

SEQ ID NO: 2381203 - RNA, 23 nt, Bordetella pertussis
ugaacgcgcauucgucgcugccg

SEQ ID NO: 2381204 - RNA, 16 nt, Bordetella pertussis
ugaacgcguccaggcc

SEQ ID NO: 2381205 - RNA, 17 nt, Bordetella pertussis
ugaacgcuugacggcca

SEQ ID NO: 2381206 - RNA, 20 nt, Bordetella pertussis
ugaacgcuugacggccagga

SEQ ID NO: 2381207 - RNA, 21 nt, Bordetella pertussis
ugaacgcuugacggccaggac

SEQ ID NO: 2381208 - RNA, 15 nt, Bordetella pertussis
ugaacggcagcgcgc

SEQ ID NO: 2381209 - RNA, 20 nt, Bordetella pertussis
ugaacggcagcgcgcgcgug

SEQ ID NO: 2381210 - RNA, 16 nt, Bordetella pertussis
ugaacggccccgccag

SEQ ID NO: 2381211 - RNA, 15 nt, Bordetella pertussis
ugaacggcgcggccu

SEQ ID NO: 2381212 - RNA, 18 nt, Bordetella pertussis
ugaacguguaggucagcg

SEQ ID NO: 2381213 - RNA, 14 nt, Bordetella pertussis
ugaacuccugcaac

SEQ ID NO: 2381214 - RNA, 16 nt, Bordetella pertussis
ugaacucggccagcag

SEQ ID NO: 2381215 - RNA, 17 nt, Bordetella pertussis
ugaagacgcccaggucc

SEQ ID NO: 2381216 - RNA, 21 nt, Bordetella pertussis
agagcaggccgcccagcgcau

SEQ ID NO: 2381217 - RNA, 17 nt, Bordetella pertussis
agagcaugcggcguccu

SEQ ID NO: 2381218 - RNA, 19 nt, Bordetella pertussis
agagcccuucgacgcggcg

SEQ ID NO: 2381219 - RNA, 14 nt, Bordetella pertussis
agagccuggagcuc

SEQ ID NO: 2381220 - RNA, 19 nt, Bordetella pertussis
agagccugggcgcgcgccc

SEQ ID NO: 2381221 - RNA, 21 nt, Bordetella pertussis
agagccugggcgcgcgcccag

SEQ ID NO: 2381222 - RNA, 22 nt, Bordetella pertussis
agagccugggcgcgcgcccagg

SEQ ID NO: 2381223 - RNA, 14 nt, Bordetella pertussis
agagccuguccccg

SEQ ID NO: 2381224 - RNA, 13 nt, Bordetella pertussis
agagcgaauccau

SEQ ID NO: 2381225 - RNA, 13 nt, Bordetella pertussis
agagcgccacgcc

SEQ ID NO: 2381226 - RNA, 15 nt, Bordetella pertussis
agagcgccacgccag

SEQ ID NO: 2381227 - RNA, 21 nt, Bordetella pertussis
agagcgggauggucgcggccg

SEQ ID NO: 2381228 - RNA, 15 nt, Bordetella pertussis
agagcuccagccggg

SEQ ID NO: 2381229 - RNA, 12 nt, Bordetella pertussis
agagcugcggcg

SEQ ID NO: 2381230 - RNA, 20 nt, Bordetella pertussis
agaggcauuggcggcggcgu

SEQ ID NO: 2381231 - RNA, 22 nt, Bordetella pertussis
agaggcauuggcggcggcguuc

SEQ ID NO: 2381232 - RNA, 12 nt, Bordetella pertussis
agaggccaggcc

SEQ ID NO: 2381233 - RNA, 13 nt, Bordetella pertussis
agagggccugguc

SEQ ID NO: 2381234 - RNA, 12 nt, Bordetella pertussis
agagggcgacgg

SEQ ID NO: 2381235 - RNA, 22 nt, Bordetella pertussis
agaggguguugccgaggucgcc

SEQ ID NO: 2381236 - RNA, 18 nt, Bordetella pertussis
agaguguugacggugguc

SEQ ID NO: 2381237 - RNA, 20 nt, Bordetella pertussis
agaguguugacgguggucgg

SEQ ID NO: 2381238 - RNA, 16 nt, Bordetella pertussis
agaguuucggcgacga

SEQ ID NO: 2381239 - RNA, 15 nt, Bordetella pertussis
agauaccguccuuga

SEQ ID NO: 2381240 - RNA, 23 nt, Bordetella pertussis
agauaccgucuuggccgucaagc

SEQ ID NO: 2381241 - RNA, 19 nt, Bordetella pertussis
agauacuguucgccgcacc

SEQ ID NO: 2381242 - RNA, 22 nt, Bordetella pertussis
agauacuugcgcagcgcggcgu

SEQ ID NO: 2381243 - RNA, 14 nt, Bordetella pertussis
agauagcccagcac

SEQ ID NO: 2381244 - RNA, 16 nt, Bordetella pertussis
agauagcccagcaccu

SEQ ID NO: 2381245 - RNA, 18 nt, Bordetella pertussis
agauagcccuugaucagc

SEQ ID NO: 2381246 - RNA, 20 nt, Bordetella pertussis
agauagucgcggaugcgcgc

SEQ ID NO: 2381247 - RNA, 21 nt, Bordetella pertussis
agauauugggggucagcgccg

SEQ ID NO: 2381248 - RNA, 18 nt, Bordetella pertussis
agaucacauaggccggca

SEQ ID NO: 2381249 - RNA, 18 nt, Bordetella pertussis
agaucagccgcugcagca

SEQ ID NO: 2381250 - RNA, 20 nt, Bordetella pertussis
agaucaggcggcugcccacc

SEQ ID NO: 2381251 - RNA, 19 nt, Bordetella pertussis
agaucaucgagcaccgccu

SEQ ID NO: 2381252 - RNA, 22 nt, Bordetella pertussis
agaucaucgaggcaaucagccc

SEQ ID NO: 2381253 - RNA, 21 nt, Bordetella pertussis
agaucaugaauaugcgcccga

SEQ ID NO: 2381254 - RNA, 17 nt, Bordetella pertussis
agauccacgcccgcgcc

SEQ ID NO: 2381255 - RNA, 19 nt, Bordetella pertussis
agauccacgcccgcgccga

SEQ ID NO: 2381256 - RNA, 21 nt, Bordetella pertussis
agauccagcgcggccacggcc

SEQ ID NO: 2381257 - RNA, 18 nt, Bordetella pertussis
agauccaggcggccacca

SEQ ID NO: 2381258 - RNA, 21 nt, Bordetella pertussis
agauccaggcggccaccacca

SEQ ID NO: 2381259 - RNA, 17 nt, Bordetella pertussis
ugaccagggcgccgacc

SEQ ID NO: 2381260 - RNA, 20 nt, Bordetella pertussis
ugaccaguucgcgcagcgcc

SEQ ID NO: 2381261 - RNA, 17 nt, Bordetella pertussis
ugaccaugccggccugc

SEQ ID NO: 2381262 - RNA, 22 nt, Bordetella pertussis
ugaccauguugcuuggcgucag

SEQ ID NO: 2381263 - RNA, 16 nt, Bordetella pertussis
ugacccauaccagccc

SEQ ID NO: 2381264 - RNA, 18 nt, Bordetella pertussis
ugacccguuugcgcagcu

SEQ ID NO: 2381265 - RNA, 21 nt, Bordetella pertussis
ugacccguuugcgcagcucgu

SEQ ID NO: 2381266 - RNA, 21 nt, Bordetella pertussis
ugacccugcgcacccgccugg

SEQ ID NO: 2381267 - RNA, 15 nt, Bordetella pertussis
ugaccgaagcgcggg

SEQ ID NO: 2381268 - RNA, 21 nt, Bordetella pertussis
ugaccgaagcgggcgaggacu

SEQ ID NO: 2381269 - RNA, 13 nt, Bordetella pertussis
ugaccgacaggcc

SEQ ID NO: 2381270 - RNA, 14 nt, Bordetella pertussis
ugaccgacaggccu

SEQ ID NO: 2381271 - RNA, 16 nt, Bordetella pertussis
ugaccgacaggccugg

SEQ ID NO: 2381272 - RNA, 17 nt, Bordetella pertussis
ugaccgacaggccuggc

SEQ ID NO: 2381273 - RNA, 14 nt, Bordetella pertussis
ugaccgagcccggc

SEQ ID NO: 2381274 - RNA, 20 nt, Bordetella pertussis
ugaccgagcccggcaccaug

SEQ ID NO: 2381275 - RNA, 14 nt, Bordetella pertussis
ugaccgagggcgcg

SEQ ID NO: 2381276 - RNA, 15 nt, Bordetella pertussis
ugaccgagggcgcgu

SEQ ID NO: 2381277 - RNA, 20 nt, Bordetella pertussis
ugaccgcaugcugcagcugc

SEQ ID NO: 2381278 - RNA, 22 nt, Bordetella pertussis
ugaccgccagcaggcgcucggc

SEQ ID NO: 2381279 - RNA, 20 nt, Bordetella pertussis
ugaccgccagcauccagccg

SEQ ID NO: 2381280 - RNA, 15 nt, Bordetella pertussis
ugaccgccgccagca

SEQ ID NO: 2381281 - RNA, 18 nt, Bordetella pertussis
ugaccgccgccagcagcg

SEQ ID NO: 2381282 - RNA, 23 nt, Bordetella pertussis
ugaccgccgcgccgguggccagc

SEQ ID NO: 2381283 - RNA, 20 nt, Bordetella pertussis
ugaccgccggcaccagcgcc

SEQ ID NO: 2381284 - RNA, 23 nt, Bordetella pertussis
ugaccgcggacgccauggcggcg

SEQ ID NO: 2381285 - RNA, 24 nt, Bordetella pertussis
ugaccgcggacgccauggcggcgg

SEQ ID NO: 2381286 - RNA, 19 nt, Bordetella pertussis
ugaccgcguccgcgacgcu

SEQ ID NO: 2381287 - RNA, 17 nt, Bordetella pertussis
ugaccggccaggcgcgg

SEQ ID NO: 2381288 - RNA, 22 nt, Bordetella pertussis
ugaccggccuggucaugacggg

SEQ ID NO: 2381289 - RNA, 12 nt, Bordetella pertussis
ugaccggcgcgg

SEQ ID NO: 2381290 - RNA, 16 nt, Bordetella pertussis
ugaccggcgcggccug

SEQ ID NO: 2381291 - RNA, 17 nt, Bordetella pertussis
ugaccggcgcggccugc

SEQ ID NO: 2381292 - RNA, 19 nt, Bordetella pertussis
ugaccggcggcacggccgg

SEQ ID NO: 2381293 - RNA, 21 nt, Bordetella pertussis
ugaccggcggcgcucaucauc

SEQ ID NO: 2381294 - RNA, 22 nt, Bordetella pertussis
ugaccggcggcgcucaucaucg

SEQ ID NO: 2381295 - RNA, 20 nt, Bordetella pertussis
ugaccggcuauaccgggcug

SEQ ID NO: 2381296 - RNA, 22 nt, Bordetella pertussis
ugaccggcuauaccgggcuggu

SEQ ID NO: 2381297 - RNA, 15 nt, Bordetella pertussis
ugaccggcuggcgca

SEQ ID NO: 2381298 - RNA, 19 nt, Bordetella pertussis
ugaccggcuggcgcacguc

SEQ ID NO: 2381299 - RNA, 14 nt, Bordetella pertussis
ugaccggggcgucc

SEQ ID NO: 2381300 - RNA, 21 nt, Bordetella pertussis
ugaccggggcguccaccgccg

SEQ ID NO: 2381301 - RNA, 23 nt, Bordetella pertussis
ugaccgggucgucgggcggcgcg

SEQ ID NO: 2381302 - RNA, 18 nt, Bordetella pertussis
ugaccggguggcugcgca

SEQ ID NO: 2381303 - RNA, 15 nt, Bordetella pertussis
ugaccucgcccaggc

SEQ ID NO: 2381304 - RNA, 17 nt, Bordetella pertussis
ugaccucgcgcugcagc

SEQ ID NO: 2381305 - RNA, 18 nt, Bordetella pertussis
ugaccucgcgcugcagca

SEQ ID NO: 2381306 - RNA, 15 nt, Bordetella pertussis
ugaccucgcgguugc

SEQ ID NO: 2381307 - RNA, 14 nt, Bordetella pertussis
ugaccucggccugc

SEQ ID NO: 2381308 - RNA, 14 nt, Bordetella pertussis
ugaccugcgacagc

SEQ ID NO: 2381309 - RNA, 16 nt, Bordetella pertussis
ugaccugcgacagcac

SEQ ID NO: 2381310 - RNA, 18 nt, Bordetella pertussis
ugaccugcgacagcaccg

SEQ ID NO: 2381311 - RNA, 17 nt, Bordetella pertussis
ugaccugcucgucgcca

SEQ ID NO: 2381312 - RNA, 14 nt, Bordetella pertussis
ugaccugggccagc

SEQ ID NO: 2381313 - RNA, 15 nt, Bordetella pertussis
ugaccugggccagca

SEQ ID NO: 2381314 - RNA, 17 nt, Bordetella pertussis
ugaccuggucgggcgug

SEQ ID NO: 2381315 - RNA, 19 nt, Bordetella pertussis
ugaccuggugugccugucc

SEQ ID NO: 2381316 - RNA, 19 nt, Bordetella pertussis
ugaccuugagaugccagcg

SEQ ID NO: 2381317 - RNA, 21 nt, Bordetella pertussis
ugaccuugagaugccagcggc

SEQ ID NO: 2381318 - RNA, 18 nt, Bordetella pertussis
ugaccuugccgauccagc

SEQ ID NO: 2381319 - RNA, 21 nt, Bordetella pertussis
ugacgaaacgcgcguccuugg

SEQ ID NO: 2381320 - RNA, 23 nt, Bordetella pertussis
ugacgaccgcgacccgauagccg

SEQ ID NO: 2381321 - RNA, 23 nt, Bordetella pertussis
ugacgaccuugcggccgcgcacc

SEQ ID NO: 2381322 - RNA, 13 nt, Bordetella pertussis
ugacgacgccggc

SEQ ID NO: 2381323 - RNA, 22 nt, Bordetella pertussis
ugacgacgcguuguucgggccg

SEQ ID NO: 2381324 - RNA, 16 nt, Bordetella pertussis
ugacgauauccaggcg

SEQ ID NO: 2381325 - RNA, 20 nt, Bordetella pertussis
ugacgaucucgcccugcucg

SEQ ID NO: 2381326 - RNA, 18 nt, Bordetella pertussis
ugacgaucucggcguuga

SEQ ID NO: 2381327 - RNA, 15 nt, Bordetella pertussis
ugacgaugcccaggu

SEQ ID NO: 2381328 - RNA, 20 nt, Bordetella pertussis
ugacgauguucaggccaugc

SEQ ID NO: 2381329 - RNA, 13 nt, Bordetella pertussis
ugacgcagccgcc

SEQ ID NO: 2381330 - RNA, 20 nt, Bordetella pertussis
ugacgcagccgcccggcagc

SEQ ID NO: 2381331 - RNA, 20 nt, Bordetella pertussis
ugacgccgccgaacggggcc

SEQ ID NO: 2381332 - RNA, 19 nt, Bordetella pertussis
ugacgccggcggcgugcgc

SEQ ID NO: 2381333 - RNA, 23 nt, Bordetella pertussis
ugacgccggcuucagccgcaagc

SEQ ID NO: 2381334 - RNA, 21 nt, Bordetella pertussis
ugacgccgggcgcggcccggc

SEQ ID NO: 2381335 - RNA, 22 nt, Bordetella pertussis
ugacgccgguguagcugcccgc

SEQ ID NO: 2381336 - RNA, 23 nt, Bordetella pertussis
ugacgccgguguagcugcccgcg

SEQ ID NO: 2381337 - RNA, 22 nt, Bordetella pertussis
ugacgcgauacugcgcaugggc

SEQ ID NO: 2381338 - RNA, 17 nt, Bordetella pertussis
ugacgcgcggguccagg

SEQ ID NO: 2381339 - RNA, 18 nt, Bordetella pertussis
ugacgcgcugaugcgcgg

SEQ ID NO: 2381340 - RNA, 14 nt, Bordetella pertussis
ugacgcucauccag

SEQ ID NO: 2381341 - RNA, 23 nt, Bordetella pertussis
ugacgcugacccuggccgaacgc

SEQ ID NO: 2381342 - RNA, 16 nt, Bordetella pertussis
ugacgcugcucuuggc

SEQ ID NO: 2381343 - RNA, 20 nt, Bordetella pertussis
ugacgcugcucuuggcgccg

SEQ ID NO: 2381344 - RNA, 23 nt, Bordetella pertussis
ugacgcuggagcgcggcggcgug

SEQ ID NO: 2381345 - RNA, 16 nt, Bordetella pertussis
ugacggauucccagcu

SEQ ID NO: 2381346 - RNA, 22 nt, Bordetella pertussis
ugacggccauccggccacgcau

SEQ ID NO: 2381347 - RNA, 13 nt, Bordetella pertussis
ugacggcccagcu

SEQ ID NO: 2381348 - RNA, 12 nt, Bordetella pertussis
ugacggcgcgga

SEQ ID NO: 2381349 - RNA, 20 nt, Bordetella pertussis
ugacgggcggcggcgcgcgc

SEQ ID NO: 2381350 - RNA, 19 nt, Bordetella pertussis
ugacgggcugggccgaggc

SEQ ID NO: 2381351 - RNA, 13 nt, Bordetella pertussis
ugacggggcggcg

SEQ ID NO: 2381352 - RNA, 16 nt, Bordetella pertussis
ugacggugccgagcag

SEQ ID NO: 2381353 - RNA, 16 nt, Bordetella pertussis
ugacgguggugucggc

SEQ ID NO: 2381354 - RNA, 22 nt, Bordetella pertussis
ugacgguggugucggcggccag

SEQ ID NO: 2381355 - RNA, 21 nt, Bordetella pertussis
ugacguagcggaucgcggcgc

SEQ ID NO: 2381356 - RNA, 17 nt, Bordetella pertussis
ugacgucauggccgaua

SEQ ID NO: 2381357 - RNA, 16 nt, Bordetella pertussis
ugacguccagcgccac

SEQ ID NO: 2381358 - RNA, 22 nt, Bordetella pertussis
ugacguccagcgccaccagcag

SEQ ID NO: 2381359 - RNA, 14 nt, Bordetella pertussis
ugacguccggcggg

SEQ ID NO: 2381360 - RNA, 17 nt, Bordetella pertussis
ugacguccggcgggccg

SEQ ID NO: 2381361 - RNA, 14 nt, Bordetella pertussis
ugacguugccgcgc

SEQ ID NO: 2381362 - RNA, 15 nt, Bordetella pertussis
ugacguugccgcgcg

SEQ ID NO: 2381363 - RNA, 18 nt, Bordetella pertussis
ugacguugccgcgcgcgu

SEQ ID NO: 2381364 - RNA, 17 nt, Bordetella pertussis
ugacugcggugccuguc

SEQ ID NO: 2381365 - RNA, 22 nt, Bordetella pertussis
ugacugugcagccacgccuggc

SEQ ID NO: 2381366 - RNA, 18 nt, Bordetella pertussis
ugacuucggccgccagcc

SEQ ID NO: 2381367 - RNA, 17 nt, Bordetella pertussis
ugacuugaccgcaugcu

SEQ ID NO: 2381368 - RNA, 19 nt, Bordetella pertussis
ugacuugaccgcaugcugc

SEQ ID NO: 2381369 - RNA, 21 nt, Bordetella pertussis
ugagaaaagugaucaccgcca

SEQ ID NO: 2381370 - RNA, 22 nt, Bordetella pertussis
ugagaaaagugaucaccgccau

SEQ ID NO: 2381371 - RNA, 22 nt, Bordetella pertussis
ugaugcggcgccacgcagaagg

SEQ ID NO: 2381372 - RNA, 14 nt, Bordetella pertussis
ugaugcggcgcgcc

SEQ ID NO: 2381373 - RNA, 16 nt, Bordetella pertussis
ugaugcggcgcgccgc

SEQ ID NO: 2381374 - RNA, 15 nt, Bordetella pertussis
ugaugcucgcccuug

SEQ ID NO: 2381375 - RNA, 16 nt, Bordetella pertussis
ugaugcuggcauugac

SEQ ID NO: 2381376 - RNA, 12 nt, Bordetella pertussis
ugaugcugguca

SEQ ID NO: 2381377 - RNA, 15 nt, Bordetella pertussis
ugauggaggccagga

SEQ ID NO: 2381378 - RNA, 16 nt, Bordetella pertussis
ugauggaggccaggau

SEQ ID NO: 2381379 - RNA, 18 nt, Bordetella pertussis
ugauggaggccaggaucc

SEQ ID NO: 2381380 - RNA, 17 nt, Bordetella pertussis
ugauggauucgcgccgg

SEQ ID NO: 2381381 - RNA, 13 nt, Bordetella pertussis
ugauggcccgggu

SEQ ID NO: 2381382 - RNA, 12 nt, Bordetella pertussis
ugauggcccggu

SEQ ID NO: 2381383 - RNA, 17 nt, Bordetella pertussis
ugauggccgccagcggc

SEQ ID NO: 2381384 - RNA, 13 nt, Bordetella pertussis
ugauggccgcgcg

SEQ ID NO: 2381385 - RNA, 17 nt, Bordetella pertussis
ugauggccgcgcgcagc

SEQ ID NO: 2381386 - RNA, 22 nt, Bordetella pertussis
ugauggccgggccguggcgauc

SEQ ID NO: 2381387 - RNA, 22 nt, Bordetella pertussis
ugauggccugcuuggcgcgcag

SEQ ID NO: 2381388 - RNA, 23 nt, Bordetella pertussis
ugauggccugcuuggcgcgcagc

SEQ ID NO: 2381389 - RNA, 24 nt, Bordetella pertussis
ugauggcguccgcgucgccgccgu

SEQ ID NO: 2381390 - RNA, 14 nt, Bordetella pertussis
ugaugggcgcaucc

SEQ ID NO: 2381391 - RNA, 17 nt, Bordetella pertussis
ugauggggccgcgccgu

SEQ ID NO: 2381392 - RNA, 21 nt, Bordetella pertussis
ugauggggucgccgggcagcg

SEQ ID NO: 2381393 - RNA, 21 nt, Bordetella pertussis
ugauggugcugccgcugccca

SEQ ID NO: 2381394 - RNA, 16 nt, Bordetella pertussis
ugaugguggggcuggc

SEQ ID NO: 2381395 - RNA, 19 nt, Bordetella pertussis
ugaugguggggcuggccgc

SEQ ID NO: 2381396 - RNA, 14 nt, Bordetella pertussis
ugauguagcccaug

SEQ ID NO: 2381397 - RNA, 20 nt, Bordetella pertussis
ugaugucggccagggaggcg

SEQ ID NO: 2381398 - RNA, 18 nt, Bordetella pertussis
ugaugugguagccgccgu

SEQ ID NO: 2381399 - RNA, 22 nt, Bordetella pertussis
ugauuccaccuugccgcuuauc

SEQ ID NO: 2381400 - RNA, 21 nt, Bordetella pertussis
ugcaaaagcguuccagcagau

SEQ ID NO: 2381401 - RNA, 16 nt, Bordetella pertussis
ugcaaauucugcaaaa

SEQ ID NO: 2381402 - RNA, 19 nt, Bordetella pertussis
ugcaacuccacgcccugca

SEQ ID NO: 2381403 - RNA, 17 nt, Bordetella pertussis
ugcaagacaggccgcua

SEQ ID NO: 2381404 - RNA, 13 nt, Bordetella pertussis
ugcaagcggccgg

SEQ ID NO: 2381405 - RNA, 14 nt, Bordetella pertussis
ugcaagcggccggc

SEQ ID NO: 2381406 - RNA, 15 nt, Bordetella pertussis
ugcaaggccugcugc

SEQ ID NO: 2381407 - RNA, 16 nt, Bordetella pertussis
ugcaaggccugcugca

SEQ ID NO: 2381408 - RNA, 17 nt, Bordetella pertussis
ugcaagucuucuucagc

SEQ ID NO: 2381409 - RNA, 23 nt, Bordetella pertussis
ugcaauaacgccacuugcaggcc

SEQ ID NO: 2381410 - RNA, 21 nt, Bordetella pertussis
ugcacacgccuucggcgacuu

SEQ ID NO: 2381411 - RNA, 21 nt, Bordetella pertussis
ugcacagguagaucagccgcu

SEQ ID NO: 2381412 - RNA, 21 nt, Bordetella pertussis
ugcaccagccauucgauggcg

SEQ ID NO: 2381413 - RNA, 22 nt, Bordetella pertussis
ugcaccagcccgaugcgccagg

SEQ ID NO: 2381414 - RNA, 18 nt, Bordetella pertussis
ugcaccaggugguuggcg

SEQ ID NO: 2381415 - RNA, 22 nt, Bordetella pertussis
ugcaccaggugguuggcgugcc

SEQ ID NO: 2381416 - RNA, 21 nt, Bordetella pertussis
ugcaccagugcgccggcgcgg

SEQ ID NO: 2381417 - RNA, 21 nt, Bordetella pertussis
ugcaccaguuuucucauggcc

SEQ ID NO: 2381418 - RNA, 19 nt, Bordetella pertussis
ugcacccaggcgccgaucc

SEQ ID NO: 2381419 - RNA, 23 nt, Bordetella pertussis
ugcacccaggcgccgauccaggg

SEQ ID NO: 2381420 - RNA, 21 nt, Bordetella pertussis
ugcaccgaagcaucccagucg

SEQ ID NO: 2381421 - RNA, 21 nt, Bordetella pertussis
ugcaccgccgcguugcgcgac

SEQ ID NO: 2381422 - RNA, 18 nt, Bordetella pertussis
ugcaccgcgucggccugc

SEQ ID NO: 2381423 - RNA, 19 nt, Bordetella pertussis
ugcaccgcguggcgcugcg

SEQ ID NO: 2381424 - RNA, 16 nt, Bordetella pertussis
ugcaccgucaggugca

SEQ ID NO: 2381425 - RNA, 16 nt, Bordetella pertussis
ugcaccugccugccgc

SEQ ID NO: 2381426 - RNA, 14 nt, Bordetella pertussis
ugcaccugcuccag

SEQ ID NO: 2381427 - RNA, 15 nt, Bordetella pertussis
ugcaccugcuccagc

SEQ ID NO: 2381428 - RNA, 17 nt, Bordetella pertussis
ugcaccuugggcgccug

SEQ ID NO: 2381429 - RNA, 12 nt, Bordetella pertussis
ugcacgaccagg

SEQ ID NO: 2381430 - RNA, 14 nt, Bordetella pertussis
ugcacgaccaggcc

SEQ ID NO: 2381431 - RNA, 22 nt, Bordetella pertussis
ugcacgaccaggccguggccca

SEQ ID NO: 2381432 - RNA, 22 nt, Bordetella pertussis
ugcacgacgucguagugcgcgc

SEQ ID NO: 2381433 - RNA, 14 nt, Bordetella pertussis
ugcacgauauuggc

SEQ ID NO: 2381434 - RNA, 19 nt, Bordetella pertussis
ugcacgaugcccagggccg

SEQ ID NO: 2381435 - RNA, 20 nt, Bordetella pertussis
ugcacgaugcccagggccgc

SEQ ID NO: 2381436 - RNA, 17 nt, Bordetella pertussis
ugcacgaugguaucggc

SEQ ID NO: 2381437 - RNA, 20 nt, Bordetella pertussis
ugcacgaugguaucggccgg

SEQ ID NO: 2381438 - RNA, 20 nt, Bordetella pertussis
ugcacgauuccgccuacugg

SEQ ID NO: 2381439 - RNA, 17 nt, Bordetella pertussis
ugcacgcccgcggcgcc

SEQ ID NO: 2381440 - RNA, 14 nt, Bordetella pertussis
ugcacgccgggcgc

SEQ ID NO: 2381441 - RNA, 17 nt, Bordetella pertussis
ugcacgccgggcgcgcu

SEQ ID NO: 2381442 - RNA, 13 nt, Bordetella pertussis
ugcacgcgcgcgg

SEQ ID NO: 2381443 - RNA, 17 nt, Bordetella pertussis
ugcacgcgcgcgggcgc

SEQ ID NO: 2381444 - RNA, 15 nt, Bordetella pertussis
ugcacgcggccgcgc

SEQ ID NO: 2381445 - RNA, 13 nt, Bordetella pertussis
ugcacgcgggcca

SEQ ID NO: 2381446 - RNA, 23 nt, Bordetella pertussis
ugcacgcucuugagcgcggccuc

SEQ ID NO: 2381447 - RNA, 19 nt, Bordetella pertussis
ugcacgggcgcugcccagg

SEQ ID NO: 2381448 - RNA, 20 nt, Bordetella pertussis
agcaauuaugcguggccgcc

SEQ ID NO: 2381449 - RNA, 16 nt, Bordetella pertussis
agcaauucgaccggca

SEQ ID NO: 2381450 - RNA, 20 nt, Bordetella pertussis
agcaauucguugaucuggcc

SEQ ID NO: 2381451 - RNA, 18 nt, Bordetella pertussis
agcaauugccccagcacg

SEQ ID NO: 2381452 - RNA, 22 nt, Bordetella pertussis
agcaauugccggaucagcgccu

SEQ ID NO: 2381453 - RNA, 17 nt, Bordetella pertussis
agcacauagcgcaagcc

SEQ ID NO: 2381454 - RNA, 20 nt, Bordetella pertussis
agcacauagcgcaagcccgu

SEQ ID NO: 2381455 - RNA, 14 nt, Bordetella pertussis
agcacaugcccggc

SEQ ID NO: 2381456 - RNA, 19 nt, Bordetella pertussis
agcacauggcgcgccggcc

SEQ ID NO: 2381457 - RNA, 20 nt, Bordetella pertussis
agcacauggcgcgccggccg

SEQ ID NO: 2381458 - RNA, 22 nt, Bordetella pertussis
agcaccaacugguagugcggcg

SEQ ID NO: 2381459 - RNA, 15 nt, Bordetella pertussis
agcaccacggcaucg

SEQ ID NO: 2381460 - RNA, 22 nt, Bordetella pertussis
agcaccacggcaucggcgccgc

SEQ ID NO: 2381461 - RNA, 15 nt, Bordetella pertussis
agcaccacggcgcgc

SEQ ID NO: 2381462 - RNA, 15 nt, Bordetella pertussis
agcaccacggcggcc

SEQ ID NO: 2381463 - RNA, 20 nt, Bordetella pertussis
agcaccacggcggccaggcc

SEQ ID NO: 2381464 - RNA, 13 nt, Bordetella pertussis
agcaccacguccu

SEQ ID NO: 2381465 - RNA, 19 nt, Bordetella pertussis
agcaccacguccuggggcg

SEQ ID NO: 2381466 - RNA, 20 nt, Bordetella pertussis
agcaccacguccuggggcgc

SEQ ID NO: 2381467 - RNA, 12 nt, Bordetella pertussis
agcaccagcagc

SEQ ID NO: 2381468 - RNA, 13 nt, Bordetella pertussis
agcaccagcagcc

SEQ ID NO: 2381469 - RNA, 15 nt, Bordetella pertussis
agcaccagcagcccc

SEQ ID NO: 2381470 - RNA, 16 nt, Bordetella pertussis
agcaccagcagcccca

SEQ ID NO: 2381471 - RNA, 18 nt, Bordetella pertussis
agcaccagcagccccagc

SEQ ID NO: 2381472 - RNA, 13 nt, Bordetella pertussis
agcaccagcaugc

SEQ ID NO: 2381473 - RNA, 17 nt, Bordetella pertussis
agcaccagcgccugccg

SEQ ID NO: 2381474 - RNA, 14 nt, Bordetella pertussis
agcaccagcuccuc

SEQ ID NO: 2381475 - RNA, 17 nt, Bordetella pertussis
agcaccaggccgccggc

SEQ ID NO: 2381476 - RNA, 21 nt, Bordetella pertussis
agcaccaggcuuugcgcgcca

SEQ ID NO: 2381477 - RNA, 22 nt, Bordetella pertussis
agcaccaggucgaacggauugc

SEQ ID NO: 2381478 - RNA, 15 nt, Bordetella pertussis
agcaccgaugcgccg

SEQ ID NO: 2381479 - RNA, 18 nt, Bordetella pertussis
agcaccgaugcgccggcc

SEQ ID NO: 2381480 - RNA, 19 nt, Bordetella pertussis
agcaccgaugcgccggccu

SEQ ID NO: 2381481 - RNA, 22 nt, Bordetella pertussis
agcaccgaugcgccggccuggc

SEQ ID NO: 2381482 - RNA, 17 nt, Bordetella pertussis
agcaccgccaccguggc

SEQ ID NO: 2381483 - RNA, 21 nt, Bordetella pertussis
agcaccgccaccguggcgucc

SEQ ID NO: 2381484 - RNA, 12 nt, Bordetella pertussis
agcaccgccacg

SEQ ID NO: 2381485 - RNA, 13 nt, Bordetella pertussis
agcaccgccagcg

SEQ ID NO: 2381486 - RNA, 20 nt, Bordetella pertussis
agcaccgccagcgcgucguc

SEQ ID NO: 2381487 - RNA, 19 nt, Bordetella pertussis
agcaccgccugcugcgccu

SEQ ID NO: 2381488 - RNA, 18 nt, Bordetella pertussis
agcaccgcgaccaugcgg

SEQ ID NO: 2381489 - RNA, 20 nt, Bordetella pertussis
agcaccgcgaccaugcggcc

SEQ ID NO: 2381490 - RNA, 22 nt, Bordetella pertussis
agcaccgcgcgcacgaccacca

SEQ ID NO: 2381491 - RNA, 15 nt, Bordetella pertussis
agcaccgcggcgggc

SEQ ID NO: 2381492 - RNA, 21 nt, Bordetella pertussis
agcaccggauccugcggcgcg

SEQ ID NO: 2381493 - RNA, 17 nt, Bordetella pertussis
agcaccggcacgacggc

SEQ ID NO: 2381494 - RNA, 19 nt, Bordetella pertussis
agcaccggcacgacggccu

SEQ ID NO: 2381495 - RNA, 20 nt, Bordetella pertussis
agcaccggcacgcgccaggc

SEQ ID NO: 2381496 - RNA, 20 nt, Bordetella pertussis
agcaccggcagcguaucgcc

SEQ ID NO: 2381497 - RNA, 15 nt, Bordetella pertussis
agcaccggccgccgc

SEQ ID NO: 2381498 - RNA, 14 nt, Bordetella pertussis
agcaccggcugcca

SEQ ID NO: 2381499 - RNA, 22 nt, Bordetella pertussis
agcaccgggaaguccgccgcgu

SEQ ID NO: 2381500 - RNA, 16 nt, Bordetella pertussis
agcaccggggcagggc

SEQ ID NO: 2381501 - RNA, 22 nt, Bordetella pertussis
agcaccggguaauggcgcucca

SEQ ID NO: 2381502 - RNA, 15 nt, Bordetella pertussis
agcaccucgacgcag

SEQ ID NO: 2381503 - RNA, 17 nt, Bordetella pertussis
agcaccucgacgcagcc

SEQ ID NO: 2381504 - RNA, 14 nt, Bordetella pertussis
agcaccucggcgcc

SEQ ID NO: 2381505 - RNA, 19 nt, Bordetella pertussis
agcaccucggcgcccagcu

SEQ ID NO: 2381506 - RNA, 20 nt, Bordetella pertussis
agcaccucggcgcccagcug

SEQ ID NO: 2381507 - RNA, 12 nt, Bordetella pertussis
agcaccugcagg

SEQ ID NO: 2381508 - RNA, 22 nt, Bordetella pertussis
agcaccugcaggccgccggcca

SEQ ID NO: 2381509 - RNA, 20 nt, Bordetella pertussis
agcaccugguggcgcuggcc

SEQ ID NO: 2381510 - RNA, 21 nt, Bordetella pertussis
agcaccuucugccgccaggca

SEQ ID NO: 2381511 - RNA, 21 nt, Bordetella pertussis
agcaccuugaccuggucggcc

SEQ ID NO: 2381512 - RNA, 19 nt, Bordetella pertussis
agcacgaagggcagcagca

SEQ ID NO: 2381513 - RNA, 22 nt, Bordetella pertussis
agcacgaagggcagcagcaguu

SEQ ID NO: 2381514 - RNA, 11 nt, Bordetella pertussis
agcacgacgac

SEQ ID NO: 2381515 - RNA, 14 nt, Bordetella pertussis
agcacgacgacggc

SEQ ID NO: 2381516 - RNA, 13 nt, Bordetella pertussis
agcacgaugagca

SEQ ID NO: 2381517 - RNA, 16 nt, Bordetella pertussis
agcacgauggcgccca

SEQ ID NO: 2381518 - RNA, 13 nt, Bordetella pertussis
agcacgauggggc

SEQ ID NO: 2381519 - RNA, 14 nt, Bordetella pertussis
agcacgauggggcc

SEQ ID NO: 2381520 - RNA, 19 nt, Bordetella pertussis
agcacgauggggccauggc

SEQ ID NO: 2381521 - RNA, 20 nt, Bordetella pertussis
agcacgauggggccauggca

SEQ ID NO: 2381522 - RNA, 20 nt, Bordetella pertussis
agcacgauggucagcggcau

SEQ ID NO: 2381523 - RNA, 16 nt, Bordetella pertussis
agcacgcaccaggcgc

SEQ ID NO: 2381524 - RNA, 16 nt, Bordetella pertussis
agcacgcccaugguca

SEQ ID NO: 2381525 - RNA, 12 nt, Bordetella pertussis
agcacgccccaa

SEQ ID NO: 2381526 - RNA, 19 nt, Bordetella pertussis
agcacgcccgccagcagcu

SEQ ID NO: 2381527 - RNA, 13 nt, Bordetella pertussis
agcacgcccgcgc

SEQ ID NO: 2381528 - RNA, 17 nt, Bordetella pertussis
agcacgcccgcgcgcga

SEQ ID NO: 2381529 - RNA, 18 nt, Bordetella pertussis
agcacgccgaucgcgcac

SEQ ID NO: 2381530 - RNA, 18 nt, Bordetella pertussis
agcacgccgcgccaggca

SEQ ID NO: 2381531 - RNA, 14 nt, Bordetella pertussis
agcacgccggccag

SEQ ID NO: 2381532 - RNA, 12 nt, Bordetella pertussis
agcacgccggcg

SEQ ID NO: 2381533 - RNA, 16 nt, Bordetella pertussis
agcacgcgcaccaggc

SEQ ID NO: 2381534 - RNA, 17 nt, Bordetella pertussis
agcacgcgcaccaggcc

SEQ ID NO: 2381535 - RNA, 14 nt, Bordetella pertussis
agcacgcgcagcuu

SEQ ID NO: 2381536 - RNA, 15 nt, Bordetella pertussis
agcacgcggcgcggc

SEQ ID NO: 2381537 - RNA, 14 nt, Bordetella pertussis
agcacgcugcgcgg

SEQ ID NO: 2381538 - RNA, 14 nt, Bordetella pertussis
agcacgcuggccuu

SEQ ID NO: 2381539 - RNA, 18 nt, Bordetella pertussis
agcacggccacggccggc

SEQ ID NO: 2381540 - RNA, 22 nt, Bordetella pertussis
agcacggccacggccggcagcg

SEQ ID NO: 2381541 - RNA, 23 nt, Bordetella pertussis
agcacggccacggccggcagcgc

SEQ ID NO: 2381542 - RNA, 15 nt, Bordetella pertussis
agcacggccgcggcc

SEQ ID NO: 2381543 - RNA, 16 nt, Bordetella pertussis
agcacggccgcggccg

SEQ ID NO: 2381544 - RNA, 19 nt, Bordetella pertussis
agcacggccgcggccggca

SEQ ID NO: 2381545 - RNA, 21 nt, Bordetella pertussis
agcacggccgcggccggcacg

SEQ ID NO: 2381546 - RNA, 20 nt, Bordetella pertussis
agcacggcgaggaugccgcg

SEQ ID NO: 2381547 - RNA, 14 nt, Bordetella pertussis
agcacggcgcggcu

SEQ ID NO: 2381548 - RNA, 17 nt, Bordetella pertussis
agcacggcguggcgcgc

SEQ ID NO: 2381549 - RNA, 16 nt, Bordetella pertussis
agcacggucggcgcgu

SEQ ID NO: 2381550 - RNA, 19 nt, Bordetella pertussis
agcacgguggcgcccggcg

SEQ ID NO: 2381551 - RNA, 23 nt, Bordetella pertussis
agcacgguggcgcccggcggcgc

SEQ ID NO: 2381552 - RNA, 14 nt, Bordetella pertussis
agcacguccagcgg

SEQ ID NO: 2381553 - RNA, 17 nt, Bordetella pertussis
agcacguccagcggcgc

SEQ ID NO: 2381554 - RNA, 18 nt, Bordetella pertussis
agcacguccagcggcgcg

SEQ ID NO: 2381555 - RNA, 19 nt, Bordetella pertussis
agcacguccagcggcgcga

SEQ ID NO: 2381556 - RNA, 14 nt, Bordetella pertussis
agcacgucgcgcaa

SEQ ID NO: 2381557 - RNA, 14 nt, Bordetella pertussis
agcacgucggcguc

SEQ ID NO: 2381558 - RNA, 16 nt, Bordetella pertussis
agcacgucggcgucgg

SEQ ID NO: 2381559 - RNA, 15 nt, Bordetella pertussis
agcacguucuugccc

SEQ ID NO: 2381560 - RNA, 21 nt, Bordetella pertussis
agcacugcaccugcuccagcg

SEQ ID NO: 2381561 - RNA, 12 nt, Bordetella pertussis
agcacugcaggc

SEQ ID NO: 2381562 - RNA, 14 nt, Bordetella pertussis
agcacuugccggcc

SEQ ID NO: 2381563 - RNA, 20 nt, Bordetella pertussis
ugcacgggcgcugcccagga

SEQ ID NO: 2381564 - RNA, 14 nt, Bordetella pertussis
ugcacggugccgcg

SEQ ID NO: 2381565 - RNA, 17 nt, Bordetella pertussis
ugcacgguggacaggcu

SEQ ID NO: 2381566 - RNA, 19 nt, Bordetella pertussis
ugcacggugggcagcagca

SEQ ID NO: 2381567 - RNA, 23 nt, Bordetella pertussis
ugcacguagcgcagcaccggcag

SEQ ID NO: 2381568 - RNA, 24 nt, Bordetella pertussis
ugcacguggaugaugcgcgagccg

SEQ ID NO: 2381569 - RNA, 18 nt, Bordetella pertussis
ugcacgugggcacgccgg

SEQ ID NO: 2381570 - RNA, 21 nt, Bordetella pertussis
ugcacgugggcacgccggccu

SEQ ID NO: 2381571 - RNA, 20 nt, Bordetella pertussis
ugcacuucgaaaaugacggc

SEQ ID NO: 2381572 - RNA, 21 nt, Bordetella pertussis
ugcagaaacacaagaucgcau

SEQ ID NO: 2381573 - RNA, 14 nt, Bordetella pertussis
ugcagaaaccccag

SEQ ID NO: 2381574 - RNA, 18 nt, Bordetella pertussis
ugcagaaaccccagggga

SEQ ID NO: 2381575 - RNA, 19 nt, Bordetella pertussis
ugcagaacagggugccgcc

SEQ ID NO: 2381576 - RNA, 20 nt, Bordetella pertussis
ugcagaacagggugccgccc

SEQ ID NO: 2381577 - RNA, 16 nt, Bordetella pertussis
ugcagacggcggcugg

SEQ ID NO: 2381578 - RNA, 13 nt, Bordetella pertussis
ugcagagcaccac

SEQ ID NO: 2381579 - RNA, 22 nt, Bordetella pertussis
ugcagaucaucgagcaccgccu

SEQ ID NO: 2381580 - RNA, 19 nt, Bordetella pertussis
ugcagaucaucggcgccau

SEQ ID NO: 2381581 - RNA, 11 nt, Bordetella pertussis
ugcagaucugc

SEQ ID NO: 2381582 - RNA, 11 nt, Bordetella pertussis
ugcagauggcg

SEQ ID NO: 2381583 - RNA, 13 nt, Bordetella pertussis
ugcagcaagccca

SEQ ID NO: 2381584 - RNA, 18 nt, Bordetella pertussis
ugcagcaagcccaccggg

SEQ ID NO: 2381585 - RNA, 20 nt, Bordetella pertussis
ugcagcaagcccaccgggcc

SEQ ID NO: 2381586 - RNA, 20 nt, Bordetella pertussis
ugcagcacgcaccaggcgca

SEQ ID NO: 2381587 - RNA, 16 nt, Bordetella pertussis
ugcagcacgcuggccu

SEQ ID NO: 2381588 - RNA, 19 nt, Bordetella pertussis
ugcagcacggccacggccg

SEQ ID NO: 2381589 - RNA, 21 nt, Bordetella pertussis
ugcagcacggccacggccggc

SEQ ID NO: 2381590 - RNA, 23 nt, Bordetella pertussis
ugcagcagcauuucgaugcgcac

SEQ ID NO: 2381591 - RNA, 14 nt, Bordetella pertussis
ugcagcagcggcag

SEQ ID NO: 2381592 - RNA, 16 nt, Bordetella pertussis
ugcagcagcguggccg

SEQ ID NO: 2381593 - RNA, 13 nt, Bordetella pertussis
ugcagcaggcgca

SEQ ID NO: 2381594 - RNA, 17 nt, Bordetella pertussis
ugcagcaggcgcaccag

SEQ ID NO: 2381595 - RNA, 19 nt, Bordetella pertussis
ugcagcaggcgcaccagcg

SEQ ID NO: 2381596 - RNA, 15 nt, Bordetella pertussis
ugcaugccgaccacc

SEQ ID NO: 2381597 - RNA, 21 nt, Bordetella pertussis
ugcaugccgaccaccagcacc

SEQ ID NO: 2381598 - RNA, 16 nt, Bordetella pertussis
ugcaugcgcacggaca

SEQ ID NO: 2381599 - RNA, 15 nt, Bordetella pertussis
ugcaugggagaguuc

SEQ ID NO: 2381600 - RNA, 11 nt, Bordetella pertussis
ugcauguccag

SEQ ID NO: 2381601 - RNA, 12 nt, Bordetella pertussis
ugcauguccagc

SEQ ID NO: 2381602 - RNA, 15 nt, Bordetella pertussis
ugcauguccugcagg

SEQ ID NO: 2381603 - RNA, 16 nt, Bordetella pertussis
ugcauguccugcaggu

SEQ ID NO: 2381604 - RNA, 21 nt, Bordetella pertussis
ugcauguguucgaagaggguu

SEQ ID NO: 2381605 - RNA, 22 nt, Bordetella pertussis
ugcauucguccagguugucggc

SEQ ID NO: 2381606 - RNA, 13 nt, Bordetella pertussis
ugccaagauggcc

SEQ ID NO: 2381607 - RNA, 18 nt, Bordetella pertussis
ugccaagauggcccaggg

SEQ ID NO: 2381608 - RNA, 19 nt, Bordetella pertussis
ugccaauagcgguggcggg

SEQ ID NO: 2381609 - RNA, 18 nt, Bordetella pertussis
ugccaaucaugcgcugcu

SEQ ID NO: 2381610 - RNA, 17 nt, Bordetella pertussis
ugccacagcgugacggc

SEQ ID NO: 2381611 - RNA, 14 nt, Bordetella pertussis
ugccacaucacgcc

SEQ ID NO: 2381612 - RNA, 16 nt, Bordetella pertussis
ugccaccagcgcgcca

SEQ ID NO: 2381613 - RNA, 17 nt, Bordetella pertussis
ugccaccagcgcgccag

SEQ ID NO: 2381614 - RNA, 18 nt, Bordetella pertussis
ugccaccagcgcgccagc

SEQ ID NO: 2381615 - RNA, 22 nt, Bordetella pertussis
ugccaccagcgcgccagcagau

SEQ ID NO: 2381616 - RNA, 19 nt, Bordetella pertussis
ugccacggugaagaacgcg

SEQ ID NO: 2381617 - RNA, 19 nt, Bordetella pertussis
ugccacuccugguugaccg

SEQ ID NO: 2381618 - RNA, 14 nt, Bordetella pertussis
ugccagacggccag

SEQ ID NO: 2381619 - RNA, 21 nt, Bordetella pertussis
ugccagauuaagacagauguc

SEQ ID NO: 2381620 - RNA, 21 nt, Bordetella pertussis
ugccagcaggucgcgcacgcu

SEQ ID NO: 2381621 - RNA, 22 nt, Bordetella pertussis
ugccagccauguucgaccagga

SEQ ID NO: 2381622 - RNA, 15 nt, Bordetella pertussis
ugccagcccccugcg

SEQ ID NO: 2381623 - RNA, 16 nt, Bordetella pertussis
ugccagcccccugcgg

SEQ ID NO: 2381624 - RNA, 20 nt, Bordetella pertussis
ugccagcccccugcgggguc

SEQ ID NO: 2381625 - RNA, 15 nt, Bordetella pertussis
ugccagccugccaca

SEQ ID NO: 2381626 - RNA, 11 nt, Bordetella pertussis
ugccagccugu

SEQ ID NO: 2381627 - RNA, 15 nt, Bordetella pertussis
ugccagcggcgcagc

SEQ ID NO: 2381628 - RNA, 16 nt, Bordetella pertussis
ugccagcuugcaggcg

SEQ ID NO: 2381629 - RNA, 13 nt, Bordetella pertussis
ugccaggcccggc

SEQ ID NO: 2381630 - RNA, 15 nt, Bordetella pertussis
ugccaggcccggcgc

SEQ ID NO: 2381631 - RNA, 17 nt, Bordetella pertussis
ugccaggcccggcgcgc

SEQ ID NO: 2381632 - RNA, 23 nt, Bordetella pertussis
ugccaggcgagcgccgcgcucca

SEQ ID NO: 2381633 - RNA, 14 nt, Bordetella pertussis
ugccaggcgcccca

SEQ ID NO: 2381634 - RNA, 16 nt, Bordetella pertussis
ugccaggcgccgcguc

SEQ ID NO: 2381635 - RNA, 18 nt, Bordetella pertussis
ugccaggcgccgcguccg

SEQ ID NO: 2381636 - RNA, 22 nt, Bordetella pertussis
ugccaggcgccgcguccggcgc

SEQ ID NO: 2381637 - RNA, 22 nt, Bordetella pertussis
ugccaggcuaucguggcuggcg

SEQ ID NO: 2381638 - RNA, 14 nt, Bordetella pertussis
ugccagggccuggc

SEQ ID NO: 2381639 - RNA, 21 nt, Bordetella pertussis
ugccagggccuggcacaucgg

SEQ ID NO: 2381640 - RNA, 19 nt, Bordetella pertussis
ugccagggugaccuggcgc

SEQ ID NO: 2381641 - RNA, 17 nt, Bordetella pertussis
ugccaguaggcgcccca

SEQ ID NO: 2381642 - RNA, 14 nt, Bordetella pertussis
ugccaguccaucca

SEQ ID NO: 2381643 - RNA, 21 nt, Bordetella pertussis
ugccagucccccgcggggaca

SEQ ID NO: 2381644 - RNA, 14 nt, Bordetella pertussis
ugccagucccccug

SEQ ID NO: 2381645 - RNA, 20 nt, Bordetella pertussis
ugccaguccccguucgggga

SEQ ID NO: 2381646 - RNA, 15 nt, Bordetella pertussis
ugccaguccccugcg

SEQ ID NO: 2381647 - RNA, 16 nt, Bordetella pertussis
ugccaguccccugcgg

SEQ ID NO: 2381648 - RNA, 20 nt, Bordetella pertussis
ugccaguccccugcggggac

SEQ ID NO: 2381649 - RNA, 21 nt, Bordetella pertussis
ugccaguccccugcggggaca

SEQ ID NO: 2381650 - RNA, 14 nt, Bordetella pertussis
ugccagucuccagg

SEQ ID NO: 2381651 - RNA, 16 nt, Bordetella pertussis
ugccagucuccaggcu

SEQ ID NO: 2381652 - RNA, 17 nt, Bordetella pertussis
ugccagucuccaggcuc

SEQ ID NO: 2381653 - RNA, 24 nt, Bordetella pertussis
ugccagugaaacgcgacgcgccgg

SEQ ID NO: 2381654 - RNA, 23 nt, Bordetella pertussis
ugccaguugaaccgcaacgccag

SEQ ID NO: 2381655 - RNA, 22 nt, Bordetella pertussis
ugccaguugccgccgccggcgc

SEQ ID NO: 2381656 - RNA, 19 nt, Bordetella pertussis
ugccauaggccagcgccuu

SEQ ID NO: 2381657 - RNA, 15 nt, Bordetella pertussis
ugccauccagccagg

SEQ ID NO: 2381658 - RNA, 16 nt, Bordetella pertussis
ugccauccagccaggc

SEQ ID NO: 2381659 - RNA, 20 nt, Bordetella pertussis
ugccauccagccaggccgca

SEQ ID NO: 2381660 - RNA, 22 nt, Bordetella pertussis
ugccauccagccaggccgcaua

SEQ ID NO: 2381661 - RNA, 12 nt, Bordetella pertussis
ugccauccggcc

SEQ ID NO: 2381662 - RNA, 18 nt, Bordetella pertussis
ugccaucgauaugggcgg

SEQ ID NO: 2381663 - RNA, 19 nt, Bordetella pertussis
ugccaucgauaugggcggc

SEQ ID NO: 2381664 - RNA, 23 nt, Bordetella pertussis
ugccaucgauaugggcggccucg

SEQ ID NO: 2381665 - RNA, 19 nt, Bordetella pertussis
ugccaugccccauccagcg

SEQ ID NO: 2381666 - RNA, 18 nt, Bordetella pertussis
ugccauggaccggcgucc

SEQ ID NO: 2381667 - RNA, 20 nt, Bordetella pertussis
ugccauggccgcgcggcgcc

SEQ ID NO: 2381668 - RNA, 21 nt, Bordetella pertussis
ugccauggccgcgcggcgccu

SEQ ID NO: 2381669 - RNA, 18 nt, Bordetella pertussis
ugccauuccagcuccggc

SEQ ID NO: 2381670 - RNA, 13 nt, Bordetella pertussis
ugccauugcgcgg

SEQ ID NO: 2381671 - RNA, 17 nt, Bordetella pertussis
ugccauugcgcggccug

SEQ ID NO: 2381672 - RNA, 18 nt, Bordetella pertussis
ugccauugcgcggccugc

SEQ ID NO: 2381673 - RNA, 22 nt, Bordetella pertussis
ugcccaaugucaccgacgccag

SEQ ID NO: 2381674 - RNA, 13 nt, Bordetella pertussis
ugcccacagcacg

SEQ ID NO: 2381675 - RNA, 15 nt, Bordetella pertussis
ugcccaccacggcgg

SEQ ID NO: 2381676 - RNA, 15 nt, Bordetella pertussis
ugcccaccagccgcc

SEQ ID NO: 2381677 - RNA, 18 nt, Bordetella pertussis
ugcccaccagccgcccgg

SEQ ID NO: 2381678 - RNA, 20 nt, Bordetella pertussis
ugcccaccagccgggcggcc

SEQ ID NO: 2381679 - RNA, 22 nt, Bordetella pertussis
ugcccaccgacaugaccgcguc

SEQ ID NO: 2381680 - RNA, 13 nt, Bordetella pertussis
ugcccaccgccag

SEQ ID NO: 2381681 - RNA, 23 nt, Bordetella pertussis
ugcccaccgccgcccgccaggcc

SEQ ID NO: 2381682 - RNA, 18 nt, Bordetella pertussis
ugcccaccgccguggccg

SEQ ID NO: 2381683 - RNA, 15 nt, Bordetella pertussis
ugcccaccuuccugc

SEQ ID NO: 2381684 - RNA, 17 nt, Bordetella pertussis
ugcccaccuuccugcug

SEQ ID NO: 2381685 - RNA, 15 nt, Bordetella pertussis
ugcccacgcgcuccu

SEQ ID NO: 2381686 - RNA, 17 nt, Bordetella pertussis
ugcccacgcgcuccugc

SEQ ID NO: 2381687 - RNA, 18 nt, Bordetella pertussis
ugcccacgcgcuccugcu

SEQ ID NO: 2381688 - RNA, 20 nt, Bordetella pertussis
ugcccacgcgcuccugcucg

SEQ ID NO: 2381689 - RNA, 20 nt, Bordetella pertussis
ugcccacucccguaagcagg

SEQ ID NO: 2381690 - RNA, 14 nt, Bordetella pertussis
ugcccagauccagc

SEQ ID NO: 2381691 - RNA, 12 nt, Bordetella pertussis
ugcccagcacca

SEQ ID NO: 2381692 - RNA, 16 nt, Bordetella pertussis
ugcccagcaccacggg

SEQ ID NO: 2381693 - RNA, 15 nt, Bordetella pertussis
ugcccagcaccgcca

SEQ ID NO: 2381694 - RNA, 14 nt, Bordetella pertussis
ugcccagcagcucc

SEQ ID NO: 2381695 - RNA, 15 nt, Bordetella pertussis
ugcccagcagcuccu

SEQ ID NO: 2381696 - RNA, 22 nt, Bordetella pertussis
ugcccagcagcuccucggccug

SEQ ID NO: 2381697 - RNA, 23 nt, Bordetella pertussis
ugcccagcccggcuucgaucaug

SEQ ID NO: 2381698 - RNA, 21 nt, Bordetella pertussis
ugcccagcgagaucagcaccg

SEQ ID NO: 2381699 - RNA, 17 nt, Bordetella pertussis
ugcccagcgagcggggc

SEQ ID NO: 2381700 - RNA, 18 nt, Bordetella pertussis
ugcccagcgagcugguga

SEQ ID NO: 2381701 - RNA, 23 nt, Bordetella pertussis
ugcccagcgagcuggugauggug

SEQ ID NO: 2381702 - RNA, 12 nt, Bordetella pertussis
ugcccagcgcca

SEQ ID NO: 2381703 - RNA, 17 nt, Bordetella pertussis
ugcccagcgccagggcc

SEQ ID NO: 2381704 - RNA, 20 nt, Bordetella pertussis
ugcccagcgccagggccgcc

SEQ ID NO: 2381705 - RNA, 13 nt, Bordetella pertussis
ugcccagcgccgc

SEQ ID NO: 2381706 - RNA, 15 nt, Bordetella pertussis
ugcccagcgccgccg

SEQ ID NO: 2381707 - RNA, 22 nt, Bordetella pertussis
ugcccagcguguaggcggccgg

SEQ ID NO: 2381708 - RNA, 17 nt, Bordetella pertussis
ugcccaggaucgucguc

SEQ ID NO: 2381709 - RNA, 13 nt, Bordetella pertussis
ugccgcgcagcgu

SEQ ID NO: 2381710 - RNA, 21 nt, Bordetella pertussis
ugccgcgcauuugccgcggcg

SEQ ID NO: 2381711 - RNA, 22 nt, Bordetella pertussis
ugccgcgcauuugccgcggcga

SEQ ID NO: 2381712 - RNA, 21 nt, Bordetella pertussis
ugccgcgcccggcggccaggc

SEQ ID NO: 2381713 - RNA, 20 nt, Bordetella pertussis
ugccgcgcgauccggcgugg

SEQ ID NO: 2381714 - RNA, 13 nt, Bordetella pertussis
ugccgcgcgcacc

SEQ ID NO: 2381715 - RNA, 18 nt, Bordetella pertussis
ugccgcgcgcaccggcuu

SEQ ID NO: 2381716 - RNA, 19 nt, Bordetella pertussis
ugccgcgcgccggcgccgg

SEQ ID NO: 2381717 - RNA, 20 nt, Bordetella pertussis
ugccgcgcgccggcgccggc

SEQ ID NO: 2381718 - RNA, 11 nt, Bordetella pertussis
ugccgcgcgcg

SEQ ID NO: 2381719 - RNA, 16 nt, Bordetella pertussis
ugccgcgcgcggccgg

SEQ ID NO: 2381720 - RNA, 12 nt, Bordetella pertussis
ugccgcgcgcgu

SEQ ID NO: 2381721 - RNA, 21 nt, Bordetella pertussis
ugccgcgcgcguauggcggcg

SEQ ID NO: 2381722 - RNA, 12 nt, Bordetella pertussis
ugccgcgcggcg

SEQ ID NO: 2381723 - RNA, 15 nt, Bordetella pertussis
ugccgcgcggcgcgu

SEQ ID NO: 2381724 - RNA, 18 nt, Bordetella pertussis
ugccgcgcggcgcguuca

SEQ ID NO: 2381725 - RNA, 14 nt, Bordetella pertussis
ugccgcgcggcgua

SEQ ID NO: 2381726 - RNA, 23 nt, Bordetella pertussis
ugccgcgcggcguauggcgcggg

SEQ ID NO: 2381727 - RNA, 12 nt, Bordetella pertussis
ugccgcgcguac

SEQ ID NO: 2381728 - RNA, 18 nt, Bordetella pertussis
ugccgcgcugggcgcugc

SEQ ID NO: 2381729 - RNA, 21 nt, Bordetella pertussis
ugccgcggauugccguccugg

SEQ ID NO: 2381730 - RNA, 22 nt, Bordetella pertussis
ugccgcggcaaauggggcggcc

SEQ ID NO: 2381731 - RNA, 13 nt, Bordetella pertussis
ugccgcggcaugc

SEQ ID NO: 2381732 - RNA, 13 nt, Bordetella pertussis
ugccgcggccgcc

SEQ ID NO: 2381733 - RNA, 17 nt, Bordetella pertussis
ugccgcggccgccccca

SEQ ID NO: 2381734 - RNA, 21 nt, Bordetella pertussis
ugccgcggccgcccccagcgc

SEQ ID NO: 2381735 - RNA, 12 nt, Bordetella pertussis
ugccgcggcgcg

SEQ ID NO: 2381736 - RNA, 13 nt, Bordetella pertussis
ugccgcggcgcgg

SEQ ID NO: 2381737 - RNA, 14 nt, Bordetella pertussis
ugccgcggcgcggc

SEQ ID NO: 2381738 - RNA, 19 nt, Bordetella pertussis
ugccgcggcgcggcccgcc

SEQ ID NO: 2381739 - RNA, 21 nt, Bordetella pertussis
ugccgcggcgcggcccgccac

SEQ ID NO: 2381740 - RNA, 20 nt, Bordetella pertussis
ugccgcgggcggcgccggcc

SEQ ID NO: 2381741 - RNA, 21 nt, Bordetella pertussis
ugccgcgggcggcgccggccg

SEQ ID NO: 2381742 - RNA, 15 nt, Bordetella pertussis
ugccgcgggugucgc

SEQ ID NO: 2381743 - RNA, 18 nt, Bordetella pertussis
ugccgcgguggcgggcgu

SEQ ID NO: 2381744 - RNA, 20 nt, Bordetella pertussis
ugccgcgucccgugccggcc

SEQ ID NO: 2381745 - RNA, 17 nt, Bordetella pertussis
ugccgcgugcccgcguc

SEQ ID NO: 2381746 - RNA, 18 nt, Bordetella pertussis
ugccgcucaauucggccu

SEQ ID NO: 2381747 - RNA, 21 nt, Bordetella pertussis
ugccgcucaauucggccugac

SEQ ID NO: 2381748 - RNA, 14 nt, Bordetella pertussis
ugccgcugaccagc

SEQ ID NO: 2381749 - RNA, 15 nt, Bordetella pertussis
ugccgcugaccggcg

SEQ ID NO: 2381750 - RNA, 22 nt, Bordetella pertussis
ugccgcugaucuuccugggcga

SEQ ID NO: 2381751 - RNA, 15 nt, Bordetella pertussis
ugccgcugcaggccc

SEQ ID NO: 2381752 - RNA, 19 nt, Bordetella pertussis
ugccgcugcaggcccugga

SEQ ID NO: 2381753 - RNA, 19 nt, Bordetella pertussis
ugccgcugcaggucgggau

SEQ ID NO: 2381754 - RNA, 17 nt, Bordetella pertussis
ugccgcugcaugggcgg

SEQ ID NO: 2381755 - RNA, 18 nt, Bordetella pertussis
ugccgcugcaugggcggc

SEQ ID NO: 2381756 - RNA, 19 nt, Bordetella pertussis
ugccgcugcaugggcggcc

SEQ ID NO: 2381757 - RNA, 23 nt, Bordetella pertussis
ugccgcugcccagcgucagcugg

SEQ ID NO: 2381758 - RNA, 18 nt, Bordetella pertussis
ugccgcuggacgcgccga

SEQ ID NO: 2381759 - RNA, 17 nt, Bordetella pertussis
ugccgcuggugaucugc

SEQ ID NO: 2381760 - RNA, 21 nt, Bordetella pertussis
ugccgcuggugaucugcugcg

SEQ ID NO: 2381761 - RNA, 17 nt, Bordetella pertussis
ugccgcuggugcugaga

SEQ ID NO: 2381762 - RNA, 19 nt, Bordetella pertussis
ugccggaccugggcaucaa

SEQ ID NO: 2381763 - RNA, 14 nt, Bordetella pertussis
ugccggacgccgac

SEQ ID NO: 2381764 - RNA, 20 nt, Bordetella pertussis
ugccggagauccggccuucc

SEQ ID NO: 2381765 - RNA, 14 nt, Bordetella pertussis
ugccggagcagcag

SEQ ID NO: 2381766 - RNA, 15 nt, Bordetella pertussis
ugccggagcagcagc

SEQ ID NO: 2381767 - RNA, 21 nt, Bordetella pertussis
ugccggagcagcagcgggcuu

SEQ ID NO: 2381768 - RNA, 17 nt, Bordetella pertussis
ugccggaggucggcgca

SEQ ID NO: 2381769 - RNA, 12 nt, Bordetella pertussis
ugccggauggcg

SEQ ID NO: 2381770 - RNA, 15 nt, Bordetella pertussis
ugccggauggcgcgg

SEQ ID NO: 2381771 - RNA, 16 nt, Bordetella pertussis
ugccggauggcgcgga

SEQ ID NO: 2381772 - RNA, 15 nt, Bordetella pertussis
ugccggauggcgucc

SEQ ID NO: 2381773 - RNA, 18 nt, Bordetella pertussis
ugccggauuggcgcugca

SEQ ID NO: 2381774 - RNA, 16 nt, Bordetella pertussis
ugccggcaagcacgaa

SEQ ID NO: 2381775 - RNA, 23 nt, Bordetella pertussis
ugccggcaagcacgaacagguug

SEQ ID NO: 2381776 - RNA, 20 nt, Bordetella pertussis
ugccggcauaggcggcgcag

SEQ ID NO: 2381777 - RNA, 12 nt, Bordetella pertussis
ugccggccagca

SEQ ID NO: 2381778 - RNA, 18 nt, Bordetella pertussis
ugccggccagcacgggcg

SEQ ID NO: 2381779 - RNA, 15 nt, Bordetella pertussis
ugccggccagcagcg

SEQ ID NO: 2381780 - RNA, 20 nt, Bordetella pertussis
ugccggcccaucuguacggc

SEQ ID NO: 2381781 - RNA, 14 nt, Bordetella pertussis
ugccggccgaccgg

SEQ ID NO: 2381782 - RNA, 23 nt, Bordetella pertussis
ugccggccgaccggcgcgcgcgu

SEQ ID NO: 2381783 - RNA, 20 nt, Bordetella pertussis
ugccggccgauagccgcggc

SEQ ID NO: 2381784 - RNA, 14 nt, Bordetella pertussis
ugccggccgcccag

SEQ ID NO: 2381785 - RNA, 18 nt, Bordetella pertussis
ugccggccgcccaggcgc

SEQ ID NO: 2381786 - RNA, 19 nt, Bordetella pertussis
ugccggccgcccaggcgca

SEQ ID NO: 2381787 - RNA, 22 nt, Bordetella pertussis
ugccggccgcccaggcgcagcc

SEQ ID NO: 2381788 - RNA, 23 nt, Bordetella pertussis
ugccggccgcccaggcgcagccg

SEQ ID NO: 2381789 - RNA, 15 nt, Bordetella pertussis
ugccggccgccucca

SEQ ID NO: 2381790 - RNA, 15 nt, Bordetella pertussis
ugccggccggaccgc

SEQ ID NO: 2381791 - RNA, 16 nt, Bordetella pertussis
ugccggccuggcgggc

SEQ ID NO: 2381792 - RNA, 18 nt, Bordetella pertussis
ugccggcgaucacgccga

SEQ ID NO: 2381793 - RNA, 15 nt, Bordetella pertussis
ugccggcgcaggaag

SEQ ID NO: 2381794 - RNA, 20 nt, Bordetella pertussis
ugccggcgcccuugaugccg

SEQ ID NO: 2381795 - RNA, 19 nt, Bordetella pertussis
ugccggcgcgggcgcaggc

SEQ ID NO: 2381796 - RNA, 20 nt, Bordetella pertussis
ugccggcgcgggcgcaggcg

SEQ ID NO: 2381797 - RNA, 21 nt, Bordetella pertussis
ugccggcgcgggcgcaggcgu

SEQ ID NO: 2381798 - RNA, 15 nt, Bordetella pertussis
ugccggcgcugcgca

SEQ ID NO: 2381799 - RNA, 18 nt, Bordetella pertussis
ugccggcgcugcgcagca

SEQ ID NO: 2381800 - RNA, 13 nt, Bordetella pertussis
ugccggcggccua

SEQ ID NO: 2381801 - RNA, 19 nt, Bordetella pertussis
ugccggcggccugcacggu

SEQ ID NO: 2381802 - RNA, 22 nt, Bordetella pertussis
ugccggcguucuggucagccgu

SEQ ID NO: 2381803 - RNA, 16 nt, Bordetella pertussis
ugccggcguuggccgg

SEQ ID NO: 2381804 - RNA, 14 nt, Bordetella pertussis
ugccgggacaggca

SEQ ID NO: 2381805 - RNA, 16 nt, Bordetella pertussis
ugccgggauccacgcc

SEQ ID NO: 2381806 - RNA, 20 nt, Bordetella pertussis
ugccgggauccacgccgccg

SEQ ID NO: 2381807 - RNA, 15 nt, Bordetella pertussis
ugccgggaugcugcu

SEQ ID NO: 2381808 - RNA, 23 nt, Bordetella pertussis
ugccgggcagcaucacggugccg

SEQ ID NO: 2381809 - RNA, 16 nt, Bordetella pertussis
ugccggucaggaugcg

SEQ ID NO: 2381810 - RNA, 19 nt, Bordetella pertussis
ugccggucaggaugcgcgc

SEQ ID NO: 2381811 - RNA, 22 nt, Bordetella pertussis
ugccggucaggaugcgcgccag

SEQ ID NO: 2381812 - RNA, 16 nt, Bordetella pertussis
ugccggucuccagcgc

SEQ ID NO: 2381813 - RNA, 13 nt, Bordetella pertussis
ugccggugcucgg

SEQ ID NO: 2381814 - RNA, 14 nt, Bordetella pertussis
ugccggugcucggc

SEQ ID NO: 2381815 - RNA, 18 nt, Bordetella pertussis
ugccggugcucggccagc

SEQ ID NO: 2381816 - RNA, 18 nt, Bordetella pertussis
ugccgguggacggccagc

SEQ ID NO: 2381817 - RNA, 16 nt, Bordetella pertussis
ugccgguugcgcgccg

SEQ ID NO: 2381818 - RNA, 16 nt, Bordetella pertussis
ugccguaccaguacac

SEQ ID NO: 2381819 - RNA, 14 nt, Bordetella pertussis
ugccguacuuggcg

SEQ ID NO: 2381820 - RNA, 15 nt, Bordetella pertussis
ugccguagcccaggu

SEQ ID NO: 2381821 - RNA, 21 nt, Bordetella pertussis
ugccguagcccagguccagcg

SEQ ID NO: 2381822 - RNA, 15 nt, Bordetella pertussis
ugcgaccgagccacg

SEQ ID NO: 2381823 - RNA, 19 nt, Bordetella pertussis
ugcgacgauccggcgaccg

SEQ ID NO: 2381824 - RNA, 21 nt, Bordetella pertussis
ugcgacgauccggcgaccgac

SEQ ID NO: 2381825 - RNA, 20 nt, Bordetella pertussis
ugcgacgcaugucagcgccu

SEQ ID NO: 2381826 - RNA, 12 nt, Bordetella pertussis
ugcgacgccgcc

SEQ ID NO: 2381827 - RNA, 12 nt, Bordetella pertussis
ugcgacugcagg

SEQ ID NO: 2381828 - RNA, 16 nt, Bordetella pertussis
ugcgagacgaaggcgc

SEQ ID NO: 2381829 - RNA, 19 nt, Bordetella pertussis
ugcgagagauagcccagca

SEQ ID NO: 2381830 - RNA, 22 nt, Bordetella pertussis
ugcgagagauagcccagcaccu

SEQ ID NO: 2381831 - RNA, 23 nt, Bordetella pertussis
ugcgagcaaaggacacgcgcgag

SEQ ID NO: 2381832 - RNA, 16 nt, Bordetella pertussis
ugcgagcacggcgugg

SEQ ID NO: 2381833 - RNA, 20 nt, Bordetella pertussis
ugcgagcagaugcaccggcc

SEQ ID NO: 2381834 - RNA, 17 nt, Bordetella pertussis
ugcgaggcccggccugc

SEQ ID NO: 2381835 - RNA, 18 nt, Bordetella pertussis
ugcgaggcccggccugcg

SEQ ID NO: 2381836 - RNA, 18 nt, Bordetella pertussis
ugcgaggcgaacauggcc

SEQ ID NO: 2381837 - RNA, 20 nt, Bordetella pertussis
ugcgaggugcccgcgaagca

SEQ ID NO: 2381838 - RNA, 16 nt, Bordetella pertussis
ugcgauaggugcgcag

SEQ ID NO: 2381839 - RNA, 18 nt, Bordetella pertussis
ugcgauaggugcgcagcc

SEQ ID NO: 2381840 - RNA, 18 nt, Bordetella pertussis
ugcgauaucccgggcucc

SEQ ID NO: 2381841 - RNA, 16 nt, Bordetella pertussis
ugcgauccagggcgau

SEQ ID NO: 2381842 - RNA, 12 nt, Bordetella pertussis
ugcgaugccggc

SEQ ID NO: 2381843 - RNA, 23 nt, Bordetella pertussis
ugcgauggaacucguuggccagc

SEQ ID NO: 2381844 - RNA, 15 nt, Bordetella pertussis
ugcgcaacgcgcgcg

SEQ ID NO: 2381845 - RNA, 22 nt, Bordetella pertussis
ugcgcaacgcgcgcgcgcacag

SEQ ID NO: 2381846 - RNA, 12 nt, Bordetella pertussis
ugcgcaagccgc

SEQ ID NO: 2381847 - RNA, 14 nt, Bordetella pertussis
ugcgcaagccgccc

SEQ ID NO: 2381848 - RNA, 18 nt, Bordetella pertussis
ugcgcaagccgcccgcgg

SEQ ID NO: 2381849 - RNA, 18 nt, Bordetella pertussis
ugcgcaagccggccgcgc

SEQ ID NO: 2381850 - RNA, 21 nt, Bordetella pertussis
ugcgcaaguucaucaucgccg

SEQ ID NO: 2381851 - RNA, 22 nt, Bordetella pertussis
ugcgcaaguucaucaucgccga

SEQ ID NO: 2381852 - RNA, 17 nt, Bordetella pertussis
ugcgcaauucuuccucc

SEQ ID NO: 2381853 - RNA, 15 nt, Bordetella pertussis
ugcgcaccaccgccg

SEQ ID NO: 2381854 - RNA, 16 nt, Bordetella pertussis
ugcgcaccaccgccga

SEQ ID NO: 2381855 - RNA, 13 nt, Bordetella pertussis
ugcgcaccaggcc

SEQ ID NO: 2381856 - RNA, 15 nt, Bordetella pertussis
ugcgcaccaggcgcu

SEQ ID NO: 2381857 - RNA, 20 nt, Bordetella pertussis
ugcgcaccaggcgcucgcgc

SEQ ID NO: 2381858 - RNA, 19 nt, Bordetella pertussis
ugcgcaccccggugucgcc

SEQ ID NO: 2381859 - RNA, 14 nt, Bordetella pertussis
ugcgcacccgccug

SEQ ID NO: 2381860 - RNA, 21 nt, Bordetella pertussis
ugcgcaccgcuucuucgucgc

SEQ ID NO: 2381861 - RNA, 16 nt, Bordetella pertussis
ugcgcaccggccaggg

SEQ ID NO: 2381862 - RNA, 14 nt, Bordetella pertussis
ugcgcaccuugccc

SEQ ID NO: 2381863 - RNA, 17 nt, Bordetella pertussis
ugcgcaccuugcccacg

SEQ ID NO: 2381864 - RNA, 18 nt, Bordetella pertussis
ugcgcaccuugcccacgc

SEQ ID NO: 2381865 - RNA, 13 nt, Bordetella pertussis
ugcgcacgcccag

SEQ ID NO: 2381866 - RNA, 22 nt, Bordetella pertussis
ugcgcacgcgcgugauggagac

SEQ ID NO: 2381867 - RNA, 22 nt, Bordetella pertussis
ugcgcacgcguucgggcggcag

SEQ ID NO: 2381868 - RNA, 18 nt, Bordetella pertussis
ugcgcacgcuggcgcccg

SEQ ID NO: 2381869 - RNA, 21 nt, Bordetella pertussis
ugcgcacgggcgagggcugcc

SEQ ID NO: 2381870 - RNA, 15 nt, Bordetella pertussis
ugcgcagacgacgca

SEQ ID NO: 2381871 - RNA, 14 nt, Bordetella pertussis
ugcgcagcaccagc

SEQ ID NO: 2381872 - RNA, 17 nt, Bordetella pertussis
ugcgcagcagcagcgca

SEQ ID NO: 2381873 - RNA, 18 nt, Bordetella pertussis
ugcgcagcaggcgcgugc

SEQ ID NO: 2381874 - RNA, 14 nt, Bordetella pertussis
ugcgcagcaggugg

SEQ ID NO: 2381875 - RNA, 12 nt, Bordetella pertussis
ugcgcagccggg

SEQ ID NO: 2381876 - RNA, 17 nt, Bordetella pertussis
ugcgcagccgggcugcc

SEQ ID NO: 2381877 - RNA, 21 nt, Bordetella pertussis
ugcgcagccgggcugccggca

SEQ ID NO: 2381878 - RNA, 16 nt, Bordetella pertussis
ugcgcagcggcaggcg

SEQ ID NO: 2381879 - RNA, 17 nt, Bordetella pertussis
ugcgcaggacggcgccg

SEQ ID NO: 2381880 - RNA, 16 nt, Bordetella pertussis
ugcgcagggcgggcgg

SEQ ID NO: 2381881 - RNA, 20 nt, Bordetella pertussis
ugcgcaggguuuccgacacc

SEQ ID NO: 2381882 - RNA, 16 nt, Bordetella pertussis
ugcgcaggucggccag

SEQ ID NO: 2381883 - RNA, 15 nt, Bordetella pertussis
ugcgcaguggcgagg

SEQ ID NO: 2381884 - RNA, 19 nt, Bordetella pertussis
ugcgcaucgaucagcgcgc

SEQ ID NO: 2381885 - RNA, 16 nt, Bordetella pertussis
ugcgcaucgaugcggc

SEQ ID NO: 2381886 - RNA, 17 nt, Bordetella pertussis
ugcgcaucgaugcggcc

SEQ ID NO: 2381887 - RNA, 16 nt, Bordetella pertussis
ugcgcaucgcgaccgc

SEQ ID NO: 2381888 - RNA, 16 nt, Bordetella pertussis
ugcgcaucggcggcag

SEQ ID NO: 2381889 - RNA, 14 nt, Bordetella pertussis
ugcgcauggccagc

SEQ ID NO: 2381890 - RNA, 22 nt, Bordetella pertussis
ugcgcauggccagcgcgcaggu

SEQ ID NO: 2381891 - RNA, 12 nt, Bordetella pertussis
ugcgcauggccg

SEQ ID NO: 2381892 - RNA, 15 nt, Bordetella pertussis
ugcgcauggucgcga

SEQ ID NO: 2381893 - RNA, 19 nt, Bordetella pertussis
ugcgcauggucgcgaugcg

SEQ ID NO: 2381894 - RNA, 17 nt, Bordetella pertussis
ugcgccaacggugccag

SEQ ID NO: 2381895 - RNA, 21 nt, Bordetella pertussis
ugcgccaccagcuugcgcgcc

SEQ ID NO: 2381896 - RNA, 18 nt, Bordetella pertussis
ugcgccaccgcauggggc

SEQ ID NO: 2381897 - RNA, 15 nt, Bordetella pertussis
ugcgccaccuggcgc

SEQ ID NO: 2381898 - RNA, 16 nt, Bordetella pertussis
ugcgccaccuggcgcc

SEQ ID NO: 2381899 - RNA, 20 nt, Bordetella pertussis
ugcgccaccuggcgcccggc

SEQ ID NO: 2381900 - RNA, 17 nt, Bordetella pertussis
ugcgccacgauguagcc

SEQ ID NO: 2381901 - RNA, 22 nt, Bordetella pertussis
ugcgccacgauguagccgaccc

SEQ ID NO: 2381902 - RNA, 20 nt, Bordetella pertussis
ugcgccacggucugcacgcc

SEQ ID NO: 2381903 - RNA, 21 nt, Bordetella pertussis
ugcgccacggucugcacgccg

SEQ ID NO: 2381904 - RNA, 14 nt, Bordetella pertussis
ugcgccacguccag

SEQ ID NO: 2381905 - RNA, 18 nt, Bordetella pertussis
ugcgccacguccagcacg

SEQ ID NO: 2381906 - RNA, 22 nt, Bordetella pertussis
ugcgccacguccagcacggccg

SEQ ID NO: 2381907 - RNA, 15 nt, Bordetella pertussis
ugcgccagcaggaug

SEQ ID NO: 2381908 - RNA, 21 nt, Bordetella pertussis
ugcgccagcaggauguccacg

SEQ ID NO: 2381909 - RNA, 16 nt, Bordetella pertussis
ugcgccagccacgcgc

SEQ ID NO: 2381910 - RNA, 18 nt, Bordetella pertussis
ugcgccagccacgcgcgc

SEQ ID NO: 2381911 - RNA, 15 nt, Bordetella pertussis
ugcgccagccagcgc

SEQ ID NO: 2381912 - RNA, 17 nt, Bordetella pertussis
ugcgccagccagcgcau

SEQ ID NO: 2381913 - RNA, 21 nt, Bordetella pertussis
ugcgccagccagcgcaugccg

SEQ ID NO: 2381914 - RNA, 21 nt, Bordetella pertussis
ugcgccagccgcgccugcagc

SEQ ID NO: 2381915 - RNA, 20 nt, Bordetella pertussis
ugcgccagccguugcgccag

SEQ ID NO: 2381916 - RNA, 13 nt, Bordetella pertussis
ugcgccagcgccu

SEQ ID NO: 2381917 - RNA, 13 nt, Bordetella pertussis
ugcgccagcgcga

SEQ ID NO: 2381918 - RNA, 15 nt, Bordetella pertussis
ugcgccagcggcgac

SEQ ID NO: 2381919 - RNA, 20 nt, Bordetella pertussis
ugcgccagcggcgacugccc

SEQ ID NO: 2381920 - RNA, 19 nt, Bordetella pertussis
ugcgccagcuccagccgca

SEQ ID NO: 2381921 - RNA, 23 nt, Bordetella pertussis
ugcgccagcuugcgcgccuuggc

SEQ ID NO: 2381922 - RNA, 12 nt, Bordetella pertussis
ugcgccaggugc

SEQ ID NO: 2381923 - RNA, 16 nt, Bordetella pertussis
ugcgccaguccagcgc

SEQ ID NO: 2381924 - RNA, 18 nt, Bordetella pertussis
ugcgccaguccagcgcgc

SEQ ID NO: 2381925 - RNA, 20 nt, Bordetella pertussis
ugcgccaguccagcgcgccg

SEQ ID NO: 2381926 - RNA, 17 nt, Bordetella pertussis
ugcgccaguugcggggc

SEQ ID NO: 2381927 - RNA, 20 nt, Bordetella pertussis
ugcgccaguugcggggcgcc

SEQ ID NO: 2381928 - RNA, 17 nt, Bordetella pertussis
ugcgccauggcgcgcag

SEQ ID NO: 2381929 - RNA, 15 nt, Bordetella pertussis
ugcgccauguccgag

SEQ ID NO: 2381930 - RNA, 18 nt, Bordetella pertussis
ugcgccauguggcgacgc

SEQ ID NO: 2381931 - RNA, 19 nt, Bordetella pertussis
ugcgccauguggcgacgcc

SEQ ID NO: 2381932 - RNA, 21 nt, Bordetella pertussis
ugcgccauguggcgacgccca

SEQ ID NO: 2381933 - RNA, 11 nt, Bordetella pertussis
ugcgcccaugg

SEQ ID NO: 2381934 - RNA, 18 nt, Bordetella pertussis
ugcgcccauggcgcgcag

SEQ ID NO: 2381935 - RNA, 15 nt, Bordetella pertussis
ugcgcccccaugucc

SEQ ID NO: 2381936 - RNA, 13 nt, Bordetella pertussis
ugcgccccgccau

SEQ ID NO: 2381937 - RNA, 21 nt, Bordetella pertussis
ugcgccccgccucgacgaugc

SEQ ID NO: 2381938 - RNA, 23 nt, Bordetella pertussis
ugcgccccgccucgacgaugccc

SEQ ID NO: 2381939 - RNA, 20 nt, Bordetella pertussis
ugcgccccgcuggccgucgc

SEQ ID NO: 2381940 - RNA, 23 nt, Bordetella pertussis
ugcgcccgacgcuguaacaacac

SEQ ID NO: 2381941 - RNA, 13 nt, Bordetella pertussis
ugcgccgaggccu

SEQ ID NO: 2381942 - RNA, 15 nt, Bordetella pertussis
ugcgccgaggccugc

SEQ ID NO: 2381943 - RNA, 20 nt, Bordetella pertussis
ugcgccgaucgcggcuccag

SEQ ID NO: 2381944 - RNA, 14 nt, Bordetella pertussis
ugcgccgcaacgcc

SEQ ID NO: 2381945 - RNA, 18 nt, Bordetella pertussis
ugcgccgcaacgccgccg

SEQ ID NO: 2381946 - RNA, 13 nt, Bordetella pertussis
ugcgccgcaccag

SEQ ID NO: 2381947 - RNA, 18 nt, Bordetella pertussis
ugcgccgcaccagcgccg

SEQ ID NO: 2381948 - RNA, 18 nt, Bordetella pertussis
ugcgccgcaugcggcggc

SEQ ID NO: 2381949 - RNA, 17 nt, Bordetella pertussis
ugcgccgccccaguugc

SEQ ID NO: 2381950 - RNA, 14 nt, Bordetella pertussis
ugcgccgcccgugc

SEQ ID NO: 2381951 - RNA, 17 nt, Bordetella pertussis
ugcgccgcccgugccag

SEQ ID NO: 2381952 - RNA, 22 nt, Bordetella pertussis
ugcgccgcccgugccaguucac

SEQ ID NO: 2381953 - RNA, 11 nt, Bordetella pertussis
ugcgccgccgc

SEQ ID NO: 2381954 - RNA, 19 nt, Bordetella pertussis
ugcgccgccgccgcggccu

SEQ ID NO: 2381955 - RNA, 22 nt, Bordetella pertussis
ugcgccgccgccgcggccuggc

SEQ ID NO: 2381956 - RNA, 21 nt, Bordetella pertussis
ugcgccgccgcgcgcuggcug

SEQ ID NO: 2381957 - RNA, 12 nt, Bordetella pertussis
ugcgccgccggc

SEQ ID NO: 2381958 - RNA, 20 nt, Bordetella pertussis
ugcgccgccggccugcugca

SEQ ID NO: 2381959 - RNA, 12 nt, Bordetella pertussis
ugcgccgcgccg

SEQ ID NO: 2381960 - RNA, 14 nt, Bordetella pertussis
ugcgccgcggcgcu

SEQ ID NO: 2381961 - RNA, 20 nt, Bordetella pertussis
ugcgccgcggcgcuggaugg

SEQ ID NO: 2381962 - RNA, 17 nt, Bordetella pertussis
ugcgccgcuacgcggcg

SEQ ID NO: 2381963 - RNA, 17 nt, Bordetella pertussis
ugcgccggcauggccaa

SEQ ID NO: 2381964 - RNA, 14 nt, Bordetella pertussis
ugcgccggcccggc

SEQ ID NO: 2381965 - RNA, 13 nt, Bordetella pertussis
ugcgccggccugg

SEQ ID NO: 2381966 - RNA, 17 nt, Bordetella pertussis
ugcgccggccuggcgcg

SEQ ID NO: 2381967 - RNA, 18 nt, Bordetella pertussis
ugcgccggccuggcgcga

SEQ ID NO: 2381968 - RNA, 14 nt, Bordetella pertussis
ugcgccggcgcggc

SEQ ID NO: 2381969 - RNA, 15 nt, Bordetella pertussis
ugcgccggcgcggcg

SEQ ID NO: 2381970 - RNA, 14 nt, Bordetella pertussis
ugcgccggcggcac

SEQ ID NO: 2381971 - RNA, 16 nt, Bordetella pertussis
ugcgccggcggcaccg

SEQ ID NO: 2381972 - RNA, 17 nt, Bordetella pertussis
ugcgccgggcgcggcca

SEQ ID NO: 2381973 - RNA, 20 nt, Bordetella pertussis
ugcgccgggcgcggccaggc

SEQ ID NO: 2381974 - RNA, 13 nt, Bordetella pertussis
ugcgccgggcguc

SEQ ID NO: 2381975 - RNA, 15 nt, Bordetella pertussis
ugcgccggggcgccg

SEQ ID NO: 2381976 - RNA, 21 nt, Bordetella pertussis
ugcgccguccgugagugcagc

SEQ ID NO: 2381977 - RNA, 14 nt, Bordetella pertussis
ugcgccguccucag

SEQ ID NO: 2381978 - RNA, 22 nt, Bordetella pertussis
ugcgccguccucaggcccgcgg

SEQ ID NO: 2381979 - RNA, 22 nt, Bordetella pertussis
ugcgccgucugcgccgccgcgu

SEQ ID NO: 2381980 - RNA, 17 nt, Bordetella pertussis
ugcgccgugcccggcgg

SEQ ID NO: 2381981 - RNA, 12 nt, Bordetella pertussis
ugcgccugcugg

SEQ ID NO: 2381982 - RNA, 14 nt, Bordetella pertussis
ugcgccugcugguc

SEQ ID NO: 2381983 - RNA, 16 nt, Bordetella pertussis
ugcgccuggccgcgcu

SEQ ID NO: 2381984 - RNA, 18 nt, Bordetella pertussis
ugcgccugggcggcgcag

SEQ ID NO: 2381985 - RNA, 19 nt, Bordetella pertussis
ugcgccugggcggcgcagu

SEQ ID NO: 2381986 - RNA, 16 nt, Bordetella pertussis
ugcgccuuacuuguac

SEQ ID NO: 2381987 - RNA, 15 nt, Bordetella pertussis
ugcgcgaaacggccg

SEQ ID NO: 2381988 - RNA, 16 nt, Bordetella pertussis
ugcgcgaaacggccgg

SEQ ID NO: 2381989 - RNA, 13 nt, Bordetella pertussis
ugcgcgaacgcgc

SEQ ID NO: 2381990 - RNA, 16 nt, Bordetella pertussis
ugcgcgaacgcgcgcc

SEQ ID NO: 2381991 - RNA, 17 nt, Bordetella pertussis
ugcgcgaacgcgcgccg

SEQ ID NO: 2381992 - RNA, 21 nt, Bordetella pertussis
ugcgcgaacgcgcgccggcca

SEQ ID NO: 2381993 - RNA, 17 nt, Bordetella pertussis
ugcgcgaacgcggccau

SEQ ID NO: 2381994 - RNA, 19 nt, Bordetella pertussis
ugcgcgaacggcaggugca

SEQ ID NO: 2381995 - RNA, 20 nt, Bordetella pertussis
ugcgcgaagcggaaacgcgc

SEQ ID NO: 2381996 - RNA, 15 nt, Bordetella pertussis
ugcgcgaaggccgcc

SEQ ID NO: 2381997 - RNA, 20 nt, Bordetella pertussis
ugcgcgacaaccgcggcgac

SEQ ID NO: 2381998 - RNA, 16 nt, Bordetella pertussis
ugcgcgacagcaggcc

SEQ ID NO: 2381999 - RNA, 13 nt, Bordetella pertussis
ugcgcgacaggcc

SEQ ID NO: 2382000 - RNA, 14 nt, Bordetella pertussis
ugcgcgaccuccag

SEQ ID NO: 2382001 - RNA, 13 nt, Bordetella pertussis
ugcgcgacggcga

SEQ ID NO: 2382002 - RNA, 16 nt, Bordetella pertussis
ugcgcgacggcggccu

SEQ ID NO: 2382003 - RNA, 16 nt, Bordetella pertussis
ugcgcgaggugccgga

SEQ ID NO: 2382004 - RNA, 19 nt, Bordetella pertussis
ugcgcgaggugggcggcag

SEQ ID NO: 2382005 - RNA, 23 nt, Bordetella pertussis
ugcgcgaggugggcggcagcagg

SEQ ID NO: 2382006 - RNA, 20 nt, Bordetella pertussis
ugcgcgaucucguggcccag

SEQ ID NO: 2382007 - RNA, 15 nt, Bordetella pertussis
ugcgcgaugcgcgcg

SEQ ID NO: 2382008 - RNA, 16 nt, Bordetella pertussis
ugcgcgaugcgcgcgu

SEQ ID NO: 2382009 - RNA, 24 nt, Bordetella pertussis
ugcgcgccaaaaggcagcaggcug

SEQ ID NO: 2382010 - RNA, 22 nt, Bordetella pertussis
ugcgcgccacauccugcacggc

SEQ ID NO: 2382011 - RNA, 12 nt, Bordetella pertussis
ugcgcgccacgu

SEQ ID NO: 2382012 - RNA, 15 nt, Bordetella pertussis
ugcgcgccaggucgc

SEQ ID NO: 2382013 - RNA, 14 nt, Bordetella pertussis
ugcgcgccaugcaa

SEQ ID NO: 2382014 - RNA, 20 nt, Bordetella pertussis
ugcgcgccaugcaacacgac

SEQ ID NO: 2382015 - RNA, 16 nt, Bordetella pertussis
ugcgcgcccgaugccc

SEQ ID NO: 2382016 - RNA, 13 nt, Bordetella pertussis
ugcgcgccgacag

SEQ ID NO: 2382017 - RNA, 12 nt, Bordetella pertussis
ugcgcgccgacc

SEQ ID NO: 2382018 - RNA, 18 nt, Bordetella pertussis
ugcgcgccgaccaccugc

SEQ ID NO: 2382019 - RNA, 19 nt, Bordetella pertussis
ugcgcgccgaccaccugca

SEQ ID NO: 2382020 - RNA, 16 nt, Bordetella pertussis
ugcgcgccgccgcgcu

SEQ ID NO: 2382021 - RNA, 22 nt, Bordetella pertussis
ugcgcgccgccgcgcugugcga

SEQ ID NO: 2382022 - RNA, 23 nt, Bordetella pertussis
ugcgcgccgccggugcaccaggc

SEQ ID NO: 2382023 - RNA, 12 nt, Bordetella pertussis
ugcgcgcgccag

SEQ ID NO: 2382024 - RNA, 22 nt, Bordetella pertussis
ugcgcgcgccauggugaacggc

SEQ ID NO: 2382025 - RNA, 14 nt, Bordetella pertussis
ugcgcgcgcgcugg

SEQ ID NO: 2382026 - RNA, 16 nt, Bordetella pertussis
ugcgcgcggccagcgc

SEQ ID NO: 2382027 - RNA, 12 nt, Bordetella pertussis
ugcgcgcggccu

SEQ ID NO: 2382028 - RNA, 13 nt, Bordetella pertussis
ugcgcgcggccug

SEQ ID NO: 2382029 - RNA, 15 nt, Bordetella pertussis
ugcgcgcggccuggc

SEQ ID NO: 2382030 - RNA, 16 nt, Bordetella pertussis
ugcgcgcucauggcgc

SEQ ID NO: 2382031 - RNA, 22 nt, Bordetella pertussis
ugcgcgcuugaacuccgcggcg

SEQ ID NO: 2382032 - RNA, 22 nt, Bordetella pertussis
ugcgcggcauacgccgauggcg

SEQ ID NO: 2382033 - RNA, 17 nt, Bordetella pertussis
ugcgcggccacccugcc

SEQ ID NO: 2382034 - RNA, 15 nt, Bordetella pertussis
ugcgcggccagcacc

SEQ ID NO: 2382035 - RNA, 16 nt, Bordetella pertussis
ugcgcggccagcaccg

SEQ ID NO: 2382036 - RNA, 21 nt, Bordetella pertussis
ugcgcggccagcaccggcccg

SEQ ID NO: 2382037 - RNA, 13 nt, Bordetella pertussis
ugcgcggccaggg

SEQ ID NO: 2382038 - RNA, 16 nt, Bordetella pertussis
ugcgcggccagggcug

SEQ ID NO: 2382039 - RNA, 15 nt, Bordetella pertussis
ugcgcggcccggccg

SEQ ID NO: 2382040 - RNA, 13 nt, Bordetella pertussis
ugcgcggccgcgc

SEQ ID NO: 2382041 - RNA, 12 nt, Bordetella pertussis
ugcgcggccguu

SEQ ID NO: 2382042 - RNA, 20 nt, Bordetella pertussis
ugcgcggccugcuccggcgu

SEQ ID NO: 2382043 - RNA, 22 nt, Bordetella pertussis
ugcgcggccugcuccggcguga

SEQ ID NO: 2382044 - RNA, 14 nt, Bordetella pertussis
ugcgcggcgagccg

SEQ ID NO: 2382045 - RNA, 17 nt, Bordetella pertussis
ugcgcggcgagcgccgc

SEQ ID NO: 2382046 - RNA, 23 nt, Bordetella pertussis
ugcgcggcgagcgccgccaggcc

SEQ ID NO: 2382047 - RNA, 14 nt, Bordetella pertussis
ugcgcggcgcgccg

SEQ ID NO: 2382048 - RNA, 22 nt, Bordetella pertussis
ugcgcggcgcgucgcgcgccag

SEQ ID NO: 2382049 - RNA, 21 nt, Bordetella pertussis
ugcggcgcccaggcccagcgc

SEQ ID NO: 2382050 - RNA, 23 nt, Bordetella pertussis
ugcggcgcccaggcccagcgcgc

SEQ ID NO: 2382051 - RNA, 17 nt, Bordetella pertussis
ugcggcgccucggucca

SEQ ID NO: 2382052 - RNA, 20 nt, Bordetella pertussis
ugcggcgccugucccgcugg

SEQ ID NO: 2382053 - RNA, 18 nt, Bordetella pertussis
ugcggcgcgcacgggcga

SEQ ID NO: 2382054 - RNA, 21 nt, Bordetella pertussis
ugcggcgcgcacgggcgaggc

SEQ ID NO: 2382055 - RNA, 14 nt, Bordetella pertussis
ugcggcgcggccag

SEQ ID NO: 2382056 - RNA, 17 nt, Bordetella pertussis
ugcggcgcggcgcgugc

SEQ ID NO: 2382057 - RNA, 14 nt, Bordetella pertussis
ugcggcgcggcggu

SEQ ID NO: 2382058 - RNA, 22 nt, Bordetella pertussis
ugcggcgcggcggugccugucc

SEQ ID NO: 2382059 - RNA, 19 nt, Bordetella pertussis
ugcggcggcgacucggcau

SEQ ID NO: 2382060 - RNA, 20 nt, Bordetella pertussis
ugcggcggcgacucggcauc

SEQ ID NO: 2382061 - RNA, 17 nt, Bordetella pertussis
ugcggcgggcgggucga

SEQ ID NO: 2382062 - RNA, 22 nt, Bordetella pertussis
ugcggcgggcgggucgaugucg

SEQ ID NO: 2382063 - RNA, 15 nt, Bordetella pertussis
ugcggcguggcgccg

SEQ ID NO: 2382064 - RNA, 16 nt, Bordetella pertussis
ugcggcugaucaccgc

SEQ ID NO: 2382065 - RNA, 18 nt, Bordetella pertussis
ugcggcugaucaccgccg

SEQ ID NO: 2382066 - RNA, 17 nt, Bordetella pertussis
ugcggcugggugcgguc

SEQ ID NO: 2382067 - RNA, 17 nt, Bordetella pertussis
ugcggcuugggcccggc

SEQ ID NO: 2382068 - RNA, 19 nt, Bordetella pertussis
ugcggcuugggcccggcgu

SEQ ID NO: 2382069 - RNA, 20 nt, Bordetella pertussis
ugcgggacaggcaucagguu

SEQ ID NO: 2382070 - RNA, 14 nt, Bordetella pertussis
ugcgggacaggcgc

SEQ ID NO: 2382071 - RNA, 16 nt, Bordetella pertussis
ugcgggacggccaggg

SEQ ID NO: 2382072 - RNA, 17 nt, Bordetella pertussis
ugcgggcaucgcccugc

SEQ ID NO: 2382073 - RNA, 12 nt, Bordetella pertussis
ugcgggccgcgc

SEQ ID NO: 2382074 - RNA, 15 nt, Bordetella pertussis
ugcgggccgcgcugg

SEQ ID NO: 2382075 - RNA, 12 nt, Bordetella pertussis
ugcgggccugca

SEQ ID NO: 2382076 - RNA, 19 nt, Bordetella pertussis
ugcgggcgcaagccagcac

SEQ ID NO: 2382077 - RNA, 22 nt, Bordetella pertussis
ugcgggcgcagcgccgcuucca

SEQ ID NO: 2382078 - RNA, 15 nt, Bordetella pertussis
ugcgggcggccuggg

SEQ ID NO: 2382079 - RNA, 22 nt, Bordetella pertussis
ugcgggcggccugggaggcgcu

SEQ ID NO: 2382080 - RNA, 17 nt, Bordetella pertussis
ugcgggcugaugcaggc

SEQ ID NO: 2382081 - RNA, 16 nt, Bordetella pertussis
ugcgggcuugcugccc

SEQ ID NO: 2382082 - RNA, 17 nt, Bordetella pertussis
ugcgggcuugcugcccc

SEQ ID NO: 2382083 - RNA, 18 nt, Bordetella pertussis
ugcgggcuugcugccccc

SEQ ID NO: 2382084 - RNA, 15 nt, Bordetella pertussis
ugcggggacaggcac

SEQ ID NO: 2382085 - RNA, 21 nt, Bordetella pertussis
ugcggggacaggcacccugcc

SEQ ID NO: 2382086 - RNA, 16 nt, Bordetella pertussis
ugcggggcgcccagcg

SEQ ID NO: 2382087 - RNA, 15 nt, Bordetella pertussis
ugcggggcggcaggu

SEQ ID NO: 2382088 - RNA, 13 nt, Bordetella pertussis
ugcgggggcaggc

SEQ ID NO: 2382089 - RNA, 14 nt, Bordetella pertussis
ugcgggggcaggca

SEQ ID NO: 2382090 - RNA, 15 nt, Bordetella pertussis
ugcgggggcaggcac

SEQ ID NO: 2382091 - RNA, 19 nt, Bordetella pertussis
ugcggggugccuguccccg

SEQ ID NO: 2382092 - RNA, 16 nt, Bordetella pertussis
ugcggguacuggccga

SEQ ID NO: 2382093 - RNA, 19 nt, Bordetella pertussis
ugcggguacuggccgacgg

SEQ ID NO: 2382094 - RNA, 21 nt, Bordetella pertussis
ugcgggucgaguugcgcgcca

SEQ ID NO: 2382095 - RNA, 18 nt, Bordetella pertussis
ugcgggucgucccagcgc

SEQ ID NO: 2382096 - RNA, 19 nt, Bordetella pertussis
ugcgggucgucccagcgca

SEQ ID NO: 2382097 - RNA, 21 nt, Bordetella pertussis
ugcgggugcgccugcagcgcc

SEQ ID NO: 2382098 - RNA, 15 nt, Bordetella pertussis
ugcgggugggcaucc

SEQ ID NO: 2382099 - RNA, 15 nt, Bordetella pertussis
ugcggguuggcaguc

SEQ ID NO: 2382100 - RNA, 19 nt, Bordetella pertussis
ugcgguacugcggcgccug

SEQ ID NO: 2382101 - RNA, 16 nt, Bordetella pertussis
ugcgguaggcccagca

SEQ ID NO: 2382102 - RNA, 15 nt, Bordetella pertussis
ugcgguccgaugucg

SEQ ID NO: 2382103 - RNA, 17 nt, Bordetella pertussis
ugcgguccguacgccac

SEQ ID NO: 2382104 - RNA, 23 nt, Bordetella pertussis
ugcggucgcggccggccugcuug

SEQ ID NO: 2382105 - RNA, 18 nt, Bordetella pertussis
ugcggucuaccgaagccg

SEQ ID NO: 2382106 - RNA, 15 nt, Bordetella pertussis
ugcggugccuguccc

SEQ ID NO: 2382107 - RNA, 16 nt, Bordetella pertussis
ugcggugcgccgcguc

SEQ ID NO: 2382108 - RNA, 17 nt, Bordetella pertussis
ugcggugcgcgaugccg

SEQ ID NO: 2382109 - RNA, 19 nt, Bordetella pertussis
ugcgguucgucagggccgc

SEQ ID NO: 2382110 - RNA, 21 nt, Bordetella pertussis
ugcgguugaucagggccgcca

SEQ ID NO: 2382111 - RNA, 22 nt, Bordetella pertussis
ugcgguugaucagggccgccag

SEQ ID NO: 2382112 - RNA, 18 nt, Bordetella pertussis
ugcgguuucucagcgcgc

SEQ ID NO: 2382113 - RNA, 19 nt, Bordetella pertussis
ugcgguuucucagcgcgcu

SEQ ID NO: 2382114 - RNA, 21 nt, Bordetella pertussis
ugcgguuugguagcaggcgcg

SEQ ID NO: 2382115 - RNA, 22 nt, Bordetella pertussis
ugcgguuugguagcaggcgcgc

SEQ ID NO: 2382116 - RNA, 21 nt, Bordetella pertussis
ugcguaucugaucggacuggg

SEQ ID NO: 2382117 - RNA, 15 nt, Bordetella pertussis
ugcguauucgguggc

SEQ ID NO: 2382118 - RNA, 23 nt, Bordetella pertussis
ugcgucacgaaagcgcccaggcc

SEQ ID NO: 2382119 - RNA, 21 nt, Bordetella pertussis
ugcgucagggcaaagaaauug

SEQ ID NO: 2382120 - RNA, 17 nt, Bordetella pertussis
ugcgucaguugaagacg

SEQ ID NO: 2382121 - RNA, 14 nt, Bordetella pertussis
ugcguccaccacca

SEQ ID NO: 2382122 - RNA, 18 nt, Bordetella pertussis
ugcguccaccaccaggcc

SEQ ID NO: 2382123 - RNA, 19 nt, Bordetella pertussis
ugcguccagccgagccugg

SEQ ID NO: 2382124 - RNA, 22 nt, Bordetella pertussis
ugcguccagccgagccuggcgu

SEQ ID NO: 2382125 - RNA, 14 nt, Bordetella pertussis
ugcguccaggacgc

SEQ ID NO: 2382126 - RNA, 18 nt, Bordetella pertussis
ugcguccuugaggaacug

SEQ ID NO: 2382127 - RNA, 19 nt, Bordetella pertussis
ugcgucgaacggccgggcg

SEQ ID NO: 2382128 - RNA, 20 nt, Bordetella pertussis
ugcgucgaacggccgggcgc

SEQ ID NO: 2382129 - RNA, 16 nt, Bordetella pertussis
ugcgucgccuggucga

SEQ ID NO: 2382130 - RNA, 16 nt, Bordetella pertussis
ugcgucuccagcgcgg

SEQ ID NO: 2382131 - RNA, 17 nt, Bordetella pertussis
ugcgucucggccuguuc

SEQ ID NO: 2382132 - RNA, 19 nt, Bordetella pertussis
ugcgugacacggccauccg

SEQ ID NO: 2382133 - RNA, 19 nt, Bordetella pertussis
ugcgugacccggggcagga

SEQ ID NO: 2382134 - RNA, 23 nt, Bordetella pertussis
ugcgugccgacgaugccgccgcc

SEQ ID NO: 2382135 - RNA, 16 nt, Bordetella pertussis
ugcgugcgcccauggc

SEQ ID NO: 2382136 - RNA, 15 nt, Bordetella pertussis
ugcgugcgccugucc

SEQ ID NO: 2382137 - RNA, 15 nt, Bordetella pertussis
ugcgugcgcggcgug

SEQ ID NO: 2382138 - RNA, 15 nt, Bordetella pertussis
ugcgugcgggacagg

SEQ ID NO: 2382139 - RNA, 17 nt, Bordetella pertussis
ugcgugcgggacaggca

SEQ ID NO: 2382140 - RNA, 18 nt, Bordetella pertussis
ugcgugcgggacaggcau

SEQ ID NO: 2382141 - RNA, 15 nt, Bordetella pertussis
ugcguggccggcggg

SEQ ID NO: 2382142 - RNA, 14 nt, Bordetella pertussis
ugcguggcgggccg

SEQ ID NO: 2382143 - RNA, 17 nt, Bordetella pertussis
ugcguggcgggccgcgc

SEQ ID NO: 2382144 - RNA, 17 nt, Bordetella pertussis
ugcguggucgcgggugg

SEQ ID NO: 2382145 - RNA, 15 nt, Bordetella pertussis
ugcgugucaggcgga

SEQ ID NO: 2382146 - RNA, 13 nt, Bordetella pertussis
ugcgugugccgcc

SEQ ID NO: 2382147 - RNA, 15 nt, Bordetella pertussis
ugcgugugccugucc

SEQ ID NO: 2382148 - RNA, 15 nt, Bordetella pertussis
ugcguucgcccgugc

SEQ ID NO: 2382149 - RNA, 17 nt, Bordetella pertussis
ugcguucgcccgugccg

SEQ ID NO: 2382150 - RNA, 14 nt, Bordetella pertussis
ugcguuggcgcggc

SEQ ID NO: 2382151 - RNA, 16 nt, Bordetella pertussis
ugcguuuucuggccuu

SEQ ID NO: 2382152 - RNA, 16 nt, Bordetella pertussis
ugcuacaccgugcugg

SEQ ID NO: 2382153 - RNA, 18 nt, Bordetella pertussis
ugcucaacggccaccagg

SEQ ID NO: 2382154 - RNA, 14 nt, Bordetella pertussis
ugcucagcagcacc

SEQ ID NO: 2382155 - RNA, 15 nt, Bordetella pertussis
ugcucagcagcaccg

SEQ ID NO: 2382156 - RNA, 16 nt, Bordetella pertussis
ugcucagucgggcagc

SEQ ID NO: 2382157 - RNA, 19 nt, Bordetella pertussis
ugcucagucgggcagcgcc

SEQ ID NO: 2382158 - RNA, 16 nt, Bordetella pertussis
ugcucauggcggcacg

SEQ ID NO: 2382159 - RNA, 15 nt, Bordetella pertussis
ugcuccacgugcggc

SEQ ID NO: 2382160 - RNA, 14 nt, Bordetella pertussis
ugcuccagccaggc

SEQ ID NO: 2382161 - RNA, 18 nt, Bordetella pertussis
ugcuccagccaggcgcgc

SEQ ID NO: 2382162 - RNA, 16 nt, Bordetella pertussis
ugcuggcggccgugcc

SEQ ID NO: 2382163 - RNA, 22 nt, Bordetella pertussis
ugcuggcucguucgcucggcgu

SEQ ID NO: 2382164 - RNA, 18 nt, Bordetella pertussis
ugcuggcuucggcgcugg

SEQ ID NO: 2382165 - RNA, 19 nt, Bordetella pertussis
ugcuggcuucggcgcuggg

SEQ ID NO: 2382166 - RNA, 23 nt, Bordetella pertussis
ugcugggcaugauggugcugccg

SEQ ID NO: 2382167 - RNA, 12 nt, Bordetella pertussis
ugcugggccauc

SEQ ID NO: 2382168 - RNA, 13 nt, Bordetella pertussis
ugcugggccaugc

SEQ ID NO: 2382169 - RNA, 13 nt, Bordetella pertussis
ugcugggccgcgc

SEQ ID NO: 2382170 - RNA, 12 nt, Bordetella pertussis
ugcugggccggc

SEQ ID NO: 2382171 - RNA, 14 nt, Bordetella pertussis
ugcugggccgggug

SEQ ID NO: 2382172 - RNA, 16 nt, Bordetella pertussis
ugcugggcggccaggc

SEQ ID NO: 2382173 - RNA, 17 nt, Bordetella pertussis
ugcugggcggcgggcac

SEQ ID NO: 2382174 - RNA, 16 nt, Bordetella pertussis
ugcugggcgggcuggu

SEQ ID NO: 2382175 - RNA, 20 nt, Bordetella pertussis
ugcugguacagccccagcgc

SEQ ID NO: 2382176 - RNA, 14 nt, Bordetella pertussis
ugcuggucagccug

SEQ ID NO: 2382177 - RNA, 17 nt, Bordetella pertussis
ugcuggucagccugggc

SEQ ID NO: 2382178 - RNA, 19 nt, Bordetella pertussis
ugcuggucagccugggcgc

SEQ ID NO: 2382179 - RNA, 17 nt, Bordetella pertussis
ugcuggucgccaucugc

SEQ ID NO: 2382180 - RNA, 12 nt, Bordetella pertussis
ugcuggucgcgc

SEQ ID NO: 2382181 - RNA, 18 nt, Bordetella pertussis
ugcuggucgcgggccagg

SEQ ID NO: 2382182 - RNA, 14 nt, Bordetella pertussis
ugcuggucggcgug

SEQ ID NO: 2382183 - RNA, 15 nt, Bordetella pertussis
ugcuggugcuggugc

SEQ ID NO: 2382184 - RNA, 15 nt, Bordetella pertussis
ugcuggugugaauga

SEQ ID NO: 2382185 - RNA, 20 nt, Bordetella pertussis
ugcuguaccucagccugcug

SEQ ID NO: 2382186 - RNA, 19 nt, Bordetella pertussis
ugcuguccagucuggaugg

SEQ ID NO: 2382187 - RNA, 20 nt, Bordetella pertussis
ugcugucgcgcgacuggccc

SEQ ID NO: 2382188 - RNA, 22 nt, Bordetella pertussis
ugcugucgcgcugcccguuggc

SEQ ID NO: 2382189 - RNA, 23 nt, Bordetella pertussis
ugcugucgcucaugaccagcggc

SEQ ID NO: 2382190 - RNA, 20 nt, Bordetella pertussis
ugcugugccugccaagcgcc

SEQ ID NO: 2382191 - RNA, 21 nt, Bordetella pertussis
ugcuguucgccacgcuguugc

SEQ ID NO: 2382192 - RNA, 17 nt, Bordetella pertussis
ugcuguuggccuucggc

SEQ ID NO: 2382193 - RNA, 17 nt, Bordetella pertussis
ugcuucaacuccuggac

SEQ ID NO: 2382194 - RNA, 20 nt, Bordetella pertussis
ugcuucgagauccgccggcg

SEQ ID NO: 2382195 - RNA, 22 nt, Bordetella pertussis
ugcuucugguaguuggccaggg

SEQ ID NO: 2382196 - RNA, 22 nt, Bordetella pertussis
ugcuugacgccgccgaagggca

SEQ ID NO: 2382197 - RNA, 12 nt, Bordetella pertussis
ugcuugaugccc

SEQ ID NO: 2382198 - RNA, 15 nt, Bordetella pertussis
ugcuugaugcccagc

SEQ ID NO: 2382199 - RNA, 13 nt, Bordetella pertussis
ugcuugccagcuc

SEQ ID NO: 2382200 - RNA, 17 nt, Bordetella pertussis
ugcuugccauaggccag

SEQ ID NO: 2382201 - RNA, 16 nt, Bordetella pertussis
ugcuugcccagcggaa

SEQ ID NO: 2382202 - RNA, 20 nt, Bordetella pertussis
ugcuugccgcagcggccaug

SEQ ID NO: 2382203 - RNA, 13 nt, Bordetella pertussis
ugcuugccugucc

SEQ ID NO: 2382204 - RNA, 16 nt, Bordetella pertussis
ugcuugccugucccca

SEQ ID NO: 2382205 - RNA, 19 nt, Bordetella pertussis
ugcuugcgauaggugcgca

SEQ ID NO: 2382206 - RNA, 16 nt, Bordetella pertussis
ugcuuggccgcguaca

SEQ ID NO: 2382207 - RNA, 17 nt, Bordetella pertussis
ugcuuggcgcgcagcag

SEQ ID NO: 2382208 - RNA, 12 nt, Bordetella pertussis
ugcuuggcgguc

SEQ ID NO: 2382209 - RNA, 14 nt, Bordetella pertussis
ugcuuguacaggcg

SEQ ID NO: 2382210 - RNA, 14 nt, Bordetella pertussis
uggaaagaccugcg

SEQ ID NO: 2382211 - RNA, 20 nt, Bordetella pertussis
uggaaauccuuggggucgcu

SEQ ID NO: 2382212 - RNA, 16 nt, Bordetella pertussis
uggaaaucgugccguc

SEQ ID NO: 2382213 - RNA, 17 nt, Bordetella pertussis
uggaaccgguuggccag

SEQ ID NO: 2382214 - RNA, 19 nt, Bordetella pertussis
uggaaccgguuggccagcu

SEQ ID NO: 2382215 - RNA, 20 nt, Bordetella pertussis
uggaaccgguuggccagcuc

SEQ ID NO: 2382216 - RNA, 22 nt, Bordetella pertussis
uggaaccgguuggccagcucca

SEQ ID NO: 2382217 - RNA, 17 nt, Bordetella pertussis
uggaacucguuggccag

SEQ ID NO: 2382218 - RNA, 23 nt, Bordetella pertussis
uggaacucguuggccagcgcgcc

SEQ ID NO: 2382219 - RNA, 15 nt, Bordetella pertussis
uggaagacguggccc

SEQ ID NO: 2382220 - RNA, 19 nt, Bordetella pertussis
uggaagacguggcccgcgu

SEQ ID NO: 2382221 - RNA, 22 nt, Bordetella pertussis
uggaagauguaccagcccagcc

SEQ ID NO: 2382222 - RNA, 19 nt, Bordetella pertussis
uggaagcgcgccaggcgca

SEQ ID NO: 2382223 - RNA, 14 nt, Bordetella pertussis
uggaagcugcggcc

SEQ ID NO: 2382224 - RNA, 19 nt, Bordetella pertussis
uggaagguccacggcaugg

SEQ ID NO: 2382225 - RNA, 23 nt, Bordetella pertussis
uggaagguccacggcauggccag

SEQ ID NO: 2382226 - RNA, 16 nt, Bordetella pertussis
uggaagugaugccgcc

SEQ ID NO: 2382227 - RNA, 18 nt, Bordetella pertussis
uggaaucauuggccagcg

SEQ ID NO: 2382228 - RNA, 23 nt, Bordetella pertussis
uggaaucgucgaccagcagcacg

SEQ ID NO: 2382229 - RNA, 17 nt, Bordetella pertussis
uggacacagcggcgcga

SEQ ID NO: 2382230 - RNA, 20 nt, Bordetella pertussis
uggacacgaugaacgcgcgc

SEQ ID NO: 2382231 - RNA, 16 nt, Bordetella pertussis
uggacagauccagcgc

SEQ ID NO: 2382232 - RNA, 18 nt, Bordetella pertussis
uggacagauccagcgcgg

SEQ ID NO: 2382233 - RNA, 20 nt, Bordetella pertussis
uggacagauccagcgcggcc

SEQ ID NO: 2382234 - RNA, 19 nt, Bordetella pertussis
uggacagcaguucggccgg

SEQ ID NO: 2382235 - RNA, 22 nt, Bordetella pertussis
uggacagcgccagcccgcugcc

SEQ ID NO: 2382236 - RNA, 22 nt, Bordetella pertussis
uggacaggcaccugcgaccgag

SEQ ID NO: 2382237 - RNA, 21 nt, Bordetella pertussis
uggacaggcgugcgcagcugu

SEQ ID NO: 2382238 - RNA, 22 nt, Bordetella pertussis
uggacaggcgugcgcagcuguu

SEQ ID NO: 2382239 - RNA, 18 nt, Bordetella pertussis
uggaccagcccguccugg

SEQ ID NO: 2382240 - RNA, 15 nt, Bordetella pertussis
uggaccagggcacgg

SEQ ID NO: 2382241 - RNA, 20 nt, Bordetella pertussis
uggaccccaguuccagcacg

SEQ ID NO: 2382242 - RNA, 22 nt, Bordetella pertussis
uggaccccaguuccagcacgac

SEQ ID NO: 2382243 - RNA, 14 nt, Bordetella pertussis
uggaccgcgcgcga

SEQ ID NO: 2382244 - RNA, 20 nt, Bordetella pertussis
uggaccgcgcgguggccgcc

SEQ ID NO: 2382245 - RNA, 16 nt, Bordetella pertussis
uggaccgggaauggcg

SEQ ID NO: 2382246 - RNA, 18 nt, Bordetella pertussis
uggaccugccguucgcgc

SEQ ID NO: 2382247 - RNA, 14 nt, Bordetella pertussis
uggaccugcuguuc

SEQ ID NO: 2382248 - RNA, 20 nt, Bordetella pertussis
uggaccuggacgagggccgc

SEQ ID NO: 2382249 - RNA, 17 nt, Bordetella pertussis
uggacgagggccggcgc

SEQ ID NO: 2382250 - RNA, 19 nt, Bordetella pertussis
uggacgagggccggcgcca

SEQ ID NO: 2382251 - RNA, 20 nt, Bordetella pertussis
uggacgaguugcucggagcc

SEQ ID NO: 2382252 - RNA, 15 nt, Bordetella pertussis
uggacgaugagcugg

SEQ ID NO: 2382253 - RNA, 14 nt, Bordetella pertussis
uggacgaugcgcga

SEQ ID NO: 2382254 - RNA, 21 nt, Bordetella pertussis
uggacgccaagaccgcggccg

SEQ ID NO: 2382255 - RNA, 13 nt, Bordetella pertussis
uggacgcccuggc

SEQ ID NO: 2382256 - RNA, 21 nt, Bordetella pertussis
uggacgcccuggcgcaggccg

SEQ ID NO: 2382257 - RNA, 22 nt, Bordetella pertussis
uggacgcccuggcgcaggccgg

SEQ ID NO: 2382258 - RNA, 19 nt, Bordetella pertussis
uggacgccgccggcccagg

SEQ ID NO: 2382259 - RNA, 21 nt, Bordetella pertussis
uggacgcgccgaacaccagcu

SEQ ID NO: 2382260 - RNA, 15 nt, Bordetella pertussis
uggacgcgcgcggcg

SEQ ID NO: 2382261 - RNA, 19 nt, Bordetella pertussis
uggacgcgcgcggcgaccg

SEQ ID NO: 2382262 - RNA, 21 nt, Bordetella pertussis
uggacgcgcuguaggcgccgg

SEQ ID NO: 2382263 - RNA, 18 nt, Bordetella pertussis
uggacgcuuucggggcgc

SEQ ID NO: 2382264 - RNA, 12 nt, Bordetella pertussis
uggacggccagc

SEQ ID NO: 2382265 - RNA, 12 nt, Bordetella pertussis
uggacggcgagg

SEQ ID NO: 2382266 - RNA, 13 nt, Bordetella pertussis
uggacggcgcugg

SEQ ID NO: 2382267 - RNA, 17 nt, Bordetella pertussis
uggacggcgcuggggaa

SEQ ID NO: 2382268 - RNA, 20 nt, Bordetella pertussis
uggacguaguugguggcagg

SEQ ID NO: 2382269 - RNA, 20 nt, Bordetella pertussis
uggacgugcgcgaccgcgcg

SEQ ID NO: 2382270 - RNA, 19 nt, Bordetella pertussis
uggacuauggccuggaugu

SEQ ID NO: 2382271 - RNA, 15 nt, Bordetella pertussis
uggagaacgagccgg

SEQ ID NO: 2382272 - RNA, 16 nt, Bordetella pertussis
uggagaacgagccggc

SEQ ID NO: 2382273 - RNA, 17 nt, Bordetella pertussis
uggagaacgagccggcc

SEQ ID NO: 2382274 - RNA, 22 nt, Bordetella pertussis
uggccacggcgucgaugcgcgc

SEQ ID NO: 2382275 - RNA, 22 nt, Bordetella pertussis
uggccacuuccagcgccugcuc

SEQ ID NO: 2382276 - RNA, 15 nt, Bordetella pertussis
uggccagcaagcgcu

SEQ ID NO: 2382277 - RNA, 21 nt, Bordetella pertussis
uggccagcaagcgcucggcca

SEQ ID NO: 2382278 - RNA, 12 nt, Bordetella pertussis
uggccagcagcg

SEQ ID NO: 2382279 - RNA, 18 nt, Bordetella pertussis
uggccagcagcgcaucgc

SEQ ID NO: 2382280 - RNA, 14 nt, Bordetella pertussis
uggccagcagcgcc

SEQ ID NO: 2382281 - RNA, 15 nt, Bordetella pertussis
uggccagcagcgccg

SEQ ID NO: 2382282 - RNA, 19 nt, Bordetella pertussis
uggccagcagcgccgccag

SEQ ID NO: 2382283 - RNA, 14 nt, Bordetella pertussis
uggccagccaggcg

SEQ ID NO: 2382284 - RNA, 21 nt, Bordetella pertussis
uggccagccaggcgguggccu

SEQ ID NO: 2382285 - RNA, 12 nt, Bordetella pertussis
uggccagccgcu

SEQ ID NO: 2382286 - RNA, 18 nt, Bordetella pertussis
uggccagccggcccagca

SEQ ID NO: 2382287 - RNA, 15 nt, Bordetella pertussis
uggccagcgccgcca

SEQ ID NO: 2382288 - RNA, 14 nt, Bordetella pertussis
uggccagcgccugg

SEQ ID NO: 2382289 - RNA, 20 nt, Bordetella pertussis
uggccagcgcgacggccucg

SEQ ID NO: 2382290 - RNA, 14 nt, Bordetella pertussis
uggccagcuccagg

SEQ ID NO: 2382291 - RNA, 17 nt, Bordetella pertussis
uggccagcuccagguag

SEQ ID NO: 2382292 - RNA, 16 nt, Bordetella pertussis
uggccagcugcguggc

SEQ ID NO: 2382293 - RNA, 17 nt, Bordetella pertussis
uggccagcugcguggcg

SEQ ID NO: 2382294 - RNA, 24 nt, Bordetella pertussis
uggccagcuggcgcguggccgcca

SEQ ID NO: 2382295 - RNA, 18 nt, Bordetella pertussis
uggccagcuggcggcgca

SEQ ID NO: 2382296 - RNA, 21 nt, Bordetella pertussis
uggccagcuggcggcgcagca

SEQ ID NO: 2382297 - RNA, 21 nt, Bordetella pertussis
uggccaggguuugcuggcgca

SEQ ID NO: 2382298 - RNA, 22 nt, Bordetella pertussis
uggccaggguuugcuggcgcag

SEQ ID NO: 2382299 - RNA, 12 nt, Bordetella pertussis
uggccaggucca

SEQ ID NO: 2382300 - RNA, 17 nt, Bordetella pertussis
uggccaucaacguggcg

SEQ ID NO: 2382301 - RNA, 18 nt, Bordetella pertussis
uggccaugcaccagcaca

SEQ ID NO: 2382302 - RNA, 21 nt, Bordetella pertussis
uggccaugcugggcgggcugg

SEQ ID NO: 2382303 - RNA, 23 nt, Bordetella pertussis
uggccaugcugggcgggcuggug

SEQ ID NO: 2382304 - RNA, 17 nt, Bordetella pertussis
uggccauguccuggcag

SEQ ID NO: 2382305 - RNA, 19 nt, Bordetella pertussis
uggccauuccuuccgggcc

SEQ ID NO: 2382306 - RNA, 16 nt, Bordetella pertussis
uggcccaagcccgugg

SEQ ID NO: 2382307 - RNA, 17 nt, Bordetella pertussis
uggcccaagcccguggc

SEQ ID NO: 2382308 - RNA, 13 nt, Bordetella pertussis
uggcccacgcgca

SEQ ID NO: 2382309 - RNA, 16 nt, Bordetella pertussis
uggcccagcugggcgg

SEQ ID NO: 2382310 - RNA, 17 nt, Bordetella pertussis
uggcccagcugggcggc

SEQ ID NO: 2382311 - RNA, 19 nt, Bordetella pertussis
uggcccagcugggcggcgu

SEQ ID NO: 2382312 - RNA, 15 nt, Bordetella pertussis
uggcccaggcgggcc

SEQ ID NO: 2382313 - RNA, 18 nt, Bordetella pertussis
uggcccaguucgcgcagc

SEQ ID NO: 2382314 - RNA, 22 nt, Bordetella pertussis
uggcccaguucgcgcagcagcu

SEQ ID NO: 2382315 - RNA, 19 nt, Bordetella pertussis
uggcccaugaacaggcacg

SEQ ID NO: 2382316 - RNA, 15 nt, Bordetella pertussis
uggccccaggcgccc

SEQ ID NO: 2382317 - RNA, 14 nt, Bordetella pertussis
uggccccaggcgug

SEQ ID NO: 2382318 - RNA, 13 nt, Bordetella pertussis
uggccccgcgcga

SEQ ID NO: 2382319 - RNA, 23 nt, Bordetella pertussis
uggcccgaauuccagcucugcuc

SEQ ID NO: 2382320 - RNA, 22 nt, Bordetella pertussis
uggcccgcaccgggcggcccgg

SEQ ID NO: 2382321 - RNA, 13 nt, Bordetella pertussis
uggcccgccacca

SEQ ID NO: 2382322 - RNA, 20 nt, Bordetella pertussis
uggcccgccucaaccuucuc

SEQ ID NO: 2382323 - RNA, 19 nt, Bordetella pertussis
uggcccgcgcgagcggcgu

SEQ ID NO: 2382324 - RNA, 20 nt, Bordetella pertussis
uggcccgcgugacggccgcc

SEQ ID NO: 2382325 - RNA, 19 nt, Bordetella pertussis
uggcccggcaccguccagc

SEQ ID NO: 2382326 - RNA, 22 nt, Bordetella pertussis
uggcccggcgggaacaggcacc

SEQ ID NO: 2382327 - RNA, 17 nt, Bordetella pertussis
uggcccggcucgccgag

SEQ ID NO: 2382328 - RNA, 17 nt, Bordetella pertussis
uggcccgggugccuguc

SEQ ID NO: 2382329 - RNA, 17 nt, Bordetella pertussis
uggcccgucaugggcgg

SEQ ID NO: 2382330 - RNA, 17 nt, Bordetella pertussis
uggcccugcagcggcca

SEQ ID NO: 2382331 - RNA, 18 nt, Bordetella pertussis
uggcccugcagcggccag

SEQ ID NO: 2382332 - RNA, 17 nt, Bordetella pertussis
uggcccugcuggggugg

SEQ ID NO: 2382333 - RNA, 22 nt, Bordetella pertussis
uggcccugcugggguggagcgc

SEQ ID NO: 2382334 - RNA, 16 nt, Bordetella pertussis
uggcccuggcaugugc

SEQ ID NO: 2382335 - RNA, 15 nt, Bordetella pertussis
uggcccuggcgggcc

SEQ ID NO: 2382336 - RNA, 13 nt, Bordetella pertussis
uggcccuugccca

SEQ ID NO: 2382337 - RNA, 18 nt, Bordetella pertussis
uggcccuuggucugcagg

SEQ ID NO: 2382338 - RNA, 19 nt, Bordetella pertussis
uggcccuuggucugcaggc

SEQ ID NO: 2382339 - RNA, 17 nt, Bordetella pertussis
uggccgaaccauugcag

SEQ ID NO: 2382340 - RNA, 22 nt, Bordetella pertussis
uggccgaacgccgccgcagccg

SEQ ID NO: 2382341 - RNA, 21 nt, Bordetella pertussis
uggccgacagcgucgagcuga

SEQ ID NO: 2382342 - RNA, 21 nt, Bordetella pertussis
uggccgacaugucgugcuggc

SEQ ID NO: 2382343 - RNA, 23 nt, Bordetella pertussis
uggccgacaugucgugcuggcug

SEQ ID NO: 2382344 - RNA, 12 nt, Bordetella pertussis
uggccgaccagc

SEQ ID NO: 2382345 - RNA, 17 nt, Bordetella pertussis
uggccgacgauggccgg

SEQ ID NO: 2382346 - RNA, 17 nt, Bordetella pertussis
uggccgacgcgcugguc

SEQ ID NO: 2382347 - RNA, 21 nt, Bordetella pertussis
uggccgagcgcggcaugcgca

SEQ ID NO: 2382348 - RNA, 18 nt, Bordetella pertussis
uggccgaguccugguugc

SEQ ID NO: 2382349 - RNA, 18 nt, Bordetella pertussis
uggccgauacgcgugcgc

SEQ ID NO: 2382350 - RNA, 23 nt, Bordetella pertussis
uggccgauacgcgugcgcggccg

SEQ ID NO: 2382351 - RNA, 16 nt, Bordetella pertussis
uggccgaucaccugca

SEQ ID NO: 2382352 - RNA, 13 nt, Bordetella pertussis
uggccgauggccu

SEQ ID NO: 2382353 - RNA, 15 nt, Bordetella pertussis
uggccgauuccagcg

SEQ ID NO: 2382354 - RNA, 16 nt, Bordetella pertussis
uggccgauuccagcgc

SEQ ID NO: 2382355 - RNA, 20 nt, Bordetella pertussis
uggccgauuucgcgcgccag

SEQ ID NO: 2382356 - RNA, 21 nt, Bordetella pertussis
uggccgauuucgcgcgccagc

SEQ ID NO: 2382357 - RNA, 14 nt, Bordetella pertussis
uggccgcagccggc

SEQ ID NO: 2382358 - RNA, 19 nt, Bordetella pertussis
uggccgccacacgaggacc

SEQ ID NO: 2382359 - RNA, 15 nt, Bordetella pertussis
uggccgccagccggc

SEQ ID NO: 2382360 - RNA, 17 nt, Bordetella pertussis
uggccgccagcggcugg

SEQ ID NO: 2382361 - RNA, 19 nt, Bordetella pertussis
uggccgccagcggcuggcg

SEQ ID NO: 2382362 - RNA, 21 nt, Bordetella pertussis
uggccgccagcggcuggcgcc

SEQ ID NO: 2382363 - RNA, 19 nt, Bordetella pertussis
uggccgccauggcgcuggc

SEQ ID NO: 2382364 - RNA, 13 nt, Bordetella pertussis
uggccgcccagca

SEQ ID NO: 2382365 - RNA, 16 nt, Bordetella pertussis
uggccgcccagcgccu

SEQ ID NO: 2382366 - RNA, 16 nt, Bordetella pertussis
uggccgcccgcggccu

SEQ ID NO: 2382367 - RNA, 14 nt, Bordetella pertussis
uggccgcccuggcg

SEQ ID NO: 2382368 - RNA, 16 nt, Bordetella pertussis
uggccgcccuggcgcg

SEQ ID NO: 2382369 - RNA, 17 nt, Bordetella pertussis
uggccgcccuggcgcga

SEQ ID NO: 2382370 - RNA, 22 nt, Bordetella pertussis
uggccgccgaacggcagcagcg

SEQ ID NO: 2382371 - RNA, 12 nt, Bordetella pertussis
uggccgccgcca

SEQ ID NO: 2382372 - RNA, 13 nt, Bordetella pertussis
uggccgccgcgcg

SEQ ID NO: 2382373 - RNA, 20 nt, Bordetella pertussis
uggccgccgcgcucaccgag

SEQ ID NO: 2382374 - RNA, 15 nt, Bordetella pertussis
uggccgccgcggccu

SEQ ID NO: 2382375 - RNA, 15 nt, Bordetella pertussis
uggccgccgcgggcg

SEQ ID NO: 2382376 - RNA, 22 nt, Bordetella pertussis
uggccgccgcgggcgccgcgca

SEQ ID NO: 2382377 - RNA, 22 nt, Bordetella pertussis
uggccgccggcgcgguggccau

SEQ ID NO: 2382378 - RNA, 20 nt, Bordetella pertussis
uggccgccggcggcgcacca

SEQ ID NO: 2382379 - RNA, 14 nt, Bordetella pertussis
uggccgccugcugc

SEQ ID NO: 2382380 - RNA, 20 nt, Bordetella pertussis
uggccgccugcugcgccguc

SEQ ID NO: 2382381 - RNA, 21 nt, Bordetella pertussis
uggccgcgcccagcgcggccu

SEQ ID NO: 2382382 - RNA, 15 nt, Bordetella pertussis
uggccgcgcccgccg

SEQ ID NO: 2382383 - RNA, 21 nt, Bordetella pertussis
uggccgcgcccgccgcgccau

SEQ ID NO: 2382384 - RNA, 16 nt, Bordetella pertussis
uggccgcgccgcuggc

SEQ ID NO: 2382385 - RNA, 19 nt, Bordetella pertussis
uggccgcgccgcuggcggc

SEQ ID NO: 2382386 - RNA, 19 nt, Bordetella pertussis
uggcgaggaccugaccauc

SEQ ID NO: 2382387 - RNA, 22 nt, Bordetella pertussis
uggcgaggaccugaccaucgaa

SEQ ID NO: 2382388 - RNA, 19 nt, Bordetella pertussis
uggcgagggucaggcgcgc

SEQ ID NO: 2382389 - RNA, 16 nt, Bordetella pertussis
uggcgauagcgcucca

SEQ ID NO: 2382390 - RNA, 18 nt, Bordetella pertussis
uggcgauagcgcuccagc

SEQ ID NO: 2382391 - RNA, 16 nt, Bordetella pertussis
uggcgaucaggccgcc

SEQ ID NO: 2382392 - RNA, 20 nt, Bordetella pertussis
uggcgaucaguuccuucugg

SEQ ID NO: 2382393 - RNA, 14 nt, Bordetella pertussis
uggcgauccaugug

SEQ ID NO: 2382394 - RNA, 22 nt, Bordetella pertussis
uggcgaucgaacgcggccagac

SEQ ID NO: 2382395 - RNA, 21 nt, Bordetella pertussis
uggcgaucgucaccaucgccg

SEQ ID NO: 2382396 - RNA, 15 nt, Bordetella pertussis
uggcgaucucguccu

SEQ ID NO: 2382397 - RNA, 19 nt, Bordetella pertussis
uggcgaucuucugggcggc

SEQ ID NO: 2382398 - RNA, 18 nt, Bordetella pertussis
uggcgaugaccucggcga

SEQ ID NO: 2382399 - RNA, 16 nt, Bordetella pertussis
uggcgaugcccaccag

SEQ ID NO: 2382400 - RNA, 20 nt, Bordetella pertussis
uggcgaugcccaccagccgc

SEQ ID NO: 2382401 - RNA, 13 nt, Bordetella pertussis
uggcgaugcgggc

SEQ ID NO: 2382402 - RNA, 20 nt, Bordetella pertussis
uggcgaugcgggccacgccg

SEQ ID NO: 2382403 - RNA, 22 nt, Bordetella pertussis
uggcgaugcgggccacgccggc

SEQ ID NO: 2382404 - RNA, 12 nt, Bordetella pertussis
uggcgaugcuca

SEQ ID NO: 2382405 - RNA, 14 nt, Bordetella pertussis
uggcgauggccgcc

SEQ ID NO: 2382406 - RNA, 18 nt, Bordetella pertussis
uggcgauguaggccaggu

SEQ ID NO: 2382407 - RNA, 18 nt, Bordetella pertussis
uggcgauguccagcgagc

SEQ ID NO: 2382408 - RNA, 16 nt, Bordetella pertussis
uggcgcaaaccacguc

SEQ ID NO: 2382409 - RNA, 18 nt, Bordetella pertussis
uggcgcaagacgcggcag

SEQ ID NO: 2382410 - RNA, 21 nt, Bordetella pertussis
uggcgcaaggcaugcgccagc

SEQ ID NO: 2382411 - RNA, 23 nt, Bordetella pertussis
uggcgcaaggcaugcgccagcgc

SEQ ID NO: 2382412 - RNA, 19 nt, Bordetella pertussis
uggcgcacgaugaggccga

SEQ ID NO: 2382413 - RNA, 18 nt, Bordetella pertussis
uggcgcacgccgggcgcg

SEQ ID NO: 2382414 - RNA, 19 nt, Bordetella pertussis
uggcgcacgccgggcgcgg

SEQ ID NO: 2382415 - RNA, 16 nt, Bordetella pertussis
uggcgcagcaaggcgc

SEQ ID NO: 2382416 - RNA, 20 nt, Bordetella pertussis
uggcgcagcaaggcgcgcca

SEQ ID NO: 2382417 - RNA, 13 nt, Bordetella pertussis
uggcgcagcacgc

SEQ ID NO: 2382418 - RNA, 15 nt, Bordetella pertussis
uggcgcagcacgccg

SEQ ID NO: 2382419 - RNA, 21 nt, Bordetella pertussis
uggcgcagcacgccgcgccag

SEQ ID NO: 2382420 - RNA, 16 nt, Bordetella pertussis
uggcgcagcagcgccg

SEQ ID NO: 2382421 - RNA, 18 nt, Bordetella pertussis
uggcgcagcagcgccggc

SEQ ID NO: 2382422 - RNA, 22 nt, Bordetella pertussis
uggcgcagcaggcgcgcggccu

SEQ ID NO: 2382423 - RNA, 19 nt, Bordetella pertussis
uggcgcagcauuucuucca

SEQ ID NO: 2382424 - RNA, 20 nt, Bordetella pertussis
uggcgcagcauuucuuccag

SEQ ID NO: 2382425 - RNA, 20 nt, Bordetella pertussis
uggcgcaggaacucagcgca

SEQ ID NO: 2382426 - RNA, 15 nt, Bordetella pertussis
uggcgcaggccggcg

SEQ ID NO: 2382427 - RNA, 20 nt, Bordetella pertussis
uggcgcaggccggcggccag

SEQ ID NO: 2382428 - RNA, 15 nt, Bordetella pertussis
uggcgcaggcgcgcc

SEQ ID NO: 2382429 - RNA, 17 nt, Bordetella pertussis
uggcgcaggcgcgccag

SEQ ID NO: 2382430 - RNA, 16 nt, Bordetella pertussis
uggcgcaguaucccgg

SEQ ID NO: 2382431 - RNA, 20 nt, Bordetella pertussis
uggcgcaguaucccggccag

SEQ ID NO: 2382432 - RNA, 21 nt, Bordetella pertussis
uggcgcaguaucccggccagg

SEQ ID NO: 2382433 - RNA, 20 nt, Bordetella pertussis
uggcgcagucgagcaccgcg

SEQ ID NO: 2382434 - RNA, 17 nt, Bordetella pertussis
uggcgcagugggccagu

SEQ ID NO: 2382435 - RNA, 19 nt, Bordetella pertussis
uggcgcaugacggcgucga

SEQ ID NO: 2382436 - RNA, 14 nt, Bordetella pertussis
uggcgcaugacggg

SEQ ID NO: 2382437 - RNA, 17 nt, Bordetella pertussis
uggcgcauggccggcgu

SEQ ID NO: 2382438 - RNA, 17 nt, Bordetella pertussis
uggcgcauucgccggac

SEQ ID NO: 2382439 - RNA, 18 nt, Bordetella pertussis
uggcgccagcuggaccgc

SEQ ID NO: 2382440 - RNA, 15 nt, Bordetella pertussis
uggcgcccacggccg

SEQ ID NO: 2382441 - RNA, 17 nt, Bordetella pertussis
uggcgcccacggccgca

SEQ ID NO: 2382442 - RNA, 13 nt, Bordetella pertussis
uggcgcccagcgc

SEQ ID NO: 2382443 - RNA, 16 nt, Bordetella pertussis
uggcgcccagcgccau

SEQ ID NO: 2382444 - RNA, 21 nt, Bordetella pertussis
uggcgcccgacggcgccgugc

SEQ ID NO: 2382445 - RNA, 21 nt, Bordetella pertussis
uggcgccgaaggcggcgccgg

SEQ ID NO: 2382446 - RNA, 15 nt, Bordetella pertussis
uggcgccgacccugc

SEQ ID NO: 2382447 - RNA, 16 nt, Bordetella pertussis
uggcgccgacccugcc

SEQ ID NO: 2382448 - RNA, 18 nt, Bordetella pertussis
uggcgccgacccugcccg

SEQ ID NO: 2382449 - RNA, 16 nt, Bordetella pertussis
uggcgccgauggcgcc

SEQ ID NO: 2382450 - RNA, 17 nt, Bordetella pertussis
uggcgccgauggcgccg

SEQ ID NO: 2382451 - RNA, 20 nt, Bordetella pertussis
uggcgccgauuucgccgccg

SEQ ID NO: 2382452 - RNA, 16 nt, Bordetella pertussis
uggcgccgcgccgccg

SEQ ID NO: 2382453 - RNA, 22 nt, Bordetella pertussis
uggcgccgcgccgccgccuggc

SEQ ID NO: 2382454 - RNA, 22 nt, Bordetella pertussis
uggcgccgcgcgccgcggccug

SEQ ID NO: 2382455 - RNA, 14 nt, Bordetella pertussis
uggcgccgcggccg

SEQ ID NO: 2382456 - RNA, 19 nt, Bordetella pertussis
uggcgccgcgggccuacuu

SEQ ID NO: 2382457 - RNA, 20 nt, Bordetella pertussis
uggcgccggacugggcgucg

SEQ ID NO: 2382458 - RNA, 14 nt, Bordetella pertussis
uggcgccggccacc

SEQ ID NO: 2382459 - RNA, 23 nt, Bordetella pertussis
uggcgccggccaccgccugugcc

SEQ ID NO: 2382460 - RNA, 18 nt, Bordetella pertussis
uggcgccggccagcgcgc

SEQ ID NO: 2382461 - RNA, 20 nt, Bordetella pertussis
uggcgccggccgcgcgcgcc

SEQ ID NO: 2382462 - RNA, 22 nt, Bordetella pertussis
uggcgccggcuucgucaugguc

SEQ ID NO: 2382463 - RNA, 14 nt, Bordetella pertussis
uggcgccggucugg

SEQ ID NO: 2382464 - RNA, 21 nt, Bordetella pertussis
uggcgccggucugggcgcgga

SEQ ID NO: 2382465 - RNA, 17 nt, Bordetella pertussis
uggcgccggugcagguc

SEQ ID NO: 2382466 - RNA, 15 nt, Bordetella pertussis
uggcgccgucgcgcu

SEQ ID NO: 2382467 - RNA, 21 nt, Bordetella pertussis
uggcgccgugaaugcgccugg

SEQ ID NO: 2382468 - RNA, 22 nt, Bordetella pertussis
uggcgccgugaaugcgccuggc

SEQ ID NO: 2382469 - RNA, 21 nt, Bordetella pertussis
uggcgccguucgucgcgcagc

SEQ ID NO: 2382470 - RNA, 22 nt, Bordetella pertussis
uggcgccguucgucgcgcagca

SEQ ID NO: 2382471 - RNA, 22 nt, Bordetella pertussis
uggcgccuuccggcagcggcca

SEQ ID NO: 2382472 - RNA, 15 nt, Bordetella pertussis
uggcgcgaggcggcg

SEQ ID NO: 2382473 - RNA, 17 nt, Bordetella pertussis
uggcgcgaggcggcgac

SEQ ID NO: 2382474 - RNA, 18 nt, Bordetella pertussis
uggcgcgaggcggcgacg

SEQ ID NO: 2382475 - RNA, 16 nt, Bordetella pertussis
uggcgcgauccagucg

SEQ ID NO: 2382476 - RNA, 17 nt, Bordetella pertussis
uggcgcgcaaccagggg

SEQ ID NO: 2382477 - RNA, 22 nt, Bordetella pertussis
uggcgcgcaaccaggggcggcg

SEQ ID NO: 2382478 - RNA, 18 nt, Bordetella pertussis
uggcgcgcacacuggcca

SEQ ID NO: 2382479 - RNA, 20 nt, Bordetella pertussis
uggcgcgcacacuggccagc

SEQ ID NO: 2382480 - RNA, 21 nt, Bordetella pertussis
uggcgcgcacacuggccagca

SEQ ID NO: 2382481 - RNA, 16 nt, Bordetella pertussis
uggcgcgcaccauggg

SEQ ID NO: 2382482 - RNA, 17 nt, Bordetella pertussis
uggcgcgcaccugggag

SEQ ID NO: 2382483 - RNA, 22 nt, Bordetella pertussis
uggcgcgcagauugcgcucggu

SEQ ID NO: 2382484 - RNA, 23 nt, Bordetella pertussis
uggcgcgcagauugcgcucgguc

SEQ ID NO: 2382485 - RNA, 16 nt, Bordetella pertussis
uggcgcgcaucggcgc

SEQ ID NO: 2382486 - RNA, 17 nt, Bordetella pertussis
uggcgcgcaucggcgcc

SEQ ID NO: 2382487 - RNA, 18 nt, Bordetella pertussis
uggcgcgcaucggcgccg

SEQ ID NO: 2382488 - RNA, 18 nt, Bordetella pertussis
uggcgcgccaggcgaugg

SEQ ID NO: 2382489 - RNA, 21 nt, Bordetella pertussis
uggcgcgccaggcgauggccg

SEQ ID NO: 2382490 - RNA, 14 nt, Bordetella pertussis
uggcgcgcccacug

SEQ ID NO: 2382491 - RNA, 21 nt, Bordetella pertussis
uggcgcgcccgcacgaugccg

SEQ ID NO: 2382492 - RNA, 15 nt, Bordetella pertussis
uggcgcgccggccgg

SEQ ID NO: 2382493 - RNA, 14 nt, Bordetella pertussis
uggcgcgccguggc

SEQ ID NO: 2382494 - RNA, 13 nt, Bordetella pertussis
uggcgcgcgaaca

SEQ ID NO: 2382495 - RNA, 16 nt, Bordetella pertussis
uggcgcgcgaccaggc

SEQ ID NO: 2382496 - RNA, 22 nt, Bordetella pertussis
uggcgcgcgcaagccgccgccc

SEQ ID NO: 2382497 - RNA, 21 nt, Bordetella pertussis
uggcgcgcgcacgcugggcga

SEQ ID NO: 2382498 - RNA, 19 nt, Bordetella pertussis
uggcguccaugcagguggc

SEQ ID NO: 2382499 - RNA, 15 nt, Bordetella pertussis
uggcgucgagcaccg

SEQ ID NO: 2382500 - RNA, 16 nt, Bordetella pertussis
uggcgucggccacguc

SEQ ID NO: 2382501 - RNA, 13 nt, Bordetella pertussis
uggcgucggccgc

SEQ ID NO: 2382502 - RNA, 15 nt, Bordetella pertussis
uggcgucgggggcgg

SEQ ID NO: 2382503 - RNA, 17 nt, Bordetella pertussis
uggcgucgggggcggcc

SEQ ID NO: 2382504 - RNA, 19 nt, Bordetella pertussis
uggcgucgggggcggccgg

SEQ ID NO: 2382505 - RNA, 23 nt, Bordetella pertussis
uggcgucgggggcggccggggcc

SEQ ID NO: 2382506 - RNA, 21 nt, Bordetella pertussis
uggcgucguccguggccggcg

SEQ ID NO: 2382507 - RNA, 14 nt, Bordetella pertussis
uggcgucugcccgu

SEQ ID NO: 2382508 - RNA, 14 nt, Bordetella pertussis
uggcgugcagccau

SEQ ID NO: 2382509 - RNA, 21 nt, Bordetella pertussis
uggcgugcagguacugggcca

SEQ ID NO: 2382510 - RNA, 21 nt, Bordetella pertussis
uggcgugcgcgaccuccggca

SEQ ID NO: 2382511 - RNA, 16 nt, Bordetella pertussis
uggcguggcuggcguc

SEQ ID NO: 2382512 - RNA, 17 nt, Bordetella pertussis
uggcguggugggcaccg

SEQ ID NO: 2382513 - RNA, 22 nt, Bordetella pertussis
uggcguguccgccguagcgcgc

SEQ ID NO: 2382514 - RNA, 18 nt, Bordetella pertussis
uggcgugucuccgggcgg

SEQ ID NO: 2382515 - RNA, 19 nt, Bordetella pertussis
uggcgugucuccgggcggg

SEQ ID NO: 2382516 - RNA, 15 nt, Bordetella pertussis
uggcguugacggccc

SEQ ID NO: 2382517 - RNA, 20 nt, Bordetella pertussis
uggcguugacggcccagcuc

SEQ ID NO: 2382518 - RNA, 18 nt, Bordetella pertussis
uggcguugcgcaccaugu

SEQ ID NO: 2382519 - RNA, 16 nt, Bordetella pertussis
uggcguuggccugcca

SEQ ID NO: 2382520 - RNA, 15 nt, Bordetella pertussis
uggcguuugcgcgcg

SEQ ID NO: 2382521 - RNA, 15 nt, Bordetella pertussis
uggcuaaaaggaaau

SEQ ID NO: 2382522 - RNA, 17 nt, Bordetella pertussis
uggcucagucggccugg

SEQ ID NO: 2382523 - RNA, 21 nt, Bordetella pertussis
uggcucagucggccuggcgcu

SEQ ID NO: 2382524 - RNA, 14 nt, Bordetella pertussis
uggcucccgaggga

SEQ ID NO: 2382525 - RNA, 15 nt, Bordetella pertussis
uggcucgggcagcag

SEQ ID NO: 2382526 - RNA, 23 nt, Bordetella pertussis
uggcucgggcagcagcagggcca

SEQ ID NO: 2382527 - RNA, 12 nt, Bordetella pertussis
uggcugagccau

SEQ ID NO: 2382528 - RNA, 14 nt, Bordetella pertussis
uggcugcaccugcc

SEQ ID NO: 2382529 - RNA, 15 nt, Bordetella pertussis
uggcugcaccugccu

SEQ ID NO: 2382530 - RNA, 18 nt, Bordetella pertussis
uggcugcaccugccugcc

SEQ ID NO: 2382531 - RNA, 13 nt, Bordetella pertussis
uggcugcccuggc

SEQ ID NO: 2382532 - RNA, 12 nt, Bordetella pertussis
uggcugcgcgcc

SEQ ID NO: 2382533 - RNA, 15 nt, Bordetella pertussis
uggcugcgcgccugg

SEQ ID NO: 2382534 - RNA, 12 nt, Bordetella pertussis
uggcuggccagc

SEQ ID NO: 2382535 - RNA, 14 nt, Bordetella pertussis
uggcuggcgaggac

SEQ ID NO: 2382536 - RNA, 14 nt, Bordetella pertussis
uggcugggccugcu

SEQ ID NO: 2382537 - RNA, 15 nt, Bordetella pertussis
uggcugggccugcug

SEQ ID NO: 2382538 - RNA, 14 nt, Bordetella pertussis
uggcugggcgcgcc

SEQ ID NO: 2382539 - RNA, 22 nt, Bordetella pertussis
uggcuggggcuggcauggcggu

SEQ ID NO: 2382540 - RNA, 15 nt, Bordetella pertussis
uggcuggugccaguc

SEQ ID NO: 2382541 - RNA, 15 nt, Bordetella pertussis
uggcuguaucuggcc

SEQ ID NO: 2382542 - RNA, 20 nt, Bordetella pertussis
uggcuuccugcaccucagga

SEQ ID NO: 2382543 - RNA, 13 nt, Bordetella pertussis
uggcuugcagcgc

SEQ ID NO: 2382544 - RNA, 16 nt, Bordetella pertussis
uggcuuggcgcaggaa

SEQ ID NO: 2382545 - RNA, 16 nt, Bordetella pertussis
uggcuuggcggccagg

SEQ ID NO: 2382546 - RNA, 17 nt, Bordetella pertussis
uggcuuggcggccagga

SEQ ID NO: 2382547 - RNA, 17 nt, Bordetella pertussis
uggcuuucuaucaucag

SEQ ID NO: 2382548 - RNA, 19 nt, Bordetella pertussis
ugggaaacagcgaaagcac

SEQ ID NO: 2382549 - RNA, 21 nt, Bordetella pertussis
ugggaaauccgccgggugugg

SEQ ID NO: 2382550 - RNA, 14 nt, Bordetella pertussis
ugggaagacuucgu

SEQ ID NO: 2382551 - RNA, 16 nt, Bordetella pertussis
ugggacaggcacaccg

SEQ ID NO: 2382552 - RNA, 22 nt, Bordetella pertussis
ugggacaggcacucugccgugg

SEQ ID NO: 2382553 - RNA, 15 nt, Bordetella pertussis
ugggacaggcccagc

SEQ ID NO: 2382554 - RNA, 18 nt, Bordetella pertussis
ugggacgccagcccgccg

SEQ ID NO: 2382555 - RNA, 13 nt, Bordetella pertussis
ugggaggggccgg

SEQ ID NO: 2382556 - RNA, 16 nt, Bordetella pertussis
ugggauaaggcgugcc

SEQ ID NO: 2382557 - RNA, 21 nt, Bordetella pertussis
ugggcaaaacgcgcauucgac

SEQ ID NO: 2382558 - RNA, 17 nt, Bordetella pertussis
ugggcaaggugaacaug

SEQ ID NO: 2382559 - RNA, 21 nt, Bordetella pertussis
ugggcaauaccuucggcaugg

SEQ ID NO: 2382560 - RNA, 22 nt, Bordetella pertussis
ugggcacacaccauaucuggca

SEQ ID NO: 2382561 - RNA, 15 nt, Bordetella pertussis
ugggcacauccagcg

SEQ ID NO: 2382562 - RNA, 23 nt, Bordetella pertussis
ugggcacauccagcgccagcacc

SEQ ID NO: 2382563 - RNA, 18 nt, Bordetella pertussis
ugggcaccaccaccgccc

SEQ ID NO: 2382564 - RNA, 20 nt, Bordetella pertussis
ugggcaccgugaugcgcgcc

SEQ ID NO: 2382565 - RNA, 19 nt, Bordetella pertussis
ugggcaccucggggugcag

SEQ ID NO: 2382566 - RNA, 13 nt, Bordetella pertussis
ugggcacgcgcgc

SEQ ID NO: 2382567 - RNA, 15 nt, Bordetella pertussis
ugggcacgcgcgcgg

SEQ ID NO: 2382568 - RNA, 16 nt, Bordetella pertussis
ugggcagaacggaaac

SEQ ID NO: 2382569 - RNA, 22 nt, Bordetella pertussis
ugggcagaacggaaacgcccag

SEQ ID NO: 2382570 - RNA, 14 nt, Bordetella pertussis
ugggcagcagcacg

SEQ ID NO: 2382571 - RNA, 20 nt, Bordetella pertussis
ugggcagcggacgguagcgc

SEQ ID NO: 2382572 - RNA, 22 nt, Bordetella pertussis
ugggcagcggacgguagcgcac

SEQ ID NO: 2382573 - RNA, 18 nt, Bordetella pertussis
ugggcagcggcaucacgc

SEQ ID NO: 2382574 - RNA, 20 nt, Bordetella pertussis
ugggcagcggcaucacgccg

SEQ ID NO: 2382575 - RNA, 16 nt, Bordetella pertussis
ugggcaggucgggcag

SEQ ID NO: 2382576 - RNA, 16 nt, Bordetella pertussis
ugggcaggugcuuggc

SEQ ID NO: 2382577 - RNA, 23 nt, Bordetella pertussis
ugggcaggugcuuggcggucugg

SEQ ID NO: 2382578 - RNA, 13 nt, Bordetella pertussis
ugggcaucaacac

SEQ ID NO: 2382579 - RNA, 17 nt, Bordetella pertussis
ugggcaucaacacgcug

SEQ ID NO: 2382580 - RNA, 16 nt, Bordetella pertussis
ugggcaugcacgaugg

SEQ ID NO: 2382581 - RNA, 14 nt, Bordetella pertussis
ugggcauggaccug

SEQ ID NO: 2382582 - RNA, 18 nt, Bordetella pertussis
ugggcauuucccagccgu

SEQ ID NO: 2382583 - RNA, 20 nt, Bordetella pertussis
ugggcauuucccagccgucg

SEQ ID NO: 2382584 - RNA, 22 nt, Bordetella pertussis
ugggcauuucccagccgucgcg

SEQ ID NO: 2382585 - RNA, 16 nt, Bordetella pertussis
ugggccacucgauggg

SEQ ID NO: 2382586 - RNA, 19 nt, Bordetella pertussis
ugggccacucgaugggcgc

SEQ ID NO: 2382587 - RNA, 24 nt, Bordetella pertussis
ugggccagauagucgcggaugcgc

SEQ ID NO: 2382588 - RNA, 21 nt, Bordetella pertussis
ugggccagcagcuggcgcagc

SEQ ID NO: 2382589 - RNA, 13 nt, Bordetella pertussis
ugggccagcaucg

SEQ ID NO: 2382590 - RNA, 15 nt, Bordetella pertussis
ugggccagcaucggc

SEQ ID NO: 2382591 - RNA, 16 nt, Bordetella pertussis
ugggccaggcgcucca

SEQ ID NO: 2382592 - RNA, 17 nt, Bordetella pertussis
ugggccaggcgcuccag

SEQ ID NO: 2382593 - RNA, 22 nt, Bordetella pertussis
ugggccaggcgcuccagcaccu

SEQ ID NO: 2382594 - RNA, 20 nt, Bordetella pertussis
ugggccagguauugcucggc

SEQ ID NO: 2382595 - RNA, 21 nt, Bordetella pertussis
ugggccagguauugcucggcg

SEQ ID NO: 2382596 - RNA, 18 nt, Bordetella pertussis
ugggccaguccgcagcgc

SEQ ID NO: 2382597 - RNA, 19 nt, Bordetella pertussis
ugggccaguccgcagcgca

SEQ ID NO: 2382598 - RNA, 15 nt, Bordetella pertussis
ugggccaguucgcgg

SEQ ID NO: 2382599 - RNA, 23 nt, Bordetella pertussis
ugggccaguucgcggcgcagcgc

SEQ ID NO: 2382600 - RNA, 23 nt, Bordetella pertussis
ugggccaucagguuguccagcgc

SEQ ID NO: 2382601 - RNA, 19 nt, Bordetella pertussis
ugggccaugccguccugcu

SEQ ID NO: 2382602 - RNA, 20 nt, Bordetella pertussis
ugggccaugccguccugcug

SEQ ID NO: 2382603 - RNA, 22 nt, Bordetella pertussis
ugggcccgggcaggcucagccc

SEQ ID NO: 2382604 - RNA, 16 nt, Bordetella pertussis
ugggccgagcccgcgu

SEQ ID NO: 2382605 - RNA, 17 nt, Bordetella pertussis
ugggccgagcgcgccag

SEQ ID NO: 2382606 - RNA, 23 nt, Bordetella pertussis
ugggccgagcgcgccagcacggu

SEQ ID NO: 2382607 - RNA, 15 nt, Bordetella pertussis
ugggccgaggcgccg

SEQ ID NO: 2382608 - RNA, 18 nt, Bordetella pertussis
ugggccgccugcugggcc

SEQ ID NO: 2382609 - RNA, 15 nt, Bordetella pertussis
ugggccgcgccugca

SEQ ID NO: 2382610 - RNA, 17 nt, Bordetella pertussis
ugggccgcgccugcagg

SEQ ID NO: 2382611 - RNA, 21 nt, Bordetella pertussis
agcagggucgagaccagcagc

SEQ ID NO: 2382612 - RNA, 23 nt, Bordetella pertussis
agcagggucugcaggccgaaacc

SEQ ID NO: 2382613 - RNA, 16 nt, Bordetella pertussis
agcaggguggccacgc

SEQ ID NO: 2382614 - RNA, 16 nt, Bordetella pertussis
agcagguccauggcca

SEQ ID NO: 2382615 - RNA, 15 nt, Bordetella pertussis
ugggccguccggccg

SEQ ID NO: 2382616 - RNA, 18 nt, Bordetella pertussis
ugggccguccggccgugc

SEQ ID NO: 2382617 - RNA, 21 nt, Bordetella pertussis
ugggccguccggccgugccgc

SEQ ID NO: 2382618 - RNA, 14 nt, Bordetella pertussis
ugggccugaucggg

SEQ ID NO: 2382619 - RNA, 17 nt, Bordetella pertussis
ugggccugaucggggcc

SEQ ID NO: 2382620 - RNA, 15 nt, Bordetella pertussis
ugggccugcggcguc

SEQ ID NO: 2382621 - RNA, 17 nt, Bordetella pertussis
ugggccugcggcgucag

SEQ ID NO: 2382622 - RNA, 15 nt, Bordetella pertussis
ugggccuucuugucg

SEQ ID NO: 2382623 - RNA, 16 nt, Bordetella pertussis
ugggcgaacuggucga

SEQ ID NO: 2382624 - RNA, 23 nt, Bordetella pertussis
ugggcgaauccaccggcgcgcgc

SEQ ID NO: 2382625 - RNA, 17 nt, Bordetella pertussis
ugggcgaggcgaugccc

SEQ ID NO: 2382626 - RNA, 16 nt, Bordetella pertussis
ugggcgaggcgcuggc

SEQ ID NO: 2382627 - RNA, 19 nt, Bordetella pertussis
ugggcgaggcgcuggccgg

SEQ ID NO: 2382628 - RNA, 22 nt, Bordetella pertussis
ugggcgagguagggcgcggcca

SEQ ID NO: 2382629 - RNA, 19 nt, Bordetella pertussis
ugggcgaucuucagcacca

SEQ ID NO: 2382630 - RNA, 21 nt, Bordetella pertussis
ugggcgaucuucagcaccagc

SEQ ID NO: 2382631 - RNA, 19 nt, Bordetella pertussis
ugggcgaugcauucggcgg

SEQ ID NO: 2382632 - RNA, 14 nt, Bordetella pertussis
ugggcgcaggccgc

SEQ ID NO: 2382633 - RNA, 16 nt, Bordetella pertussis
ugggcgcauuggcccu

SEQ ID NO: 2382634 - RNA, 19 nt, Bordetella pertussis
ugggcgcauuggcccugcu

SEQ ID NO: 2382635 - RNA, 14 nt, Bordetella pertussis
ugggcgccagcagc

SEQ ID NO: 2382636 - RNA, 19 nt, Bordetella pertussis
ugggcgccagcagcacguc

SEQ ID NO: 2382637 - RNA, 15 nt, Bordetella pertussis
ugggcgccaugcgcc

SEQ ID NO: 2382638 - RNA, 19 nt, Bordetella pertussis
ugggcgccaugcgcccggc

SEQ ID NO: 2382639 - RNA, 18 nt, Bordetella pertussis
ugggcgccgagggccgcg

SEQ ID NO: 2382640 - RNA, 14 nt, Bordetella pertussis
ugggcgccggccag

SEQ ID NO: 2382641 - RNA, 17 nt, Bordetella pertussis
ugggcgccgugcccgac

SEQ ID NO: 2382642 - RNA, 19 nt, Bordetella pertussis
ugggcgccuacggcggcgg

SEQ ID NO: 2382643 - RNA, 14 nt, Bordetella pertussis
ugggcgccuugccg

SEQ ID NO: 2382644 - RNA, 19 nt, Bordetella pertussis
ugggcgcgcacaagcgcga

SEQ ID NO: 2382645 - RNA, 16 nt, Bordetella pertussis
ugggcgcgcccagccc

SEQ ID NO: 2382646 - RNA, 14 nt, Bordetella pertussis
ugggcgcgcgccca

SEQ ID NO: 2382647 - RNA, 17 nt, Bordetella pertussis
ugggcgcgcgcccaggc

SEQ ID NO: 2382648 - RNA, 18 nt, Bordetella pertussis
ugggcgcggaacagccug

SEQ ID NO: 2382649 - RNA, 14 nt, Bordetella pertussis
ugggcgcggcgcgc

SEQ ID NO: 2382650 - RNA, 16 nt, Bordetella pertussis
ugggcgcggcgcgcgc

SEQ ID NO: 2382651 - RNA, 21 nt, Bordetella pertussis
ugggcgcggcggccugggcgg

SEQ ID NO: 2382652 - RNA, 16 nt, Bordetella pertussis
ugggcgcgguccagca

SEQ ID NO: 2382653 - RNA, 17 nt, Bordetella pertussis
ugggcgcuuggcccugc

SEQ ID NO: 2382654 - RNA, 20 nt, Bordetella pertussis
ugggcgcuuggcccugcagc

SEQ ID NO: 2382655 - RNA, 13 nt, Bordetella pertussis
ugggcggccaggc

SEQ ID NO: 2382656 - RNA, 18 nt, Bordetella pertussis
ugggcggcccggccaagc

SEQ ID NO: 2382657 - RNA, 14 nt, Bordetella pertussis
ugggcggccuuggc

SEQ ID NO: 2382658 - RNA, 15 nt, Bordetella pertussis
ugggcggccuuggcc

SEQ ID NO: 2382659 - RNA, 14 nt, Bordetella pertussis
ugggcggcgagccg

SEQ ID NO: 2382660 - RNA, 23 nt, Bordetella pertussis
ugggcggcggcgaugccgcuggc

SEQ ID NO: 2382661 - RNA, 11 nt, Bordetella pertussis
ugggcggcgua

SEQ ID NO: 2382662 - RNA, 18 nt, Bordetella pertussis
ugggcggcguagagcgcc

SEQ ID NO: 2382663 - RNA, 17 nt, Bordetella pertussis
ugggcgguugcgcugcu

SEQ ID NO: 2382664 - RNA, 13 nt, Bordetella pertussis
ugggcgucccagg

SEQ ID NO: 2382665 - RNA, 14 nt, Bordetella pertussis
ugggcgucccaggc

SEQ ID NO: 2382666 - RNA, 18 nt, Bordetella pertussis
ugggcgucguccugcagc

SEQ ID NO: 2382667 - RNA, 21 nt, Bordetella pertussis
ugggcgugaaaggccagcggc

SEQ ID NO: 2382668 - RNA, 22 nt, Bordetella pertussis
ugggcgugaaaggccagcggcg

SEQ ID NO: 2382669 - RNA, 15 nt, Bordetella pertussis
ugggcgugcccucgc

SEQ ID NO: 2382670 - RNA, 22 nt, Bordetella pertussis
ugggcgugcccucgcugcgcgu

SEQ ID NO: 2382671 - RNA, 14 nt, Bordetella pertussis
ugggcgugcccuug

SEQ ID NO: 2382672 - RNA, 15 nt, Bordetella pertussis
ugggcgugccgcgcu

SEQ ID NO: 2382673 - RNA, 16 nt, Bordetella pertussis
ugggcguggcgcgcgu

SEQ ID NO: 2382674 - RNA, 23 nt, Bordetella pertussis
ugggcguggugcugacggacugg

SEQ ID NO: 2382675 - RNA, 13 nt, Bordetella pertussis
ugggcucgaugcg

SEQ ID NO: 2382676 - RNA, 21 nt, Bordetella pertussis
ugggcucgaugcguccgucgg

SEQ ID NO: 2382677 - RNA, 14 nt, Bordetella pertussis
ugggcugcggcgug

SEQ ID NO: 2382678 - RNA, 15 nt, Bordetella pertussis
ugggcugcggcgugg

SEQ ID NO: 2382679 - RNA, 19 nt, Bordetella pertussis
ugggcugguaggggaugcg

SEQ ID NO: 2382680 - RNA, 13 nt, Bordetella pertussis
uggggaagcgcuc

SEQ ID NO: 2382681 - RNA, 14 nt, Bordetella pertussis
uggggacaggcacc

SEQ ID NO: 2382682 - RNA, 23 nt, Bordetella pertussis
uggggacaggcacccgaggguca

SEQ ID NO: 2382683 - RNA, 19 nt, Bordetella pertussis
uggggacaugcaugaacgc

SEQ ID NO: 2382684 - RNA, 14 nt, Bordetella pertussis
uggggacgggcgca

SEQ ID NO: 2382685 - RNA, 16 nt, Bordetella pertussis
uggggacuggcacccg

SEQ ID NO: 2382686 - RNA, 19 nt, Bordetella pertussis
uggggagcgcggcccgugc

SEQ ID NO: 2382687 - RNA, 12 nt, Bordetella pertussis
uggggcagcagg

SEQ ID NO: 2382688 - RNA, 13 nt, Bordetella pertussis
uggggcagcaggc

SEQ ID NO: 2382689 - RNA, 16 nt, Bordetella pertussis
uggggcagccauccuc

SEQ ID NO: 2382690 - RNA, 17 nt, Bordetella pertussis
uggggcaggcacuggcg

SEQ ID NO: 2382691 - RNA, 20 nt, Bordetella pertussis
uggggcaggcacuggcgcgg

SEQ ID NO: 2382692 - RNA, 15 nt, Bordetella pertussis
uggggcaggcgcagc

SEQ ID NO: 2382693 - RNA, 16 nt, Bordetella pertussis
uggggcaggcgcagcg

SEQ ID NO: 2382694 - RNA, 22 nt, Bordetella pertussis
uggggcaggcggcuuucauggg

SEQ ID NO: 2382695 - RNA, 20 nt, Bordetella pertussis
uggggccauggcacaggcca

SEQ ID NO: 2382696 - RNA, 15 nt, Bordetella pertussis
uggggccgccuggac

SEQ ID NO: 2382697 - RNA, 13 nt, Bordetella pertussis
uggggccgcgccg

SEQ ID NO: 2382698 - RNA, 18 nt, Bordetella pertussis
uggggccgcggcgcgcgc

SEQ ID NO: 2382699 - RNA, 22 nt, Bordetella pertussis
uggggccggccgcgcgcgccag

SEQ ID NO: 2382700 - RNA, 23 nt, Bordetella pertussis
uggggcgcucgaaaaagcccugc

SEQ ID NO: 2382701 - RNA, 17 nt, Bordetella pertussis
uggggcggcccagcggc

SEQ ID NO: 2382702 - RNA, 21 nt, Bordetella pertussis
uggggcggccgggagccuguc

SEQ ID NO: 2382703 - RNA, 12 nt, Bordetella pertussis
uggggcgggcgc

SEQ ID NO: 2382704 - RNA, 19 nt, Bordetella pertussis
uggggcgggcgcugcgcga

SEQ ID NO: 2382705 - RNA, 22 nt, Bordetella pertussis
uggggcgguggucaucgaugcg

SEQ ID NO: 2382706 - RNA, 19 nt, Bordetella pertussis
uggggcugcugggccggcg

SEQ ID NO: 2382707 - RNA, 13 nt, Bordetella pertussis
ugggggacaggca

SEQ ID NO: 2382708 - RNA, 19 nt, Bordetella pertussis
ugggggauuuuugggcagg

SEQ ID NO: 2382709 - RNA, 23 nt, Bordetella pertussis
ugggggcccacaugccgugccag

SEQ ID NO: 2382710 - RNA, 13 nt, Bordetella pertussis
ugggggcuggagg

SEQ ID NO: 2382711 - RNA, 14 nt, Bordetella pertussis
ugggggcuggaggc

SEQ ID NO: 2382712 - RNA, 14 nt, Bordetella pertussis
ugggggcuggcgcu

SEQ ID NO: 2382713 - RNA, 20 nt, Bordetella pertussis
uggggguggaaaugccggcg

SEQ ID NO: 2382714 - RNA, 17 nt, Bordetella pertussis
uggggguucgugggcga

SEQ ID NO: 2382715 - RNA, 16 nt, Bordetella pertussis
uggggugcuccugcca

SEQ ID NO: 2382716 - RNA, 13 nt, Bordetella pertussis
ugggguggagcgc

SEQ ID NO: 2382717 - RNA, 15 nt, Bordetella pertussis
uggguacagcgcgcc

SEQ ID NO: 2382718 - RNA, 15 nt, Bordetella pertussis
uggguacgacggccg

SEQ ID NO: 2382719 - RNA, 20 nt, Bordetella pertussis
ugggucaggucgcugcccag

SEQ ID NO: 2382720 - RNA, 17 nt, Bordetella pertussis
ugggucaucagcacgau

SEQ ID NO: 2382721 - RNA, 14 nt, Bordetella pertussis
ugggucauggaaaa

SEQ ID NO: 2382722 - RNA, 15 nt, Bordetella pertussis
ugggucauggaaaau

SEQ ID NO: 2382723 - RNA, 16 nt, Bordetella pertussis
ugggugacgcuggagc

SEQ ID NO: 2382724 - RNA, 18 nt, Bordetella pertussis
ugggugacgcuggagcgc

SEQ ID NO: 2382725 - RNA, 15 nt, Bordetella pertussis
uguacaggcgcggca

SEQ ID NO: 2382726 - RNA, 17 nt, Bordetella pertussis
uguaccagcccagcccg

SEQ ID NO: 2382727 - RNA, 15 nt, Bordetella pertussis
uguaccgccgggucg

SEQ ID NO: 2382728 - RNA, 16 nt, Bordetella pertussis
uguaccgggccgacgc

SEQ ID NO: 2382729 - RNA, 15 nt, Bordetella pertussis
uguaccguacccgcg

SEQ ID NO: 2382730 - RNA, 18 nt, Bordetella pertussis
uguaccguacccgcgccg

SEQ ID NO: 2382731 - RNA, 17 nt, Bordetella pertussis
uguaccguucgcugccc

SEQ ID NO: 2382732 - RNA, 18 nt, Bordetella pertussis
uguaccucagccugcugg

SEQ ID NO: 2382733 - RNA, 15 nt, Bordetella pertussis
uguacucggccaggc

SEQ ID NO: 2382734 - RNA, 16 nt, Bordetella pertussis
uguacucggccaggcc

SEQ ID NO: 2382735 - RNA, 15 nt, Bordetella pertussis
uguagaccaccagca

SEQ ID NO: 2382736 - RNA, 19 nt, Bordetella pertussis
uguagagcaggccgcccag

SEQ ID NO: 2382737 - RNA, 21 nt, Bordetella pertussis
uguagagcaggccgcccagcg

SEQ ID NO: 2382738 - RNA, 18 nt, Bordetella pertussis
uguagagggucuggccgg

SEQ ID NO: 2382739 - RNA, 18 nt, Bordetella pertussis
uguagcccauggccaggg

SEQ ID NO: 2382740 - RNA, 18 nt, Bordetella pertussis
uguagcccuggcgcugca

SEQ ID NO: 2382741 - RNA, 23 nt, Bordetella pertussis
uguagcccuggcgcugcagcguc

SEQ ID NO: 2382742 - RNA, 17 nt, Bordetella pertussis
uguaggcgauccaggcc

SEQ ID NO: 2382743 - RNA, 14 nt, Bordetella pertussis
uguaggcgccggcg

SEQ ID NO: 2382744 - RNA, 23 nt, Bordetella pertussis
uguauaacguggcgcgcaccugg

SEQ ID NO: 2382745 - RNA, 22 nt, Bordetella pertussis
uguauagaugcgcggggccagg

SEQ ID NO: 2382746 - RNA, 13 nt, Bordetella pertussis
uguaucuggccug

SEQ ID NO: 2382747 - RNA, 18 nt, Bordetella pertussis
uguaucuggccugucugg

SEQ ID NO: 2382748 - RNA, 23 nt, Bordetella pertussis
uguaucuggccugucugguggcg

SEQ ID NO: 2382749 - RNA, 19 nt, Bordetella pertussis
uguauuccaucuugccggc

SEQ ID NO: 2382750 - RNA, 15 nt, Bordetella pertussis
ugucaagcagcgccg

SEQ ID NO: 2382751 - RNA, 14 nt, Bordetella pertussis
ugucacacgaagaa

SEQ ID NO: 2382752 - RNA, 22 nt, Bordetella pertussis
ugucacgacguccacgaugucg

SEQ ID NO: 2382753 - RNA, 23 nt, Bordetella pertussis
uguccaagcgcguggccaucaac

SEQ ID NO: 2382754 - RNA, 17 nt, Bordetella pertussis
uguccaccacccaggcc

SEQ ID NO: 2382755 - RNA, 17 nt, Bordetella pertussis
uguccaccauccugccc

SEQ ID NO: 2382756 - RNA, 23 nt, Bordetella pertussis
uguccagacccgaaucucccggc

SEQ ID NO: 2382757 - RNA, 13 nt, Bordetella pertussis
uguccagcgccag

SEQ ID NO: 2382758 - RNA, 17 nt, Bordetella pertussis
uguccagcgcgcccagc

SEQ ID NO: 2382759 - RNA, 21 nt, Bordetella pertussis
uguccagcgcgcccagcgcgc

SEQ ID NO: 2382760 - RNA, 18 nt, Bordetella pertussis
uguccagcggcagcgggu

SEQ ID NO: 2382761 - RNA, 12 nt, Bordetella pertussis
uguccagcggcg

SEQ ID NO: 2382762 - RNA, 13 nt, Bordetella pertussis
uguccagcuccag

SEQ ID NO: 2382763 - RNA, 16 nt, Bordetella pertussis
uguccagcuccagcgc

SEQ ID NO: 2382764 - RNA, 24 nt, Bordetella pertussis
uguccaggccgaucagcgacagca

SEQ ID NO: 2382765 - RNA, 15 nt, Bordetella pertussis
uguccaggccggggc

SEQ ID NO: 2382766 - RNA, 17 nt, Bordetella pertussis
uguccagguugagucug

SEQ ID NO: 2382767 - RNA, 21 nt, Bordetella pertussis
uguccauggccugcaggaagc

SEQ ID NO: 2382768 - RNA, 20 nt, Bordetella pertussis
ugucccaaccgggacaggca

SEQ ID NO: 2382769 - RNA, 15 nt, Bordetella pertussis
ugucccaauccgcga

SEQ ID NO: 2382770 - RNA, 20 nt, Bordetella pertussis
ugucccacaggcgcgcggcg

SEQ ID NO: 2382771 - RNA, 16 nt, Bordetella pertussis
ugucccagauggcgcc

SEQ ID NO: 2382772 - RNA, 14 nt, Bordetella pertussis
ugucccagcgcucg

SEQ ID NO: 2382773 - RNA, 20 nt, Bordetella pertussis
ugucccagcggggacaggca

SEQ ID NO: 2382774 - RNA, 10 nt, Bordetella pertussis
uguccccaca

SEQ ID NO: 2382775 - RNA, 14 nt, Bordetella pertussis
uguccccacagggg

SEQ ID NO: 2382776 - RNA, 22 nt, Bordetella pertussis
uguccccacauggggacuggca

SEQ ID NO: 2382777 - RNA, 12 nt, Bordetella pertussis
uguccccaccgg

SEQ ID NO: 2382778 - RNA, 16 nt, Bordetella pertussis
uguccccaccgggaca

SEQ ID NO: 2382779 - RNA, 22 nt, Bordetella pertussis
uguccccaccgggacaggcacc

SEQ ID NO: 2382780 - RNA, 20 nt, Bordetella pertussis
uguccccacggggacaggca

SEQ ID NO: 2382781 - RNA, 12 nt, Bordetella pertussis
uguccccacugg

SEQ ID NO: 2382782 - RNA, 13 nt, Bordetella pertussis
uguccccacuggg

SEQ ID NO: 2382783 - RNA, 23 nt, Bordetella pertussis
uguccccacugggggacuggcac

SEQ ID NO: 2382784 - RNA, 22 nt, Bordetella pertussis
uguccccccauggggacuggca

SEQ ID NO: 2382785 - RNA, 23 nt, Bordetella pertussis
uguccccgcaagggggacuggca

SEQ ID NO: 2382786 - RNA, 18 nt, Bordetella pertussis
uguccccgcacggggaca

SEQ ID NO: 2382787 - RNA, 22 nt, Bordetella pertussis
uguccccgcacggggacaggca

SEQ ID NO: 2382788 - RNA, 20 nt, Bordetella pertussis
uguccccgcagggacaggca

SEQ ID NO: 2382789 - RNA, 20 nt, Bordetella pertussis
uguccccgccgggacaggca

SEQ ID NO: 2382790 - RNA, 15 nt, Bordetella pertussis
uguccccgccggggc

SEQ ID NO: 2382791 - RNA, 17 nt, Bordetella pertussis
uguccccgcgcgggggg

SEQ ID NO: 2382792 - RNA, 16 nt, Bordetella pertussis
uguccccgcggggaca

SEQ ID NO: 2382793 - RNA, 17 nt, Bordetella pertussis
uguccccgcugggacag

SEQ ID NO: 2382794 - RNA, 20 nt, Bordetella pertussis
uguccccgcugggacaggca

SEQ ID NO: 2382795 - RNA, 22 nt, Bordetella pertussis
uguccccgcugggacaggcaca

SEQ ID NO: 2382796 - RNA, 23 nt, Bordetella pertussis
uguccccgcugggacaggcacac

SEQ ID NO: 2382797 - RNA, 22 nt, Bordetella pertussis
uguccccgcugggacaggcacu

SEQ ID NO: 2382798 - RNA, 22 nt, Bordetella pertussis
uguccccguggggacaggcacc

SEQ ID NO: 2382799 - RNA, 16 nt, Bordetella pertussis
ugucccgacggggaca

SEQ ID NO: 2382800 - RNA, 15 nt, Bordetella pertussis
ugucccgcugggggc

SEQ ID NO: 2382801 - RNA, 14 nt, Bordetella pertussis
ugucccggcggggc

SEQ ID NO: 2382802 - RNA, 15 nt, Bordetella pertussis
ugucccggcggggca

SEQ ID NO: 2382803 - RNA, 20 nt, Bordetella pertussis
ugucccggcugggacaggca

SEQ ID NO: 2382804 - RNA, 20 nt, Bordetella pertussis
ugucccugccgggacaggca

SEQ ID NO: 2382805 - RNA, 15 nt, Bordetella pertussis
ugucccugcgggggc

SEQ ID NO: 2382806 - RNA, 20 nt, Bordetella pertussis
ugucccugcgggggcaggca

SEQ ID NO: 2382807 - RNA, 17 nt, Bordetella pertussis
uguccgaugcgcugcug

SEQ ID NO: 2382808 - RNA, 19 nt, Bordetella pertussis
uguccgccaugcgaugcug

SEQ ID NO: 2382809 - RNA, 20 nt, Bordetella pertussis
uguccgccguagcgcgccag

SEQ ID NO: 2382810 - RNA, 16 nt, Bordetella pertussis
uguccgcgccgggaaa

SEQ ID NO: 2382811 - RNA, 15 nt, Bordetella pertussis
uguccgcgucggccg

SEQ ID NO: 2382812 - RNA, 20 nt, Bordetella pertussis
uguccggcgcucgccccggc

SEQ ID NO: 2382813 - RNA, 14 nt, Bordetella pertussis
uguccggcgcuggc

SEQ ID NO: 2382814 - RNA, 18 nt, Bordetella pertussis
uguccggggcgcuugcca

SEQ ID NO: 2382815 - RNA, 20 nt, Bordetella pertussis
uguccggggcgcuugccacu

SEQ ID NO: 2382816 - RNA, 19 nt, Bordetella pertussis
uguccugauucacaggccc

SEQ ID NO: 2382817 - RNA, 14 nt, Bordetella pertussis
uguccugcaggccc

SEQ ID NO: 2382818 - RNA, 21 nt, Bordetella pertussis
uguccuggacagugcccugac

SEQ ID NO: 2382819 - RNA, 13 nt, Bordetella pertussis
uguccuggucggc

SEQ ID NO: 2382820 - RNA, 16 nt, Bordetella pertussis
uguccuucguggcgcc

SEQ ID NO: 2382821 - RNA, 18 nt, Bordetella pertussis
uguccuucguggcgccgg

SEQ ID NO: 2382822 - RNA, 22 nt, Bordetella pertussis
ugucgaccauguccgcgcccau

SEQ ID NO: 2382823 - RNA, 16 nt, Bordetella pertussis
ugucgagcaggccgcc

SEQ ID NO: 2382824 - RNA, 19 nt, Bordetella pertussis
ugucgauaucaguccuugu

SEQ ID NO: 2382825 - RNA, 24 nt, Bordetella pertussis
ugucgaucgccaccagcgucagca

SEQ ID NO: 2382826 - RNA, 21 nt, Bordetella pertussis
ugucgaugggguagucggcca

SEQ ID NO: 2382827 - RNA, 21 nt, Bordetella pertussis
ugucgcaacagcccccuggua

SEQ ID NO: 2382828 - RNA, 15 nt, Bordetella pertussis
ugucgcaaucgacga

SEQ ID NO: 2382829 - RNA, 21 nt, Bordetella pertussis
ugucgcaggccgcggccaggc

SEQ ID NO: 2382830 - RNA, 16 nt, Bordetella pertussis
ugucgcagucggggcc

SEQ ID NO: 2382831 - RNA, 18 nt, Bordetella pertussis
ugucgcagucggggccgc

SEQ ID NO: 2382832 - RNA, 15 nt, Bordetella pertussis
ugucgccacgggcgu

SEQ ID NO: 2382833 - RNA, 22 nt, Bordetella pertussis
ugucgcccaccacgccgcccag

SEQ ID NO: 2382834 - RNA, 19 nt, Bordetella pertussis
ugucgccgacccgggcggg

SEQ ID NO: 2382835 - RNA, 15 nt, Bordetella pertussis
ugucgccgccgcgca

SEQ ID NO: 2382836 - RNA, 17 nt, Bordetella pertussis
ugucgccgcggccggcg

SEQ ID NO: 2382837 - RNA, 14 nt, Bordetella pertussis
agccacggcccgcc

SEQ ID NO: 2382838 - RNA, 17 nt, Bordetella pertussis
agccacggcccgccagg

SEQ ID NO: 2382839 - RNA, 24 nt, Bordetella pertussis
agccacgugaagcgccgcgccucg

SEQ ID NO: 2382840 - RNA, 16 nt, Bordetella pertussis
agccagaacaugagcc

SEQ ID NO: 2382841 - RNA, 18 nt, Bordetella pertussis
agccagauaaaggccgca

SEQ ID NO: 2382842 - RNA, 20 nt, Bordetella pertussis
agccagauaaaggccgcaac

SEQ ID NO: 2382843 - RNA, 12 nt, Bordetella pertussis
agccagauaccg

SEQ ID NO: 2382844 - RNA, 15 nt, Bordetella pertussis
agccagauucccccg

SEQ ID NO: 2382845 - RNA, 15 nt, Bordetella pertussis
agccagccggcggcc

SEQ ID NO: 2382846 - RNA, 13 nt, Bordetella pertussis
agccagcgccgca

SEQ ID NO: 2382847 - RNA, 15 nt, Bordetella pertussis
agccagcgccgcagc

SEQ ID NO: 2382848 - RNA, 13 nt, Bordetella pertussis
agccagcgccugc

SEQ ID NO: 2382849 - RNA, 11 nt, Bordetella pertussis
ugucgcgcgcg

SEQ ID NO: 2382850 - RNA, 16 nt, Bordetella pertussis
ugucgcgcgcgcucag

SEQ ID NO: 2382851 - RNA, 22 nt, Bordetella pertussis
ugucgcgcgcgcucagggggcg

SEQ ID NO: 2382852 - RNA, 21 nt, Bordetella pertussis
ugucgcggcccacggccagca

SEQ ID NO: 2382853 - RNA, 22 nt, Bordetella pertussis
ugucgcggcccacggccagcac

SEQ ID NO: 2382854 - RNA, 20 nt, Bordetella pertussis
ugucggccaccacgauggcg

SEQ ID NO: 2382855 - RNA, 11 nt, Bordetella pertussis
ugucggccagg

SEQ ID NO: 2382856 - RNA, 13 nt, Bordetella pertussis
ugucggccaggga

SEQ ID NO: 2382857 - RNA, 23 nt, Bordetella pertussis
ugucggccagggaggcgaugcug

SEQ ID NO: 2382858 - RNA, 13 nt, Bordetella pertussis
ugucggccagggc

SEQ ID NO: 2382859 - RNA, 21 nt, Bordetella pertussis
ugucggccaugcgauaggcga

SEQ ID NO: 2382860 - RNA, 22 nt, Bordetella pertussis
ugucggcccacuggaucgccga

SEQ ID NO: 2382861 - RNA, 20 nt, Bordetella pertussis
ugucggccgaaccgcgcagc

SEQ ID NO: 2382862 - RNA, 22 nt, Bordetella pertussis
ugucggccgaaccgcgcagccg

SEQ ID NO: 2382863 - RNA, 15 nt, Bordetella pertussis
ugucggccgcgcgca

SEQ ID NO: 2382864 - RNA, 19 nt, Bordetella pertussis
ugucggccuucugcgccag

SEQ ID NO: 2382865 - RNA, 12 nt, Bordetella pertussis
ugucggcgcaga

SEQ ID NO: 2382866 - RNA, 14 nt, Bordetella pertussis
ugucggcggccagc

SEQ ID NO: 2382867 - RNA, 15 nt, Bordetella pertussis
ugucggcggccagca

SEQ ID NO: 2382868 - RNA, 20 nt, Bordetella pertussis
ugucggcggccagcagcggc

SEQ ID NO: 2382869 - RNA, 21 nt, Bordetella pertussis
ugucggcggccagcagcggca

SEQ ID NO: 2382870 - RNA, 23 nt, Bordetella pertussis
ugucggggaagauguggucggcg

SEQ ID NO: 2382871 - RNA, 14 nt, Bordetella pertussis
ugucggggccgggc

SEQ ID NO: 2382872 - RNA, 20 nt, Bordetella pertussis
ugucggugauccacugcagc

SEQ ID NO: 2382873 - RNA, 13 nt, Bordetella pertussis
ugucggugaugau

SEQ ID NO: 2382874 - RNA, 23 nt, Bordetella pertussis
ugucguccagcuccaggugccag

SEQ ID NO: 2382875 - RNA, 14 nt, Bordetella pertussis
ugucgucgcgcgag

SEQ ID NO: 2382876 - RNA, 20 nt, Bordetella pertussis
ugucgucgcgcuggccccag

SEQ ID NO: 2382877 - RNA, 17 nt, Bordetella pertussis
ugucguugaugguccgc

SEQ ID NO: 2382878 - RNA, 15 nt, Bordetella pertussis
ugucuaucauggccu

SEQ ID NO: 2382879 - RNA, 18 nt, Bordetella pertussis
ugucuuugaagggcggcg

SEQ ID NO: 2382880 - RNA, 15 nt, Bordetella pertussis
ugugacggaccuugu

SEQ ID NO: 2382881 - RNA, 19 nt, Bordetella pertussis
ugugauagacauugcccag

SEQ ID NO: 2382882 - RNA, 22 nt, Bordetella pertussis
ugugauagcacugcaccugcuc

SEQ ID NO: 2382883 - RNA, 15 nt, Bordetella pertussis
ugugaucgccgacga

SEQ ID NO: 2382884 - RNA, 21 nt, Bordetella pertussis
ugugcagccacgccuggccgc

SEQ ID NO: 2382885 - RNA, 12 nt, Bordetella pertussis
ugugcagcgcac

SEQ ID NO: 2382886 - RNA, 19 nt, Bordetella pertussis
ugugcaggccgaggaccug

SEQ ID NO: 2382887 - RNA, 14 nt, Bordetella pertussis
ugugcaugcgcgcc

SEQ ID NO: 2382888 - RNA, 12 nt, Bordetella pertussis
ugugccagcugg

SEQ ID NO: 2382889 - RNA, 21 nt, Bordetella pertussis
ugugccgaugcuuagcgcagc

SEQ ID NO: 2382890 - RNA, 16 nt, Bordetella pertussis
ugugccgccagcggga

SEQ ID NO: 2382891 - RNA, 18 nt, Bordetella pertussis
ugugccugucccagcggg

SEQ ID NO: 2382892 - RNA, 16 nt, Bordetella pertussis
ugugccuguccccgcu

SEQ ID NO: 2382893 - RNA, 22 nt, Bordetella pertussis
ugugcgagggcucgaccgccgc

SEQ ID NO: 2382894 - RNA, 17 nt, Bordetella pertussis
ugugcgccccgcuggcc

SEQ ID NO: 2382895 - RNA, 23 nt, Bordetella pertussis
ugugcgccgcgccguacagggcc

SEQ ID NO: 2382896 - RNA, 14 nt, Bordetella pertussis
ugugcgccggggcg

SEQ ID NO: 2382897 - RNA, 17 nt, Bordetella pertussis
ugugcgccggggcgccg

SEQ ID NO: 2382898 - RNA, 13 nt, Bordetella pertussis
ugugcgcgggcgc

SEQ ID NO: 2382899 - RNA, 21 nt, Bordetella pertussis
ugugcgcgggcgcgggcuguc

SEQ ID NO: 2382900 - RNA, 16 nt, Bordetella pertussis
ugugcugccaugccgc

SEQ ID NO: 2382901 - RNA, 17 nt, Bordetella pertussis
ugugcuugagauugugc

SEQ ID NO: 2382902 - RNA, 14 nt, Bordetella pertussis
ugugcuugccgcag

SEQ ID NO: 2382903 - RNA, 13 nt, Bordetella pertussis
uguggacgccgcc

SEQ ID NO: 2382904 - RNA, 20 nt, Bordetella pertussis
uguggcaggcgucggccagc

SEQ ID NO: 2382905 - RNA, 12 nt, Bordetella pertussis
uguggccagcuc

SEQ ID NO: 2382906 - RNA, 22 nt, Bordetella pertussis
uguggccgucgucaucgccauc

SEQ ID NO: 2382907 - RNA, 23 nt, Bordetella pertussis
uguggcgacgcccagccugccgg

SEQ ID NO: 2382908 - RNA, 17 nt, Bordetella pertussis
ugugggggacaggcacg

SEQ ID NO: 2382909 - RNA, 20 nt, Bordetella pertussis
ugugggggacaggcacgccg

SEQ ID NO: 2382910 - RNA, 15 nt, Bordetella pertussis
uguggggggucaggc

SEQ ID NO: 2382911 - RNA, 17 nt, Bordetella pertussis
uguggggggucaggccg

SEQ ID NO: 2382912 - RNA, 18 nt, Bordetella pertussis
uguggggggucaggccgu

SEQ ID NO: 2382913 - RNA, 22 nt, Bordetella pertussis
uguggucggcgaccgugcgcca

SEQ ID NO: 2382914 - RNA, 15 nt, Bordetella pertussis
uguggugaaagccgc

SEQ ID NO: 2382915 - RNA, 13 nt, Bordetella pertussis
ugugguuggcgcu

SEQ ID NO: 2382916 - RNA, 15 nt, Bordetella pertussis
ugugguuggcgcugc

SEQ ID NO: 2382917 - RNA, 14 nt, Bordetella pertussis
uguucacgcccagg

SEQ ID NO: 2382918 - RNA, 21 nt, Bordetella pertussis
uguucacgcgcaagccgcugg

SEQ ID NO: 2382919 - RNA, 18 nt, Bordetella pertussis
uguucagcuucagccugg

SEQ ID NO: 2382920 - RNA, 14 nt, Bordetella pertussis
uguuccggcgcgcg

SEQ ID NO: 2382921 - RNA, 14 nt, Bordetella pertussis
uguuccugcgcgac

SEQ ID NO: 2382922 - RNA, 21 nt, Bordetella pertussis
uguucgacacuucggucgcgu

SEQ ID NO: 2382923 - RNA, 17 nt, Bordetella pertussis
uguucgagcaggcgcgc

SEQ ID NO: 2382924 - RNA, 16 nt, Bordetella pertussis
uguucgccaaucugcc

SEQ ID NO: 2382925 - RNA, 19 nt, Bordetella pertussis
uguucgcgcaauugcuucu

SEQ ID NO: 2382926 - RNA, 16 nt, Bordetella pertussis
uguucgcgcaccagcg

SEQ ID NO: 2382927 - RNA, 14 nt, Bordetella pertussis
uguucgcgcgcggu

SEQ ID NO: 2382928 - RNA, 23 nt, Bordetella pertussis
uguucgcgcgcgguauccagguc

SEQ ID NO: 2382929 - RNA, 19 nt, Bordetella pertussis
uguucggcgccgggcgacg

SEQ ID NO: 2382930 - RNA, 20 nt, Bordetella pertussis
uguucggggcagggcgccug

SEQ ID NO: 2382931 - RNA, 14 nt, Bordetella pertussis
uguucuccaacugg

SEQ ID NO: 2382932 - RNA, 20 nt, Bordetella pertussis
uguucuuguugcucuugacc

SEQ ID NO: 2382933 - RNA, 14 nt, Bordetella pertussis
uguugaacugcagg

SEQ ID NO: 2382934 - RNA, 14 nt, Bordetella pertussis
uguugaccacgccc

SEQ ID NO: 2382935 - RNA, 13 nt, Bordetella pertussis
uguugcaggaucu

SEQ ID NO: 2382936 - RNA, 14 nt, Bordetella pertussis
uguugcccaccagc

SEQ ID NO: 2382937 - RNA, 15 nt, Bordetella pertussis
uguugcccaccagcc

SEQ ID NO: 2382938 - RNA, 16 nt, Bordetella pertussis
uguugcccaccgccag

SEQ ID NO: 2382939 - RNA, 20 nt, Bordetella pertussis
uguugcgaaacccgcugggc

SEQ ID NO: 2382940 - RNA, 16 nt, Bordetella pertussis
uguugcgguggugcgc

SEQ ID NO: 2382941 - RNA, 15 nt, Bordetella pertussis
uguugcgugccgccc

SEQ ID NO: 2382942 - RNA, 13 nt, Bordetella pertussis
uguuggccgccag

SEQ ID NO: 2382943 - RNA, 16 nt, Bordetella pertussis
uguuggccgucgccag

SEQ ID NO: 2382944 - RNA, 16 nt, Bordetella pertussis
uguuggcgccggccgc

SEQ ID NO: 2382945 - RNA, 19 nt, Bordetella pertussis
uguuggcgccggccgcgcg

SEQ ID NO: 2382946 - RNA, 14 nt, Bordetella pertussis
uguuggcgugcagg

SEQ ID NO: 2382947 - RNA, 21 nt, Bordetella pertussis
uguugggccaccuggcagccg

SEQ ID NO: 2382948 - RNA, 18 nt, Bordetella pertussis
uguuggucgccacgccau

SEQ ID NO: 2382949 - RNA, 22 nt, Bordetella pertussis
uguuguagugcuccaccaccau

SEQ ID NO: 2382950 - RNA, 20 nt, Bordetella pertussis
uucgaucaugcccgccacgg

SEQ ID NO: 2382951 - RNA, 21 nt, Bordetella pertussis
uucgauggcggccagggcaag

SEQ ID NO: 2382952 - RNA, 21 nt, Bordetella pertussis
uucgcacagccggggcgagcg

SEQ ID NO: 2382953 - RNA, 23 nt, Bordetella pertussis
uucgcaccagucccgcaccgacc

SEQ ID NO: 2382954 - RNA, 16 nt, Bordetella pertussis
uucgcagcggaugccg

SEQ ID NO: 2382955 - RNA, 17 nt, Bordetella pertussis
uucgcagcggaugccgc

SEQ ID NO: 2382956 - RNA, 18 nt, Bordetella pertussis
uucgcagcggaugccgcc

SEQ ID NO: 2382957 - RNA, 17 nt, Bordetella pertussis
uucgccaaucugccgcu

SEQ ID NO: 2382958 - RNA, 22 nt, Bordetella pertussis
uucgccaaucugccgcugaccg

SEQ ID NO: 2382959 - RNA, 17 nt, Bordetella pertussis
uucgcccaccaccagcg

SEQ ID NO: 2382960 - RNA, 13 nt, Bordetella pertussis
uucgcccgugccg

SEQ ID NO: 2382961 - RNA, 12 nt, Bordetella pertussis
uucgccgauccg

SEQ ID NO: 2382962 - RNA, 19 nt, Bordetella pertussis
uucgccgaucgagcaggcc

SEQ ID NO: 2382963 - RNA, 19 nt, Bordetella pertussis
uucgccgaugaccagcagc

SEQ ID NO: 2382964 - RNA, 22 nt, Bordetella pertussis
uucgccgaugaccagcagcgcc

SEQ ID NO: 2382965 - RNA, 23 nt, Bordetella pertussis
uucgccgaugaccagcagcgccg

SEQ ID NO: 2382966 - RNA, 13 nt, Bordetella pertussis
uucgccgcaccag

SEQ ID NO: 2382967 - RNA, 11 nt, Bordetella pertussis
uucgccgcgca

SEQ ID NO: 2382968 - RNA, 18 nt, Bordetella pertussis
uucgccggaggcgcgcag

SEQ ID NO: 2382969 - RNA, 20 nt, Bordetella pertussis
uucgccgugcagggccaggu

SEQ ID NO: 2382970 - RNA, 19 nt, Bordetella pertussis
uucgcgaaagcgcugcgcc

SEQ ID NO: 2382971 - RNA, 20 nt, Bordetella pertussis
uucgcgcagaucccaggcgc

SEQ ID NO: 2382972 - RNA, 23 nt, Bordetella pertussis
uucgcgcagcaacccgcccgggu

SEQ ID NO: 2382973 - RNA, 13 nt, Bordetella pertussis
uucgcgcagcggc

SEQ ID NO: 2382974 - RNA, 16 nt, Bordetella pertussis
uucgcgccugagcugc

SEQ ID NO: 2382975 - RNA, 12 nt, Bordetella pertussis
uucgcgcgccag

SEQ ID NO: 2382976 - RNA, 12 nt, Bordetella pertussis
uucgcgcgcgcc

SEQ ID NO: 2382977 - RNA, 21 nt, Bordetella pertussis
uucgcgcgcgguauccagguc

SEQ ID NO: 2382978 - RNA, 16 nt, Bordetella pertussis
uucgcgcugcagauca

SEQ ID NO: 2382979 - RNA, 15 nt, Bordetella pertussis
uucgcggcccugggc

SEQ ID NO: 2382980 - RNA, 18 nt, Bordetella pertussis
uucgcgguacgcccagcu

SEQ ID NO: 2382981 - RNA, 22 nt, Bordetella pertussis
uucgcgguaggacggcagcacc

SEQ ID NO: 2382982 - RNA, 23 nt, Bordetella pertussis
uucgcgguaggacggcagcaccg

SEQ ID NO: 2382983 - RNA, 18 nt, Bordetella pertussis
uucgcggugggcagcggc

SEQ ID NO: 2382984 - RNA, 16 nt, Bordetella pertussis
uucgcugggcgcgcac

SEQ ID NO: 2382985 - RNA, 16 nt, Bordetella pertussis
uucgcuuuccagggug

SEQ ID NO: 2382986 - RNA, 19 nt, Bordetella pertussis
uucggaguaguugucgucg

SEQ ID NO: 2382987 - RNA, 18 nt, Bordetella pertussis
uucggaugcgcguugccg

SEQ ID NO: 2382988 - RNA, 17 nt, Bordetella pertussis
uucggcaaccgcgccuc

SEQ ID NO: 2382989 - RNA, 23 nt, Bordetella pertussis
uucggcagcgaggcgcagcgcag

SEQ ID NO: 2382990 - RNA, 17 nt, Bordetella pertussis
uucggcaggcgccggcu

SEQ ID NO: 2382991 - RNA, 20 nt, Bordetella pertussis
uucggccagcagcuuggcca

SEQ ID NO: 2382992 - RNA, 21 nt, Bordetella pertussis
uucggccagccccaccuugcc

SEQ ID NO: 2382993 - RNA, 16 nt, Bordetella pertussis
uucggccagcgcgcgg

SEQ ID NO: 2382994 - RNA, 12 nt, Bordetella pertussis
uucggccgccag

SEQ ID NO: 2382995 - RNA, 16 nt, Bordetella pertussis
uucggccgccagguag

SEQ ID NO: 2382996 - RNA, 15 nt, Bordetella pertussis
uucggccgccagguc

SEQ ID NO: 2382997 - RNA, 21 nt, Bordetella pertussis
uucggccugcaggcccagcac

SEQ ID NO: 2382998 - RNA, 12 nt, Bordetella pertussis
uucggcgaugcg

SEQ ID NO: 2382999 - RNA, 19 nt, Bordetella pertussis
uucggcgcaucggcgccag

SEQ ID NO: 2383000 - RNA, 13 nt, Bordetella pertussis
uucggcgccgccg

SEQ ID NO: 2383001 - RNA, 13 nt, Bordetella pertussis
uucggcgcgcgcc

SEQ ID NO: 2383002 - RNA, 14 nt, Bordetella pertussis
uucggcgcgcgccg

SEQ ID NO: 2383003 - RNA, 16 nt, Bordetella pertussis
uucggcgcgcgugccg

SEQ ID NO: 2383004 - RNA, 23 nt, Bordetella pertussis
uucggcgcggcgggcgcuggcgc

SEQ ID NO: 2383005 - RNA, 12 nt, Bordetella pertussis
uucggcgcguac

SEQ ID NO: 2383006 - RNA, 15 nt, Bordetella pertussis
uucggcgcgugcgga

SEQ ID NO: 2383007 - RNA, 12 nt, Bordetella pertussis
uucggcggccag

SEQ ID NO: 2383008 - RNA, 19 nt, Bordetella pertussis
uucggcggccugcuuggca

SEQ ID NO: 2383009 - RNA, 16 nt, Bordetella pertussis
uucggcggugaugucg

SEQ ID NO: 2383010 - RNA, 23 nt, Bordetella pertussis
uucggcuugcguuggcauggcgc

SEQ ID NO: 2383011 - RNA, 11 nt, Bordetella pertussis
uucgggcaugu

SEQ ID NO: 2383012 - RNA, 20 nt, Bordetella pertussis
uucggggcgucgcugcuggc

SEQ ID NO: 2383013 - RNA, 19 nt, Bordetella pertussis
uucgggugaggggccagcc

SEQ ID NO: 2383014 - RNA, 20 nt, Bordetella pertussis
uucgggugaggggccagccu

SEQ ID NO: 2383015 - RNA, 18 nt, Bordetella pertussis
uucggucagcuugccgcc

SEQ ID NO: 2383016 - RNA, 20 nt, Bordetella pertussis
uucguacagccugcccuggu

SEQ ID NO: 2383017 - RNA, 23 nt, Bordetella pertussis
uucgucagggccgcagcaccuug

SEQ ID NO: 2383018 - RNA, 21 nt, Bordetella pertussis
uucgucauggucgaccagcag

SEQ ID NO: 2383019 - RNA, 14 nt, Bordetella pertussis
uucgucgcgcagca

SEQ ID NO: 2383020 - RNA, 17 nt, Bordetella pertussis
uucgucgcugccgcgcg

SEQ ID NO: 2383021 - RNA, 18 nt, Bordetella pertussis
uucgucggcgcucuuggg

SEQ ID NO: 2383022 - RNA, 17 nt, Bordetella pertussis
uucgugaugccccaggu

SEQ ID NO: 2383023 - RNA, 18 nt, Bordetella pertussis
uucgugaugccccagguc

SEQ ID NO: 2383024 - RNA, 13 nt, Bordetella pertussis
uucgugcagcgcg

SEQ ID NO: 2383025 - RNA, 18 nt, Bordetella pertussis
uucgugcggccgcagcag

SEQ ID NO: 2383026 - RNA, 14 nt, Bordetella pertussis
uucguggcgcagcu

SEQ ID NO: 2383027 - RNA, 13 nt, Bordetella pertussis
uucgugguggcga

SEQ ID NO: 2383028 - RNA, 21 nt, Bordetella pertussis
uucucaaggccgaauugccgc

SEQ ID NO: 2383029 - RNA, 18 nt, Bordetella pertussis
uucucgaccaggcgggca

SEQ ID NO: 2383030 - RNA, 13 nt, Bordetella pertussis
uucucgccgcgcg

SEQ ID NO: 2383031 - RNA, 18 nt, Bordetella pertussis
uucucggccagcgccgaa

SEQ ID NO: 2383032 - RNA, 14 nt, Bordetella pertussis
uucugcaccggcgc

SEQ ID NO: 2383033 - RNA, 18 nt, Bordetella pertussis
uucugcaucggcaugagc

SEQ ID NO: 2383034 - RNA, 18 nt, Bordetella pertussis
uucugcgcguccuggcgc

SEQ ID NO: 2383035 - RNA, 17 nt, Bordetella pertussis
uucuggccuuccugcug

SEQ ID NO: 2383036 - RNA, 21 nt, Bordetella pertussis
uucuggcugcgcgccuggcac

SEQ ID NO: 2383037 - RNA, 17 nt, Bordetella pertussis
uucuucagcauggagcu

SEQ ID NO: 2383038 - RNA, 20 nt, Bordetella pertussis
uucuuccuugcgaugccagu

SEQ ID NO: 2383039 - RNA, 13 nt, Bordetella pertussis
uucuucuuggcca

SEQ ID NO: 2383040 - RNA, 14 nt, Bordetella pertussis
uucuucuuggccag

SEQ ID NO: 2383041 - RNA, 15 nt, Bordetella pertussis
uucuucuuggccaga

SEQ ID NO: 2383042 - RNA, 21 nt, Bordetella pertussis
uucuugaaaaagcugccggca

SEQ ID NO: 2383043 - RNA, 20 nt, Bordetella pertussis
uucuugcgcaucggcggcag

SEQ ID NO: 2383044 - RNA, 21 nt, Bordetella pertussis
uucuugucgaacaggcgcuug

SEQ ID NO: 2383045 - RNA, 20 nt, Bordetella pertussis
uugaacagccgccccagcag

SEQ ID NO: 2383046 - RNA, 16 nt, Bordetella pertussis
uugaacuccgcggcgu

SEQ ID NO: 2383047 - RNA, 15 nt, Bordetella pertussis
uugaagccguaguug

SEQ ID NO: 2383048 - RNA, 19 nt, Bordetella pertussis
uugaaggccgaggccaggu

SEQ ID NO: 2383049 - RNA, 18 nt, Bordetella pertussis
uugaaguaaucgcccggc

SEQ ID NO: 2383050 - RNA, 13 nt, Bordetella pertussis
uugaccagcacca

SEQ ID NO: 2383051 - RNA, 14 nt, Bordetella pertussis
uugaccgccagcau

SEQ ID NO: 2383052 - RNA, 19 nt, Bordetella pertussis
uugaccgccuccaggauga

SEQ ID NO: 2383053 - RNA, 16 nt, Bordetella pertussis
uugaccggcuggcgca

SEQ ID NO: 2383054 - RNA, 19 nt, Bordetella pertussis
uugaccggcuggcgcacgu

SEQ ID NO: 2383055 - RNA, 14 nt, Bordetella pertussis
uugacgccgccgaa

SEQ ID NO: 2383056 - RNA, 19 nt, Bordetella pertussis
uugacgccggcggcgugcg

SEQ ID NO: 2383057 - RNA, 14 nt, Bordetella pertussis
uugacggcccagcu

SEQ ID NO: 2383058 - RNA, 15 nt, Bordetella pertussis
uugacggcgcucuug

SEQ ID NO: 2383059 - RNA, 17 nt, Bordetella pertussis
uugacggggacgccggc

SEQ ID NO: 2383060 - RNA, 22 nt, Bordetella pertussis
uugacggucacggucuggccca

SEQ ID NO: 2383061 - RNA, 19 nt, Bordetella pertussis
uugacgguggccgcggcgu

SEQ ID NO: 2383062 - RNA, 20 nt, Bordetella pertussis
uugagcaacgugcgcacgcg

SEQ ID NO: 2383063 - RNA, 20 nt, Bordetella pertussis
uuggcaaccucgccgcgcca

SEQ ID NO: 2383064 - RNA, 22 nt, Bordetella pertussis
uuggcaaggcccgccgcggcag

SEQ ID NO: 2383065 - RNA, 19 nt, Bordetella pertussis
uuggccaaugcgccgcgcc

SEQ ID NO: 2383066 - RNA, 15 nt, Bordetella pertussis
uuggccacuucgccg

SEQ ID NO: 2383067 - RNA, 13 nt, Bordetella pertussis
uuggccagcgccg

SEQ ID NO: 2383068 - RNA, 14 nt, Bordetella pertussis
uuggccagcgccgc

SEQ ID NO: 2383069 - RNA, 14 nt, Bordetella pertussis
uuggccagcgcgcc

SEQ ID NO: 2383070 - RNA, 16 nt, Bordetella pertussis
uuggcccugcagcggc

SEQ ID NO: 2383071 - RNA, 19 nt, Bordetella pertussis
uuggcccugcagcggccag

SEQ ID NO: 2383072 - RNA, 22 nt, Bordetella pertussis
uuggccgaacauauccacgcca

SEQ ID NO: 2383073 - RNA, 16 nt, Bordetella pertussis
uuggccgccagccggc

SEQ ID NO: 2383074 - RNA, 11 nt, Bordetella pertussis
uuggccgcgcg

SEQ ID NO: 2383075 - RNA, 14 nt, Bordetella pertussis
uuggccgcgcgccg

SEQ ID NO: 2383076 - RNA, 17 nt, Bordetella pertussis
uuggccgcgcgccggcg

SEQ ID NO: 2383077 - RNA, 14 nt, Bordetella pertussis
uuggccggcgcgcc

SEQ ID NO: 2383078 - RNA, 15 nt, Bordetella pertussis
uuggccggcgcgccc

SEQ ID NO: 2383079 - RNA, 18 nt, Bordetella pertussis
uuggccgggucgcgcagc

SEQ ID NO: 2383080 - RNA, 21 nt, Bordetella pertussis
uuggccguccacgaaggcagc

SEQ ID NO: 2383081 - RNA, 22 nt, Bordetella pertussis
uuggccguccacgaaggcagca

SEQ ID NO: 2383082 - RNA, 13 nt, Bordetella pertussis
uuggccugccauc

SEQ ID NO: 2383083 - RNA, 12 nt, Bordetella pertussis
uuggccugcccu

SEQ ID NO: 2383084 - RNA, 19 nt, Bordetella pertussis
uuggccugggcgcggucca

SEQ ID NO: 2383085 - RNA, 22 nt, Bordetella pertussis
uuggccuucggcgaucugggcc

SEQ ID NO: 2383086 - RNA, 22 nt, Bordetella pertussis
uuggccuugcccaggcugggcc

SEQ ID NO: 2383087 - RNA, 18 nt, Bordetella pertussis
uuggccuugcgcguccag

SEQ ID NO: 2383088 - RNA, 17 nt, Bordetella pertussis
uuggcgaacgugcgcgc

SEQ ID NO: 2383089 - RNA, 17 nt, Bordetella pertussis
uuggcgaaggcgucggc

SEQ ID NO: 2383090 - RNA, 21 nt, Bordetella pertussis
uuggcgaaucaguucgcgcag

SEQ ID NO: 2383091 - RNA, 20 nt, Bordetella pertussis
uuggcgaugcucacgcccag

SEQ ID NO: 2383092 - RNA, 22 nt, Bordetella pertussis
uuggcgcaggaacucagcgcac

SEQ ID NO: 2383093 - RNA, 17 nt, Bordetella pertussis
uuggcgcccagcgccau

SEQ ID NO: 2383094 - RNA, 21 nt, Bordetella pertussis
uuggcgccggccgcgcgcgcc

SEQ ID NO: 2383095 - RNA, 20 nt, Bordetella pertussis
uuggcgcgccuugcgcggcg

SEQ ID NO: 2383096 - RNA, 22 nt, Bordetella pertussis
uuggcgcgcggauccagcgagg

SEQ ID NO: 2383097 - RNA, 14 nt, Bordetella pertussis
uuggcgcugcugcu

SEQ ID NO: 2383098 - RNA, 17 nt, Bordetella pertussis
uuggcgcugcugcuggc

SEQ ID NO: 2383099 - RNA, 21 nt, Bordetella pertussis
uuggcggccuggccgcgcgcc

SEQ ID NO: 2383100 - RNA, 13 nt, Bordetella pertussis
uuggcggcgcagc

SEQ ID NO: 2383101 - RNA, 15 nt, Bordetella pertussis
uuggcggcuggcgcg

SEQ ID NO: 2383102 - RNA, 14 nt, Bordetella pertussis
uuggcggcuuccug

SEQ ID NO: 2383103 - RNA, 17 nt, Bordetella pertussis
uuggcguagauccaggc

SEQ ID NO: 2383104 - RNA, 19 nt, Bordetella pertussis
uuggcguagauccaggcgg

SEQ ID NO: 2383105 - RNA, 21 nt, Bordetella pertussis
uuggcguagccggugcgcagc

SEQ ID NO: 2383106 - RNA, 22 nt, Bordetella pertussis
uuggcguagccggugcgcagca

SEQ ID NO: 2383107 - RNA, 16 nt, Bordetella pertussis
uuggcgugcaggcugg

SEQ ID NO: 2383108 - RNA, 18 nt, Bordetella pertussis
uugggauggaugccgucg

SEQ ID NO: 2383109 - RNA, 15 nt, Bordetella pertussis
uugggcaaaaaaaga

SEQ ID NO: 2383110 - RNA, 18 nt, Bordetella pertussis
uugggcaaaaaaagaggc

SEQ ID NO: 2383111 - RNA, 18 nt, Bordetella pertussis
uugggcaccaccaccgcc

SEQ ID NO: 2383112 - RNA, 12 nt, Bordetella pertussis
uugggccgcgcc

SEQ ID NO: 2383113 - RNA, 16 nt, Bordetella pertussis
uugggggucagcgccg

SEQ ID NO: 2383114 - RNA, 22 nt, Bordetella pertussis
uuggggucccacugccaguagg

SEQ ID NO: 2383115 - RNA, 18 nt, Bordetella pertussis
uugguggggucgaugcca

SEQ ID NO: 2383116 - RNA, 20 nt, Bordetella pertussis
uugguggggucgaugccagu

SEQ ID NO: 2383117 - RNA, 18 nt, Bordetella pertussis
uuggugucauagcgccag

SEQ ID NO: 2383118 - RNA, 15 nt, Bordetella pertussis
uugguguugccggcc

SEQ ID NO: 2383119 - RNA, 22 nt, Bordetella pertussis
uugguuggccugggccaggacc

SEQ ID NO: 2383120 - RNA, 19 nt, Bordetella pertussis
uuguaccccauaguccucu

SEQ ID NO: 2383121 - RNA, 17 nt, Bordetella pertussis
uuguacgacgucuugcu

SEQ ID NO: 2383122 - RNA, 15 nt, Bordetella pertussis
uugucaagcagcgcc

SEQ ID NO: 2383123 - RNA, 13 nt, Bordetella pertussis
uuguccuggcgcg

SEQ ID NO: 2383124 - RNA, 22 nt, Bordetella pertussis
uugucgcgcgugagcgaaucca

SEQ ID NO: 2383125 - RNA, 13 nt, Bordetella pertussis
uugucgcugcgca

SEQ ID NO: 2383126 - RNA, 17 nt, Bordetella pertussis
uugucguugauggggcc

SEQ ID NO: 2383127 - RNA, 19 nt, Bordetella pertussis
uugugcagcaacgccggcg

SEQ ID NO: 2383128 - RNA, 17 nt, Bordetella pertussis
uugugcugccaugccgc

SEQ ID NO: 2383129 - RNA, 13 nt, Bordetella pertussis
uuguggccgccga

SEQ ID NO: 2383130 - RNA, 21 nt, Bordetella pertussis
uuguuccacgaggucuugccg

SEQ ID NO: 2383131 - RNA, 14 nt, Bordetella pertussis
uuguucgcgcgcgg

SEQ ID NO: 2383132 - RNA, 16 nt, Bordetella pertussis
uuguugcgugccgccc

SEQ ID NO: 2383133 - RNA, 17 nt, Bordetella pertussis
uuguuggcgccggccgc

SEQ ID NO: 2383134 - RNA, 14 nt, Bordetella pertussis
uuucaaagaucugc

SEQ ID NO: 2383135 - RNA, 17 nt, Bordetella pertussis
uuuccagcgcgaaaugc

SEQ ID NO: 2383136 - RNA, 14 nt, Bordetella pertussis
uuuccagggcgcgc

SEQ ID NO: 2383137 - RNA, 18 nt, Bordetella pertussis
uuuccaugacggugccga

SEQ ID NO: 2383138 - RNA, 12 nt, Bordetella pertussis
uuucccuuccug

SEQ ID NO: 2383139 - RNA, 14 nt, Bordetella pertussis
uuuccgcacccggu

SEQ ID NO: 2383140 - RNA, 19 nt, Bordetella pertussis
uuuccgcuaccaggcgcgc

SEQ ID NO: 2383141 - RNA, 16 nt, Bordetella pertussis
uuuccgggccuggccu

SEQ ID NO: 2383142 - RNA, 20 nt, Bordetella pertussis
uuucgaacaaggcgguggcc

SEQ ID NO: 2383143 - RNA, 18 nt, Bordetella pertussis
uuucgaccgcaugcggca

SEQ ID NO: 2383144 - RNA, 21 nt, Bordetella pertussis
uuucgacgccuuccuugaacu

SEQ ID NO: 2383145 - RNA, 21 nt, Bordetella pertussis
uuucgagccgcagaacagcag

SEQ ID NO: 2383146 - RNA, 13 nt, Bordetella pertussis
uuucggagcggcu

SEQ ID NO: 2383147 - RNA, 16 nt, Bordetella pertussis
uuucggccaugugcgc

SEQ ID NO: 2383148 - RNA, 19 nt, Bordetella pertussis
uuucggcgccgccggccau

SEQ ID NO: 2383149 - RNA, 18 nt, Bordetella pertussis
uuucgucaccgaacuguc

SEQ ID NO: 2383150 - RNA, 18 nt, Bordetella pertussis
uuucuccagcgccagcac

SEQ ID NO: 2383151 - RNA, 18 nt, Bordetella pertussis
uuucuggccuuccugcug

SEQ ID NO: 2383152 - RNA, 20 nt, Bordetella pertussis
uuugcccaguacgaugccgu

SEQ ID NO: 2383153 - RNA, 15 nt, Bordetella pertussis
uuugcccuggccacg

SEQ ID NO: 2383154 - RNA, 17 nt, Bordetella pertussis
uuugcgcaguggcgagg

SEQ ID NO: 2383155 - RNA, 18 nt, Bordetella pertussis
uuugcggacgggccagua

SEQ ID NO: 2383156 - RNA, 11 nt, Bordetella pertussis
uuuggcaggcu

SEQ ID NO: 2383157 - RNA, 24 nt, Bordetella pertussis
uuuguccuguauuccugaccgucc

SEQ ID NO: 2383158 - RNA, 17 nt, Bordetella pertussis
uuuuccacagccaggcc

SEQ ID NO: 2383159 - RNA, 16 nt, Bordetella pertussis
uuuuccaucagcucga

SEQ ID NO: 2383160 - RNA, 22 nt, Bordetella pertussis
uuuucuccagcgccagcacagu

SEQ ID NO: 2383161 - RNA, 22 nt, Bordetella pertussis
uuuucuugccggcccaucugua

SEQ ID NO: 2383162 - RNA, 22 nt, Bordetella pertussis
cgcaguuugacgucauggccga

SEQ ID NO: 2383163 - RNA, 18 nt, Bordetella pertussis
cgcauacaacuucagcca

SEQ ID NO: 2383164 - RNA, 16 nt, Bordetella pertussis
cgcauaccggccgcgg

SEQ ID NO: 2383165 - RNA, 21 nt, Bordetella pertussis
cgcauacgacacgucaucgug

SEQ ID NO: 2383166 - RNA, 21 nt, Bordetella pertussis
cgcauacgcggguucgacgcc

SEQ ID NO: 2383167 - RNA, 16 nt, Bordetella pertussis
cgcauacggacgagcg

SEQ ID NO: 2383168 - RNA, 19 nt, Bordetella pertussis
cgcauacucgaugcccagc

SEQ ID NO: 2383169 - RNA, 15 nt, Bordetella pertussis
ggcucgagcggcagc

SEQ ID NO: 2383170 - RNA, 19 nt, Bordetella pertussis
ggcucgagcggcagcagcg

SEQ ID NO: 2383171 - RNA, 18 nt, Bordetella pertussis
ggcucgagcuccugcucg

SEQ ID NO: 2383172 - RNA, 19 nt, Bordetella pertussis
ggcucgagcuccugcucga

SEQ ID NO: 2383173 - RNA, 18 nt, Bordetella pertussis
ggcucgaucgccgccggc

SEQ ID NO: 2383174 - RNA, 19 nt, Bordetella pertussis
ggcucgaucgccgccggca

SEQ ID NO: 2383175 - RNA, 16 nt, Bordetella pertussis
ggcucgaugaccagca

SEQ ID NO: 2383176 - RNA, 13 nt, Bordetella pertussis
ggcucgccccugg

SEQ ID NO: 2383177 - RNA, 22 nt, Bordetella pertussis
ggcucgccgagccgggccaugc

SEQ ID NO: 2383178 - RNA, 16 nt, Bordetella pertussis
ggcucgccggccgcgc

SEQ ID NO: 2383179 - RNA, 17 nt, Bordetella pertussis
ggcucgccggccgcgcc

SEQ ID NO: 2383180 - RNA, 21 nt, Bordetella pertussis
ggcucgccggccgcgcccagc

SEQ ID NO: 2383181 - RNA, 17 nt, Bordetella pertussis
ggcucgccuccccaggc

SEQ ID NO: 2383182 - RNA, 18 nt, Bordetella pertussis
ggcucgccuccccaggcc

SEQ ID NO: 2383183 - RNA, 24 nt, Bordetella pertussis
ggcucgcgcgcgcgggcgcgcagc

SEQ ID NO: 2383184 - RNA, 18 nt, Bordetella pertussis
ggcucgcgcucgcccggc

SEQ ID NO: 2383185 - RNA, 19 nt, Bordetella pertussis
ggcucgcgcucgcccggcc

SEQ ID NO: 2383186 - RNA, 19 nt, Bordetella pertussis
ggcucgcugucgugccgca

SEQ ID NO: 2383187 - RNA, 18 nt, Bordetella pertussis
ggcucggaccuggccagc

SEQ ID NO: 2383188 - RNA, 15 nt, Bordetella pertussis
ggcucggccaccaug

SEQ ID NO: 2383189 - RNA, 23 nt, Bordetella pertussis
ggcucggcccuagagcaugcggc

SEQ ID NO: 2383190 - RNA, 18 nt, Bordetella pertussis
ggcucggcgccggcggcg

SEQ ID NO: 2383191 - RNA, 21 nt, Bordetella pertussis
ggcucgggaaugaugcagcug

SEQ ID NO: 2383192 - RNA, 19 nt, Bordetella pertussis
ggcucggucucgcccaugg

SEQ ID NO: 2383193 - RNA, 22 nt, Bordetella pertussis
ggcucguacggcgucgggcagu

SEQ ID NO: 2383194 - RNA, 15 nt, Bordetella pertussis
ggcucguaggcgagg

SEQ ID NO: 2383195 - RNA, 17 nt, Bordetella pertussis
ggcucgucgacgcggcc

SEQ ID NO: 2383196 - RNA, 15 nt, Bordetella pertussis
ggcucgugcagcagg

SEQ ID NO: 2383197 - RNA, 16 nt, Bordetella pertussis
ggcucgugcagcaggg

SEQ ID NO: 2383198 - RNA, 17 nt, Bordetella pertussis
ggcucgugcagcagggg

SEQ ID NO: 2383199 - RNA, 18 nt, Bordetella pertussis
ggcucgugcagcaggggc

SEQ ID NO: 2383200 - RNA, 22 nt, Bordetella pertussis
ggcucgugcagcaggggcugcc

SEQ ID NO: 2383201 - RNA, 17 nt, Bordetella pertussis
ggcucguucgcucggcg

SEQ ID NO: 2383202 - RNA, 16 nt, Bordetella pertussis
ggcucuccgugcaucg

SEQ ID NO: 2383203 - RNA, 18 nt, Bordetella pertussis
ggcugaaaucccccgcgu

SEQ ID NO: 2383204 - RNA, 21 nt, Bordetella pertussis
ggcugaacauccugaccggcu

SEQ ID NO: 2383205 - RNA, 15 nt, Bordetella pertussis
ggcugaagaagcccg

SEQ ID NO: 2383206 - RNA, 14 nt, Bordetella pertussis
ggcugaaggggcuc

SEQ ID NO: 2383207 - RNA, 16 nt, Bordetella pertussis
ggcugaaggggcuccc

SEQ ID NO: 2383208 - RNA, 15 nt, Bordetella pertussis
ggcugaauuggcgcc

SEQ ID NO: 2383209 - RNA, 14 nt, Bordetella pertussis
ggcugaccagcagc

SEQ ID NO: 2383210 - RNA, 18 nt, Bordetella pertussis
ggcugaccagcgcgucgc

SEQ ID NO: 2383211 - RNA, 14 nt, Bordetella pertussis
ggcugacgcccggc

SEQ ID NO: 2383212 - RNA, 15 nt, Bordetella pertussis
ggcugacgcccggcu

SEQ ID NO: 2383213 - RNA, 22 nt, Bordetella pertussis
ggcugagaucguccagcgacuc

SEQ ID NO: 2383214 - RNA, 19 nt, Bordetella pertussis
ggcugagccauuccggcug

SEQ ID NO: 2383215 - RNA, 20 nt, Bordetella pertussis
ggcugagccauuccggcugg

SEQ ID NO: 2383216 - RNA, 21 nt, Bordetella pertussis
ggcugagccauuccggcuggu

SEQ ID NO: 2383217 - RNA, 22 nt, Bordetella pertussis
ggcugagcgacaugucgccgcg

SEQ ID NO: 2383218 - RNA, 15 nt, Bordetella pertussis
ggcugagcucgugua

SEQ ID NO: 2383219 - RNA, 22 nt, Bordetella pertussis
ggcugaucacccacagcagcgc

SEQ ID NO: 2383220 - RNA, 15 nt, Bordetella pertussis
ggcugaucaccgccg

SEQ ID NO: 2383221 - RNA, 16 nt, Bordetella pertussis
ggcugauccgcaccgg

SEQ ID NO: 2383222 - RNA, 19 nt, Bordetella pertussis
ggcugaucuugaugcggcc

SEQ ID NO: 2383223 - RNA, 15 nt, Bordetella pertussis
ggcugaugcaggccu

SEQ ID NO: 2383224 - RNA, 22 nt, Bordetella pertussis
ggcugcaagucuucuucagcau

SEQ ID NO: 2383225 - RNA, 18 nt, Bordetella pertussis
ggcugcaccagcgcgccg

SEQ ID NO: 2383226 - RNA, 20 nt, Bordetella pertussis
ggcugcaccagcgcgccgcg

SEQ ID NO: 2383227 - RNA, 16 nt, Bordetella pertussis
ggcugcaccugccugc

SEQ ID NO: 2383228 - RNA, 20 nt, Bordetella pertussis
ggcugcaccugccugccgcc

SEQ ID NO: 2383229 - RNA, 19 nt, Bordetella pertussis
ggcugcacgauguugccgc

SEQ ID NO: 2383230 - RNA, 23 nt, Bordetella pertussis
ggcugcacgauguugccgccggc

SEQ ID NO: 2383231 - RNA, 24 nt, Bordetella pertussis
ggcugcaugcgcgaacgcgcgccg

SEQ ID NO: 2383232 - RNA, 14 nt, Bordetella pertussis
ggcugccagggccg

SEQ ID NO: 2383233 - RNA, 13 nt, Bordetella pertussis
ggcugccauucca

SEQ ID NO: 2383234 - RNA, 22 nt, Bordetella pertussis
ggcugccauuccagcuccggcg

SEQ ID NO: 2383235 - RNA, 22 nt, Bordetella pertussis
ggcugcccucggucagcgccag

SEQ ID NO: 2383236 - RNA, 18 nt, Bordetella pertussis
ggcugcccuggcccaggc

SEQ ID NO: 2383237 - RNA, 14 nt, Bordetella pertussis
ggcugcccuggcgc

SEQ ID NO: 2383238 - RNA, 19 nt, Bordetella pertussis
ggcugccgauacgggcgcg

SEQ ID NO: 2383239 - RNA, 22 nt, Bordetella pertussis
ggcugccgauacgggcgcggcg

SEQ ID NO: 2383240 - RNA, 20 nt, Bordetella pertussis
ggcugccgcggauugccguc

SEQ ID NO: 2383241 - RNA, 14 nt, Bordetella pertussis
ggcugccgucggcc

SEQ ID NO: 2383242 - RNA, 18 nt, Bordetella pertussis
ggcugccgucggccagcu

SEQ ID NO: 2383243 - RNA, 20 nt, Bordetella pertussis
ggcugccgucggccagcuug

SEQ ID NO: 2383244 - RNA, 15 nt, Bordetella pertussis
ggcugccgucgucgu

SEQ ID NO: 2383245 - RNA, 21 nt, Bordetella pertussis
ggcugcgaaaggccgagccau

SEQ ID NO: 2383246 - RNA, 12 nt, Bordetella pertussis
ggcugcgacagg

SEQ ID NO: 2383247 - RNA, 15 nt, Bordetella pertussis
ggcugcgacaggcgc

SEQ ID NO: 2383248 - RNA, 23 nt, Bordetella pertussis
ggcugcgaugcgggccuggaucg

SEQ ID NO: 2383249 - RNA, 11 nt, Bordetella pertussis
ggcugcgcgcc

SEQ ID NO: 2383250 - RNA, 14 nt, Bordetella pertussis
ggcugcgcgccggc

SEQ ID NO: 2383251 - RNA, 18 nt, Bordetella pertussis
ggcugcgcgccggcgccu

SEQ ID NO: 2383252 - RNA, 15 nt, Bordetella pertussis
ggcugcgcgccgugg

SEQ ID NO: 2383253 - RNA, 16 nt, Bordetella pertussis
ggcugcgcgccguggu

SEQ ID NO: 2383254 - RNA, 15 nt, Bordetella pertussis
ggcugcgcgccuggc

SEQ ID NO: 2383255 - RNA, 12 nt, Bordetella pertussis
ggcugcgcgcgc

SEQ ID NO: 2383256 - RNA, 19 nt, Bordetella pertussis
ggcugcgcgcgcagccagg

SEQ ID NO: 2383257 - RNA, 14 nt, Bordetella pertussis
ggcugcgcgcgcca

SEQ ID NO: 2383258 - RNA, 19 nt, Bordetella pertussis
ggcugcgcgcgccagcgcc

SEQ ID NO: 2383259 - RNA, 23 nt, Bordetella pertussis
ggcugcgcgcgccagcgccuggg

SEQ ID NO: 2383260 - RNA, 12 nt, Bordetella pertussis
ggcugcgcggcc

SEQ ID NO: 2383261 - RNA, 21 nt, Bordetella pertussis
ggcugcgcggguccggcgugc

SEQ ID NO: 2383262 - RNA, 14 nt, Bordetella pertussis
ggcugcggcguggc

SEQ ID NO: 2383263 - RNA, 17 nt, Bordetella pertussis
ggcugcggcguggcgcc

SEQ ID NO: 2383264 - RNA, 15 nt, Bordetella pertussis
ggcugcgggccggcg

SEQ ID NO: 2383265 - RNA, 17 nt, Bordetella pertussis
ggcugcgggccggcgcc

SEQ ID NO: 2383266 - RNA, 21 nt, Bordetella pertussis
ggcugcgggcgcaagccagca

SEQ ID NO: 2383267 - RNA, 18 nt, Bordetella pertussis
ggcugcgugcgggacagg

SEQ ID NO: 2383268 - RNA, 19 nt, Bordetella pertussis
ggcugcgugcgggacaggc

SEQ ID NO: 2383269 - RNA, 20 nt, Bordetella pertussis
ggcugcucguucugcgcgcc

SEQ ID NO: 2383270 - RNA, 21 nt, Bordetella pertussis
ggcugcucguucugcgcgccc

SEQ ID NO: 2383271 - RNA, 13 nt, Bordetella pertussis
ggcugcugcacgc

SEQ ID NO: 2383272 - RNA, 19 nt, Bordetella pertussis
ggcugcugcacgcgcgcgg

SEQ ID NO: 2383273 - RNA, 16 nt, Bordetella pertussis
ggcugcuggaacggug

SEQ ID NO: 2383274 - RNA, 13 nt, Bordetella pertussis
ggcugcuggccca

SEQ ID NO: 2383275 - RNA, 16 nt, Bordetella pertussis
ggcugcugggcaugga

SEQ ID NO: 2383276 - RNA, 15 nt, Bordetella pertussis
ggcugcugggccggc

SEQ ID NO: 2383277 - RNA, 17 nt, Bordetella pertussis
ggcugcugggccggcgc

SEQ ID NO: 2383278 - RNA, 18 nt, Bordetella pertussis
ggcugcugggccggcgcg

SEQ ID NO: 2383279 - RNA, 13 nt, Bordetella pertussis
ggcugcuugccca

SEQ ID NO: 2383280 - RNA, 14 nt, Bordetella pertussis
ggcuggaagucagc

SEQ ID NO: 2383281 - RNA, 17 nt, Bordetella pertussis
ggcuggaagucagccgg

SEQ ID NO: 2383282 - RNA, 13 nt, Bordetella pertussis
ggcuggacgcgcg

SEQ ID NO: 2383283 - RNA, 19 nt, Bordetella pertussis
ggcuggacgcgcgcggcga

SEQ ID NO: 2383284 - RNA, 22 nt, Bordetella pertussis
ggcuggacgcgcgcggcgaccg

SEQ ID NO: 2383285 - RNA, 22 nt, Bordetella pertussis
ggcuggagaacgagccggccgc

SEQ ID NO: 2383286 - RNA, 23 nt, Bordetella pertussis
ggcuggagaacgagccggccgcg

SEQ ID NO: 2383287 - RNA, 13 nt, Bordetella pertussis
ggcuggagcucua

SEQ ID NO: 2383288 - RNA, 22 nt, Bordetella pertussis
ggcuggagcucuaugucgccgg

SEQ ID NO: 2383289 - RNA, 22 nt, Bordetella pertussis
ggcuggauccggcgcuggcgca

SEQ ID NO: 2383290 - RNA, 17 nt, Bordetella pertussis
ggcuggauggugccgcc

SEQ ID NO: 2383291 - RNA, 21 nt, Bordetella pertussis
ggcuggauggugccgccgccc

SEQ ID NO: 2383292 - RNA, 14 nt, Bordetella pertussis
ggcuggcagcgacc

SEQ ID NO: 2383293 - RNA, 18 nt, Bordetella pertussis
ggcuggcaugcggcggac

SEQ ID NO: 2383294 - RNA, 21 nt, Bordetella pertussis
ggcuggcauggaacgggcggg

SEQ ID NO: 2383295 - RNA, 12 nt, Bordetella pertussis
ggcuggcauggc

SEQ ID NO: 2383296 - RNA, 19 nt, Bordetella pertussis
ggcuggcauggcggucucc

SEQ ID NO: 2383297 - RNA, 22 nt, Bordetella pertussis
ggcuggcauugagggcguacga

SEQ ID NO: 2383298 - RNA, 22 nt, Bordetella pertussis
ggcuggccaccgaagcggcguu

SEQ ID NO: 2383299 - RNA, 14 nt, Bordetella pertussis
ggcuggccacuggc

SEQ ID NO: 2383300 - RNA, 18 nt, Bordetella pertussis
ggcuggccacuggccgcg

SEQ ID NO: 2383301 - RNA, 14 nt, Bordetella pertussis
ggcuggccagccgg

SEQ ID NO: 2383302 - RNA, 15 nt, Bordetella pertussis
ggcuggccagccggc

SEQ ID NO: 2383303 - RNA, 19 nt, Bordetella pertussis
ggcuggccagccggcccag

SEQ ID NO: 2383304 - RNA, 21 nt, Bordetella pertussis
ggcuggccagccggcccagca

SEQ ID NO: 2383305 - RNA, 16 nt, Bordetella pertussis
ggcuggccagcggggc

SEQ ID NO: 2383306 - RNA, 13 nt, Bordetella pertussis
ggcuggccagcug

SEQ ID NO: 2383307 - RNA, 19 nt, Bordetella pertussis
ggcuggccagcuggcggcg

SEQ ID NO: 2383308 - RNA, 20 nt, Bordetella pertussis
ggcuggccgaucaccugcag

SEQ ID NO: 2383309 - RNA, 22 nt, Bordetella pertussis
ggcuggccgaucaccugcaggc

SEQ ID NO: 2383310 - RNA, 14 nt, Bordetella pertussis
ggcuggccgccgcg

SEQ ID NO: 2383311 - RNA, 13 nt, Bordetella pertussis
ggcuggccggcca

SEQ ID NO: 2383312 - RNA, 12 nt, Bordetella pertussis
ggcuggccggcg

SEQ ID NO: 2383313 - RNA, 21 nt, Bordetella pertussis
ggcuggccggcguggccugcc

SEQ ID NO: 2383314 - RNA, 17 nt, Bordetella pertussis
ggcuggcgaucaccgac

SEQ ID NO: 2383315 - RNA, 13 nt, Bordetella pertussis
ggcuggcgcaaga

SEQ ID NO: 2383316 - RNA, 13 nt, Bordetella pertussis
ggcuggcgcacga

SEQ ID NO: 2383317 - RNA, 13 nt, Bordetella pertussis
ggcuggcgcacgu

SEQ ID NO: 2383318 - RNA, 20 nt, Bordetella pertussis
ggcuggcgccguucgucgcg

SEQ ID NO: 2383319 - RNA, 15 nt, Bordetella pertussis
ggcuggcgcggccgu

SEQ ID NO: 2383320 - RNA, 20 nt, Bordetella pertussis
ggcuggcgcggcuggcgaug

SEQ ID NO: 2383321 - RNA, 14 nt, Bordetella pertussis
ggcuggcggugcgu

SEQ ID NO: 2383322 - RNA, 15 nt, Bordetella pertussis
ggcuggcugggcgcg

SEQ ID NO: 2383323 - RNA, 13 nt, Bordetella pertussis
ggcugggacaggc

SEQ ID NO: 2383324 - RNA, 14 nt, Bordetella pertussis
ggcugggacaggca

SEQ ID NO: 2383325 - RNA, 13 nt, Bordetella pertussis
ggcugggagagcc

SEQ ID NO: 2383326 - RNA, 18 nt, Bordetella pertussis
ggcugggagagccggcca

SEQ ID NO: 2383327 - RNA, 17 nt, Bordetella pertussis
ggcugggccgaggcgcc

SEQ ID NO: 2383328 - RNA, 17 nt, Bordetella pertussis
ggcugggcgcgccgcug

SEQ ID NO: 2383329 - RNA, 14 nt, Bordetella pertussis
ggcugggcggccuu

SEQ ID NO: 2383330 - RNA, 14 nt, Bordetella pertussis
ggcuggggcaggca

SEQ ID NO: 2383331 - RNA, 15 nt, Bordetella pertussis
ggcuggggcaggcac

SEQ ID NO: 2383332 - RNA, 16 nt, Bordetella pertussis
ggcuggggcaggcacu

SEQ ID NO: 2383333 - RNA, 15 nt, Bordetella pertussis
ggcuggggcugcugg

SEQ ID NO: 2383334 - RNA, 16 nt, Bordetella pertussis
ggcuggggcugcuggg

SEQ ID NO: 2383335 - RNA, 18 nt, Bordetella pertussis
ggcuggucaacucgcccg

SEQ ID NO: 2383336 - RNA, 15 nt, Bordetella pertussis
ggcuggucagccugg

SEQ ID NO: 2383337 - RNA, 16 nt, Bordetella pertussis
ggcuggucagccuggg

SEQ ID NO: 2383338 - RNA, 23 nt, Bordetella pertussis
ggcuggucagccuggggcaggcg

SEQ ID NO: 2383339 - RNA, 14 nt, Bordetella pertussis
ggcuggucaggcgg

SEQ ID NO: 2383340 - RNA, 20 nt, Bordetella pertussis
ggcuggucaggcggucgaca

SEQ ID NO: 2383341 - RNA, 21 nt, Bordetella pertussis
ggcuggucccugcgcgaggug

SEQ ID NO: 2383342 - RNA, 19 nt, Bordetella pertussis
ggcuggucuucgagcgcga

SEQ ID NO: 2383343 - RNA, 15 nt, Bordetella pertussis
ggcuggugccgacgg

SEQ ID NO: 2383344 - RNA, 22 nt, Bordetella pertussis
ggcuggugcgccgugcccggcg

SEQ ID NO: 2383345 - RNA, 23 nt, Bordetella pertussis
ggcuggugcgccgugcccggcgg

SEQ ID NO: 2383346 - RNA, 15 nt, Bordetella pertussis
ggcugguggugggcg

SEQ ID NO: 2383347 - RNA, 18 nt, Bordetella pertussis
ggcuguaucuggccuguc

SEQ ID NO: 2383348 - RNA, 17 nt, Bordetella pertussis
ggcuguccaccugcacc

SEQ ID NO: 2383349 - RNA, 15 nt, Bordetella pertussis
ggcuguccccgcaug

SEQ ID NO: 2383350 - RNA, 20 nt, Bordetella pertussis
ggcuguccccgcgcgggggg

SEQ ID NO: 2383351 - RNA, 17 nt, Bordetella pertussis
ggcugucgcgcgcaucg

SEQ ID NO: 2383352 - RNA, 21 nt, Bordetella pertussis
ggcugucgcgcgcaucgccga

SEQ ID NO: 2383353 - RNA, 15 nt, Bordetella pertussis
ggcugucgggcggcg

SEQ ID NO: 2383354 - RNA, 20 nt, Bordetella pertussis
ggcugucgucgucggcaccu

SEQ ID NO: 2383355 - RNA, 14 nt, Bordetella pertussis
ggcuguggccgcgg

SEQ ID NO: 2383356 - RNA, 23 nt, Bordetella pertussis
ggcuguggccgcggcccagcgcg

SEQ ID NO: 2383357 - RNA, 13 nt, Bordetella pertussis
ggcugugggccuc

SEQ ID NO: 2383358 - RNA, 18 nt, Bordetella pertussis
ggcugugggccucgcugg

SEQ ID NO: 2383359 - RNA, 15 nt, Bordetella pertussis
ggcuguucgccaugu

SEQ ID NO: 2383360 - RNA, 18 nt, Bordetella pertussis
ggcuguucgcgcagcagg

SEQ ID NO: 2383361 - RNA, 19 nt, Bordetella pertussis
ggcuguucgcgcagcaggc

SEQ ID NO: 2383362 - RNA, 16 nt, Bordetella pertussis
ggcuguugggcaaggu

SEQ ID NO: 2383363 - RNA, 13 nt, Bordetella pertussis
ggcuuccaguucg

SEQ ID NO: 2383364 - RNA, 22 nt, Bordetella pertussis
ggcuuccaucaggaacggcaug

SEQ ID NO: 2383365 - RNA, 13 nt, Bordetella pertussis
ggcuuccugcacc

SEQ ID NO: 2383366 - RNA, 18 nt, Bordetella pertussis
ggcuuccugcaccucagg

SEQ ID NO: 2383367 - RNA, 17 nt, Bordetella pertussis
ggcuuccugcggcacga

SEQ ID NO: 2383368 - RNA, 23 nt, Bordetella pertussis
ggcuuccuggucacccggcgcau

SEQ ID NO: 2383369 - RNA, 13 nt, Bordetella pertussis
ggcuuccuugcgg

SEQ ID NO: 2383370 - RNA, 21 nt, Bordetella pertussis
ggcuucgacucccucgaugag

SEQ ID NO: 2383371 - RNA, 21 nt, Bordetella pertussis
ggcuucgaucaugcccgccac

SEQ ID NO: 2383372 - RNA, 22 nt, Bordetella pertussis
ggcuucgcccagcgcuugcacg

SEQ ID NO: 2383373 - RNA, 24 nt, Bordetella pertussis
ggcuucgcccagcgcuugcacgcc

SEQ ID NO: 2383374 - RNA, 22 nt, Bordetella pertussis
ggcuucgcgcacauccagccga

SEQ ID NO: 2383375 - RNA, 22 nt, Bordetella pertussis
ggcuucggccgucagcagcagg

SEQ ID NO: 2383376 - RNA, 15 nt, Bordetella pertussis
ggcuucggcgcuggg

SEQ ID NO: 2383377 - RNA, 17 nt, Bordetella pertussis
ggcuucggcgcugggcg

SEQ ID NO: 2383378 - RNA, 19 nt, Bordetella pertussis
ggcuucggcguacugcugc

SEQ ID NO: 2383379 - RNA, 12 nt, Bordetella pertussis
ggcuucggucac

SEQ ID NO: 2383380 - RNA, 20 nt, Bordetella pertussis
ggcuucggucacacugggcg

SEQ ID NO: 2383381 - RNA, 14 nt, Bordetella pertussis
ggcuucgucgacca

SEQ ID NO: 2383382 - RNA, 14 nt, Bordetella pertussis
ggcuucgucgccgg

SEQ ID NO: 2383383 - RNA, 16 nt, Bordetella pertussis
ggcuucgucgccggcg

SEQ ID NO: 2383384 - RNA, 16 nt, Bordetella pertussis
ggcuucguuggugucg

SEQ ID NO: 2383385 - RNA, 22 nt, Bordetella pertussis
ggcuucguuggugucggcggcg

SEQ ID NO: 2383386 - RNA, 23 nt, Bordetella pertussis
ggcuucguuggugucggcggcga

SEQ ID NO: 2383387 - RNA, 16 nt, Bordetella pertussis
ggcuucucgaccaggc

SEQ ID NO: 2383388 - RNA, 18 nt, Bordetella pertussis
ggcuucucgaccaggcgg

SEQ ID NO: 2383389 - RNA, 14 nt, Bordetella pertussis
ggcuugaccacggc

SEQ ID NO: 2383390 - RNA, 20 nt, Bordetella pertussis
ggcuugaccacggccagcag

SEQ ID NO: 2383391 - RNA, 18 nt, Bordetella pertussis
ggcuugauggccagcgcg

SEQ ID NO: 2383392 - RNA, 15 nt, Bordetella pertussis
ggcuugauggcgaug

SEQ ID NO: 2383393 - RNA, 14 nt, Bordetella pertussis
ggcuugcacgccgg

SEQ ID NO: 2383394 - RNA, 20 nt, Bordetella pertussis
ggcuugcacgccggccacga

SEQ ID NO: 2383395 - RNA, 20 nt, Bordetella pertussis
ggcuugcagcaacgcggcgu

SEQ ID NO: 2383396 - RNA, 20 nt, Bordetella pertussis
ggcuugcagcggacggcgcg

SEQ ID NO: 2383397 - RNA, 12 nt, Bordetella pertussis
ggcuugcauggu

SEQ ID NO: 2383398 - RNA, 15 nt, Bordetella pertussis
ggcuugccgcgcggc

SEQ ID NO: 2383399 - RNA, 17 nt, Bordetella pertussis
ggcuugccgcgcggcgu

SEQ ID NO: 2383400 - RNA, 20 nt, Bordetella pertussis
ggcuugccgcggcgcggccu

SEQ ID NO: 2383401 - RNA, 19 nt, Bordetella pertussis
ggcuugccgucgaccgcga

SEQ ID NO: 2383402 - RNA, 19 nt, Bordetella pertussis
ggcuugcgcaagccggccg

SEQ ID NO: 2383403 - RNA, 21 nt, Bordetella pertussis
ggcuugcgccagccacgcgcg

SEQ ID NO: 2383404 - RNA, 15 nt, Bordetella pertussis
ggcuugcgcggcgcg

SEQ ID NO: 2383405 - RNA, 19 nt, Bordetella pertussis
ggcuugcgcggcgcgucgc

SEQ ID NO: 2383406 - RNA, 15 nt, Bordetella pertussis
ggcuugcggcgcugg

SEQ ID NO: 2383407 - RNA, 14 nt, Bordetella pertussis
ggcuugcugccccc

SEQ ID NO: 2383408 - RNA, 17 nt, Bordetella pertussis
ggcuugcugccccccga

SEQ ID NO: 2383409 - RNA, 12 nt, Bordetella pertussis
ggcuuggccgaa

SEQ ID NO: 2383410 - RNA, 19 nt, Bordetella pertussis
ggcuuggccucggccggca

SEQ ID NO: 2383411 - RNA, 12 nt, Bordetella pertussis
ggcuuggcggcc

SEQ ID NO: 2383412 - RNA, 15 nt, Bordetella pertussis
ggcuugggcccggcg

SEQ ID NO: 2383413 - RNA, 16 nt, Bordetella pertussis
ggcuugggcccggcgu

SEQ ID NO: 2383414 - RNA, 22 nt, Bordetella pertussis
ggcuuguuuuccaucagcucga

SEQ ID NO: 2383415 - RNA, 20 nt, Bordetella pertussis
ggcuuucaugggccugggcg

SEQ ID NO: 2383416 - RNA, 21 nt, Bordetella pertussis
ggcuuucgauuugcagcagca

SEQ ID NO: 2383417 - RNA, 20 nt, Bordetella pertussis
ggcuuucgcaauacgucgcg

SEQ ID NO: 2383418 - RNA, 17 nt, Bordetella pertussis
ggcuuucgccgcgggcc

SEQ ID NO: 2383419 - RNA, 18 nt, Bordetella pertussis
ggcuuucggucucgcgcg

SEQ ID NO: 2383420 - RNA, 22 nt, Bordetella pertussis
ggcuuucuaucaucaggcccac

SEQ ID NO: 2383421 - RNA, 14 nt, Bordetella pertussis
ggcuuugcuggcca

SEQ ID NO: 2383422 - RNA, 16 nt, Bordetella pertussis
ggcuuugcuggccaua

SEQ ID NO: 2383423 - RNA, 18 nt, Bordetella pertussis
ggcuuuggcuuggcgaau

SEQ ID NO: 2383424 - RNA, 15 nt, Bordetella pertussis
ggcuuuguggcgucg

SEQ ID NO: 2383425 - RNA, 16 nt, Bordetella pertussis
ggcuuuuucucggccu

SEQ ID NO: 2383426 - RNA, 23 nt, Bordetella pertussis
ggcuuuuucucggccucgcggcg

SEQ ID NO: 2383427 - RNA, 12 nt, Bordetella pertussis
ggcuuuuuugcc

SEQ ID NO: 2383428 - RNA, 20 nt, Bordetella pertussis
ggcuuuuuuucgccgggcgg

SEQ ID NO: 2383429 - RNA, 23 nt, Bordetella pertussis
ggcuuuuuuucgccgggcggcgc

SEQ ID NO: 2383430 - RNA, 19 nt, Bordetella pertussis
gggaaaagccggcggccgg

SEQ ID NO: 2383431 - RNA, 17 nt, Bordetella pertussis
gggaaacaggcccacgg

SEQ ID NO: 2383432 - RNA, 13 nt, Bordetella pertussis
gggaaaugauagu

SEQ ID NO: 2383433 - RNA, 13 nt, Bordetella pertussis
gggaacaggcacc

SEQ ID NO: 2383434 - RNA, 12 nt, Bordetella pertussis
gggaacaggcgc

SEQ ID NO: 2383435 - RNA, 23 nt, Bordetella pertussis
gggaacaggcgcgccagccgcgc

SEQ ID NO: 2383436 - RNA, 14 nt, Bordetella pertussis
gggaagcgcucgcg

SEQ ID NO: 2383437 - RNA, 16 nt, Bordetella pertussis
gggaagcgcucgcgca

SEQ ID NO: 2383438 - RNA, 19 nt, Bordetella pertussis
gggaagcgcucgcgcaggc

SEQ ID NO: 2383439 - RNA, 18 nt, Bordetella pertussis
gggaagcgcucgucgggg

SEQ ID NO: 2383440 - RNA, 19 nt, Bordetella pertussis
gggaagcugucggcgcugg

SEQ ID NO: 2383441 - RNA, 20 nt, Bordetella pertussis
gggaagcugucggcgcuggc

SEQ ID NO: 2383442 - RNA, 13 nt, Bordetella pertussis
gggaaggccgcgc

SEQ ID NO: 2383443 - RNA, 12 nt, Bordetella pertussis
gggaaggggcgg

SEQ ID NO: 2383444 - RNA, 22 nt, Bordetella pertussis
gggaaggggcggcuucaggcgc

SEQ ID NO: 2383445 - RNA, 19 nt, Bordetella pertussis
gggaaugaugcagcuguag

SEQ ID NO: 2383446 - RNA, 23 nt, Bordetella pertussis
gggaaugucccacaggcgcgcgg

SEQ ID NO: 2383447 - RNA, 14 nt, Bordetella pertussis
gggacaggcaccca

SEQ ID NO: 2383448 - RNA, 20 nt, Bordetella pertussis
gggacaggcaccccggcgcc

SEQ ID NO: 2383449 - RNA, 20 nt, Bordetella pertussis
gggacaggcaccccgucaug

SEQ ID NO: 2383450 - RNA, 14 nt, Bordetella pertussis
gggacaggcacccu

SEQ ID NO: 2383451 - RNA, 15 nt, Bordetella pertussis
gggacaggcaccgcc

SEQ ID NO: 2383452 - RNA, 17 nt, Bordetella pertussis
gggacaggcaccgccgc

SEQ ID NO: 2383453 - RNA, 16 nt, Bordetella pertussis
gggacaggcacgccgg

SEQ ID NO: 2383454 - RNA, 20 nt, Bordetella pertussis
gggacaggcacgcgccgacu

SEQ ID NO: 2383455 - RNA, 15 nt, Bordetella pertussis
gggacaggcaucagg

SEQ ID NO: 2383456 - RNA, 13 nt, Bordetella pertussis
gggacaggcccag

SEQ ID NO: 2383457 - RNA, 15 nt, Bordetella pertussis
gggacaggcccagcc

SEQ ID NO: 2383458 - RNA, 23 nt, Bordetella pertussis
gggacaggcucccgcuggcggca

SEQ ID NO: 2383459 - RNA, 20 nt, Bordetella pertussis
gggacaggcuccgagggaca

SEQ ID NO: 2383460 - RNA, 22 nt, Bordetella pertussis
gggaccgaacaccaccgagggc

SEQ ID NO: 2383461 - RNA, 14 nt, Bordetella pertussis
gggacgaagccggg

SEQ ID NO: 2383462 - RNA, 15 nt, Bordetella pertussis
gggacgaagccgggu

SEQ ID NO: 2383463 - RNA, 16 nt, Bordetella pertussis
gggacgagcuccugga

SEQ ID NO: 2383464 - RNA, 13 nt, Bordetella pertussis
gggacgcaggccc

SEQ ID NO: 2383465 - RNA, 20 nt, Bordetella pertussis
gggacgccagcccgccggcg

SEQ ID NO: 2383466 - RNA, 12 nt, Bordetella pertussis
gggacgccggcg

SEQ ID NO: 2383467 - RNA, 16 nt, Bordetella pertussis
gggacgccggcgggca

SEQ ID NO: 2383468 - RNA, 18 nt, Bordetella pertussis
gggacgccggcgggcagg

SEQ ID NO: 2383469 - RNA, 12 nt, Bordetella pertussis
gggacggccagg

SEQ ID NO: 2383470 - RNA, 16 nt, Bordetella pertussis
gggacggcccugcagg

SEQ ID NO: 2383471 - RNA, 16 nt, Bordetella pertussis
gggacuggcaccugca

SEQ ID NO: 2383472 - RNA, 19 nt, Bordetella pertussis
gggacuggcuccgaagggc

SEQ ID NO: 2383473 - RNA, 15 nt, Bordetella pertussis
gggacuugguuggcc

SEQ ID NO: 2383474 - RNA, 23 nt, Bordetella pertussis
gggagaccggguuuccagcccgu

SEQ ID NO: 2383475 - RNA, 20 nt, Bordetella pertussis
gggagccaguccccgcgggg

SEQ ID NO: 2383476 - RNA, 16 nt, Bordetella pertussis
gggagccuguccccga

SEQ ID NO: 2383477 - RNA, 20 nt, Bordetella pertussis
gggagccuguccccgcgggg

SEQ ID NO: 2383478 - RNA, 16 nt, Bordetella pertussis
gggagcgacacccgcg

SEQ ID NO: 2383479 - RNA, 16 nt, Bordetella pertussis
gggaggaacugggcgc

SEQ ID NO: 2383480 - RNA, 14 nt, Bordetella pertussis
gggauaccgcuggc

SEQ ID NO: 2383481 - RNA, 15 nt, Bordetella pertussis
gggauaccgcuggcc

SEQ ID NO: 2383482 - RNA, 14 nt, Bordetella pertussis
gggauaggccucgg

SEQ ID NO: 2383483 - RNA, 22 nt, Bordetella pertussis
gggauaucccgcucggcuggag

SEQ ID NO: 2383484 - RNA, 13 nt, Bordetella pertussis
gggaucgcgccag

SEQ ID NO: 2383485 - RNA, 23 nt, Bordetella pertussis
gggaucgggcagcuuggcgcgcc

SEQ ID NO: 2383486 - RNA, 15 nt, Bordetella pertussis
gggaugacgggcgag

SEQ ID NO: 2383487 - RNA, 17 nt, Bordetella pertussis
gggaugacgggcgagca

SEQ ID NO: 2383488 - RNA, 13 nt, Bordetella pertussis
gggaugccccgcc

SEQ ID NO: 2383489 - RNA, 14 nt, Bordetella pertussis
gggaugccccgccc

SEQ ID NO: 2383490 - RNA, 16 nt, Bordetella pertussis
gggauuuuugggcagg

SEQ ID NO: 2383491 - RNA, 21 nt, Bordetella pertussis
gggcaaagaaauugggcgugg

SEQ ID NO: 2383492 - RNA, 15 nt, Bordetella pertussis
gggcaaagcccagca

SEQ ID NO: 2383493 - RNA, 22 nt, Bordetella pertussis
gggcaauaccuucggcaugguc

SEQ ID NO: 2383494 - RNA, 20 nt, Bordetella pertussis
gggcaauuuuguugauggcg

SEQ ID NO: 2383495 - RNA, 19 nt, Bordetella pertussis
gggcacaccgucacgcgca

SEQ ID NO: 2383496 - RNA, 22 nt, Bordetella pertussis
gggcacauacagcggagccgcg

SEQ ID NO: 2383497 - RNA, 15 nt, Bordetella pertussis
gggcacaucggccac

SEQ ID NO: 2383498 - RNA, 20 nt, Bordetella pertussis
gggcaccaucucccgcaggc

SEQ ID NO: 2383499 - RNA, 17 nt, Bordetella pertussis
gggcaccgacacgcugg

SEQ ID NO: 2383500 - RNA, 21 nt, Bordetella pertussis
gggcaccgacacgcuggcgga

SEQ ID NO: 2383501 - RNA, 20 nt, Bordetella pertussis
gggcaccugcuugagcacca

SEQ ID NO: 2383502 - RNA, 21 nt, Bordetella pertussis
gggcacgaugcguugcgccuc

SEQ ID NO: 2383503 - RNA, 14 nt, Bordetella pertussis
gggcacgccggccu

SEQ ID NO: 2383504 - RNA, 14 nt, Bordetella pertussis
gggcacgcgcgcgg

SEQ ID NO: 2383505 - RNA, 14 nt, Bordetella pertussis
gggcacgcgcuuga

SEQ ID NO: 2383506 - RNA, 20 nt, Bordetella pertussis
gggcacguaguacagcagca

SEQ ID NO: 2383507 - RNA, 21 nt, Bordetella pertussis
gggcagaacggaaacgcccag

SEQ ID NO: 2383508 - RNA, 22 nt, Bordetella pertussis
gggcagaacggaaacgcccagc

SEQ ID NO: 2383509 - RNA, 23 nt, Bordetella pertussis
gggcagaacggaaacgcccagcc

SEQ ID NO: 2383510 - RNA, 20 nt, Bordetella pertussis
gggcagauugaugcccaugc

SEQ ID NO: 2383511 - RNA, 22 nt, Bordetella pertussis
gggcagcaauucgaccggcagg

SEQ ID NO: 2383512 - RNA, 13 nt, Bordetella pertussis
gggcagcaccgcu

SEQ ID NO: 2383513 - RNA, 19 nt, Bordetella pertussis
gggcagcaccggggcaggg

SEQ ID NO: 2383514 - RNA, 20 nt, Bordetella pertussis
gggcagcaccggggcagggc

SEQ ID NO: 2383515 - RNA, 12 nt, Bordetella pertussis
gggcagcacgcg

SEQ ID NO: 2383516 - RNA, 17 nt, Bordetella pertussis
gggcagcacgcgcacca

SEQ ID NO: 2383517 - RNA, 19 nt, Bordetella pertussis
gggcagcacgcgcaccagg

SEQ ID NO: 2383518 - RNA, 20 nt, Bordetella pertussis
gggcagcacgcgcaccaggc

SEQ ID NO: 2383519 - RNA, 22 nt, Bordetella pertussis
gggcagcacgcgcaccaggccu

SEQ ID NO: 2383520 - RNA, 19 nt, Bordetella pertussis
gggcagcagcagggccagg

SEQ ID NO: 2383521 - RNA, 13 nt, Bordetella pertussis
gggcagcaucacg

SEQ ID NO: 2383522 - RNA, 15 nt, Bordetella pertussis
gggcagcauggcgcc

SEQ ID NO: 2383523 - RNA, 22 nt, Bordetella pertussis
gggcagcauucuggugcagcgg

SEQ ID NO: 2383524 - RNA, 21 nt, Bordetella pertussis
gggcagccauccucgcccagc

SEQ ID NO: 2383525 - RNA, 19 nt, Bordetella pertussis
gggcagcccgcgcacgccc

SEQ ID NO: 2383526 - RNA, 19 nt, Bordetella pertussis
gggcagcgcccgcgccauc

SEQ ID NO: 2383527 - RNA, 14 nt, Bordetella pertussis
gggcagcgcggcgg

SEQ ID NO: 2383528 - RNA, 15 nt, Bordetella pertussis
gggcagcgcggcggc

SEQ ID NO: 2383529 - RNA, 22 nt, Bordetella pertussis
gggcagcggcgacggcgccugg

SEQ ID NO: 2383530 - RNA, 16 nt, Bordetella pertussis
gggcagcgggccgcag

SEQ ID NO: 2383531 - RNA, 18 nt, Bordetella pertussis
gggcagcuuggcgcgccg

SEQ ID NO: 2383532 - RNA, 13 nt, Bordetella pertussis
gggcaggacgccg

SEQ ID NO: 2383533 - RNA, 15 nt, Bordetella pertussis
gggcaggacgccggc

SEQ ID NO: 2383534 - RNA, 14 nt, Bordetella pertussis
gggcaggagcgccg

SEQ ID NO: 2383535 - RNA, 15 nt, Bordetella pertussis
gggcaggaggcgcgg

SEQ ID NO: 2383536 - RNA, 18 nt, Bordetella pertussis
gggcaggaggcgcgggca

SEQ ID NO: 2383537 - RNA, 17 nt, Bordetella pertussis
gggcaggauggccaugc

SEQ ID NO: 2383538 - RNA, 17 nt, Bordetella pertussis
gggcaggcacgcggagg

SEQ ID NO: 2383539 - RNA, 11 nt, Bordetella pertussis
gggcaggccca

SEQ ID NO: 2383540 - RNA, 14 nt, Bordetella pertussis
gggcaggcccagcc

SEQ ID NO: 2383541 - RNA, 19 nt, Bordetella pertussis
gggcaggcccagccagcgg

SEQ ID NO: 2383542 - RNA, 14 nt, Bordetella pertussis
gggcaggccugguc

SEQ ID NO: 2383543 - RNA, 14 nt, Bordetella pertussis
gggcaggcgcacgc

SEQ ID NO: 2383544 - RNA, 15 nt, Bordetella pertussis
gggcaggcgcagcgg

SEQ ID NO: 2383545 - RNA, 12 nt, Bordetella pertussis
gggcaggcgccu

SEQ ID NO: 2383546 - RNA, 14 nt, Bordetella pertussis
gggcaggcgccugc

SEQ ID NO: 2383547 - RNA, 18 nt, Bordetella pertussis
gggcaggcgggccaggcc

SEQ ID NO: 2383548 - RNA, 14 nt, Bordetella pertussis
gggcaggcucagcc

SEQ ID NO: 2383549 - RNA, 17 nt, Bordetella pertussis
gggcaggcucagcccgg

SEQ ID NO: 2383550 - RNA, 22 nt, Bordetella pertussis
gggcaggcucagcccggcgagg

SEQ ID NO: 2383551 - RNA, 15 nt, Bordetella pertussis
gggcaggcuggcgcg

SEQ ID NO: 2383552 - RNA, 15 nt, Bordetella pertussis
gggcagggcgccguc

SEQ ID NO: 2383553 - RNA, 18 nt, Bordetella pertussis
gggcagggcgccugcaga

SEQ ID NO: 2383554 - RNA, 12 nt, Bordetella pertussis
gggcagggcggg

SEQ ID NO: 2383555 - RNA, 14 nt, Bordetella pertussis
gggcagggcuucca

SEQ ID NO: 2383556 - RNA, 16 nt, Bordetella pertussis
gggcaggucgccagca

SEQ ID NO: 2383557 - RNA, 15 nt, Bordetella pertussis
gggcaggucggccag

SEQ ID NO: 2383558 - RNA, 18 nt, Bordetella pertussis
gggcaggucggccagcgu

SEQ ID NO: 2383559 - RNA, 18 nt, Bordetella pertussis
gggcaggucgggcagggu

SEQ ID NO: 2383560 - RNA, 20 nt, Bordetella pertussis
gggcaggucgggcagggugg

SEQ ID NO: 2383561 - RNA, 15 nt, Bordetella pertussis
gggcaggugccccac

SEQ ID NO: 2383562 - RNA, 14 nt, Bordetella pertussis
gggcagugcgccgg

SEQ ID NO: 2383563 - RNA, 16 nt, Bordetella pertussis
gggcaguucgcccggc

SEQ ID NO: 2383564 - RNA, 16 nt, Bordetella pertussis
gggcaguuuccagggc

SEQ ID NO: 2383565 - RNA, 21 nt, Bordetella pertussis
gggcauagcgcgccacaauug

SEQ ID NO: 2383566 - RNA, 24 nt, Bordetella pertussis
gggcauagcguuuuguacucugug

SEQ ID NO: 2383567 - RNA, 21 nt, Bordetella pertussis
gggcaucaggggcucggccag

SEQ ID NO: 2383568 - RNA, 23 nt, Bordetella pertussis
gggcaucgcuuccuuggucagcg

SEQ ID NO: 2383569 - RNA, 13 nt, Bordetella pertussis
gggcaucguugga

SEQ ID NO: 2383570 - RNA, 19 nt, Bordetella pertussis
gggcaucguuggaccccag

SEQ ID NO: 2383571 - RNA, 14 nt, Bordetella pertussis
gggcaugacgauca

SEQ ID NO: 2383572 - RNA, 19 nt, Bordetella pertussis
gggcaugauggugcugccg

SEQ ID NO: 2383573 - RNA, 13 nt, Bordetella pertussis
gggcaugccggca

SEQ ID NO: 2383574 - RNA, 12 nt, Bordetella pertussis
gggcauggcgcc

SEQ ID NO: 2383575 - RNA, 14 nt, Bordetella pertussis
gggcaugggcggcc

SEQ ID NO: 2383576 - RNA, 14 nt, Bordetella pertussis
gggcauugccggag

SEQ ID NO: 2383577 - RNA, 20 nt, Bordetella pertussis
gggcauugccggagcagcag

SEQ ID NO: 2383578 - RNA, 17 nt, Bordetella pertussis
gggcauuucccagccgu

SEQ ID NO: 2383579 - RNA, 23 nt, Bordetella pertussis
gggccacagggcgaaggccagcg

SEQ ID NO: 2383580 - RNA, 23 nt, Bordetella pertussis
gggccacauggucgcccagcaga

SEQ ID NO: 2383581 - RNA, 19 nt, Bordetella pertussis
gggccaccacgccgaugca

SEQ ID NO: 2383582 - RNA, 15 nt, Bordetella pertussis
gggccacccgccgcc

SEQ ID NO: 2383583 - RNA, 14 nt, Bordetella pertussis
gggccaccuggcag

SEQ ID NO: 2383584 - RNA, 17 nt, Bordetella pertussis
gggccaccuggcagccg

SEQ ID NO: 2383585 - RNA, 16 nt, Bordetella pertussis
gggccaccuugguggg

SEQ ID NO: 2383586 - RNA, 17 nt, Bordetella pertussis
gggccacgaaacccagg

SEQ ID NO: 2383587 - RNA, 12 nt, Bordetella pertussis
gggccacgccca

SEQ ID NO: 2383588 - RNA, 22 nt, Bordetella pertussis
gggccacgcccacgcgccgcca

SEQ ID NO: 2383589 - RNA, 14 nt, Bordetella pertussis
gggccacgcccagg

SEQ ID NO: 2383590 - RNA, 15 nt, Bordetella pertussis
gggccacgcccaggc

SEQ ID NO: 2383591 - RNA, 17 nt, Bordetella pertussis
gggccacgcccaggccg

SEQ ID NO: 2383592 - RNA, 18 nt, Bordetella pertussis
gggccacgcccaggccgu

SEQ ID NO: 2383593 - RNA, 20 nt, Bordetella pertussis
gggccacgcccaggccgugg

SEQ ID NO: 2383594 - RNA, 13 nt, Bordetella pertussis
gggccacgccggc

SEQ ID NO: 2383595 - RNA, 14 nt, Bordetella pertussis
gggccacgccggcc

SEQ ID NO: 2383596 - RNA, 19 nt, Bordetella pertussis
gggccacgccggccgccug

SEQ ID NO: 2383597 - RNA, 16 nt, Bordetella pertussis
gggccacgccggccgg

SEQ ID NO: 2383598 - RNA, 19 nt, Bordetella pertussis
gggccacucgaugggcgcg

SEQ ID NO: 2383599 - RNA, 20 nt, Bordetella pertussis
gggccacugcgccugggcgg

SEQ ID NO: 2383600 - RNA, 22 nt, Bordetella pertussis
gggccacugcgccugggcggcg

SEQ ID NO: 2383601 - RNA, 19 nt, Bordetella pertussis
gggccagaccgcgcgcacc

SEQ ID NO: 2383602 - RNA, 13 nt, Bordetella pertussis
gggccagaccugg

SEQ ID NO: 2383603 - RNA, 17 nt, Bordetella pertussis
gggccagauagucgcgg

SEQ ID NO: 2383604 - RNA, 11 nt, Bordetella pertussis
gggccagcaac

SEQ ID NO: 2383605 - RNA, 22 nt, Bordetella pertussis
gggccagcaacuggugcccgua

SEQ ID NO: 2383606 - RNA, 15 nt, Bordetella pertussis
gggccagcagcuggc

SEQ ID NO: 2383607 - RNA, 17 nt, Bordetella pertussis
gggccagcagcuggcgc

SEQ ID NO: 2383608 - RNA, 18 nt, Bordetella pertussis
gggccagcagcuggcgca

SEQ ID NO: 2383609 - RNA, 13 nt, Bordetella pertussis
gggccagccagcg

SEQ ID NO: 2383610 - RNA, 18 nt, Bordetella pertussis
gggccagccagcgccgca

SEQ ID NO: 2383611 - RNA, 20 nt, Bordetella pertussis
gggccagccagcgccgcagc

SEQ ID NO: 2383612 - RNA, 14 nt, Bordetella pertussis
gggccagccccggc

SEQ ID NO: 2383613 - RNA, 12 nt, Bordetella pertussis
gggccagccugg

SEQ ID NO: 2383614 - RNA, 15 nt, Bordetella pertussis
gggccagcgccagca

SEQ ID NO: 2383615 - RNA, 16 nt, Bordetella pertussis
gggccagcgcggccag

SEQ ID NO: 2383616 - RNA, 18 nt, Bordetella pertussis
gggccagcgcggccaggu

SEQ ID NO: 2383617 - RNA, 21 nt, Bordetella pertussis
gggccagcuccccgggcguga

SEQ ID NO: 2383618 - RNA, 18 nt, Bordetella pertussis
gggccaggaccgaggugc

SEQ ID NO: 2383619 - RNA, 21 nt, Bordetella pertussis
gggccaggaccgaggugccag

SEQ ID NO: 2383620 - RNA, 23 nt, Bordetella pertussis
gggccaggccgauuucggccgcc

SEQ ID NO: 2383621 - RNA, 21 nt, Bordetella pertussis
gggccaggcgcaguaucuggu

SEQ ID NO: 2383622 - RNA, 18 nt, Bordetella pertussis
gggccaggcgcuccagca

SEQ ID NO: 2383623 - RNA, 12 nt, Bordetella pertussis
gggccagggccu

SEQ ID NO: 2383624 - RNA, 17 nt, Bordetella pertussis
gggccagggccucgcgg

SEQ ID NO: 2383625 - RNA, 19 nt, Bordetella pertussis
gggccaguccgcagcgcag

SEQ ID NO: 2383626 - RNA, 20 nt, Bordetella pertussis
gggccaguucgcggcgcagc

SEQ ID NO: 2383627 - RNA, 23 nt, Bordetella pertussis
gggccaucgggauaccgcuggcc

SEQ ID NO: 2383628 - RNA, 21 nt, Bordetella pertussis
gggccaugccguccugcugcg

SEQ ID NO: 2383629 - RNA, 20 nt, Bordetella pertussis
gggccaugcguaucggcagc

SEQ ID NO: 2383630 - RNA, 13 nt, Bordetella pertussis
guacucggccagg

SEQ ID NO: 2383631 - RNA, 14 nt, Bordetella pertussis
guacucggccaggc

SEQ ID NO: 2383632 - RNA, 15 nt, Bordetella pertussis
guacucggccaggcc

SEQ ID NO: 2383633 - RNA, 22 nt, Bordetella pertussis
guacucggccaggccauggcgc

SEQ ID NO: 2383634 - RNA, 18 nt, Bordetella pertussis
guacugcugcaaggacac

SEQ ID NO: 2383635 - RNA, 17 nt, Bordetella pertussis
guacuggccgacgggug

SEQ ID NO: 2383636 - RNA, 16 nt, Bordetella pertussis
guacuggcgcggcggc

SEQ ID NO: 2383637 - RNA, 18 nt, Bordetella pertussis
guacuggcgcggcggcca

SEQ ID NO: 2383638 - RNA, 19 nt, Bordetella pertussis
guacuggcgcggcggccag

SEQ ID NO: 2383639 - RNA, 11 nt, Bordetella pertussis
guacuggcugg

SEQ ID NO: 2383640 - RNA, 15 nt, Bordetella pertussis
guacuggcuggucuu

SEQ ID NO: 2383641 - RNA, 20 nt, Bordetella pertussis
guacugggccaccuuggugg

SEQ ID NO: 2383642 - RNA, 20 nt, Bordetella pertussis
guacugguaccaggcggcga

SEQ ID NO: 2383643 - RNA, 16 nt, Bordetella pertussis
guacuggucgcgcagc

SEQ ID NO: 2383644 - RNA, 22 nt, Bordetella pertussis
guacuggucgcgcagcugccug

SEQ ID NO: 2383645 - RNA, 17 nt, Bordetella pertussis
guacuggugggccgacg

SEQ ID NO: 2383646 - RNA, 22 nt, Bordetella pertussis
guacuggugggccgacggcucg

SEQ ID NO: 2383647 - RNA, 17 nt, Bordetella pertussis
guacuucucgucgcgca

SEQ ID NO: 2383648 - RNA, 20 nt, Bordetella pertussis
guacuucucgucgcgcaugg

SEQ ID NO: 2383649 - RNA, 15 nt, Bordetella pertussis
guagaacgccagggu

SEQ ID NO: 2383650 - RNA, 19 nt, Bordetella pertussis
guagaagaacagcagaugg

SEQ ID NO: 2383651 - RNA, 18 nt, Bordetella pertussis
guagaaguaggcggccag

SEQ ID NO: 2383652 - RNA, 19 nt, Bordetella pertussis
guagacaugcucgaugccg

SEQ ID NO: 2383653 - RNA, 14 nt, Bordetella pertussis
guagaccaccagca

SEQ ID NO: 2383654 - RNA, 17 nt, Bordetella pertussis
guagaccaccagcagga

SEQ ID NO: 2383655 - RNA, 18 nt, Bordetella pertussis
guagaccaccagcaggau

SEQ ID NO: 2383656 - RNA, 20 nt, Bordetella pertussis
guagaccacgcgcugcgcgc

SEQ ID NO: 2383657 - RNA, 23 nt, Bordetella pertussis
guagaccgcguugaccggcuggc

SEQ ID NO: 2383658 - RNA, 16 nt, Bordetella pertussis
guagaccgggucgggc

SEQ ID NO: 2383659 - RNA, 15 nt, Bordetella pertussis
guagaccugcgggcc

SEQ ID NO: 2383660 - RNA, 18 nt, Bordetella pertussis
guagaccugcgggccgca

SEQ ID NO: 2383661 - RNA, 14 nt, Bordetella pertussis
guagagcaggccgc

SEQ ID NO: 2383662 - RNA, 22 nt, Bordetella pertussis
guagagcaggccgcccagcgca

SEQ ID NO: 2383663 - RNA, 22 nt, Bordetella pertussis
guagaguacugcguucgggacg

SEQ ID NO: 2383664 - RNA, 20 nt, Bordetella pertussis
guagaucagccgcugcagca

SEQ ID NO: 2383665 - RNA, 13 nt, Bordetella pertussis
guagaucagcgcg

SEQ ID NO: 2383666 - RNA, 18 nt, Bordetella pertussis
guagauccaggcggccac

SEQ ID NO: 2383667 - RNA, 15 nt, Bordetella pertussis
guagaugcgggucgg

SEQ ID NO: 2383668 - RNA, 20 nt, Bordetella pertussis
guagaugcgggucggcgcca

SEQ ID NO: 2383669 - RNA, 15 nt, Bordetella pertussis
guagauggccgccuu

SEQ ID NO: 2383670 - RNA, 13 nt, Bordetella pertussis
guagaugggcagg

SEQ ID NO: 2383671 - RNA, 14 nt, Bordetella pertussis
guagcacacgccga

SEQ ID NO: 2383672 - RNA, 23 nt, Bordetella pertussis
guagcacacgccgauugaggcca

SEQ ID NO: 2383673 - RNA, 14 nt, Bordetella pertussis
guagcaggcgcgcu

SEQ ID NO: 2383674 - RNA, 19 nt, Bordetella pertussis
guagcccagguccagcgcc

SEQ ID NO: 2383675 - RNA, 17 nt, Bordetella pertussis
guagcccauggccaggg

SEQ ID NO: 2383676 - RNA, 20 nt, Bordetella pertussis
guagcccauguucuggucuc

SEQ ID NO: 2383677 - RNA, 14 nt, Bordetella pertussis
guagcccuggcgcu

SEQ ID NO: 2383678 - RNA, 20 nt, Bordetella pertussis
guagcccuggcgcugcagcg

SEQ ID NO: 2383679 - RNA, 18 nt, Bordetella pertussis
guagcccuuguggccgcc

SEQ ID NO: 2383680 - RNA, 19 nt, Bordetella pertussis
guagcccuuguggccgccg

SEQ ID NO: 2383681 - RNA, 18 nt, Bordetella pertussis
guagccgaauccggccag

SEQ ID NO: 2383682 - RNA, 19 nt, Bordetella pertussis
guagccgaauccggccagc

SEQ ID NO: 2383683 - RNA, 20 nt, Bordetella pertussis
guagccgaauccggccagca

SEQ ID NO: 2383684 - RNA, 19 nt, Bordetella pertussis
guagccgaucuggcccuug

SEQ ID NO: 2383685 - RNA, 22 nt, Bordetella pertussis
guagccgaugaccggccaggcg

SEQ ID NO: 2383686 - RNA, 17 nt, Bordetella pertussis
guagccgccgcugucgg

SEQ ID NO: 2383687 - RNA, 15 nt, Bordetella pertussis
guagccgcugcgcgc

SEQ ID NO: 2383688 - RNA, 23 nt, Bordetella pertussis
guagccgcugcgcgcggccuggc

SEQ ID NO: 2383689 - RNA, 13 nt, Bordetella pertussis
guagccggccagg

SEQ ID NO: 2383690 - RNA, 13 nt, Bordetella pertussis
guagccggcgacg

SEQ ID NO: 2383691 - RNA, 19 nt, Bordetella pertussis
guagccgggucuggccggc

SEQ ID NO: 2383692 - RNA, 19 nt, Bordetella pertussis
guagccggugcgcagcacc

SEQ ID NO: 2383693 - RNA, 23 nt, Bordetella pertussis
guagccguccucgcgggccuggc

SEQ ID NO: 2383694 - RNA, 17 nt, Bordetella pertussis
guagcgauccgaugccc

SEQ ID NO: 2383695 - RNA, 18 nt, Bordetella pertussis
guagcgcaagcaggucac

SEQ ID NO: 2383696 - RNA, 14 nt, Bordetella pertussis
guagcgcagcaccg

SEQ ID NO: 2383697 - RNA, 16 nt, Bordetella pertussis
guagcgcagcaccggc

SEQ ID NO: 2383698 - RNA, 17 nt, Bordetella pertussis
guagcgcagcaccggca

SEQ ID NO: 2383699 - RNA, 22 nt, Bordetella pertussis
guagcgcagcaccggcagaugg

SEQ ID NO: 2383700 - RNA, 17 nt, Bordetella pertussis
guagcgcaggcgcuuga

SEQ ID NO: 2383701 - RNA, 14 nt, Bordetella pertussis
guagcgccagcguu

SEQ ID NO: 2383702 - RNA, 23 nt, Bordetella pertussis
guagcgccggcuugcgccagcca

SEQ ID NO: 2383703 - RNA, 19 nt, Bordetella pertussis
guagcgccucgcaucggcc

SEQ ID NO: 2383704 - RNA, 15 nt, Bordetella pertussis
guagcgcguggccag

SEQ ID NO: 2383705 - RNA, 16 nt, Bordetella pertussis
guagcgcguggccagc

SEQ ID NO: 2383706 - RNA, 17 nt, Bordetella pertussis
guagcgcguggccagca

SEQ ID NO: 2383707 - RNA, 20 nt, Bordetella pertussis
guagcgcguggccagcacgg

SEQ ID NO: 2383708 - RNA, 14 nt, Bordetella pertussis
guagcgcucgacuu

SEQ ID NO: 2383709 - RNA, 23 nt, Bordetella pertussis
guagcgcucgacuucgucgggcu

SEQ ID NO: 2383710 - RNA, 21 nt, Bordetella pertussis
guagcgcugggcgccagcagc

SEQ ID NO: 2383711 - RNA, 18 nt, Bordetella pertussis
guagcgggcggcggcgcg

SEQ ID NO: 2383712 - RNA, 20 nt, Bordetella pertussis
guagcgguagggcgauggcg

SEQ ID NO: 2383713 - RNA, 17 nt, Bordetella pertussis
guagcgguccagcugcg

SEQ ID NO: 2383714 - RNA, 13 nt, Bordetella pertussis
guagcgguccggg

SEQ ID NO: 2383715 - RNA, 16 nt, Bordetella pertussis
guagcgguccggggcg

SEQ ID NO: 2383716 - RNA, 17 nt, Bordetella pertussis
guagcgguccggggcgg

SEQ ID NO: 2383717 - RNA, 16 nt, Bordetella pertussis
guagcggucgccgcgg

SEQ ID NO: 2383718 - RNA, 18 nt, Bordetella pertussis
guagcggucgccgcgguc

SEQ ID NO: 2383719 - RNA, 18 nt, Bordetella pertussis
guagcguuggcggccggc

SEQ ID NO: 2383720 - RNA, 21 nt, Bordetella pertussis
guagcucgaccaucauggcca

SEQ ID NO: 2383721 - RNA, 22 nt, Bordetella pertussis
guagcucgaccaucauggccag

SEQ ID NO: 2383722 - RNA, 16 nt, Bordetella pertussis
guagcugcgccgcauu

SEQ ID NO: 2383723 - RNA, 14 nt, Bordetella pertussis
guaggacagcccca

SEQ ID NO: 2383724 - RNA, 20 nt, Bordetella pertussis
guaggacagccccagcagca

SEQ ID NO: 2383725 - RNA, 14 nt, Bordetella pertussis
guaggacggcagca

SEQ ID NO: 2383726 - RNA, 14 nt, Bordetella pertussis
guaggcaaagcgca

SEQ ID NO: 2383727 - RNA, 17 nt, Bordetella pertussis
guaggcaaagcgcagca

SEQ ID NO: 2383728 - RNA, 18 nt, Bordetella pertussis
guaggcaaagcgcagcag

SEQ ID NO: 2383729 - RNA, 23 nt, Bordetella pertussis
guaggcaaagcgcggcugcgggc

SEQ ID NO: 2383730 - RNA, 21 nt, Bordetella pertussis
guaggccacgcgcgggcuggg

SEQ ID NO: 2383731 - RNA, 23 nt, Bordetella pertussis
guaggccggcacguccggcacgg

SEQ ID NO: 2383732 - RNA, 14 nt, Bordetella pertussis
guaggccggcgcga

SEQ ID NO: 2383733 - RNA, 19 nt, Bordetella pertussis
guaggccucgcgcucgaac

SEQ ID NO: 2383734 - RNA, 14 nt, Bordetella pertussis
guaggcgagcaggu

SEQ ID NO: 2383735 - RNA, 16 nt, Bordetella pertussis
guaggcgccccaggcg

SEQ ID NO: 2383736 - RNA, 12 nt, Bordetella pertussis
guaggcgccgcg

SEQ ID NO: 2383737 - RNA, 12 nt, Bordetella pertussis
guaggcgccggc

SEQ ID NO: 2383738 - RNA, 23 nt, Bordetella pertussis
guaggcgccggccuugccguagg

SEQ ID NO: 2383739 - RNA, 15 nt, Bordetella pertussis
guaggcgccggcgcc

SEQ ID NO: 2383740 - RNA, 16 nt, Bordetella pertussis
guaggcgccggcgccg

SEQ ID NO: 2383741 - RNA, 13 nt, Bordetella pertussis
guaggcgccgguc

SEQ ID NO: 2383742 - RNA, 20 nt, Bordetella pertussis
guaggcgccgguccagcgcc

SEQ ID NO: 2383743 - RNA, 21 nt, Bordetella pertussis
guaggcgccgguccagcgccc

SEQ ID NO: 2383744 - RNA, 19 nt, Bordetella pertussis
guaggcgcgcgcaucggcc

SEQ ID NO: 2383745 - RNA, 22 nt, Bordetella pertussis
guaggcgcgcgcaucggccgga

SEQ ID NO: 2383746 - RNA, 18 nt, Bordetella pertussis
guaggcgcgguccaccuc

SEQ ID NO: 2383747 - RNA, 20 nt, Bordetella pertussis
guaggcgcgguccaccucgu

SEQ ID NO: 2383748 - RNA, 14 nt, Bordetella pertussis
guaggcggccaggc

SEQ ID NO: 2383749 - RNA, 21 nt, Bordetella pertussis
guaggcggccuugagcaucug

SEQ ID NO: 2383750 - RNA, 16 nt, Bordetella pertussis
guaggcggcgcgcccg

SEQ ID NO: 2383751 - RNA, 15 nt, Bordetella pertussis
guaggcgggacuggc

SEQ ID NO: 2383752 - RNA, 21 nt, Bordetella pertussis
guaggcgggcagcggcgacgg

SEQ ID NO: 2383753 - RNA, 14 nt, Bordetella pertussis
guaggcggucagcu

SEQ ID NO: 2383754 - RNA, 16 nt, Bordetella pertussis
guaggcggucagcugg

SEQ ID NO: 2383755 - RNA, 13 nt, Bordetella pertussis
guagggcagcagg

SEQ ID NO: 2383756 - RNA, 14 nt, Bordetella pertussis
guagggcgcggcca

SEQ ID NO: 2383757 - RNA, 14 nt, Bordetella pertussis
guagguagcgcgca

SEQ ID NO: 2383758 - RNA, 21 nt, Bordetella pertussis
guagguaugguuggccacgaa

SEQ ID NO: 2383759 - RNA, 14 nt, Bordetella pertussis
guaggucaggccca

SEQ ID NO: 2383760 - RNA, 19 nt, Bordetella pertussis
guaggucaggcccacgccg

SEQ ID NO: 2383761 - RNA, 15 nt, Bordetella pertussis
guaggugcgcgccac

SEQ ID NO: 2383762 - RNA, 14 nt, Bordetella pertussis
guaggugugagcgu

SEQ ID NO: 2383763 - RNA, 23 nt, Bordetella pertussis
guaguacucgccguugucgacga

SEQ ID NO: 2383764 - RNA, 21 nt, Bordetella pertussis
guaguccaucgcguccaggcc

SEQ ID NO: 2383765 - RNA, 22 nt, Bordetella pertussis
guagucgccgcugccgggcucg

SEQ ID NO: 2383766 - RNA, 14 nt, Bordetella pertussis
guagucggccacca

SEQ ID NO: 2383767 - RNA, 13 nt, Bordetella pertussis
guagucggcgccc

SEQ ID NO: 2383768 - RNA, 18 nt, Bordetella pertussis
guagugcaggccgcgcag

SEQ ID NO: 2383769 - RNA, 20 nt, Bordetella pertussis
guagugcccccacgcugcgc

SEQ ID NO: 2383770 - RNA, 18 nt, Bordetella pertussis
guagugguaugaccggcg

SEQ ID NO: 2383771 - RNA, 18 nt, Bordetella pertussis
guaguguuccugguagcc

SEQ ID NO: 2383772 - RNA, 22 nt, Bordetella pertussis
guaguguuccugguagccggcg

SEQ ID NO: 2383773 - RNA, 20 nt, Bordetella pertussis
guaguguucgauggcggcca

SEQ ID NO: 2383774 - RNA, 23 nt, Bordetella pertussis
guaguguucgauggcggccaggg

SEQ ID NO: 2383775 - RNA, 16 nt, Bordetella pertussis
guaguuggucgagcgc

SEQ ID NO: 2383776 - RNA, 21 nt, Bordetella pertussis
guaguugguggcaggcgccca

SEQ ID NO: 2383777 - RNA, 19 nt, Bordetella pertussis
guaguugucgucgcgcugg

SEQ ID NO: 2383778 - RNA, 15 nt, Bordetella pertussis
guaucagcgccugca

SEQ ID NO: 2383779 - RNA, 17 nt, Bordetella pertussis
guaucagcgccugcagg

SEQ ID NO: 2383780 - RNA, 18 nt, Bordetella pertussis
guaucagcgccugcaggu

SEQ ID NO: 2383781 - RNA, 14 nt, Bordetella pertussis
guaucccggccagg

SEQ ID NO: 2383782 - RNA, 16 nt, Bordetella pertussis
guaucccggccaggcg

SEQ ID NO: 2383783 - RNA, 17 nt, Bordetella pertussis
guaucccucgcccagcg

SEQ ID NO: 2383784 - RNA, 18 nt, Bordetella pertussis
guaucgacccaggccggc

SEQ ID NO: 2383785 - RNA, 13 nt, Bordetella pertussis
guaucgacgcgcg

SEQ ID NO: 2383786 - RNA, 16 nt, Bordetella pertussis
guaucgcgccagcgcc

SEQ ID NO: 2383787 - RNA, 19 nt, Bordetella pertussis
guaucgcgccagcgccgcg

SEQ ID NO: 2383788 - RNA, 19 nt, Bordetella pertussis
guaucgcggccgagcuccu

SEQ ID NO: 2383789 - RNA, 14 nt, Bordetella pertussis
guaucgcggcgcag

SEQ ID NO: 2383790 - RNA, 18 nt, Bordetella pertussis
guaucgcggcgcaggcgg

SEQ ID NO: 2383791 - RNA, 19 nt, Bordetella pertussis
guaucgcggcgcaggcggg

SEQ ID NO: 2383792 - RNA, 13 nt, Bordetella pertussis
guaucggccagca

SEQ ID NO: 2383793 - RNA, 12 nt, Bordetella pertussis
guaucggcgcga

SEQ ID NO: 2383794 - RNA, 18 nt, Bordetella pertussis
guaucgggcaacaaggcc

SEQ ID NO: 2383795 - RNA, 17 nt, Bordetella pertussis
guaucguucgcgcgcgc

SEQ ID NO: 2383796 - RNA, 16 nt, Bordetella pertussis
guaucguugucgcgcc

SEQ ID NO: 2383797 - RNA, 20 nt, Bordetella pertussis
guaucucggcgcccgcggcc

SEQ ID NO: 2383798 - RNA, 17 nt, Bordetella pertussis
guaucugucccggcggg

SEQ ID NO: 2383799 - RNA, 23 nt, Bordetella pertussis
guaucugucccggcggggacagg

SEQ ID NO: 2383800 - RNA, 15 nt, Bordetella pertussis
guaugacagggugcc

SEQ ID NO: 2383801 - RNA, 23 nt, Bordetella pertussis
guaugacagggugccuguccccg

SEQ ID NO: 2383802 - RNA, 15 nt, Bordetella pertussis
guaugaccggcgcgg

SEQ ID NO: 2383803 - RNA, 19 nt, Bordetella pertussis
guaugaccggcgcggccug

SEQ ID NO: 2383804 - RNA, 14 nt, Bordetella pertussis
guaugacgcgcuga

SEQ ID NO: 2383805 - RNA, 16 nt, Bordetella pertussis
guaugcaaccggcacg

SEQ ID NO: 2383806 - RNA, 18 nt, Bordetella pertussis
guaugcaccgggccgaac

SEQ ID NO: 2383807 - RNA, 21 nt, Bordetella pertussis
guaugccguaggcgccggccu

SEQ ID NO: 2383808 - RNA, 13 nt, Bordetella pertussis
guaugccugccag

SEQ ID NO: 2383809 - RNA, 12 nt, Bordetella pertussis
guaugcgcagcg

SEQ ID NO: 2383810 - RNA, 15 nt, Bordetella pertussis
guaugcgcagcgagu

SEQ ID NO: 2383811 - RNA, 12 nt, Bordetella pertussis
guaugcggcgcc

SEQ ID NO: 2383812 - RNA, 17 nt, Bordetella pertussis
guaugcggcgcccaggc

SEQ ID NO: 2383813 - RNA, 21 nt, Bordetella pertussis
guauggcccgccaccacggcg

SEQ ID NO: 2383814 - RNA, 14 nt, Bordetella pertussis
guauggccgcccag

SEQ ID NO: 2383815 - RNA, 15 nt, Bordetella pertussis
guauggccgcccagc

SEQ ID NO: 2383816 - RNA, 17 nt, Bordetella pertussis
guauggccguuggccag

SEQ ID NO: 2383817 - RNA, 20 nt, Bordetella pertussis
guauggcggcaacgugcagg

SEQ ID NO: 2383818 - RNA, 12 nt, Bordetella pertussis
guauggcggcgc

SEQ ID NO: 2383819 - RNA, 13 nt, Bordetella pertussis
guauggcggcgcc

SEQ ID NO: 2383820 - RNA, 15 nt, Bordetella pertussis
guaugguuggccacg

SEQ ID NO: 2383821 - RNA, 23 nt, Bordetella pertussis
guauucaucacgggcgccagcag

SEQ ID NO: 2383822 - RNA, 18 nt, Bordetella pertussis
guauuccggguccagccc

SEQ ID NO: 2383823 - RNA, 13 nt, Bordetella pertussis
guauucgcgcggc

SEQ ID NO: 2383824 - RNA, 14 nt, Bordetella pertussis
guauucgcgcggcg

SEQ ID NO: 2383825 - RNA, 14 nt, Bordetella pertussis
guauucgcgcuggc

SEQ ID NO: 2383826 - RNA, 13 nt, Bordetella pertussis
guauugcaugacc

SEQ ID NO: 2383827 - RNA, 19 nt, Bordetella pertussis
guauugcccuucggggcag

SEQ ID NO: 2383828 - RNA, 14 nt, Bordetella pertussis
guauugcggggcgg

SEQ ID NO: 2383829 - RNA, 17 nt, Bordetella pertussis
guauugcugcugcuggc

SEQ ID NO: 2383830 - RNA, 14 nt, Bordetella pertussis
guauugugcaugcg

SEQ ID NO: 2383831 - RNA, 13 nt, Bordetella pertussis
gucaacgcccagg

SEQ ID NO: 2383832 - RNA, 19 nt, Bordetella pertussis
gucaacgcccugacgacca

SEQ ID NO: 2383833 - RNA, 21 nt, Bordetella pertussis
gucaacggcaagaagauccgc

SEQ ID NO: 2383834 - RNA, 15 nt, Bordetella pertussis
gucaagcagcgccgg

SEQ ID NO: 2383835 - RNA, 13 nt, Bordetella pertussis
gucaagcggcugc

SEQ ID NO: 2383836 - RNA, 18 nt, Bordetella pertussis
gucaagcgucgauggcgu

SEQ ID NO: 2383837 - RNA, 18 nt, Bordetella pertussis
gucaagcguucauggcgc

SEQ ID NO: 2383838 - RNA, 15 nt, Bordetella pertussis
gucaaggccugcccg

SEQ ID NO: 2383839 - RNA, 17 nt, Bordetella pertussis
gucaaggcgcggccguc

SEQ ID NO: 2383840 - RNA, 17 nt, Bordetella pertussis
gucaaggcggggcuccu

SEQ ID NO: 2383841 - RNA, 14 nt, Bordetella pertussis
gucaagggcggcca

SEQ ID NO: 2383842 - RNA, 16 nt, Bordetella pertussis
gucaagggcggccaug

SEQ ID NO: 2383843 - RNA, 14 nt, Bordetella pertussis
gucaaggggcugua

SEQ ID NO: 2383844 - RNA, 15 nt, Bordetella pertussis
gucaaggggcuguac

SEQ ID NO: 2383845 - RNA, 22 nt, Bordetella pertussis
gucaaggggcuguaccuggcga

SEQ ID NO: 2383846 - RNA, 18 nt, Bordetella pertussis
gucaaguccggcgccgcc

SEQ ID NO: 2383847 - RNA, 20 nt, Bordetella pertussis
gucaauccgccgccagcacg

SEQ ID NO: 2383848 - RNA, 22 nt, Bordetella pertussis
gucaauccgccgccagcacgcc

SEQ ID NO: 2383849 - RNA, 16 nt, Bordetella pertussis
gucaaugcggcggcgc

SEQ ID NO: 2383850 - RNA, 24 nt, Bordetella pertussis
gucaaugcggcggcgcuggccugc

SEQ ID NO: 2383851 - RNA, 18 nt, Bordetella pertussis
gucacaaagacggcuuga

SEQ ID NO: 2383852 - RNA, 13 nt, Bordetella pertussis
gucacaccccacc

SEQ ID NO: 2383853 - RNA, 23 nt, Bordetella pertussis
gucacacugucgccacgggcguc

SEQ ID NO: 2383854 - RNA, 14 nt, Bordetella pertussis
gucaccaucgccgc

SEQ ID NO: 2383855 - RNA, 14 nt, Bordetella pertussis
gucacccggcgcau

SEQ ID NO: 2383856 - RNA, 15 nt, Bordetella pertussis
gucacccggcgcaug

SEQ ID NO: 2383857 - RNA, 16 nt, Bordetella pertussis
gucacccggcgcaugc

SEQ ID NO: 2383858 - RNA, 19 nt, Bordetella pertussis
gucacccggcgcaugcugg

SEQ ID NO: 2383859 - RNA, 16 nt, Bordetella pertussis
gucaccgacgccagcg

SEQ ID NO: 2383860 - RNA, 16 nt, Bordetella pertussis
gucaccgagcugagca

SEQ ID NO: 2383861 - RNA, 17 nt, Bordetella pertussis
gucaccgccgccgccac

SEQ ID NO: 2383862 - RNA, 19 nt, Bordetella pertussis
gucaccgcgcccagggugg

SEQ ID NO: 2383863 - RNA, 15 nt, Bordetella pertussis
gucacgauuucggcc

SEQ ID NO: 2383864 - RNA, 18 nt, Bordetella pertussis
gucacgauuucggccaug

SEQ ID NO: 2383865 - RNA, 21 nt, Bordetella pertussis
gucacgcacagcaccuggugg

SEQ ID NO: 2383866 - RNA, 14 nt, Bordetella pertussis
gucacgcccaggcg

SEQ ID NO: 2383867 - RNA, 18 nt, Bordetella pertussis
gucacgcccaggcgcugg

SEQ ID NO: 2383868 - RNA, 19 nt, Bordetella pertussis
gucacgcccaggcgcuggu

SEQ ID NO: 2383869 - RNA, 13 nt, Bordetella pertussis
gucacgccgauga

SEQ ID NO: 2383870 - RNA, 18 nt, Bordetella pertussis
gucacgccgaugaccagg

SEQ ID NO: 2383871 - RNA, 20 nt, Bordetella pertussis
gucacgccgaugaccagggc

SEQ ID NO: 2383872 - RNA, 13 nt, Bordetella pertussis
gucacgcggccgg

SEQ ID NO: 2383873 - RNA, 16 nt, Bordetella pertussis
gucacgcggccgggca

SEQ ID NO: 2383874 - RNA, 19 nt, Bordetella pertussis
gucacgcggccgggcacac

SEQ ID NO: 2383875 - RNA, 14 nt, Bordetella pertussis
gucacgcugguggc

SEQ ID NO: 2383876 - RNA, 12 nt, Bordetella pertussis
gucacggaucag

SEQ ID NO: 2383877 - RNA, 17 nt, Bordetella pertussis
gucacggaucagccgcu

SEQ ID NO: 2383878 - RNA, 18 nt, Bordetella pertussis
gucacggcaagacggcgc

SEQ ID NO: 2383879 - RNA, 17 nt, Bordetella pertussis
gucacggucuggcccac

SEQ ID NO: 2383880 - RNA, 18 nt, Bordetella pertussis
gucacguacucgccgucg

SEQ ID NO: 2383881 - RNA, 16 nt, Bordetella pertussis
gucacguucagcgccg

SEQ ID NO: 2383882 - RNA, 17 nt, Bordetella pertussis
gucacguucagcgccgg

SEQ ID NO: 2383883 - RNA, 23 nt, Bordetella pertussis
gucacguucgaccugccgcccga

SEQ ID NO: 2383884 - RNA, 14 nt, Bordetella pertussis
gucagacgcgcuuu

SEQ ID NO: 2383885 - RNA, 23 nt, Bordetella pertussis
gucagagcccuucgacgcggcgg

SEQ ID NO: 2383886 - RNA, 14 nt, Bordetella pertussis
gucagcaaccccag

SEQ ID NO: 2383887 - RNA, 16 nt, Bordetella pertussis
gucagcaaccccagca

SEQ ID NO: 2383888 - RNA, 18 nt, Bordetella pertussis
gucagcaaccccagcagc

SEQ ID NO: 2383889 - RNA, 20 nt, Bordetella pertussis
gucagcaaccccagcagcgc

SEQ ID NO: 2383890 - RNA, 23 nt, Bordetella pertussis
gucagcaaccccagcagcgccgg

SEQ ID NO: 2383891 - RNA, 15 nt, Bordetella pertussis
gucagcacaucgccc

SEQ ID NO: 2383892 - RNA, 20 nt, Bordetella pertussis
gucagcacaucgcccggcag

SEQ ID NO: 2383893 - RNA, 18 nt, Bordetella pertussis
gucagcaccucggcgccc

SEQ ID NO: 2383894 - RNA, 19 nt, Bordetella pertussis
gucagcaccucggcgccca

SEQ ID NO: 2383895 - RNA, 15 nt, Bordetella pertussis
gucagcacggucggc

SEQ ID NO: 2383896 - RNA, 18 nt, Bordetella pertussis
gucagcacggucggcgcg

SEQ ID NO: 2383897 - RNA, 21 nt, Bordetella pertussis
gucagcacuugccggccgccc

SEQ ID NO: 2383898 - RNA, 10 nt, Bordetella pertussis
gucagcagca

SEQ ID NO: 2383899 - RNA, 14 nt, Bordetella pertussis
gucagcagcacgcc

SEQ ID NO: 2383900 - RNA, 12 nt, Bordetella pertussis
gucagcagcagg

SEQ ID NO: 2383901 - RNA, 14 nt, Bordetella pertussis
gucagcagcaugcc

SEQ ID NO: 2383902 - RNA, 10 nt, Bordetella pertussis
gucagcagcg

SEQ ID NO: 2383903 - RNA, 15 nt, Bordetella pertussis
gucagcagcgcggcg

SEQ ID NO: 2383904 - RNA, 17 nt, Bordetella pertussis
gucagcagcgcggcgcc

SEQ ID NO: 2383905 - RNA, 18 nt, Bordetella pertussis
gucagcagcgcggcgccg

SEQ ID NO: 2383906 - RNA, 13 nt, Bordetella pertussis
gucagcagggcgc

SEQ ID NO: 2383907 - RNA, 15 nt, Bordetella pertussis
gucagcagggcgccg

SEQ ID NO: 2383908 - RNA, 19 nt, Bordetella pertussis
gucagcaugaagcgguggc

SEQ ID NO: 2383909 - RNA, 19 nt, Bordetella pertussis
gucagcaugaagcugccca

SEQ ID NO: 2383910 - RNA, 22 nt, Bordetella pertussis
gucagcaugaagcugcccagca

SEQ ID NO: 2383911 - RNA, 23 nt, Bordetella pertussis
gucagcaugaagcugcccagcaa

SEQ ID NO: 2383912 - RNA, 17 nt, Bordetella pertussis
gucagcaugucgacguu

SEQ ID NO: 2383913 - RNA, 13 nt, Bordetella pertussis
gucagcccggcgg

SEQ ID NO: 2383914 - RNA, 14 nt, Bordetella pertussis
gucagcccggcggc

SEQ ID NO: 2383915 - RNA, 16 nt, Bordetella pertussis
gucagcccggcggcca

SEQ ID NO: 2383916 - RNA, 14 nt, Bordetella pertussis
gucagccggugcca

SEQ ID NO: 2383917 - RNA, 22 nt, Bordetella pertussis
gucagccugauucccaggcccg

SEQ ID NO: 2383918 - RNA, 23 nt, Bordetella pertussis
gucagccugauucccaggcccgg

SEQ ID NO: 2383919 - RNA, 20 nt, Bordetella pertussis
gucagccugccggcgcgccc

SEQ ID NO: 2383920 - RNA, 21 nt, Bordetella pertussis
gucagccuggggcaggcggcu

SEQ ID NO: 2383921 - RNA, 19 nt, Bordetella pertussis
gucagcgaaaugccgaagc

SEQ ID NO: 2383922 - RNA, 20 nt, Bordetella pertussis
gucagcgaaucguaggcgcu

SEQ ID NO: 2383923 - RNA, 21 nt, Bordetella pertussis
gucagcgaaucguaggcgcug

SEQ ID NO: 2383924 - RNA, 18 nt, Bordetella pertussis
gucagcgacaucgugcug

SEQ ID NO: 2383925 - RNA, 21 nt, Bordetella pertussis
gucagcgccagggugccgaaa

SEQ ID NO: 2383926 - RNA, 22 nt, Bordetella pertussis
gucagcgcccaaucgggcagca

SEQ ID NO: 2383927 - RNA, 12 nt, Bordetella pertussis
gucagcgccgac

SEQ ID NO: 2383928 - RNA, 21 nt, Bordetella pertussis
gucagcgccgacgauaucgcg

SEQ ID NO: 2383929 - RNA, 13 nt, Bordetella pertussis
gucagcgccgcga

SEQ ID NO: 2383930 - RNA, 15 nt, Bordetella pertussis
gucagcgccggcacg

SEQ ID NO: 2383931 - RNA, 14 nt, Bordetella pertussis
gucagcgcggcgca

SEQ ID NO: 2383932 - RNA, 14 nt, Bordetella pertussis
gucagcgcggcgcc

SEQ ID NO: 2383933 - RNA, 15 nt, Bordetella pertussis
gucagcgcggcgccg

SEQ ID NO: 2383934 - RNA, 13 nt, Bordetella pertussis
gucagcggccggc

SEQ ID NO: 2383935 - RNA, 16 nt, Bordetella pertussis
gucagcggccggcccg

SEQ ID NO: 2383936 - RNA, 22 nt, Bordetella pertussis
gucagcggccggcccgugcgca

SEQ ID NO: 2383937 - RNA, 21 nt, Bordetella pertussis
gucagcggcgcgcccaccagg

SEQ ID NO: 2383938 - RNA, 22 nt, Bordetella pertussis
gucagcggcgcgcccaccaggg

SEQ ID NO: 2383939 - RNA, 20 nt, Bordetella pertussis
gucagcggcuucgagcgcga

SEQ ID NO: 2383940 - RNA, 17 nt, Bordetella pertussis
gucagcgugucgccgac

SEQ ID NO: 2383941 - RNA, 18 nt, Bordetella pertussis
gucagcucgaucaggcgc

SEQ ID NO: 2383942 - RNA, 19 nt, Bordetella pertussis
gucagcugugguaggccga

SEQ ID NO: 2383943 - RNA, 15 nt, Bordetella pertussis
gucagcuugccgccc

SEQ ID NO: 2383944 - RNA, 19 nt, Bordetella pertussis
gucagcuugccgcccaggu

SEQ ID NO: 2383945 - RNA, 22 nt, Bordetella pertussis
gucaggaugcccuggguggcgg

SEQ ID NO: 2383946 - RNA, 14 nt, Bordetella pertussis
gucaggaugcgcgc

SEQ ID NO: 2383947 - RNA, 19 nt, Bordetella pertussis
gucaggcaggcgcgccggg

SEQ ID NO: 2383948 - RNA, 22 nt, Bordetella pertussis
gucaggcccacgccgccgaagu

SEQ ID NO: 2383949 - RNA, 13 nt, Bordetella pertussis
gucaggccgggca

SEQ ID NO: 2383950 - RNA, 17 nt, Bordetella pertussis
gucaggcgagcgcggcg

SEQ ID NO: 2383951 - RNA, 18 nt, Bordetella pertussis
gucaggcguugcgccgca

SEQ ID NO: 2383952 - RNA, 12 nt, Bordetella pertussis
gucagggccgca

SEQ ID NO: 2383953 - RNA, 14 nt, Bordetella pertussis
gucagggccgcagc

SEQ ID NO: 2383954 - RNA, 19 nt, Bordetella pertussis
gucagggcgaagcgcgccu

SEQ ID NO: 2383955 - RNA, 16 nt, Bordetella pertussis
gucaggggcaggcgca

SEQ ID NO: 2383956 - RNA, 17 nt, Bordetella pertussis
gucaggggcaggcgcac

SEQ ID NO: 2383957 - RNA, 23 nt, Bordetella pertussis
gucaggggcaggcgcacgccgcc

SEQ ID NO: 2383958 - RNA, 21 nt, Bordetella pertussis
gucaggucgcugcccagcaug

SEQ ID NO: 2383959 - RNA, 22 nt, Bordetella pertussis
gucaggugcagcgagaccgugg

SEQ ID NO: 2383960 - RNA, 23 nt, Bordetella pertussis
gucagguuagccagugccucagg

SEQ ID NO: 2383961 - RNA, 16 nt, Bordetella pertussis
gucagguuagcggcag

SEQ ID NO: 2383962 - RNA, 15 nt, Bordetella pertussis
gucaguccgcccagc

SEQ ID NO: 2383963 - RNA, 16 nt, Bordetella pertussis
gucaguccgcccagcc

SEQ ID NO: 2383964 - RNA, 19 nt, Bordetella pertussis
gucaguccgcccagccagg

SEQ ID NO: 2383965 - RNA, 21 nt, Bordetella pertussis
gucaguccgcccagccaggcg

SEQ ID NO: 2383966 - RNA, 23 nt, Bordetella pertussis
gucaguccgcccagccaggcgcc

SEQ ID NO: 2383967 - RNA, 19 nt, Bordetella pertussis
gucaguccguggcgcggcc

SEQ ID NO: 2383968 - RNA, 17 nt, Bordetella pertussis
gucagucgggacggcgc

SEQ ID NO: 2383969 - RNA, 17 nt, Bordetella pertussis
gucagucguccuccgcg

SEQ ID NO: 2383970 - RNA, 17 nt, Bordetella pertussis
gucaguugggcgcgccc

SEQ ID NO: 2383971 - RNA, 15 nt, Bordetella pertussis
gucaguuuccaucgg

SEQ ID NO: 2383972 - RNA, 23 nt, Bordetella pertussis
gucauaaaacagcuuccuuuauu

SEQ ID NO: 2383973 - RNA, 16 nt, Bordetella pertussis
gucauacacggcgcgg

SEQ ID NO: 2383974 - RNA, 14 nt, Bordetella pertussis
gucauacgccauga

SEQ ID NO: 2383975 - RNA, 19 nt, Bordetella pertussis
gucaucaccaggguggcgg

SEQ ID NO: 2383976 - RNA, 20 nt, Bordetella pertussis
gucaucaccaggguggcggg

SEQ ID NO: 2383977 - RNA, 12 nt, Bordetella pertussis
gucauccacagg

SEQ ID NO: 2383978 - RNA, 16 nt, Bordetella pertussis
gucaucgagguggcgg

SEQ ID NO: 2383979 - RNA, 16 nt, Bordetella pertussis
gucaucgccaggcgcg

SEQ ID NO: 2383980 - RNA, 20 nt, Bordetella pertussis
gucaucgccaggcgcgugca

SEQ ID NO: 2383981 - RNA, 16 nt, Bordetella pertussis
gucaucgccgcggcgg

SEQ ID NO: 2383982 - RNA, 17 nt, Bordetella pertussis
gucaucgccgcggcggg

SEQ ID NO: 2383983 - RNA, 14 nt, Bordetella pertussis
gucaucggcgacga

SEQ ID NO: 2383984 - RNA, 17 nt, Bordetella pertussis
gucaucggcgcgcagca

SEQ ID NO: 2383985 - RNA, 21 nt, Bordetella pertussis
gucaucgggugcggcgccugc

SEQ ID NO: 2383986 - RNA, 16 nt, Bordetella pertussis
gucaucguggccgcgc

SEQ ID NO: 2383987 - RNA, 15 nt, Bordetella pertussis
gucaucuacagcgcc

SEQ ID NO: 2383988 - RNA, 19 nt, Bordetella pertussis
gucaucuacagcgccuggc

SEQ ID NO: 2383989 - RNA, 22 nt, Bordetella pertussis
gucaucuacagcgccuggcggc

SEQ ID NO: 2383990 - RNA, 14 nt, Bordetella pertussis
gucaugacgggcgg

SEQ ID NO: 2383991 - RNA, 16 nt, Bordetella pertussis
gucaugacgggcggcg

SEQ ID NO: 2383992 - RNA, 17 nt, Bordetella pertussis
gucaugacgggcggcgg

SEQ ID NO: 2383993 - RNA, 20 nt, Bordetella pertussis
gucaugacgggcggcggcgc

SEQ ID NO: 2383994 - RNA, 19 nt, Bordetella pertussis
gucaugaugucggccaggg

SEQ ID NO: 2383995 - RNA, 16 nt, Bordetella pertussis
gucaugcaccugcagg

SEQ ID NO: 2383996 - RNA, 16 nt, Bordetella pertussis
gucaugcagaacaggg

SEQ ID NO: 2383997 - RNA, 18 nt, Bordetella pertussis
gucaugcccaugccgcca

SEQ ID NO: 2383998 - RNA, 16 nt, Bordetella pertussis
gucaugcccuccucgg

SEQ ID NO: 2383999 - RNA, 18 nt, Bordetella pertussis
gucaugcccuccucggcc

SEQ ID NO: 2384000 - RNA, 13 nt, Bordetella pertussis
gucaugccgaaca

SEQ ID NO: 2384001 - RNA, 15 nt, Bordetella pertussis
gucaugccgaacagc

SEQ ID NO: 2384002 - RNA, 17 nt, Bordetella pertussis
gucaugcgcaccuuguc

SEQ ID NO: 2384003 - RNA, 13 nt, Bordetella pertussis
gucaugcgccgca

SEQ ID NO: 2384004 - RNA, 21 nt, Bordetella pertussis
gucaugcgcuugucgccgcug

SEQ ID NO: 2384005 - RNA, 17 nt, Bordetella pertussis
gucauggaaaaucuggg

SEQ ID NO: 2384006 - RNA, 14 nt, Bordetella pertussis
gucaugggcggggc

SEQ ID NO: 2384007 - RNA, 14 nt, Bordetella pertussis
gucauggucgacca

SEQ ID NO: 2384008 - RNA, 18 nt, Bordetella pertussis
gucauggucgaccagcag

SEQ ID NO: 2384009 - RNA, 19 nt, Bordetella pertussis
gucauggucgaccagcagc

SEQ ID NO: 2384010 - RNA, 20 nt, Bordetella pertussis
gucauggucgaccagcagcc

SEQ ID NO: 2384011 - RNA, 15 nt, Bordetella pertussis
gucauguagcggccg

SEQ ID NO: 2384012 - RNA, 18 nt, Bordetella pertussis
gucauguagcggccgccc

SEQ ID NO: 2384013 - RNA, 16 nt, Bordetella pertussis
gucauguccagcgcca

SEQ ID NO: 2384014 - RNA, 20 nt, Bordetella pertussis
gucaugugcugcggcagcca

SEQ ID NO: 2384015 - RNA, 22 nt, Bordetella pertussis
gucaugugcugcggcagccagg

SEQ ID NO: 2384016 - RNA, 14 nt, Bordetella pertussis
guccaaaacagaca

SEQ ID NO: 2384017 - RNA, 15 nt, Bordetella pertussis
guccaaaacagacag

SEQ ID NO: 2384018 - RNA, 14 nt, Bordetella pertussis
guccaaggaaagcc

SEQ ID NO: 2384019 - RNA, 15 nt, Bordetella pertussis
guccaaugccagggu

SEQ ID NO: 2384020 - RNA, 17 nt, Bordetella pertussis
guccaauucgagcaggc

SEQ ID NO: 2384021 - RNA, 15 nt, Bordetella pertussis
guccacagcccggcc

SEQ ID NO: 2384022 - RNA, 19 nt, Bordetella pertussis
guccacauccgcgcugcug

SEQ ID NO: 2384023 - RNA, 23 nt, Bordetella pertussis
guccacauccgcgcugcugccgu

SEQ ID NO: 2384024 - RNA, 15 nt, Bordetella pertussis
guccaccaccaggcc

SEQ ID NO: 2384025 - RNA, 18 nt, Bordetella pertussis
guccaccaccaggccggc

SEQ ID NO: 2384026 - RNA, 21 nt, Bordetella pertussis
guccaccaccaggccggccag

SEQ ID NO: 2384027 - RNA, 22 nt, Bordetella pertussis
guccaccaccaggccggccagg

SEQ ID NO: 2384028 - RNA, 15 nt, Bordetella pertussis
guccaccacccaggc

SEQ ID NO: 2384029 - RNA, 16 nt, Bordetella pertussis
guccaccacccaggcc

SEQ ID NO: 2384030 - RNA, 21 nt, Bordetella pertussis
guccaccaccuucagggcgcc

SEQ ID NO: 2384031 - RNA, 14 nt, Bordetella pertussis
guccaccagccggc

SEQ ID NO: 2384032 - RNA, 15 nt, Bordetella pertussis
guccaccagccggcc

SEQ ID NO: 2384033 - RNA, 19 nt, Bordetella pertussis
guccaccagccggccgccg

SEQ ID NO: 2384034 - RNA, 16 nt, Bordetella pertussis
guccaccauccugccc

SEQ ID NO: 2384035 - RNA, 20 nt, Bordetella pertussis
guccaccgccgaugccgcca

SEQ ID NO: 2384036 - RNA, 20 nt, Bordetella pertussis
guccaccucgucguccagcg

SEQ ID NO: 2384037 - RNA, 22 nt, Bordetella pertussis
guccaccuugacgcgcaggcca

SEQ ID NO: 2384038 - RNA, 13 nt, Bordetella pertussis
guccacgaaggca

SEQ ID NO: 2384039 - RNA, 20 nt, Bordetella pertussis
guccacgaugucguccagcu

SEQ ID NO: 2384040 - RNA, 22 nt, Bordetella pertussis
guccacgcagaaauggaugcgc

SEQ ID NO: 2384041 - RNA, 18 nt, Bordetella pertussis
guccacgcccagcgccgg

SEQ ID NO: 2384042 - RNA, 18 nt, Bordetella pertussis
guccacgcccggugccug

SEQ ID NO: 2384043 - RNA, 20 nt, Bordetella pertussis
guccacgcccggugccugcc

SEQ ID NO: 2384044 - RNA, 19 nt, Bordetella pertussis
guccacgcccuggcuggcg

SEQ ID NO: 2384045 - RNA, 16 nt, Bordetella pertussis
guccacgccgcgcgcg

SEQ ID NO: 2384046 - RNA, 23 nt, Bordetella pertussis
guccacgccgcgcgcgucgccgc

SEQ ID NO: 2384047 - RNA, 13 nt, Bordetella pertussis
guccacgccgggu

SEQ ID NO: 2384048 - RNA, 23 nt, Bordetella pertussis
guccacgccggguugcggcggac

SEQ ID NO: 2384049 - RNA, 15 nt, Bordetella pertussis
guccacgccguggcg

SEQ ID NO: 2384050 - RNA, 17 nt, Bordetella pertussis
guccacgccguggcgca

SEQ ID NO: 2384051 - RNA, 23 nt, Bordetella pertussis
guccacgccguggcgcaaggcau

SEQ ID NO: 2384052 - RNA, 20 nt, Bordetella pertussis
guccacgcggguggugcugc

SEQ ID NO: 2384053 - RNA, 21 nt, Bordetella pertussis
guccacgcggguggugcugcu

SEQ ID NO: 2384054 - RNA, 20 nt, Bordetella pertussis
guccacggcaucggccagca

SEQ ID NO: 2384055 - RNA, 19 nt, Bordetella pertussis
guccacggcauggccagcu

SEQ ID NO: 2384056 - RNA, 13 nt, Bordetella pertussis
guccacggccugc

SEQ ID NO: 2384057 - RNA, 16 nt, Bordetella pertussis
guccacggccugcgcg

SEQ ID NO: 2384058 - RNA, 20 nt, Bordetella pertussis
guccacggccugcgcgccga

SEQ ID NO: 2384059 - RNA, 21 nt, Bordetella pertussis
guccacggccugcgcgccgac

SEQ ID NO: 2384060 - RNA, 23 nt, Bordetella pertussis
guccacggccugcgcgccgacca

SEQ ID NO: 2384061 - RNA, 12 nt, Bordetella pertussis
guccacggcggc

SEQ ID NO: 2384062 - RNA, 13 nt, Bordetella pertussis
guccacggcggcg

SEQ ID NO: 2384063 - RNA, 14 nt, Bordetella pertussis
guccacggcggcgg

SEQ ID NO: 2384064 - RNA, 15 nt, Bordetella pertussis
guccacggucgccgg

SEQ ID NO: 2384065 - RNA, 16 nt, Bordetella pertussis
guccacggucgccggc

SEQ ID NO: 2384066 - RNA, 15 nt, Bordetella pertussis
guccacguggcgacg

SEQ ID NO: 2384067 - RNA, 16 nt, Bordetella pertussis
guccacguggcgacgu

SEQ ID NO: 2384068 - RNA, 22 nt, Bordetella pertussis
guccacguggcgacgucgggca

SEQ ID NO: 2384069 - RNA, 23 nt, Bordetella pertussis
guccacugaaagaaccgccuucg

SEQ ID NO: 2384070 - RNA, 23 nt, Bordetella pertussis
guccacuucaccgcugaucaggu

SEQ ID NO: 2384071 - RNA, 16 nt, Bordetella pertussis
guccagacgggcugga

SEQ ID NO: 2384072 - RNA, 23 nt, Bordetella pertussis
guccagaugauggucggugccgc

SEQ ID NO: 2384073 - RNA, 22 nt, Bordetella pertussis
guccagcaaaugggccgcagcg

SEQ ID NO: 2384074 - RNA, 11 nt, Bordetella pertussis
guccagcaagg

SEQ ID NO: 2384075 - RNA, 18 nt, Bordetella pertussis
guccagcaccagggcgcg

SEQ ID NO: 2384076 - RNA, 23 nt, Bordetella pertussis
guccagcacgccuugcucgacca

SEQ ID NO: 2384077 - RNA, 13 nt, Bordetella pertussis
guccagcacgcgg

SEQ ID NO: 2384078 - RNA, 19 nt, Bordetella pertussis
guccagcacgcggcgcagc

SEQ ID NO: 2384079 - RNA, 20 nt, Bordetella pertussis
guccagcacgcggcgcagca

SEQ ID NO: 2384080 - RNA, 15 nt, Bordetella pertussis
guccagcacggccgc

SEQ ID NO: 2384081 - RNA, 16 nt, Bordetella pertussis
guccagcacggccgcg

SEQ ID NO: 2384082 - RNA, 19 nt, Bordetella pertussis
guccagcacggccgcggcc

SEQ ID NO: 2384083 - RNA, 14 nt, Bordetella pertussis
guccagcagcagcg

SEQ ID NO: 2384084 - RNA, 16 nt, Bordetella pertussis
guccagcagcagcgcc

SEQ ID NO: 2384085 - RNA, 18 nt, Bordetella pertussis
guccagcagcagcgccgc

SEQ ID NO: 2384086 - RNA, 13 nt, Bordetella pertussis
guccagcagcagg

SEQ ID NO: 2384087 - RNA, 23 nt, Bordetella pertussis
guccagcagcgugaugccgucga

SEQ ID NO: 2384088 - RNA, 15 nt, Bordetella pertussis
guccagccccugccc

SEQ ID NO: 2384089 - RNA, 16 nt, Bordetella pertussis
guccagccccugcccg

SEQ ID NO: 2384090 - RNA, 13 nt, Bordetella pertussis
guccagccgagcc

SEQ ID NO: 2384091 - RNA, 20 nt, Bordetella pertussis
guccagcgacuccggccggg

SEQ ID NO: 2384092 - RNA, 18 nt, Bordetella pertussis
guccagcgagcgaaagcc

SEQ ID NO: 2384093 - RNA, 16 nt, Bordetella pertussis
guccagcgccaccagc

SEQ ID NO: 2384094 - RNA, 17 nt, Bordetella pertussis
guccagcgccaccagca

SEQ ID NO: 2384095 - RNA, 22 nt, Bordetella pertussis
guccagcgccaccagcagcgcc

SEQ ID NO: 2384096 - RNA, 23 nt, Bordetella pertussis
guccagcgccaccagcagcgcca

SEQ ID NO: 2384097 - RNA, 18 nt, Bordetella pertussis
guccagcgccacggcggu

SEQ ID NO: 2384098 - RNA, 20 nt, Bordetella pertussis
guccagcgccacggcgguga

SEQ ID NO: 2384099 - RNA, 13 nt, Bordetella pertussis
guccagcgccagc

SEQ ID NO: 2384100 - RNA, 15 nt, Bordetella pertussis
guccagcgccagcag

SEQ ID NO: 2384101 - RNA, 17 nt, Bordetella pertussis
guccagcgccagcaggg

SEQ ID NO: 2384102 - RNA, 14 nt, Bordetella pertussis
guccagcgccaggc

SEQ ID NO: 2384103 - RNA, 12 nt, Bordetella pertussis
guccagcgcccg

SEQ ID NO: 2384104 - RNA, 13 nt, Bordetella pertussis
guccagcgccgcg

SEQ ID NO: 2384105 - RNA, 22 nt, Bordetella pertussis
guccagcgcgcccagcgcgccg

SEQ ID NO: 2384106 - RNA, 13 nt, Bordetella pertussis
guccagcgcgccg

SEQ ID NO: 2384107 - RNA, 18 nt, Bordetella pertussis
guccagcgcgcggccucg

SEQ ID NO: 2384108 - RNA, 15 nt, Bordetella pertussis
guccagcgcggcgcc

SEQ ID NO: 2384109 - RNA, 16 nt, Bordetella pertussis
guccagcgcggcgcca

SEQ ID NO: 2384110 - RNA, 14 nt, Bordetella pertussis
guccagcggcagcg

SEQ ID NO: 2384111 - RNA, 16 nt, Bordetella pertussis
guccagcggcagcggg

SEQ ID NO: 2384112 - RNA, 16 nt, Bordetella pertussis
guccagcggcgccagc

SEQ ID NO: 2384113 - RNA, 18 nt, Bordetella pertussis
guccagcggcgccagcgg

SEQ ID NO: 2384114 - RNA, 14 nt, Bordetella pertussis
guccagcggcgcga

SEQ ID NO: 2384115 - RNA, 20 nt, Bordetella pertussis
guccagcggcgcgacgcgcu

SEQ ID NO: 2384116 - RNA, 21 nt, Bordetella pertussis
guccagcggcgcgacgcgcuu

SEQ ID NO: 2384117 - RNA, 21 nt, Bordetella pertussis
guccagcggcguauaggccac

SEQ ID NO: 2384118 - RNA, 19 nt, Bordetella pertussis
guccagcgucaugcgcacc

SEQ ID NO: 2384119 - RNA, 12 nt, Bordetella pertussis
guccagcguggc

SEQ ID NO: 2384120 - RNA, 14 nt, Bordetella pertussis
guccagcguggcgc

SEQ ID NO: 2384121 - RNA, 14 nt, Bordetella pertussis
guccagcgugguga

SEQ ID NO: 2384122 - RNA, 15 nt, Bordetella pertussis
guccagcugcgcgcg

SEQ ID NO: 2384123 - RNA, 21 nt, Bordetella pertussis
guccagcugcgcgcgagcggc

SEQ ID NO: 2384124 - RNA, 19 nt, Bordetella pertussis
guccagcuggcccuggcag

SEQ ID NO: 2384125 - RNA, 20 nt, Bordetella pertussis
guccagcuuggacagcgcgu

SEQ ID NO: 2384126 - RNA, 21 nt, Bordetella pertussis
guccaggaagcagcccagcac

SEQ ID NO: 2384127 - RNA, 14 nt, Bordetella pertussis
guccaggcccagcg

SEQ ID NO: 2384128 - RNA, 23 nt, Bordetella pertussis
guccaggcccgaaacgcgcagca

SEQ ID NO: 2384129 - RNA, 19 nt, Bordetella pertussis
guccaggcccuggcggcgc

SEQ ID NO: 2384130 - RNA, 17 nt, Bordetella pertussis
guccaggccgaaauggc

SEQ ID NO: 2384131 - RNA, 16 nt, Bordetella pertussis
guccaggccggccugc

SEQ ID NO: 2384132 - RNA, 17 nt, Bordetella pertussis
guccaggccggccugca

SEQ ID NO: 2384133 - RNA, 19 nt, Bordetella pertussis
guccaggccggccugcaau

SEQ ID NO: 2384134 - RNA, 16 nt, Bordetella pertussis
guccaggccggggccg

SEQ ID NO: 2384135 - RNA, 23 nt, Bordetella pertussis
guccaggccggggccgcccagca

SEQ ID NO: 2384136 - RNA, 13 nt, Bordetella pertussis
guccaggcgccgc

SEQ ID NO: 2384137 - RNA, 16 nt, Bordetella pertussis
guccaggcgccgcacg

SEQ ID NO: 2384138 - RNA, 12 nt, Bordetella pertussis
guccaggcgcgc

SEQ ID NO: 2384139 - RNA, 22 nt, Bordetella pertussis
guccaggcggccaucgccgcca

SEQ ID NO: 2384140 - RNA, 15 nt, Bordetella pertussis
guccaggcggccgcg

SEQ ID NO: 2384141 - RNA, 16 nt, Bordetella pertussis
guccaggcggccgcgg

SEQ ID NO: 2384142 - RNA, 14 nt, Bordetella pertussis
guccaggcgguccu

SEQ ID NO: 2384143 - RNA, 16 nt, Bordetella pertussis
guccaggcugccggcg

SEQ ID NO: 2384144 - RNA, 20 nt, Bordetella pertussis
guccaggcugccggcguugg

SEQ ID NO: 2384145 - RNA, 16 nt, Bordetella pertussis
guccaggugcggcggc

SEQ ID NO: 2384146 - RNA, 22 nt, Bordetella pertussis
guccaggugcggcggcgacucg

SEQ ID NO: 2384147 - RNA, 18 nt, Bordetella pertussis
guccagguggcccgcacc

SEQ ID NO: 2384148 - RNA, 20 nt, Bordetella pertussis
guccagguugggcaccacca

SEQ ID NO: 2384149 - RNA, 23 nt, Bordetella pertussis
guccagguugggcaccaccaccg

SEQ ID NO: 2384150 - RNA, 16 nt, Bordetella pertussis
guccaguacaccaggu

SEQ ID NO: 2384151 - RNA, 16 nt, Bordetella pertussis
guccagucccguggcg

SEQ ID NO: 2384152 - RNA, 17 nt, Bordetella pertussis
guccagucccguggcgc

SEQ ID NO: 2384153 - RNA, 16 nt, Bordetella pertussis
guccaucgccugcacg

SEQ ID NO: 2384154 - RNA, 17 nt, Bordetella pertussis
guccaucgcguccaggc

SEQ ID NO: 2384155 - RNA, 18 nt, Bordetella pertussis
guccaucuggaccgcgcg

SEQ ID NO: 2384156 - RNA, 12 nt, Bordetella pertussis
guccaugaacgc

SEQ ID NO: 2384157 - RNA, 20 nt, Bordetella pertussis
guccaugaacgccgcgcccg

SEQ ID NO: 2384158 - RNA, 16 nt, Bordetella pertussis
guccaugccggccaug

SEQ ID NO: 2384159 - RNA, 20 nt, Bordetella pertussis
guccaugccggccaugcuca

SEQ ID NO: 2384160 - RNA, 21 nt, Bordetella pertussis
guccaugcgaaugaucucgcg

SEQ ID NO: 2384161 - RNA, 16 nt, Bordetella pertussis
guccauggccugcagg

SEQ ID NO: 2384162 - RNA, 13 nt, Bordetella pertussis
guccauggcgugc

SEQ ID NO: 2384163 - RNA, 23 nt, Bordetella pertussis
guccauggugggcaggucgggca

SEQ ID NO: 2384164 - RNA, 16 nt, Bordetella pertussis
guccaugucggccgac

SEQ ID NO: 2384165 - RNA, 17 nt, Bordetella pertussis
guccauuagggcccagc

SEQ ID NO: 2384166 - RNA, 14 nt, Bordetella pertussis
gucccacaggcgcg

SEQ ID NO: 2384167 - RNA, 15 nt, Bordetella pertussis
gucccacaggcgcgc

SEQ ID NO: 2384168 - RNA, 22 nt, Bordetella pertussis
gucccacaggcgcgcggcguug

SEQ ID NO: 2384169 - RNA, 12 nt, Bordetella pertussis
gucccagccggc

SEQ ID NO: 2384170 - RNA, 15 nt, Bordetella pertussis
gucccagccggcggc

SEQ ID NO: 2384171 - RNA, 22 nt, Bordetella pertussis
gucccagccggcggcaugcgcc

SEQ ID NO: 2384172 - RNA, 14 nt, Bordetella pertussis
gucccagcgcacgc

SEQ ID NO: 2384173 - RNA, 18 nt, Bordetella pertussis
gucccagcgcacgcagcg

SEQ ID NO: 2384174 - RNA, 19 nt, Bordetella pertussis
gucccagcggggacaggca

SEQ ID NO: 2384175 - RNA, 20 nt, Bordetella pertussis
gucccagcggggacaggcac

SEQ ID NO: 2384176 - RNA, 19 nt, Bordetella pertussis
gucccaggaucaccgccgc

SEQ ID NO: 2384177 - RNA, 22 nt, Bordetella pertussis
gucccaggaucaccgccgcgcc

SEQ ID NO: 2384178 - RNA, 16 nt, Bordetella pertussis
gucccaggcgcucgcg

SEQ ID NO: 2384179 - RNA, 13 nt, Bordetella pertussis
gucccaguccggc

SEQ ID NO: 2384180 - RNA, 20 nt, Bordetella pertussis
gucccaguccggcagcaccc

SEQ ID NO: 2384181 - RNA, 16 nt, Bordetella pertussis
gucccagucgccgcgc

SEQ ID NO: 2384182 - RNA, 17 nt, Bordetella pertussis
gucccagucgccgcgcc

SEQ ID NO: 2384183 - RNA, 16 nt, Bordetella pertussis
guccccaauacccgcc

SEQ ID NO: 2384184 - RNA, 13 nt, Bordetella pertussis
guccccacagggg

SEQ ID NO: 2384185 - RNA, 19 nt, Bordetella pertussis
guccccaccgggacaggca

SEQ ID NO: 2384186 - RNA, 20 nt, Bordetella pertussis
guccccaccgggacaggcac

SEQ ID NO: 2384187 - RNA, 20 nt, Bordetella pertussis
guccccacggggacaggcac

SEQ ID NO: 2384188 - RNA, 19 nt, Bordetella pertussis
guccccacguggacaggca

SEQ ID NO: 2384189 - RNA, 21 nt, Bordetella pertussis
guccccacguggacaggcacc

SEQ ID NO: 2384190 - RNA, 21 nt, Bordetella pertussis
guccccacugggggacuggca

SEQ ID NO: 2384191 - RNA, 16 nt, Bordetella pertussis
guccccagauccgcaa

SEQ ID NO: 2384192 - RNA, 15 nt, Bordetella pertussis
guccccaugcggccc

SEQ ID NO: 2384193 - RNA, 16 nt, Bordetella pertussis
guccccaugcggggac

SEQ ID NO: 2384194 - RNA, 21 nt, Bordetella pertussis
guccccaugcggggacuggca

SEQ ID NO: 2384195 - RNA, 23 nt, Bordetella pertussis
guccccauguggggacaggcacc

SEQ ID NO: 2384196 - RNA, 21 nt, Bordetella pertussis
guccccccauggggacuggca

SEQ ID NO: 2384197 - RNA, 14 nt, Bordetella pertussis
gucccccuacugcc

SEQ ID NO: 2384198 - RNA, 12 nt, Bordetella pertussis
guccccgaacgg

SEQ ID NO: 2384199 - RNA, 15 nt, Bordetella pertussis
guccccgcacgggga

SEQ ID NO: 2384200 - RNA, 21 nt, Bordetella pertussis
guccccgcacggggacaggca

SEQ ID NO: 2384201 - RNA, 23 nt, Bordetella pertussis
guccccgcacggggacaggcacg

SEQ ID NO: 2384202 - RNA, 21 nt, Bordetella pertussis
guccccgcacggggacuggca

SEQ ID NO: 2384203 - RNA, 15 nt, Bordetella pertussis
guccccgcagggaca

SEQ ID NO: 2384204 - RNA, 19 nt, Bordetella pertussis
guccccgcagggacaggcu

SEQ ID NO: 2384205 - RNA, 23 nt, Bordetella pertussis
guccccgcauggagaccggcgcc

SEQ ID NO: 2384206 - RNA, 14 nt, Bordetella pertussis
guccccgcaugggg

SEQ ID NO: 2384207 - RNA, 13 nt, Bordetella pertussis
guccccgccggga

SEQ ID NO: 2384208 - RNA, 14 nt, Bordetella pertussis
guccccgccgggac

SEQ ID NO: 2384209 - RNA, 19 nt, Bordetella pertussis
guccccgccgggacaggca

SEQ ID NO: 2384210 - RNA, 14 nt, Bordetella pertussis
guccccgccggggc

SEQ ID NO: 2384211 - RNA, 21 nt, Bordetella pertussis
guccccgcgcggggggcugac

SEQ ID NO: 2384212 - RNA, 14 nt, Bordetella pertussis
guccccgcggggac

SEQ ID NO: 2384213 - RNA, 19 nt, Bordetella pertussis
guccccgcggggacagaua

SEQ ID NO: 2384214 - RNA, 23 nt, Bordetella pertussis
guccccgcggggacaggcaccgc

SEQ ID NO: 2384215 - RNA, 22 nt, Bordetella pertussis
guccccgcggggacaggcaccu

SEQ ID NO: 2384216 - RNA, 19 nt, Bordetella pertussis
guccccgcggggacaggcu

SEQ ID NO: 2384217 - RNA, 19 nt, Bordetella pertussis
guccccgcugggacaggca

SEQ ID NO: 2384218 - RNA, 21 nt, Bordetella pertussis
guccccgcugggacaggcaca

SEQ ID NO: 2384219 - RNA, 21 nt, Bordetella pertussis
guccccgcugggacaggcacu

SEQ ID NO: 2384220 - RNA, 19 nt, Bordetella pertussis
guccccgucgggacaggcu

SEQ ID NO: 2384221 - RNA, 20 nt, Bordetella pertussis
guccccgucgggacaggcuc

SEQ ID NO: 2384222 - RNA, 19 nt, Bordetella pertussis
guccccguggggacagaua

SEQ ID NO: 2384223 - RNA, 19 nt, Bordetella pertussis
guccccguggggacaggca

SEQ ID NO: 2384224 - RNA, 23 nt, Bordetella pertussis
guccccguucggggacaggcacc

SEQ ID NO: 2384225 - RNA, 22 nt, Bordetella pertussis
guccccugcggggacaggcacc

SEQ ID NO: 2384226 - RNA, 17 nt, Bordetella pertussis
gucccgacccccggccc

SEQ ID NO: 2384227 - RNA, 19 nt, Bordetella pertussis
gucccgacggggacaggcu

SEQ ID NO: 2384228 - RNA, 18 nt, Bordetella pertussis
gucccgcaccgaccagcg

SEQ ID NO: 2384229 - RNA, 21 nt, Bordetella pertussis
gucccgcacgcagcccuucgg

SEQ ID NO: 2384230 - RNA, 21 nt, Bordetella pertussis
gucccgccuucccggccgaaa

SEQ ID NO: 2384231 - RNA, 15 nt, Bordetella pertussis
gucccggcggggaca

SEQ ID NO: 2384232 - RNA, 21 nt, Bordetella pertussis
gucccggcggggacaggcgcc

SEQ ID NO: 2384233 - RNA, 21 nt, Bordetella pertussis
gucccggcggggcaggcgccu

SEQ ID NO: 2384234 - RNA, 16 nt, Bordetella pertussis
gucccgugccggccgg

SEQ ID NO: 2384235 - RNA, 21 nt, Bordetella pertussis
gucccucggagccugucccug

SEQ ID NO: 2384236 - RNA, 15 nt, Bordetella pertussis
gucccugccgggaca

SEQ ID NO: 2384237 - RNA, 19 nt, Bordetella pertussis
gucccugccgggacaggca

SEQ ID NO: 2384238 - RNA, 18 nt, Bordetella pertussis
gucccugcgggggcaggc

SEQ ID NO: 2384239 - RNA, 19 nt, Bordetella pertussis
gucccugcgggggcaggca

SEQ ID NO: 2384240 - RNA, 11 nt, Bordetella pertussis
gucccuggcca

SEQ ID NO: 2384241 - RNA, 12 nt, Bordetella pertussis
gucccuggccau

SEQ ID NO: 2384242 - RNA, 19 nt, Bordetella pertussis
gucccuggcccuggcgggc

SEQ ID NO: 2384243 - RNA, 23 nt, Bordetella pertussis
gucccuggcccuggcgggccgga

SEQ ID NO: 2384244 - RNA, 20 nt, Bordetella pertussis
guccgaaagacugcggcgcg

SEQ ID NO: 2384245 - RNA, 15 nt, Bordetella pertussis
guccgaaccacccgg

SEQ ID NO: 2384246 - RNA, 21 nt, Bordetella pertussis
guccgaaccacccggccaucg

SEQ ID NO: 2384247 - RNA, 22 nt, Bordetella pertussis
guccgaaccgaccgccacgaag

SEQ ID NO: 2384248 - RNA, 16 nt, Bordetella pertussis
guccgaauacgccacg

SEQ ID NO: 2384249 - RNA, 17 nt, Bordetella pertussis
guccgaauacgccacgu

SEQ ID NO: 2384250 - RNA, 20 nt, Bordetella pertussis
guccgacgacaaacccgacg

SEQ ID NO: 2384251 - RNA, 19 nt, Bordetella pertussis
guccgacgguagccggguc

SEQ ID NO: 2384252 - RNA, 21 nt, Bordetella pertussis
guccgauggcgauguaggcca

SEQ ID NO: 2384253 - RNA, 22 nt, Bordetella pertussis
guccgauggcgauguaggccag

SEQ ID NO: 2384254 - RNA, 12 nt, Bordetella pertussis
guccgcagcgca

SEQ ID NO: 2384255 - RNA, 18 nt, Bordetella pertussis
guccgcagcgcagcgcca

SEQ ID NO: 2384256 - RNA, 19 nt, Bordetella pertussis
guccgcagcgcagcgccac

SEQ ID NO: 2384257 - RNA, 20 nt, Bordetella pertussis
guccgcagcgcagcgccacg

SEQ ID NO: 2384258 - RNA, 14 nt, Bordetella pertussis
guccgcagcgcucg

SEQ ID NO: 2384259 - RNA, 13 nt, Bordetella pertussis
guccgcaucgcgc

SEQ ID NO: 2384260 - RNA, 18 nt, Bordetella pertussis
guccgccacccuggcacg

SEQ ID NO: 2384261 - RNA, 18 nt, Bordetella pertussis
guccgccacgccggccac

SEQ ID NO: 2384262 - RNA, 19 nt, Bordetella pertussis
guccgccacgccggccacg

SEQ ID NO: 2384263 - RNA, 14 nt, Bordetella pertussis
guccgccaugcgau

SEQ ID NO: 2384264 - RNA, 22 nt, Bordetella pertussis
guccgccaugcgaugcugcagg

SEQ ID NO: 2384265 - RNA, 16 nt, Bordetella pertussis
guccgcccagccaggc

SEQ ID NO: 2384266 - RNA, 19 nt, Bordetella pertussis
guccgcccagccaggcgcc

SEQ ID NO: 2384267 - RNA, 23 nt, Bordetella pertussis
guccgccccauccacggcgccau

SEQ ID NO: 2384268 - RNA, 17 nt, Bordetella pertussis
guccgcccgcuccacca

SEQ ID NO: 2384269 - RNA, 17 nt, Bordetella pertussis
guccgccgccgcgugga

SEQ ID NO: 2384270 - RNA, 19 nt, Bordetella pertussis
guccgccgcgaccaccagc

SEQ ID NO: 2384271 - RNA, 20 nt, Bordetella pertussis
guccgccgcgaccaccagca

SEQ ID NO: 2384272 - RNA, 13 nt, Bordetella pertussis
guccgccggcacg

SEQ ID NO: 2384273 - RNA, 18 nt, Bordetella pertussis
guccgccggcacgcgcgg

SEQ ID NO: 2384274 - RNA, 14 nt, Bordetella pertussis
guccgccgugcagg

SEQ ID NO: 2384275 - RNA, 21 nt, Bordetella pertussis
guccgccgugcaggcccgggc

SEQ ID NO: 2384276 - RNA, 22 nt, Bordetella pertussis
guccgcgcccauuucgauggcc

SEQ ID NO: 2384277 - RNA, 16 nt, Bordetella pertussis
guccgcgcgccgcugu

SEQ ID NO: 2384278 - RNA, 15 nt, Bordetella pertussis
guccgcgcucgccca

SEQ ID NO: 2384279 - RNA, 17 nt, Bordetella pertussis
guccgcgcucgcccagc

SEQ ID NO: 2384280 - RNA, 17 nt, Bordetella pertussis
guccgcggcccgcccgc

SEQ ID NO: 2384281 - RNA, 14 nt, Bordetella pertussis
guccgcgucgccgc

SEQ ID NO: 2384282 - RNA, 15 nt, Bordetella pertussis
guccgcgucggccgc

SEQ ID NO: 2384283 - RNA, 16 nt, Bordetella pertussis
guccgcgucggccgcg

SEQ ID NO: 2384284 - RNA, 14 nt, Bordetella pertussis
guccgcgugggcau

SEQ ID NO: 2384285 - RNA, 19 nt, Bordetella pertussis
guccgcgugggcauggugg

SEQ ID NO: 2384286 - RNA, 17 nt, Bordetella pertussis
guccgcucaugccggca

SEQ ID NO: 2384287 - RNA, 15 nt, Bordetella pertussis
guccgcucgaggcca

SEQ ID NO: 2384288 - RNA, 18 nt, Bordetella pertussis
guccgcucgaggccaggc

SEQ ID NO: 2384289 - RNA, 22 nt, Bordetella pertussis
guccgcucgaggccaggcugac

SEQ ID NO: 2384290 - RNA, 24 nt, Bordetella pertussis
guccgcucgaggccaggcugacca

SEQ ID NO: 2384291 - RNA, 17 nt, Bordetella pertussis
guccgcuucgucgggca

SEQ ID NO: 2384292 - RNA, 19 nt, Bordetella pertussis
guccggaucccaggccggc

SEQ ID NO: 2384293 - RNA, 23 nt, Bordetella pertussis
guccggaugcacguagcgcagca

SEQ ID NO: 2384294 - RNA, 23 nt, Bordetella pertussis
guccggcaacaccaaccaacaug

SEQ ID NO: 2384295 - RNA, 14 nt, Bordetella pertussis
guccggcagcaccc

SEQ ID NO: 2384296 - RNA, 14 nt, Bordetella pertussis
guccggccccagga

SEQ ID NO: 2384297 - RNA, 13 nt, Bordetella pertussis
guccggccgcgca

SEQ ID NO: 2384298 - RNA, 23 nt, Bordetella pertussis
guccggccgcgcaaggcggcccg

SEQ ID NO: 2384299 - RNA, 19 nt, Bordetella pertussis
guccggcgcccgccgccgg

SEQ ID NO: 2384300 - RNA, 15 nt, Bordetella pertussis
guccggcgccgccgg

SEQ ID NO: 2384301 - RNA, 16 nt, Bordetella pertussis
guccggcgccgccggg

SEQ ID NO: 2384302 - RNA, 22 nt, Bordetella pertussis
guccggcgcucgccccggcgcg

SEQ ID NO: 2384303 - RNA, 14 nt, Bordetella pertussis
guccggcgcuggcu

SEQ ID NO: 2384304 - RNA, 17 nt, Bordetella pertussis
guccggcgugccaugga

SEQ ID NO: 2384305 - RNA, 17 nt, Bordetella pertussis
guccgggccgguuucgg

SEQ ID NO: 2384306 - RNA, 16 nt, Bordetella pertussis
guccgguauccuggcg

SEQ ID NO: 2384307 - RNA, 17 nt, Bordetella pertussis
guccgguauccuggcgc

SEQ ID NO: 2384308 - RNA, 21 nt, Bordetella pertussis
guccggucguuccagaacggc

SEQ ID NO: 2384309 - RNA, 15 nt, Bordetella pertussis
guccggugcgauagc

SEQ ID NO: 2384310 - RNA, 18 nt, Bordetella pertussis
guccgguucgcccaccac

SEQ ID NO: 2384311 - RNA, 23 nt, Bordetella pertussis
guccgguucgcccaccaccagcg

SEQ ID NO: 2384312 - RNA, 20 nt, Bordetella pertussis
guccguaucgcggccgagcu

SEQ ID NO: 2384313 - RNA, 20 nt, Bordetella pertussis
guccgucaccgacgccagca

SEQ ID NO: 2384314 - RNA, 14 nt, Bordetella pertussis
guccguccuggcca

SEQ ID NO: 2384315 - RNA, 20 nt, Bordetella pertussis
guccgucggguugccgcugc

SEQ ID NO: 2384316 - RNA, 16 nt, Bordetella pertussis
guccgucucgcccagg

SEQ ID NO: 2384317 - RNA, 22 nt, Bordetella pertussis
guccgugaagccguccuugagg

SEQ ID NO: 2384318 - RNA, 18 nt, Bordetella pertussis
guccgugcuggccgcgga

SEQ ID NO: 2384319 - RNA, 19 nt, Bordetella pertussis
guccguggccaagugggca

SEQ ID NO: 2384320 - RNA, 16 nt, Bordetella pertussis
guccguggcggccgcg

SEQ ID NO: 2384321 - RNA, 17 nt, Bordetella pertussis
guccguggcggccgcgg

SEQ ID NO: 2384322 - RNA, 23 nt, Bordetella pertussis
guccguggcggccgcgggcagca

SEQ ID NO: 2384323 - RNA, 20 nt, Bordetella pertussis
guccguguucgacgcggccg

SEQ ID NO: 2384324 - RNA, 16 nt, Bordetella pertussis
guccguuucgucggcg

SEQ ID NO: 2384325 - RNA, 18 nt, Bordetella pertussis
guccguuucgucggcgcg

SEQ ID NO: 2384326 - RNA, 17 nt, Bordetella pertussis
guccuaaauugccgcga

SEQ ID NO: 2384327 - RNA, 15 nt, Bordetella pertussis
guccucaugcgggac

SEQ ID NO: 2384328 - RNA, 20 nt, Bordetella pertussis
guccucaugcgggacaggcg

SEQ ID NO: 2384329 - RNA, 16 nt, Bordetella pertussis
guccuccccgcugacc

SEQ ID NO: 2384330 - RNA, 18 nt, Bordetella pertussis
guccuccccgcugaccug

SEQ ID NO: 2384331 - RNA, 22 nt, Bordetella pertussis
guccuccccgcugaccuggugu

SEQ ID NO: 2384332 - RNA, 13 nt, Bordetella pertussis
guccuccgagacg

SEQ ID NO: 2384333 - RNA, 17 nt, Bordetella pertussis
guccucgcacgugacgc

SEQ ID NO: 2384334 - RNA, 17 nt, Bordetella pertussis
guccucgcgggccuggc

SEQ ID NO: 2384335 - RNA, 18 nt, Bordetella pertussis
guccucgcgggccuggcg

SEQ ID NO: 2384336 - RNA, 14 nt, Bordetella pertussis
guccucggccacgu

SEQ ID NO: 2384337 - RNA, 14 nt, Bordetella pertussis
guccucggccagcc

SEQ ID NO: 2384338 - RNA, 19 nt, Bordetella pertussis
guccucggccagccgggcg

SEQ ID NO: 2384339 - RNA, 11 nt, Bordetella pertussis
guccucggccu

SEQ ID NO: 2384340 - RNA, 13 nt, Bordetella pertussis
guccucggccugg

SEQ ID NO: 2384341 - RNA, 15 nt, Bordetella pertussis
guccucggccuggcc

SEQ ID NO: 2384342 - RNA, 15 nt, Bordetella pertussis
guccucuacuggcug

SEQ ID NO: 2384343 - RNA, 16 nt, Bordetella pertussis
guccucuacuggcuga

SEQ ID NO: 2384344 - RNA, 16 nt, Bordetella pertussis
guccugaccggcggcg

SEQ ID NO: 2384345 - RNA, 16 nt, Bordetella pertussis
guccugaggccaggcc

SEQ ID NO: 2384346 - RNA, 16 nt, Bordetella pertussis
guccugaucgaggagc

SEQ ID NO: 2384347 - RNA, 20 nt, Bordetella pertussis
guccugauucacaggcccgc

SEQ ID NO: 2384348 - RNA, 15 nt, Bordetella pertussis
guccugcacgcgggc

SEQ ID NO: 2384349 - RNA, 14 nt, Bordetella pertussis
guccugcagcaggg

SEQ ID NO: 2384350 - RNA, 15 nt, Bordetella pertussis
guccugcaggaaggc

SEQ ID NO: 2384351 - RNA, 21 nt, Bordetella pertussis
guccugcaggaaggccgccgc

SEQ ID NO: 2384352 - RNA, 17 nt, Bordetella pertussis
guccugcaggcccggcg

SEQ ID NO: 2384353 - RNA, 19 nt, Bordetella pertussis
guccugcaggcccggcgcg

SEQ ID NO: 2384354 - RNA, 18 nt, Bordetella pertussis
guccugcaggcggcgcau

SEQ ID NO: 2384355 - RNA, 22 nt, Bordetella pertussis
guccugcaggcggcgcaucagc

SEQ ID NO: 2384356 - RNA, 14 nt, Bordetella pertussis
guccugcaucgcca

SEQ ID NO: 2384357 - RNA, 17 nt, Bordetella pertussis
guccugcaucgccaugc

SEQ ID NO: 2384358 - RNA, 20 nt, Bordetella pertussis
guccugcaucgccaugccgg

SEQ ID NO: 2384359 - RNA, 21 nt, Bordetella pertussis
guccugcaucgccaugccggc

SEQ ID NO: 2384360 - RNA, 15 nt, Bordetella pertussis
guccugcaugccaug

SEQ ID NO: 2384361 - RNA, 22 nt, Bordetella pertussis
guccugccaguugccgccgccg

SEQ ID NO: 2384362 - RNA, 23 nt, Bordetella pertussis
guccugccaguugccgccgccgg

SEQ ID NO: 2384363 - RNA, 21 nt, Bordetella pertussis
guccugccggggcacccaggc

SEQ ID NO: 2384364 - RNA, 17 nt, Bordetella pertussis
guccugcgugauggcgu

SEQ ID NO: 2384365 - RNA, 14 nt, Bordetella pertussis
guccugcucggugc

SEQ ID NO: 2384366 - RNA, 16 nt, Bordetella pertussis
guccugcugcggcacg

SEQ ID NO: 2384367 - RNA, 16 nt, Bordetella pertussis
guccuggacagugccc

SEQ ID NO: 2384368 - RNA, 19 nt, Bordetella pertussis
guccuggacagugcccuga

SEQ ID NO: 2384369 - RNA, 20 nt, Bordetella pertussis
guccuggacagugcccugac

SEQ ID NO: 2384370 - RNA, 15 nt, Bordetella pertussis
guccuggcagucagc

SEQ ID NO: 2384371 - RNA, 13 nt, Bordetella pertussis
guccuggcgaccg

SEQ ID NO: 2384372 - RNA, 17 nt, Bordetella pertussis
guccuggcgaccggcgg

SEQ ID NO: 2384373 - RNA, 19 nt, Bordetella pertussis
guccuggcgcgccaggaag

SEQ ID NO: 2384374 - RNA, 13 nt, Bordetella pertussis
guccuggcggccg

SEQ ID NO: 2384375 - RNA, 20 nt, Bordetella pertussis
guccuggcggccgcccagca

SEQ ID NO: 2384376 - RNA, 20 nt, Bordetella pertussis
guccuggcguggccguucgg

SEQ ID NO: 2384377 - RNA, 18 nt, Bordetella pertussis
guccugggccgagcgcgc

SEQ ID NO: 2384378 - RNA, 23 nt, Bordetella pertussis
guccugggccgagcgcgccagca

SEQ ID NO: 2384379 - RNA, 14 nt, Bordetella pertussis
guccugggccguca

SEQ ID NO: 2384380 - RNA, 20 nt, Bordetella pertussis
guccugggccgucaugcgcc

SEQ ID NO: 2384381 - RNA, 17 nt, Bordetella pertussis
guccuggggcgcggucu

SEQ ID NO: 2384382 - RNA, 23 nt, Bordetella pertussis
guccugguaagaaaccuggcccg

SEQ ID NO: 2384383 - RNA, 20 nt, Bordetella pertussis
guccugguagaucagcgcgu

SEQ ID NO: 2384384 - RNA, 18 nt, Bordetella pertussis
guccugguaucccucgcc

SEQ ID NO: 2384385 - RNA, 15 nt, Bordetella pertussis
guccugguggaccug

SEQ ID NO: 2384386 - RNA, 19 nt, Bordetella pertussis
guccugguugccgaggacg

SEQ ID NO: 2384387 - RNA, 14 nt, Bordetella pertussis
guccuucguggcgc

SEQ ID NO: 2384388 - RNA, 16 nt, Bordetella pertussis
guccuucguggcgccg

SEQ ID NO: 2384389 - RNA, 15 nt, Bordetella pertussis
guccuugacgccgcc

SEQ ID NO: 2384390 - RNA, 16 nt, Bordetella pertussis
guccuugacgccgccg

SEQ ID NO: 2384391 - RNA, 15 nt, Bordetella pertussis
guccuugagcgccag

SEQ ID NO: 2384392 - RNA, 16 nt, Bordetella pertussis
guccuugagggcgcgg

SEQ ID NO: 2384393 - RNA, 13 nt, Bordetella pertussis
guccuugccgggc

SEQ ID NO: 2384394 - RNA, 14 nt, Bordetella pertussis
guccuugccgggcu

SEQ ID NO: 2384395 - RNA, 17 nt, Bordetella pertussis
guccuuggaguucuucu

SEQ ID NO: 2384396 - RNA, 18 nt, Bordetella pertussis
guccuuggaguucuucuu

SEQ ID NO: 2384397 - RNA, 23 nt, Bordetella pertussis
gucgaaauaggaucccggcgcca

SEQ ID NO: 2384398 - RNA, 14 nt, Bordetella pertussis
gucgaacagcauca

SEQ ID NO: 2384399 - RNA, 14 nt, Bordetella pertussis
gucgaacagcgaga

SEQ ID NO: 2384400 - RNA, 17 nt, Bordetella pertussis
gucgaacagcugcagcg

SEQ ID NO: 2384401 - RNA, 23 nt, Bordetella pertussis
gucgaacaggcugguggcgucga

SEQ ID NO: 2384402 - RNA, 14 nt, Bordetella pertussis
gucgaaccagccgu

SEQ ID NO: 2384403 - RNA, 23 nt, Bordetella pertussis
gucgaaccagccguucaucagcg

SEQ ID NO: 2384404 - RNA, 22 nt, Bordetella pertussis
gucgaacgcuuccugggccugc

SEQ ID NO: 2384405 - RNA, 21 nt, Bordetella pertussis
gucgaacucgaacacgccgac

SEQ ID NO: 2384406 - RNA, 16 nt, Bordetella pertussis
gucgaacuuguucuug

SEQ ID NO: 2384407 - RNA, 19 nt, Bordetella pertussis
gucgaagaucuucggcaug

SEQ ID NO: 2384408 - RNA, 16 nt, Bordetella pertussis
gucgaagcacugcagg

SEQ ID NO: 2384409 - RNA, 17 nt, Bordetella pertussis
gucgaagccggcgccau

SEQ ID NO: 2384410 - RNA, 17 nt, Bordetella pertussis
gucgaaggcggccggca

SEQ ID NO: 2384411 - RNA, 21 nt, Bordetella pertussis
gucgaaggcggccggcaggcc

SEQ ID NO: 2384412 - RNA, 19 nt, Bordetella pertussis
gucgaagguuucgcugcgc

SEQ ID NO: 2384413 - RNA, 22 nt, Bordetella pertussis
gucgaaugcacgggcgcugccc

SEQ ID NO: 2384414 - RNA, 20 nt, Bordetella pertussis
gucgacaccaaccugcuggc

SEQ ID NO: 2384415 - RNA, 18 nt, Bordetella pertussis
gucgacagguagcggucg

SEQ ID NO: 2384416 - RNA, 12 nt, Bordetella pertussis
gucgacauacgc

SEQ ID NO: 2384417 - RNA, 18 nt, Bordetella pertussis
gucgacauagacgcgcag

SEQ ID NO: 2384418 - RNA, 19 nt, Bordetella pertussis
gucgacauagacgcgcagc

SEQ ID NO: 2384419 - RNA, 21 nt, Bordetella pertussis
gucgacauagacgcgcagcgg

SEQ ID NO: 2384420 - RNA, 23 nt, Bordetella pertussis
gucgacauagacgcgcagcggca

SEQ ID NO: 2384421 - RNA, 16 nt, Bordetella pertussis
gucgaccacgccggcg

SEQ ID NO: 2384422 - RNA, 20 nt, Bordetella pertussis
gucgaccacgccggcggcca

SEQ ID NO: 2384423 - RNA, 17 nt, Bordetella pertussis
gucgaccagcagccggu

SEQ ID NO: 2384424 - RNA, 21 nt, Bordetella pertussis
gucgaccagcagccgguuggc

SEQ ID NO: 2384425 - RNA, 12 nt, Bordetella pertussis
gucgaccaggcc

SEQ ID NO: 2384426 - RNA, 19 nt, Bordetella pertussis
gucgaccaguucggccagc

SEQ ID NO: 2384427 - RNA, 20 nt, Bordetella pertussis
gucgaccaguucggccagca

SEQ ID NO: 2384428 - RNA, 22 nt, Bordetella pertussis
gucgaccaguucggccagcagc

SEQ ID NO: 2384429 - RNA, 23 nt, Bordetella pertussis
gucgaccaguucggccagcagcu

SEQ ID NO: 2384430 - RNA, 17 nt, Bordetella pertussis
gucgaccaguuggcccu

SEQ ID NO: 2384431 - RNA, 17 nt, Bordetella pertussis
gucgacccaccuggcca

SEQ ID NO: 2384432 - RNA, 20 nt, Bordetella pertussis
gucgacccacuugagcagcg

SEQ ID NO: 2384433 - RNA, 22 nt, Bordetella pertussis
gucgacccacuugagcagcgcc

SEQ ID NO: 2384434 - RNA, 18 nt, Bordetella pertussis
gucgacccucagcccgca

SEQ ID NO: 2384435 - RNA, 16 nt, Bordetella pertussis
gucgaccgacagcaca

SEQ ID NO: 2384436 - RNA, 23 nt, Bordetella pertussis
gucgaccgccucgacgcccgggc

SEQ ID NO: 2384437 - RNA, 21 nt, Bordetella pertussis
gucgaccgcgaagcgcgccag

SEQ ID NO: 2384438 - RNA, 23 nt, Bordetella pertussis
gucgaccgcgaagcgcgccagca

SEQ ID NO: 2384439 - RNA, 14 nt, Bordetella pertussis
gucgaccgcgggcg

SEQ ID NO: 2384440 - RNA, 16 nt, Bordetella pertussis
gucgaccgcgggcgcg

SEQ ID NO: 2384441 - RNA, 23 nt, Bordetella pertussis
gucgaccggaaucaccgccgcga

SEQ ID NO: 2384442 - RNA, 14 nt, Bordetella pertussis
gucgaccggcccgc

SEQ ID NO: 2384443 - RNA, 14 nt, Bordetella pertussis
gucgaccucgagca

SEQ ID NO: 2384444 - RNA, 16 nt, Bordetella pertussis
gucgaccucgagcacc

SEQ ID NO: 2384445 - RNA, 16 nt, Bordetella pertussis
gucgacgaucaggccc

SEQ ID NO: 2384446 - RNA, 18 nt, Bordetella pertussis
gucgacgaucaggcccug

SEQ ID NO: 2384447 - RNA, 23 nt, Bordetella pertussis
gucgacgaucaggcccuggggcc

SEQ ID NO: 2384448 - RNA, 14 nt, Bordetella pertussis
gucgacgaucucgc

SEQ ID NO: 2384449 - RNA, 15 nt, Bordetella pertussis
gucgacgaucucgcg

SEQ ID NO: 2384450 - RNA, 18 nt, Bordetella pertussis
gucgacgaucucgcggcu

SEQ ID NO: 2384451 - RNA, 21 nt, Bordetella pertussis
gucgacgaucucgcggcuggu

SEQ ID NO: 2384452 - RNA, 22 nt, Bordetella pertussis
gucgacgaucucgcggcuggug

SEQ ID NO: 2384453 - RNA, 14 nt, Bordetella pertussis
gucgacgcccgcgc

SEQ ID NO: 2384454 - RNA, 18 nt, Bordetella pertussis
gucgacgcccgcgcccag

SEQ ID NO: 2384455 - RNA, 14 nt, Bordetella pertussis
gucgacgccggcga

SEQ ID NO: 2384456 - RNA, 12 nt, Bordetella pertussis
gucgacgcgaug

SEQ ID NO: 2384457 - RNA, 16 nt, Bordetella pertussis
gucgacgcgaugcccg

SEQ ID NO: 2384458 - RNA, 17 nt, Bordetella pertussis
gucgacgcgaugcccgc

SEQ ID NO: 2384459 - RNA, 14 nt, Bordetella pertussis
gucgacgcugaucg

SEQ ID NO: 2384460 - RNA, 20 nt, Bordetella pertussis
gucgacgcugaucggccgac

SEQ ID NO: 2384461 - RNA, 18 nt, Bordetella pertussis
gucgacggugcgcgccac

SEQ ID NO: 2384462 - RNA, 17 nt, Bordetella pertussis
gucgacguuaugcucgc

SEQ ID NO: 2384463 - RNA, 18 nt, Bordetella pertussis
gucgacguugcgcgacag

SEQ ID NO: 2384464 - RNA, 19 nt, Bordetella pertussis
gucgacguugcgcgacagg

SEQ ID NO: 2384465 - RNA, 21 nt, Bordetella pertussis
gucgacguugcgcgacaggcc

SEQ ID NO: 2384466 - RNA, 14 nt, Bordetella pertussis
gucgacuucgaccc

SEQ ID NO: 2384467 - RNA, 15 nt, Bordetella pertussis
gucgagaccagcagc

SEQ ID NO: 2384468 - RNA, 17 nt, Bordetella pertussis
gucgagagccugggcgc

SEQ ID NO: 2384469 - RNA, 21 nt, Bordetella pertussis
gucgagagccugggcgcgcgc

SEQ ID NO: 2384470 - RNA, 20 nt, Bordetella pertussis
gucgagauauagccggucug

SEQ ID NO: 2384471 - RNA, 14 nt, Bordetella pertussis
gucgagcaccgcgc

SEQ ID NO: 2384472 - RNA, 17 nt, Bordetella pertussis
gucgagcaccgcgcggg

SEQ ID NO: 2384473 - RNA, 16 nt, Bordetella pertussis
gucgagcacgcggcgc

SEQ ID NO: 2384474 - RNA, 20 nt, Bordetella pertussis
gucgagcacgcggcgcggca

SEQ ID NO: 2384475 - RNA, 21 nt, Bordetella pertussis
gucgagcacgcggcgcggcag

SEQ ID NO: 2384476 - RNA, 22 nt, Bordetella pertussis
gucgagcacgcggcgcggcagg

SEQ ID NO: 2384477 - RNA, 13 nt, Bordetella pertussis
gucgagcagcgca

SEQ ID NO: 2384478 - RNA, 17 nt, Bordetella pertussis
gucgagcagcgcaucga

SEQ ID NO: 2384479 - RNA, 13 nt, Bordetella pertussis
gucgagcaggccg

SEQ ID NO: 2384480 - RNA, 15 nt, Bordetella pertussis
gucgagcaucccggc

SEQ ID NO: 2384481 - RNA, 20 nt, Bordetella pertussis
gucgagcaucccggcgcuca

SEQ ID NO: 2384482 - RNA, 23 nt, Bordetella pertussis
gucgagcaucccggcgcucagcg

SEQ ID NO: 2384483 - RNA, 22 nt, Bordetella pertussis
gucgagccagguggacagcgcc

SEQ ID NO: 2384484 - RNA, 16 nt, Bordetella pertussis
gucgagccgggccacg

SEQ ID NO: 2384485 - RNA, 20 nt, Bordetella pertussis
gucgagccgggccacgcgca

SEQ ID NO: 2384486 - RNA, 21 nt, Bordetella pertussis
gucgagccgggccacgcgcac

SEQ ID NO: 2384487 - RNA, 13 nt, Bordetella pertussis
gucgagccgggcg

SEQ ID NO: 2384488 - RNA, 15 nt, Bordetella pertussis
gucgagccgggcgcc

SEQ ID NO: 2384489 - RNA, 17 nt, Bordetella pertussis
gucgagccgggcgccga

SEQ ID NO: 2384490 - RNA, 16 nt, Bordetella pertussis
gucgagccgguccgcc

SEQ ID NO: 2384491 - RNA, 17 nt, Bordetella pertussis
gucgagcgccugcgcca

SEQ ID NO: 2384492 - RNA, 20 nt, Bordetella pertussis
gucgagcgccugcgccacgu

SEQ ID NO: 2384493 - RNA, 23 nt, Bordetella pertussis
gucgagcgcgaaauccagcgcgc

SEQ ID NO: 2384494 - RNA, 15 nt, Bordetella pertussis
gucgagcgcgacgcg

SEQ ID NO: 2384495 - RNA, 13 nt, Bordetella pertussis
gucgagcgcgaug

SEQ ID NO: 2384496 - RNA, 17 nt, Bordetella pertussis
gucgagcgcggccaggc

SEQ ID NO: 2384497 - RNA, 13 nt, Bordetella pertussis
gucgagcgcucgc

SEQ ID NO: 2384498 - RNA, 16 nt, Bordetella pertussis
gucgagcgcucgcuca

SEQ ID NO: 2384499 - RNA, 13 nt, Bordetella pertussis
gucgaggaucaag

SEQ ID NO: 2384500 - RNA, 23 nt, Bordetella pertussis
gucgagguaagugggcugcggcg

SEQ ID NO: 2384501 - RNA, 19 nt, Bordetella pertussis
gucgagguacucgggggcg

SEQ ID NO: 2384502 - RNA, 22 nt, Bordetella pertussis
gucgaguagaaguaggcggcca

SEQ ID NO: 2384503 - RNA, 18 nt, Bordetella pertussis
gucgaguucggcgcgccc

SEQ ID NO: 2384504 - RNA, 16 nt, Bordetella pertussis
gucgaguugcgcgcca

SEQ ID NO: 2384505 - RNA, 18 nt, Bordetella pertussis
gucgaguugcgcgccaug

SEQ ID NO: 2384506 - RNA, 23 nt, Bordetella pertussis
gucgauaucgaugaauucgaccc

SEQ ID NO: 2384507 - RNA, 19 nt, Bordetella pertussis
gucgaucaggcccagcacg

SEQ ID NO: 2384508 - RNA, 19 nt, Bordetella pertussis
gucgaucagggcgcggacu

SEQ ID NO: 2384509 - RNA, 17 nt, Bordetella pertussis
gucgaucaucaggucca

SEQ ID NO: 2384510 - RNA, 21 nt, Bordetella pertussis
gucgaucaugaugcgcugggc

SEQ ID NO: 2384511 - RNA, 16 nt, Bordetella pertussis
gucgaucauggccagc

SEQ ID NO: 2384512 - RNA, 17 nt, Bordetella pertussis
gucgaucauggcgccga

SEQ ID NO: 2384513 - RNA, 18 nt, Bordetella pertussis
gucgauccggcagcagca

SEQ ID NO: 2384514 - RNA, 22 nt, Bordetella pertussis
gucgauccggcagcagcagcgu

SEQ ID NO: 2384515 - RNA, 13 nt, Bordetella pertussis
gucgaucgccacc

SEQ ID NO: 2384516 - RNA, 14 nt, Bordetella pertussis
gucgaucggcgcgc

SEQ ID NO: 2384517 - RNA, 17 nt, Bordetella pertussis
gucgaucuucgccugca

SEQ ID NO: 2384518 - RNA, 12 nt, Bordetella pertussis
gucgaugaaaua

SEQ ID NO: 2384519 - RNA, 20 nt, Bordetella pertussis
gucgaugaccagcgccggcg

SEQ ID NO: 2384520 - RNA, 21 nt, Bordetella pertussis
gucgaugaccagcgccggcgc

SEQ ID NO: 2384521 - RNA, 18 nt, Bordetella pertussis
gucgaugacgcgccgcgc

SEQ ID NO: 2384522 - RNA, 19 nt, Bordetella pertussis
gucgaugacgcgccgcgcc

SEQ ID NO: 2384523 - RNA, 13 nt, Bordetella pertussis
gucgaugcaaccg

SEQ ID NO: 2384524 - RNA, 14 nt, Bordetella pertussis
gucgaugccaguug

SEQ ID NO: 2384525 - RNA, 20 nt, Bordetella pertussis
gucgaugcccucccagaaac

SEQ ID NO: 2384526 - RNA, 16 nt, Bordetella pertussis
gucgaugccgaccagg

SEQ ID NO: 2384527 - RNA, 19 nt, Bordetella pertussis
gucgaugccgaccaggcug

SEQ ID NO: 2384528 - RNA, 13 nt, Bordetella pertussis
gucgaugccggaa

SEQ ID NO: 2384529 - RNA, 14 nt, Bordetella pertussis
gucgaugcgcgcgc

SEQ ID NO: 2384530 - RNA, 14 nt, Bordetella pertussis
gucgauggcccgca

SEQ ID NO: 2384531 - RNA, 17 nt, Bordetella pertussis
gucgauggcccgcaggu

SEQ ID NO: 2384532 - RNA, 21 nt, Bordetella pertussis
gucgauggcguacagcagggu

SEQ ID NO: 2384533 - RNA, 20 nt, Bordetella pertussis
gucgaugggguagucggcca

SEQ ID NO: 2384534 - RNA, 21 nt, Bordetella pertussis
gucgaugggguagucggccac

SEQ ID NO: 2384535 - RNA, 23 nt, Bordetella pertussis
gucgaugggguagucggccacca

SEQ ID NO: 2384536 - RNA, 22 nt, Bordetella pertussis
gucgauggucaguccgcccagc

SEQ ID NO: 2384537 - RNA, 16 nt, Bordetella pertussis
gucgauguccagcgcc

SEQ ID NO: 2384538 - RNA, 23 nt, Bordetella pertussis
gucgaugucgugaucgccagcgc

SEQ ID NO: 2384539 - RNA, 20 nt, Bordetella pertussis
gucgcaacagcccccuggua

SEQ ID NO: 2384540 - RNA, 17 nt, Bordetella pertussis
gucgcacaucaggucga

SEQ ID NO: 2384541 - RNA, 21 nt, Bordetella pertussis
gucgcacuggguggccagcgc

SEQ ID NO: 2384542 - RNA, 21 nt, Bordetella pertussis
gucgcagcacgcccagauggc

SEQ ID NO: 2384543 - RNA, 20 nt, Bordetella pertussis
gucgcaggccgcggccaggc

SEQ ID NO: 2384544 - RNA, 23 nt, Bordetella pertussis
gucgcaggccgcggccaggccca

SEQ ID NO: 2384545 - RNA, 16 nt, Bordetella pertussis
gucgcagucccagucc

SEQ ID NO: 2384546 - RNA, 14 nt, Bordetella pertussis
gucgcagucggggc

SEQ ID NO: 2384547 - RNA, 15 nt, Bordetella pertussis
gucgcagucggggcc

SEQ ID NO: 2384548 - RNA, 18 nt, Bordetella pertussis
gucgcagucggggccgca

SEQ ID NO: 2384549 - RNA, 15 nt, Bordetella pertussis
gucgcauuggccgcc

SEQ ID NO: 2384550 - RNA, 17 nt, Bordetella pertussis
gucgcauuggccgccgc

SEQ ID NO: 2384551 - RNA, 15 nt, Bordetella pertussis
gucgccaccgcccag

SEQ ID NO: 2384552 - RNA, 22 nt, Bordetella pertussis
gucgccaccucgaucaccaccg

SEQ ID NO: 2384553 - RNA, 20 nt, Bordetella pertussis
gucgccacgggcgucaccgg

SEQ ID NO: 2384554 - RNA, 18 nt, Bordetella pertussis
gucgccagcacgcgcagc

SEQ ID NO: 2384555 - RNA, 12 nt, Bordetella pertussis
gucgccagcagg

SEQ ID NO: 2384556 - RNA, 13 nt, Bordetella pertussis
gucgccagcgacg

SEQ ID NO: 2384557 - RNA, 17 nt, Bordetella pertussis
gucgccagcgcgucgcg

SEQ ID NO: 2384558 - RNA, 19 nt, Bordetella pertussis
gucgccagggcgaugaccg

SEQ ID NO: 2384559 - RNA, 17 nt, Bordetella pertussis
gucgccaugcggcuggc

SEQ ID NO: 2384560 - RNA, 20 nt, Bordetella pertussis
gucgccaugcggcuggccga

SEQ ID NO: 2384561 - RNA, 18 nt, Bordetella pertussis
gucgcccaacccggcgag

SEQ ID NO: 2384562 - RNA, 22 nt, Bordetella pertussis
gucgcccaacccggcgaggccg

SEQ ID NO: 2384563 - RNA, 21 nt, Bordetella pertussis
gucgcccacauagaccggcug

SEQ ID NO: 2384564 - RNA, 13 nt, Bordetella pertussis
gucgcccgccgcg

SEQ ID NO: 2384565 - RNA, 16 nt, Bordetella pertussis
gucgcccggggcggcg

SEQ ID NO: 2384566 - RNA, 21 nt, Bordetella pertussis
gucgcccuggauggcggccgc

SEQ ID NO: 2384567 - RNA, 14 nt, Bordetella pertussis
gucgcccuggcggc

SEQ ID NO: 2384568 - RNA, 16 nt, Bordetella pertussis
gucgcccuggcggcgg

SEQ ID NO: 2384569 - RNA, 22 nt, Bordetella pertussis
gucgcccuugggcucgucgacg

SEQ ID NO: 2384570 - RNA, 15 nt, Bordetella pertussis
gucgccgacccgggc

SEQ ID NO: 2384571 - RNA, 20 nt, Bordetella pertussis
gucgccgacccgggcgggcg

SEQ ID NO: 2384572 - RNA, 13 nt, Bordetella pertussis
gucgccgccgcgc

SEQ ID NO: 2384573 - RNA, 14 nt, Bordetella pertussis
gucgccgccgcgca

SEQ ID NO: 2384574 - RNA, 16 nt, Bordetella pertussis
gucgccgccgcgccga

SEQ ID NO: 2384575 - RNA, 18 nt, Bordetella pertussis
gucgccgccugcggcgcg

SEQ ID NO: 2384576 - RNA, 20 nt, Bordetella pertussis
gucgccgccugcggcgcggc

SEQ ID NO: 2384577 - RNA, 12 nt, Bordetella pertussis
gucgccgcgccg

SEQ ID NO: 2384578 - RNA, 11 nt, Bordetella pertussis
gucgccgcgcg

SEQ ID NO: 2384579 - RNA, 14 nt, Bordetella pertussis
gucgccgcgcggcg

SEQ ID NO: 2384580 - RNA, 15 nt, Bordetella pertussis
gucgccgcggccggc

SEQ ID NO: 2384581 - RNA, 12 nt, Bordetella pertussis
gucgccgcgggc

SEQ ID NO: 2384582 - RNA, 22 nt, Bordetella pertussis
gucgccgcugcgcuugaccgcc

SEQ ID NO: 2384583 - RNA, 13 nt, Bordetella pertussis
gucgccgcuggcc

SEQ ID NO: 2384584 - RNA, 20 nt, Bordetella pertussis
gucgccgcuggccagccgcu

SEQ ID NO: 2384585 - RNA, 12 nt, Bordetella pertussis
gucgccggcaug

SEQ ID NO: 2384586 - RNA, 12 nt, Bordetella pertussis
gucgccggccag

SEQ ID NO: 2384587 - RNA, 13 nt, Bordetella pertussis
gucgccggccagg

SEQ ID NO: 2384588 - RNA, 14 nt, Bordetella pertussis
gucgccggccaggc

SEQ ID NO: 2384589 - RNA, 15 nt, Bordetella pertussis
gucgccggccaggca

SEQ ID NO: 2384590 - RNA, 16 nt, Bordetella pertussis
gucgccggccaggcaa

SEQ ID NO: 2384591 - RNA, 13 nt, Bordetella pertussis
gucgccggcgcaa

SEQ ID NO: 2384592 - RNA, 14 nt, Bordetella pertussis
gucgccggcgcaac

SEQ ID NO: 2384593 - RNA, 13 nt, Bordetella pertussis
gucgccggcgcug

SEQ ID NO: 2384594 - RNA, 14 nt, Bordetella pertussis
gucgccggcgcugc

SEQ ID NO: 2384595 - RNA, 18 nt, Bordetella pertussis
gucgccgggcagcgggcc

SEQ ID NO: 2384596 - RNA, 21 nt, Bordetella pertussis
gucgccgggcagcgggccgca

SEQ ID NO: 2384597 - RNA, 20 nt, Bordetella pertussis
gucgccggggcgcaccggca

SEQ ID NO: 2384598 - RNA, 22 nt, Bordetella pertussis
gucgccggggcgcaccggcacg

SEQ ID NO: 2384599 - RNA, 23 nt, Bordetella pertussis
gucgccgguggugucgaacagcg

SEQ ID NO: 2384600 - RNA, 21 nt, Bordetella pertussis
gucgccguacucgccggucgc

SEQ ID NO: 2384601 - RNA, 22 nt, Bordetella pertussis
gucgccgucaggaucaggccgg

SEQ ID NO: 2384602 - RNA, 17 nt, Bordetella pertussis
gucgccguccaggcgcc

SEQ ID NO: 2384603 - RNA, 13 nt, Bordetella pertussis
gucgccgucggca

SEQ ID NO: 2384604 - RNA, 14 nt, Bordetella pertussis
gucgccguggcggg

SEQ ID NO: 2384605 - RNA, 18 nt, Bordetella pertussis
gucgccguucuggcugcg

SEQ ID NO: 2384606 - RNA, 19 nt, Bordetella pertussis
gucgccguucuggcugcgc

SEQ ID NO: 2384607 - RNA, 15 nt, Bordetella pertussis
gucgccucccauugc

SEQ ID NO: 2384608 - RNA, 19 nt, Bordetella pertussis
gucgccucccauugcgcgg

SEQ ID NO: 2384609 - RNA, 22 nt, Bordetella pertussis
gucgccucgaagaccucggcgc

SEQ ID NO: 2384610 - RNA, 23 nt, Bordetella pertussis
gucgccugcccgcacgggccgac

SEQ ID NO: 2384611 - RNA, 12 nt, Bordetella pertussis
gucgccuggucg

SEQ ID NO: 2384612 - RNA, 18 nt, Bordetella pertussis
gucgccuggucgacgccg

SEQ ID NO: 2384613 - RNA, 21 nt, Bordetella pertussis
gucgccuggucgacgccggcg

SEQ ID NO: 2384614 - RNA, 15 nt, Bordetella pertussis
gucgccuguaucagc

SEQ ID NO: 2384615 - RNA, 19 nt, Bordetella pertussis
gucgccuguaucagcgccu

SEQ ID NO: 2384616 - RNA, 15 nt, Bordetella pertussis
gucgccuucggcggc

SEQ ID NO: 2384617 - RNA, 12 nt, Bordetella pertussis
gucgcgaccgcc

SEQ ID NO: 2384618 - RNA, 14 nt, Bordetella pertussis
gucgcgaccgccgc

SEQ ID NO: 2384619 - RNA, 17 nt, Bordetella pertussis
gucgcgaccucggcggc

SEQ ID NO: 2384620 - RNA, 14 nt, Bordetella pertussis
gucgcgagcugcgc

SEQ ID NO: 2384621 - RNA, 21 nt, Bordetella pertussis
gucgcgauccggugaucaucg

SEQ ID NO: 2384622 - RNA, 19 nt, Bordetella pertussis
gucgcgaucgucgaccgcg

SEQ ID NO: 2384623 - RNA, 20 nt, Bordetella pertussis
gucgcgaugcgccaggcgcu

SEQ ID NO: 2384624 - RNA, 23 nt, Bordetella pertussis
gucgcgauugaguucgcgcgccg

SEQ ID NO: 2384625 - RNA, 15 nt, Bordetella pertussis
gucgcgcaacgccgg

SEQ ID NO: 2384626 - RNA, 17 nt, Bordetella pertussis
gucgcgcaacgccgggu

SEQ ID NO: 2384627 - RNA, 17 nt, Bordetella pertussis
gucgcgcaauacgccgc

SEQ ID NO: 2384628 - RNA, 20 nt, Bordetella pertussis
gucgcgcaauacgccgccgg

SEQ ID NO: 2384629 - RNA, 21 nt, Bordetella pertussis
gucgcgcaauacgccgccggc

SEQ ID NO: 2384630 - RNA, 23 nt, Bordetella pertussis
gucgcgcaauacgccgccggcgc

SEQ ID NO: 2384631 - RNA, 22 nt, Bordetella pertussis
gucgcgcaauacgugcgcgacg

SEQ ID NO: 2384632 - RNA, 15 nt, Bordetella pertussis
gucgcgcacccgcag

SEQ ID NO: 2384633 - RNA, 20 nt, Bordetella pertussis
gucgcgcacccgcaggccgu

SEQ ID NO: 2384634 - RNA, 22 nt, Bordetella pertussis
gucgcgcacccgcaggccguug

SEQ ID NO: 2384635 - RNA, 13 nt, Bordetella pertussis
gucgcgcaccgcc

SEQ ID NO: 2384636 - RNA, 18 nt, Bordetella pertussis
gucgcgcaccgccugcug

SEQ ID NO: 2384637 - RNA, 16 nt, Bordetella pertussis
gucgcgcacgaagccg

SEQ ID NO: 2384638 - RNA, 20 nt, Bordetella pertussis
gucgcgcagcaccucggggc

SEQ ID NO: 2384639 - RNA, 21 nt, Bordetella pertussis
gucgcgcagcagggccuggca

SEQ ID NO: 2384640 - RNA, 14 nt, Bordetella pertussis
gucgcgcagcgagu

SEQ ID NO: 2384641 - RNA, 15 nt, Bordetella pertussis
gucgcgcagcgccgc

SEQ ID NO: 2384642 - RNA, 19 nt, Bordetella pertussis
gucgcgcagcgccgccacc

SEQ ID NO: 2384643 - RNA, 22 nt, Bordetella pertussis
gucgcgcagcugccugagcacc

SEQ ID NO: 2384644 - RNA, 19 nt, Bordetella pertussis
gucgcgcauggacgccgcc

SEQ ID NO: 2384645 - RNA, 14 nt, Bordetella pertussis
gucgcgccacggcu

SEQ ID NO: 2384646 - RNA, 18 nt, Bordetella pertussis
gucgcgccagcggccguc

SEQ ID NO: 2384647 - RNA, 14 nt, Bordetella pertussis
gucgcgccaggccg

SEQ ID NO: 2384648 - RNA, 16 nt, Bordetella pertussis
gucgcgccaggccggc

SEQ ID NO: 2384649 - RNA, 17 nt, Bordetella pertussis
gucgcgccaggccggcg

SEQ ID NO: 2384650 - RNA, 19 nt, Bordetella pertussis
gucgcgccaggccggcggc

SEQ ID NO: 2384651 - RNA, 23 nt, Bordetella pertussis
gucgcgcgacgugucggccacca

SEQ ID NO: 2384652 - RNA, 14 nt, Bordetella pertussis
gucgcgcgacuggc

SEQ ID NO: 2384653 - RNA, 18 nt, Bordetella pertussis
gucgcgcgagaccagcgg

SEQ ID NO: 2384654 - RNA, 20 nt, Bordetella pertussis
gucgcgcgaucaggcggugc

SEQ ID NO: 2384655 - RNA, 13 nt, Bordetella pertussis
gucgcgcgcacgc

SEQ ID NO: 2384656 - RNA, 12 nt, Bordetella pertussis
gucgcgcgcauc

SEQ ID NO: 2384657 - RNA, 16 nt, Bordetella pertussis
gucgcgcgcaucgccg

SEQ ID NO: 2384658 - RNA, 14 nt, Bordetella pertussis
gucgcgcgccaggc

SEQ ID NO: 2384659 - RNA, 15 nt, Bordetella pertussis
gucgcgcgccaggcg

SEQ ID NO: 2384660 - RNA, 16 nt, Bordetella pertussis
gucgcgcgccaggcgg

SEQ ID NO: 2384661 - RNA, 22 nt, Bordetella pertussis
gucgcgcgccugcgcgccgccu

SEQ ID NO: 2384662 - RNA, 13 nt, Bordetella pertussis
gucgcgcggcggc

SEQ ID NO: 2384663 - RNA, 16 nt, Bordetella pertussis
gucgcgcggcggcacc

SEQ ID NO: 2384664 - RNA, 17 nt, Bordetella pertussis
gucgcgcggcggcacca

SEQ ID NO: 2384665 - RNA, 22 nt, Bordetella pertussis
gucgcgcggcggcaccagcagg

SEQ ID NO: 2384666 - RNA, 17 nt, Bordetella pertussis
gucgcgcuacagcgugg

SEQ ID NO: 2384667 - RNA, 15 nt, Bordetella pertussis
gucgcgcucggacgc

SEQ ID NO: 2384668 - RNA, 23 nt, Bordetella pertussis
gucgcgcugcaauugcgcggcca

SEQ ID NO: 2384669 - RNA, 22 nt, Bordetella pertussis
gucgcgcugcgacagcagcaug

SEQ ID NO: 2384670 - RNA, 13 nt, Bordetella pertussis
gucgcgcuggccc

SEQ ID NO: 2384671 - RNA, 22 nt, Bordetella pertussis
gucgcgcuggccccagaugccg

SEQ ID NO: 2384672 - RNA, 13 nt, Bordetella pertussis
gucgcgcuggggc

SEQ ID NO: 2384673 - RNA, 22 nt, Bordetella pertussis
gucgcgcuggggcaggacgccg

SEQ ID NO: 2384674 - RNA, 12 nt, Bordetella pertussis
gucgcgcuucuu

SEQ ID NO: 2384675 - RNA, 20 nt, Bordetella pertussis
gucgcgcuucuuguccuuga

SEQ ID NO: 2384676 - RNA, 15 nt, Bordetella pertussis
gucgcggaugcgcgc

SEQ ID NO: 2384677 - RNA, 18 nt, Bordetella pertussis
gucgcggaugcgcgccuu

SEQ ID NO: 2384678 - RNA, 20 nt, Bordetella pertussis
gucgcggcccacggccagca

SEQ ID NO: 2384679 - RNA, 22 nt, Bordetella pertussis
gucgcggcccacggccagcacu

SEQ ID NO: 2384680 - RNA, 23 nt, Bordetella pertussis
gucgcggcccacggccagcacuu

SEQ ID NO: 2384681 - RNA, 15 nt, Bordetella pertussis
gucgcggcccgccag

SEQ ID NO: 2384682 - RNA, 17 nt, Bordetella pertussis
gucgcggcccugggcca

SEQ ID NO: 2384683 - RNA, 12 nt, Bordetella pertussis
gucgcggccgag

SEQ ID NO: 2384684 - RNA, 22 nt, Bordetella pertussis
gucgcggccguaguucggcggg

SEQ ID NO: 2384685 - RNA, 18 nt, Bordetella pertussis
gucgcggcgucgaccgcg

SEQ ID NO: 2384686 - RNA, 21 nt, Bordetella pertussis
gucgcggcgucgaccgcgggc

SEQ ID NO: 2384687 - RNA, 20 nt, Bordetella pertussis
gucgcggcguuguagccgua

SEQ ID NO: 2384688 - RNA, 12 nt, Bordetella pertussis
gucgcggcuggg

SEQ ID NO: 2384689 - RNA, 13 nt, Bordetella pertussis
gucgcggcugggc

SEQ ID NO: 2384690 - RNA, 14 nt, Bordetella pertussis
gucgcggcugggca

SEQ ID NO: 2384691 - RNA, 15 nt, Bordetella pertussis
gucgcgggccaggcc

SEQ ID NO: 2384692 - RNA, 16 nt, Bordetella pertussis
gucgcgggccaggccg

SEQ ID NO: 2384693 - RNA, 16 nt, Bordetella pertussis
gucgcgggugcgggca

SEQ ID NO: 2384694 - RNA, 17 nt, Bordetella pertussis
gucgcgggugcgggcaa

SEQ ID NO: 2384695 - RNA, 14 nt, Bordetella pertussis
gucgcgguccagca

SEQ ID NO: 2384696 - RNA, 17 nt, Bordetella pertussis
gucgcggugcgccacga

SEQ ID NO: 2384697 - RNA, 17 nt, Bordetella pertussis
gucgcguagcgcggccg

SEQ ID NO: 2384698 - RNA, 20 nt, Bordetella pertussis
gucgcguagcgcggccgggu

SEQ ID NO: 2384699 - RNA, 21 nt, Bordetella pertussis
gucgcucaggguacggcgaug

SEQ ID NO: 2384700 - RNA, 17 nt, Bordetella pertussis
gucgcucaugaccagcg

SEQ ID NO: 2384701 - RNA, 20 nt, Bordetella pertussis
gucgcucaugaccagcggcg

SEQ ID NO: 2384702 - RNA, 17 nt, Bordetella pertussis
gucgcucccccaugcgg

SEQ ID NO: 2384703 - RNA, 12 nt, Bordetella pertussis
gucgcucggccu

SEQ ID NO: 2384704 - RNA, 18 nt, Bordetella pertussis
gucgcugacuucgccguc

SEQ ID NO: 2384705 - RNA, 18 nt, Bordetella pertussis
gucgcugcccagcauggg

SEQ ID NO: 2384706 - RNA, 20 nt, Bordetella pertussis
gucgcugccgcgcgauccgg

SEQ ID NO: 2384707 - RNA, 14 nt, Bordetella pertussis
gucgcugcgcgacg

SEQ ID NO: 2384708 - RNA, 15 nt, Bordetella pertussis
gucgcugcggccggu

SEQ ID NO: 2384709 - RNA, 14 nt, Bordetella pertussis
gucgcugcuggcgg

SEQ ID NO: 2384710 - RNA, 19 nt, Bordetella pertussis
gucgcugcuggcggcgcug

SEQ ID NO: 2384711 - RNA, 22 nt, Bordetella pertussis
gucgcuggagaacaggcggcug

SEQ ID NO: 2384712 - RNA, 13 nt, Bordetella pertussis
gucgcuggcagcc

SEQ ID NO: 2384713 - RNA, 16 nt, Bordetella pertussis
gucgcuggcagccuug

SEQ ID NO: 2384714 - RNA, 22 nt, Bordetella pertussis
gucgcuggcccacucggugcgc

SEQ ID NO: 2384715 - RNA, 17 nt, Bordetella pertussis
gucgcuggcgccggugc

SEQ ID NO: 2384716 - RNA, 12 nt, Bordetella pertussis
gucgcuggcgcg

SEQ ID NO: 2384717 - RNA, 16 nt, Bordetella pertussis
gucgcugugcgcggcg

SEQ ID NO: 2384718 - RNA, 14 nt, Bordetella pertussis
gucgcuucgguggc

SEQ ID NO: 2384719 - RNA, 16 nt, Bordetella pertussis
gucggacaacgccagg

SEQ ID NO: 2384720 - RNA, 15 nt, Bordetella pertussis
gucggacaacugcgc

SEQ ID NO: 2384721 - RNA, 20 nt, Bordetella pertussis
gucggacagggccccggccu

SEQ ID NO: 2384722 - RNA, 16 nt, Bordetella pertussis
gucggacgcgccgggc

SEQ ID NO: 2384723 - RNA, 14 nt, Bordetella pertussis
gucggacgcgcgcc

SEQ ID NO: 2384724 - RNA, 15 nt, Bordetella pertussis
gucggacgcgcgccg

SEQ ID NO: 2384725 - RNA, 14 nt, Bordetella pertussis
gucggagucggcgc

SEQ ID NO: 2384726 - RNA, 15 nt, Bordetella pertussis
gucggagucggcgcc

SEQ ID NO: 2384727 - RNA, 22 nt, Bordetella pertussis
gucggagucggcgccgcgcagc

SEQ ID NO: 2384728 - RNA, 16 nt, Bordetella pertussis
gucggaguugcccgaa

SEQ ID NO: 2384729 - RNA, 22 nt, Bordetella pertussis
gucggauagaguucggcgcggc

SEQ ID NO: 2384730 - RNA, 18 nt, Bordetella pertussis
gucggcaaccgucgccag

SEQ ID NO: 2384731 - RNA, 19 nt, Bordetella pertussis
gucggcaccuucgcgcagc

SEQ ID NO: 2384732 - RNA, 13 nt, Bordetella pertussis
gucggcacgucgg

SEQ ID NO: 2384733 - RNA, 17 nt, Bordetella pertussis
gucggcacgucgggcag

SEQ ID NO: 2384734 - RNA, 19 nt, Bordetella pertussis
gucggcacgucgggcagga

SEQ ID NO: 2384735 - RNA, 16 nt, Bordetella pertussis
gucggcauggccagga

SEQ ID NO: 2384736 - RNA, 21 nt, Bordetella pertussis
gucggcauggccaucgcgguc

SEQ ID NO: 2384737 - RNA, 18 nt, Bordetella pertussis
gucggcaugucgaugccg

SEQ ID NO: 2384738 - RNA, 19 nt, Bordetella pertussis
gucggccaaggccggcgcg

SEQ ID NO: 2384739 - RNA, 20 nt, Bordetella pertussis
gucggccaaggccggcgcgu

SEQ ID NO: 2384740 - RNA, 21 nt, Bordetella pertussis
gucggccaccacgauggcgca

SEQ ID NO: 2384741 - RNA, 22 nt, Bordetella pertussis
gucggccaccaggccgucggcc

SEQ ID NO: 2384742 - RNA, 19 nt, Bordetella pertussis
gucggccaccgccguggca

SEQ ID NO: 2384743 - RNA, 19 nt, Bordetella pertussis
gucggccacguccggguug

SEQ ID NO: 2384744 - RNA, 18 nt, Bordetella pertussis
gucggccacgucgcccac

SEQ ID NO: 2384745 - RNA, 13 nt, Bordetella pertussis
gucggccagcgcc

SEQ ID NO: 2384746 - RNA, 14 nt, Bordetella pertussis
gucggccagcgcga

SEQ ID NO: 2384747 - RNA, 12 nt, Bordetella pertussis
gucggccagcgu

SEQ ID NO: 2384748 - RNA, 13 nt, Bordetella pertussis
gucggccagcuug

SEQ ID NO: 2384749 - RNA, 14 nt, Bordetella pertussis
gucggccaggcgcc

SEQ ID NO: 2384750 - RNA, 15 nt, Bordetella pertussis
gucggccaggcgcca

SEQ ID NO: 2384751 - RNA, 15 nt, Bordetella pertussis
gucggccagggcggc

SEQ ID NO: 2384752 - RNA, 16 nt, Bordetella pertussis
gucggccagggcggcg

SEQ ID NO: 2384753 - RNA, 19 nt, Bordetella pertussis
gucggccagggcggcgacu

SEQ ID NO: 2384754 - RNA, 12 nt, Bordetella pertussis
gucggccagggg

SEQ ID NO: 2384755 - RNA, 14 nt, Bordetella pertussis
gucggccaggggca

SEQ ID NO: 2384756 - RNA, 19 nt, Bordetella pertussis
gucggccaugcgauaggcg

SEQ ID NO: 2384757 - RNA, 18 nt, Bordetella pertussis
gucggccaugcgcgccag

SEQ ID NO: 2384758 - RNA, 20 nt, Bordetella pertussis
gucggccaugcgcgccagca

SEQ ID NO: 2384759 - RNA, 16 nt, Bordetella pertussis
gucggccauggcgcug

SEQ ID NO: 2384760 - RNA, 21 nt, Bordetella pertussis
gucggcccacuggaucgccga

SEQ ID NO: 2384761 - RNA, 19 nt, Bordetella pertussis
gucggcccaggucaucgcc

SEQ ID NO: 2384762 - RNA, 21 nt, Bordetella pertussis
gucggcccaggucaucgccag

SEQ ID NO: 2384763 - RNA, 22 nt, Bordetella pertussis
gucggcccgcccgcccugggca

SEQ ID NO: 2384764 - RNA, 13 nt, Bordetella pertussis
gucggccgaaccg

SEQ ID NO: 2384765 - RNA, 20 nt, Bordetella pertussis
gucggccgaccacuggaagc

SEQ ID NO: 2384766 - RNA, 12 nt, Bordetella pertussis
gucggccgccgc

SEQ ID NO: 2384767 - RNA, 14 nt, Bordetella pertussis
gucggccgccguga

SEQ ID NO: 2384768 - RNA, 13 nt, Bordetella pertussis
gucggccgcgccg

SEQ ID NO: 2384769 - RNA, 14 nt, Bordetella pertussis
gucggccgcgccgc

SEQ ID NO: 2384770 - RNA, 15 nt, Bordetella pertussis
gucggccgcgcgcau

SEQ ID NO: 2384771 - RNA, 22 nt, Bordetella pertussis
gucggccgcuccgccauggagg

SEQ ID NO: 2384772 - RNA, 16 nt, Bordetella pertussis
gucggccggaugcgca

SEQ ID NO: 2384773 - RNA, 15 nt, Bordetella pertussis
gucggccggcaaggu

SEQ ID NO: 2384774 - RNA, 21 nt, Bordetella pertussis
gucggccggcagcggcgccau

SEQ ID NO: 2384775 - RNA, 16 nt, Bordetella pertussis
gucggccucaucgagc

SEQ ID NO: 2384776 - RNA, 21 nt, Bordetella pertussis
gucggccucgcgcagggcggc

SEQ ID NO: 2384777 - RNA, 20 nt, Bordetella pertussis
gucggcgaacagcgcguucg

SEQ ID NO: 2384778 - RNA, 23 nt, Bordetella pertussis
gucggcgaagccuugcgcggcca

SEQ ID NO: 2384779 - RNA, 24 nt, Bordetella pertussis
gucggcgaagccuugcgcggccag

SEQ ID NO: 2384780 - RNA, 18 nt, Bordetella pertussis
gucggcgaccgugcgcca

SEQ ID NO: 2384781 - RNA, 13 nt, Bordetella pertussis
gucggcgacguga

SEQ ID NO: 2384782 - RNA, 16 nt, Bordetella pertussis
gucggcgaugaacagg

SEQ ID NO: 2384783 - RNA, 13 nt, Bordetella pertussis
gucggcgaugccg

SEQ ID NO: 2384784 - RNA, 15 nt, Bordetella pertussis
gucggcgaugcgcgg

SEQ ID NO: 2384785 - RNA, 17 nt, Bordetella pertussis
gucggcgauggcccggu

SEQ ID NO: 2384786 - RNA, 16 nt, Bordetella pertussis
gucggcgauggcgcgc

SEQ ID NO: 2384787 - RNA, 17 nt, Bordetella pertussis
gucggcgauggcgcgcg

SEQ ID NO: 2384788 - RNA, 21 nt, Bordetella pertussis
gucggcgcagauggcggcgau

SEQ ID NO: 2384789 - RNA, 22 nt, Bordetella pertussis
gucggcgcagauggcggcgaug

SEQ ID NO: 2384790 - RNA, 13 nt, Bordetella pertussis
gucggcgccaugc

SEQ ID NO: 2384791 - RNA, 18 nt, Bordetella pertussis
gucggcgccaugcuggcc

SEQ ID NO: 2384792 - RNA, 17 nt, Bordetella pertussis
gucggcgccgaggcggu

SEQ ID NO: 2384793 - RNA, 14 nt, Bordetella pertussis
gucggcgccgaugg

SEQ ID NO: 2384794 - RNA, 14 nt, Bordetella pertussis
gucggcgccgcgca

SEQ ID NO: 2384795 - RNA, 15 nt, Bordetella pertussis
gucggcgccgcgcag

SEQ ID NO: 2384796 - RNA, 17 nt, Bordetella pertussis
gucggcgccgcgcagca

SEQ ID NO: 2384797 - RNA, 12 nt, Bordetella pertussis
gucggcgcgcgc

SEQ ID NO: 2384798 - RNA, 13 nt, Bordetella pertussis
gucggcgcgcgcc

SEQ ID NO: 2384799 - RNA, 18 nt, Bordetella pertussis
gucggcgcgcgccaggcc

SEQ ID NO: 2384800 - RNA, 13 nt, Bordetella pertussis
gucggcgcggcag

SEQ ID NO: 2384801 - RNA, 21 nt, Bordetella pertussis
gucggcgcggcgccguccagc

SEQ ID NO: 2384802 - RNA, 16 nt, Bordetella pertussis
gucggcgcggggcacc

SEQ ID NO: 2384803 - RNA, 17 nt, Bordetella pertussis
gucggcgcggggcaccg

SEQ ID NO: 2384804 - RNA, 19 nt, Bordetella pertussis
gucggcgcgguauucgcgc

SEQ ID NO: 2384805 - RNA, 11 nt, Bordetella pertussis
gucggcgcugc

SEQ ID NO: 2384806 - RNA, 12 nt, Bordetella pertussis
gucggcgcuggc

SEQ ID NO: 2384807 - RNA, 14 nt, Bordetella pertussis
gucggcgcuggcca

SEQ ID NO: 2384808 - RNA, 15 nt, Bordetella pertussis
gucggcgcuggcgcg

SEQ ID NO: 2384809 - RNA, 13 nt, Bordetella pertussis
gucggcggccagc

SEQ ID NO: 2384810 - RNA, 14 nt, Bordetella pertussis
gucggcggccagca

SEQ ID NO: 2384811 - RNA, 15 nt, Bordetella pertussis
gucggcggccagcgc

SEQ ID NO: 2384812 - RNA, 17 nt, Bordetella pertussis
gucggcggccagcgcgc

SEQ ID NO: 2384813 - RNA, 19 nt, Bordetella pertussis
gucggcgggacgcaggccc

SEQ ID NO: 2384814 - RNA, 20 nt, Bordetella pertussis
gucggcgggacgcaggccca

SEQ ID NO: 2384815 - RNA, 20 nt, Bordetella pertussis
gucggcggguuugcccagua

SEQ ID NO: 2384816 - RNA, 19 nt, Bordetella pertussis
gucggcguaaggccgccgg

SEQ ID NO: 2384817 - RNA, 20 nt, Bordetella pertussis
gucggcgucgaagguuucgc

SEQ ID NO: 2384818 - RNA, 18 nt, Bordetella pertussis
gucggcgugacguugccg

SEQ ID NO: 2384819 - RNA, 17 nt, Bordetella pertussis
gucggcguuccuggcgc

SEQ ID NO: 2384820 - RNA, 18 nt, Bordetella pertussis
gucggcguuccuggcgcu

SEQ ID NO: 2384821 - RNA, 19 nt, Bordetella pertussis
gucggcguuccuggcgcug

SEQ ID NO: 2384822 - RNA, 20 nt, Bordetella pertussis
gucggcguuccuggcgcugu

SEQ ID NO: 2384823 - RNA, 19 nt, Bordetella pertussis
gucggcguugugccggcgc

SEQ ID NO: 2384824 - RNA, 20 nt, Bordetella pertussis
gucggcguugugccggcgca

SEQ ID NO: 2384825 - RNA, 22 nt, Bordetella pertussis
gucggcguugugccggcgcagg

SEQ ID NO: 2384826 - RNA, 19 nt, Bordetella pertussis
gucggcucggugaugaugg

SEQ ID NO: 2384827 - RNA, 21 nt, Bordetella pertussis
gucggcucgucgaacagcauc

SEQ ID NO: 2384828 - RNA, 18 nt, Bordetella pertussis
gucggcugaugcccuucg

SEQ ID NO: 2384829 - RNA, 16 nt, Bordetella pertussis
gucggcuuccaucagg

SEQ ID NO: 2384830 - RNA, 19 nt, Bordetella pertussis
gucggcuuccaucaggaac

SEQ ID NO: 2384831 - RNA, 19 nt, Bordetella pertussis
gucggcuuuuuugcguucg

SEQ ID NO: 2384832 - RNA, 12 nt, Bordetella pertussis
gucgggacaggc

SEQ ID NO: 2384833 - RNA, 13 nt, Bordetella pertussis
gucgggaccggcg

SEQ ID NO: 2384834 - RNA, 13 nt, Bordetella pertussis
gucgggacggcgc

SEQ ID NO: 2384835 - RNA, 14 nt, Bordetella pertussis
gucgggacggcgcg

SEQ ID NO: 2384836 - RNA, 15 nt, Bordetella pertussis
gucgggacggcgcgg

SEQ ID NO: 2384837 - RNA, 17 nt, Bordetella pertussis
gucgggauaguccagca

SEQ ID NO: 2384838 - RNA, 18 nt, Bordetella pertussis
gucgggauaguccagcac

SEQ ID NO: 2384839 - RNA, 18 nt, Bordetella pertussis
gucgggaugccccgcccg

SEQ ID NO: 2384840 - RNA, 14 nt, Bordetella pertussis
gucgggcaagcggc

SEQ ID NO: 2384841 - RNA, 14 nt, Bordetella pertussis
gucgggcaccagca

SEQ ID NO: 2384842 - RNA, 17 nt, Bordetella pertussis
gucgggcagcaggcgca

SEQ ID NO: 2384843 - RNA, 16 nt, Bordetella pertussis
gucgggcagcgcccgc

SEQ ID NO: 2384844 - RNA, 21 nt, Bordetella pertussis
gucgggcagcgcccgcgccau

SEQ ID NO: 2384845 - RNA, 15 nt, Bordetella pertussis
gucgggcagcgcggc

SEQ ID NO: 2384846 - RNA, 17 nt, Bordetella pertussis
gucgggcagggugggca

SEQ ID NO: 2384847 - RNA, 19 nt, Bordetella pertussis
gucgggcagggugggcacg

SEQ ID NO: 2384848 - RNA, 20 nt, Bordetella pertussis
gucgggcagggugggcacgc

SEQ ID NO: 2384849 - RNA, 19 nt, Bordetella pertussis
gucgggcaguugcuggcgg

SEQ ID NO: 2384850 - RNA, 12 nt, Bordetella pertussis
gucgggccgcgc

SEQ ID NO: 2384851 - RNA, 13 nt, Bordetella pertussis
gucgggcgccgca

SEQ ID NO: 2384852 - RNA, 18 nt, Bordetella pertussis
gucgggcgccgcaacgcc

SEQ ID NO: 2384853 - RNA, 15 nt, Bordetella pertussis
gucgggcgugagcgc

SEQ ID NO: 2384854 - RNA, 12 nt, Bordetella pertussis
gucgggcugcug

SEQ ID NO: 2384855 - RNA, 17 nt, Bordetella pertussis
gucggggcaggccuggu

SEQ ID NO: 2384856 - RNA, 17 nt, Bordetella pertussis
gucggggccgcagcugg

SEQ ID NO: 2384857 - RNA, 14 nt, Bordetella pertussis
gucggggccgggcc

SEQ ID NO: 2384858 - RNA, 15 nt, Bordetella pertussis
gucggggcgccgguc

SEQ ID NO: 2384859 - RNA, 13 nt, Bordetella pertussis
gucgggggccggc

SEQ ID NO: 2384860 - RNA, 17 nt, Bordetella pertussis
gucgggggccggcucgc

SEQ ID NO: 2384861 - RNA, 13 nt, Bordetella pertussis
gucgggggcggcc

SEQ ID NO: 2384862 - RNA, 16 nt, Bordetella pertussis
gucgggggcggccggg

SEQ ID NO: 2384863 - RNA, 14 nt, Bordetella pertussis
gucggggucggcca

SEQ ID NO: 2384864 - RNA, 16 nt, Bordetella pertussis
gucggggugccguucg

SEQ ID NO: 2384865 - RNA, 13 nt, Bordetella pertussis
gucggguccagca

SEQ ID NO: 2384866 - RNA, 22 nt, Bordetella pertussis
gucggguugcccugcgcaucga

SEQ ID NO: 2384867 - RNA, 17 nt, Bordetella pertussis
gucggguugccgcugca

SEQ ID NO: 2384868 - RNA, 21 nt, Bordetella pertussis
gucggucagcacuugccggcc

SEQ ID NO: 2384869 - RNA, 18 nt, Bordetella pertussis
gucggucaucacgcgguc

SEQ ID NO: 2384870 - RNA, 20 nt, Bordetella pertussis
gucggucaugcccaugccgc

SEQ ID NO: 2384871 - RNA, 21 nt, Bordetella pertussis
gucggucugcgugcgcggcgu

SEQ ID NO: 2384872 - RNA, 18 nt, Bordetella pertussis
gucggugaugauccugcu

SEQ ID NO: 2384873 - RNA, 22 nt, Bordetella pertussis
gucggugcacacgccuucggcg

SEQ ID NO: 2384874 - RNA, 14 nt, Bordetella pertussis
gucggugccgucca

SEQ ID NO: 2384875 - RNA, 13 nt, Bordetella pertussis
gucgguggccagc

SEQ ID NO: 2384876 - RNA, 14 nt, Bordetella pertussis
gucgguggccagcc

SEQ ID NO: 2384877 - RNA, 19 nt, Bordetella pertussis
gucgguggccagccaggcg

SEQ ID NO: 2384878 - RNA, 23 nt, Bordetella pertussis
gucgguggccagccaggcggugg

SEQ ID NO: 2384879 - RNA, 19 nt, Bordetella pertussis
gucggugggaaucggcacc

SEQ ID NO: 2384880 - RNA, 15 nt, Bordetella pertussis
gucgguggggcaggu

SEQ ID NO: 2384881 - RNA, 18 nt, Bordetella pertussis
gucgguggggcaggucgc

SEQ ID NO: 2384882 - RNA, 19 nt, Bordetella pertussis
gucgguggggugauggcga

SEQ ID NO: 2384883 - RNA, 14 nt, Bordetella pertussis
gucguacagcgccu

SEQ ID NO: 2384884 - RNA, 19 nt, Bordetella pertussis
gucguacuggugggccgac

SEQ ID NO: 2384885 - RNA, 17 nt, Bordetella pertussis
gucguagaccgccgcgc

SEQ ID NO: 2384886 - RNA, 14 nt, Bordetella pertussis
gucguagcgccagc

SEQ ID NO: 2384887 - RNA, 16 nt, Bordetella pertussis
gucguagcgccagcgu

SEQ ID NO: 2384888 - RNA, 17 nt, Bordetella pertussis
gucguagcgccagcguu

SEQ ID NO: 2384889 - RNA, 18 nt, Bordetella pertussis
gucguagcgcugcagcca

SEQ ID NO: 2384890 - RNA, 13 nt, Bordetella pertussis
gucguagcgggcg

SEQ ID NO: 2384891 - RNA, 14 nt, Bordetella pertussis
gucguagcgggcgg

SEQ ID NO: 2384892 - RNA, 13 nt, Bordetella pertussis
gucguaucgccgc

SEQ ID NO: 2384893 - RNA, 14 nt, Bordetella pertussis
gucgucagcacgcc

SEQ ID NO: 2384894 - RNA, 15 nt, Bordetella pertussis
gucgucagcacgccc

SEQ ID NO: 2384895 - RNA, 14 nt, Bordetella pertussis
gucgucagcgccgc

SEQ ID NO: 2384896 - RNA, 15 nt, Bordetella pertussis
gucgucagcgccgcg

SEQ ID NO: 2384897 - RNA, 18 nt, Bordetella pertussis
gucguccaauucgagcag

SEQ ID NO: 2384898 - RNA, 22 nt, Bordetella pertussis
gucguccacgcccggugccugc

SEQ ID NO: 2384899 - RNA, 13 nt, Bordetella pertussis
gucguccagcacg

SEQ ID NO: 2384900 - RNA, 21 nt, Bordetella pertussis
gucguccagcacgcggcgcag

SEQ ID NO: 2384901 - RNA, 14 nt, Bordetella pertussis
gucguccagcgugg

SEQ ID NO: 2384902 - RNA, 14 nt, Bordetella pertussis
gucguccaggcgca

SEQ ID NO: 2384903 - RNA, 18 nt, Bordetella pertussis
gucguccaucgacgcggc

SEQ ID NO: 2384904 - RNA, 16 nt, Bordetella pertussis
gucgucccagcgcacg

SEQ ID NO: 2384905 - RNA, 18 nt, Bordetella pertussis
gucguccccaauacccgc

SEQ ID NO: 2384906 - RNA, 17 nt, Bordetella pertussis
gucguccguggccggcg

SEQ ID NO: 2384907 - RNA, 22 nt, Bordetella pertussis
gucguccguggccggcgcggca

SEQ ID NO: 2384908 - RNA, 12 nt, Bordetella pertussis
gucguccucggc

SEQ ID NO: 2384909 - RNA, 18 nt, Bordetella pertussis
gucguccucggcacggcc

SEQ ID NO: 2384910 - RNA, 14 nt, Bordetella pertussis
gucguccucggcca

SEQ ID NO: 2384911 - RNA, 15 nt, Bordetella pertussis
gucguccucggccac

SEQ ID NO: 2384912 - RNA, 16 nt, Bordetella pertussis
gucguccugcagcagg

SEQ ID NO: 2384913 - RNA, 12 nt, Bordetella pertussis
gucgucgaaggc

SEQ ID NO: 2384914 - RNA, 21 nt, Bordetella pertussis
gucgucgaaggcgcgcuccag

SEQ ID NO: 2384915 - RNA, 23 nt, Bordetella pertussis
gucgucgaugaugacgaccuugc

SEQ ID NO: 2384916 - RNA, 15 nt, Bordetella pertussis
gucgucgccaccgcc

SEQ ID NO: 2384917 - RNA, 15 nt, Bordetella pertussis
gucgucgccgucgcc

SEQ ID NO: 2384918 - RNA, 15 nt, Bordetella pertussis
gucgucgcuggccca

SEQ ID NO: 2384919 - RNA, 24 nt, Bordetella pertussis
gucgucgcuggcccacucggugcg

SEQ ID NO: 2384920 - RNA, 13 nt, Bordetella pertussis
gucgucggcgcug

SEQ ID NO: 2384921 - RNA, 18 nt, Bordetella pertussis
gucgucggcgcugcagcg

SEQ ID NO: 2384922 - RNA, 17 nt, Bordetella pertussis
gucgucgggcggcgcga

SEQ ID NO: 2384923 - RNA, 16 nt, Bordetella pertussis
gucgucgguggggcag

SEQ ID NO: 2384924 - RNA, 21 nt, Bordetella pertussis
gucgucguagcgggcggcggc

SEQ ID NO: 2384925 - RNA, 22 nt, Bordetella pertussis
gucgucguccacgcccggugcc

SEQ ID NO: 2384926 - RNA, 16 nt, Bordetella pertussis
gucgucguccaggcgc

SEQ ID NO: 2384927 - RNA, 18 nt, Bordetella pertussis
gucgugaucgccagcgcc

SEQ ID NO: 2384928 - RNA, 19 nt, Bordetella pertussis
gucgugaucgccagcgccg

SEQ ID NO: 2384929 - RNA, 13 nt, Bordetella pertussis
gucgugcaggacc

SEQ ID NO: 2384930 - RNA, 19 nt, Bordetella pertussis
gucgugcaggauggcgucg

SEQ ID NO: 2384931 - RNA, 22 nt, Bordetella pertussis
gucgugcaucgugacaugcacg

SEQ ID NO: 2384932 - RNA, 23 nt, Bordetella pertussis
gucgugcccucgggaaacaggcc

SEQ ID NO: 2384933 - RNA, 12 nt, Bordetella pertussis
gucgugcuggcg

SEQ ID NO: 2384934 - RNA, 21 nt, Bordetella pertussis
gucguggcccagccggugcgc

SEQ ID NO: 2384935 - RNA, 23 nt, Bordetella pertussis
gucguggccgugcgaggcgaaca

SEQ ID NO: 2384936 - RNA, 16 nt, Bordetella pertussis
gucguggcgauagcgc

SEQ ID NO: 2384937 - RNA, 20 nt, Bordetella pertussis
gucguggcgauagcgcucca

SEQ ID NO: 2384938 - RNA, 15 nt, Bordetella pertussis
gucguggcugaccag

SEQ ID NO: 2384939 - RNA, 23 nt, Bordetella pertussis
gucguggcugaccagcagcaccg

SEQ ID NO: 2384940 - RNA, 14 nt, Bordetella pertussis
gucguggggcgcgg

SEQ ID NO: 2384941 - RNA, 20 nt, Bordetella pertussis
gucguggggcgcggcggcgu

SEQ ID NO: 2384942 - RNA, 21 nt, Bordetella pertussis
gucguggggcgcggcggcguu

SEQ ID NO: 2384943 - RNA, 13 nt, Bordetella pertussis
gucguggucgaca

SEQ ID NO: 2384944 - RNA, 20 nt, Bordetella pertussis
gucguggucgucccgcagua

SEQ ID NO: 2384945 - RNA, 22 nt, Bordetella pertussis
gucguuccagaacggcgcggga

SEQ ID NO: 2384946 - RNA, 17 nt, Bordetella pertussis
gucguucggcugagcuc

SEQ ID NO: 2384947 - RNA, 19 nt, Bordetella pertussis
gucguucugcguggcggcg

SEQ ID NO: 2384948 - RNA, 23 nt, Bordetella pertussis
gucguugacggggacgccggcgg

SEQ ID NO: 2384949 - RNA, 22 nt, Bordetella pertussis
gucguugccccgauccgcgggc

SEQ ID NO: 2384950 - RNA, 19 nt, Bordetella pertussis
gucguugccggccagcacg

SEQ ID NO: 2384951 - RNA, 20 nt, Bordetella pertussis
gucguugccggccagcacgg

SEQ ID NO: 2384952 - RNA, 21 nt, Bordetella pertussis
gucguugcgccgaucgcggcu

SEQ ID NO: 2384953 - RNA, 16 nt, Bordetella pertussis
gucguugcgcgaagcg

SEQ ID NO: 2384954 - RNA, 16 nt, Bordetella pertussis
gucguuucccagcaag

SEQ ID NO: 2384955 - RNA, 17 nt, Bordetella pertussis
gucuacgccaugagcgc

SEQ ID NO: 2384956 - RNA, 19 nt, Bordetella pertussis
gucuaucauggccuuggca

SEQ ID NO: 2384957 - RNA, 16 nt, Bordetella pertussis
gucuaugucgaggacc

SEQ ID NO: 2384958 - RNA, 23 nt, Bordetella pertussis
gucuccacgaagucgaaccagcc

SEQ ID NO: 2384959 - RNA, 16 nt, Bordetella pertussis
gucuccacgccgccga

SEQ ID NO: 2384960 - RNA, 15 nt, Bordetella pertussis
gucuccagcgccggc

SEQ ID NO: 2384961 - RNA, 20 nt, Bordetella pertussis
gucuccagcgccggcagccc

SEQ ID NO: 2384962 - RNA, 15 nt, Bordetella pertussis
gucuccagcgcggcg

SEQ ID NO: 2384963 - RNA, 21 nt, Bordetella pertussis
gucuccagcgcggcggacugc

SEQ ID NO: 2384964 - RNA, 19 nt, Bordetella pertussis
gucuccaggcucaggcggc

SEQ ID NO: 2384965 - RNA, 17 nt, Bordetella pertussis
gucucccccucggccug

SEQ ID NO: 2384966 - RNA, 18 nt, Bordetella pertussis
gucucccccucggccugc

SEQ ID NO: 2384967 - RNA, 20 nt, Bordetella pertussis
gucucccccucggccugcgc

SEQ ID NO: 2384968 - RNA, 15 nt, Bordetella pertussis
gucucccggcaugau

SEQ ID NO: 2384969 - RNA, 18 nt, Bordetella pertussis
gucuccgguucggcgcgg

SEQ ID NO: 2384970 - RNA, 12 nt, Bordetella pertussis
gucucgaacgcc

SEQ ID NO: 2384971 - RNA, 15 nt, Bordetella pertussis
gucucgaacgccgcg

SEQ ID NO: 2384972 - RNA, 19 nt, Bordetella pertussis
gucucgcccaggcccagca

SEQ ID NO: 2384973 - RNA, 20 nt, Bordetella pertussis
gucucgcccaugaucagggc

SEQ ID NO: 2384974 - RNA, 19 nt, Bordetella pertussis
gucucgcgcgccaggugca

SEQ ID NO: 2384975 - RNA, 13 nt, Bordetella pertussis
gucucgcgcggcc

SEQ ID NO: 2384976 - RNA, 14 nt, Bordetella pertussis
gucucgggcugggu

SEQ ID NO: 2384977 - RNA, 22 nt, Bordetella pertussis
gucucguccacccccgucagca

SEQ ID NO: 2384978 - RNA, 21 nt, Bordetella pertussis
gucucguuccagaugcgcagc

SEQ ID NO: 2384979 - RNA, 19 nt, Bordetella pertussis
gucugcaagguggcgugca

SEQ ID NO: 2384980 - RNA, 14 nt, Bordetella pertussis
gucugcaccggcuu

SEQ ID NO: 2384981 - RNA, 16 nt, Bordetella pertussis
gucugcaccggcuugu

SEQ ID NO: 2384982 - RNA, 22 nt, Bordetella pertussis
gucugcaccggcuugucgacca

SEQ ID NO: 2384983 - RNA, 16 nt, Bordetella pertussis
gucugcacgcugaacg

SEQ ID NO: 2384984 - RNA, 19 nt, Bordetella pertussis
gucugccacaucacgccgg

SEQ ID NO: 2384985 - RNA, 15 nt, Bordetella pertussis
gucugcccgcggucc

SEQ ID NO: 2384986 - RNA, 20 nt, Bordetella pertussis
gucugcccgcgguccagcac

SEQ ID NO: 2384987 - RNA, 16 nt, Bordetella pertussis
gucugcccgugcgugc

SEQ ID NO: 2384988 - RNA, 15 nt, Bordetella pertussis
gucugccuggcgaac

SEQ ID NO: 2384989 - RNA, 22 nt, Bordetella pertussis
gucugcgccuuccgggcgaccc

SEQ ID NO: 2384990 - RNA, 23 nt, Bordetella pertussis
gucugcgcgaugagcuggcgcag

SEQ ID NO: 2384991 - RNA, 13 nt, Bordetella pertussis
gucugcgugcgcg

SEQ ID NO: 2384992 - RNA, 17 nt, Bordetella pertussis
gucugcgugcgcggcgu

SEQ ID NO: 2384993 - RNA, 19 nt, Bordetella pertussis
gucugcgugugccgccagc

SEQ ID NO: 2384994 - RNA, 20 nt, Bordetella pertussis
gucugcgugugccgccagcg

SEQ ID NO: 2384995 - RNA, 16 nt, Bordetella pertussis
gucugcuacaccgugc

SEQ ID NO: 2384996 - RNA, 20 nt, Bordetella pertussis
gucugcuacaccgugcuggc

SEQ ID NO: 2384997 - RNA, 22 nt, Bordetella pertussis
gucugcuacaccgugcuggccg

SEQ ID NO: 2384998 - RNA, 19 nt, Bordetella pertussis
gucugcugguacagcccca

SEQ ID NO: 2384999 - RNA, 20 nt, Bordetella pertussis
gucugcugguacagccccag

SEQ ID NO: 2385000 - RNA, 20 nt, Bordetella pertussis
gucugcuggucgcgggccag

SEQ ID NO: 2385001 - RNA, 16 nt, Bordetella pertussis
gucugcuucauccagg

SEQ ID NO: 2385002 - RNA, 13 nt, Bordetella pertussis
gucuggaggacga

SEQ ID NO: 2385003 - RNA, 20 nt, Bordetella pertussis
gucuggaggacgagcgggug

SEQ ID NO: 2385004 - RNA, 20 nt, Bordetella pertussis
gucuggcacgcuugccgcaa

SEQ ID NO: 2385005 - RNA, 16 nt, Bordetella pertussis
gucuggcccacgcgca

SEQ ID NO: 2385006 - RNA, 18 nt, Bordetella pertussis
gucuggcccacgcgcacg

SEQ ID NO: 2385007 - RNA, 12 nt, Bordetella pertussis
gucuggcggccg

SEQ ID NO: 2385008 - RNA, 15 nt, Bordetella pertussis
gcuggcgcgccaggc

SEQ ID NO: 2385009 - RNA, 14 nt, Bordetella pertussis
gcuggcgcgccgcc

SEQ ID NO: 2385010 - RNA, 22 nt, Bordetella pertussis
gcuggcgcgccgccucgcgcuc

SEQ ID NO: 2385011 - RNA, 24 nt, Bordetella pertussis
gcuggcgcgccgccucgcgcucca

SEQ ID NO: 2385012 - RNA, 12 nt, Bordetella pertussis
gcuggcgcgcug

SEQ ID NO: 2385013 - RNA, 15 nt, Bordetella pertussis
gcuggcgcggaccug

SEQ ID NO: 2385014 - RNA, 12 nt, Bordetella pertussis
gcuggcgcggcc

SEQ ID NO: 2385015 - RNA, 17 nt, Bordetella pertussis
gcuggcgcggccguuug

SEQ ID NO: 2385016 - RNA, 12 nt, Bordetella pertussis
gcuggcgcggcu

SEQ ID NO: 2385017 - RNA, 13 nt, Bordetella pertussis
gcuggcgcggcug

SEQ ID NO: 2385018 - RNA, 14 nt, Bordetella pertussis
gcuggcgcggcugg

SEQ ID NO: 2385019 - RNA, 22 nt, Bordetella pertussis
gcuggcgcggcuggcgauggug

SEQ ID NO: 2385020 - RNA, 20 nt, Bordetella pertussis
gcuggcgcgucggcgcgcgc

SEQ ID NO: 2385021 - RNA, 14 nt, Bordetella pertussis
gcuggcgcgucugg

SEQ ID NO: 2385022 - RNA, 22 nt, Bordetella pertussis
gcuggcgcguugcgcaucgcgc

SEQ ID NO: 2385023 - RNA, 23 nt, Bordetella pertussis
gcuggcgcguugcgcaucgcgca

SEQ ID NO: 2385024 - RNA, 20 nt, Bordetella pertussis
gcuggcgcucgggcgcggca

SEQ ID NO: 2385025 - RNA, 15 nt, Bordetella pertussis
gcuggcgcuuggcca

SEQ ID NO: 2385026 - RNA, 19 nt, Bordetella pertussis
gcuggcggacacgcccugg

SEQ ID NO: 2385027 - RNA, 22 nt, Bordetella pertussis
gcuggcggacacgcccuggccg

SEQ ID NO: 2385028 - RNA, 22 nt, Bordetella pertussis
gcuggcggaccgaacggccggu

SEQ ID NO: 2385029 - RNA, 14 nt, Bordetella pertussis
gcuggcggcccugc

SEQ ID NO: 2385030 - RNA, 15 nt, Bordetella pertussis
gcuggcggcccugcc

SEQ ID NO: 2385031 - RNA, 12 nt, Bordetella pertussis
gcuggcggcgca

SEQ ID NO: 2385032 - RNA, 14 nt, Bordetella pertussis
gcuggcggcgcagc

SEQ ID NO: 2385033 - RNA, 15 nt, Bordetella pertussis
gcuggcggcgcagca

SEQ ID NO: 2385034 - RNA, 20 nt, Bordetella pertussis
gcuggcggcgcagcaccagg

SEQ ID NO: 2385035 - RNA, 15 nt, Bordetella pertussis
gcuggcggcgcaggc

SEQ ID NO: 2385036 - RNA, 17 nt, Bordetella pertussis
gcuggcggcgcaggccg

SEQ ID NO: 2385037 - RNA, 18 nt, Bordetella pertussis
gcuggcggcgcaggccgc

SEQ ID NO: 2385038 - RNA, 17 nt, Bordetella pertussis
gcuggcggcgcgcggcu

SEQ ID NO: 2385039 - RNA, 14 nt, Bordetella pertussis
gcuggcggcgcgcu

SEQ ID NO: 2385040 - RNA, 15 nt, Bordetella pertussis
gcuggcggcgcuggu

SEQ ID NO: 2385041 - RNA, 20 nt, Bordetella pertussis
gcuggcggugcgugcgccca

SEQ ID NO: 2385042 - RNA, 23 nt, Bordetella pertussis
gcuggcguccagccugcccgggc

SEQ ID NO: 2385043 - RNA, 14 nt, Bordetella pertussis
gcuggcguccaggu

SEQ ID NO: 2385044 - RNA, 22 nt, Bordetella pertussis
gcuggcgucgcgcuucuugucc

SEQ ID NO: 2385045 - RNA, 17 nt, Bordetella pertussis
gcuggcguucagcgggc

SEQ ID NO: 2385046 - RNA, 20 nt, Bordetella pertussis
gcuggcguucagcgggcgcg

SEQ ID NO: 2385047 - RNA, 22 nt, Bordetella pertussis
gcuggcguugacguggcugagc

SEQ ID NO: 2385048 - RNA, 23 nt, Bordetella pertussis
gcuggcguugcgguagcgcaagc

SEQ ID NO: 2385049 - RNA, 18 nt, Bordetella pertussis
gcuggcguuugcgcgcgc

SEQ ID NO: 2385050 - RNA, 23 nt, Bordetella pertussis
gcuggcguuugcgcgcgcgcugg

SEQ ID NO: 2385051 - RNA, 20 nt, Bordetella pertussis
gcuggcucguucgcucggcg

SEQ ID NO: 2385052 - RNA, 17 nt, Bordetella pertussis
gcuggcugagcaggccg

SEQ ID NO: 2385053 - RNA, 14 nt, Bordetella pertussis
gcuggcugcccugg

SEQ ID NO: 2385054 - RNA, 18 nt, Bordetella pertussis
gcuggcugcccuggcgcu

SEQ ID NO: 2385055 - RNA, 17 nt, Bordetella pertussis
gcuggcugggccugcug

SEQ ID NO: 2385056 - RNA, 22 nt, Bordetella pertussis
gcuggcugggccugcugucgcu

SEQ ID NO: 2385057 - RNA, 18 nt, Bordetella pertussis
gcuggcuguucgccaugu

SEQ ID NO: 2385058 - RNA, 23 nt, Bordetella pertussis
gcuggcuguucgccauguucagc

SEQ ID NO: 2385059 - RNA, 19 nt, Bordetella pertussis
gcuggcuucggcgcugggc

SEQ ID NO: 2385060 - RNA, 22 nt, Bordetella pertussis
gcuggcuucggcgcugggcgca

SEQ ID NO: 2385061 - RNA, 23 nt, Bordetella pertussis
gcuggcuucggcgcugggcgcau

SEQ ID NO: 2385062 - RNA, 21 nt, Bordetella pertussis
gcugggacaggcacaccgguc

SEQ ID NO: 2385063 - RNA, 16 nt, Bordetella pertussis
gcugggacaggcacuc

SEQ ID NO: 2385064 - RNA, 20 nt, Bordetella pertussis
gcugggacaggcacucugcc

SEQ ID NO: 2385065 - RNA, 17 nt, Bordetella pertussis
gcugggagagccggcca

SEQ ID NO: 2385066 - RNA, 18 nt, Bordetella pertussis
gcugggagagccggccac

SEQ ID NO: 2385067 - RNA, 19 nt, Bordetella pertussis
gcugggagagccggccacg

SEQ ID NO: 2385068 - RNA, 20 nt, Bordetella pertussis
gcugggauggguacgccggc

SEQ ID NO: 2385069 - RNA, 22 nt, Bordetella pertussis
gcugggauggguacgccggccu

SEQ ID NO: 2385070 - RNA, 23 nt, Bordetella pertussis
gcugggauggguacgccggccug

SEQ ID NO: 2385071 - RNA, 20 nt, Bordetella pertussis
ggacgucugagcgccggggu

SEQ ID NO: 2385072 - RNA, 14 nt, Bordetella pertussis
ggacgugcgcgacc

SEQ ID NO: 2385073 - RNA, 17 nt, Bordetella pertussis
ggacguguugccaggcg

SEQ ID NO: 2385074 - RNA, 20 nt, Bordetella pertussis
ggacucgauggcgcaggcgc

SEQ ID NO: 2385075 - RNA, 21 nt, Bordetella pertussis
ggacucguccauggugggcag

SEQ ID NO: 2385076 - RNA, 17 nt, Bordetella pertussis
ggacugaacgcguccag

SEQ ID NO: 2385077 - RNA, 22 nt, Bordetella pertussis
ggacugaacgcguccaggcccu

SEQ ID NO: 2385078 - RNA, 14 nt, Bordetella pertussis
ggacuggcacccgc

SEQ ID NO: 2385079 - RNA, 15 nt, Bordetella pertussis
ggacuggcaccggcc

SEQ ID NO: 2385080 - RNA, 17 nt, Bordetella pertussis
ggacuggcaccugcaag

SEQ ID NO: 2385081 - RNA, 13 nt, Bordetella pertussis
ggacuggccgcga

SEQ ID NO: 2385082 - RNA, 13 nt, Bordetella pertussis
ggacuggccgcgc

SEQ ID NO: 2385083 - RNA, 17 nt, Bordetella pertussis
ggacuggcucccaccgg

SEQ ID NO: 2385084 - RNA, 16 nt, Bordetella pertussis
ggacuggcucccgcug

SEQ ID NO: 2385085 - RNA, 17 nt, Bordetella pertussis
ggacuggcuggucaggc

SEQ ID NO: 2385086 - RNA, 15 nt, Bordetella pertussis
ggacuguccggcaac

SEQ ID NO: 2385087 - RNA, 13 nt, Bordetella pertussis
ggacuucgcccgg

SEQ ID NO: 2385088 - RNA, 19 nt, Bordetella pertussis
ggacuucgucgaucauggc

SEQ ID NO: 2385089 - RNA, 21 nt, Bordetella pertussis
ggacuucgucgaucauggcgc

SEQ ID NO: 2385090 - RNA, 14 nt, Bordetella pertussis
ggagaaaucgccgc

SEQ ID NO: 2385091 - RNA, 19 nt, Bordetella pertussis
ggagaaaucgccgccggcg

SEQ ID NO: 2385092 - RNA, 17 nt, Bordetella pertussis
ggagaagcgccgcgccg

SEQ ID NO: 2385093 - RNA, 13 nt, Bordetella pertussis
ggagaccggcaug

SEQ ID NO: 2385094 - RNA, 16 nt, Bordetella pertussis
ggagaccggcgccugc

SEQ ID NO: 2385095 - RNA, 17 nt, Bordetella pertussis
ggagaccggguugcccg

SEQ ID NO: 2385096 - RNA, 22 nt, Bordetella pertussis
ggagaccggguugcccggcagg

SEQ ID NO: 2385097 - RNA, 19 nt, Bordetella pertussis
ggagacuggcaccggccaa

SEQ ID NO: 2385098 - RNA, 17 nt, Bordetella pertussis
ggagagccggccacgcg

SEQ ID NO: 2385099 - RNA, 20 nt, Bordetella pertussis
ggagagccggccacgcgcug

SEQ ID NO: 2385100 - RNA, 14 nt, Bordetella pertussis
ggagaguucaucca

SEQ ID NO: 2385101 - RNA, 22 nt, Bordetella pertussis
ggagaguucggugucggcgucc

SEQ ID NO: 2385102 - RNA, 14 nt, Bordetella pertussis
ggagauacuggccg

SEQ ID NO: 2385103 - RNA, 17 nt, Bordetella pertussis
ggagaucaugaccacgu

SEQ ID NO: 2385104 - RNA, 22 nt, Bordetella pertussis
ggagauccggccuuccaaguug

SEQ ID NO: 2385105 - RNA, 15 nt, Bordetella pertussis
ggagaucgccgagcg

SEQ ID NO: 2385106 - RNA, 17 nt, Bordetella pertussis
ggagcaacuggggcgcu

SEQ ID NO: 2385107 - RNA, 13 nt, Bordetella pertussis
ggagcagcagcgg

SEQ ID NO: 2385108 - RNA, 15 nt, Bordetella pertussis
ggagcagcagcgggc

SEQ ID NO: 2385109 - RNA, 20 nt, Bordetella pertussis
ggagcauggcaugagcgccu

SEQ ID NO: 2385110 - RNA, 15 nt, Bordetella pertussis
ggagccaggcggcgu

SEQ ID NO: 2385111 - RNA, 19 nt, Bordetella pertussis
ggagccaguccccgcaggg

SEQ ID NO: 2385112 - RNA, 21 nt, Bordetella pertussis
ggagccaguccccgcagggac

SEQ ID NO: 2385113 - RNA, 15 nt, Bordetella pertussis
ggagcccgcugccga

SEQ ID NO: 2385114 - RNA, 13 nt, Bordetella pertussis
ggagccgcgcaca

SEQ ID NO: 2385115 - RNA, 20 nt, Bordetella pertussis
ggagccgcgcacacauggcg

SEQ ID NO: 2385116 - RNA, 17 nt, Bordetella pertussis
ggagccggagcagucgc

SEQ ID NO: 2385117 - RNA, 19 nt, Bordetella pertussis
ggagccggcgggcggcugc

SEQ ID NO: 2385118 - RNA, 13 nt, Bordetella pertussis
ggagccguucugg

SEQ ID NO: 2385119 - RNA, 15 nt, Bordetella pertussis
ggagccuguccccgc

SEQ ID NO: 2385120 - RNA, 21 nt, Bordetella pertussis
ggagccuguccccgccggggc

SEQ ID NO: 2385121 - RNA, 16 nt, Bordetella pertussis
ggagcgacacccgcgg

SEQ ID NO: 2385122 - RNA, 21 nt, Bordetella pertussis
ggagcgacccguggcccgggu

SEQ ID NO: 2385123 - RNA, 19 nt, Bordetella pertussis
ggagcgccgucucgugccc

SEQ ID NO: 2385124 - RNA, 11 nt, Bordetella pertussis
ggagcgcggcg

SEQ ID NO: 2385125 - RNA, 15 nt, Bordetella pertussis
ggagcgcggcgcugg

SEQ ID NO: 2385126 - RNA, 17 nt, Bordetella pertussis
ggagcgcggcgcuggcg

SEQ ID NO: 2385127 - RNA, 12 nt, Bordetella pertussis
ggagcgcgggcc

SEQ ID NO: 2385128 - RNA, 13 nt, Bordetella pertussis
ggagcgcgggccg

SEQ ID NO: 2385129 - RNA, 13 nt, Bordetella pertussis
ggagcggccagca

SEQ ID NO: 2385130 - RNA, 15 nt, Bordetella pertussis
ggagcggccagcaag

SEQ ID NO: 2385131 - RNA, 22 nt, Bordetella pertussis
ggagcggcucgccgcuccggca

SEQ ID NO: 2385132 - RNA, 20 nt, Bordetella pertussis
ggagcgguugaaauccuuca

SEQ ID NO: 2385133 - RNA, 16 nt, Bordetella pertussis
ggagcugcacaagguc

SEQ ID NO: 2385134 - RNA, 21 nt, Bordetella pertussis
ggagcugcugugcgccggggc

SEQ ID NO: 2385135 - RNA, 23 nt, Bordetella pertussis
ggaggaagggugcggcgccacug

SEQ ID NO: 2385136 - RNA, 23 nt, Bordetella pertussis
ggaggacgccgaccucggcaccg

SEQ ID NO: 2385137 - RNA, 12 nt, Bordetella pertussis
ggaggagguggc

SEQ ID NO: 2385138 - RNA, 14 nt, Bordetella pertussis
ggaggagguggcug

SEQ ID NO: 2385139 - RNA, 23 nt, Bordetella pertussis
ggaggcacuccgucauggcgccg

SEQ ID NO: 2385140 - RNA, 14 nt, Bordetella pertussis
ggaggccgagcgcg

SEQ ID NO: 2385141 - RNA, 13 nt, Bordetella pertussis
ggaggcgccgcgg

SEQ ID NO: 2385142 - RNA, 17 nt, Bordetella pertussis
ggaggcgcgcagcuccg

SEQ ID NO: 2385143 - RNA, 14 nt, Bordetella pertussis
ggaggcggccgcgg

SEQ ID NO: 2385144 - RNA, 21 nt, Bordetella pertussis
ggaggcggcgcgugaugucga

SEQ ID NO: 2385145 - RNA, 15 nt, Bordetella pertussis
ggaggcggcggccgu

SEQ ID NO: 2385146 - RNA, 23 nt, Bordetella pertussis
ggaggcuuugucguugauggggc

SEQ ID NO: 2385147 - RNA, 23 nt, Bordetella pertussis
ggaggcuuuguggcgucgggggc

SEQ ID NO: 2385148 - RNA, 16 nt, Bordetella pertussis
ggagggcuccaggcug

SEQ ID NO: 2385149 - RNA, 14 nt, Bordetella pertussis
ggaggggccggcuu

SEQ ID NO: 2385150 - RNA, 13 nt, Bordetella pertussis
ggaggggcgcagg

SEQ ID NO: 2385151 - RNA, 14 nt, Bordetella pertussis
ggaggggcgcaggc

SEQ ID NO: 2385152 - RNA, 21 nt, Bordetella pertussis
ggagguaugcacgaccaggcc

SEQ ID NO: 2385153 - RNA, 23 nt, Bordetella pertussis
ggagguaugcacgaccaggccgu

SEQ ID NO: 2385154 - RNA, 22 nt, Bordetella pertussis
ggagguggcuggugccaguccc

SEQ ID NO: 2385155 - RNA, 16 nt, Bordetella pertussis
ggagguugcccgcccg

SEQ ID NO: 2385156 - RNA, 23 nt, Bordetella pertussis
ggagguugcccgcccgacgagga

SEQ ID NO: 2385157 - RNA, 15 nt, Bordetella pertussis
ggagucggucagccu

SEQ ID NO: 2385158 - RNA, 17 nt, Bordetella pertussis
ggagucgugcaggaugg

SEQ ID NO: 2385159 - RNA, 22 nt, Bordetella pertussis
ggauaacaucaugggcgaagcc

SEQ ID NO: 2385160 - RNA, 19 nt, Bordetella pertussis
ggauaccgcuggccaggcu

SEQ ID NO: 2385161 - RNA, 16 nt, Bordetella pertussis
ggauaccggagcggcu

SEQ ID NO: 2385162 - RNA, 17 nt, Bordetella pertussis
ggauagaguucggcgcg

SEQ ID NO: 2385163 - RNA, 18 nt, Bordetella pertussis
ggauagcggugcaggggc

SEQ ID NO: 2385164 - RNA, 18 nt, Bordetella pertussis
ggauaggccucggccacc

SEQ ID NO: 2385165 - RNA, 19 nt, Bordetella pertussis
ggauauccacgccuucggc

SEQ ID NO: 2385166 - RNA, 17 nt, Bordetella pertussis
ggauaucggccaggcgc

SEQ ID NO: 2385167 - RNA, 17 nt, Bordetella pertussis
ggaucaccgccggcggc

SEQ ID NO: 2385168 - RNA, 19 nt, Bordetella pertussis
ggaucacgggaaugaagcg

SEQ ID NO: 2385169 - RNA, 16 nt, Bordetella pertussis
ggaucacgugccagcc

SEQ ID NO: 2385170 - RNA, 19 nt, Bordetella pertussis
ggaucagcuugaugccggc

SEQ ID NO: 2385171 - RNA, 17 nt, Bordetella pertussis
ggaucaggaugggcgcg

SEQ ID NO: 2385172 - RNA, 20 nt, Bordetella pertussis
ggaucaggaugggcgcggcg

SEQ ID NO: 2385173 - RNA, 14 nt, Bordetella pertussis
ggaucaggccggcg

SEQ ID NO: 2385174 - RNA, 20 nt, Bordetella pertussis
ggaucaugucguccucggcc

SEQ ID NO: 2385175 - RNA, 14 nt, Bordetella pertussis
ggauccacgccgcc

SEQ ID NO: 2385176 - RNA, 15 nt, Bordetella pertussis
ggauccagccaugga

SEQ ID NO: 2385177 - RNA, 13 nt, Bordetella pertussis
ggauccagccgcu

SEQ ID NO: 2385178 - RNA, 14 nt, Bordetella pertussis
ggauccagccgcuc

SEQ ID NO: 2385179 - RNA, 11 nt, Bordetella pertussis
ggauccagcug

SEQ ID NO: 2385180 - RNA, 14 nt, Bordetella pertussis
ggaucccaggccgg

SEQ ID NO: 2385181 - RNA, 23 nt, Bordetella pertussis
ggaucccgagcgggcaugggccc

SEQ ID NO: 2385182 - RNA, 15 nt, Bordetella pertussis
ggaucccggcgauca

SEQ ID NO: 2385183 - RNA, 13 nt, Bordetella pertussis
ggaucccggcgcc

SEQ ID NO: 2385184 - RNA, 21 nt, Bordetella pertussis
ggauccgccggugucggggcc

SEQ ID NO: 2385185 - RNA, 13 nt, Bordetella pertussis
ggauccggcgcug

SEQ ID NO: 2385186 - RNA, 17 nt, Bordetella pertussis
ggauccggcgcuggcgc

SEQ ID NO: 2385187 - RNA, 14 nt, Bordetella pertussis
ggauccgugcggcg

SEQ ID NO: 2385188 - RNA, 16 nt, Bordetella pertussis
ggauccugcggcgcgg

SEQ ID NO: 2385189 - RNA, 16 nt, Bordetella pertussis
ggaucgaaaccggcgc

SEQ ID NO: 2385190 - RNA, 17 nt, Bordetella pertussis
ggaucgaaaccggcgcg

SEQ ID NO: 2385191 - RNA, 23 nt, Bordetella pertussis
ggaucgaaaccggcgcgcgcggc

SEQ ID NO: 2385192 - RNA, 18 nt, Bordetella pertussis
ggaucgaaggcagcgcgg

SEQ ID NO: 2385193 - RNA, 19 nt, Bordetella pertussis
ggaucgaaggcagcgcggc

SEQ ID NO: 2385194 - RNA, 23 nt, Bordetella pertussis
ggaucgacugccccauggcaugc

SEQ ID NO: 2385195 - RNA, 21 nt, Bordetella pertussis
ggaucgcacacaccgcgucau

SEQ ID NO: 2385196 - RNA, 20 nt, Bordetella pertussis
ggaucgccgguagcgcuggg

SEQ ID NO: 2385197 - RNA, 15 nt, Bordetella pertussis
ggaucgcgccaggcg

SEQ ID NO: 2385198 - RNA, 16 nt, Bordetella pertussis
ggaucgcgccaggcgu

SEQ ID NO: 2385199 - RNA, 15 nt, Bordetella pertussis
ggaucgcggccagcc

SEQ ID NO: 2385200 - RNA, 17 nt, Bordetella pertussis
ggaucgcggccagccgg

SEQ ID NO: 2385201 - RNA, 16 nt, Bordetella pertussis
ggaucgcggccagcgg

SEQ ID NO: 2385202 - RNA, 17 nt, Bordetella pertussis
ggaucgcggccagcggc

SEQ ID NO: 2385203 - RNA, 15 nt, Bordetella pertussis
ggaucggccaggccg

SEQ ID NO: 2385204 - RNA, 16 nt, Bordetella pertussis
ggaucggccaggccgg

SEQ ID NO: 2385205 - RNA, 13 nt, Bordetella pertussis
ggaucggccggca

SEQ ID NO: 2385206 - RNA, 19 nt, Bordetella pertussis
ggaucggccggcagcgcga

SEQ ID NO: 2385207 - RNA, 19 nt, Bordetella pertussis
ggaucggcgucagcgccca

SEQ ID NO: 2385208 - RNA, 16 nt, Bordetella pertussis
ggaucgggcagcuugg

SEQ ID NO: 2385209 - RNA, 22 nt, Bordetella pertussis
ggaucgggcagcuuggcgcgcc

SEQ ID NO: 2385210 - RNA, 14 nt, Bordetella pertussis
ggaucgucccaggu

SEQ ID NO: 2385211 - RNA, 14 nt, Bordetella pertussis
ggaucgugcccagc

SEQ ID NO: 2385212 - RNA, 14 nt, Bordetella pertussis
ggaucucggccagc

SEQ ID NO: 2385213 - RNA, 15 nt, Bordetella pertussis
ggaucucggccagca

SEQ ID NO: 2385214 - RNA, 22 nt, Bordetella pertussis
ggaucugcgagccuucggccgg

SEQ ID NO: 2385215 - RNA, 21 nt, Bordetella pertussis
ggaucugguagugcaggccgc

SEQ ID NO: 2385216 - RNA, 21 nt, Bordetella pertussis
ggaugaacagcgagaagcaac

SEQ ID NO: 2385217 - RNA, 21 nt, Bordetella pertussis
ggaugaagggcuggccggcca

SEQ ID NO: 2385218 - RNA, 17 nt, Bordetella pertussis
ggaugaccugcgccagg

SEQ ID NO: 2385219 - RNA, 21 nt, Bordetella pertussis
ggaugaccugcgccaggugcu

SEQ ID NO: 2385220 - RNA, 17 nt, Bordetella pertussis
ggaugacucgggcaugc

SEQ ID NO: 2385221 - RNA, 20 nt, Bordetella pertussis
ggaugaugcggcgccacgca

SEQ ID NO: 2385222 - RNA, 19 nt, Bordetella pertussis
ggaugcacguagcgcagca

SEQ ID NO: 2385223 - RNA, 15 nt, Bordetella pertussis
ggaugccccgcccgc

SEQ ID NO: 2385224 - RNA, 17 nt, Bordetella pertussis
ggaugccccgcccgcgu

SEQ ID NO: 2385225 - RNA, 22 nt, Bordetella pertussis
ggaugcccgggguugccaagau

SEQ ID NO: 2385226 - RNA, 17 nt, Bordetella pertussis
ggaugcccuggguggcg

SEQ ID NO: 2385227 - RNA, 21 nt, Bordetella pertussis
ggaugcccuuggcggcgaucg

SEQ ID NO: 2385228 - RNA, 20 nt, Bordetella pertussis
ggaugccguaggugcgcgcc

SEQ ID NO: 2385229 - RNA, 23 nt, Bordetella pertussis
ggaugccguccacgccgcgcgcg

SEQ ID NO: 2385230 - RNA, 23 nt, Bordetella pertussis
ggaugcgagcaaaggacacgcgc

SEQ ID NO: 2385231 - RNA, 21 nt, Bordetella pertussis
ggaugcgcaccggccaggggc

SEQ ID NO: 2385232 - RNA, 22 nt, Bordetella pertussis
ggaugcgcgccaggcugucguc

SEQ ID NO: 2385233 - RNA, 15 nt, Bordetella pertussis
ggaugcgcgcggcca

SEQ ID NO: 2385234 - RNA, 12 nt, Bordetella pertussis
ggaugcgcggca

SEQ ID NO: 2385235 - RNA, 14 nt, Bordetella pertussis
ggaugcgcggcacg

SEQ ID NO: 2385236 - RNA, 20 nt, Bordetella pertussis
ggaugcgguacugcggcgcc

SEQ ID NO: 2385237 - RNA, 23 nt, Bordetella pertussis
ggaugcguucgaaagccagcgcc

SEQ ID NO: 2385238 - RNA, 14 nt, Bordetella pertussis
ggauggacuggccg

SEQ ID NO: 2385239 - RNA, 17 nt, Bordetella pertussis
ggauggaugccgucggc

SEQ ID NO: 2385240 - RNA, 23 nt, Bordetella pertussis
ggauggccacgaccaccagcguc

SEQ ID NO: 2385241 - RNA, 18 nt, Bordetella pertussis
ggauggccugcucgccca

SEQ ID NO: 2385242 - RNA, 14 nt, Bordetella pertussis
ggauggcgaacaug

SEQ ID NO: 2385243 - RNA, 12 nt, Bordetella pertussis
ggauggcgcgga

SEQ ID NO: 2385244 - RNA, 23 nt, Bordetella pertussis
ggauggcgcggaugaccugcgcc

SEQ ID NO: 2385245 - RNA, 11 nt, Bordetella pertussis
ggauggcggcc

SEQ ID NO: 2385246 - RNA, 15 nt, Bordetella pertussis
ggauggcggccgcca

SEQ ID NO: 2385247 - RNA, 20 nt, Bordetella pertussis
ggauggcggccgccagcgcc

SEQ ID NO: 2385248 - RNA, 13 nt, Bordetella pertussis
ggauggcguaugg

SEQ ID NO: 2385249 - RNA, 17 nt, Bordetella pertussis
ggauggcucgggcagca

SEQ ID NO: 2385250 - RNA, 20 nt, Bordetella pertussis
ggauggcucgggcagcagca

SEQ ID NO: 2385251 - RNA, 18 nt, Bordetella pertussis
ggauggcuuccugcggca

SEQ ID NO: 2385252 - RNA, 19 nt, Bordetella pertussis
ggaugggcgcggcgcgcgc

SEQ ID NO: 2385253 - RNA, 12 nt, Bordetella pertussis
ggaugggcggcc

SEQ ID NO: 2385254 - RNA, 12 nt, Bordetella pertussis
ggauggguacgc

SEQ ID NO: 2385255 - RNA, 19 nt, Bordetella pertussis
ggaugguagaugcgcgcga

SEQ ID NO: 2385256 - RNA, 14 nt, Bordetella pertussis
ggauggucacgccc

SEQ ID NO: 2385257 - RNA, 14 nt, Bordetella pertussis
ggauggucgugcgg

SEQ ID NO: 2385258 - RNA, 18 nt, Bordetella pertussis
ggauggugccgccgcccg

SEQ ID NO: 2385259 - RNA, 15 nt, Bordetella pertussis
ggauggugcucggcg

SEQ ID NO: 2385260 - RNA, 14 nt, Bordetella pertussis
ggauguccggcgcg

SEQ ID NO: 2385261 - RNA, 15 nt, Bordetella pertussis
ggauguccggcgcga

SEQ ID NO: 2385262 - RNA, 14 nt, Bordetella pertussis
ggaugugcaggccg

SEQ ID NO: 2385263 - RNA, 15 nt, Bordetella pertussis
ggaugugcaggccga

SEQ ID NO: 2385264 - RNA, 21 nt, Bordetella pertussis
ggauguucaugaccgccgcgc

SEQ ID NO: 2385265 - RNA, 22 nt, Bordetella pertussis
ggauuccugcgaggacaggggc

SEQ ID NO: 2385266 - RNA, 15 nt, Bordetella pertussis
ggauucgcccagggu

SEQ ID NO: 2385267 - RNA, 20 nt, Bordetella pertussis
ggauucgcggugcaagcggc

SEQ ID NO: 2385268 - RNA, 18 nt, Bordetella pertussis
ggauugaccagcgcggcc

SEQ ID NO: 2385269 - RNA, 18 nt, Bordetella pertussis
ggauugaugucgcgcacc

SEQ ID NO: 2385270 - RNA, 16 nt, Bordetella pertussis
ggauugccgccgcgca

SEQ ID NO: 2385271 - RNA, 20 nt, Bordetella pertussis
ggauugcuugacgccgccga

SEQ ID NO: 2385272 - RNA, 21 nt, Bordetella pertussis
ggauuuuugggcaggccucuu

SEQ ID NO: 2385273 - RNA, 12 nt, Bordetella pertussis
ggcaaaacggug

SEQ ID NO: 2385274 - RNA, 18 nt, Bordetella pertussis
ggcaaaagccggggugcc

SEQ ID NO: 2385275 - RNA, 20 nt, Bordetella pertussis
ggcaaacggauugccgccgc

SEQ ID NO: 2385276 - RNA, 23 nt, Bordetella pertussis
ggcaaacggauugccgccgcgca

SEQ ID NO: 2385277 - RNA, 13 nt, Bordetella pertussis
ggcaaacggcggc

SEQ ID NO: 2385278 - RNA, 14 nt, Bordetella pertussis
ggcaaacggcggca

SEQ ID NO: 2385279 - RNA, 16 nt, Bordetella pertussis
ggcaaacggcggcagg

SEQ ID NO: 2385280 - RNA, 17 nt, Bordetella pertussis
ggcaaacggcggcaggc

SEQ ID NO: 2385281 - RNA, 19 nt, Bordetella pertussis
ggcaaacggcggcaggccg

SEQ ID NO: 2385282 - RNA, 12 nt, Bordetella pertussis
ggcaaagcgcgc

SEQ ID NO: 2385283 - RNA, 21 nt, Bordetella pertussis
ggcaaagcgcgcguccugcgc

SEQ ID NO: 2385284 - RNA, 14 nt, Bordetella pertussis
ggcaaagcgcggcu

SEQ ID NO: 2385285 - RNA, 18 nt, Bordetella pertussis
ggcaaagucggggcgccg

SEQ ID NO: 2385286 - RNA, 16 nt, Bordetella pertussis
ggcaacaaggccacga

SEQ ID NO: 2385287 - RNA, 12 nt, Bordetella pertussis
ggcaacagcagg

SEQ ID NO: 2385288 - RNA, 16 nt, Bordetella pertussis
ggcaacccgcccacgc

SEQ ID NO: 2385289 - RNA, 19 nt, Bordetella pertussis
ggcaacccgcccacgcggc

SEQ ID NO: 2385290 - RNA, 13 nt, Bordetella pertussis
ggcaaccgccacg

SEQ ID NO: 2385291 - RNA, 23 nt, Bordetella pertussis
ggcaaccgccacgugcugcugga

SEQ ID NO: 2385292 - RNA, 12 nt, Bordetella pertussis
ggcaaccgcgcc

SEQ ID NO: 2385293 - RNA, 17 nt, Bordetella pertussis
ggcaaccgcgccucguc

SEQ ID NO: 2385294 - RNA, 16 nt, Bordetella pertussis
ggcaaccucgccgcgc

SEQ ID NO: 2385295 - RNA, 14 nt, Bordetella pertussis
ggcaaccugcacgc

SEQ ID NO: 2385296 - RNA, 18 nt, Bordetella pertussis
ggcaacgacgcaggcgcc

SEQ ID NO: 2385297 - RNA, 16 nt, Bordetella pertussis
ggcaacgugcaggcca

SEQ ID NO: 2385298 - RNA, 17 nt, Bordetella pertussis
ggcaacguugcugcagc

SEQ ID NO: 2385299 - RNA, 18 nt, Bordetella pertussis
ggcaacuucaccgucgac

SEQ ID NO: 2385300 - RNA, 19 nt, Bordetella pertussis
ggcaacuucaccgucgacu

SEQ ID NO: 2385301 - RNA, 14 nt, Bordetella pertussis
ggcaagaagauccg

SEQ ID NO: 2385302 - RNA, 14 nt, Bordetella pertussis
ggcaagaagaucgu

SEQ ID NO: 2385303 - RNA, 20 nt, Bordetella pertussis
ggcaagaaucgacucggccg

SEQ ID NO: 2385304 - RNA, 14 nt, Bordetella pertussis
ggcaagacggcgcu

SEQ ID NO: 2385305 - RNA, 17 nt, Bordetella pertussis
ggcaagacggcgcucgg

SEQ ID NO: 2385306 - RNA, 20 nt, Bordetella pertussis
ggcaagacggcgcucggccu

SEQ ID NO: 2385307 - RNA, 22 nt, Bordetella pertussis
ggcaagacggcgcucggccucg

SEQ ID NO: 2385308 - RNA, 12 nt, Bordetella pertussis
ggcaagagccug

SEQ ID NO: 2385309 - RNA, 17 nt, Bordetella pertussis
ggcaagagccuggcucu

SEQ ID NO: 2385310 - RNA, 23 nt, Bordetella pertussis
ggcaagcagccggaaacggaaac

SEQ ID NO: 2385311 - RNA, 21 nt, Bordetella pertussis
ggcaagcagcgagagcgccac

SEQ ID NO: 2385312 - RNA, 16 nt, Bordetella pertussis
ggcaagccagggcagg

SEQ ID NO: 2385313 - RNA, 22 nt, Bordetella pertussis
ggcaagccgauccgcgacgccc

SEQ ID NO: 2385314 - RNA, 18 nt, Bordetella pertussis
ggcaagccgcccggccgg

SEQ ID NO: 2385315 - RNA, 22 nt, Bordetella pertussis
ggcaagcgcaauggacacagcg

SEQ ID NO: 2385316 - RNA, 16 nt, Bordetella pertussis
ggcaagcggcguaucg

SEQ ID NO: 2385317 - RNA, 14 nt, Bordetella pertussis
ggcaagcggcgugg

SEQ ID NO: 2385318 - RNA, 15 nt, Bordetella pertussis
ggcaagcggcguggg

SEQ ID NO: 2385319 - RNA, 20 nt, Bordetella pertussis
ggcaagcggcguggggccgg

SEQ ID NO: 2385320 - RNA, 22 nt, Bordetella pertussis
ggcaagcugcuggcgcgccagg

SEQ ID NO: 2385321 - RNA, 15 nt, Bordetella pertussis
ggcaaggcccgccgc

SEQ ID NO: 2385322 - RNA, 19 nt, Bordetella pertussis
ggcaaggcccgccgcggca

SEQ ID NO: 2385323 - RNA, 22 nt, Bordetella pertussis
ggcaaggcccgccgcggcaggc

SEQ ID NO: 2385324 - RNA, 12 nt, Bordetella pertussis
ggcaaggccgcg

SEQ ID NO: 2385325 - RNA, 13 nt, Bordetella pertussis
ggcaaggccgcga

SEQ ID NO: 2385326 - RNA, 21 nt, Bordetella pertussis
ggcaaggcgcacaaccuggua

SEQ ID NO: 2385327 - RNA, 14 nt, Bordetella pertussis
ggcaaggggccagc

SEQ ID NO: 2385328 - RNA, 16 nt, Bordetella pertussis
ggcaaggggccagccu

SEQ ID NO: 2385329 - RNA, 15 nt, Bordetella pertussis
ggcaaggucagcagc

SEQ ID NO: 2385330 - RNA, 14 nt, Bordetella pertussis
ggcaaucagcccgg

SEQ ID NO: 2385331 - RNA, 14 nt, Bordetella pertussis
ggcaaucccggcga

SEQ ID NO: 2385332 - RNA, 16 nt, Bordetella pertussis
ggcaaucccggcgaca

SEQ ID NO: 2385333 - RNA, 15 nt, Bordetella pertussis
ggcaaucgaaaagcc

SEQ ID NO: 2385334 - RNA, 20 nt, Bordetella pertussis
ggcaaucgaaaagcccgccg

SEQ ID NO: 2385335 - RNA, 13 nt, Bordetella pertussis
ggcaaucggggug

SEQ ID NO: 2385336 - RNA, 16 nt, Bordetella pertussis
ggcaaucgggguggcg

SEQ ID NO: 2385337 - RNA, 13 nt, Bordetella pertussis
ggcaaugcgcagg

SEQ ID NO: 2385338 - RNA, 20 nt, Bordetella pertussis
ggcaaugcgcaggcccgaca

SEQ ID NO: 2385339 - RNA, 16 nt, Bordetella pertussis
ggcaaugcgcgcgcgg

SEQ ID NO: 2385340 - RNA, 15 nt, Bordetella pertussis
ggcaaugcguggccg

SEQ ID NO: 2385341 - RNA, 16 nt, Bordetella pertussis
ggcaaugguccagcag

SEQ ID NO: 2385342 - RNA, 12 nt, Bordetella pertussis
ggcaauguccgg

SEQ ID NO: 2385343 - RNA, 13 nt, Bordetella pertussis
ggcaauguccggg

SEQ ID NO: 2385344 - RNA, 15 nt, Bordetella pertussis
ggcaaugucgcaggc

SEQ ID NO: 2385345 - RNA, 19 nt, Bordetella pertussis
ggcaaugucgcaggccgcg

SEQ ID NO: 2385346 - RNA, 20 nt, Bordetella pertussis
ggcaaugucgcaggccgcgg

SEQ ID NO: 2385347 - RNA, 14 nt, Bordetella pertussis
ggcacaaccuggcg

SEQ ID NO: 2385348 - RNA, 13 nt, Bordetella pertussis
ggcacaccagcgc

SEQ ID NO: 2385349 - RNA, 16 nt, Bordetella pertussis
ggcacaccccgggcgg

SEQ ID NO: 2385350 - RNA, 14 nt, Bordetella pertussis
ggcacacccuccua

SEQ ID NO: 2385351 - RNA, 20 nt, Bordetella pertussis
ggcacacccuccuacgccau

SEQ ID NO: 2385352 - RNA, 22 nt, Bordetella pertussis
ggcacacccuccuacgccauga

SEQ ID NO: 2385353 - RNA, 20 nt, Bordetella pertussis
ggcacaccggucuacgccau

SEQ ID NO: 2385354 - RNA, 18 nt, Bordetella pertussis
ggcacaccgucacgcgca

SEQ ID NO: 2385355 - RNA, 18 nt, Bordetella pertussis
ggcacacgaccggcuugc

SEQ ID NO: 2385356 - RNA, 20 nt, Bordetella pertussis
ggcacacgaccggcuugccg

SEQ ID NO: 2385357 - RNA, 14 nt, Bordetella pertussis
ggcacaggaacagc

SEQ ID NO: 2385358 - RNA, 18 nt, Bordetella pertussis
ggcacaggaacagccugc

SEQ ID NO: 2385359 - RNA, 20 nt, Bordetella pertussis
ggcacaucagcgugccgccg

SEQ ID NO: 2385360 - RNA, 15 nt, Bordetella pertussis
ggcacauccagcgcc

SEQ ID NO: 2385361 - RNA, 18 nt, Bordetella pertussis
ggcacauccagcgccagc

SEQ ID NO: 2385362 - RNA, 22 nt, Bordetella pertussis
ggcacauugccguacgccaucg

SEQ ID NO: 2385363 - RNA, 15 nt, Bordetella pertussis
ggcaccaccaccgcc

SEQ ID NO: 2385364 - RNA, 16 nt, Bordetella pertussis
ggcaccaccaccgccc

SEQ ID NO: 2385365 - RNA, 16 nt, Bordetella pertussis
ggcaccagcaggccgg

SEQ ID NO: 2385366 - RNA, 16 nt, Bordetella pertussis
ggcaccagcgccacgc

SEQ ID NO: 2385367 - RNA, 21 nt, Bordetella pertussis
ggcaccagcgccacgcccagg

SEQ ID NO: 2385368 - RNA, 19 nt, Bordetella pertussis
ggcaccaggauccccagca

SEQ ID NO: 2385369 - RNA, 21 nt, Bordetella pertussis
ggcaccaggauuccugcgagg

SEQ ID NO: 2385370 - RNA, 17 nt, Bordetella pertussis
ggcaccagguccuggcg

SEQ ID NO: 2385371 - RNA, 18 nt, Bordetella pertussis
ggcaccagguccuggcgg

SEQ ID NO: 2385372 - RNA, 13 nt, Bordetella pertussis
ggcaccaucgccg

SEQ ID NO: 2385373 - RNA, 14 nt, Bordetella pertussis
ggcaccaucgccgc

SEQ ID NO: 2385374 - RNA, 16 nt, Bordetella pertussis
ggcaccaucguugccu

SEQ ID NO: 2385375 - RNA, 19 nt, Bordetella pertussis
ggcaccaucucccgcaggc

SEQ ID NO: 2385376 - RNA, 20 nt, Bordetella pertussis
ggcaccaucucccgcaggcc

SEQ ID NO: 2385377 - RNA, 19 nt, Bordetella pertussis
ggcaccaucugcgucgcgu

SEQ ID NO: 2385378 - RNA, 13 nt, Bordetella pertussis
ggcaccaugcgca

SEQ ID NO: 2385379 - RNA, 18 nt, Bordetella pertussis
ggcaccaugcgcgagggc

SEQ ID NO: 2385380 - RNA, 18 nt, Bordetella pertussis
ggcaccauugccggcgcg

SEQ ID NO: 2385381 - RNA, 13 nt, Bordetella pertussis
ggcacccaggcgg

SEQ ID NO: 2385382 - RNA, 17 nt, Bordetella pertussis
ggcacccaggcgggcug

SEQ ID NO: 2385383 - RNA, 15 nt, Bordetella pertussis
ggcaccccggcgccg

SEQ ID NO: 2385384 - RNA, 13 nt, Bordetella pertussis
ggcaccccgucgu

SEQ ID NO: 2385385 - RNA, 17 nt, Bordetella pertussis
ggcacccgagggucagg

SEQ ID NO: 2385386 - RNA, 14 nt, Bordetella pertussis
ggcacccgcaaacc

SEQ ID NO: 2385387 - RNA, 22 nt, Bordetella pertussis
ggcacccgcaagauuucauggc

SEQ ID NO: 2385388 - RNA, 15 nt, Bordetella pertussis
ggcacccgcacgggc

SEQ ID NO: 2385389 - RNA, 14 nt, Bordetella pertussis
ggcacccgcauggu

SEQ ID NO: 2385390 - RNA, 13 nt, Bordetella pertussis
ggcacccgcgcgc

SEQ ID NO: 2385391 - RNA, 20 nt, Bordetella pertussis
ggcacccgcuaccccggcag

SEQ ID NO: 2385392 - RNA, 22 nt, Bordetella pertussis
ggcacccgcuaccccggcagcg

SEQ ID NO: 2385393 - RNA, 23 nt, Bordetella pertussis
ggcacccgcuaccccggcagcgu

SEQ ID NO: 2385394 - RNA, 12 nt, Bordetella pertussis
ggcacccggccg

SEQ ID NO: 2385395 - RNA, 14 nt, Bordetella pertussis
ggcacccggccgcu

SEQ ID NO: 2385396 - RNA, 16 nt, Bordetella pertussis
ggcacccggcucagcc

SEQ ID NO: 2385397 - RNA, 17 nt, Bordetella pertussis
ggcacccggcucagccu

SEQ ID NO: 2385398 - RNA, 20 nt, Bordetella pertussis
ggcacccugucauacgccau

SEQ ID NO: 2385399 - RNA, 22 nt, Bordetella pertussis
ggcacccugucauacgccauga

SEQ ID NO: 2385400 - RNA, 13 nt, Bordetella pertussis
ggcacccuugccg

SEQ ID NO: 2385401 - RNA, 15 nt, Bordetella pertussis
ggcacccuugccgca

SEQ ID NO: 2385402 - RNA, 17 nt, Bordetella pertussis
ggcacccuugccgcagc

SEQ ID NO: 2385403 - RNA, 24 nt, Bordetella pertussis
ggcacccuugccgcaggagucgcu

SEQ ID NO: 2385404 - RNA, 15 nt, Bordetella pertussis
ggcacccuugccgcg

SEQ ID NO: 2385405 - RNA, 18 nt, Bordetella pertussis
ggcacccuugccgcgggu

SEQ ID NO: 2385406 - RNA, 17 nt, Bordetella pertussis
ggcacccuuuugccgca

SEQ ID NO: 2385407 - RNA, 16 nt, Bordetella pertussis
ggcaccgaacccugcc

SEQ ID NO: 2385408 - RNA, 23 nt, Bordetella pertussis
ggcaccgaacccugccucagacc

SEQ ID NO: 2385409 - RNA, 17 nt, Bordetella pertussis
ggcaccgaacgggcgug

SEQ ID NO: 2385410 - RNA, 18 nt, Bordetella pertussis
ggcaccgaacgggcgugg

SEQ ID NO: 2385411 - RNA, 23 nt, Bordetella pertussis
ggcaccgaacgggcguggcgcag

SEQ ID NO: 2385412 - RNA, 15 nt, Bordetella pertussis
ggcaccgagcacagc

SEQ ID NO: 2385413 - RNA, 17 nt, Bordetella pertussis
ggcaccgagcacagcaa

SEQ ID NO: 2385414 - RNA, 14 nt, Bordetella pertussis
ggcaccgagccgca

SEQ ID NO: 2385415 - RNA, 17 nt, Bordetella pertussis
ggcaccgagccgcaggu

SEQ ID NO: 2385416 - RNA, 14 nt, Bordetella pertussis
ggcaccgaggccga

SEQ ID NO: 2385417 - RNA, 16 nt, Bordetella pertussis
ggcaccgaggccgagu

SEQ ID NO: 2385418 - RNA, 16 nt, Bordetella pertussis
ggcaccgccgcacagc

SEQ ID NO: 2385419 - RNA, 12 nt, Bordetella pertussis
ggcaccgcgacg

SEQ ID NO: 2385420 - RNA, 13 nt, Bordetella pertussis
ggcaccgcgacga

SEQ ID NO: 2385421 - RNA, 17 nt, Bordetella pertussis
ggcaccgcgcagcccgg

SEQ ID NO: 2385422 - RNA, 20 nt, Bordetella pertussis
ggcaccgcgcagcccggcgu

SEQ ID NO: 2385423 - RNA, 20 nt, Bordetella pertussis
ggcaccggcaaacuuccccg

SEQ ID NO: 2385424 - RNA, 13 nt, Bordetella pertussis
ggcaccggccaag

SEQ ID NO: 2385425 - RNA, 20 nt, Bordetella pertussis
ggcaccggccaagcuccagg

SEQ ID NO: 2385426 - RNA, 18 nt, Bordetella pertussis
ggcaccgugaugcgcgcc

SEQ ID NO: 2385427 - RNA, 16 nt, Bordetella pertussis
ggcaccgugaugucgc

SEQ ID NO: 2385428 - RNA, 23 nt, Bordetella pertussis
ggcaccgugaugucgccgucggc

SEQ ID NO: 2385429 - RNA, 22 nt, Bordetella pertussis
ggcaccucgauuuccgaggccu

SEQ ID NO: 2385430 - RNA, 13 nt, Bordetella pertussis
ggcaccucggccg

SEQ ID NO: 2385431 - RNA, 15 nt, Bordetella pertussis
ggcaccucggccggg

SEQ ID NO: 2385432 - RNA, 16 nt, Bordetella pertussis
ggcaccucggccgggg

SEQ ID NO: 2385433 - RNA, 18 nt, Bordetella pertussis
ggcaccucggccggggcg

SEQ ID NO: 2385434 - RNA, 19 nt, Bordetella pertussis
ggcaccucggcgccgcggc

SEQ ID NO: 2385435 - RNA, 16 nt, Bordetella pertussis
ggcaccucggggugca

SEQ ID NO: 2385436 - RNA, 19 nt, Bordetella pertussis
ggcaccucggggugcagcu

SEQ ID NO: 2385437 - RNA, 19 nt, Bordetella pertussis
ggcaccucguucacccccc

SEQ ID NO: 2385438 - RNA, 15 nt, Bordetella pertussis
ggcaccugccgacuu

SEQ ID NO: 2385439 - RNA, 14 nt, Bordetella pertussis
ggcaccugcugcuu

SEQ ID NO: 2385440 - RNA, 19 nt, Bordetella pertussis
ggcaccugcugcuugaccu

SEQ ID NO: 2385441 - RNA, 16 nt, Bordetella pertussis
ggcaccugggccuuca

SEQ ID NO: 2385442 - RNA, 21 nt, Bordetella pertussis
ggcaccuucgcgcagcggcgc

SEQ ID NO: 2385443 - RNA, 20 nt, Bordetella pertussis
ggcaccuucuuccaggcgcc

SEQ ID NO: 2385444 - RNA, 16 nt, Bordetella pertussis
ggcaccuuggcccggc

SEQ ID NO: 2385445 - RNA, 23 nt, Bordetella pertussis
ggcaccuuuuuccuugcgggccu

SEQ ID NO: 2385446 - RNA, 18 nt, Bordetella pertussis
ggcacgacgcgaaccagg

SEQ ID NO: 2385447 - RNA, 21 nt, Bordetella pertussis
ggcacgacgcugaugcccagc

SEQ ID NO: 2385448 - RNA, 14 nt, Bordetella pertussis
ggcacgacggccuc

SEQ ID NO: 2385449 - RNA, 22 nt, Bordetella pertussis
ggcacgacggccuccgcgccga

SEQ ID NO: 2385450 - RNA, 14 nt, Bordetella pertussis
ggcacgacgucguc

SEQ ID NO: 2385451 - RNA, 17 nt, Bordetella pertussis
ggcacgagaucgccugg

SEQ ID NO: 2385452 - RNA, 15 nt, Bordetella pertussis
ggcacgaucaccgcc

SEQ ID NO: 2385453 - RNA, 16 nt, Bordetella pertussis
ggcacgaucaccgccg

SEQ ID NO: 2385454 - RNA, 17 nt, Bordetella pertussis
ggcacgaucaccgccgc

SEQ ID NO: 2385455 - RNA, 22 nt, Bordetella pertussis
ggcacgaucaccgccgcggcga

SEQ ID NO: 2385456 - RNA, 16 nt, Bordetella pertussis
ggcacgauggccgcgc

SEQ ID NO: 2385457 - RNA, 18 nt, Bordetella pertussis
ggcacgauggccgcgccc

SEQ ID NO: 2385458 - RNA, 19 nt, Bordetella pertussis
ggcacgauggccgcgccca

SEQ ID NO: 2385459 - RNA, 14 nt, Bordetella pertussis
ggcacgcacagcau

SEQ ID NO: 2385460 - RNA, 22 nt, Bordetella pertussis
ggcacgcacagcaugcgcuggu

SEQ ID NO: 2385461 - RNA, 12 nt, Bordetella pertussis
ggcacgcccagc

SEQ ID NO: 2385462 - RNA, 13 nt, Bordetella pertussis
ggcacgcccagcc

SEQ ID NO: 2385463 - RNA, 14 nt, Bordetella pertussis
ggcacgcccagccg

SEQ ID NO: 2385464 - RNA, 21 nt, Bordetella pertussis
ggcacgccgaugaacgacagg

SEQ ID NO: 2385465 - RNA, 12 nt, Bordetella pertussis
ggcacgccggcg

SEQ ID NO: 2385466 - RNA, 15 nt, Bordetella pertussis
ggcacgccggcggcc

SEQ ID NO: 2385467 - RNA, 16 nt, Bordetella pertussis
ggcacgccggcggcgc

SEQ ID NO: 2385468 - RNA, 19 nt, Bordetella pertussis
ggcacgccggcggcgcugg

SEQ ID NO: 2385469 - RNA, 14 nt, Bordetella pertussis
ggcacgccucgccg

SEQ ID NO: 2385470 - RNA, 17 nt, Bordetella pertussis
ggcacgccucgccggcc

SEQ ID NO: 2385471 - RNA, 22 nt, Bordetella pertussis
ggcacgccucgccggcccugcc

SEQ ID NO: 2385472 - RNA, 17 nt, Bordetella pertussis
ggcacgccugccgcgcc

SEQ ID NO: 2385473 - RNA, 14 nt, Bordetella pertussis
ggcacgcgccagcu

SEQ ID NO: 2385474 - RNA, 15 nt, Bordetella pertussis
ggcacgcgccagcug

SEQ ID NO: 2385475 - RNA, 13 nt, Bordetella pertussis
ggcacgcgccagg

SEQ ID NO: 2385476 - RNA, 12 nt, Bordetella pertussis
ggcacgcgcgcc

SEQ ID NO: 2385477 - RNA, 14 nt, Bordetella pertussis
ggcacgcgcgccgg

SEQ ID NO: 2385478 - RNA, 16 nt, Bordetella pertussis
ggcacgcgcgccggca

SEQ ID NO: 2385479 - RNA, 18 nt, Bordetella pertussis
ggcacgcgcgccggcagg

SEQ ID NO: 2385480 - RNA, 13 nt, Bordetella pertussis
ggcacgcgcgcgg

SEQ ID NO: 2385481 - RNA, 17 nt, Bordetella pertussis
ggcacgcgcgcggcgcg

SEQ ID NO: 2385482 - RNA, 15 nt, Bordetella pertussis
ggcacgcgcgguucg

SEQ ID NO: 2385483 - RNA, 22 nt, Bordetella pertussis
ggcacgcgcugaauccggggug

SEQ ID NO: 2385484 - RNA, 22 nt, Bordetella pertussis
ggcacgcggaggagguggcugg

SEQ ID NO: 2385485 - RNA, 17 nt, Bordetella pertussis
ggcacgcugaucgccgg

SEQ ID NO: 2385486 - RNA, 19 nt, Bordetella pertussis
ggcacgcugaucgccggcg

SEQ ID NO: 2385487 - RNA, 21 nt, Bordetella pertussis
ggcacgcugaucgccggcgcc

SEQ ID NO: 2385488 - RNA, 22 nt, Bordetella pertussis
ggcacgcugaucgccggcgccc

SEQ ID NO: 2385489 - RNA, 14 nt, Bordetella pertussis
ggcacgcugcgcag

SEQ ID NO: 2385490 - RNA, 13 nt, Bordetella pertussis
ggcacgcugcuga

SEQ ID NO: 2385491 - RNA, 22 nt, Bordetella pertussis
ggcacgcugcugauccucgcca

SEQ ID NO: 2385492 - RNA, 18 nt, Bordetella pertussis
ggcacgcuugccgcaacc

SEQ ID NO: 2385493 - RNA, 16 nt, Bordetella pertussis
ggcacggcacgccucg

SEQ ID NO: 2385494 - RNA, 12 nt, Bordetella pertussis
ggcacggccagc

SEQ ID NO: 2385495 - RNA, 15 nt, Bordetella pertussis
ggcacggccagcauu

SEQ ID NO: 2385496 - RNA, 14 nt, Bordetella pertussis
ggcacggccggcca

SEQ ID NO: 2385497 - RNA, 16 nt, Bordetella pertussis
ggcacggccggccagg

SEQ ID NO: 2385498 - RNA, 17 nt, Bordetella pertussis
ggcacggccggccugca

SEQ ID NO: 2385499 - RNA, 18 nt, Bordetella pertussis
ggcacggccggccugcag

SEQ ID NO: 2385500 - RNA, 12 nt, Bordetella pertussis
ggcacggcggca

SEQ ID NO: 2385501 - RNA, 13 nt, Bordetella pertussis
ggcacgggucagg

SEQ ID NO: 2385502 - RNA, 20 nt, Bordetella pertussis
ggcacgguggcgaaggccgc

SEQ ID NO: 2385503 - RNA, 18 nt, Bordetella pertussis
ggcacgguucagaacgcg

SEQ ID NO: 2385504 - RNA, 17 nt, Bordetella pertussis
ggcacguaccaggcgcu

SEQ ID NO: 2385505 - RNA, 19 nt, Bordetella pertussis
ggcacguaguacagcagca

SEQ ID NO: 2385506 - RNA, 16 nt, Bordetella pertussis
ggcacguccgagagga

SEQ ID NO: 2385507 - RNA, 23 nt, Bordetella pertussis
ggcacgugccggauggcgcggau

SEQ ID NO: 2385508 - RNA, 16 nt, Bordetella pertussis
ggcacguugucgagca

SEQ ID NO: 2385509 - RNA, 19 nt, Bordetella pertussis
ggcacuccggauaccgccg

SEQ ID NO: 2385510 - RNA, 21 nt, Bordetella pertussis
ggcacucugccgugggacagg

SEQ ID NO: 2385511 - RNA, 13 nt, Bordetella pertussis
ggcacucuugccg

SEQ ID NO: 2385512 - RNA, 17 nt, Bordetella pertussis
ggcacucuugccgcugc

SEQ ID NO: 2385513 - RNA, 14 nt, Bordetella pertussis
ggcacugaugcugg

SEQ ID NO: 2385514 - RNA, 15 nt, Bordetella pertussis
ggcacuggcgcggcg

SEQ ID NO: 2385515 - RNA, 13 nt, Bordetella pertussis
ggcacugucggcg

SEQ ID NO: 2385516 - RNA, 22 nt, Bordetella pertussis
ggcacugucggcguuccuggcg

SEQ ID NO: 2385517 - RNA, 20 nt, Bordetella pertussis
ggcagaacggaaacgcccag

SEQ ID NO: 2385518 - RNA, 13 nt, Bordetella pertussis
ggcagaccgagcg

SEQ ID NO: 2385519 - RNA, 18 nt, Bordetella pertussis
ggcagaccgagcgcgccc

SEQ ID NO: 2385520 - RNA, 20 nt, Bordetella pertussis
ggcagaccgagcgcgcccgc

SEQ ID NO: 2385521 - RNA, 20 nt, Bordetella pertussis
ggcagacgaucauccaggcc

SEQ ID NO: 2385522 - RNA, 22 nt, Bordetella pertussis
ggcagacgaucauccaggccgu

SEQ ID NO: 2385523 - RNA, 18 nt, Bordetella pertussis
ggcagacgaugcccaggc

SEQ ID NO: 2385524 - RNA, 22 nt, Bordetella pertussis
ggcagacgaugcccaggcccgc

SEQ ID NO: 2385525 - RNA, 15 nt, Bordetella pertussis
ggcagagggcgacgg

SEQ ID NO: 2385526 - RNA, 17 nt, Bordetella pertussis
ggcagagggcgacggcg

SEQ ID NO: 2385527 - RNA, 20 nt, Bordetella pertussis
ggcagagggcgacggcggcg

SEQ ID NO: 2385528 - RNA, 22 nt, Bordetella pertussis
ggcagagggcgacggcggcgug

SEQ ID NO: 2385529 - RNA, 23 nt, Bordetella pertussis
ggcagagggcgacggcggcgugg

SEQ ID NO: 2385530 - RNA, 20 nt, Bordetella pertussis
ggcagaucggcgcuggccug

SEQ ID NO: 2385531 - RNA, 18 nt, Bordetella pertussis
ggcagaugaucuacgcgc

SEQ ID NO: 2385532 - RNA, 17 nt, Bordetella pertussis
ggcccgcucggccagca

SEQ ID NO: 2385533 - RNA, 19 nt, Bordetella pertussis
ggcccggaauaccgccagc

SEQ ID NO: 2385534 - RNA, 21 nt, Bordetella pertussis
ggcccggaauaccgccagcuc

SEQ ID NO: 2385535 - RNA, 18 nt, Bordetella pertussis
ggcccggacgcggccggc

SEQ ID NO: 2385536 - RNA, 17 nt, Bordetella pertussis
ggcccggauauggccgg

SEQ ID NO: 2385537 - RNA, 19 nt, Bordetella pertussis
ggcccggaucauccgggcc

SEQ ID NO: 2385538 - RNA, 15 nt, Bordetella pertussis
ggcccggccgcaggg

SEQ ID NO: 2385539 - RNA, 13 nt, Bordetella pertussis
ggcccggccgccg

SEQ ID NO: 2385540 - RNA, 14 nt, Bordetella pertussis
ggcccggccgccgc

SEQ ID NO: 2385541 - RNA, 15 nt, Bordetella pertussis
ggcccggccgccgcc

SEQ ID NO: 2385542 - RNA, 19 nt, Bordetella pertussis
ggcccggccgccgccggca

SEQ ID NO: 2385543 - RNA, 14 nt, Bordetella pertussis
ggcccggccugcgu

SEQ ID NO: 2385544 - RNA, 23 nt, Bordetella pertussis
ggcccggccugcgugucaggcgg

SEQ ID NO: 2385545 - RNA, 13 nt, Bordetella pertussis
ggcccggcgccgg

SEQ ID NO: 2385546 - RNA, 10 nt, Bordetella pertussis
ggcccggcgg

SEQ ID NO: 2385547 - RNA, 12 nt, Bordetella pertussis
ggcccggcggca

SEQ ID NO: 2385548 - RNA, 14 nt, Bordetella pertussis
ggcccggcgggaac

SEQ ID NO: 2385549 - RNA, 21 nt, Bordetella pertussis
ggcccggcgggaacaggcacc

SEQ ID NO: 2385550 - RNA, 13 nt, Bordetella pertussis
ggcccggcgggcc

SEQ ID NO: 2385551 - RNA, 17 nt, Bordetella pertussis
ggcccggcgggccggcu

SEQ ID NO: 2385552 - RNA, 21 nt, Bordetella pertussis
ggcccggcguagcugcgccgc

SEQ ID NO: 2385553 - RNA, 14 nt, Bordetella pertussis
ggcccggcucgccg

SEQ ID NO: 2385554 - RNA, 13 nt, Bordetella pertussis
ggcccgggcaggc

SEQ ID NO: 2385555 - RNA, 18 nt, Bordetella pertussis
ggcccgggcaggcucagc

SEQ ID NO: 2385556 - RNA, 21 nt, Bordetella pertussis
ggcccgggcaggcucagcccg

SEQ ID NO: 2385557 - RNA, 19 nt, Bordetella pertussis
ggcccgggcgagauggcgu

SEQ ID NO: 2385558 - RNA, 13 nt, Bordetella pertussis
ggcccgggcgccu

SEQ ID NO: 2385559 - RNA, 15 nt, Bordetella pertussis
ggcccgggcgccugc

SEQ ID NO: 2385560 - RNA, 12 nt, Bordetella pertussis
ggcccgggcgcg

SEQ ID NO: 2385561 - RNA, 15 nt, Bordetella pertussis
ggcccgggcgcgcug

SEQ ID NO: 2385562 - RNA, 14 nt, Bordetella pertussis
ggcccgggcguggc

SEQ ID NO: 2385563 - RNA, 24 nt, Bordetella pertussis
ggcccgguauuccucgacgauggc

SEQ ID NO: 2385564 - RNA, 15 nt, Bordetella pertussis
ggcccggucguggcu

SEQ ID NO: 2385565 - RNA, 19 nt, Bordetella pertussis
ggcccggugcagccgccgc

SEQ ID NO: 2385566 - RNA, 23 nt, Bordetella pertussis
ggcccggugcagccgccgcaggc

SEQ ID NO: 2385567 - RNA, 16 nt, Bordetella pertussis
ggcccgguucaaccgg

SEQ ID NO: 2385568 - RNA, 16 nt, Bordetella pertussis
ggcccgguuggggucg

SEQ ID NO: 2385569 - RNA, 19 nt, Bordetella pertussis
ggcccgucaugggcggggc

SEQ ID NO: 2385570 - RNA, 20 nt, Bordetella pertussis
ggcccgucaugggcggggcc

SEQ ID NO: 2385571 - RNA, 13 nt, Bordetella pertussis
ggcccgucgcgcc

SEQ ID NO: 2385572 - RNA, 20 nt, Bordetella pertussis
ggcccgucgcgccaggccgg

SEQ ID NO: 2385573 - RNA, 21 nt, Bordetella pertussis
ggcccgucgcgccaggccggc

SEQ ID NO: 2385574 - RNA, 18 nt, Bordetella pertussis
ggcccgugcgcaacgcgc

SEQ ID NO: 2385575 - RNA, 21 nt, Bordetella pertussis
ggcccguguagacggcaaucu

SEQ ID NO: 2385576 - RNA, 22 nt, Bordetella pertussis
ggcccguuccacaggcgaugau

SEQ ID NO: 2385577 - RNA, 17 nt, Bordetella pertussis
ggcccguuggcaggcca

SEQ ID NO: 2385578 - RNA, 18 nt, Bordetella pertussis
ggcccguuggcaggccag

SEQ ID NO: 2385579 - RNA, 19 nt, Bordetella pertussis
ggcccguuggcaggccagc

SEQ ID NO: 2385580 - RNA, 22 nt, Bordetella pertussis
ggcccguuggcaggccagcaug

SEQ ID NO: 2385581 - RNA, 22 nt, Bordetella pertussis
ggcccuagagcaugcggcgucc

SEQ ID NO: 2385582 - RNA, 14 nt, Bordetella pertussis
ggcccuccggcgcc

SEQ ID NO: 2385583 - RNA, 15 nt, Bordetella pertussis
ggcccuccggcgcca

SEQ ID NO: 2385584 - RNA, 17 nt, Bordetella pertussis
ggcccuccggcgccagc

SEQ ID NO: 2385585 - RNA, 13 nt, Bordetella pertussis
ggcccucgcggcc

SEQ ID NO: 2385586 - RNA, 14 nt, Bordetella pertussis
ggcccucgcggccg

SEQ ID NO: 2385587 - RNA, 23 nt, Bordetella pertussis
ggcccucggugcggaagacgaug

SEQ ID NO: 2385588 - RNA, 15 nt, Bordetella pertussis
ggcccugcagcggcc

SEQ ID NO: 2385589 - RNA, 18 nt, Bordetella pertussis
ggcccugcagcggccagu

SEQ ID NO: 2385590 - RNA, 16 nt, Bordetella pertussis
ggcccugcaggaacuc

SEQ ID NO: 2385591 - RNA, 21 nt, Bordetella pertussis
ggcccugccgaucaagagccu

SEQ ID NO: 2385592 - RNA, 18 nt, Bordetella pertussis
ggcccugcgcguugagca

SEQ ID NO: 2385593 - RNA, 21 nt, Bordetella pertussis
ggcccugcgcguugagcagca

SEQ ID NO: 2385594 - RNA, 16 nt, Bordetella pertussis
ggcccuggcggcgcag

SEQ ID NO: 2385595 - RNA, 14 nt, Bordetella pertussis
ggcccuggcgggcc

SEQ ID NO: 2385596 - RNA, 17 nt, Bordetella pertussis
ggcccuggcgggccgga

SEQ ID NO: 2385597 - RNA, 14 nt, Bordetella pertussis
ggcccuggcguucg

SEQ ID NO: 2385598 - RNA, 13 nt, Bordetella pertussis
ggcccuggcuggc

SEQ ID NO: 2385599 - RNA, 16 nt, Bordetella pertussis
ggcccuggcuggccag

SEQ ID NO: 2385600 - RNA, 17 nt, Bordetella pertussis
ggcccuggcuggccagc

SEQ ID NO: 2385601 - RNA, 18 nt, Bordetella pertussis
ggcccuggcuggccagcc

SEQ ID NO: 2385602 - RNA, 15 nt, Bordetella pertussis
ggcccugggccagca

SEQ ID NO: 2385603 - RNA, 19 nt, Bordetella pertussis
ggcccugggccagcagcug

SEQ ID NO: 2385604 - RNA, 19 nt, Bordetella pertussis
ggcccugggccagccagcg

SEQ ID NO: 2385605 - RNA, 21 nt, Bordetella pertussis
ggcccugggccagccagcgcc

SEQ ID NO: 2385606 - RNA, 18 nt, Bordetella pertussis
ggcccugggcgcggcggu

SEQ ID NO: 2385607 - RNA, 21 nt, Bordetella pertussis
ggcccugggcgcggcgguggc

SEQ ID NO: 2385608 - RNA, 21 nt, Bordetella pertussis
ggcccugggcuuuggcuuggc

SEQ ID NO: 2385609 - RNA, 14 nt, Bordetella pertussis
ggcccuggggccgc

SEQ ID NO: 2385610 - RNA, 16 nt, Bordetella pertussis
ggcccuggggccgcgg

SEQ ID NO: 2385611 - RNA, 23 nt, Bordetella pertussis
ggcccuguaugccguaggcgccg

SEQ ID NO: 2385612 - RNA, 20 nt, Bordetella pertussis
ggcccuguucgcgcggcccg

SEQ ID NO: 2385613 - RNA, 21 nt, Bordetella pertussis
ggcccuugagcaaucaagggc

SEQ ID NO: 2385614 - RNA, 22 nt, Bordetella pertussis
ggcccuugauaaaaaggggggc

SEQ ID NO: 2385615 - RNA, 19 nt, Bordetella pertussis
ggcccuugauggccgggcc

SEQ ID NO: 2385616 - RNA, 20 nt, Bordetella pertussis
ggcccuugauggccgggccg

SEQ ID NO: 2385617 - RNA, 14 nt, Bordetella pertussis
ggcccuugcgcgaa

SEQ ID NO: 2385618 - RNA, 21 nt, Bordetella pertussis
ggcccuuggucugcaggcucu

SEQ ID NO: 2385619 - RNA, 15 nt, Bordetella pertussis
ggccgaaaccgccgc

SEQ ID NO: 2385620 - RNA, 18 nt, Bordetella pertussis
ggccgaaaccgccgcggc

SEQ ID NO: 2385621 - RNA, 23 nt, Bordetella pertussis
ggccgaaaccgccgcggcuugcc

SEQ ID NO: 2385622 - RNA, 16 nt, Bordetella pertussis
ggccgaaauggcggcg

SEQ ID NO: 2385623 - RNA, 15 nt, Bordetella pertussis
ggccgaacgccgccg

SEQ ID NO: 2385624 - RNA, 17 nt, Bordetella pertussis
ggccgaacugggacagg

SEQ ID NO: 2385625 - RNA, 22 nt, Bordetella pertussis
ggccgaacugggacaggcccag

SEQ ID NO: 2385626 - RNA, 20 nt, Bordetella pertussis
ggccgaagaucuccucgcgc

SEQ ID NO: 2385627 - RNA, 15 nt, Bordetella pertussis
ggccgaagcgcaagc

SEQ ID NO: 2385628 - RNA, 23 nt, Bordetella pertussis
ggccgaagcgcaagcccaggcgg

SEQ ID NO: 2385629 - RNA, 19 nt, Bordetella pertussis
ggccgaaucguucacgccc

SEQ ID NO: 2385630 - RNA, 20 nt, Bordetella pertussis
ggccgaaucguucacgcccg

SEQ ID NO: 2385631 - RNA, 15 nt, Bordetella pertussis
ggccgaauugccgcc

SEQ ID NO: 2385632 - RNA, 17 nt, Bordetella pertussis
ggccgaauugccgccgc

SEQ ID NO: 2385633 - RNA, 19 nt, Bordetella pertussis
ggccgaauugccgccgcug

SEQ ID NO: 2385634 - RNA, 18 nt, Bordetella pertussis
ggccgacagcgucgagcu

SEQ ID NO: 2385635 - RNA, 21 nt, Bordetella pertussis
ggccgacagcgucgagcugac

SEQ ID NO: 2385636 - RNA, 22 nt, Bordetella pertussis
ggccgacagcuugcgcuggcgc

SEQ ID NO: 2385637 - RNA, 14 nt, Bordetella pertussis
ggccgacagguggu

SEQ ID NO: 2385638 - RNA, 14 nt, Bordetella pertussis
ggccgaccacugga

SEQ ID NO: 2385639 - RNA, 23 nt, Bordetella pertussis
ggccgaccacuggaagcugcggc

SEQ ID NO: 2385640 - RNA, 14 nt, Bordetella pertussis
ggccgaccagcacg

SEQ ID NO: 2385641 - RNA, 22 nt, Bordetella pertussis
ggccgaccagcacgauccagcc

SEQ ID NO: 2385642 - RNA, 12 nt, Bordetella pertussis
ggccgaccagcg

SEQ ID NO: 2385643 - RNA, 15 nt, Bordetella pertussis
ggccgaccaggccgg

SEQ ID NO: 2385644 - RNA, 17 nt, Bordetella pertussis
ggccgaccaggccggcg

SEQ ID NO: 2385645 - RNA, 19 nt, Bordetella pertussis
ggccgaccauguggcagau

SEQ ID NO: 2385646 - RNA, 15 nt, Bordetella pertussis
ggccgacgaggcgcu

SEQ ID NO: 2385647 - RNA, 22 nt, Bordetella pertussis
ggcagaugaucuacgcgcgcgc

SEQ ID NO: 2385648 - RNA, 23 nt, Bordetella pertussis
ggcagaugaucuacgcgcgcgcc

SEQ ID NO: 2385649 - RNA, 24 nt, Bordetella pertussis
ggcagaugaucuacgcgcgcgccg

SEQ ID NO: 2385650 - RNA, 19 nt, Bordetella pertussis
ggcagauugaugcccaugc

SEQ ID NO: 2385651 - RNA, 22 nt, Bordetella pertussis
ggcagcaaccggaacaccagca

SEQ ID NO: 2385652 - RNA, 19 nt, Bordetella pertussis
ggcagcaauucgaccggca

SEQ ID NO: 2385653 - RNA, 21 nt, Bordetella pertussis
ggcagcaauucgaccggcagg

SEQ ID NO: 2385654 - RNA, 23 nt, Bordetella pertussis
ggcagcaauucgaccggcagggu

SEQ ID NO: 2385655 - RNA, 16 nt, Bordetella pertussis
ggcagcacaagggccc

SEQ ID NO: 2385656 - RNA, 22 nt, Bordetella pertussis
ggcagcacaagggccccucgcg

SEQ ID NO: 2385657 - RNA, 14 nt, Bordetella pertussis
ggcagcacccagcg

SEQ ID NO: 2385658 - RNA, 13 nt, Bordetella pertussis
ggcagcaccgcca

SEQ ID NO: 2385659 - RNA, 16 nt, Bordetella pertussis
ggcagcaccgccaugu

SEQ ID NO: 2385660 - RNA, 15 nt, Bordetella pertussis
ggcagcaccgcugcu

SEQ ID NO: 2385661 - RNA, 21 nt, Bordetella pertussis
ggcagcaccggggcagggcgg

SEQ ID NO: 2385662 - RNA, 15 nt, Bordetella pertussis
ggcagcacgauggcg

SEQ ID NO: 2385663 - RNA, 18 nt, Bordetella pertussis
ggcagcacgauggcgccc

SEQ ID NO: 2385664 - RNA, 13 nt, Bordetella pertussis
ggcagcacgcgca

SEQ ID NO: 2385665 - RNA, 18 nt, Bordetella pertussis
ggcagcacgcgcaccagg

SEQ ID NO: 2385666 - RNA, 19 nt, Bordetella pertussis
ggcagcacgcgcaccaggc

SEQ ID NO: 2385667 - RNA, 21 nt, Bordetella pertussis
ggcagcacgcgcaccaggccu

SEQ ID NO: 2385668 - RNA, 14 nt, Bordetella pertussis
ggcagcacuaccug

SEQ ID NO: 2385669 - RNA, 17 nt, Bordetella pertussis
ggcagcacuaccugcgc

SEQ ID NO: 2385670 - RNA, 18 nt, Bordetella pertussis
ggcagcagaucggcggcc

SEQ ID NO: 2385671 - RNA, 19 nt, Bordetella pertussis
ggcagcagaucggcggccu

SEQ ID NO: 2385672 - RNA, 14 nt, Bordetella pertussis
ggcagcagcacgcc

SEQ ID NO: 2385673 - RNA, 15 nt, Bordetella pertussis
ggcagcagcacgccc

SEQ ID NO: 2385674 - RNA, 13 nt, Bordetella pertussis
ggcagcagcagcg

SEQ ID NO: 2385675 - RNA, 14 nt, Bordetella pertussis
ggcagcagcagcgc

SEQ ID NO: 2385676 - RNA, 12 nt, Bordetella pertussis
ggcagcagcagg

SEQ ID NO: 2385677 - RNA, 13 nt, Bordetella pertussis
ggcagcagcaguu

SEQ ID NO: 2385678 - RNA, 23 nt, Bordetella pertussis
ggcagcagcaguugcagcaugau

SEQ ID NO: 2385679 - RNA, 14 nt, Bordetella pertussis
ggcagcagcgcgcc

SEQ ID NO: 2385680 - RNA, 19 nt, Bordetella pertussis
ggcagcagcgcgccgggcg

SEQ ID NO: 2385681 - RNA, 21 nt, Bordetella pertussis
ggcagcagcgcgccgggcggg

SEQ ID NO: 2385682 - RNA, 13 nt, Bordetella pertussis
ggcagcaggcgca

SEQ ID NO: 2385683 - RNA, 18 nt, Bordetella pertussis
ggcagcaggcgcaucagc

SEQ ID NO: 2385684 - RNA, 15 nt, Bordetella pertussis
ggcagcaggcugccg

SEQ ID NO: 2385685 - RNA, 23 nt, Bordetella pertussis
ggcagcagggauucggcgaacga

SEQ ID NO: 2385686 - RNA, 13 nt, Bordetella pertussis
ggcagcagggcca

SEQ ID NO: 2385687 - RNA, 17 nt, Bordetella pertussis
ggcagcauggcgcgcgg

SEQ ID NO: 2385688 - RNA, 13 nt, Bordetella pertussis
ggcagccaggugg

SEQ ID NO: 2385689 - RNA, 13 nt, Bordetella pertussis
ggcagccauccca

SEQ ID NO: 2385690 - RNA, 20 nt, Bordetella pertussis
ggcagccauccucgcccagc

SEQ ID NO: 2385691 - RNA, 21 nt, Bordetella pertussis
ggcagccauccucgcccagcg

SEQ ID NO: 2385692 - RNA, 22 nt, Bordetella pertussis
ggcagccauccucgcccagcgg

SEQ ID NO: 2385693 - RNA, 10 nt, Bordetella pertussis
ggcagcccca

SEQ ID NO: 2385694 - RNA, 13 nt, Bordetella pertussis
ggcagccccagcg

SEQ ID NO: 2385695 - RNA, 20 nt, Bordetella pertussis
ggcagccccagcgcccaggc

SEQ ID NO: 2385696 - RNA, 22 nt, Bordetella pertussis
ggcagccccagcgcccaggcga

SEQ ID NO: 2385697 - RNA, 16 nt, Bordetella pertussis
ggcagcccgcgcacgc

SEQ ID NO: 2385698 - RNA, 18 nt, Bordetella pertussis
ggcagcccgcgcacgccc

SEQ ID NO: 2385699 - RNA, 12 nt, Bordetella pertussis
ggcagccgauga

SEQ ID NO: 2385700 - RNA, 15 nt, Bordetella pertussis
ggcagccggccaugg

SEQ ID NO: 2385701 - RNA, 19 nt, Bordetella pertussis
ggcagcgaccgcggcgguc

SEQ ID NO: 2385702 - RNA, 22 nt, Bordetella pertussis
ggcagcgaccgcggcgguccug

SEQ ID NO: 2385703 - RNA, 20 nt, Bordetella pertussis
ggcagcgacucgccgugcug

SEQ ID NO: 2385704 - RNA, 22 nt, Bordetella pertussis
ggcagcgcccgcgccaucgcgu

SEQ ID NO: 2385705 - RNA, 21 nt, Bordetella pertussis
ggcagcgcgaacggcgggcgg

SEQ ID NO: 2385706 - RNA, 22 nt, Bordetella pertussis
ggcagcgcgaacggcgggcgga

SEQ ID NO: 2385707 - RNA, 16 nt, Bordetella pertussis
ggcagcgcgcaggaca

SEQ ID NO: 2385708 - RNA, 20 nt, Bordetella pertussis
ggcagcgcgcaggacaaggc

SEQ ID NO: 2385709 - RNA, 15 nt, Bordetella pertussis
ggcagcgcgcgcgug

SEQ ID NO: 2385710 - RNA, 16 nt, Bordetella pertussis
ggcagcgcgcgcguga

SEQ ID NO: 2385711 - RNA, 15 nt, Bordetella pertussis
ggcagcgcggccggc

SEQ ID NO: 2385712 - RNA, 16 nt, Bordetella pertussis
ggcagcgcggccggca

SEQ ID NO: 2385713 - RNA, 12 nt, Bordetella pertussis
ggcagcgcggcg

SEQ ID NO: 2385714 - RNA, 18 nt, Bordetella pertussis
ggcagcgcggcggcgacc

SEQ ID NO: 2385715 - RNA, 21 nt, Bordetella pertussis
ggcagcggagcgacggcagau

SEQ ID NO: 2385716 - RNA, 13 nt, Bordetella pertussis
ggcagcggcauca

SEQ ID NO: 2385717 - RNA, 19 nt, Bordetella pertussis
ggcagcggcaucacgccgg

SEQ ID NO: 2385718 - RNA, 13 nt, Bordetella pertussis
ggcagcggccaga

SEQ ID NO: 2385719 - RNA, 13 nt, Bordetella pertussis
ggcagcggccagc

SEQ ID NO: 2385720 - RNA, 21 nt, Bordetella pertussis
ggcagcggccagcgcggcggc

SEQ ID NO: 2385721 - RNA, 15 nt, Bordetella pertussis
ggcagcggccgcgcg

SEQ ID NO: 2385722 - RNA, 12 nt, Bordetella pertussis
ggcagcggcgcc

SEQ ID NO: 2385723 - RNA, 21 nt, Bordetella pertussis
ggcagcggcgccaugcgcacc

SEQ ID NO: 2385724 - RNA, 22 nt, Bordetella pertussis
ggcagcggcgccaugcgcacca

SEQ ID NO: 2385725 - RNA, 22 nt, Bordetella pertussis
ggcagcggcuccccuggucagg

SEQ ID NO: 2385726 - RNA, 14 nt, Bordetella pertussis
ggcagcgggccgca

SEQ ID NO: 2385727 - RNA, 16 nt, Bordetella pertussis
ggcagcgggccgcagc

SEQ ID NO: 2385728 - RNA, 17 nt, Bordetella pertussis
ggcagcgggucgaucgu

SEQ ID NO: 2385729 - RNA, 16 nt, Bordetella pertussis
ggcagcguacgcacgc

SEQ ID NO: 2385730 - RNA, 15 nt, Bordetella pertussis
ggcagcucgcggucg

SEQ ID NO: 2385731 - RNA, 23 nt, Bordetella pertussis
ggcagcugcgcgucgacagcaug

SEQ ID NO: 2385732 - RNA, 15 nt, Bordetella pertussis
ggcagcuggcgcggg

SEQ ID NO: 2385733 - RNA, 15 nt, Bordetella pertussis
ggcagcuugaccgcc

SEQ ID NO: 2385734 - RNA, 19 nt, Bordetella pertussis
ggcagcuugaccgccucca

SEQ ID NO: 2385735 - RNA, 16 nt, Bordetella pertussis
ggcagcuuggcgcgcc

SEQ ID NO: 2385736 - RNA, 16 nt, Bordetella pertussis
ggcagcuugucgaucg

SEQ ID NO: 2385737 - RNA, 17 nt, Bordetella pertussis
ggcagcuugucgaucgc

SEQ ID NO: 2385738 - RNA, 21 nt, Bordetella pertussis
ggcagcuugucgaucgccacc

SEQ ID NO: 2385739 - RNA, 22 nt, Bordetella pertussis
ggcagcuugucgaucgccacca

SEQ ID NO: 2385740 - RNA, 14 nt, Bordetella pertussis
ggcaggaagccggc

SEQ ID NO: 2385741 - RNA, 19 nt, Bordetella pertussis
ggcaggaagccggcccguu

SEQ ID NO: 2385742 - RNA, 14 nt, Bordetella pertussis
ggcaggacgccggc

SEQ ID NO: 2385743 - RNA, 16 nt, Bordetella pertussis
ggcaggacgccggcgc

SEQ ID NO: 2385744 - RNA, 20 nt, Bordetella pertussis
ggcaggacgccggcgccggc

SEQ ID NO: 2385745 - RNA, 23 nt, Bordetella pertussis
ggcaggacggggaacaggcgcgc

SEQ ID NO: 2385746 - RNA, 18 nt, Bordetella pertussis
ggcaggaggcggcgcgug

SEQ ID NO: 2385747 - RNA, 14 nt, Bordetella pertussis
ggcaggaucugcac

SEQ ID NO: 2385748 - RNA, 17 nt, Bordetella pertussis
ggcaggcacacgaccgg

SEQ ID NO: 2385749 - RNA, 20 nt, Bordetella pertussis
ggcaggcacacgaccggcuu

SEQ ID NO: 2385750 - RNA, 12 nt, Bordetella pertussis
ggcaggccagca

SEQ ID NO: 2385751 - RNA, 14 nt, Bordetella pertussis
ggcaggccagcaug

SEQ ID NO: 2385752 - RNA, 12 nt, Bordetella pertussis
ggcaggcccagc

SEQ ID NO: 2385753 - RNA, 14 nt, Bordetella pertussis
ggcaggcccagcca

SEQ ID NO: 2385754 - RNA, 15 nt, Bordetella pertussis
ggcaggcccagccag

SEQ ID NO: 2385755 - RNA, 17 nt, Bordetella pertussis
ggcaggcccagccagcg

SEQ ID NO: 2385756 - RNA, 21 nt, Bordetella pertussis
ggcaggcccaugauccgcacc

SEQ ID NO: 2385757 - RNA, 16 nt, Bordetella pertussis
ggcaggccccggcccg

SEQ ID NO: 2385758 - RNA, 16 nt, Bordetella pertussis
ggcaggcccugccgcc

SEQ ID NO: 2385759 - RNA, 14 nt, Bordetella pertussis
ggcaggccgcagcg

SEQ ID NO: 2385760 - RNA, 13 nt, Bordetella pertussis
ggcaggccgcgcc

SEQ ID NO: 2385761 - RNA, 15 nt, Bordetella pertussis
ggcaggccgcgccac

SEQ ID NO: 2385762 - RNA, 16 nt, Bordetella pertussis
ggcaggccgcgccaca

SEQ ID NO: 2385763 - RNA, 13 nt, Bordetella pertussis
ggcaggccgcgcu

SEQ ID NO: 2385764 - RNA, 16 nt, Bordetella pertussis
ggcaggccgcgcuggu

SEQ ID NO: 2385765 - RNA, 16 nt, Bordetella pertussis
ggcaggccgcgguggu

SEQ ID NO: 2385766 - RNA, 15 nt, Bordetella pertussis
ggcaggccggccagc

SEQ ID NO: 2385767 - RNA, 14 nt, Bordetella pertussis
ggcaggccggcgcg

SEQ ID NO: 2385768 - RNA, 17 nt, Bordetella pertussis
ggcaggccggcgcgcgc

SEQ ID NO: 2385769 - RNA, 18 nt, Bordetella pertussis
ggcaggccuggucgagcg

SEQ ID NO: 2385770 - RNA, 14 nt, Bordetella pertussis
ggcaggccuucgcg

SEQ ID NO: 2385771 - RNA, 14 nt, Bordetella pertussis
ggcaggcgcagcgg

SEQ ID NO: 2385772 - RNA, 21 nt, Bordetella pertussis
ggcaggcgccgccgcccggca

SEQ ID NO: 2385773 - RNA, 16 nt, Bordetella pertussis
ggcaggcgccggcugg

SEQ ID NO: 2385774 - RNA, 13 nt, Bordetella pertussis
ggcaggcgccugc

SEQ ID NO: 2385775 - RNA, 15 nt, Bordetella pertussis
ggcaggcgcgccagc

SEQ ID NO: 2385776 - RNA, 13 nt, Bordetella pertussis
ggcaggcgcgccg

SEQ ID NO: 2385777 - RNA, 19 nt, Bordetella pertussis
ggcaggcggcugacggucg

SEQ ID NO: 2385778 - RNA, 20 nt, Bordetella pertussis
ggcaggcgggccaggccggu

SEQ ID NO: 2385779 - RNA, 22 nt, Bordetella pertussis
ggcaggcgggcccgcaucgcgc

SEQ ID NO: 2385780 - RNA, 13 nt, Bordetella pertussis
ggcaggcggugcg

SEQ ID NO: 2385781 - RNA, 21 nt, Bordetella pertussis
ggcaggcgucuugccggaggu

SEQ ID NO: 2385782 - RNA, 20 nt, Bordetella pertussis
ggcaggcucagcccggcgag

SEQ ID NO: 2385783 - RNA, 21 nt, Bordetella pertussis
ggcaggcuccucgccacacgc

SEQ ID NO: 2385784 - RNA, 11 nt, Bordetella pertussis
ggcaggcuggc

SEQ ID NO: 2385785 - RNA, 13 nt, Bordetella pertussis
ggcaggcuggccg

SEQ ID NO: 2385786 - RNA, 19 nt, Bordetella pertussis
ggcaggcuggccggcgugg

SEQ ID NO: 2385787 - RNA, 13 nt, Bordetella pertussis
ggcagggccagcg

SEQ ID NO: 2385788 - RNA, 15 nt, Bordetella pertussis
ggcagggccagcgcc

SEQ ID NO: 2385789 - RNA, 16 nt, Bordetella pertussis
ggcagggccagcgcca

SEQ ID NO: 2385790 - RNA, 18 nt, Bordetella pertussis
ggcagggccagcgccagc

SEQ ID NO: 2385791 - RNA, 23 nt, Bordetella pertussis
ggcagggccauucucaauagcgg

SEQ ID NO: 2385792 - RNA, 22 nt, Bordetella pertussis
ggcagggccuccugcagcaggu

SEQ ID NO: 2385793 - RNA, 14 nt, Bordetella pertussis
ggcagggcgacguc

SEQ ID NO: 2385794 - RNA, 16 nt, Bordetella pertussis
ggcagggcgccgcgcg

SEQ ID NO: 2385795 - RNA, 15 nt, Bordetella pertussis
ggcagggcggccagg

SEQ ID NO: 2385796 - RNA, 16 nt, Bordetella pertussis
ggcagggcgggcggga

SEQ ID NO: 2385797 - RNA, 14 nt, Bordetella pertussis
ggcagggcggggga

SEQ ID NO: 2385798 - RNA, 23 nt, Bordetella pertussis
ggcagggcgggggacgcccgccc

SEQ ID NO: 2385799 - RNA, 15 nt, Bordetella pertussis
ggcagggcgucggcc

SEQ ID NO: 2385800 - RNA, 18 nt, Bordetella pertussis
ggcaggggcuccaggaac

SEQ ID NO: 2385801 - RNA, 16 nt, Bordetella pertussis
ggcaggggcucgcgcc

SEQ ID NO: 2385802 - RNA, 22 nt, Bordetella pertussis
ggcaggggcucgcgcccgagcg

SEQ ID NO: 2385803 - RNA, 15 nt, Bordetella pertussis
ggcagggugacgggc

SEQ ID NO: 2385804 - RNA, 17 nt, Bordetella pertussis
ggcagggugacgggcug

SEQ ID NO: 2385805 - RNA, 19 nt, Bordetella pertussis
ggcagggugacgggcuggg

SEQ ID NO: 2385806 - RNA, 17 nt, Bordetella pertussis
ggcagggugccuguccc

SEQ ID NO: 2385807 - RNA, 16 nt, Bordetella pertussis
ggcaggucgccagcag

SEQ ID NO: 2385808 - RNA, 17 nt, Bordetella pertussis
ggcaggucgccagcagg

SEQ ID NO: 2385809 - RNA, 21 nt, Bordetella pertussis
ggcaggucgccagcaggcccu

SEQ ID NO: 2385810 - RNA, 16 nt, Bordetella pertussis
ggcaggucggccagcg

SEQ ID NO: 2385811 - RNA, 16 nt, Bordetella pertussis
ggcaggucggcgcggg

SEQ ID NO: 2385812 - RNA, 15 nt, Bordetella pertussis
ggcaggucgggcagg

SEQ ID NO: 2385813 - RNA, 14 nt, Bordetella pertussis
ggcaggucggugca

SEQ ID NO: 2385814 - RNA, 19 nt, Bordetella pertussis
ggcaggucgucgagccggg

SEQ ID NO: 2385815 - RNA, 22 nt, Bordetella pertussis
ggcaggucgucgagccgggcca

SEQ ID NO: 2385816 - RNA, 14 nt, Bordetella pertussis
ggcaggugccccac

SEQ ID NO: 2385817 - RNA, 16 nt, Bordetella pertussis
ggcaggugccccacgc

SEQ ID NO: 2385818 - RNA, 16 nt, Bordetella pertussis
ggcaggugcgccagca

SEQ ID NO: 2385819 - RNA, 18 nt, Bordetella pertussis
ggcaggugcgccagcacg

SEQ ID NO: 2385820 - RNA, 13 nt, Bordetella pertussis
ggcaggugcggcc

SEQ ID NO: 2385821 - RNA, 16 nt, Bordetella pertussis
ggcaggugcggccgca

SEQ ID NO: 2385822 - RNA, 21 nt, Bordetella pertussis
ggcaggugcuuggcggucugg

SEQ ID NO: 2385823 - RNA, 22 nt, Bordetella pertussis
ggcagguugaaguugcucggcg

SEQ ID NO: 2385824 - RNA, 19 nt, Bordetella pertussis
ggcaguacgagcggcggcu

SEQ ID NO: 2385825 - RNA, 20 nt, Bordetella pertussis
ggcagucaaccguucauggc

SEQ ID NO: 2385826 - RNA, 13 nt, Bordetella pertussis
ggcagucagccgu

SEQ ID NO: 2385827 - RNA, 14 nt, Bordetella pertussis
ggcagucagccguu

SEQ ID NO: 2385828 - RNA, 22 nt, Bordetella pertussis
ggcagucagccguucauggcgu

SEQ ID NO: 2385829 - RNA, 21 nt, Bordetella pertussis
ggcaguccucguugcccgcgg

SEQ ID NO: 2385830 - RNA, 18 nt, Bordetella pertussis
ggcagucggcaggagccu

SEQ ID NO: 2385831 - RNA, 14 nt, Bordetella pertussis
ggcagugcgccugg

SEQ ID NO: 2385832 - RNA, 18 nt, Bordetella pertussis
ggcagugguggugcagcg

SEQ ID NO: 2385833 - RNA, 20 nt, Bordetella pertussis
ggcagugguggugcagcggc

SEQ ID NO: 2385834 - RNA, 19 nt, Bordetella pertussis
ggcaguucgcccggcucca

SEQ ID NO: 2385835 - RNA, 18 nt, Bordetella pertussis
ggcaguugcuggcggccg

SEQ ID NO: 2385836 - RNA, 16 nt, Bordetella pertussis
ggcaguuggcggcgca

SEQ ID NO: 2385837 - RNA, 18 nt, Bordetella pertussis
ggcaguuggcggcgcagc

SEQ ID NO: 2385838 - RNA, 23 nt, Bordetella pertussis
ggcauacaggcuguggccgcggc

SEQ ID NO: 2385839 - RNA, 19 nt, Bordetella pertussis
ggcauacauccucgaugcc

SEQ ID NO: 2385840 - RNA, 18 nt, Bordetella pertussis
ggcauagcccaggccgcc

SEQ ID NO: 2385841 - RNA, 15 nt, Bordetella pertussis
ggcauagcgcgccac

SEQ ID NO: 2385842 - RNA, 15 nt, Bordetella pertussis
ggcauagcguuuugu

SEQ ID NO: 2385843 - RNA, 20 nt, Bordetella pertussis
ggcauagcguuuuguacucu

SEQ ID NO: 2385844 - RNA, 21 nt, Bordetella pertussis
ggcauaggcggcgcaggccag

SEQ ID NO: 2385845 - RNA, 22 nt, Bordetella pertussis
ggcaucaauagcccgugcgggc

SEQ ID NO: 2385846 - RNA, 16 nt, Bordetella pertussis
ggcaucagcgcgaaca

SEQ ID NO: 2385847 - RNA, 14 nt, Bordetella pertussis
ggcaucaggggcuc

SEQ ID NO: 2385848 - RNA, 22 nt, Bordetella pertussis
ggcaucaggggcucggccaggu

SEQ ID NO: 2385849 - RNA, 20 nt, Bordetella pertussis
ggcaucagguuugcgggugc

SEQ ID NO: 2385850 - RNA, 17 nt, Bordetella pertussis
ggcaucaguucaggcug

SEQ ID NO: 2385851 - RNA, 19 nt, Bordetella pertussis
ggcauccagcucggcgaug

SEQ ID NO: 2385852 - RNA, 15 nt, Bordetella pertussis
ggcaucccgacaugc

SEQ ID NO: 2385853 - RNA, 21 nt, Bordetella pertussis
ggcaucccgacaugccgcccc

SEQ ID NO: 2385854 - RNA, 24 nt, Bordetella pertussis
ggcaucccugcuugcgcggaccuu

SEQ ID NO: 2385855 - RNA, 16 nt, Bordetella pertussis
ggcaucgacaugcccg

SEQ ID NO: 2385856 - RNA, 21 nt, Bordetella pertussis
ggcaucgacaugcccgccggc

SEQ ID NO: 2385857 - RNA, 17 nt, Bordetella pertussis
ggcaucgaccacgcgcg

SEQ ID NO: 2385858 - RNA, 17 nt, Bordetella pertussis
ggcaucgaccagcgcac

SEQ ID NO: 2385859 - RNA, 18 nt, Bordetella pertussis
ggcaucgagaaaccagcc

SEQ ID NO: 2385860 - RNA, 21 nt, Bordetella pertussis
ggcaucgagaaaccagccgcc

SEQ ID NO: 2385861 - RNA, 13 nt, Bordetella pertussis
ggcaucgcccacc

SEQ ID NO: 2385862 - RNA, 13 nt, Bordetella pertussis
ggcaucgccccgg

SEQ ID NO: 2385863 - RNA, 16 nt, Bordetella pertussis
ggcaucgccgcgggcg

SEQ ID NO: 2385864 - RNA, 18 nt, Bordetella pertussis
ggcaucgcgcugacagcg

SEQ ID NO: 2385865 - RNA, 19 nt, Bordetella pertussis
ggcaucgcgcugacagcgc

SEQ ID NO: 2385866 - RNA, 12 nt, Bordetella pertussis
ggcaucggcgcc

SEQ ID NO: 2385867 - RNA, 17 nt, Bordetella pertussis
ggcaucggcgccgcgcg

SEQ ID NO: 2385868 - RNA, 13 nt, Bordetella pertussis
ggcaucggcggcu

SEQ ID NO: 2385869 - RNA, 19 nt, Bordetella pertussis
ggcaucgggguuccacagc

SEQ ID NO: 2385870 - RNA, 21 nt, Bordetella pertussis
ggcaucgggguuccacagcgc

SEQ ID NO: 2385871 - RNA, 22 nt, Bordetella pertussis
ggcaucgggguuccacagcgcc

SEQ ID NO: 2385872 - RNA, 21 nt, Bordetella pertussis
ggcaucguaguugggcgccuu

SEQ ID NO: 2385873 - RNA, 20 nt, Bordetella pertussis
ggcaucgugugccagccccc

SEQ ID NO: 2385874 - RNA, 20 nt, Bordetella pertussis
ggcaucguucaggcgcaugg

SEQ ID NO: 2385875 - RNA, 13 nt, Bordetella pertussis
ggcaucugccagu

SEQ ID NO: 2385876 - RNA, 17 nt, Bordetella pertussis
ggcaucuugccuuggcg

SEQ ID NO: 2385877 - RNA, 23 nt, Bordetella pertussis
ggcaugaaacggcaagagccugg

SEQ ID NO: 2385878 - RNA, 16 nt, Bordetella pertussis
ggcaugaagcgcagca

SEQ ID NO: 2385879 - RNA, 18 nt, Bordetella pertussis
ggcaugaccgcggacgcc

SEQ ID NO: 2385880 - RNA, 22 nt, Bordetella pertussis
ggcaugaccgcggacgccaugg

SEQ ID NO: 2385881 - RNA, 20 nt, Bordetella pertussis
ggcaugacgaucacgggcug

SEQ ID NO: 2385882 - RNA, 17 nt, Bordetella pertussis
ggcaugccaugcgcacu

SEQ ID NO: 2385883 - RNA, 23 nt, Bordetella pertussis
ggcaugccggcauaggcggcgca

SEQ ID NO: 2385884 - RNA, 16 nt, Bordetella pertussis
ggcaugcgaaagccgg

SEQ ID NO: 2385885 - RNA, 21 nt, Bordetella pertussis
ggcaugcgaaagccggccucc

SEQ ID NO: 2385886 - RNA, 13 nt, Bordetella pertussis
ggcaugcgcaugc

SEQ ID NO: 2385887 - RNA, 16 nt, Bordetella pertussis
ggcaugcgcaugcugg

SEQ ID NO: 2385888 - RNA, 12 nt, Bordetella pertussis
ggcaugcgccgg

SEQ ID NO: 2385889 - RNA, 13 nt, Bordetella pertussis
ggcaugcgccggc

SEQ ID NO: 2385890 - RNA, 19 nt, Bordetella pertussis
ggcaugcgccggcccggca

SEQ ID NO: 2385891 - RNA, 15 nt, Bordetella pertussis
ggcaugcgccugcgc

SEQ ID NO: 2385892 - RNA, 22 nt, Bordetella pertussis
ggcaugcugcguaggcaggggc

SEQ ID NO: 2385893 - RNA, 21 nt, Bordetella pertussis
ggcauggaacgggcgggucgu

SEQ ID NO: 2385894 - RNA, 12 nt, Bordetella pertussis
ggcauggccaau

SEQ ID NO: 2385895 - RNA, 20 nt, Bordetella pertussis
ggcauggcccggcucgccga

SEQ ID NO: 2385896 - RNA, 15 nt, Bordetella pertussis
ggcauggccggcagg

SEQ ID NO: 2385897 - RNA, 14 nt, Bordetella pertussis
ggcauggcgaucga

SEQ ID NO: 2385898 - RNA, 16 nt, Bordetella pertussis
ggcauggcgccgcgcc

SEQ ID NO: 2385899 - RNA, 14 nt, Bordetella pertussis
ggcauggcggccag

SEQ ID NO: 2385900 - RNA, 15 nt, Bordetella pertussis
ggcaugggcccgggc

SEQ ID NO: 2385901 - RNA, 19 nt, Bordetella pertussis
ggcaugggcccgggcgcgc

SEQ ID NO: 2385902 - RNA, 14 nt, Bordetella pertussis
ggcaugggcggccc

SEQ ID NO: 2385903 - RNA, 20 nt, Bordetella pertussis
ggcaugggcgugccgcgcug

SEQ ID NO: 2385904 - RNA, 16 nt, Bordetella pertussis
ggcauggggcaggcgc

SEQ ID NO: 2385905 - RNA, 22 nt, Bordetella pertussis
ggcauggggcaggcgcagcggc

SEQ ID NO: 2385906 - RNA, 20 nt, Bordetella pertussis
ggcauggguaaagcgccggc

SEQ ID NO: 2385907 - RNA, 22 nt, Bordetella pertussis
ggcauggguaaagcgccggccc

SEQ ID NO: 2385908 - RNA, 23 nt, Bordetella pertussis
ggcauggguaaagcgccggcccg

SEQ ID NO: 2385909 - RNA, 21 nt, Bordetella pertussis
ggcaugguagcgguccagcug

SEQ ID NO: 2385910 - RNA, 17 nt, Bordetella pertussis
ggcauggucgaugaagu

SEQ ID NO: 2385911 - RNA, 21 nt, Bordetella pertussis
ggcauggucggcauggccauc

SEQ ID NO: 2385912 - RNA, 22 nt, Bordetella pertussis
ggcauggucggcauggccaucg

SEQ ID NO: 2385913 - RNA, 17 nt, Bordetella pertussis
ggcauucccgcccagcg

SEQ ID NO: 2385914 - RNA, 14 nt, Bordetella pertussis
ggcauucgaacaac

SEQ ID NO: 2385915 - RNA, 20 nt, Bordetella pertussis
ggcauugaagcuggcgccgg

SEQ ID NO: 2385916 - RNA, 14 nt, Bordetella pertussis
ggcauugacgccca

SEQ ID NO: 2385917 - RNA, 14 nt, Bordetella pertussis
ggcauugcccaggu

SEQ ID NO: 2385918 - RNA, 16 nt, Bordetella pertussis
ggcauugccggagcag

SEQ ID NO: 2385919 - RNA, 19 nt, Bordetella pertussis
ggcauugccggagcagcag

SEQ ID NO: 2385920 - RNA, 20 nt, Bordetella pertussis
ggcauugccggagcagcagc

SEQ ID NO: 2385921 - RNA, 17 nt, Bordetella pertussis
ggcauugcgccagccgu

SEQ ID NO: 2385922 - RNA, 13 nt, Bordetella pertussis
ggcauuggcggcg

SEQ ID NO: 2385923 - RNA, 16 nt, Bordetella pertussis
ggcauuggcggcggcg

SEQ ID NO: 2385924 - RNA, 15 nt, Bordetella pertussis
ggcauuucccagccg

SEQ ID NO: 2385925 - RNA, 16 nt, Bordetella pertussis
ggcauuucgcugggcg

SEQ ID NO: 2385926 - RNA, 19 nt, Bordetella pertussis
ggcauuucgcugggcgcgc

SEQ ID NO: 2385927 - RNA, 14 nt, Bordetella pertussis
ggccaacagcucgc

SEQ ID NO: 2385928 - RNA, 20 nt, Bordetella pertussis
ggccaacagcucgcgccagg

SEQ ID NO: 2385929 - RNA, 22 nt, Bordetella pertussis
ggccaacagcucgcgccagggc

SEQ ID NO: 2385930 - RNA, 18 nt, Bordetella pertussis
ggccaaccacgagcugca

SEQ ID NO: 2385931 - RNA, 21 nt, Bordetella pertussis
ggccaaccccgagggcgcggc

SEQ ID NO: 2385932 - RNA, 14 nt, Bordetella pertussis
ggccaacgccacgc

SEQ ID NO: 2385933 - RNA, 20 nt, Bordetella pertussis
ggccaacgccacgcccaucu

SEQ ID NO: 2385934 - RNA, 22 nt, Bordetella pertussis
ggccaacggaagagggcggggc

SEQ ID NO: 2385935 - RNA, 17 nt, Bordetella pertussis
ggccaacggcuggcugg

SEQ ID NO: 2385936 - RNA, 21 nt, Bordetella pertussis
ggccaacgggauccggcagca

SEQ ID NO: 2385937 - RNA, 14 nt, Bordetella pertussis
ggccaagacgcggg

SEQ ID NO: 2385938 - RNA, 13 nt, Bordetella pertussis
ggccaagauccag

SEQ ID NO: 2385939 - RNA, 14 nt, Bordetella pertussis
ggccaagcagcgcc

SEQ ID NO: 2385940 - RNA, 15 nt, Bordetella pertussis
ggccaagcagcgccu

SEQ ID NO: 2385941 - RNA, 16 nt, Bordetella pertussis
ggccaagcagcgccug

SEQ ID NO: 2385942 - RNA, 17 nt, Bordetella pertussis
ggccaagcagcgccugc

SEQ ID NO: 2385943 - RNA, 18 nt, Bordetella pertussis
ggccaagcagcgccugcc

SEQ ID NO: 2385944 - RNA, 14 nt, Bordetella pertussis
ggccaagcgcgccg

SEQ ID NO: 2385945 - RNA, 15 nt, Bordetella pertussis
ggccaagcgcgccgg

SEQ ID NO: 2385946 - RNA, 18 nt, Bordetella pertussis
ggccaaggcaagcagcga

SEQ ID NO: 2385947 - RNA, 22 nt, Bordetella pertussis
ggccaaggcauuggcgccgcgc

SEQ ID NO: 2385948 - RNA, 16 nt, Bordetella pertussis
ggccaaggccggcgcg

SEQ ID NO: 2385949 - RNA, 15 nt, Bordetella pertussis
ggccaagggcgccgc

SEQ ID NO: 2385950 - RNA, 14 nt, Bordetella pertussis
ggccaaucggccug

SEQ ID NO: 2385951 - RNA, 19 nt, Bordetella pertussis
ggccaaugccauuggugcg

SEQ ID NO: 2385952 - RNA, 22 nt, Bordetella pertussis
ggccaaugccuauuggcuguau

SEQ ID NO: 2385953 - RNA, 14 nt, Bordetella pertussis
ggccaaugcgccgc

SEQ ID NO: 2385954 - RNA, 15 nt, Bordetella pertussis
ggccaaugcgccgcg

SEQ ID NO: 2385955 - RNA, 16 nt, Bordetella pertussis
ggccaaugcgccgcgc

SEQ ID NO: 2385956 - RNA, 15 nt, Bordetella pertussis
ggccaauggccgcgg

SEQ ID NO: 2385957 - RNA, 18 nt, Bordetella pertussis
ggccacaagcggccccag

SEQ ID NO: 2385958 - RNA, 17 nt, Bordetella pertussis
ggccacaucaucgacca

SEQ ID NO: 2385959 - RNA, 19 nt, Bordetella pertussis
ggccacauggucgcccagc

SEQ ID NO: 2385960 - RNA, 20 nt, Bordetella pertussis
ggccacauggucgcccagca

SEQ ID NO: 2385961 - RNA, 19 nt, Bordetella pertussis
ggccaccaccaggcccagg

SEQ ID NO: 2385962 - RNA, 20 nt, Bordetella pertussis
ggccaccaccaggcccaggg

SEQ ID NO: 2385963 - RNA, 17 nt, Bordetella pertussis
ggccaccacgccgaugc

SEQ ID NO: 2385964 - RNA, 23 nt, Bordetella pertussis
ggccaccagcguguagagcaggc

SEQ ID NO: 2385965 - RNA, 22 nt, Bordetella pertussis
ggccaccaggccgucggccagg

SEQ ID NO: 2385966 - RNA, 13 nt, Bordetella pertussis
ggccaccaggcgc

SEQ ID NO: 2385967 - RNA, 18 nt, Bordetella pertussis
ggccaccccguugcagcc

SEQ ID NO: 2385968 - RNA, 22 nt, Bordetella pertussis
ggccaccccguugcagcccagc

SEQ ID NO: 2385969 - RNA, 17 nt, Bordetella pertussis
ggccacccgccgccggc

SEQ ID NO: 2385970 - RNA, 18 nt, Bordetella pertussis
ggccacccgccgccggcg

SEQ ID NO: 2385971 - RNA, 19 nt, Bordetella pertussis
ggccacccgccgccggcga

SEQ ID NO: 2385972 - RNA, 20 nt, Bordetella pertussis
ggccacccgccguaccgggc

SEQ ID NO: 2385973 - RNA, 22 nt, Bordetella pertussis
ggccacccgccguaccgggcgg

SEQ ID NO: 2385974 - RNA, 15 nt, Bordetella pertussis
ggccacccggcccau

SEQ ID NO: 2385975 - RNA, 17 nt, Bordetella pertussis
ggccaccgaagcggcgu

SEQ ID NO: 2385976 - RNA, 16 nt, Bordetella pertussis
ggccaccgacggcgcg

SEQ ID NO: 2385977 - RNA, 18 nt, Bordetella pertussis
ggccaccgacggcgcggc

SEQ ID NO: 2385978 - RNA, 23 nt, Bordetella pertussis
ggccaccgacggcgcggcgaucg

SEQ ID NO: 2385979 - RNA, 14 nt, Bordetella pertussis
ggccaccgagaugu

SEQ ID NO: 2385980 - RNA, 20 nt, Bordetella pertussis
ggccaccgccugugccagcu

SEQ ID NO: 2385981 - RNA, 22 nt, Bordetella pertussis
ggccaccgccugugccagcugg

SEQ ID NO: 2385982 - RNA, 16 nt, Bordetella pertussis
ggccaccgcggcggac

SEQ ID NO: 2385983 - RNA, 16 nt, Bordetella pertussis
ggccaccgcggugccg

SEQ ID NO: 2385984 - RNA, 19 nt, Bordetella pertussis
ggccaccgcggugccgcgc

SEQ ID NO: 2385985 - RNA, 20 nt, Bordetella pertussis
ggccaccgcggugccgcgcg

SEQ ID NO: 2385986 - RNA, 24 nt, Bordetella pertussis
ggccaccgcggugccgcgcgcggc

SEQ ID NO: 2385987 - RNA, 20 nt, Bordetella pertussis
ggccaccgcguugagcgccg

SEQ ID NO: 2385988 - RNA, 16 nt, Bordetella pertussis
ggccaccgucgccacc

SEQ ID NO: 2385989 - RNA, 14 nt, Bordetella pertussis
ggccaccucuucag

SEQ ID NO: 2385990 - RNA, 21 nt, Bordetella pertussis
ggccaccucuucagcccggcg

SEQ ID NO: 2385991 - RNA, 18 nt, Bordetella pertussis
ggccaccuggucgucggc

SEQ ID NO: 2385992 - RNA, 19 nt, Bordetella pertussis
ggccaccuggucgucggcc

SEQ ID NO: 2385993 - RNA, 22 nt, Bordetella pertussis
ggccaccuggucgucggccacg

SEQ ID NO: 2385994 - RNA, 17 nt, Bordetella pertussis
ggccacgaaacccagga

SEQ ID NO: 2385995 - RNA, 17 nt, Bordetella pertussis
ggccacgaacggcgcga

SEQ ID NO: 2385996 - RNA, 16 nt, Bordetella pertussis
ggccacgaagcgcagc

SEQ ID NO: 2385997 - RNA, 19 nt, Bordetella pertussis
ggccacgaagcgcagcacc

SEQ ID NO: 2385998 - RNA, 15 nt, Bordetella pertussis
ggccacgaauuccuc

SEQ ID NO: 2385999 - RNA, 22 nt, Bordetella pertussis
ggccacgaauuccucgccgccc

SEQ ID NO: 2386000 - RNA, 16 nt, Bordetella pertussis
ggccacgaccaccagc

SEQ ID NO: 2386001 - RNA, 17 nt, Bordetella pertussis
ggccacgaccaccagcg

SEQ ID NO: 2386002 - RNA, 14 nt, Bordetella pertussis
ggccacgagcagua

SEQ ID NO: 2386003 - RNA, 21 nt, Bordetella pertussis
ggccacgagcaguacacgcgc

SEQ ID NO: 2386004 - RNA, 15 nt, Bordetella pertussis
ggccacgaugaugga

SEQ ID NO: 2386005 - RNA, 22 nt, Bordetella pertussis
ggccacgaugauggaggccagg

SEQ ID NO: 2386006 - RNA, 23 nt, Bordetella pertussis
ggccacgaugauggaggccagga

SEQ ID NO: 2386007 - RNA, 19 nt, Bordetella pertussis
ggccacgauguugcgcagg

SEQ ID NO: 2386008 - RNA, 15 nt, Bordetella pertussis
ggccacgcagcgcgu

SEQ ID NO: 2386009 - RNA, 17 nt, Bordetella pertussis
ggccacgcagcgcgugu

SEQ ID NO: 2386010 - RNA, 18 nt, Bordetella pertussis
ggccacgcccacgcgccg

SEQ ID NO: 2386011 - RNA, 20 nt, Bordetella pertussis
ggccacgcccacgcgccgcc

SEQ ID NO: 2386012 - RNA, 22 nt, Bordetella pertussis
ggccacgcccacgcgccgccag

SEQ ID NO: 2386013 - RNA, 17 nt, Bordetella pertussis
ggccacgcccaggccgu

SEQ ID NO: 2386014 - RNA, 19 nt, Bordetella pertussis
ggccacgccggccgccugg

SEQ ID NO: 2386015 - RNA, 15 nt, Bordetella pertussis
ggccacgccggccgg

SEQ ID NO: 2386016 - RNA, 17 nt, Bordetella pertussis
ggccacgccggccgggg

SEQ ID NO: 2386017 - RNA, 11 nt, Bordetella pertussis
ggccacgcgca

SEQ ID NO: 2386018 - RNA, 15 nt, Bordetella pertussis
ggccacgcgcaacgc

SEQ ID NO: 2386019 - RNA, 17 nt, Bordetella pertussis
ggccacgcgcaacgccg

SEQ ID NO: 2386020 - RNA, 12 nt, Bordetella pertussis
ggccacgcgccg

SEQ ID NO: 2386021 - RNA, 14 nt, Bordetella pertussis
ggccacgcgccgcc

SEQ ID NO: 2386022 - RNA, 17 nt, Bordetella pertussis
ggccacgcgcgggcugg

SEQ ID NO: 2386023 - RNA, 16 nt, Bordetella pertussis
ggccacgcgcugcagc

SEQ ID NO: 2386024 - RNA, 20 nt, Bordetella pertussis
ggccacgcgcugcagcagca

SEQ ID NO: 2386025 - RNA, 22 nt, Bordetella pertussis
ggccacgcgcuguugcuggcca

SEQ ID NO: 2386026 - RNA, 21 nt, Bordetella pertussis
ggccacgcgcuugcgcgccac

SEQ ID NO: 2386027 - RNA, 13 nt, Bordetella pertussis
ggccacgcgggcg

SEQ ID NO: 2386028 - RNA, 21 nt, Bordetella pertussis
ggccacgcucacgcccguguc

SEQ ID NO: 2386029 - RNA, 17 nt, Bordetella pertussis
ggccacgcugcccugcu

SEQ ID NO: 2386030 - RNA, 18 nt, Bordetella pertussis
ggccacgcugcccugcug

SEQ ID NO: 2386031 - RNA, 13 nt, Bordetella pertussis
ggccacgcugcug

SEQ ID NO: 2386032 - RNA, 16 nt, Bordetella pertussis
ggccacgcugcugccg

SEQ ID NO: 2386033 - RNA, 12 nt, Bordetella pertussis
ggccacggccgg

SEQ ID NO: 2386034 - RNA, 14 nt, Bordetella pertussis
ggccacggccgggc

SEQ ID NO: 2386035 - RNA, 17 nt, Bordetella pertussis
ggccacggccgggccuc

SEQ ID NO: 2386036 - RNA, 12 nt, Bordetella pertussis
ggccacggccug

SEQ ID NO: 2386037 - RNA, 13 nt, Bordetella pertussis
ggccacggccugc

SEQ ID NO: 2386038 - RNA, 15 nt, Bordetella pertussis
ggccacggccugccc

SEQ ID NO: 2386039 - RNA, 17 nt, Bordetella pertussis
ggccacggccugcccgg

SEQ ID NO: 2386040 - RNA, 14 nt, Bordetella pertussis
ggccacggcgguga

SEQ ID NO: 2386041 - RNA, 13 nt, Bordetella pertussis
ggccacggcugga

SEQ ID NO: 2386042 - RNA, 13 nt, Bordetella pertussis
ggccacguccggg

SEQ ID NO: 2386043 - RNA, 19 nt, Bordetella pertussis
ggccacguccggguuggcg

SEQ ID NO: 2386044 - RNA, 13 nt, Bordetella pertussis
ggccacgucgccc

SEQ ID NO: 2386045 - RNA, 22 nt, Bordetella pertussis
ggccacgucggcggccgccuug

SEQ ID NO: 2386046 - RNA, 20 nt, Bordetella pertussis
ggccacguugauccagcgcu

SEQ ID NO: 2386047 - RNA, 15 nt, Bordetella pertussis
ggccacucgaugggc

SEQ ID NO: 2386048 - RNA, 15 nt, Bordetella pertussis
ggccacugcgccugg

SEQ ID NO: 2386049 - RNA, 12 nt, Bordetella pertussis
ggccacuggccg

SEQ ID NO: 2386050 - RNA, 16 nt, Bordetella pertussis
ggccacuuccagcgcc

SEQ ID NO: 2386051 - RNA, 19 nt, Bordetella pertussis
ggccacuuccuggugggcg

SEQ ID NO: 2386052 - RNA, 21 nt, Bordetella pertussis
ggccacuuccuggugggcggc

SEQ ID NO: 2386053 - RNA, 14 nt, Bordetella pertussis
ggccacuucgccgg

SEQ ID NO: 2386054 - RNA, 20 nt, Bordetella pertussis
ggccacuucgcggccgaugu

SEQ ID NO: 2386055 - RNA, 16 nt, Bordetella pertussis
ggccacuuucgcgcgc

SEQ ID NO: 2386056 - RNA, 17 nt, Bordetella pertussis
ggccagacauugucaag

SEQ ID NO: 2386057 - RNA, 21 nt, Bordetella pertussis
ggccagacauugucaagcagc

SEQ ID NO: 2386058 - RNA, 14 nt, Bordetella pertussis
ggccagaccgcgcg

SEQ ID NO: 2386059 - RNA, 18 nt, Bordetella pertussis
ggccagaccgcgcgcacc

SEQ ID NO: 2386060 - RNA, 20 nt, Bordetella pertussis
ggccagaccuugcgcgacgg

SEQ ID NO: 2386061 - RNA, 19 nt, Bordetella pertussis
ggccagauagcccaggcgg

SEQ ID NO: 2386062 - RNA, 19 nt, Bordetella pertussis
ggccagaucgaacacgagc

SEQ ID NO: 2386063 - RNA, 19 nt, Bordetella pertussis
ggccagaucggacgggccg

SEQ ID NO: 2386064 - RNA, 20 nt, Bordetella pertussis
ggccagaucgucgaacuugu

SEQ ID NO: 2386065 - RNA, 13 nt, Bordetella pertussis
ggccagcaagcgc

SEQ ID NO: 2386066 - RNA, 20 nt, Bordetella pertussis
ggccagcaagcgcgccauga

SEQ ID NO: 2386067 - RNA, 17 nt, Bordetella pertussis
ggccagcaagcgcucgg

SEQ ID NO: 2386068 - RNA, 20 nt, Bordetella pertussis
ggccagcaagcgcucggcca

SEQ ID NO: 2386069 - RNA, 20 nt, Bordetella pertussis
ggccagcacauacgccgccg

SEQ ID NO: 2386070 - RNA, 16 nt, Bordetella pertussis
ggccagcaccggcccg

SEQ ID NO: 2386071 - RNA, 15 nt, Bordetella pertussis
ggccagcaccggccg

SEQ ID NO: 2386072 - RNA, 16 nt, Bordetella pertussis
ggccagcaccggccgc

SEQ ID NO: 2386073 - RNA, 17 nt, Bordetella pertussis
ggccagcaccggccgcc

SEQ ID NO: 2386074 - RNA, 18 nt, Bordetella pertussis
ggccagcaccggccgccg

SEQ ID NO: 2386075 - RNA, 19 nt, Bordetella pertussis
ggccagcaccggccgccgc

SEQ ID NO: 2386076 - RNA, 13 nt, Bordetella pertussis
ggccagcacgccg

SEQ ID NO: 2386077 - RNA, 14 nt, Bordetella pertussis
ggccagcacgccgg

SEQ ID NO: 2386078 - RNA, 20 nt, Bordetella pertussis
ggccagcacgccggccaggu

SEQ ID NO: 2386079 - RNA, 16 nt, Bordetella pertussis
ggccagcacgccggcg

SEQ ID NO: 2386080 - RNA, 22 nt, Bordetella pertussis
ggccagcacgccggcgggcagg

SEQ ID NO: 2386081 - RNA, 14 nt, Bordetella pertussis
ggccagcacggcgc

SEQ ID NO: 2386082 - RNA, 19 nt, Bordetella pertussis
ggccagcagaaugccgccc

SEQ ID NO: 2386083 - RNA, 23 nt, Bordetella pertussis
ggccagcagaaugccgcccacga

SEQ ID NO: 2386084 - RNA, 13 nt, Bordetella pertussis
ggccagcagcacg

SEQ ID NO: 2386085 - RNA, 14 nt, Bordetella pertussis
ggccagcagcacga

SEQ ID NO: 2386086 - RNA, 16 nt, Bordetella pertussis
ggccagcagcgacggc

SEQ ID NO: 2386087 - RNA, 12 nt, Bordetella pertussis
ggccagcagcgc

SEQ ID NO: 2386088 - RNA, 17 nt, Bordetella pertussis
ggccagcagcgcaucgc

SEQ ID NO: 2386089 - RNA, 18 nt, Bordetella pertussis
ggccagcagcgcaucgcg

SEQ ID NO: 2386090 - RNA, 14 nt, Bordetella pertussis
ggccagcagcgccg

SEQ ID NO: 2386091 - RNA, 17 nt, Bordetella pertussis
ggccagcagcgccgcca

SEQ ID NO: 2386092 - RNA, 19 nt, Bordetella pertussis
ggccagcagcgccgccagc

SEQ ID NO: 2386093 - RNA, 16 nt, Bordetella pertussis
ggccagcagcgccugg

SEQ ID NO: 2386094 - RNA, 17 nt, Bordetella pertussis
ggccagcagcgcgugca

SEQ ID NO: 2386095 - RNA, 22 nt, Bordetella pertussis
ggccagcagcgcgugcagccag

SEQ ID NO: 2386096 - RNA, 23 nt, Bordetella pertussis
ggccagcagcgcgugcagccagc

SEQ ID NO: 2386097 - RNA, 18 nt, Bordetella pertussis
ggccagcagcggcagguc

SEQ ID NO: 2386098 - RNA, 14 nt, Bordetella pertussis
ggccagcagcucgg

SEQ ID NO: 2386099 - RNA, 23 nt, Bordetella pertussis
ggccagcagcucggccaccgccg

SEQ ID NO: 2386100 - RNA, 18 nt, Bordetella pertussis
ggccagcaggcucagcgg

SEQ ID NO: 2386101 - RNA, 14 nt, Bordetella pertussis
ggccagcaggucgu

SEQ ID NO: 2386102 - RNA, 18 nt, Bordetella pertussis
ggccagcaggucguuggc

SEQ ID NO: 2386103 - RNA, 23 nt, Bordetella pertussis
ggccagcaguguuucggccugcu

SEQ ID NO: 2386104 - RNA, 14 nt, Bordetella pertussis
ggccagcaugcugg

SEQ ID NO: 2386105 - RNA, 15 nt, Bordetella pertussis
ggccagccacgccgg

SEQ ID NO: 2386106 - RNA, 16 nt, Bordetella pertussis
ggccagccacgccggc

SEQ ID NO: 2386107 - RNA, 15 nt, Bordetella pertussis
ggccagccagcgccg

SEQ ID NO: 2386108 - RNA, 20 nt, Bordetella pertussis
ggccagccagcgccgcagcg

SEQ ID NO: 2386109 - RNA, 14 nt, Bordetella pertussis
ggccagccaggcgg

SEQ ID NO: 2386110 - RNA, 18 nt, Bordetella pertussis
ggccagccaggcgguggc

SEQ ID NO: 2386111 - RNA, 19 nt, Bordetella pertussis
ggccagccauugccgcacg

SEQ ID NO: 2386112 - RNA, 14 nt, Bordetella pertussis
ggccagccccggcg

SEQ ID NO: 2386113 - RNA, 18 nt, Bordetella pertussis
ggccagccccggcgcgcc

SEQ ID NO: 2386114 - RNA, 21 nt, Bordetella pertussis
ggccagccccggcgcgccggc

SEQ ID NO: 2386115 - RNA, 17 nt, Bordetella pertussis
ggccagcccggugaucg

SEQ ID NO: 2386116 - RNA, 14 nt, Bordetella pertussis
ggccagccgcucgc

SEQ ID NO: 2386117 - RNA, 17 nt, Bordetella pertussis
ggccagccggcccagca

SEQ ID NO: 2386118 - RNA, 17 nt, Bordetella pertussis
ggccagccgggcgaucg

SEQ ID NO: 2386119 - RNA, 18 nt, Bordetella pertussis
ggccagccgggcgaucgc

SEQ ID NO: 2386120 - RNA, 14 nt, Bordetella pertussis
ggccagccgggugg

SEQ ID NO: 2386121 - RNA, 15 nt, Bordetella pertussis
ggccagccuggccuu

SEQ ID NO: 2386122 - RNA, 18 nt, Bordetella pertussis
ggccagccuggccuugcg

SEQ ID NO: 2386123 - RNA, 15 nt, Bordetella pertussis
ggccagccuggcgcc

SEQ ID NO: 2386124 - RNA, 19 nt, Bordetella pertussis
ggccagccuggcgccaacc

SEQ ID NO: 2386125 - RNA, 22 nt, Bordetella pertussis
ggccagccuggcgccaacccgc

SEQ ID NO: 2386126 - RNA, 13 nt, Bordetella pertussis
ggccagccugugc

SEQ ID NO: 2386127 - RNA, 13 nt, Bordetella pertussis
ggccagcgccacc

SEQ ID NO: 2386128 - RNA, 14 nt, Bordetella pertussis
ggccagcgccacca

SEQ ID NO: 2386129 - RNA, 18 nt, Bordetella pertussis
ggccagcgccaccaccgg

SEQ ID NO: 2386130 - RNA, 13 nt, Bordetella pertussis
ggccagcgccaga

SEQ ID NO: 2386131 - RNA, 13 nt, Bordetella pertussis
ggccagcgccagc

SEQ ID NO: 2386132 - RNA, 15 nt, Bordetella pertussis
ggccagcgccagcac

SEQ ID NO: 2386133 - RNA, 16 nt, Bordetella pertussis
ggccagcgccagccgc

SEQ ID NO: 2386134 - RNA, 19 nt, Bordetella pertussis
ggccagcgccgaaauaugg

SEQ ID NO: 2386135 - RNA, 12 nt, Bordetella pertussis
ggccagcgccgc

SEQ ID NO: 2386136 - RNA, 13 nt, Bordetella pertussis
ggccagcgccgcc

SEQ ID NO: 2386137 - RNA, 18 nt, Bordetella pertussis
ggccagcgccgccagccg

SEQ ID NO: 2386138 - RNA, 16 nt, Bordetella pertussis
ggccagcgccgccauc

SEQ ID NO: 2386139 - RNA, 16 nt, Bordetella pertussis
ggccagcgccgcgccg

SEQ ID NO: 2386140 - RNA, 16 nt, Bordetella pertussis
ggccagcgccgcggcc

SEQ ID NO: 2386141 - RNA, 18 nt, Bordetella pertussis
ggccagcgccgcggccgg

SEQ ID NO: 2386142 - RNA, 20 nt, Bordetella pertussis
ggccagcgccgcggccggcg

SEQ ID NO: 2386143 - RNA, 17 nt, Bordetella pertussis
ggccagcgccgcgguga

SEQ ID NO: 2386144 - RNA, 16 nt, Bordetella pertussis
ggccagcgccuggaug

SEQ ID NO: 2386145 - RNA, 11 nt, Bordetella pertussis
ggccagcgcga

SEQ ID NO: 2386146 - RNA, 14 nt, Bordetella pertussis
ggccagcgcgacgg

SEQ ID NO: 2386147 - RNA, 15 nt, Bordetella pertussis
ggccagcgcgacggc

SEQ ID NO: 2386148 - RNA, 16 nt, Bordetella pertussis
ggccagcgcgacggcc

SEQ ID NO: 2386149 - RNA, 20 nt, Bordetella pertussis
ggccagcgcgaucucgcgca

SEQ ID NO: 2386150 - RNA, 24 nt, Bordetella pertussis
ggccagcgcgaucucgcgcagggu

SEQ ID NO: 2386151 - RNA, 16 nt, Bordetella pertussis
ggccagcgcgcaggug

SEQ ID NO: 2386152 - RNA, 23 nt, Bordetella pertussis
ggccagcgcgcaggugugccagc

SEQ ID NO: 2386153 - RNA, 13 nt, Bordetella pertussis
ggccagcgcgccc

SEQ ID NO: 2386154 - RNA, 22 nt, Bordetella pertussis
ggccagcgcgcccucguugacg

SEQ ID NO: 2386155 - RNA, 17 nt, Bordetella pertussis
ggccagcgcgccgccag

SEQ ID NO: 2386156 - RNA, 18 nt, Bordetella pertussis
ggccagcgcgccgccagc

SEQ ID NO: 2386157 - RNA, 15 nt, Bordetella pertussis
ggccagcgcgccggc

SEQ ID NO: 2386158 - RNA, 19 nt, Bordetella pertussis
ggccagcgcgccggccagg

SEQ ID NO: 2386159 - RNA, 21 nt, Bordetella pertussis
ggccagcgcgccggccagggc

SEQ ID NO: 2386160 - RNA, 17 nt, Bordetella pertussis
ggccagcgcgcgccagu

SEQ ID NO: 2386161 - RNA, 13 nt, Bordetella pertussis
ggccagcgcgcgg

SEQ ID NO: 2386162 - RNA, 14 nt, Bordetella pertussis
ggccagcgcgcggc

SEQ ID NO: 2386163 - RNA, 15 nt, Bordetella pertussis
ggccagcgcgcggcc

SEQ ID NO: 2386164 - RNA, 23 nt, Bordetella pertussis
ggccagcgcgcggccggccgcgc

SEQ ID NO: 2386165 - RNA, 19 nt, Bordetella pertussis
ggccagcgcgcggcgcagc

SEQ ID NO: 2386166 - RNA, 23 nt, Bordetella pertussis
ggccagcgcgcggcgcagcgcac

SEQ ID NO: 2386167 - RNA, 16 nt, Bordetella pertussis
ggccagcgcgcgggcg

SEQ ID NO: 2386168 - RNA, 20 nt, Bordetella pertussis
ggccagcgcgcggggcaggc

SEQ ID NO: 2386169 - RNA, 14 nt, Bordetella pertussis
ggccagcgcgcgug

SEQ ID NO: 2386170 - RNA, 15 nt, Bordetella pertussis
ggccagcgcgcgugc

SEQ ID NO: 2386171 - RNA, 17 nt, Bordetella pertussis
ggccagcgcgcgugcgu

SEQ ID NO: 2386172 - RNA, 12 nt, Bordetella pertussis
ggccagcgcggc

SEQ ID NO: 2386173 - RNA, 13 nt, Bordetella pertussis
ggccagcgcggca

SEQ ID NO: 2386174 - RNA, 16 nt, Bordetella pertussis
ggccagcgcggccagg

SEQ ID NO: 2386175 - RNA, 21 nt, Bordetella pertussis
ggccagcgcggccaggucggc

SEQ ID NO: 2386176 - RNA, 15 nt, Bordetella pertussis
ggccagcgcggcggc

SEQ ID NO: 2386177 - RNA, 21 nt, Bordetella pertussis
ggccagcgcgguugacugcag

SEQ ID NO: 2386178 - RNA, 17 nt, Bordetella pertussis
ggccagcgcgucgagca

SEQ ID NO: 2386179 - RNA, 19 nt, Bordetella pertussis
ggccagcgcgucgagcagc

SEQ ID NO: 2386180 - RNA, 21 nt, Bordetella pertussis
ggccagcggaugaugcggcgc

SEQ ID NO: 2386181 - RNA, 13 nt, Bordetella pertussis
ggccagcggcagg

SEQ ID NO: 2386182 - RNA, 14 nt, Bordetella pertussis
ggccagcggcaggc

SEQ ID NO: 2386183 - RNA, 20 nt, Bordetella pertussis
ggccagcggcaggcccagcu

SEQ ID NO: 2386184 - RNA, 23 nt, Bordetella pertussis
ggccagcggcgaaaugucgagcg

SEQ ID NO: 2386185 - RNA, 15 nt, Bordetella pertussis
ggccagcggcgcuua

SEQ ID NO: 2386186 - RNA, 23 nt, Bordetella pertussis
ggccagcggcgcuuaccgcgccg

SEQ ID NO: 2386187 - RNA, 20 nt, Bordetella pertussis
ggccagcgguacgccgaacu

SEQ ID NO: 2386188 - RNA, 14 nt, Bordetella pertussis
ggccagcuccaccg

SEQ ID NO: 2386189 - RNA, 13 nt, Bordetella pertussis
ggccagcuccagg

SEQ ID NO: 2386190 - RNA, 13 nt, Bordetella pertussis
ggccagcuccccg

SEQ ID NO: 2386191 - RNA, 15 nt, Bordetella pertussis
ggccagcuccccggg

SEQ ID NO: 2386192 - RNA, 20 nt, Bordetella pertussis
ggccagcuccccgggcguga

SEQ ID NO: 2386193 - RNA, 19 nt, Bordetella pertussis
ggccagcucggcggccgcc

SEQ ID NO: 2386194 - RNA, 21 nt, Bordetella pertussis
ggccagcucggcggccgccug

SEQ ID NO: 2386195 - RNA, 18 nt, Bordetella pertussis
ggccagcugcaugcgcac

SEQ ID NO: 2386196 - RNA, 15 nt, Bordetella pertussis
ggccagcugcgcccc

SEQ ID NO: 2386197 - RNA, 14 nt, Bordetella pertussis
ggccagcugcgugg

SEQ ID NO: 2386198 - RNA, 19 nt, Bordetella pertussis
ggccagcugcguggcgacg

SEQ ID NO: 2386199 - RNA, 22 nt, Bordetella pertussis
ggccagcugcguggcgacgcgc

SEQ ID NO: 2386200 - RNA, 12 nt, Bordetella pertussis
ggccagcuggcg

SEQ ID NO: 2386201 - RNA, 17 nt, Bordetella pertussis
ggccagcuggcgcgugg

SEQ ID NO: 2386202 - RNA, 23 nt, Bordetella pertussis
ggccagcuggcgcguggccgcca

SEQ ID NO: 2386203 - RNA, 14 nt, Bordetella pertussis
ggccagcuggcggc

SEQ ID NO: 2386204 - RNA, 15 nt, Bordetella pertussis
ggccagcuggcggcg

SEQ ID NO: 2386205 - RNA, 17 nt, Bordetella pertussis
ggccagcuugaccgcca

SEQ ID NO: 2386206 - RNA, 20 nt, Bordetella pertussis
ggccagcuugaccgccagca

SEQ ID NO: 2386207 - RNA, 22 nt, Bordetella pertussis
ggccagcuugaccgccagcauc

SEQ ID NO: 2386208 - RNA, 23 nt, Bordetella pertussis
ggccagcuugaccuugagcacgc

SEQ ID NO: 2386209 - RNA, 18 nt, Bordetella pertussis
ggccagcuugacguccag

SEQ ID NO: 2386210 - RNA, 21 nt, Bordetella pertussis
ggccagcuugacguccagcca

SEQ ID NO: 2386211 - RNA, 23 nt, Bordetella pertussis
ggccagcuugacguccagccagg

SEQ ID NO: 2386212 - RNA, 16 nt, Bordetella pertussis
ggccagcuugagcagg

SEQ ID NO: 2386213 - RNA, 14 nt, Bordetella pertussis
ggccagcuugccgc

SEQ ID NO: 2386214 - RNA, 19 nt, Bordetella pertussis
ggccagcuuguagcggcca

SEQ ID NO: 2386215 - RNA, 19 nt, Bordetella pertussis
ggccaggaagcggcgcacc

SEQ ID NO: 2386216 - RNA, 23 nt, Bordetella pertussis
ggccaggaagcggcgcaccagcg

SEQ ID NO: 2386217 - RNA, 18 nt, Bordetella pertussis
ggccaggaccgaggugcc

SEQ ID NO: 2386218 - RNA, 18 nt, Bordetella pertussis
ggccaggacgaucccggc

SEQ ID NO: 2386219 - RNA, 17 nt, Bordetella pertussis
ggccaggacggugucgc

SEQ ID NO: 2386220 - RNA, 20 nt, Bordetella pertussis
ggccaggaucgcggccagcc

SEQ ID NO: 2386221 - RNA, 11 nt, Bordetella pertussis
ggccaggccau

SEQ ID NO: 2386222 - RNA, 14 nt, Bordetella pertussis
ggccaggccauggc

SEQ ID NO: 2386223 - RNA, 16 nt, Bordetella pertussis
ggccaggccauggcgc

SEQ ID NO: 2386224 - RNA, 18 nt, Bordetella pertussis
ggccaggccauggcgcga

SEQ ID NO: 2386225 - RNA, 18 nt, Bordetella pertussis
ggccaggcccacggcgcc

SEQ ID NO: 2386226 - RNA, 12 nt, Bordetella pertussis
ggccaggcccau

SEQ ID NO: 2386227 - RNA, 17 nt, Bordetella pertussis
ggccaggcccaugccgc

SEQ ID NO: 2386228 - RNA, 23 nt, Bordetella pertussis
ggccaggcccaugccgcccgcca

SEQ ID NO: 2386229 - RNA, 14 nt, Bordetella pertussis
ggccaggcccugcg

SEQ ID NO: 2386230 - RNA, 13 nt, Bordetella pertussis
ggccaggccgaac

SEQ ID NO: 2386231 - RNA, 14 nt, Bordetella pertussis
ggccaggccgaacg

SEQ ID NO: 2386232 - RNA, 13 nt, Bordetella pertussis
ggccaggccgccg

SEQ ID NO: 2386233 - RNA, 14 nt, Bordetella pertussis
ggccaggccgccgc

SEQ ID NO: 2386234 - RNA, 15 nt, Bordetella pertussis
ggccaggccgccgcc

SEQ ID NO: 2386235 - RNA, 13 nt, Bordetella pertussis
ggccaggccggcc

SEQ ID NO: 2386236 - RNA, 14 nt, Bordetella pertussis
ggccaggccggccc

SEQ ID NO: 2386237 - RNA, 22 nt, Bordetella pertussis
ggccaggccggcccaguccagg

SEQ ID NO: 2386238 - RNA, 14 nt, Bordetella pertussis
ggccaggccggccu

SEQ ID NO: 2386239 - RNA, 18 nt, Bordetella pertussis
ggccaggccggccugcag

SEQ ID NO: 2386240 - RNA, 16 nt, Bordetella pertussis
ggccaggccggccuug

SEQ ID NO: 2386241 - RNA, 18 nt, Bordetella pertussis
ggccaggccggcgcgccg

SEQ ID NO: 2386242 - RNA, 21 nt, Bordetella pertussis
ggccaggccggcgcgccggcc

SEQ ID NO: 2386243 - RNA, 16 nt, Bordetella pertussis
ggccaggccggggccg

SEQ ID NO: 2386244 - RNA, 22 nt, Bordetella pertussis
ggccaggccgguggaccagggc

SEQ ID NO: 2386245 - RNA, 13 nt, Bordetella pertussis
ggccaggcgcagu

SEQ ID NO: 2386246 - RNA, 13 nt, Bordetella pertussis
ggccaggcgccag

SEQ ID NO: 2386247 - RNA, 20 nt, Bordetella pertussis
ggccaggcgccagaugcgcc

SEQ ID NO: 2386248 - RNA, 22 nt, Bordetella pertussis
ggccaggcgccgcucagcgcgg

SEQ ID NO: 2386249 - RNA, 15 nt, Bordetella pertussis
ggccaggcgccggcg

SEQ ID NO: 2386250 - RNA, 14 nt, Bordetella pertussis
ggccaggcgcgugc

SEQ ID NO: 2386251 - RNA, 19 nt, Bordetella pertussis
ggccaggcgcgugcgcagg

SEQ ID NO: 2386252 - RNA, 20 nt, Bordetella pertussis
ggccaggcgcgugcgcaggc

SEQ ID NO: 2386253 - RNA, 24 nt, Bordetella pertussis
ggccaggcgcgugcgcaggcgcgu

SEQ ID NO: 2386254 - RNA, 15 nt, Bordetella pertussis
ggccaggcgcucagc

SEQ ID NO: 2386255 - RNA, 21 nt, Bordetella pertussis
ggccaggcgcuccagcaccug

SEQ ID NO: 2386256 - RNA, 17 nt, Bordetella pertussis
ggccaggcgcugcgcgg

SEQ ID NO: 2386257 - RNA, 14 nt, Bordetella pertussis
ggccaggcggggug

SEQ ID NO: 2386258 - RNA, 13 nt, Bordetella pertussis
ggccaggcucagc

SEQ ID NO: 2386259 - RNA, 18 nt, Bordetella pertussis
ggccaggcugaccagcgc

SEQ ID NO: 2386260 - RNA, 20 nt, Bordetella pertussis
ggccaggcugaccagcgcgu

SEQ ID NO: 2386261 - RNA, 22 nt, Bordetella pertussis
ggccagggaggaacugggcgcc

SEQ ID NO: 2386262 - RNA, 23 nt, Bordetella pertussis
ggccagggaggaacugggcgccg

SEQ ID NO: 2386263 - RNA, 16 nt, Bordetella pertussis
ggccagggccaccacg

SEQ ID NO: 2386264 - RNA, 16 nt, Bordetella pertussis
ggccagggccacgccg

SEQ ID NO: 2386265 - RNA, 18 nt, Bordetella pertussis
ggccagggccacgccggc

SEQ ID NO: 2386266 - RNA, 23 nt, Bordetella pertussis
ggccagggccacgccggccgccu

SEQ ID NO: 2386267 - RNA, 21 nt, Bordetella pertussis
ggccagggccucgcgggccuu

SEQ ID NO: 2386268 - RNA, 17 nt, Bordetella pertussis
ggccagggccugcgggc

SEQ ID NO: 2386269 - RNA, 23 nt, Bordetella pertussis
ggccagggccugcgggccgggca

SEQ ID NO: 2386270 - RNA, 20 nt, Bordetella pertussis
ggccagggcgaugcggcggc

SEQ ID NO: 2386271 - RNA, 14 nt, Bordetella pertussis
ggccagggcggcga

SEQ ID NO: 2386272 - RNA, 14 nt, Bordetella pertussis
ggccaggggcagcu

SEQ ID NO: 2386273 - RNA, 16 nt, Bordetella pertussis
ggccaggggcgcuggu

SEQ ID NO: 2386274 - RNA, 19 nt, Bordetella pertussis
ggccagggucaggggcagg

SEQ ID NO: 2386275 - RNA, 22 nt, Bordetella pertussis
ggccagggucgguugcaguccu

SEQ ID NO: 2386276 - RNA, 19 nt, Bordetella pertussis
ggccagggugccccgccgg

SEQ ID NO: 2386277 - RNA, 22 nt, Bordetella pertussis
ggccagguaaugaucgcccuug

SEQ ID NO: 2386278 - RNA, 20 nt, Bordetella pertussis
ggccagguacaggccgccgg

SEQ ID NO: 2386279 - RNA, 21 nt, Bordetella pertussis
ggccagguacaggccgccggu

SEQ ID NO: 2386280 - RNA, 23 nt, Bordetella pertussis
ggccagguacaggccgccgguca

SEQ ID NO: 2386281 - RNA, 16 nt, Bordetella pertussis
ggccagguagucgucg

SEQ ID NO: 2386282 - RNA, 17 nt, Bordetella pertussis
ggccagguauugcgggg

SEQ ID NO: 2386283 - RNA, 18 nt, Bordetella pertussis
ggccagguauugcggggc

SEQ ID NO: 2386284 - RNA, 19 nt, Bordetella pertussis
ggccagguauugcggggcg

SEQ ID NO: 2386285 - RNA, 21 nt, Bordetella pertussis
ggccagguauugcggggcggc

SEQ ID NO: 2386286 - RNA, 14 nt, Bordetella pertussis
ggccaggucgcgca

SEQ ID NO: 2386287 - RNA, 20 nt, Bordetella pertussis
ggccaggucgcgcaucaccu

SEQ ID NO: 2386288 - RNA, 16 nt, Bordetella pertussis
ggccaggucggcggcc

SEQ ID NO: 2386289 - RNA, 19 nt, Bordetella pertussis
ggccaggucggcggccagc

SEQ ID NO: 2386290 - RNA, 21 nt, Bordetella pertussis
ggccaggucggcggccagcgc

SEQ ID NO: 2386291 - RNA, 23 nt, Bordetella pertussis
ggccaggucggcggccagcgcgc

SEQ ID NO: 2386292 - RNA, 16 nt, Bordetella pertussis
ggccaggucggcgucg

SEQ ID NO: 2386293 - RNA, 17 nt, Bordetella pertussis
ggccaggucggcgucgu

SEQ ID NO: 2386294 - RNA, 18 nt, Bordetella pertussis
ggccaggucggcgucguc

SEQ ID NO: 2386295 - RNA, 19 nt, Bordetella pertussis
ggccaggugcacagcgucc

SEQ ID NO: 2386296 - RNA, 15 nt, Bordetella pertussis
ggccaggugcgccau

SEQ ID NO: 2386297 - RNA, 17 nt, Bordetella pertussis
ggccaggugcgccaugc

SEQ ID NO: 2386298 - RNA, 19 nt, Bordetella pertussis
ggccaggugcgccaugcgg

SEQ ID NO: 2386299 - RNA, 12 nt, Bordetella pertussis
ggccagguggcg

SEQ ID NO: 2386300 - RNA, 17 nt, Bordetella pertussis
ggccagguggcggcggc

SEQ ID NO: 2386301 - RNA, 15 nt, Bordetella pertussis
ggccagguucugguc

SEQ ID NO: 2386302 - RNA, 22 nt, Bordetella pertussis
ggccagguucuggucgaacugg

SEQ ID NO: 2386303 - RNA, 19 nt, Bordetella pertussis
ggccagguugggugcgccg

SEQ ID NO: 2386304 - RNA, 21 nt, Bordetella pertussis
ggccagguugggugcgccgcc

SEQ ID NO: 2386305 - RNA, 21 nt, Bordetella pertussis
ggccaguacgucggacagggc

SEQ ID NO: 2386306 - RNA, 16 nt, Bordetella pertussis
ggccagucccaggauc

SEQ ID NO: 2386307 - RNA, 17 nt, Bordetella pertussis
ggccagucccaggauca

SEQ ID NO: 2386308 - RNA, 15 nt, Bordetella pertussis
ggccaguccgcagcg

SEQ ID NO: 2386309 - RNA, 16 nt, Bordetella pertussis
ggccaguccgcagcgc

SEQ ID NO: 2386310 - RNA, 19 nt, Bordetella pertussis
ggccaguccgcagcgcagc

SEQ ID NO: 2386311 - RNA, 18 nt, Bordetella pertussis
ggccagugauggccugcu

SEQ ID NO: 2386312 - RNA, 14 nt, Bordetella pertussis
ggccagugccugga

SEQ ID NO: 2386313 - RNA, 23 nt, Bordetella pertussis
ggccagugccuggacgcgcuggc

SEQ ID NO: 2386314 - RNA, 16 nt, Bordetella pertussis
ggccaguggcgcggcg

SEQ ID NO: 2386315 - RNA, 20 nt, Bordetella pertussis
ggccaguuccgugcgcgccc

SEQ ID NO: 2386316 - RNA, 23 nt, Bordetella pertussis
ggccaguuccgugcgcgcccgau

SEQ ID NO: 2386317 - RNA, 20 nt, Bordetella pertussis
ggccaguucgacgcccaugc

SEQ ID NO: 2386318 - RNA, 15 nt, Bordetella pertussis
ggccaguucgcggcg

SEQ ID NO: 2386319 - RNA, 18 nt, Bordetella pertussis
ggccaguucgcggcgcag

SEQ ID NO: 2386320 - RNA, 19 nt, Bordetella pertussis
ggccaguucgcggcgcagc

SEQ ID NO: 2386321 - RNA, 23 nt, Bordetella pertussis
ggccaguucgcggcgcagcgcgu

SEQ ID NO: 2386322 - RNA, 21 nt, Bordetella pertussis
ggccaguucggcuugcacgcc

SEQ ID NO: 2386323 - RNA, 21 nt, Bordetella pertussis
ggccaucaagaaggucgacga

SEQ ID NO: 2386324 - RNA, 13 nt, Bordetella pertussis
ggccaucacgccg

SEQ ID NO: 2386325 - RNA, 16 nt, Bordetella pertussis
ggccaucacgccgauc

SEQ ID NO: 2386326 - RNA, 17 nt, Bordetella pertussis
ggccaucaggugcaggg

SEQ ID NO: 2386327 - RNA, 20 nt, Bordetella pertussis
ggccaucaggugcaggguug

SEQ ID NO: 2386328 - RNA, 14 nt, Bordetella pertussis
ggccauccggccac

SEQ ID NO: 2386329 - RNA, 17 nt, Bordetella pertussis
ggccauccguccgccag

SEQ ID NO: 2386330 - RNA, 14 nt, Bordetella pertussis
ggccaucgccaugg

SEQ ID NO: 2386331 - RNA, 18 nt, Bordetella pertussis
ggccaucgccauggccac

SEQ ID NO: 2386332 - RNA, 22 nt, Bordetella pertussis
ggccaucgccauggccacgacg

SEQ ID NO: 2386333 - RNA, 13 nt, Bordetella pertussis
ggccaucgccgcc

SEQ ID NO: 2386334 - RNA, 16 nt, Bordetella pertussis
ggccaucgccgccacg

SEQ ID NO: 2386335 - RNA, 15 nt, Bordetella pertussis
ggccaucgccgccgc

SEQ ID NO: 2386336 - RNA, 17 nt, Bordetella pertussis
ggccaucgccgccgccg

SEQ ID NO: 2386337 - RNA, 18 nt, Bordetella pertussis
ggccaucgccgccgccgg

SEQ ID NO: 2386338 - RNA, 20 nt, Bordetella pertussis
ggccaucgccgccgccgggc

SEQ ID NO: 2386339 - RNA, 23 nt, Bordetella pertussis
ggccaucgccgccgccgggcugg

SEQ ID NO: 2386340 - RNA, 20 nt, Bordetella pertussis
ggccaucgcggucgaugacc

SEQ ID NO: 2386341 - RNA, 15 nt, Bordetella pertussis
ggccaucggcgccaa

SEQ ID NO: 2386342 - RNA, 17 nt, Bordetella pertussis
ggccaucggcgccaagc

SEQ ID NO: 2386343 - RNA, 18 nt, Bordetella pertussis
ggccaucggcgccaagcg

SEQ ID NO: 2386344 - RNA, 24 nt, Bordetella pertussis
ggccaucguacgcgugggcggcgg

SEQ ID NO: 2386345 - RNA, 16 nt, Bordetella pertussis
ggccaucuaugucggc

SEQ ID NO: 2386346 - RNA, 19 nt, Bordetella pertussis
ggccaucuuggugcgcgcc

SEQ ID NO: 2386347 - RNA, 21 nt, Bordetella pertussis
ggccaucuuggugcgcgccag

SEQ ID NO: 2386348 - RNA, 22 nt, Bordetella pertussis
ggccaucuuggugcgcgccagg

SEQ ID NO: 2386349 - RNA, 23 nt, Bordetella pertussis
ggccaucuuggugcgcgccaggu

SEQ ID NO: 2386350 - RNA, 19 nt, Bordetella pertussis
ggccaugaucaggccgaac

SEQ ID NO: 2386351 - RNA, 16 nt, Bordetella pertussis
ggccaugcaccagcac

SEQ ID NO: 2386352 - RNA, 17 nt, Bordetella pertussis
ggccaugcaccagcaca

SEQ ID NO: 2386353 - RNA, 14 nt, Bordetella pertussis
ggccaugcccaggc

SEQ ID NO: 2386354 - RNA, 18 nt, Bordetella pertussis
ggccaugcccaggcccag

SEQ ID NO: 2386355 - RNA, 14 nt, Bordetella pertussis
ggccaugccgacgg

SEQ ID NO: 2386356 - RNA, 16 nt, Bordetella pertussis
ggccaugccggguugc

SEQ ID NO: 2386357 - RNA, 17 nt, Bordetella pertussis
ggccaugccggguugca

SEQ ID NO: 2386358 - RNA, 16 nt, Bordetella pertussis
ggccaugccguccugc

SEQ ID NO: 2386359 - RNA, 19 nt, Bordetella pertussis
ggccaugccguccugcugc

SEQ ID NO: 2386360 - RNA, 22 nt, Bordetella pertussis
ggccaugccguccugcugcggc

SEQ ID NO: 2386361 - RNA, 19 nt, Bordetella pertussis
ggccaugccgucgcgcacc

SEQ ID NO: 2386362 - RNA, 13 nt, Bordetella pertussis
ggccaugcgcgcc

SEQ ID NO: 2386363 - RNA, 15 nt, Bordetella pertussis
ggccaugcgcgccag

SEQ ID NO: 2386364 - RNA, 20 nt, Bordetella pertussis
ggccaugcgggucaggccgc

SEQ ID NO: 2386365 - RNA, 23 nt, Bordetella pertussis
ggccaugcgggucaggccgccgu

SEQ ID NO: 2386366 - RNA, 18 nt, Bordetella pertussis
ggccaugcggugcgccgc

SEQ ID NO: 2386367 - RNA, 16 nt, Bordetella pertussis
ggccaugcucagcagc

SEQ ID NO: 2386368 - RNA, 15 nt, Bordetella pertussis
ggccaugcucgucca

SEQ ID NO: 2386369 - RNA, 18 nt, Bordetella pertussis
ggccaugcugggccauca

SEQ ID NO: 2386370 - RNA, 14 nt, Bordetella pertussis
ggccauggacagca

SEQ ID NO: 2386371 - RNA, 21 nt, Bordetella pertussis
ggccauggacgaguugcucgg

SEQ ID NO: 2386372 - RNA, 20 nt, Bordetella pertussis
ggccauggcacaggccaucg

SEQ ID NO: 2386373 - RNA, 16 nt, Bordetella pertussis
ggccauggccagcuug

SEQ ID NO: 2386374 - RNA, 16 nt, Bordetella pertussis
ggccauggcccuugcc

SEQ ID NO: 2386375 - RNA, 22 nt, Bordetella pertussis
ggccauggcgcuguuggccggc

SEQ ID NO: 2386376 - RNA, 13 nt, Bordetella pertussis
ggccauggcggcc

SEQ ID NO: 2386377 - RNA, 15 nt, Bordetella pertussis
ggccauggcggccgg

SEQ ID NO: 2386378 - RNA, 23 nt, Bordetella pertussis
ggccauggcggccggcguugcgc

SEQ ID NO: 2386379 - RNA, 16 nt, Bordetella pertussis
ggccauggugccccau

SEQ ID NO: 2386380 - RNA, 20 nt, Bordetella pertussis
ggccauggugccccaugcgc

SEQ ID NO: 2386381 - RNA, 19 nt, Bordetella pertussis
ggccauguagauggccgcc

SEQ ID NO: 2386382 - RNA, 15 nt, Bordetella pertussis
ggccauguccagcag

SEQ ID NO: 2386383 - RNA, 14 nt, Bordetella pertussis
ggccauguccuggc

SEQ ID NO: 2386384 - RNA, 17 nt, Bordetella pertussis
ggccauucagaccgggu

SEQ ID NO: 2386385 - RNA, 19 nt, Bordetella pertussis
ggccauugaaagcgcgagc

SEQ ID NO: 2386386 - RNA, 20 nt, Bordetella pertussis
ggccauugaaagcgcgagcu

SEQ ID NO: 2386387 - RNA, 22 nt, Bordetella pertussis
ggccauugaaagcgcgagcucu

SEQ ID NO: 2386388 - RNA, 16 nt, Bordetella pertussis
ggccauugcuggcgcg

SEQ ID NO: 2386389 - RNA, 12 nt, Bordetella pertussis
ggcccaagcccg

SEQ ID NO: 2386390 - RNA, 13 nt, Bordetella pertussis
ggcccaagcccgu

SEQ ID NO: 2386391 - RNA, 14 nt, Bordetella pertussis
ggcccaagcccgug

SEQ ID NO: 2386392 - RNA, 19 nt, Bordetella pertussis
ggcccaaggccccgcgacc

SEQ ID NO: 2386393 - RNA, 14 nt, Bordetella pertussis
ggcccacagcgccc

SEQ ID NO: 2386394 - RNA, 17 nt, Bordetella pertussis
ggcccacagcgccccca

SEQ ID NO: 2386395 - RNA, 19 nt, Bordetella pertussis
ggcccacaucgucgcgcug

SEQ ID NO: 2386396 - RNA, 21 nt, Bordetella pertussis
ggcccacaucgucgcgcuggg

SEQ ID NO: 2386397 - RNA, 23 nt, Bordetella pertussis
ggcccacaucgucgcgcuggggc

SEQ ID NO: 2386398 - RNA, 21 nt, Bordetella pertussis
ggcccaccagggccagcuuga

SEQ ID NO: 2386399 - RNA, 15 nt, Bordetella pertussis
ggcccaccggcaugc

SEQ ID NO: 2386400 - RNA, 12 nt, Bordetella pertussis
ggcccacgccca

SEQ ID NO: 2386401 - RNA, 13 nt, Bordetella pertussis
ggcccacgccgcc

SEQ ID NO: 2386402 - RNA, 14 nt, Bordetella pertussis
ggcccacgcgcacg

SEQ ID NO: 2386403 - RNA, 15 nt, Bordetella pertussis
ggcccacgcgcacga

SEQ ID NO: 2386404 - RNA, 14 nt, Bordetella pertussis
ggcccacggcaucg

SEQ ID NO: 2386405 - RNA, 22 nt, Bordetella pertussis
ggcccacggcaucgccgcgggc

SEQ ID NO: 2386406 - RNA, 13 nt, Bordetella pertussis
ggcccacggccag

SEQ ID NO: 2386407 - RNA, 14 nt, Bordetella pertussis
ggcccacggccagc

SEQ ID NO: 2386408 - RNA, 17 nt, Bordetella pertussis
ggcccacucggugcgcg

SEQ ID NO: 2386409 - RNA, 21 nt, Bordetella pertussis
ggcccacucggugcgcgcgcc

SEQ ID NO: 2386410 - RNA, 22 nt, Bordetella pertussis
ggcccacucggugcgcgcgccc

SEQ ID NO: 2386411 - RNA, 17 nt, Bordetella pertussis
ggcccacuggaucgccg

SEQ ID NO: 2386412 - RNA, 16 nt, Bordetella pertussis
ggcccagaccaagcgc

SEQ ID NO: 2386413 - RNA, 22 nt, Bordetella pertussis
ggcccagcaauuaugcguggcc

SEQ ID NO: 2386414 - RNA, 14 nt, Bordetella pertussis
ggcccagcaccgcc

SEQ ID NO: 2386415 - RNA, 16 nt, Bordetella pertussis
ggcccagcaccgccgc

SEQ ID NO: 2386416 - RNA, 19 nt, Bordetella pertussis
ggcccagcaccgccgccag

SEQ ID NO: 2386417 - RNA, 16 nt, Bordetella pertussis
ggcccagcacgcgcgc

SEQ ID NO: 2386418 - RNA, 18 nt, Bordetella pertussis
ggcccagcacgcgcgcca

SEQ ID NO: 2386419 - RNA, 22 nt, Bordetella pertussis
ggcccagcacgcgcgccagcug

SEQ ID NO: 2386420 - RNA, 12 nt, Bordetella pertussis
ggcccagcauca

SEQ ID NO: 2386421 - RNA, 12 nt, Bordetella pertussis
ggcccagccagc

SEQ ID NO: 2386422 - RNA, 13 nt, Bordetella pertussis
ggcccagccagcc

SEQ ID NO: 2386423 - RNA, 15 nt, Bordetella pertussis
ggcccagccagcccu

SEQ ID NO: 2386424 - RNA, 21 nt, Bordetella pertussis
ggcccagccagcccuggccca

SEQ ID NO: 2386425 - RNA, 21 nt, Bordetella pertussis
ggcccagccagcggugcgcgg

SEQ ID NO: 2386426 - RNA, 22 nt, Bordetella pertussis
ggcccagccagcggugcgcggc

SEQ ID NO: 2386427 - RNA, 17 nt, Bordetella pertussis
ggcccagcccgccgauc

SEQ ID NO: 2386428 - RNA, 15 nt, Bordetella pertussis
ggcccagccgcaugc

SEQ ID NO: 2386429 - RNA, 18 nt, Bordetella pertussis
ggcccagccgcucggcca

SEQ ID NO: 2386430 - RNA, 20 nt, Bordetella pertussis
ggcccagcgcauagacccac

SEQ ID NO: 2386431 - RNA, 17 nt, Bordetella pertussis
ggcccagcgccagcagc

SEQ ID NO: 2386432 - RNA, 18 nt, Bordetella pertussis
ggcccagcgccagcagca

SEQ ID NO: 2386433 - RNA, 14 nt, Bordetella pertussis
ggcccagcgcgcca

SEQ ID NO: 2386434 - RNA, 16 nt, Bordetella pertussis
ggcccagcgcggcggc

SEQ ID NO: 2386435 - RNA, 17 nt, Bordetella pertussis
ggcccagcgcggcggcc

SEQ ID NO: 2386436 - RNA, 22 nt, Bordetella pertussis
ggcccagcgcggcggccaugcc

SEQ ID NO: 2386437 - RNA, 15 nt, Bordetella pertussis
ggcccagcuccagcu

SEQ ID NO: 2386438 - RNA, 16 nt, Bordetella pertussis
ggcccagcuccagcug

SEQ ID NO: 2386439 - RNA, 21 nt, Bordetella pertussis
ggcccagcuccagcuggcgca

SEQ ID NO: 2386440 - RNA, 20 nt, Bordetella pertussis
ggcccagcucugguccaggc

SEQ ID NO: 2386441 - RNA, 12 nt, Bordetella pertussis
ggcccagcuggg

SEQ ID NO: 2386442 - RNA, 17 nt, Bordetella pertussis
ggcccagcugggcggcg

SEQ ID NO: 2386443 - RNA, 21 nt, Bordetella pertussis
ggcccagcuugaacaggcagu

SEQ ID NO: 2386444 - RNA, 20 nt, Bordetella pertussis
ggcccaggaaaccggcgacc

SEQ ID NO: 2386445 - RNA, 19 nt, Bordetella pertussis
ggcccaggauggcgccagc

SEQ ID NO: 2386446 - RNA, 20 nt, Bordetella pertussis
ggcccaggcaaugcgcaggc

SEQ ID NO: 2386447 - RNA, 20 nt, Bordetella pertussis
ggcccaggccgaaccacagc

SEQ ID NO: 2386448 - RNA, 15 nt, Bordetella pertussis
ggcccaggccgggcg

SEQ ID NO: 2386449 - RNA, 18 nt, Bordetella pertussis
ggcccaggcgacccagca

SEQ ID NO: 2386450 - RNA, 20 nt, Bordetella pertussis
ggcccaggcgacccagcacc

SEQ ID NO: 2386451 - RNA, 16 nt, Bordetella pertussis
ggcccaggcgcgcugg

SEQ ID NO: 2386452 - RNA, 23 nt, Bordetella pertussis
ggcccaggcgcgcuggcgcucgg

SEQ ID NO: 2386453 - RNA, 16 nt, Bordetella pertussis
ggcccaggcgggccag

SEQ ID NO: 2386454 - RNA, 16 nt, Bordetella pertussis
ggcccaggcguccagg

SEQ ID NO: 2386455 - RNA, 20 nt, Bordetella pertussis
ggcccaggcguccaggcugc

SEQ ID NO: 2386456 - RNA, 15 nt, Bordetella pertussis
ggcccagggcagcgg

SEQ ID NO: 2386457 - RNA, 14 nt, Bordetella pertussis
ggcccagggccagg

SEQ ID NO: 2386458 - RNA, 20 nt, Bordetella pertussis
ggcccaggucaucgccaggc

SEQ ID NO: 2386459 - RNA, 13 nt, Bordetella pertussis
ggcccaguccagg

SEQ ID NO: 2386460 - RNA, 14 nt, Bordetella pertussis
ggcccaguccaggg

SEQ ID NO: 2386461 - RNA, 17 nt, Bordetella pertussis
ggcccaguucggcgacg

SEQ ID NO: 2386462 - RNA, 16 nt, Bordetella pertussis
ggcccaguucggcgcg

SEQ ID NO: 2386463 - RNA, 22 nt, Bordetella pertussis
ggcccaguucggcgcgcgugcc

SEQ ID NO: 2386464 - RNA, 23 nt, Bordetella pertussis
ggcccaguugaaucggcgcgagc

SEQ ID NO: 2386465 - RNA, 23 nt, Bordetella pertussis
ggcccaguugacgaugcccaggu

SEQ ID NO: 2386466 - RNA, 16 nt, Bordetella pertussis
ggcccauaugccgccg

SEQ ID NO: 2386467 - RNA, 19 nt, Bordetella pertussis
ggcccauaugccgccggcc

SEQ ID NO: 2386468 - RNA, 17 nt, Bordetella pertussis
ggcccauccaucuggug

SEQ ID NO: 2386469 - RNA, 21 nt, Bordetella pertussis
ggcccaucuguacggccggcu

SEQ ID NO: 2386470 - RNA, 23 nt, Bordetella pertussis
ggcccaugaacaggcacgacgcg

SEQ ID NO: 2386471 - RNA, 17 nt, Bordetella pertussis
ggcccaugaaggcggcc

SEQ ID NO: 2386472 - RNA, 19 nt, Bordetella pertussis
ggcccaugaaggcggccag

SEQ ID NO: 2386473 - RNA, 20 nt, Bordetella pertussis
ggcccaugaaggcggccagc

SEQ ID NO: 2386474 - RNA, 21 nt, Bordetella pertussis
ggcccaugaaggcggccagca

SEQ ID NO: 2386475 - RNA, 19 nt, Bordetella pertussis
ggcccaugacgaccuugcg

SEQ ID NO: 2386476 - RNA, 22 nt, Bordetella pertussis
ggcccaugacgaccuugcggcc

SEQ ID NO: 2386477 - RNA, 15 nt, Bordetella pertussis
ggcccaugacgccgg

SEQ ID NO: 2386478 - RNA, 14 nt, Bordetella pertussis
ggcccaugccgccc

SEQ ID NO: 2386479 - RNA, 16 nt, Bordetella pertussis
ggcccaugccgcccgc

SEQ ID NO: 2386480 - RNA, 18 nt, Bordetella pertussis
ggcccaugccgcccgcca

SEQ ID NO: 2386481 - RNA, 13 nt, Bordetella pertussis
ggcccaugccgcg

SEQ ID NO: 2386482 - RNA, 15 nt, Bordetella pertussis
ggcccaugccgcgga

SEQ ID NO: 2386483 - RNA, 15 nt, Bordetella pertussis
ggccccaccuggcgg

SEQ ID NO: 2386484 - RNA, 14 nt, Bordetella pertussis
ggccccagcgccgc

SEQ ID NO: 2386485 - RNA, 16 nt, Bordetella pertussis
ggccccaugcgcggca

SEQ ID NO: 2386486 - RNA, 22 nt, Bordetella pertussis
ggccccaugucgaucuggcuca

SEQ ID NO: 2386487 - RNA, 14 nt, Bordetella pertussis
ggccccccggcgcg

SEQ ID NO: 2386488 - RNA, 17 nt, Bordetella pertussis
ggccccccggcgcggcc

SEQ ID NO: 2386489 - RNA, 15 nt, Bordetella pertussis
ggccccgcaaggggc

SEQ ID NO: 2386490 - RNA, 23 nt, Bordetella pertussis
ggccccgcaaggggccggcgccg

SEQ ID NO: 2386491 - RNA, 13 nt, Bordetella pertussis
ggccccgccaggg

SEQ ID NO: 2386492 - RNA, 19 nt, Bordetella pertussis
ggccccgccgggccgcgcc

SEQ ID NO: 2386493 - RNA, 19 nt, Bordetella pertussis
ggccccgcgaggggcccuu

SEQ ID NO: 2386494 - RNA, 14 nt, Bordetella pertussis
ggccccgcgcgagc

SEQ ID NO: 2386495 - RNA, 15 nt, Bordetella pertussis
ggccccgcgucggcg

SEQ ID NO: 2386496 - RNA, 15 nt, Bordetella pertussis
ggccccggcccggcg

SEQ ID NO: 2386497 - RNA, 16 nt, Bordetella pertussis
ggccccggcccggcgg

SEQ ID NO: 2386498 - RNA, 23 nt, Bordetella pertussis
ggccccggccucccggaccagca

SEQ ID NO: 2386499 - RNA, 13 nt, Bordetella pertussis
ggccccguugucg

SEQ ID NO: 2386500 - RNA, 18 nt, Bordetella pertussis
ggccccguugucgccgcg

SEQ ID NO: 2386501 - RNA, 18 nt, Bordetella pertussis
ggccccucaaggggugga

SEQ ID NO: 2386502 - RNA, 15 nt, Bordetella pertussis
ggccccucgcggggc

SEQ ID NO: 2386503 - RNA, 24 nt, Bordetella pertussis
ggccccucgcggggcccuugugcg

SEQ ID NO: 2386504 - RNA, 12 nt, Bordetella pertussis
ggccccuguccu

SEQ ID NO: 2386505 - RNA, 21 nt, Bordetella pertussis
ggccccuguccucgcaggaau

SEQ ID NO: 2386506 - RNA, 17 nt, Bordetella pertussis
ggcccgaaacgcgcagc

SEQ ID NO: 2386507 - RNA, 18 nt, Bordetella pertussis
ggcccgaaacgcgcagca

SEQ ID NO: 2386508 - RNA, 19 nt, Bordetella pertussis
ggcccgaacggcccaucca

SEQ ID NO: 2386509 - RNA, 22 nt, Bordetella pertussis
ggcccgaagauuuccucgcgca

SEQ ID NO: 2386510 - RNA, 20 nt, Bordetella pertussis
ggcccgacaccuggacccgc

SEQ ID NO: 2386511 - RNA, 21 nt, Bordetella pertussis
ggcccgacaccuggacccgcu

SEQ ID NO: 2386512 - RNA, 23 nt, Bordetella pertussis
ggcccgacaccuggacccgcucg

SEQ ID NO: 2386513 - RNA, 17 nt, Bordetella pertussis
ggcccgauggcggggau

SEQ ID NO: 2386514 - RNA, 19 nt, Bordetella pertussis
ggcccgauggcggggaugg

SEQ ID NO: 2386515 - RNA, 20 nt, Bordetella pertussis
ggcccgauggcggggaugga

SEQ ID NO: 2386516 - RNA, 16 nt, Bordetella pertussis
ggcccgcaccgggcgg

SEQ ID NO: 2386517 - RNA, 23 nt, Bordetella pertussis
ggcccgcaccgggcggcccggcg

SEQ ID NO: 2386518 - RNA, 20 nt, Bordetella pertussis
ggcccgcagguggggcagca

SEQ ID NO: 2386519 - RNA, 18 nt, Bordetella pertussis
ggcccgcaucgcgcgccg

SEQ ID NO: 2386520 - RNA, 19 nt, Bordetella pertussis
ggcccgcaucgcgcgccgc

SEQ ID NO: 2386521 - RNA, 14 nt, Bordetella pertussis
ggcccgccaccacg

SEQ ID NO: 2386522 - RNA, 17 nt, Bordetella pertussis
ggcccgccacgcgggcc

SEQ ID NO: 2386523 - RNA, 18 nt, Bordetella pertussis
ggcccgccacgcgggccg

SEQ ID NO: 2386524 - RNA, 22 nt, Bordetella pertussis
ggcccgccacgcgggccggccg

SEQ ID NO: 2386525 - RNA, 21 nt, Bordetella pertussis
ggcccgccacggcgcccgagg

SEQ ID NO: 2386526 - RNA, 14 nt, Bordetella pertussis
ggcccgccagcaag

SEQ ID NO: 2386527 - RNA, 16 nt, Bordetella pertussis
ggcccgccaggaagcg

SEQ ID NO: 2386528 - RNA, 12 nt, Bordetella pertussis
ggcccgccaggg

SEQ ID NO: 2386529 - RNA, 15 nt, Bordetella pertussis
ggcccgccagggcgu

SEQ ID NO: 2386530 - RNA, 19 nt, Bordetella pertussis
ggcccgccccgggcaggag

SEQ ID NO: 2386531 - RNA, 17 nt, Bordetella pertussis
ggcccgcccgcccuggg

SEQ ID NO: 2386532 - RNA, 22 nt, Bordetella pertussis
ggcccgcccgcccugggcagca

SEQ ID NO: 2386533 - RNA, 22 nt, Bordetella pertussis
ggcccgcccgcggaucggggca

SEQ ID NO: 2386534 - RNA, 22 nt, Bordetella pertussis
ggcccgccgacugggcuugccg

SEQ ID NO: 2386535 - RNA, 18 nt, Bordetella pertussis
ggcccgccgcggcaggcc

SEQ ID NO: 2386536 - RNA, 15 nt, Bordetella pertussis
ggcccgccucaaccu

SEQ ID NO: 2386537 - RNA, 12 nt, Bordetella pertussis
ggcccgcgcaga

SEQ ID NO: 2386538 - RNA, 12 nt, Bordetella pertussis
ggcccgcgccag

SEQ ID NO: 2386539 - RNA, 13 nt, Bordetella pertussis
ggcccgcgccagc

SEQ ID NO: 2386540 - RNA, 16 nt, Bordetella pertussis
ggcccgcgccagcgcc

SEQ ID NO: 2386541 - RNA, 14 nt, Bordetella pertussis
ggcccgcgcccugc

SEQ ID NO: 2386542 - RNA, 17 nt, Bordetella pertussis
ggcccgcgccgacggcg

SEQ ID NO: 2386543 - RNA, 19 nt, Bordetella pertussis
ggcccgcgccgcgucaugg

SEQ ID NO: 2386544 - RNA, 16 nt, Bordetella pertussis
ggcccgcgcgagcggc

SEQ ID NO: 2386545 - RNA, 19 nt, Bordetella pertussis
ggcccgcgcgagcggcgug

SEQ ID NO: 2386546 - RNA, 22 nt, Bordetella pertussis
ggcccgcgcgccuuacuccggc

SEQ ID NO: 2386547 - RNA, 12 nt, Bordetella pertussis
ggcccgcgcggc

SEQ ID NO: 2386548 - RNA, 13 nt, Bordetella pertussis
ggcccgcgcggcc

SEQ ID NO: 2386549 - RNA, 18 nt, Bordetella pertussis
ggcccgcgcggccagcgc

SEQ ID NO: 2386550 - RNA, 13 nt, Bordetella pertussis
ggcccgcggccgc

SEQ ID NO: 2386551 - RNA, 15 nt, Bordetella pertussis
ggcccgcggccgcgu

SEQ ID NO: 2386552 - RNA, 12 nt, Bordetella pertussis
ggcccgcggcgc

SEQ ID NO: 2386553 - RNA, 13 nt, Bordetella pertussis
ggcccgcggcgcc

SEQ ID NO: 2386554 - RNA, 15 nt, Bordetella pertussis
ggcccgcggcgccag

SEQ ID NO: 2386555 - RNA, 16 nt, Bordetella pertussis
ggcccgcggcgccagc

SEQ ID NO: 2386556 - RNA, 13 nt, Bordetella pertussis
ggcccgcgggcgc

SEQ ID NO: 2386557 - RNA, 18 nt, Bordetella pertussis
ggcccgcgggcgcccggc

SEQ ID NO: 2386558 - RNA, 21 nt, Bordetella pertussis
ggcccgcgggcgcccggccgg

SEQ ID NO: 2386559 - RNA, 13 nt, Bordetella pertussis
ggcccgcgugacg

SEQ ID NO: 2386560 - RNA, 19 nt, Bordetella pertussis
ggcccgcgugacggccgcc

SEQ ID NO: 2386561 - RNA, 20 nt, Bordetella pertussis
ggcccgcgugacggccgcca

SEQ ID NO: 2386562 - RNA, 21 nt, Bordetella pertussis
ggcccgcgugacggccgccac

SEQ ID NO: 2386563 - RNA, 14 nt, Bordetella pertussis
ggcccgcuccaggc

SEQ ID NO: 2386564 - RNA, 15 nt, Bordetella pertussis
ggcccgcucggccag

SEQ ID NO: 2386565 - RNA, 14 nt, Bordetella pertussis
ggccgacgcgcccg

SEQ ID NO: 2386566 - RNA, 19 nt, Bordetella pertussis
ggccgacgcgcccgggcug

SEQ ID NO: 2386567 - RNA, 20 nt, Bordetella pertussis
ggccgacgcgcccgggcuga

SEQ ID NO: 2386568 - RNA, 13 nt, Bordetella pertussis
ggccgacgcgcug

SEQ ID NO: 2386569 - RNA, 15 nt, Bordetella pertussis
ggccgacgcgcuggu

SEQ ID NO: 2386570 - RNA, 16 nt, Bordetella pertussis
ggccgacgcgcugucc

SEQ ID NO: 2386571 - RNA, 23 nt, Bordetella pertussis
ggccgacgcgcuguccgaugcgc

SEQ ID NO: 2386572 - RNA, 18 nt, Bordetella pertussis
ggccgacggcaagaucgc

SEQ ID NO: 2386573 - RNA, 13 nt, Bordetella pertussis
ggccgacgggcgg

SEQ ID NO: 2386574 - RNA, 14 nt, Bordetella pertussis
ggccgacgggcggc

SEQ ID NO: 2386575 - RNA, 22 nt, Bordetella pertussis
ggccgacucgaaacgggcggcg

SEQ ID NO: 2386576 - RNA, 16 nt, Bordetella pertussis
ggccgacuggaugaag

SEQ ID NO: 2386577 - RNA, 15 nt, Bordetella pertussis
ggccgagaacgccgu

SEQ ID NO: 2386578 - RNA, 17 nt, Bordetella pertussis
ggccgagaacgccgucg

SEQ ID NO: 2386579 - RNA, 22 nt, Bordetella pertussis
ggccgagaacgccgucggggug

SEQ ID NO: 2386580 - RNA, 18 nt, Bordetella pertussis
ggccgagaugugcggcgu

SEQ ID NO: 2386581 - RNA, 20 nt, Bordetella pertussis
ggccgagaugugcggcgugg

SEQ ID NO: 2386582 - RNA, 16 nt, Bordetella pertussis
ggccgagcccgcgucg

SEQ ID NO: 2386583 - RNA, 21 nt, Bordetella pertussis
ggccgagcgcaccccggccga

SEQ ID NO: 2386584 - RNA, 12 nt, Bordetella pertussis
ggccgagcgcga

SEQ ID NO: 2386585 - RNA, 16 nt, Bordetella pertussis
ggccgagcgcgccagc

SEQ ID NO: 2386586 - RNA, 17 nt, Bordetella pertussis
ggccgagcgcgccagca

SEQ ID NO: 2386587 - RNA, 20 nt, Bordetella pertussis
ggccgagcgcgccagcacgg

SEQ ID NO: 2386588 - RNA, 14 nt, Bordetella pertussis
ggccgagcgcggca

SEQ ID NO: 2386589 - RNA, 16 nt, Bordetella pertussis
ggccgagcgggccagc

SEQ ID NO: 2386590 - RNA, 18 nt, Bordetella pertussis
ggccgagcgggccagcgc

SEQ ID NO: 2386591 - RNA, 21 nt, Bordetella pertussis
ggccgagcgggccagcgcggc

SEQ ID NO: 2386592 - RNA, 17 nt, Bordetella pertussis
ggccgagcuccucgagc

SEQ ID NO: 2386593 - RNA, 18 nt, Bordetella pertussis
ggccgagcuccucgagcg

SEQ ID NO: 2386594 - RNA, 13 nt, Bordetella pertussis
ggccgaggaccug

SEQ ID NO: 2386595 - RNA, 20 nt, Bordetella pertussis
ggccgaggaccugcuggcgu

SEQ ID NO: 2386596 - RNA, 13 nt, Bordetella pertussis
ggccgaggccagc

SEQ ID NO: 2386597 - RNA, 14 nt, Bordetella pertussis
ggccgaggccagcg

SEQ ID NO: 2386598 - RNA, 16 nt, Bordetella pertussis
ggccgaggccagcgug

SEQ ID NO: 2386599 - RNA, 14 nt, Bordetella pertussis
ggccgaggcgccgc

SEQ ID NO: 2386600 - RNA, 15 nt, Bordetella pertussis
ggccgaggcgccgcc

SEQ ID NO: 2386601 - RNA, 19 nt, Bordetella pertussis
ggccgaggcgccgccgugc

SEQ ID NO: 2386602 - RNA, 20 nt, Bordetella pertussis
ggccgaggcgccgccgugcg

SEQ ID NO: 2386603 - RNA, 13 nt, Bordetella pertussis
ggccgaggcugcg

SEQ ID NO: 2386604 - RNA, 14 nt, Bordetella pertussis
ggccgaggcugcgc

SEQ ID NO: 2386605 - RNA, 19 nt, Bordetella pertussis
ggccgaggcugcgcgcgcc

SEQ ID NO: 2386606 - RNA, 22 nt, Bordetella pertussis
ggccgaggcugcgcgcgccagc

SEQ ID NO: 2386607 - RNA, 23 nt, Bordetella pertussis
ggccgaggcugcgcgcgccagcg

SEQ ID NO: 2386608 - RNA, 14 nt, Bordetella pertussis
ggccgaggucggcg

SEQ ID NO: 2386609 - RNA, 22 nt, Bordetella pertussis
ggccgaggucggcgguccacag

SEQ ID NO: 2386610 - RNA, 20 nt, Bordetella pertussis
ggccgauacgcgugcgcggc

SEQ ID NO: 2386611 - RNA, 20 nt, Bordetella pertussis
ggccgauagccgcggcgccg

SEQ ID NO: 2386612 - RNA, 21 nt, Bordetella pertussis
ggccgauagccgcggcgccgc

SEQ ID NO: 2386613 - RNA, 15 nt, Bordetella pertussis
ggccgauagccguga

SEQ ID NO: 2386614 - RNA, 19 nt, Bordetella pertussis
ggccgauaucguuggugcg

SEQ ID NO: 2386615 - RNA, 23 nt, Bordetella pertussis
ggccgauaucguuggugcgcacc

SEQ ID NO: 2386616 - RNA, 20 nt, Bordetella pertussis
ggccgaucaccugcaggccc

SEQ ID NO: 2386617 - RNA, 19 nt, Bordetella pertussis
ggccgaucagcaccacggc

SEQ ID NO: 2386618 - RNA, 12 nt, Bordetella pertussis
ggccgaucagcg

SEQ ID NO: 2386619 - RNA, 15 nt, Bordetella pertussis
ggccgaucagcggau

SEQ ID NO: 2386620 - RNA, 18 nt, Bordetella pertussis
ggccgaucagcggauuga

SEQ ID NO: 2386621 - RNA, 17 nt, Bordetella pertussis
ggccgaucugcugggcc

SEQ ID NO: 2386622 - RNA, 21 nt, Bordetella pertussis
ggccgaucugcugggccgggu

SEQ ID NO: 2386623 - RNA, 13 nt, Bordetella pertussis
ggccgaugaagac

SEQ ID NO: 2386624 - RNA, 20 nt, Bordetella pertussis
ggccgaugacaucgccgcug

SEQ ID NO: 2386625 - RNA, 21 nt, Bordetella pertussis
ggccgaugacaucgccgcugc

SEQ ID NO: 2386626 - RNA, 17 nt, Bordetella pertussis
ggccgauggcaucgccc

SEQ ID NO: 2386627 - RNA, 19 nt, Bordetella pertussis
ggccgauggcaucgccccg

SEQ ID NO: 2386628 - RNA, 18 nt, Bordetella pertussis
ggccgauggcguccagca

SEQ ID NO: 2386629 - RNA, 22 nt, Bordetella pertussis
ggccgauggcguccagcagcag

SEQ ID NO: 2386630 - RNA, 23 nt, Bordetella pertussis
ggccgauggcguccagcagcagg

SEQ ID NO: 2386631 - RNA, 17 nt, Bordetella pertussis
ggccgauggucagcaug

SEQ ID NO: 2386632 - RNA, 16 nt, Bordetella pertussis
ggccgauguagcccau

SEQ ID NO: 2386633 - RNA, 16 nt, Bordetella pertussis
ggccgaugucgccgcc

SEQ ID NO: 2386634 - RNA, 17 nt, Bordetella pertussis
ggccgaugucgccgccu

SEQ ID NO: 2386635 - RNA, 19 nt, Bordetella pertussis
ggccgaugucgccgccugc

SEQ ID NO: 2386636 - RNA, 18 nt, Bordetella pertussis
ggccgauuccagcgccgc

SEQ ID NO: 2386637 - RNA, 20 nt, Bordetella pertussis
ggccgauuccagcgccgccu

SEQ ID NO: 2386638 - RNA, 21 nt, Bordetella pertussis
ggccgauuucgcgcgccagcg

SEQ ID NO: 2386639 - RNA, 16 nt, Bordetella pertussis
ggccgauuucggccgc

SEQ ID NO: 2386640 - RNA, 18 nt, Bordetella pertussis
ggccgauuucggccgccg

SEQ ID NO: 2386641 - RNA, 21 nt, Bordetella pertussis
ggccgauuucggccgccggcg

SEQ ID NO: 2386642 - RNA, 19 nt, Bordetella pertussis
ggccgcaacccacccccag

SEQ ID NO: 2386643 - RNA, 17 nt, Bordetella pertussis
ggccgcaagcaagcccc

SEQ ID NO: 2386644 - RNA, 15 nt, Bordetella pertussis
ggccgcacagcucgu

SEQ ID NO: 2386645 - RNA, 18 nt, Bordetella pertussis
ggccgcacgcgcggcagc

SEQ ID NO: 2386646 - RNA, 20 nt, Bordetella pertussis
ggccgcacgcgcggcagcgc

SEQ ID NO: 2386647 - RNA, 21 nt, Bordetella pertussis
ggccgcacgcgcggcagcgcc

SEQ ID NO: 2386648 - RNA, 14 nt, Bordetella pertussis
ggccgcacgcggcc

SEQ ID NO: 2386649 - RNA, 22 nt, Bordetella pertussis
ggccgcacgcggccgcgggccg

SEQ ID NO: 2386650 - RNA, 21 nt, Bordetella pertussis
ggccgcagcaauugccccagc

SEQ ID NO: 2386651 - RNA, 20 nt, Bordetella pertussis
ggccgcagcauggcgccagc

SEQ ID NO: 2386652 - RNA, 22 nt, Bordetella pertussis
ggccgcagcauggcgccagcug

SEQ ID NO: 2386653 - RNA, 23 nt, Bordetella pertussis
ggccgcagcauggcgccagcugg

SEQ ID NO: 2386654 - RNA, 13 nt, Bordetella pertussis
ggccgcagccggc

SEQ ID NO: 2386655 - RNA, 14 nt, Bordetella pertussis
ggccgcagccggcu

SEQ ID NO: 2386656 - RNA, 17 nt, Bordetella pertussis
ggccgcagccggcugca

SEQ ID NO: 2386657 - RNA, 15 nt, Bordetella pertussis
ggccgcagcggacgu

SEQ ID NO: 2386658 - RNA, 22 nt, Bordetella pertussis
ggccgcauacgacacgucaucg

SEQ ID NO: 2386659 - RNA, 14 nt, Bordetella pertussis
ggccgcauggcggc

SEQ ID NO: 2386660 - RNA, 13 nt, Bordetella pertussis
ggccgcauuggga

SEQ ID NO: 2386661 - RNA, 18 nt, Bordetella pertussis
ggccgcauugggacgcgg

SEQ ID NO: 2386662 - RNA, 14 nt, Bordetella pertussis
ggccgccaacgcca

SEQ ID NO: 2386663 - RNA, 15 nt, Bordetella pertussis
ggccgccacccaggc

SEQ ID NO: 2386664 - RNA, 17 nt, Bordetella pertussis
ggccgccacccaggcgg

SEQ ID NO: 2386665 - RNA, 23 nt, Bordetella pertussis
ggccgccacccaggcggcaggcg

SEQ ID NO: 2386666 - RNA, 17 nt, Bordetella pertussis
ggccgccaccugggccg

SEQ ID NO: 2386667 - RNA, 21 nt, Bordetella pertussis
ggccgccaccugggccgccug

SEQ ID NO: 2386668 - RNA, 12 nt, Bordetella pertussis
ggccgccacgaa

SEQ ID NO: 2386669 - RNA, 17 nt, Bordetella pertussis
ggccgccacgcccuggc

SEQ ID NO: 2386670 - RNA, 21 nt, Bordetella pertussis
ggccgccacgcccuggcagcu

SEQ ID NO: 2386671 - RNA, 22 nt, Bordetella pertussis
ggccgccacgcccuggcagcug

SEQ ID NO: 2386672 - RNA, 12 nt, Bordetella pertussis
ggccgccagcaa

SEQ ID NO: 2386673 - RNA, 13 nt, Bordetella pertussis
ggccgccagcaag

SEQ ID NO: 2386674 - RNA, 17 nt, Bordetella pertussis
ggccgccagcaaggcgu

SEQ ID NO: 2386675 - RNA, 13 nt, Bordetella pertussis
ggccgccagcacc

SEQ ID NO: 2386676 - RNA, 18 nt, Bordetella pertussis
ggccgccagcaccugcuu

SEQ ID NO: 2386677 - RNA, 13 nt, Bordetella pertussis
ggccgccagcaug

SEQ ID NO: 2386678 - RNA, 21 nt, Bordetella pertussis
ggccgccagcauggcgucgaa

SEQ ID NO: 2386679 - RNA, 12 nt, Bordetella pertussis
ggccgccagccg

SEQ ID NO: 2386680 - RNA, 20 nt, Bordetella pertussis
ggccgccagccggcccgaca

SEQ ID NO: 2386681 - RNA, 16 nt, Bordetella pertussis
ggccgccagcgccaug

SEQ ID NO: 2386682 - RNA, 12 nt, Bordetella pertussis
ggccgccagcgg

SEQ ID NO: 2386683 - RNA, 18 nt, Bordetella pertussis
ggccgccagcggcuggcg

SEQ ID NO: 2386684 - RNA, 21 nt, Bordetella pertussis
ggccgccagcggcuggcgccg

SEQ ID NO: 2386685 - RNA, 11 nt, Bordetella pertussis
ggccgccagga

SEQ ID NO: 2386686 - RNA, 14 nt, Bordetella pertussis
ggccgccagggccg

SEQ ID NO: 2386687 - RNA, 15 nt, Bordetella pertussis
ggccgccagggccga

SEQ ID NO: 2386688 - RNA, 17 nt, Bordetella pertussis
ggccgccaggucggcca

SEQ ID NO: 2386689 - RNA, 12 nt, Bordetella pertussis
ggccgcccagca

SEQ ID NO: 2386690 - RNA, 13 nt, Bordetella pertussis
ggccgcccagcac

SEQ ID NO: 2386691 - RNA, 14 nt, Bordetella pertussis
ggccgcccagcaga

SEQ ID NO: 2386692 - RNA, 16 nt, Bordetella pertussis
ggccgcccagcagaug

SEQ ID NO: 2386693 - RNA, 18 nt, Bordetella pertussis
ggccgcccagcagauggc

SEQ ID NO: 2386694 - RNA, 14 nt, Bordetella pertussis
ggccgcccagcauu

SEQ ID NO: 2386695 - RNA, 15 nt, Bordetella pertussis
ggccgcccagccgcg

SEQ ID NO: 2386696 - RNA, 18 nt, Bordetella pertussis
ggccgcccagccgcgcca

SEQ ID NO: 2386697 - RNA, 19 nt, Bordetella pertussis
ggccgcccagccgcgccag

SEQ ID NO: 2386698 - RNA, 12 nt, Bordetella pertussis
ggccgcccagcg

SEQ ID NO: 2386699 - RNA, 13 nt, Bordetella pertussis
ggccgcccagcgc

SEQ ID NO: 2386700 - RNA, 15 nt, Bordetella pertussis
ggccgcccagcgcau

SEQ ID NO: 2386701 - RNA, 17 nt, Bordetella pertussis
ggccgcccagcgccugc

SEQ ID NO: 2386702 - RNA, 12 nt, Bordetella pertussis
ggccgcccaggc

SEQ ID NO: 2386703 - RNA, 16 nt, Bordetella pertussis
ggccgcccaggcgcag

SEQ ID NO: 2386704 - RNA, 19 nt, Bordetella pertussis
ggccgcccaggcgcagccg

SEQ ID NO: 2386705 - RNA, 21 nt, Bordetella pertussis
ggccgcccaggcgcagccgcg

SEQ ID NO: 2386706 - RNA, 20 nt, Bordetella pertussis
ggccgcccagucguccagca

SEQ ID NO: 2386707 - RNA, 16 nt, Bordetella pertussis
ggccgccccaacggcc

SEQ ID NO: 2386708 - RNA, 15 nt, Bordetella pertussis
ggccgcccccagcgc

SEQ ID NO: 2386709 - RNA, 19 nt, Bordetella pertussis
ggccgcccccagcgcgccu

SEQ ID NO: 2386710 - RNA, 17 nt, Bordetella pertussis
ggccgcccccgacgcca

SEQ ID NO: 2386711 - RNA, 16 nt, Bordetella pertussis
ggccgcccgccccggc

SEQ ID NO: 2386712 - RNA, 13 nt, Bordetella pertussis
ggccgcccgccug

SEQ ID NO: 2386713 - RNA, 14 nt, Bordetella pertussis
ggccgcccgccugc

SEQ ID NO: 2386714 - RNA, 15 nt, Bordetella pertussis
ggccgcccgccugcc

SEQ ID NO: 2386715 - RNA, 15 nt, Bordetella pertussis
ggccgcccgcggccu

SEQ ID NO: 2386716 - RNA, 17 nt, Bordetella pertussis
ggccgcccgcggccugc

SEQ ID NO: 2386717 - RNA, 18 nt, Bordetella pertussis
ggccgcccgcggccugca

SEQ ID NO: 2386718 - RNA, 16 nt, Bordetella pertussis
ggccgcccuggcgcga

SEQ ID NO: 2386719 - RNA, 20 nt, Bordetella pertussis
ggccgcccuggucaucgcca

SEQ ID NO: 2386720 - RNA, 16 nt, Bordetella pertussis
ggccgccgaacggcag

SEQ ID NO: 2386721 - RNA, 22 nt, Bordetella pertussis
ggccgccgaacggcagcagcgc

SEQ ID NO: 2386722 - RNA, 12 nt, Bordetella pertussis
ggccgccgcaug

SEQ ID NO: 2386723 - RNA, 20 nt, Bordetella pertussis
ggccgccgcaugccgggcug

SEQ ID NO: 2386724 - RNA, 13 nt, Bordetella pertussis
ggccgccgccagc

SEQ ID NO: 2386725 - RNA, 16 nt, Bordetella pertussis
ggccgccgccagcgcg

SEQ ID NO: 2386726 - RNA, 17 nt, Bordetella pertussis
ggccgccgccagcgcgc

SEQ ID NO: 2386727 - RNA, 19 nt, Bordetella pertussis
ggccgccgccagcgcgccg

SEQ ID NO: 2386728 - RNA, 13 nt, Bordetella pertussis
ggccgccgccggu

SEQ ID NO: 2386729 - RNA, 14 nt, Bordetella pertussis
ggccgccgccggug

SEQ ID NO: 2386730 - RNA, 12 nt, Bordetella pertussis
ggccgccgcgcc

SEQ ID NO: 2386731 - RNA, 21 nt, Bordetella pertussis
ggccgccgcgcccagcagcgc

SEQ ID NO: 2386732 - RNA, 18 nt, Bordetella pertussis
ggccgccgcgcccagccg

SEQ ID NO: 2386733 - RNA, 21 nt, Bordetella pertussis
ggccgccgcgcccagccgcgc

SEQ ID NO: 2386734 - RNA, 16 nt, Bordetella pertussis
ggccgccgcgcccgga

SEQ ID NO: 2386735 - RNA, 13 nt, Bordetella pertussis
ggccgccgcggcc

SEQ ID NO: 2386736 - RNA, 14 nt, Bordetella pertussis
ggccgccgcggccu

SEQ ID NO: 2386737 - RNA, 12 nt, Bordetella pertussis
ggccgccgcggg

SEQ ID NO: 2386738 - RNA, 14 nt, Bordetella pertussis
ggccgccgcgggcg

SEQ ID NO: 2386739 - RNA, 17 nt, Bordetella pertussis
ggccgccgcgggcgccg

SEQ ID NO: 2386740 - RNA, 19 nt, Bordetella pertussis
ggccgccgcgggcgccgcg

SEQ ID NO: 2386741 - RNA, 23 nt, Bordetella pertussis
ggccgccgcgggcgccgcgcacg

SEQ ID NO: 2386742 - RNA, 17 nt, Bordetella pertussis
ggccgccgcgugcgccg

SEQ ID NO: 2386743 - RNA, 22 nt, Bordetella pertussis
ggccgccgcgugcgccgggcug

SEQ ID NO: 2386744 - RNA, 12 nt, Bordetella pertussis
ggccgccggcca

SEQ ID NO: 2386745 - RNA, 14 nt, Bordetella pertussis
ggccgccggccacc

SEQ ID NO: 2386746 - RNA, 15 nt, Bordetella pertussis
ggccgccggccacca

SEQ ID NO: 2386747 - RNA, 13 nt, Bordetella pertussis
ggccgccggccag

SEQ ID NO: 2386748 - RNA, 15 nt, Bordetella pertussis
ggccgccggccagcg

SEQ ID NO: 2386749 - RNA, 17 nt, Bordetella pertussis
ggccgccggccagcgcc

SEQ ID NO: 2386750 - RNA, 18 nt, Bordetella pertussis
ggccgccggccagcgcgg

SEQ ID NO: 2386751 - RNA, 20 nt, Bordetella pertussis
ggccgccggccagcgcggca

SEQ ID NO: 2386752 - RNA, 19 nt, Bordetella pertussis
ggccgccggcgcgguggcc

SEQ ID NO: 2386753 - RNA, 13 nt, Bordetella pertussis
ggccgccggcggc

SEQ ID NO: 2386754 - RNA, 23 nt, Bordetella pertussis
ggccgccggcggcauucagcgcu

SEQ ID NO: 2386755 - RNA, 14 nt, Bordetella pertussis
ggccgccggcggcg

SEQ ID NO: 2386756 - RNA, 17 nt, Bordetella pertussis
ggccgccggcggcgccg

SEQ ID NO: 2386757 - RNA, 19 nt, Bordetella pertussis
ggccgccggcggcgccggc

SEQ ID NO: 2386758 - RNA, 15 nt, Bordetella pertussis
ggccgccggcggcgu

SEQ ID NO: 2386759 - RNA, 23 nt, Bordetella pertussis
ggccgccggcggcgucggcgccc

SEQ ID NO: 2386760 - RNA, 16 nt, Bordetella pertussis
ggccgccgggccgcga

SEQ ID NO: 2386761 - RNA, 18 nt, Bordetella pertussis
ggccgccgggccgcgacc

SEQ ID NO: 2386762 - RNA, 20 nt, Bordetella pertussis
ggccgccggggaggccucga

SEQ ID NO: 2386763 - RNA, 14 nt, Bordetella pertussis
ggccgccgggucgc

SEQ ID NO: 2386764 - RNA, 18 nt, Bordetella pertussis
ggccgccgggucgcugug

SEQ ID NO: 2386765 - RNA, 20 nt, Bordetella pertussis
ggccgccguaaucggcgucg

SEQ ID NO: 2386766 - RNA, 13 nt, Bordetella pertussis
ggccgccgugacu

SEQ ID NO: 2386767 - RNA, 21 nt, Bordetella pertussis
ggccgccgugacuucggccgc

SEQ ID NO: 2386768 - RNA, 23 nt, Bordetella pertussis
ggccgccgugacuucggccgcca

SEQ ID NO: 2386769 - RNA, 24 nt, Bordetella pertussis
ggccgccgugacuucggccgccag

SEQ ID NO: 2386770 - RNA, 21 nt, Bordetella pertussis
ggccgccuauguaggcgccgc

SEQ ID NO: 2386771 - RNA, 22 nt, Bordetella pertussis
ggccgccuauguaggcgccgcg

SEQ ID NO: 2386772 - RNA, 18 nt, Bordetella pertussis
ggccgccucaccgcgccg

SEQ ID NO: 2386773 - RNA, 16 nt, Bordetella pertussis
ggccgccuccaggcgg

SEQ ID NO: 2386774 - RNA, 15 nt, Bordetella pertussis
ggccgccucggcggc

SEQ ID NO: 2386775 - RNA, 16 nt, Bordetella pertussis
ggccgccucggcggcc

SEQ ID NO: 2386776 - RNA, 19 nt, Bordetella pertussis
ggccgccucggcggccagc

SEQ ID NO: 2386777 - RNA, 22 nt, Bordetella pertussis
ggccgccucggcggccagcgcg

SEQ ID NO: 2386778 - RNA, 12 nt, Bordetella pertussis
ggccgccugcgc

SEQ ID NO: 2386779 - RNA, 13 nt, Bordetella pertussis
ggccgccugcugc

SEQ ID NO: 2386780 - RNA, 17 nt, Bordetella pertussis
ggccgccugcugcgccg

SEQ ID NO: 2386781 - RNA, 17 nt, Bordetella pertussis
ggccgccuggaccugac

SEQ ID NO: 2386782 - RNA, 23 nt, Bordetella pertussis
ggccgccuggcccaugaacaggc

SEQ ID NO: 2386783 - RNA, 19 nt, Bordetella pertussis
ggccgccuuuucgcagcgg

SEQ ID NO: 2386784 - RNA, 16 nt, Bordetella pertussis
ggccgcgaacgcgccg

SEQ ID NO: 2386785 - RNA, 17 nt, Bordetella pertussis
ggccgcgaacgcgccgg

SEQ ID NO: 2386786 - RNA, 18 nt, Bordetella pertussis
ggccgcgaacgcgccggc

SEQ ID NO: 2386787 - RNA, 19 nt, Bordetella pertussis
ggccgcgaacgcgccggcc

SEQ ID NO: 2386788 - RNA, 22 nt, Bordetella pertussis
ggccgcgaaggcuucgucgacc

SEQ ID NO: 2386789 - RNA, 19 nt, Bordetella pertussis
ggccgcgacauagcgcugg

SEQ ID NO: 2386790 - RNA, 22 nt, Bordetella pertussis
ggccgcgaccacggucuggcgc

SEQ ID NO: 2386791 - RNA, 15 nt, Bordetella pertussis
ggccgcgacgaucag

SEQ ID NO: 2386792 - RNA, 22 nt, Bordetella pertussis
ggccgcgacgcuacagcgucau

SEQ ID NO: 2386793 - RNA, 16 nt, Bordetella pertussis
ggccgcgagcaugcgc

SEQ ID NO: 2386794 - RNA, 18 nt, Bordetella pertussis
ggccgcgauauccuugcg

SEQ ID NO: 2386795 - RNA, 17 nt, Bordetella pertussis
ggccgcgaugucgcgcg

SEQ ID NO: 2386796 - RNA, 18 nt, Bordetella pertussis
ggccgcgaugucgcgcgc

SEQ ID NO: 2386797 - RNA, 19 nt, Bordetella pertussis
ggccgcgaugucgcgcgcg

SEQ ID NO: 2386798 - RNA, 17 nt, Bordetella pertussis
ggccgcgcaaggccugc

SEQ ID NO: 2386799 - RNA, 17 nt, Bordetella pertussis
ggccgcgcaaggcggcc

SEQ ID NO: 2386800 - RNA, 19 nt, Bordetella pertussis
ggccgcgcaaggcggcccg

SEQ ID NO: 2386801 - RNA, 21 nt, Bordetella pertussis
ggccgcgcaaggcggcccggc

SEQ ID NO: 2386802 - RNA, 22 nt, Bordetella pertussis
ggccgcgcagcacgcccgcgcg

SEQ ID NO: 2386803 - RNA, 23 nt, Bordetella pertussis
ggccgcgcaggauuucaucgccc

SEQ ID NO: 2386804 - RNA, 13 nt, Bordetella pertussis
ggccgcgcagggc

SEQ ID NO: 2386805 - RNA, 12 nt, Bordetella pertussis
ggccgcgcaugc

SEQ ID NO: 2386806 - RNA, 17 nt, Bordetella pertussis
ggccgcgcaugccagcu

SEQ ID NO: 2386807 - RNA, 19 nt, Bordetella pertussis
ggccgcgcaugccagcuug

SEQ ID NO: 2386808 - RNA, 15 nt, Bordetella pertussis
ggccgcgccacaggc

SEQ ID NO: 2386809 - RNA, 12 nt, Bordetella pertussis
ggccgcgccagc

SEQ ID NO: 2386810 - RNA, 11 nt, Bordetella pertussis
ggccgcgccca

SEQ ID NO: 2386811 - RNA, 12 nt, Bordetella pertussis
ggccgcgcccaa

SEQ ID NO: 2386812 - RNA, 12 nt, Bordetella pertussis
ggccgcgcccag

SEQ ID NO: 2386813 - RNA, 15 nt, Bordetella pertussis
ggccgcgcccagcgu

SEQ ID NO: 2386814 - RNA, 17 nt, Bordetella pertussis
ggccgcgcccagcgugu

SEQ ID NO: 2386815 - RNA, 22 nt, Bordetella pertussis
ggccgcgcccagguccugcgcc

SEQ ID NO: 2386816 - RNA, 12 nt, Bordetella pertussis
ggccgcgcccau

SEQ ID NO: 2386817 - RNA, 14 nt, Bordetella pertussis
ggccgcgcccaugc

SEQ ID NO: 2386818 - RNA, 22 nt, Bordetella pertussis
ggccgcgcccaugcgcuggcgc

SEQ ID NO: 2386819 - RNA, 18 nt, Bordetella pertussis
ggccgcgccccuagcgcc

SEQ ID NO: 2386820 - RNA, 20 nt, Bordetella pertussis
ggccgcgccccuagcgccgc

SEQ ID NO: 2386821 - RNA, 14 nt, Bordetella pertussis
ggccgcgcccgccg

SEQ ID NO: 2386822 - RNA, 16 nt, Bordetella pertussis
ggccgcgccgccgccc

SEQ ID NO: 2386823 - RNA, 13 nt, Bordetella pertussis
ggccgcgccgccu

SEQ ID NO: 2386824 - RNA, 16 nt, Bordetella pertussis
ggccgcgccgcgccgg

SEQ ID NO: 2386825 - RNA, 17 nt, Bordetella pertussis
ggccgcgccgcgccggu

SEQ ID NO: 2386826 - RNA, 14 nt, Bordetella pertussis
ggccgcgccgcggc

SEQ ID NO: 2386827 - RNA, 15 nt, Bordetella pertussis
ggccgcgccgcggca

SEQ ID NO: 2386828 - RNA, 14 nt, Bordetella pertussis
ggccgcgccgcugg

SEQ ID NO: 2386829 - RNA, 12 nt, Bordetella pertussis
ggccgcgccggc

SEQ ID NO: 2386830 - RNA, 15 nt, Bordetella pertussis
ggccgcgcgcaucac

SEQ ID NO: 2386831 - RNA, 15 nt, Bordetella pertussis
ggccgcgcgcaucca

SEQ ID NO: 2386832 - RNA, 19 nt, Bordetella pertussis
ggccgcgcgccaaucagau

SEQ ID NO: 2386833 - RNA, 12 nt, Bordetella pertussis
ggccgcgcgccg

SEQ ID NO: 2386834 - RNA, 14 nt, Bordetella pertussis
ggccgcgcgccggc

SEQ ID NO: 2386835 - RNA, 16 nt, Bordetella pertussis
ggccgcgcgcgccagg

SEQ ID NO: 2386836 - RNA, 19 nt, Bordetella pertussis
ggccgcgcgcgccaggccu

SEQ ID NO: 2386837 - RNA, 15 nt, Bordetella pertussis
ggccgcgcgcgccau

SEQ ID NO: 2386838 - RNA, 20 nt, Bordetella pertussis
ggccgcgcgcuucaggcgcc

SEQ ID NO: 2386839 - RNA, 22 nt, Bordetella pertussis
ggccgcgcgcuucaggcgccgc

SEQ ID NO: 2386840 - RNA, 23 nt, Bordetella pertussis
ggccgcgcgggccuggcucaggc

SEQ ID NO: 2386841 - RNA, 18 nt, Bordetella pertussis
ggccgcgcgggcggcccg

SEQ ID NO: 2386842 - RNA, 20 nt, Bordetella pertussis
ggccgcgcgggcggcccgca

SEQ ID NO: 2386843 - RNA, 22 nt, Bordetella pertussis
ggccgcgcgggcggcccgcaug

SEQ ID NO: 2386844 - RNA, 23 nt, Bordetella pertussis
ggccgcgcgggcggcccgcaugu

SEQ ID NO: 2386845 - RNA, 17 nt, Bordetella pertussis
ggccgcgcgugcggggc

SEQ ID NO: 2386846 - RNA, 14 nt, Bordetella pertussis
ggccgcgcucaggc

SEQ ID NO: 2386847 - RNA, 17 nt, Bordetella pertussis
ggccgcgcucaggccgc

SEQ ID NO: 2386848 - RNA, 13 nt, Bordetella pertussis
ggccgcgcugcug

SEQ ID NO: 2386849 - RNA, 21 nt, Bordetella pertussis
ggccgcgcugcugcaggccgg

SEQ ID NO: 2386850 - RNA, 14 nt, Bordetella pertussis
ggccgcgcuggcgc

SEQ ID NO: 2386851 - RNA, 18 nt, Bordetella pertussis
ggccgcgcuggcgcuggc

SEQ ID NO: 2386852 - RNA, 23 nt, Bordetella pertussis
ggccgcgcuggcgcuggccgccc

SEQ ID NO: 2386853 - RNA, 21 nt, Bordetella pertussis
ggccgcgcuggcggcgcaggc

SEQ ID NO: 2386854 - RNA, 17 nt, Bordetella pertussis
ggccgcgcuggugcugg

SEQ ID NO: 2386855 - RNA, 18 nt, Bordetella pertussis
ggccgcggaagucgggca

SEQ ID NO: 2386856 - RNA, 13 nt, Bordetella pertussis
ggccgcggccagg

SEQ ID NO: 2386857 - RNA, 14 nt, Bordetella pertussis
ggccgcggccaggc

SEQ ID NO: 2386858 - RNA, 15 nt, Bordetella pertussis
ggccgcggccaggcc

SEQ ID NO: 2386859 - RNA, 14 nt, Bordetella pertussis
ggccgcggcccagc

SEQ ID NO: 2386860 - RNA, 18 nt, Bordetella pertussis
ggccgcggcccagcgcgg

SEQ ID NO: 2386861 - RNA, 12 nt, Bordetella pertussis
ggccgcggccgg

SEQ ID NO: 2386862 - RNA, 19 nt, Bordetella pertussis
ggccgcggccuucaccccg

SEQ ID NO: 2386863 - RNA, 23 nt, Bordetella pertussis
ggccgcggccuucaccccgccac

SEQ ID NO: 2386864 - RNA, 12 nt, Bordetella pertussis
ggccgcggcgcc

SEQ ID NO: 2386865 - RNA, 13 nt, Bordetella pertussis
ggccgcggcgccc

SEQ ID NO: 2386866 - RNA, 15 nt, Bordetella pertussis
ggccgcggcgcccgg

SEQ ID NO: 2386867 - RNA, 22 nt, Bordetella pertussis
ggccgcggcgcgcgcggcgccu

SEQ ID NO: 2386868 - RNA, 13 nt, Bordetella pertussis
ggccgcggcgucc

SEQ ID NO: 2386869 - RNA, 18 nt, Bordetella pertussis
ggccgcggcgugcugccc

SEQ ID NO: 2386870 - RNA, 14 nt, Bordetella pertussis
ggccgcgggcagca

SEQ ID NO: 2386871 - RNA, 16 nt, Bordetella pertussis
ggccgcgggcggcgcg

SEQ ID NO: 2386872 - RNA, 22 nt, Bordetella pertussis
ggccgcgggcggcgcgcccagc

SEQ ID NO: 2386873 - RNA, 19 nt, Bordetella pertussis
ggccgcggggcuggccagc

SEQ ID NO: 2386874 - RNA, 20 nt, Bordetella pertussis
ggccgcggggcuggccagcu

SEQ ID NO: 2386875 - RNA, 22 nt, Bordetella pertussis
ggccgcggggcuggccagcugg

SEQ ID NO: 2386876 - RNA, 22 nt, Bordetella pertussis
ggccgcgguaaugacgcagccg

SEQ ID NO: 2386877 - RNA, 23 nt, Bordetella pertussis
ggccgcgguaaugacgcagccgc

SEQ ID NO: 2386878 - RNA, 15 nt, Bordetella pertussis
ggccgcggucagcca

SEQ ID NO: 2386879 - RNA, 17 nt, Bordetella pertussis
ggccgcggucagccaga

SEQ ID NO: 2386880 - RNA, 20 nt, Bordetella pertussis
ggccgcggucagccagagcg

SEQ ID NO: 2386881 - RNA, 22 nt, Bordetella pertussis
ggccgcggucagccagagcggg

SEQ ID NO: 2386882 - RNA, 14 nt, Bordetella pertussis
ggccgcgguccggg

SEQ ID NO: 2386883 - RNA, 15 nt, Bordetella pertussis
ggccgcgguccgggc

SEQ ID NO: 2386884 - RNA, 17 nt, Bordetella pertussis
ggccgcguacaacgccg

SEQ ID NO: 2386885 - RNA, 19 nt, Bordetella pertussis
ggccgcguacaacgccgcg

SEQ ID NO: 2386886 - RNA, 20 nt, Bordetella pertussis
ggccgcguacaacgccgcgu

SEQ ID NO: 2386887 - RNA, 19 nt, Bordetella pertussis
ggccgcgucauacgacgcg

SEQ ID NO: 2386888 - RNA, 20 nt, Bordetella pertussis
ggccgcgucauacgacgcgg

SEQ ID NO: 2386889 - RNA, 14 nt, Bordetella pertussis
ggccgcguccagcg

SEQ ID NO: 2386890 - RNA, 17 nt, Bordetella pertussis
ggccgcguccagcgcgc

SEQ ID NO: 2386891 - RNA, 13 nt, Bordetella pertussis
ggccgcgucgauc

SEQ ID NO: 2386892 - RNA, 21 nt, Bordetella pertussis
ggccgcgucgaucagcgcggg

SEQ ID NO: 2386893 - RNA, 16 nt, Bordetella pertussis
ggccgcgucggccuca

SEQ ID NO: 2386894 - RNA, 19 nt, Bordetella pertussis
ggccgcguggccgcgcugc

SEQ ID NO: 2386895 - RNA, 15 nt, Bordetella pertussis
ggccgcuacggcggu

SEQ ID NO: 2386896 - RNA, 17 nt, Bordetella pertussis
ggccgcuaggccuugcc

SEQ ID NO: 2386897 - RNA, 14 nt, Bordetella pertussis
ggccgcuccagagc

SEQ ID NO: 2386898 - RNA, 16 nt, Bordetella pertussis
ggccgcuccagagcgc

SEQ ID NO: 2386899 - RNA, 13 nt, Bordetella pertussis
ggccgcuccgcca

SEQ ID NO: 2386900 - RNA, 12 nt, Bordetella pertussis
ggccgcuggccc

SEQ ID NO: 2386901 - RNA, 14 nt, Bordetella pertussis
ggccgcuggcccgg

SEQ ID NO: 2386902 - RNA, 13 nt, Bordetella pertussis
ggccgcugggcac

SEQ ID NO: 2386903 - RNA, 22 nt, Bordetella pertussis
ggccgcugggcacauccagcgc

SEQ ID NO: 2386904 - RNA, 18 nt, Bordetella pertussis
ggccgcuggucaccgccc

SEQ ID NO: 2386905 - RNA, 19 nt, Bordetella pertussis
ggccgcuggucaccgcccc

SEQ ID NO: 2386906 - RNA, 13 nt, Bordetella pertussis
ggccgcuucgaug

SEQ ID NO: 2386907 - RNA, 16 nt, Bordetella pertussis
ggccgcuucggccugc

SEQ ID NO: 2386908 - RNA, 18 nt, Bordetella pertussis
ggccgcuucggccugcgc

SEQ ID NO: 2386909 - RNA, 15 nt, Bordetella pertussis
ggccgcuucggcggc

SEQ ID NO: 2386910 - RNA, 16 nt, Bordetella pertussis
ggccgcuucggcggcc

SEQ ID NO: 2386911 - RNA, 17 nt, Bordetella pertussis
ggccgcuucggcggcca

SEQ ID NO: 2386912 - RNA, 17 nt, Bordetella pertussis
ggccgcuuucgaccagc

SEQ ID NO: 2386913 - RNA, 21 nt, Bordetella pertussis
ggccgcuuucgaccagcgaca

SEQ ID NO: 2386914 - RNA, 23 nt, Bordetella pertussis
ggccgcuuucgaccagcgacagc

SEQ ID NO: 2386915 - RNA, 15 nt, Bordetella pertussis
ggccggaaacgcggu

SEQ ID NO: 2386916 - RNA, 13 nt, Bordetella pertussis
ggccggaacagcg

SEQ ID NO: 2386917 - RNA, 16 nt, Bordetella pertussis
ggccggaacagcgucc

SEQ ID NO: 2386918 - RNA, 21 nt, Bordetella pertussis
ggccggaacagcguccagccg

SEQ ID NO: 2386919 - RNA, 22 nt, Bordetella pertussis
ggccggaacagcguccagccgc

SEQ ID NO: 2386920 - RNA, 21 nt, Bordetella pertussis
ggccggaacugaugccgaccg

SEQ ID NO: 2386921 - RNA, 13 nt, Bordetella pertussis
ggccggacagggc

SEQ ID NO: 2386922 - RNA, 23 nt, Bordetella pertussis
ggccggacagggccgcgagcaug

SEQ ID NO: 2386923 - RNA, 14 nt, Bordetella pertussis
ggccggaccgcugu

SEQ ID NO: 2386924 - RNA, 14 nt, Bordetella pertussis
ggccggaccuugcg

SEQ ID NO: 2386925 - RNA, 22 nt, Bordetella pertussis
ggccggacgcaaccggucggcc

SEQ ID NO: 2386926 - RNA, 20 nt, Bordetella pertussis
ggccggacuggcgcgcacca

SEQ ID NO: 2386927 - RNA, 13 nt, Bordetella pertussis
ggccggagccagg

SEQ ID NO: 2386928 - RNA, 15 nt, Bordetella pertussis
ggccggagccaggua

SEQ ID NO: 2386929 - RNA, 14 nt, Bordetella pertussis
ggccggaggccgcc

SEQ ID NO: 2386930 - RNA, 15 nt, Bordetella pertussis
ggccggaggccgccc

SEQ ID NO: 2386931 - RNA, 13 nt, Bordetella pertussis
ggccggauccagc

SEQ ID NO: 2386932 - RNA, 16 nt, Bordetella pertussis
ggccggauccagcugc

SEQ ID NO: 2386933 - RNA, 21 nt, Bordetella pertussis
ggccggaucguagugcguggu

SEQ ID NO: 2386934 - RNA, 14 nt, Bordetella pertussis
ggccggaugcgcag

SEQ ID NO: 2386935 - RNA, 17 nt, Bordetella pertussis
ggccggcaaggugaucg

SEQ ID NO: 2386936 - RNA, 13 nt, Bordetella pertussis
ggccggcaccacg

SEQ ID NO: 2386937 - RNA, 17 nt, Bordetella pertussis
ggccggcaccacgaccg

SEQ ID NO: 2386938 - RNA, 21 nt, Bordetella pertussis
ggccggcaccacgaccggcuc

SEQ ID NO: 2386939 - RNA, 13 nt, Bordetella pertussis
ggccggcaccccg

SEQ ID NO: 2386940 - RNA, 16 nt, Bordetella pertussis
ggccggcacgcccagc

SEQ ID NO: 2386941 - RNA, 20 nt, Bordetella pertussis
ggccggcacgcccagccgca

SEQ ID NO: 2386942 - RNA, 14 nt, Bordetella pertussis
ggccggcacgccga

SEQ ID NO: 2386943 - RNA, 14 nt, Bordetella pertussis
ggccggcacggccg

SEQ ID NO: 2386944 - RNA, 17 nt, Bordetella pertussis
ggccggcacggccggcc

SEQ ID NO: 2386945 - RNA, 19 nt, Bordetella pertussis
ggccggcacggccggccag

SEQ ID NO: 2386946 - RNA, 21 nt, Bordetella pertussis
ggccggcacggccggccaggc

SEQ ID NO: 2386947 - RNA, 22 nt, Bordetella pertussis
ggccggcacggccggccaggcg

SEQ ID NO: 2386948 - RNA, 15 nt, Bordetella pertussis
ggccggcacguccgg

SEQ ID NO: 2386949 - RNA, 21 nt, Bordetella pertussis
ggccggcacguccggcacggc

SEQ ID NO: 2386950 - RNA, 22 nt, Bordetella pertussis
ggccggcagcgcgaccggcgcg

SEQ ID NO: 2386951 - RNA, 15 nt, Bordetella pertussis
ggccggcagcggcgc

SEQ ID NO: 2386952 - RNA, 17 nt, Bordetella pertussis
ggccggcagcggcgcca

SEQ ID NO: 2386953 - RNA, 18 nt, Bordetella pertussis
ggccggcaggccggccag

SEQ ID NO: 2386954 - RNA, 16 nt, Bordetella pertussis
ggccggcaucgcgcug

SEQ ID NO: 2386955 - RNA, 22 nt, Bordetella pertussis
ggccggcaucgcgcugacagcg

SEQ ID NO: 2386956 - RNA, 17 nt, Bordetella pertussis
ggccggcaugcgccggc

SEQ ID NO: 2386957 - RNA, 20 nt, Bordetella pertussis
ggccggcaugcgccggcccg

SEQ ID NO: 2386958 - RNA, 21 nt, Bordetella pertussis
ggccggcaugcgccggcccgg

SEQ ID NO: 2386959 - RNA, 13 nt, Bordetella pertussis
ggccggccagcaa

SEQ ID NO: 2386960 - RNA, 14 nt, Bordetella pertussis
ggccggccagcaag

SEQ ID NO: 2386961 - RNA, 12 nt, Bordetella pertussis
ggccggccagcc

SEQ ID NO: 2386962 - RNA, 14 nt, Bordetella pertussis
ggccggccaggcgc

SEQ ID NO: 2386963 - RNA, 12 nt, Bordetella pertussis
ggccggccaggg

SEQ ID NO: 2386964 - RNA, 15 nt, Bordetella pertussis
ggccggccagggcca

SEQ ID NO: 2386965 - RNA, 19 nt, Bordetella pertussis
ggccggcccaguccagggu

SEQ ID NO: 2386966 - RNA, 21 nt, Bordetella pertussis
ggccggcccaguccagggugu

SEQ ID NO: 2386967 - RNA, 15 nt, Bordetella pertussis
ggccggcccgugcgc

SEQ ID NO: 2386968 - RNA, 20 nt, Bordetella pertussis
ggccggcccgugcgcaacgc

SEQ ID NO: 2386969 - RNA, 13 nt, Bordetella pertussis
ggccggccgccgg

SEQ ID NO: 2386970 - RNA, 14 nt, Bordetella pertussis
ggccggccgccggc

SEQ ID NO: 2386971 - RNA, 17 nt, Bordetella pertussis
ggccggccgccgggccg

SEQ ID NO: 2386972 - RNA, 15 nt, Bordetella pertussis
ggccggccgcgccca

SEQ ID NO: 2386973 - RNA, 13 nt, Bordetella pertussis
ggccggccgcgcg

SEQ ID NO: 2386974 - RNA, 17 nt, Bordetella pertussis
ggccggccgcgcgcgcc

SEQ ID NO: 2386975 - RNA, 22 nt, Bordetella pertussis
ggccggccgcguggccgcgcug

SEQ ID NO: 2386976 - RNA, 12 nt, Bordetella pertussis
ggccggccgggc

SEQ ID NO: 2386977 - RNA, 14 nt, Bordetella pertussis
ggccggccgggccg

SEQ ID NO: 2386978 - RNA, 21 nt, Bordetella pertussis
ggccggccgggcgcggcgccc

SEQ ID NO: 2386979 - RNA, 15 nt, Bordetella pertussis
ggccggccugcaggc

SEQ ID NO: 2386980 - RNA, 17 nt, Bordetella pertussis
ggccggccugcaggugc

SEQ ID NO: 2386981 - RNA, 14 nt, Bordetella pertussis
ggccggccugccgg

SEQ ID NO: 2386982 - RNA, 12 nt, Bordetella pertussis
ggccggccugcg

SEQ ID NO: 2386983 - RNA, 16 nt, Bordetella pertussis
ggccggccugcgggcu

SEQ ID NO: 2386984 - RNA, 17 nt, Bordetella pertussis
ggccggccuggcgcgca

SEQ ID NO: 2386985 - RNA, 19 nt, Bordetella pertussis
ggccggccuggcgcgcauc

SEQ ID NO: 2386986 - RNA, 21 nt, Bordetella pertussis
ggccggccuuggccauguccu

SEQ ID NO: 2386987 - RNA, 14 nt, Bordetella pertussis
ggccggcgacggca

SEQ ID NO: 2386988 - RNA, 15 nt, Bordetella pertussis
ggccggcgaugaagu

SEQ ID NO: 2386989 - RNA, 22 nt, Bordetella pertussis
ggccggcgaugaagucgcggcc

SEQ ID NO: 2386990 - RNA, 19 nt, Bordetella pertussis
ggccggcgauugcgccagc

SEQ ID NO: 2386991 - RNA, 21 nt, Bordetella pertussis
ggccggcgauugcgccagcgc

SEQ ID NO: 2386992 - RNA, 13 nt, Bordetella pertussis
ggccggcgcacgc

SEQ ID NO: 2386993 - RNA, 15 nt, Bordetella pertussis
ggccggcgcacgccg

SEQ ID NO: 2386994 - RNA, 15 nt, Bordetella pertussis
ggccggcgccagccg

SEQ ID NO: 2386995 - RNA, 14 nt, Bordetella pertussis
ggccggcgccgaca

SEQ ID NO: 2386996 - RNA, 16 nt, Bordetella pertussis
ggccggcgccgguguc

SEQ ID NO: 2386997 - RNA, 13 nt, Bordetella pertussis
ggccggcgccugg

SEQ ID NO: 2386998 - RNA, 20 nt, Bordetella pertussis
ggccggcgccuggggcgggc

SEQ ID NO: 2386999 - RNA, 21 nt, Bordetella pertussis
ggccggcgccuggggcgggcg

SEQ ID NO: 2387000 - RNA, 14 nt, Bordetella pertussis
ggccggcgcgaacc

SEQ ID NO: 2387001 - RNA, 17 nt, Bordetella pertussis
ggccggcgcgaccgccu

SEQ ID NO: 2387002 - RNA, 18 nt, Bordetella pertussis
ggccggcgcgaccgccuc

SEQ ID NO: 2387003 - RNA, 14 nt, Bordetella pertussis
ggccggcgcgcauc

SEQ ID NO: 2387004 - RNA, 13 nt, Bordetella pertussis
ggccggcgcgccc

SEQ ID NO: 2387005 - RNA, 18 nt, Bordetella pertussis
ggccggcgcgccgcgccg

SEQ ID NO: 2387006 - RNA, 20 nt, Bordetella pertussis
ggccggcgcgccgcgccgcc

SEQ ID NO: 2387007 - RNA, 14 nt, Bordetella pertussis
ggccggcgcgccgg

SEQ ID NO: 2387008 - RNA, 15 nt, Bordetella pertussis
ggccggcgcgccggc

SEQ ID NO: 2387009 - RNA, 18 nt, Bordetella pertussis
ggccggcgcgccggccug

SEQ ID NO: 2387010 - RNA, 15 nt, Bordetella pertussis
ggccggcgcgccugc

SEQ ID NO: 2387011 - RNA, 16 nt, Bordetella pertussis
ggccggcgcgccugcc

SEQ ID NO: 2387012 - RNA, 17 nt, Bordetella pertussis
ggccggcgcgcgcaggc

SEQ ID NO: 2387013 - RNA, 15 nt, Bordetella pertussis
ggccggcgcgcgcgu

SEQ ID NO: 2387014 - RNA, 14 nt, Bordetella pertussis
ggccggcgcgcggc

SEQ ID NO: 2387015 - RNA, 15 nt, Bordetella pertussis
ggccggcgcgcggcc

SEQ ID NO: 2387016 - RNA, 16 nt, Bordetella pertussis
ggccggcgcgcucgcu

SEQ ID NO: 2387017 - RNA, 15 nt, Bordetella pertussis
ggccggcgcggcagc

SEQ ID NO: 2387018 - RNA, 17 nt, Bordetella pertussis
ggccggcgcggcagccu

SEQ ID NO: 2387019 - RNA, 17 nt, Bordetella pertussis
ggccggcgcgucgccgg

SEQ ID NO: 2387020 - RNA, 22 nt, Bordetella pertussis
ggccggcgcgucgccggcgaug

SEQ ID NO: 2387021 - RNA, 13 nt, Bordetella pertussis
ggccggcgcuggg

SEQ ID NO: 2387022 - RNA, 19 nt, Bordetella pertussis
ggccggcgcugggcaggcu

SEQ ID NO: 2387023 - RNA, 19 nt, Bordetella pertussis
ggccggcggcacgcugcgc

SEQ ID NO: 2387024 - RNA, 23 nt, Bordetella pertussis
ggccggcggcacgcugcgcaggc

SEQ ID NO: 2387025 - RNA, 19 nt, Bordetella pertussis
ggccggcggcagccggcca

SEQ ID NO: 2387026 - RNA, 17 nt, Bordetella pertussis
ggccggcggccagcgcg

SEQ ID NO: 2387027 - RNA, 20 nt, Bordetella pertussis
ggccggcggccagcgcgccg

SEQ ID NO: 2387028 - RNA, 22 nt, Bordetella pertussis
ggccggcggcgagcgcggcgcg

SEQ ID NO: 2387029 - RNA, 14 nt, Bordetella pertussis
ggccggcggcgucu

SEQ ID NO: 2387030 - RNA, 14 nt, Bordetella pertussis
ggccggcgggcgua

SEQ ID NO: 2387031 - RNA, 15 nt, Bordetella pertussis
ggccggcgggcguac

SEQ ID NO: 2387032 - RNA, 14 nt, Bordetella pertussis
ggccggcgggggcg

SEQ ID NO: 2387033 - RNA, 13 nt, Bordetella pertussis
ggccggcggucgc

SEQ ID NO: 2387034 - RNA, 19 nt, Bordetella pertussis
ggccggcggucgcgcuggc

SEQ ID NO: 2387035 - RNA, 14 nt, Bordetella pertussis
ggccggcgugcugu

SEQ ID NO: 2387036 - RNA, 18 nt, Bordetella pertussis
ggccggcguggccugccc

SEQ ID NO: 2387037 - RNA, 20 nt, Bordetella pertussis
ggccggcguguucagcgcgc

SEQ ID NO: 2387038 - RNA, 17 nt, Bordetella pertussis
ggccggcguucaccagg

SEQ ID NO: 2387039 - RNA, 19 nt, Bordetella pertussis
ggccggcuacagcucgccg

SEQ ID NO: 2387040 - RNA, 23 nt, Bordetella pertussis
ggccggcuacagcucgccggcga

SEQ ID NO: 2387041 - RNA, 18 nt, Bordetella pertussis
ggccggcucauucggcgc

SEQ ID NO: 2387042 - RNA, 14 nt, Bordetella pertussis
ggccggcucgcccc

SEQ ID NO: 2387043 - RNA, 13 nt, Bordetella pertussis
ggccggcucgccg

SEQ ID NO: 2387044 - RNA, 15 nt, Bordetella pertussis
ggccggcucgccgca

SEQ ID NO: 2387045 - RNA, 13 nt, Bordetella pertussis
ggccggcucggcg

SEQ ID NO: 2387046 - RNA, 15 nt, Bordetella pertussis
ggccggcucggcggc

SEQ ID NO: 2387047 - RNA, 14 nt, Bordetella pertussis
ggccggcugcacca

SEQ ID NO: 2387048 - RNA, 22 nt, Bordetella pertussis
ggccggcugcaccagcgcgccg

SEQ ID NO: 2387049 - RNA, 16 nt, Bordetella pertussis
ggccggcugcgcgccg

SEQ ID NO: 2387050 - RNA, 19 nt, Bordetella pertussis
ggccggcugcgcgccgacc

SEQ ID NO: 2387051 - RNA, 17 nt, Bordetella pertussis
ggccggcugggcggccu

SEQ ID NO: 2387052 - RNA, 18 nt, Bordetella pertussis
ggccggcugggcggccuu

SEQ ID NO: 2387053 - RNA, 22 nt, Bordetella pertussis
ggccggcugggcggccuuggcc

SEQ ID NO: 2387054 - RNA, 11 nt, Bordetella pertussis
ggccggcuugc

SEQ ID NO: 2387055 - RNA, 23 nt, Bordetella pertussis
ggccggcuugcgcaagccggccg

SEQ ID NO: 2387056 - RNA, 17 nt, Bordetella pertussis
ggccggcuuuggacagg

SEQ ID NO: 2387057 - RNA, 20 nt, Bordetella pertussis
ggccggcuuuggacaggcgu

SEQ ID NO: 2387058 - RNA, 22 nt, Bordetella pertussis
ggccggcuuuggacaggcgugc

SEQ ID NO: 2387059 - RNA, 17 nt, Bordetella pertussis
ggccgggaaggcgggac

SEQ ID NO: 2387060 - RNA, 23 nt, Bordetella pertussis
ggccgggcacaccgucacgcgca

SEQ ID NO: 2387061 - RNA, 15 nt, Bordetella pertussis
ggccgggcaggccgc

SEQ ID NO: 2387062 - RNA, 16 nt, Bordetella pertussis
ggccgggcaggccgcg

SEQ ID NO: 2387063 - RNA, 14 nt, Bordetella pertussis
ggccgggcaguccu

SEQ ID NO: 2387064 - RNA, 20 nt, Bordetella pertussis
ggccgggcaguccuggcugg

SEQ ID NO: 2387065 - RNA, 13 nt, Bordetella pertussis
ggccgggccagcg

SEQ ID NO: 2387066 - RNA, 13 nt, Bordetella pertussis
ggccgggccagua

SEQ ID NO: 2387067 - RNA, 18 nt, Bordetella pertussis
ggccgggcccggcgcgcc

SEQ ID NO: 2387068 - RNA, 15 nt, Bordetella pertussis
ggccgggccguggcg

SEQ ID NO: 2387069 - RNA, 12 nt, Bordetella pertussis
ggccgggccuca

SEQ ID NO: 2387070 - RNA, 14 nt, Bordetella pertussis
ggccgggcgccagg

SEQ ID NO: 2387071 - RNA, 17 nt, Bordetella pertussis
ggccgggcgccaggcug

SEQ ID NO: 2387072 - RNA, 12 nt, Bordetella pertussis
ggccgggcgccc

SEQ ID NO: 2387073 - RNA, 15 nt, Bordetella pertussis
ggccgggcgcccagc

SEQ ID NO: 2387074 - RNA, 17 nt, Bordetella pertussis
ggccgggcgcccagcgu

SEQ ID NO: 2387075 - RNA, 14 nt, Bordetella pertussis
ggccgggcgcggcg

SEQ ID NO: 2387076 - RNA, 17 nt, Bordetella pertussis
ggccgggcgcggcgccc

SEQ ID NO: 2387077 - RNA, 21 nt, Bordetella pertussis
ggccgggcguacguacugcca

SEQ ID NO: 2387078 - RNA, 15 nt, Bordetella pertussis
ggccgggcucaggcu

SEQ ID NO: 2387079 - RNA, 19 nt, Bordetella pertussis
ggccggggaaacggccaag

SEQ ID NO: 2387080 - RNA, 23 nt, Bordetella pertussis
ggccggggaaacggccaagcagc

SEQ ID NO: 2387081 - RNA, 18 nt, Bordetella pertussis
ggccggggaagccgccgg

SEQ ID NO: 2387082 - RNA, 21 nt, Bordetella pertussis
ggccggggaagccgccggcgu

SEQ ID NO: 2387083 - RNA, 22 nt, Bordetella pertussis
ggccggggaagccgccggcgug

SEQ ID NO: 2387084 - RNA, 15 nt, Bordetella pertussis
ggccggggcccgcgg

SEQ ID NO: 2387085 - RNA, 13 nt, Bordetella pertussis
ggccggggccgcc

SEQ ID NO: 2387086 - RNA, 14 nt, Bordetella pertussis
ggccggggccgccc

SEQ ID NO: 2387087 - RNA, 17 nt, Bordetella pertussis
ggccggggccgcccagc

SEQ ID NO: 2387088 - RNA, 18 nt, Bordetella pertussis
ggccggggccgcccagca

SEQ ID NO: 2387089 - RNA, 15 nt, Bordetella pertussis
ggccggggccgcccu

SEQ ID NO: 2387090 - RNA, 17 nt, Bordetella pertussis
ggccggggccgcccugg

SEQ ID NO: 2387091 - RNA, 16 nt, Bordetella pertussis
ggccggggcgucgucg

SEQ ID NO: 2387092 - RNA, 23 nt, Bordetella pertussis
ggccggggguuccugcccauggc

SEQ ID NO: 2387093 - RNA, 17 nt, Bordetella pertussis
ggccgggguccugaggc

SEQ ID NO: 2387094 - RNA, 22 nt, Bordetella pertussis
ggccgggguccugaggccaggc

SEQ ID NO: 2387095 - RNA, 15 nt, Bordetella pertussis
ggccgggucccuggc

SEQ ID NO: 2387096 - RNA, 23 nt, Bordetella pertussis
ggccgggucccuggcccuggcgg

SEQ ID NO: 2387097 - RNA, 14 nt, Bordetella pertussis
ggccgggucgcgca

SEQ ID NO: 2387098 - RNA, 16 nt, Bordetella pertussis
ggccgggucgcgcagc

SEQ ID NO: 2387099 - RNA, 20 nt, Bordetella pertussis
ggccgggucgcgcagcaggg

SEQ ID NO: 2387100 - RNA, 18 nt, Bordetella pertussis
ggccgggugguccaugcg

SEQ ID NO: 2387101 - RNA, 17 nt, Bordetella pertussis
ggccggguugucgccca

SEQ ID NO: 2387102 - RNA, 19 nt, Bordetella pertussis
ggccggguugucgcccacc

SEQ ID NO: 2387103 - RNA, 20 nt, Bordetella pertussis
ggccggguugucgcccacca

SEQ ID NO: 2387104 - RNA, 22 nt, Bordetella pertussis
ggccgguaaggcgcuugcgcag

SEQ ID NO: 2387105 - RNA, 18 nt, Bordetella pertussis
ggccgguaucgacgcgcg

SEQ ID NO: 2387106 - RNA, 15 nt, Bordetella pertussis
ggccgguaucggccu

SEQ ID NO: 2387107 - RNA, 23 nt, Bordetella pertussis
ggccggucagcccaggcgggcgu

SEQ ID NO: 2387108 - RNA, 20 nt, Bordetella pertussis
ggccggugaugcggcgcgcc

SEQ ID NO: 2387109 - RNA, 23 nt, Bordetella pertussis
ggccggugcaucggccggcgguc

SEQ ID NO: 2387110 - RNA, 16 nt, Bordetella pertussis
ggccgguggaccaggg

SEQ ID NO: 2387111 - RNA, 18 nt, Bordetella pertussis
ggccgguggaccagggca

SEQ ID NO: 2387112 - RNA, 13 nt, Bordetella pertussis
ggccgguucgaug

SEQ ID NO: 2387113 - RNA, 19 nt, Bordetella pertussis
ggccgguucgaugaccugg

SEQ ID NO: 2387114 - RNA, 22 nt, Bordetella pertussis
ggccgguucgaugaccugggcc

SEQ ID NO: 2387115 - RNA, 21 nt, Bordetella pertussis
ggccgguuucggccugcaggc

SEQ ID NO: 2387116 - RNA, 23 nt, Bordetella pertussis
ggccgguuucggccugcaggccc

SEQ ID NO: 2387117 - RNA, 20 nt, Bordetella pertussis
ggccguaaccggccaguccc

SEQ ID NO: 2387118 - RNA, 19 nt, Bordetella pertussis
ggccguagagggucuggcg

SEQ ID NO: 2387119 - RNA, 16 nt, Bordetella pertussis
ggccguagcguuggcg

SEQ ID NO: 2387120 - RNA, 24 nt, Bordetella pertussis
ggccguagcguuggcggccggcca

SEQ ID NO: 2387121 - RNA, 19 nt, Bordetella pertussis
ggccguauggccguuggcc

SEQ ID NO: 2387122 - RNA, 16 nt, Bordetella pertussis
ggccgucaacagcaug

SEQ ID NO: 2387123 - RNA, 17 nt, Bordetella pertussis
ggccgucaacggcuugg

SEQ ID NO: 2387124 - RNA, 16 nt, Bordetella pertussis
ggccgucaagcgucga

SEQ ID NO: 2387125 - RNA, 21 nt, Bordetella pertussis
ggccgucaagcgucgauggcg

SEQ ID NO: 2387126 - RNA, 15 nt, Bordetella pertussis
ggccgucaccgccgc

SEQ ID NO: 2387127 - RNA, 17 nt, Bordetella pertussis
ggccgucaccgccgccg

SEQ ID NO: 2387128 - RNA, 13 nt, Bordetella pertussis
ggccgucagcagc

SEQ ID NO: 2387129 - RNA, 14 nt, Bordetella pertussis
ggccgucagcagca

SEQ ID NO: 2387130 - RNA, 15 nt, Bordetella pertussis
ggccgucagcagcag

SEQ ID NO: 2387131 - RNA, 16 nt, Bordetella pertussis
ggccgucagcagcagg

SEQ ID NO: 2387132 - RNA, 17 nt, Bordetella pertussis
ggccgucagcagcaggc

SEQ ID NO: 2387133 - RNA, 18 nt, Bordetella pertussis
ggccgucaggcguugcgc

SEQ ID NO: 2387134 - RNA, 21 nt, Bordetella pertussis
ggccgucaggcguugcgccgc

SEQ ID NO: 2387135 - RNA, 17 nt, Bordetella pertussis
ggccgucauccacaggu

SEQ ID NO: 2387136 - RNA, 17 nt, Bordetella pertussis
ggccgucauggcggucu

SEQ ID NO: 2387137 - RNA, 17 nt, Bordetella pertussis
ggccguccacgaaggca

SEQ ID NO: 2387138 - RNA, 15 nt, Bordetella pertussis
ggccgucgaccgaca

SEQ ID NO: 2387139 - RNA, 21 nt, Bordetella pertussis
ggccgucgaccgacagcacau

SEQ ID NO: 2387140 - RNA, 21 nt, Bordetella pertussis
ggccgucgagccgggcgccga

SEQ ID NO: 2387141 - RNA, 22 nt, Bordetella pertussis
ggccgucgagccgguccgccuc

SEQ ID NO: 2387142 - RNA, 13 nt, Bordetella pertussis
ggccgucgccagc

SEQ ID NO: 2387143 - RNA, 14 nt, Bordetella pertussis
ggccgucgccgauc

SEQ ID NO: 2387144 - RNA, 15 nt, Bordetella pertussis
ggccgucgccgaucg

SEQ ID NO: 2387145 - RNA, 16 nt, Bordetella pertussis
ggccgucgccgaucgg

SEQ ID NO: 2387146 - RNA, 13 nt, Bordetella pertussis
ggccgucgccgcc

SEQ ID NO: 2387147 - RNA, 14 nt, Bordetella pertussis
ggccgucgccgccc

SEQ ID NO: 2387148 - RNA, 17 nt, Bordetella pertussis
ggccgucgccgcccugc

SEQ ID NO: 2387149 - RNA, 20 nt, Bordetella pertussis
ggccgucgccgcccugcugc

SEQ ID NO: 2387150 - RNA, 17 nt, Bordetella pertussis
ggccgucgccuucggcg

SEQ ID NO: 2387151 - RNA, 14 nt, Bordetella pertussis
ggccgucggccagg

SEQ ID NO: 2387152 - RNA, 17 nt, Bordetella pertussis
ggccgucggccaggggc

SEQ ID NO: 2387153 - RNA, 14 nt, Bordetella pertussis
ggccgucggcgcug

SEQ ID NO: 2387154 - RNA, 15 nt, Bordetella pertussis
ggccgucggcgcugg

SEQ ID NO: 2387155 - RNA, 15 nt, Bordetella pertussis
ggccgucggggccga

SEQ ID NO: 2387156 - RNA, 19 nt, Bordetella pertussis
ggccgucggggccgauggu

SEQ ID NO: 2387157 - RNA, 17 nt, Bordetella pertussis
ggccgucgugcgccugg

SEQ ID NO: 2387158 - RNA, 20 nt, Bordetella pertussis
ggccgucuacaggcccagcg

SEQ ID NO: 2387159 - RNA, 21 nt, Bordetella pertussis
ggccgucuacaggcccagcgc

SEQ ID NO: 2387160 - RNA, 22 nt, Bordetella pertussis
ggccgucuacaggcccagcgcc

SEQ ID NO: 2387161 - RNA, 13 nt, Bordetella pertussis
ggccgucugggcg

SEQ ID NO: 2387162 - RNA, 15 nt, Bordetella pertussis
ggccgucugggcgug

SEQ ID NO: 2387163 - RNA, 17 nt, Bordetella pertussis
ggccgugagcgccgccg

SEQ ID NO: 2387164 - RNA, 18 nt, Bordetella pertussis
ggccgugagcgccgccgc

SEQ ID NO: 2387165 - RNA, 20 nt, Bordetella pertussis
ggccgugagcgccgccgcca

SEQ ID NO: 2387166 - RNA, 18 nt, Bordetella pertussis
ggccgugcccgagggcgc

SEQ ID NO: 2387167 - RNA, 14 nt, Bordetella pertussis
ggccgugccgcccg

SEQ ID NO: 2387168 - RNA, 22 nt, Bordetella pertussis
ggccgugccgcccgguucgccg

SEQ ID NO: 2387169 - RNA, 20 nt, Bordetella pertussis
ggccgugccucaacuggccg

SEQ ID NO: 2387170 - RNA, 15 nt, Bordetella pertussis
ggccgugcgccagcg

SEQ ID NO: 2387171 - RNA, 16 nt, Bordetella pertussis
ggccgugcgccagcgc

SEQ ID NO: 2387172 - RNA, 17 nt, Bordetella pertussis
ggccgugcgccagcgcc

SEQ ID NO: 2387173 - RNA, 18 nt, Bordetella pertussis
ggccgugcgccgggcguc

SEQ ID NO: 2387174 - RNA, 20 nt, Bordetella pertussis
ggccguggaggcggcggccg

SEQ ID NO: 2387175 - RNA, 14 nt, Bordetella pertussis
ggccguggcccagc

SEQ ID NO: 2387176 - RNA, 17 nt, Bordetella pertussis
ggccguggcccagccgc

SEQ ID NO: 2387177 - RNA, 20 nt, Bordetella pertussis
ggccguggcccagccgcaug

SEQ ID NO: 2387178 - RNA, 16 nt, Bordetella pertussis
ggccguggccgggccc

SEQ ID NO: 2387179 - RNA, 16 nt, Bordetella pertussis
ggccguggcgauccag

SEQ ID NO: 2387180 - RNA, 14 nt, Bordetella pertussis
ggccguggcggcca

SEQ ID NO: 2387181 - RNA, 14 nt, Bordetella pertussis
ggccguggcggccu

SEQ ID NO: 2387182 - RNA, 16 nt, Bordetella pertussis
ggccguggcggccugc

SEQ ID NO: 2387183 - RNA, 18 nt, Bordetella pertussis
ggccguggcggccugcgc

SEQ ID NO: 2387184 - RNA, 22 nt, Bordetella pertussis
ggccguggcggccugcgccggc

SEQ ID NO: 2387185 - RNA, 17 nt, Bordetella pertussis
ggccguggcgugcaggc

SEQ ID NO: 2387186 - RNA, 19 nt, Bordetella pertussis
ggccguggcgugcaggccg

SEQ ID NO: 2387187 - RNA, 18 nt, Bordetella pertussis
ggccguguucgagcaggc

SEQ ID NO: 2387188 - RNA, 20 nt, Bordetella pertussis
ggccguuaugguucggccuc

SEQ ID NO: 2387189 - RNA, 18 nt, Bordetella pertussis
ggccguuccaguccagcg

SEQ ID NO: 2387190 - RNA, 23 nt, Bordetella pertussis
ggccguuccaguccagcgucggc

SEQ ID NO: 2387191 - RNA, 14 nt, Bordetella pertussis
ggccguucggugcg

SEQ ID NO: 2387192 - RNA, 15 nt, Bordetella pertussis
ggccguucggugcgc

SEQ ID NO: 2387193 - RNA, 15 nt, Bordetella pertussis
ggccguugcuccagc

SEQ ID NO: 2387194 - RNA, 16 nt, Bordetella pertussis
ggccguugcuccagcc

SEQ ID NO: 2387195 - RNA, 18 nt, Bordetella pertussis
ggccguugcuccagccag

SEQ ID NO: 2387196 - RNA, 15 nt, Bordetella pertussis
ggccguuggccagcg

SEQ ID NO: 2387197 - RNA, 16 nt, Bordetella pertussis
ggccguuggccagcgc

SEQ ID NO: 2387198 - RNA, 15 nt, Bordetella pertussis
ggccguuggccgcgc

SEQ ID NO: 2387199 - RNA, 16 nt, Bordetella pertussis
ggccguuggccgcgcg

SEQ ID NO: 2387200 - RNA, 17 nt, Bordetella pertussis
ggccguuggcgauggcg

SEQ ID NO: 2387201 - RNA, 22 nt, Bordetella pertussis
ggccguuggcgauggcgcggcc

SEQ ID NO: 2387202 - RNA, 16 nt, Bordetella pertussis
ggccguuggcgcgccu

SEQ ID NO: 2387203 - RNA, 17 nt, Bordetella pertussis
ggccguuggcgcgccuu

SEQ ID NO: 2387204 - RNA, 14 nt, Bordetella pertussis
ggccguuguccugg

SEQ ID NO: 2387205 - RNA, 17 nt, Bordetella pertussis
ggccguuucaggccugc

SEQ ID NO: 2387206 - RNA, 21 nt, Bordetella pertussis
ggccguuucaggccugcggcg

SEQ ID NO: 2387207 - RNA, 22 nt, Bordetella pertussis
ggccguuucaggccugcggcgc

SEQ ID NO: 2387208 - RNA, 17 nt, Bordetella pertussis
ggccguuuccucuggag

SEQ ID NO: 2387209 - RNA, 17 nt, Bordetella pertussis
ggccuacuucggcagcu

SEQ ID NO: 2387210 - RNA, 18 nt, Bordetella pertussis
ggccuacuugccggcgcu

SEQ ID NO: 2387211 - RNA, 15 nt, Bordetella pertussis
ggccuagcccggcgc

SEQ ID NO: 2387212 - RNA, 17 nt, Bordetella pertussis
ggccuagcccggcgcca

SEQ ID NO: 2387213 - RNA, 18 nt, Bordetella pertussis
ggccuagcccggcgccac

SEQ ID NO: 2387214 - RNA, 15 nt, Bordetella pertussis
ggccuaucaccuggg

SEQ ID NO: 2387215 - RNA, 20 nt, Bordetella pertussis
ggccuaugugcaggccaccg

SEQ ID NO: 2387216 - RNA, 18 nt, Bordetella pertussis
ggccuauuuggcggccug

SEQ ID NO: 2387217 - RNA, 20 nt, Bordetella pertussis
ggccuauuuggcggccuggc

SEQ ID NO: 2387218 - RNA, 13 nt, Bordetella pertussis
ggccucagcggcc

SEQ ID NO: 2387219 - RNA, 21 nt, Bordetella pertussis
ggccucagcggccgcugccgc

SEQ ID NO: 2387220 - RNA, 15 nt, Bordetella pertussis
ggccucaucgagcgc

SEQ ID NO: 2387221 - RNA, 13 nt, Bordetella pertussis
ggccuccagcauc

SEQ ID NO: 2387222 - RNA, 15 nt, Bordetella pertussis
ggccuccagcaucgc

SEQ ID NO: 2387223 - RNA, 18 nt, Bordetella pertussis
ggccuccagcaucgccgc

SEQ ID NO: 2387224 - RNA, 21 nt, Bordetella pertussis
ggccuccagcaucgccgccag

SEQ ID NO: 2387225 - RNA, 22 nt, Bordetella pertussis
ggccuccagcaucgccgccagc

SEQ ID NO: 2387226 - RNA, 18 nt, Bordetella pertussis
ggccucccgccgcccggc

SEQ ID NO: 2387227 - RNA, 19 nt, Bordetella pertussis
ggccucccgccgcccggcc

SEQ ID NO: 2387228 - RNA, 15 nt, Bordetella pertussis
ggccucccggaccag

SEQ ID NO: 2387229 - RNA, 17 nt, Bordetella pertussis
ggccucccggaccagca

SEQ ID NO: 2387230 - RNA, 18 nt, Bordetella pertussis
ggccucccggaccagcag

SEQ ID NO: 2387231 - RNA, 22 nt, Bordetella pertussis
ggccucccggaccagcaguugc

SEQ ID NO: 2387232 - RNA, 19 nt, Bordetella pertussis
ggccuccgcgcacagcgcg

SEQ ID NO: 2387233 - RNA, 15 nt, Bordetella pertussis
ggccuccgcgccgac

SEQ ID NO: 2387234 - RNA, 16 nt, Bordetella pertussis
ggccuccgcgccgacc

SEQ ID NO: 2387235 - RNA, 12 nt, Bordetella pertussis
ggccuccugcag

SEQ ID NO: 2387236 - RNA, 15 nt, Bordetella pertussis
ggccucgaagcccgg

SEQ ID NO: 2387237 - RNA, 16 nt, Bordetella pertussis
ggccucgaagcccggc

SEQ ID NO: 2387238 - RNA, 17 nt, Bordetella pertussis
ggccucgaagcccggca

SEQ ID NO: 2387239 - RNA, 22 nt, Bordetella pertussis
ggccucgacgauggccggggcg

SEQ ID NO: 2387240 - RNA, 14 nt, Bordetella pertussis
ggccucgacggccg

SEQ ID NO: 2387241 - RNA, 22 nt, Bordetella pertussis
ggccucgaugguggcgauggca

SEQ ID NO: 2387242 - RNA, 14 nt, Bordetella pertussis
ggccucgcccaugc

SEQ ID NO: 2387243 - RNA, 17 nt, Bordetella pertussis
ggccucgcccaugcggg

SEQ ID NO: 2387244 - RNA, 19 nt, Bordetella pertussis
ggccucgcccaugcgggcg

SEQ ID NO: 2387245 - RNA, 14 nt, Bordetella pertussis
ggccucgcccuggc

SEQ ID NO: 2387246 - RNA, 17 nt, Bordetella pertussis
ggccucgcccuggcgca

SEQ ID NO: 2387247 - RNA, 14 nt, Bordetella pertussis
ggccucgccggccu

SEQ ID NO: 2387248 - RNA, 15 nt, Bordetella pertussis
ggccucgccggccug

SEQ ID NO: 2387249 - RNA, 16 nt, Bordetella pertussis
ggccucgccggccugg

SEQ ID NO: 2387250 - RNA, 17 nt, Bordetella pertussis
ggccucgccggccuggc

SEQ ID NO: 2387251 - RNA, 20 nt, Bordetella pertussis
ggccucgccggccuggcgcg

SEQ ID NO: 2387252 - RNA, 15 nt, Bordetella pertussis
ggccucgcgcagggc

SEQ ID NO: 2387253 - RNA, 20 nt, Bordetella pertussis
ggccucgcgcagggcggccu

SEQ ID NO: 2387254 - RNA, 13 nt, Bordetella pertussis
ggccucgcgcucg

SEQ ID NO: 2387255 - RNA, 19 nt, Bordetella pertussis
ggccucgcgcucgaacauc

SEQ ID NO: 2387256 - RNA, 22 nt, Bordetella pertussis
ggccucgcgcucgaacaucgcg

SEQ ID NO: 2387257 - RNA, 17 nt, Bordetella pertussis
ggccucgcgcucgcgcu

SEQ ID NO: 2387258 - RNA, 23 nt, Bordetella pertussis
ggccucgcgcucgcgcucggcca

SEQ ID NO: 2387259 - RNA, 16 nt, Bordetella pertussis
ggccucgcggcgcagc

SEQ ID NO: 2387260 - RNA, 17 nt, Bordetella pertussis
ggccucgcggcgcagca

SEQ ID NO: 2387261 - RNA, 23 nt, Bordetella pertussis
ggccucgcgggccuuggccagca

SEQ ID NO: 2387262 - RNA, 16 nt, Bordetella pertussis
ggccucgcugcgggcg

SEQ ID NO: 2387263 - RNA, 20 nt, Bordetella pertussis
ggccucggccaccuggcgca

SEQ ID NO: 2387264 - RNA, 14 nt, Bordetella pertussis
ggccucggccagcu

SEQ ID NO: 2387265 - RNA, 15 nt, Bordetella pertussis
ggccucggccagcug

SEQ ID NO: 2387266 - RNA, 13 nt, Bordetella pertussis
ggccucggccagg

SEQ ID NO: 2387267 - RNA, 17 nt, Bordetella pertussis
ggccucggccauguaga

SEQ ID NO: 2387268 - RNA, 13 nt, Bordetella pertussis
ggccucggcggcc

SEQ ID NO: 2387269 - RNA, 15 nt, Bordetella pertussis
ggccucggcggccuc

SEQ ID NO: 2387270 - RNA, 22 nt, Bordetella pertussis
ggccucggcgggcggcgccagc

SEQ ID NO: 2387271 - RNA, 13 nt, Bordetella pertussis
ggccucggcuugc

SEQ ID NO: 2387272 - RNA, 14 nt, Bordetella pertussis
ggccucguccacgu

SEQ ID NO: 2387273 - RNA, 19 nt, Bordetella pertussis
ggccucguccucgucggcg

SEQ ID NO: 2387274 - RNA, 19 nt, Bordetella pertussis
ggccucgucgaccacgccg

SEQ ID NO: 2387275 - RNA, 21 nt, Bordetella pertussis
ggccucgucgaccacgccggc

SEQ ID NO: 2387276 - RNA, 15 nt, Bordetella pertussis
ggccucgugcugcug

SEQ ID NO: 2387277 - RNA, 16 nt, Bordetella pertussis
ggccucgugcugcugc

SEQ ID NO: 2387278 - RNA, 17 nt, Bordetella pertussis
ggccucgugcugcugca

SEQ ID NO: 2387279 - RNA, 23 nt, Bordetella pertussis
ggccucgugcugcugcaggcgcg

SEQ ID NO: 2387280 - RNA, 18 nt, Bordetella pertussis
ggccucuucgucgccggc

SEQ ID NO: 2387281 - RNA, 22 nt, Bordetella pertussis
ggccucuugcgugacccggggc

SEQ ID NO: 2387282 - RNA, 19 nt, Bordetella pertussis
ggccugaaccaggccgcca

SEQ ID NO: 2387283 - RNA, 20 nt, Bordetella pertussis
ggccugaaccaggccgccag

SEQ ID NO: 2387284 - RNA, 16 nt, Bordetella pertussis
ggccugacgcgcaagc

SEQ ID NO: 2387285 - RNA, 21 nt, Bordetella pertussis
ggccugacgcgcaagcggccc

SEQ ID NO: 2387286 - RNA, 13 nt, Bordetella pertussis
ggccugacgcuca

SEQ ID NO: 2387287 - RNA, 22 nt, Bordetella pertussis
ggccugacgcucauccaggcgc

SEQ ID NO: 2387288 - RNA, 15 nt, Bordetella pertussis
ggccugacgggccuc

SEQ ID NO: 2387289 - RNA, 16 nt, Bordetella pertussis
ggccugacgggccucg

SEQ ID NO: 2387290 - RNA, 14 nt, Bordetella pertussis
ggccugcaaccugg

SEQ ID NO: 2387291 - RNA, 12 nt, Bordetella pertussis
ggccugcaccgg

SEQ ID NO: 2387292 - RNA, 19 nt, Bordetella pertussis
ggccugcacgcucuugagc

SEQ ID NO: 2387293 - RNA, 23 nt, Bordetella pertussis
ggccugcacgcucuugagcgcgg

SEQ ID NO: 2387294 - RNA, 21 nt, Bordetella pertussis
ggccugcacggugggcagcag

SEQ ID NO: 2387295 - RNA, 22 nt, Bordetella pertussis
ggccugcacggugggcagcagc

SEQ ID NO: 2387296 - RNA, 22 nt, Bordetella pertussis
ggccugcacgucccagucgccg

SEQ ID NO: 2387297 - RNA, 23 nt, Bordetella pertussis
ggccugcacgucccagucgccgc

SEQ ID NO: 2387298 - RNA, 17 nt, Bordetella pertussis
ggccugcagaccagcac

SEQ ID NO: 2387299 - RNA, 22 nt, Bordetella pertussis
ggccugcagcaugaccgacagg

SEQ ID NO: 2387300 - RNA, 16 nt, Bordetella pertussis
ggccugcaggaagccu

SEQ ID NO: 2387301 - RNA, 18 nt, Bordetella pertussis
ggccugcaggaagccugc

SEQ ID NO: 2387302 - RNA, 20 nt, Bordetella pertussis
ggccugcaggaagccugcgc

SEQ ID NO: 2387303 - RNA, 16 nt, Bordetella pertussis
ggccugcaggcccagc

SEQ ID NO: 2387304 - RNA, 18 nt, Bordetella pertussis
ggccugcaggcccagcac

SEQ ID NO: 2387305 - RNA, 22 nt, Bordetella pertussis
ggccugcaggcucuugaccagc

SEQ ID NO: 2387306 - RNA, 20 nt, Bordetella pertussis
ggccugcaggugccgccggc

SEQ ID NO: 2387307 - RNA, 20 nt, Bordetella pertussis
ggccugcaguucggccgcca

SEQ ID NO: 2387308 - RNA, 21 nt, Bordetella pertussis
ggccugccaaagacaaugccc

SEQ ID NO: 2387309 - RNA, 14 nt, Bordetella pertussis
ggccugccaccagc

SEQ ID NO: 2387310 - RNA, 17 nt, Bordetella pertussis
ggccugccaccagcgcg

SEQ ID NO: 2387311 - RNA, 13 nt, Bordetella pertussis
ggccugccagccu

SEQ ID NO: 2387312 - RNA, 17 nt, Bordetella pertussis
ggccugccauccggccg

SEQ ID NO: 2387313 - RNA, 19 nt, Bordetella pertussis
ggccugccauccggccgca

SEQ ID NO: 2387314 - RNA, 22 nt, Bordetella pertussis
ggccugccauccggccgcacgc

SEQ ID NO: 2387315 - RNA, 14 nt, Bordetella pertussis
ggccugcccauggc

SEQ ID NO: 2387316 - RNA, 15 nt, Bordetella pertussis
ggccugcccgcaucc

SEQ ID NO: 2387317 - RNA, 14 nt, Bordetella pertussis
ggccugcccgggca

SEQ ID NO: 2387318 - RNA, 14 nt, Bordetella pertussis
ggccugcccgggcg

SEQ ID NO: 2387319 - RNA, 15 nt, Bordetella pertussis
ggccugcccgggcgg

SEQ ID NO: 2387320 - RNA, 12 nt, Bordetella pertussis
ggccugcccguc

SEQ ID NO: 2387321 - RNA, 17 nt, Bordetella pertussis
ggccugcccgucgggca

SEQ ID NO: 2387322 - RNA, 12 nt, Bordetella pertussis
ggccugccggcg

SEQ ID NO: 2387323 - RNA, 15 nt, Bordetella pertussis
ggccugccggcgcac

SEQ ID NO: 2387324 - RNA, 16 nt, Bordetella pertussis
ggccugccggcgcgcc

SEQ ID NO: 2387325 - RNA, 19 nt, Bordetella pertussis
ggccugcgccaccagcuug

SEQ ID NO: 2387326 - RNA, 14 nt, Bordetella pertussis
ggccugcgccaccg

SEQ ID NO: 2387327 - RNA, 13 nt, Bordetella pertussis
ggccugcgccagc

SEQ ID NO: 2387328 - RNA, 14 nt, Bordetella pertussis
ggccugcgccgccg

SEQ ID NO: 2387329 - RNA, 16 nt, Bordetella pertussis
ggccugcgccgccgcg

SEQ ID NO: 2387330 - RNA, 18 nt, Bordetella pertussis
ggccugcgccgccgcgcg

SEQ ID NO: 2387331 - RNA, 20 nt, Bordetella pertussis
ggccugcgccgccgcgcgcu

SEQ ID NO: 2387332 - RNA, 21 nt, Bordetella pertussis
ggccugcgccgccgcgcgcug

SEQ ID NO: 2387333 - RNA, 14 nt, Bordetella pertussis
ggccugcgccggca

SEQ ID NO: 2387334 - RNA, 16 nt, Bordetella pertussis
ggccugcgccggcaug

SEQ ID NO: 2387335 - RNA, 17 nt, Bordetella pertussis
ggccugcgccggcaugg

SEQ ID NO: 2387336 - RNA, 15 nt, Bordetella pertussis
ggccugcgccgggcg

SEQ ID NO: 2387337 - RNA, 16 nt, Bordetella pertussis
ggccugcgccgggcgc

SEQ ID NO: 2387338 - RNA, 12 nt, Bordetella pertussis
ggccugcgcgau

SEQ ID NO: 2387339 - RNA, 13 nt, Bordetella pertussis
ggccugcgcgccg

SEQ ID NO: 2387340 - RNA, 17 nt, Bordetella pertussis
ggccugcgcgccgacca

SEQ ID NO: 2387341 - RNA, 13 nt, Bordetella pertussis
ggccugcggcgcc

SEQ ID NO: 2387342 - RNA, 14 nt, Bordetella pertussis
ggccugcggcgcca

SEQ ID NO: 2387343 - RNA, 17 nt, Bordetella pertussis
ggccugcgggccgggca

SEQ ID NO: 2387344 - RNA, 20 nt, Bordetella pertussis
ggccugcgggccgggcaggc

SEQ ID NO: 2387345 - RNA, 13 nt, Bordetella pertussis
ggccugcgggcgc

SEQ ID NO: 2387346 - RNA, 17 nt, Bordetella pertussis
ggccugcgggcgccgcg

SEQ ID NO: 2387347 - RNA, 21 nt, Bordetella pertussis
ggccugcgggcugaugcaggc

SEQ ID NO: 2387348 - RNA, 13 nt, Bordetella pertussis
ggccugcgggugc

SEQ ID NO: 2387349 - RNA, 22 nt, Bordetella pertussis
ggccugcgggugcgccugcagc

SEQ ID NO: 2387350 - RNA, 14 nt, Bordetella pertussis
ggccugcgucgcca

SEQ ID NO: 2387351 - RNA, 16 nt, Bordetella pertussis
ggccugcgucgccacc

SEQ ID NO: 2387352 - RNA, 18 nt, Bordetella pertussis
ggccugcgugucaggcgg

SEQ ID NO: 2387353 - RNA, 21 nt, Bordetella pertussis
ggccugcgugucaggcggagu

SEQ ID NO: 2387354 - RNA, 14 nt, Bordetella pertussis
ggccugcuccggcg

SEQ ID NO: 2387355 - RNA, 16 nt, Bordetella pertussis
ggccugcuccggcgug

SEQ ID NO: 2387356 - RNA, 14 nt, Bordetella pertussis
ggccugcucgccca

SEQ ID NO: 2387357 - RNA, 17 nt, Bordetella pertussis
ggccugcucgcccacau

SEQ ID NO: 2387358 - RNA, 23 nt, Bordetella pertussis
ggccugcucgcccacauagcggc

SEQ ID NO: 2387359 - RNA, 20 nt, Bordetella pertussis
ggccugcucgccggccagcg

SEQ ID NO: 2387360 - RNA, 23 nt, Bordetella pertussis
ggccugcucgccggccagcgcgg

SEQ ID NO: 2387361 - RNA, 14 nt, Bordetella pertussis
ggccugcucgggcg

SEQ ID NO: 2387362 - RNA, 15 nt, Bordetella pertussis
ggccugcucgggcgc

SEQ ID NO: 2387363 - RNA, 16 nt, Bordetella pertussis
ggccugcucgggcgcc

SEQ ID NO: 2387364 - RNA, 18 nt, Bordetella pertussis
ggccugcucgggcgccuc

SEQ ID NO: 2387365 - RNA, 21 nt, Bordetella pertussis
ggccugcucgugcaucaucug

SEQ ID NO: 2387366 - RNA, 19 nt, Bordetella pertussis
ggccugcugugcgauggca

SEQ ID NO: 2387367 - RNA, 22 nt, Bordetella pertussis
ggccugcuugaagacgcccagg

SEQ ID NO: 2387368 - RNA, 23 nt, Bordetella pertussis
ggccugcuugaagacgcccaggu

SEQ ID NO: 2387369 - RNA, 16 nt, Bordetella pertussis
ggccugcuuggcagcc

SEQ ID NO: 2387370 - RNA, 17 nt, Bordetella pertussis
ggccugcuuggcagccu

SEQ ID NO: 2387371 - RNA, 19 nt, Bordetella pertussis
ggccugcuuggcagccuug

SEQ ID NO: 2387372 - RNA, 18 nt, Bordetella pertussis
ggccugcuuggcgcgcag

SEQ ID NO: 2387373 - RNA, 21 nt, Bordetella pertussis
ggcgaagccaucgacaagcgc

SEQ ID NO: 2387374 - RNA, 22 nt, Bordetella pertussis
ggcgaagccaucgacaagcgcu

SEQ ID NO: 2387375 - RNA, 15 nt, Bordetella pertussis
ggcgaagccgcagcg

SEQ ID NO: 2387376 - RNA, 13 nt, Bordetella pertussis
ggcgaagccggca

SEQ ID NO: 2387377 - RNA, 19 nt, Bordetella pertussis
ggcgaagccuugcgcggcc

SEQ ID NO: 2387378 - RNA, 13 nt, Bordetella pertussis
ggcgaagcgcgcc

SEQ ID NO: 2387379 - RNA, 23 nt, Bordetella pertussis
ggcgaagcgcgccucgugcgagg

SEQ ID NO: 2387380 - RNA, 20 nt, Bordetella pertussis
ggcgaagcgcgggaagcgcu

SEQ ID NO: 2387381 - RNA, 14 nt, Bordetella pertussis
ggcgaaggccgccg

SEQ ID NO: 2387382 - RNA, 15 nt, Bordetella pertussis
ggcgaaggccgccgc

SEQ ID NO: 2387383 - RNA, 14 nt, Bordetella pertussis
ggcgaaggcgcggc

SEQ ID NO: 2387384 - RNA, 11 nt, Bordetella pertussis
ggcgaaggcgu

SEQ ID NO: 2387385 - RNA, 16 nt, Bordetella pertussis
ggcgaaggcgucggcc

SEQ ID NO: 2387386 - RNA, 17 nt, Bordetella pertussis
ggcgaaggcgucggcca

SEQ ID NO: 2387387 - RNA, 21 nt, Bordetella pertussis
ggcgaagguggcacaucagcg

SEQ ID NO: 2387388 - RNA, 20 nt, Bordetella pertussis
ggcgaagucauguagcggcc

SEQ ID NO: 2387389 - RNA, 23 nt, Bordetella pertussis
ggcgaagucauguagcggccgcc

SEQ ID NO: 2387390 - RNA, 18 nt, Bordetella pertussis
ggcgaaguccugcaugcc

SEQ ID NO: 2387391 - RNA, 21 nt, Bordetella pertussis
ggcgaaguccugcaugccaug

SEQ ID NO: 2387392 - RNA, 13 nt, Bordetella pertussis
ggcgaagugcccg

SEQ ID NO: 2387393 - RNA, 19 nt, Bordetella pertussis
ggcgaagugcccgcuggcc

SEQ ID NO: 2387394 - RNA, 22 nt, Bordetella pertussis
ggcgaaucaguucgcgcaggcg

SEQ ID NO: 2387395 - RNA, 17 nt, Bordetella pertussis
ggcgaauccaccggcgc

SEQ ID NO: 2387396 - RNA, 19 nt, Bordetella pertussis
ggcgaauccaccggcgcgc

SEQ ID NO: 2387397 - RNA, 15 nt, Bordetella pertussis
ggcgaaugccggccg

SEQ ID NO: 2387398 - RNA, 14 nt, Bordetella pertussis
ggcgaauggccacg

SEQ ID NO: 2387399 - RNA, 21 nt, Bordetella pertussis
ggcgacacccccagggcgcgc

SEQ ID NO: 2387400 - RNA, 23 nt, Bordetella pertussis
ggcgacacccccagggcgcgccg

SEQ ID NO: 2387401 - RNA, 17 nt, Bordetella pertussis
ggcgacaccgcggccuu

SEQ ID NO: 2387402 - RNA, 17 nt, Bordetella pertussis
ggcgacagcaaugacga

SEQ ID NO: 2387403 - RNA, 19 nt, Bordetella pertussis
ggcgacagcaaugacgacg

SEQ ID NO: 2387404 - RNA, 13 nt, Bordetella pertussis
ggcgacagggcgu

SEQ ID NO: 2387405 - RNA, 16 nt, Bordetella pertussis
ggcgacagggcgucgu

SEQ ID NO: 2387406 - RNA, 18 nt, Bordetella pertussis
ggcgacagggcgucgucg

SEQ ID NO: 2387407 - RNA, 22 nt, Bordetella pertussis
ggcgacauagaucuccggcgcc

SEQ ID NO: 2387408 - RNA, 20 nt, Bordetella pertussis
ggcgaccacuaucagcgcgu

SEQ ID NO: 2387409 - RNA, 13 nt, Bordetella pertussis
ggcgaccaggccc

SEQ ID NO: 2387410 - RNA, 22 nt, Bordetella pertussis
ggcgaccaggcccacgacgaac

SEQ ID NO: 2387411 - RNA, 20 nt, Bordetella pertussis
ggcgaccaggcccauggcgu

SEQ ID NO: 2387412 - RNA, 19 nt, Bordetella pertussis
ggcgaccaggugcgggccg

SEQ ID NO: 2387413 - RNA, 21 nt, Bordetella pertussis
ggcgaccaggugcgggccgcu

SEQ ID NO: 2387414 - RNA, 14 nt, Bordetella pertussis
ggcgaccgacggca

SEQ ID NO: 2387415 - RNA, 14 nt, Bordetella pertussis
ggcgaccgccggcc

SEQ ID NO: 2387416 - RNA, 14 nt, Bordetella pertussis
ggcgaccgcgaacc

SEQ ID NO: 2387417 - RNA, 16 nt, Bordetella pertussis
ggcgaccgcgaaccgg

SEQ ID NO: 2387418 - RNA, 21 nt, Bordetella pertussis
ggcgaccgcgaaccggugcug

SEQ ID NO: 2387419 - RNA, 17 nt, Bordetella pertussis
ggcgaccggcgccggcu

SEQ ID NO: 2387420 - RNA, 16 nt, Bordetella pertussis
ggcgaccggcggcacc

SEQ ID NO: 2387421 - RNA, 17 nt, Bordetella pertussis
ggcgacgaacccgggcg

SEQ ID NO: 2387422 - RNA, 20 nt, Bordetella pertussis
ggcgacgaacccgggcguga

SEQ ID NO: 2387423 - RNA, 19 nt, Bordetella pertussis
ggcgacgacuacgcgcugg

SEQ ID NO: 2387424 - RNA, 23 nt, Bordetella pertussis
ggcgacgacuacgcgcuggcgca

SEQ ID NO: 2387425 - RNA, 20 nt, Bordetella pertussis
ggcgacgaucuccacccccg

SEQ ID NO: 2387426 - RNA, 16 nt, Bordetella pertussis
ggcgacgcgcugccgg

SEQ ID NO: 2387427 - RNA, 18 nt, Bordetella pertussis
ggcgacgcggcguacugg

SEQ ID NO: 2387428 - RNA, 13 nt, Bordetella pertussis
ggcgacggcgccu

SEQ ID NO: 2387429 - RNA, 16 nt, Bordetella pertussis
ggcgacggcgccuggc

SEQ ID NO: 2387430 - RNA, 19 nt, Bordetella pertussis
ggcgacggcgucggccugg

SEQ ID NO: 2387431 - RNA, 14 nt, Bordetella pertussis
ggcgacggcgugcu

SEQ ID NO: 2387432 - RNA, 20 nt, Bordetella pertussis
ggcgacggucaggggcaggc

SEQ ID NO: 2387433 - RNA, 21 nt, Bordetella pertussis
ggcgacgugaugcucgaucuu

SEQ ID NO: 2387434 - RNA, 12 nt, Bordetella pertussis
ggcgacguggcg

SEQ ID NO: 2387435 - RNA, 20 nt, Bordetella pertussis
ggcgacguggcgcuccaugc

SEQ ID NO: 2387436 - RNA, 16 nt, Bordetella pertussis
ggcgacugcagcaggc

SEQ ID NO: 2387437 - RNA, 20 nt, Bordetella pertussis
ggcgacugcagcaggcuggg

SEQ ID NO: 2387438 - RNA, 18 nt, Bordetella pertussis
ggcgacugccccagcggc

SEQ ID NO: 2387439 - RNA, 23 nt, Bordetella pertussis
ggcgacugccccagcggcuggcg

SEQ ID NO: 2387440 - RNA, 18 nt, Bordetella pertussis
ggcgacuuccagcagauu

SEQ ID NO: 2387441 - RNA, 21 nt, Bordetella pertussis
ggcgacuuccgcuuccggccg

SEQ ID NO: 2387442 - RNA, 16 nt, Bordetella pertussis
ggcgacuucggcggcc

SEQ ID NO: 2387443 - RNA, 17 nt, Bordetella pertussis
ggcgacuucggcggcca

SEQ ID NO: 2387444 - RNA, 20 nt, Bordetella pertussis
ggcgacuucggcggccaugc

SEQ ID NO: 2387445 - RNA, 21 nt, Bordetella pertussis
ggcgacuucggcggccugcuu

SEQ ID NO: 2387446 - RNA, 15 nt, Bordetella pertussis
ggcgagacgucggcg

SEQ ID NO: 2387447 - RNA, 14 nt, Bordetella pertussis
ggcgagaggggcuc

SEQ ID NO: 2387448 - RNA, 20 nt, Bordetella pertussis
ggcgagcacccgcaggcggc

SEQ ID NO: 2387449 - RNA, 24 nt, Bordetella pertussis
ggcgagcacccgcaggcggcuggu

SEQ ID NO: 2387450 - RNA, 15 nt, Bordetella pertussis
ggcgagcacggccug

SEQ ID NO: 2387451 - RNA, 12 nt, Bordetella pertussis
ggcgagcaguuc

SEQ ID NO: 2387452 - RNA, 19 nt, Bordetella pertussis
ggcgagcauggcgguggcc

SEQ ID NO: 2387453 - RNA, 21 nt, Bordetella pertussis
ggcgagcccagguugcucgcc

SEQ ID NO: 2387454 - RNA, 13 nt, Bordetella pertussis
ggcgagccgauga

SEQ ID NO: 2387455 - RNA, 13 nt, Bordetella pertussis
ggcgagccgcgcg

SEQ ID NO: 2387456 - RNA, 22 nt, Bordetella pertussis
ggcgagccgggcaccgagccgc

SEQ ID NO: 2387457 - RNA, 17 nt, Bordetella pertussis
ggcgagcgccgccaggc

SEQ ID NO: 2387458 - RNA, 23 nt, Bordetella pertussis
ggcgagcgccgccaggccgucga

SEQ ID NO: 2387459 - RNA, 13 nt, Bordetella pertussis
ggcgagcgcggcg

SEQ ID NO: 2387460 - RNA, 22 nt, Bordetella pertussis
ggcgagcgcggcgcgcgccagg

SEQ ID NO: 2387461 - RNA, 14 nt, Bordetella pertussis
ggcgagcggcgucg

SEQ ID NO: 2387462 - RNA, 20 nt, Bordetella pertussis
ggcgagcgggccggucgcga

SEQ ID NO: 2387463 - RNA, 17 nt, Bordetella pertussis
ggcgagcucggcauggc

SEQ ID NO: 2387464 - RNA, 16 nt, Bordetella pertussis
ggcgagcuggcccugg

SEQ ID NO: 2387465 - RNA, 23 nt, Bordetella pertussis
ggcgaggacaggccagugccugg

SEQ ID NO: 2387466 - RNA, 12 nt, Bordetella pertussis
ggcgaggccgcc

SEQ ID NO: 2387467 - RNA, 13 nt, Bordetella pertussis
ggcgaggccgccc

SEQ ID NO: 2387468 - RNA, 14 nt, Bordetella pertussis
ggcgaggccgcccg

SEQ ID NO: 2387469 - RNA, 15 nt, Bordetella pertussis
ggcgaggccgcccgc

SEQ ID NO: 2387470 - RNA, 13 nt, Bordetella pertussis
ggcgaggcgcugg

SEQ ID NO: 2387471 - RNA, 15 nt, Bordetella pertussis
ggcgaggcgcuggcc

SEQ ID NO: 2387472 - RNA, 17 nt, Bordetella pertussis
ggcgaggcgcuggccgg

SEQ ID NO: 2387473 - RNA, 15 nt, Bordetella pertussis
ggcgaggcggggcug

SEQ ID NO: 2387474 - RNA, 16 nt, Bordetella pertussis
ggcgaggcggggcugg

SEQ ID NO: 2387475 - RNA, 15 nt, Bordetella pertussis
ggcgaggcguccagc

SEQ ID NO: 2387476 - RNA, 15 nt, Bordetella pertussis
ggcgaggcuggcgcc

SEQ ID NO: 2387477 - RNA, 16 nt, Bordetella pertussis
ggcgaggcuggcgccc

SEQ ID NO: 2387478 - RNA, 21 nt, Bordetella pertussis
ggcgagggcugcccucgcccg

SEQ ID NO: 2387479 - RNA, 15 nt, Bordetella pertussis
ggcgaggggggcgug

SEQ ID NO: 2387480 - RNA, 15 nt, Bordetella pertussis
ggcgagguagggcgc

SEQ ID NO: 2387481 - RNA, 20 nt, Bordetella pertussis
ggcgagguagggcgcggcca

SEQ ID NO: 2387482 - RNA, 12 nt, Bordetella pertussis
ggcgaggucagc

SEQ ID NO: 2387483 - RNA, 17 nt, Bordetella pertussis
ggcgaggucagcccggc

SEQ ID NO: 2387484 - RNA, 15 nt, Bordetella pertussis
ggcgauacgcgccgc

SEQ ID NO: 2387485 - RNA, 19 nt, Bordetella pertussis
ggcgauacgcgccgccugg

SEQ ID NO: 2387486 - RNA, 15 nt, Bordetella pertussis
ggcgauagcgcucca

SEQ ID NO: 2387487 - RNA, 20 nt, Bordetella pertussis
ggcgauauccaucggcgcgc

SEQ ID NO: 2387488 - RNA, 15 nt, Bordetella pertussis
ggcgauauggccagg

SEQ ID NO: 2387489 - RNA, 20 nt, Bordetella pertussis
ggcgaucaacgugcgccagg

SEQ ID NO: 2387490 - RNA, 22 nt, Bordetella pertussis
ggcgaucaacgugcgccaggca

SEQ ID NO: 2387491 - RNA, 18 nt, Bordetella pertussis
ggcgaucaccgacagcgc

SEQ ID NO: 2387492 - RNA, 21 nt, Bordetella pertussis
ggcgaucaccgacagcgccag

SEQ ID NO: 2387493 - RNA, 23 nt, Bordetella pertussis
ggcgaucaccgacagcgccagcg

SEQ ID NO: 2387494 - RNA, 16 nt, Bordetella pertussis
ggcgaucagcaccgcg

SEQ ID NO: 2387495 - RNA, 19 nt, Bordetella pertussis
ggcgaucaugcaguacagg

SEQ ID NO: 2387496 - RNA, 17 nt, Bordetella pertussis
ggcgaucaugccgccga

SEQ ID NO: 2387497 - RNA, 13 nt, Bordetella pertussis
ggcgauccaggcc

SEQ ID NO: 2387498 - RNA, 15 nt, Bordetella pertussis
ggcgauccaggccac

SEQ ID NO: 2387499 - RNA, 19 nt, Bordetella pertussis
ggcgauccaggccaccgcg

SEQ ID NO: 2387500 - RNA, 21 nt, Bordetella pertussis
ggcgauccaggccaccgcggc

SEQ ID NO: 2387501 - RNA, 20 nt, Bordetella pertussis
ggcgauccauguggccagcu

SEQ ID NO: 2387502 - RNA, 13 nt, Bordetella pertussis
ggcgauccgccgc

SEQ ID NO: 2387503 - RNA, 19 nt, Bordetella pertussis
ggcgauccgccgcggccag

SEQ ID NO: 2387504 - RNA, 20 nt, Bordetella pertussis
ggcgauccgccgcggccagc

SEQ ID NO: 2387505 - RNA, 21 nt, Bordetella pertussis
ggcgauccgccgcggccagcg

SEQ ID NO: 2387506 - RNA, 14 nt, Bordetella pertussis
ggcgauccugccca

SEQ ID NO: 2387507 - RNA, 17 nt, Bordetella pertussis
ggcgauccugcccaccg

SEQ ID NO: 2387508 - RNA, 21 nt, Bordetella pertussis
ggcgauccugcccaccgccgc

SEQ ID NO: 2387509 - RNA, 14 nt, Bordetella pertussis
ggcgaucgaacgcg

SEQ ID NO: 2387510 - RNA, 16 nt, Bordetella pertussis
ggcgaucgaacgcggc

SEQ ID NO: 2387511 - RNA, 20 nt, Bordetella pertussis
ggcgaucgaacgcggccaga

SEQ ID NO: 2387512 - RNA, 22 nt, Bordetella pertussis
ggcgaucgaauggucggccucg

SEQ ID NO: 2387513 - RNA, 15 nt, Bordetella pertussis
ggcgaucgcgucggc

SEQ ID NO: 2387514 - RNA, 22 nt, Bordetella pertussis
ggcgaucucguccugcaggaag

SEQ ID NO: 2387515 - RNA, 23 nt, Bordetella pertussis
ggcgaucucguccugcaggaagg

SEQ ID NO: 2387516 - RNA, 21 nt, Bordetella pertussis
ggcgaucucgucgaccgccuc

SEQ ID NO: 2387517 - RNA, 14 nt, Bordetella pertussis
ggcgaucugcgcgg

SEQ ID NO: 2387518 - RNA, 16 nt, Bordetella pertussis
ggcgaucugcgcggcg

SEQ ID NO: 2387519 - RNA, 18 nt, Bordetella pertussis
ggcgaucugcgcggcggu

SEQ ID NO: 2387520 - RNA, 19 nt, Bordetella pertussis
ggcgaucugcggcguggcg

SEQ ID NO: 2387521 - RNA, 16 nt, Bordetella pertussis
ggcgaucugggccucg

SEQ ID NO: 2387522 - RNA, 18 nt, Bordetella pertussis
ggcgaucugggccucggc

SEQ ID NO: 2387523 - RNA, 17 nt, Bordetella pertussis
ggcgaucuucagcacca

SEQ ID NO: 2387524 - RNA, 15 nt, Bordetella pertussis
ggcgaucuucugggc

SEQ ID NO: 2387525 - RNA, 18 nt, Bordetella pertussis
ggcgaucuugccggccug

SEQ ID NO: 2387526 - RNA, 21 nt, Bordetella pertussis
ggcgaucuugccggccuggcg

SEQ ID NO: 2387527 - RNA, 18 nt, Bordetella pertussis
ggcgaugaagucgcggcc

SEQ ID NO: 2387528 - RNA, 14 nt, Bordetella pertussis
ggcgaugaccggca

SEQ ID NO: 2387529 - RNA, 17 nt, Bordetella pertussis
ggcgaugaccucggcga

SEQ ID NO: 2387530 - RNA, 20 nt, Bordetella pertussis
ggcgaugaccucggcgagcg

SEQ ID NO: 2387531 - RNA, 21 nt, Bordetella pertussis
ggcgaugaccucggcgagcgc

SEQ ID NO: 2387532 - RNA, 17 nt, Bordetella pertussis
ggcgaugauggggucgc

SEQ ID NO: 2387533 - RNA, 22 nt, Bordetella pertussis
ggcgaugauggggucgccgggc

SEQ ID NO: 2387534 - RNA, 23 nt, Bordetella pertussis
ggcgaugauggggucgccgggca

SEQ ID NO: 2387535 - RNA, 17 nt, Bordetella pertussis
ggcgaugcccaccagcc

SEQ ID NO: 2387536 - RNA, 14 nt, Bordetella pertussis
ggcgaugcccagcg

SEQ ID NO: 2387537 - RNA, 19 nt, Bordetella pertussis
ggcgaugccccaguccagg

SEQ ID NO: 2387538 - RNA, 14 nt, Bordetella pertussis
ggcgaugccccggu

SEQ ID NO: 2387539 - RNA, 18 nt, Bordetella pertussis
ggcgaugccggccagcag

SEQ ID NO: 2387540 - RNA, 13 nt, Bordetella pertussis
ggcgaugccggcg

SEQ ID NO: 2387541 - RNA, 13 nt, Bordetella pertussis
ggcgaugccgggc

SEQ ID NO: 2387542 - RNA, 14 nt, Bordetella pertussis
ggcgaugcgcgagc

SEQ ID NO: 2387543 - RNA, 15 nt, Bordetella pertussis
ggcgaugcggcggcc

SEQ ID NO: 2387544 - RNA, 16 nt, Bordetella pertussis
ggcgaugcggcggccg

SEQ ID NO: 2387545 - RNA, 20 nt, Bordetella pertussis
ggcgaugcgggccacgccgg

SEQ ID NO: 2387546 - RNA, 17 nt, Bordetella pertussis
ggcgaugcucacgccca

SEQ ID NO: 2387547 - RNA, 13 nt, Bordetella pertussis
ggcgaugcugccg

SEQ ID NO: 2387548 - RNA, 14 nt, Bordetella pertussis
ggcgauggcaucgg

SEQ ID NO: 2387549 - RNA, 21 nt, Bordetella pertussis
ggcgauggcaucgggcagggc

SEQ ID NO: 2387550 - RNA, 22 nt, Bordetella pertussis
ggcgauggcccgguaggccacg

SEQ ID NO: 2387551 - RNA, 14 nt, Bordetella pertussis
ggcgauggccgaca

SEQ ID NO: 2387552 - RNA, 18 nt, Bordetella pertussis
ggcgauggccgacauguc

SEQ ID NO: 2387553 - RNA, 12 nt, Bordetella pertussis
ggcgauggccgc

SEQ ID NO: 2387554 - RNA, 15 nt, Bordetella pertussis
ggcgauggccgccag

SEQ ID NO: 2387555 - RNA, 19 nt, Bordetella pertussis
ggcgauggccgggagcggc

SEQ ID NO: 2387556 - RNA, 20 nt, Bordetella pertussis
ggcgauggccgggagcggcc

SEQ ID NO: 2387557 - RNA, 24 nt, Bordetella pertussis
ggcgauggccgggagcggccagca

SEQ ID NO: 2387558 - RNA, 21 nt, Bordetella pertussis
ggcgauggccugauggguguc

SEQ ID NO: 2387559 - RNA, 16 nt, Bordetella pertussis
ggcgauggcgcgcgcc

SEQ ID NO: 2387560 - RNA, 18 nt, Bordetella pertussis
ggcgauggcgcgcgccac

SEQ ID NO: 2387561 - RNA, 14 nt, Bordetella pertussis
ggcgauggcgcggc

SEQ ID NO: 2387562 - RNA, 15 nt, Bordetella pertussis
ggcgauggcgcggcc

SEQ ID NO: 2387563 - RNA, 18 nt, Bordetella pertussis
ggcgauggcgcgucgccg

SEQ ID NO: 2387564 - RNA, 10 nt, Bordetella pertussis
ggcgauggcu

SEQ ID NO: 2387565 - RNA, 19 nt, Bordetella pertussis
ggcgauggcuuggcgcuua

SEQ ID NO: 2387566 - RNA, 17 nt, Bordetella pertussis
ggcgaugggcaccugcu

SEQ ID NO: 2387567 - RNA, 17 nt, Bordetella pertussis
ggcgauggucggccgga

SEQ ID NO: 2387568 - RNA, 15 nt, Bordetella pertussis
ggcgauggucugggu

SEQ ID NO: 2387569 - RNA, 17 nt, Bordetella pertussis
ggcgauguagggcagcu

SEQ ID NO: 2387570 - RNA, 20 nt, Bordetella pertussis
ggcgauguggcgcgccaugu

SEQ ID NO: 2387571 - RNA, 15 nt, Bordetella pertussis
ggcgauguucacgcg

SEQ ID NO: 2387572 - RNA, 12 nt, Bordetella pertussis
ggcgauugcgcc

SEQ ID NO: 2387573 - RNA, 15 nt, Bordetella pertussis
ggcgauugcgccagc

SEQ ID NO: 2387574 - RNA, 13 nt, Bordetella pertussis
ggcgauugcggcc

SEQ ID NO: 2387575 - RNA, 21 nt, Bordetella pertussis
ggcgauugcggcccgcggccu

SEQ ID NO: 2387576 - RNA, 22 nt, Bordetella pertussis
ggcgauugcggcccgcggccuu

SEQ ID NO: 2387577 - RNA, 21 nt, Bordetella pertussis
ggcgauugcucgacauagaga

SEQ ID NO: 2387578 - RNA, 17 nt, Bordetella pertussis
ggcgauuucgucaucgg

SEQ ID NO: 2387579 - RNA, 18 nt, Bordetella pertussis
ggcgauuucuacgccgaa

SEQ ID NO: 2387580 - RNA, 19 nt, Bordetella pertussis
ggcgauuugccgcagcccg

SEQ ID NO: 2387581 - RNA, 18 nt, Bordetella pertussis
ggcgcaaaccacgucggu

SEQ ID NO: 2387582 - RNA, 15 nt, Bordetella pertussis
ggcgcaacccggccu

SEQ ID NO: 2387583 - RNA, 15 nt, Bordetella pertussis
ggcgcaaccggcccg

SEQ ID NO: 2387584 - RNA, 16 nt, Bordetella pertussis
ggcgcaaccggcccga

SEQ ID NO: 2387585 - RNA, 13 nt, Bordetella pertussis
ggcgcaacgccgg

SEQ ID NO: 2387586 - RNA, 14 nt, Bordetella pertussis
ggcgcaacgccggc

SEQ ID NO: 2387587 - RNA, 15 nt, Bordetella pertussis
ggcgcaacgccggcc

SEQ ID NO: 2387588 - RNA, 22 nt, Bordetella pertussis
ggcgcaacgccggccgccaugg

SEQ ID NO: 2387589 - RNA, 23 nt, Bordetella pertussis
ggcgcaacgccggccgccauggc

SEQ ID NO: 2387590 - RNA, 16 nt, Bordetella pertussis
ggcgcaagacgcggca

SEQ ID NO: 2387591 - RNA, 15 nt, Bordetella pertussis
ggcgcaagaucugga

SEQ ID NO: 2387592 - RNA, 14 nt, Bordetella pertussis
ggcgcaagcgcgcc

SEQ ID NO: 2387593 - RNA, 15 nt, Bordetella pertussis
ggcgcaagcgcgccg

SEQ ID NO: 2387594 - RNA, 21 nt, Bordetella pertussis
ggcgcaaggcaugcgccagcg

SEQ ID NO: 2387595 - RNA, 17 nt, Bordetella pertussis
ggcgcaaggcgucgggc

SEQ ID NO: 2387596 - RNA, 22 nt, Bordetella pertussis
ggcgcaaguguggcgcaccgcg

SEQ ID NO: 2387597 - RNA, 16 nt, Bordetella pertussis
ggcgcaauaggccgcg

SEQ ID NO: 2387598 - RNA, 17 nt, Bordetella pertussis
ggcgcaauaggccgcga

SEQ ID NO: 2387599 - RNA, 19 nt, Bordetella pertussis
ggcgcaauaggccgcgaug

SEQ ID NO: 2387600 - RNA, 21 nt, Bordetella pertussis
ggcgcacaaucugcgucgccu

SEQ ID NO: 2387601 - RNA, 23 nt, Bordetella pertussis
ggcgcacaaucugcgucgccugg

SEQ ID NO: 2387602 - RNA, 18 nt, Bordetella pertussis
ggcgcacaccaucagcug

SEQ ID NO: 2387603 - RNA, 19 nt, Bordetella pertussis
ggcgcacaccaucagcugg

SEQ ID NO: 2387604 - RNA, 15 nt, Bordetella pertussis
ggcgcacagggcguc

SEQ ID NO: 2387605 - RNA, 22 nt, Bordetella pertussis
ggcgcacaguugcaggccaugc

SEQ ID NO: 2387606 - RNA, 23 nt, Bordetella pertussis
ggcgcacaguugcaggccaugcu

SEQ ID NO: 2387607 - RNA, 12 nt, Bordetella pertussis
ggcgcaccagcg

SEQ ID NO: 2387608 - RNA, 20 nt, Bordetella pertussis
ggcgcaccagcgaggcggca

SEQ ID NO: 2387609 - RNA, 19 nt, Bordetella pertussis
ggcgcaccagcgcgccgau

SEQ ID NO: 2387610 - RNA, 18 nt, Bordetella pertussis
ggcgcaccaggcuggggc

SEQ ID NO: 2387611 - RNA, 21 nt, Bordetella pertussis
ggcgcaccaggcuggggccga

SEQ ID NO: 2387612 - RNA, 16 nt, Bordetella pertussis
ggcgcacccgcggcgc

SEQ ID NO: 2387613 - RNA, 21 nt, Bordetella pertussis
ggcgcacccggugaucaugcc

SEQ ID NO: 2387614 - RNA, 21 nt, Bordetella pertussis
ggcgcacccugcaggccgggc

SEQ ID NO: 2387615 - RNA, 15 nt, Bordetella pertussis
ggcgcaccgacagca

SEQ ID NO: 2387616 - RNA, 14 nt, Bordetella pertussis
ggcgcaccgcgcug

SEQ ID NO: 2387617 - RNA, 18 nt, Bordetella pertussis
ggcgcaccggcacgcgcc

SEQ ID NO: 2387618 - RNA, 22 nt, Bordetella pertussis
ggcgcaccggcacgcgccagcu

SEQ ID NO: 2387619 - RNA, 23 nt, Bordetella pertussis
ggcgcaccgucacgcgcuccagc

SEQ ID NO: 2387620 - RNA, 20 nt, Bordetella pertussis
ggcgcaccugguccauggcg

SEQ ID NO: 2387621 - RNA, 12 nt, Bordetella pertussis
ggcgcacgcccc

SEQ ID NO: 2387622 - RNA, 16 nt, Bordetella pertussis
ggcgcacgccccgacg

SEQ ID NO: 2387623 - RNA, 13 nt, Bordetella pertussis
ggcgcacgccgcg

SEQ ID NO: 2387624 - RNA, 14 nt, Bordetella pertussis
ggcgcacgccgcgc

SEQ ID NO: 2387625 - RNA, 16 nt, Bordetella pertussis
ggcgcacgccgcgccg

SEQ ID NO: 2387626 - RNA, 12 nt, Bordetella pertussis
ggcgcacgccgg

SEQ ID NO: 2387627 - RNA, 13 nt, Bordetella pertussis
ggcgcacgccgga

SEQ ID NO: 2387628 - RNA, 15 nt, Bordetella pertussis
ggcgcacgccgggcg

SEQ ID NO: 2387629 - RNA, 20 nt, Bordetella pertussis
ggcgcacgccgggcgcggcc

SEQ ID NO: 2387630 - RNA, 21 nt, Bordetella pertussis
ggcgcacgccgggcgcggccg

SEQ ID NO: 2387631 - RNA, 14 nt, Bordetella pertussis
ggcgcacggcggca

SEQ ID NO: 2387632 - RNA, 16 nt, Bordetella pertussis
ggcgcagauggcggcg

SEQ ID NO: 2387633 - RNA, 17 nt, Bordetella pertussis
ggcgcagauggcggcga

SEQ ID NO: 2387634 - RNA, 20 nt, Bordetella pertussis
ggcgcagcaaggcgcgccac

SEQ ID NO: 2387635 - RNA, 14 nt, Bordetella pertussis
ggcgcagcaccagg

SEQ ID NO: 2387636 - RNA, 15 nt, Bordetella pertussis
ggcgcagcaccaggc

SEQ ID NO: 2387637 - RNA, 14 nt, Bordetella pertussis
ggcgcagcacgccg

SEQ ID NO: 2387638 - RNA, 20 nt, Bordetella pertussis
ggcgcagcacgccgcgccag

SEQ ID NO: 2387639 - RNA, 23 nt, Bordetella pertussis
ggcgcagcacgccgcgccaggca

SEQ ID NO: 2387640 - RNA, 22 nt, Bordetella pertussis
ggcgcagcagcgccggcaggcg

SEQ ID NO: 2387641 - RNA, 14 nt, Bordetella pertussis
ggcgcagcaggcgc

SEQ ID NO: 2387642 - RNA, 20 nt, Bordetella pertussis
ggcgcagcaggcgcgcggcc

SEQ ID NO: 2387643 - RNA, 21 nt, Bordetella pertussis
ggcgcagcaggcgcgcggccu

SEQ ID NO: 2387644 - RNA, 18 nt, Bordetella pertussis
ggcgcagcaucuugcgcc

SEQ ID NO: 2387645 - RNA, 22 nt, Bordetella pertussis
ggcgcagcaucuugcgccgcug

SEQ ID NO: 2387646 - RNA, 12 nt, Bordetella pertussis
ggcgcagcauga

SEQ ID NO: 2387647 - RNA, 21 nt, Bordetella pertussis
ggcgcagcauuucggcgccgc

SEQ ID NO: 2387648 - RNA, 22 nt, Bordetella pertussis
ggcgcagcauuucggcgccgcc

SEQ ID NO: 2387649 - RNA, 14 nt, Bordetella pertussis
ggcgcagcccagcg

SEQ ID NO: 2387650 - RNA, 23 nt, Bordetella pertussis
ggcgcagcccagcgcgaugucgc

SEQ ID NO: 2387651 - RNA, 16 nt, Bordetella pertussis
ggcgcagccgccauag

SEQ ID NO: 2387652 - RNA, 14 nt, Bordetella pertussis
ggcgcagccgcgcg

SEQ ID NO: 2387653 - RNA, 16 nt, Bordetella pertussis
ggcgcagccgcgcgcc

SEQ ID NO: 2387654 - RNA, 15 nt, Bordetella pertussis
ggcgcagcgcagcuu

SEQ ID NO: 2387655 - RNA, 15 nt, Bordetella pertussis
ggcgcagcgcccagg

SEQ ID NO: 2387656 - RNA, 13 nt, Bordetella pertussis
ggcgcagcgccgc

SEQ ID NO: 2387657 - RNA, 14 nt, Bordetella pertussis
ggcgcagcgcggca

SEQ ID NO: 2387658 - RNA, 20 nt, Bordetella pertussis
ggcgcagcgcggcacgcugc

SEQ ID NO: 2387659 - RNA, 14 nt, Bordetella pertussis
ggcgcagcggcggc

SEQ ID NO: 2387660 - RNA, 15 nt, Bordetella pertussis
ggcgcagcggcggcg

SEQ ID NO: 2387661 - RNA, 22 nt, Bordetella pertussis
ggcgcagcuccgggucgagcgc

SEQ ID NO: 2387662 - RNA, 15 nt, Bordetella pertussis
ggcgcagcucgaccg

SEQ ID NO: 2387663 - RNA, 20 nt, Bordetella pertussis
ggcgcaggaacucagcgcac

SEQ ID NO: 2387664 - RNA, 13 nt, Bordetella pertussis
ggcgcaggaugcg

SEQ ID NO: 2387665 - RNA, 17 nt, Bordetella pertussis
ggcgcaggaugcgcugg

SEQ ID NO: 2387666 - RNA, 12 nt, Bordetella pertussis
ggcgcaggcauu

SEQ ID NO: 2387667 - RNA, 13 nt, Bordetella pertussis
ggcgcaggccagc

SEQ ID NO: 2387668 - RNA, 17 nt, Bordetella pertussis
ggcgcaggccagcgccg

SEQ ID NO: 2387669 - RNA, 19 nt, Bordetella pertussis
ggcgcaggccagcgccgcg

SEQ ID NO: 2387670 - RNA, 14 nt, Bordetella pertussis
ggcgcaggccgacg

SEQ ID NO: 2387671 - RNA, 14 nt, Bordetella pertussis
ggcgcaggccgcca

SEQ ID NO: 2387672 - RNA, 15 nt, Bordetella pertussis
ggcgcaggccgccac

SEQ ID NO: 2387673 - RNA, 17 nt, Bordetella pertussis
ggcgcaggccgccacuu

SEQ ID NO: 2387674 - RNA, 13 nt, Bordetella pertussis
ggcgcaggccgcg

SEQ ID NO: 2387675 - RNA, 17 nt, Bordetella pertussis
ggcgcaggccgcgccgg

SEQ ID NO: 2387676 - RNA, 18 nt, Bordetella pertussis
ggcgcaggccgcgccggc

SEQ ID NO: 2387677 - RNA, 19 nt, Bordetella pertussis
ggcgcaggccgcgccggcu

SEQ ID NO: 2387678 - RNA, 14 nt, Bordetella pertussis
ggcgcaggccggcg

SEQ ID NO: 2387679 - RNA, 17 nt, Bordetella pertussis
ggcgcaggccggcggcc

SEQ ID NO: 2387680 - RNA, 12 nt, Bordetella pertussis
ggcgcaggcgcg

SEQ ID NO: 2387681 - RNA, 13 nt, Bordetella pertussis
ggcgcaggcgcgc

SEQ ID NO: 2387682 - RNA, 16 nt, Bordetella pertussis
ggcgcaggcgcgccag

SEQ ID NO: 2387683 - RNA, 19 nt, Bordetella pertussis
ggcgcaggcgcgccagggg

SEQ ID NO: 2387684 - RNA, 17 nt, Bordetella pertussis
ggcgcaggcgcgcgccu

SEQ ID NO: 2387685 - RNA, 13 nt, Bordetella pertussis
ggcgcagggugcg

SEQ ID NO: 2387686 - RNA, 12 nt, Bordetella pertussis
ggcgcaggucca

SEQ ID NO: 2387687 - RNA, 17 nt, Bordetella pertussis
ggcgcagguccaccgcc

SEQ ID NO: 2387688 - RNA, 22 nt, Bordetella pertussis
ggcgcaguaucccggccaggcg

SEQ ID NO: 2387689 - RNA, 17 nt, Bordetella pertussis
ggcgcaguaucuggugc

SEQ ID NO: 2387690 - RNA, 18 nt, Bordetella pertussis
ggcgcagucgagcaccgc

SEQ ID NO: 2387691 - RNA, 19 nt, Bordetella pertussis
ggcgcagucgagcaccgcg

SEQ ID NO: 2387692 - RNA, 22 nt, Bordetella pertussis
ggcgcagucgagcaccgcgcgg

SEQ ID NO: 2387693 - RNA, 21 nt, Bordetella pertussis
ggcgcauauggagccaggcgg

SEQ ID NO: 2387694 - RNA, 16 nt, Bordetella pertussis
ggcgcaucagcgcgcc

SEQ ID NO: 2387695 - RNA, 17 nt, Bordetella pertussis
ggcgcaucagcgcgccc

SEQ ID NO: 2387696 - RNA, 19 nt, Bordetella pertussis
ggcgcaucagcgcgcccgc

SEQ ID NO: 2387697 - RNA, 16 nt, Bordetella pertussis
ggcgcauccagcucgg

SEQ ID NO: 2387698 - RNA, 14 nt, Bordetella pertussis
ggcgcaucggcgcc

SEQ ID NO: 2387699 - RNA, 15 nt, Bordetella pertussis
ggcgcaucggcgcca

SEQ ID NO: 2387700 - RNA, 17 nt, Bordetella pertussis
ggcgcaucucgucgagg

SEQ ID NO: 2387701 - RNA, 17 nt, Bordetella pertussis
ggcgcaugacggcgucg

SEQ ID NO: 2387702 - RNA, 17 nt, Bordetella pertussis
ggcgcaugacggggugc

SEQ ID NO: 2387703 - RNA, 15 nt, Bordetella pertussis
ggcgcaugagccggc

SEQ ID NO: 2387704 - RNA, 17 nt, Bordetella pertussis
ggcgcaugagccggcag

SEQ ID NO: 2387705 - RNA, 20 nt, Bordetella pertussis
ggcgcaugauggccggccug

SEQ ID NO: 2387706 - RNA, 16 nt, Bordetella pertussis
ggcgcaugcagccgca

SEQ ID NO: 2387707 - RNA, 14 nt, Bordetella pertussis
ggcgcaugccacca

SEQ ID NO: 2387708 - RNA, 13 nt, Bordetella pertussis
ggcgcaugcugcg

SEQ ID NO: 2387709 - RNA, 15 nt, Bordetella pertussis
ggcgcaugcugcgcg

SEQ ID NO: 2387710 - RNA, 15 nt, Bordetella pertussis
ggcgcauggccggcg

SEQ ID NO: 2387711 - RNA, 17 nt, Bordetella pertussis
ggcgcauggccggcgug

SEQ ID NO: 2387712 - RNA, 14 nt, Bordetella pertussis
ggcgcauggcuggu

SEQ ID NO: 2387713 - RNA, 16 nt, Bordetella pertussis
ggcgcauggcuggucc

SEQ ID NO: 2387714 - RNA, 20 nt, Bordetella pertussis
ggcgcauguccgccacgccg

SEQ ID NO: 2387715 - RNA, 15 nt, Bordetella pertussis
ggcgcauucgccgga

SEQ ID NO: 2387716 - RNA, 16 nt, Bordetella pertussis
ggcgcauucgcgccug

SEQ ID NO: 2387717 - RNA, 17 nt, Bordetella pertussis
ggcgcauucgcgccuga

SEQ ID NO: 2387718 - RNA, 19 nt, Bordetella pertussis
ggcgcauucgcgccugagc

SEQ ID NO: 2387719 - RNA, 22 nt, Bordetella pertussis
ggcgcauucgcgccugagcugc

SEQ ID NO: 2387720 - RNA, 14 nt, Bordetella pertussis
ggcgcauugccgcc

SEQ ID NO: 2387721 - RNA, 20 nt, Bordetella pertussis
ggcgcauugccgucggccgc

SEQ ID NO: 2387722 - RNA, 22 nt, Bordetella pertussis
ggcgcauugccgucggccgcgc

SEQ ID NO: 2387723 - RNA, 17 nt, Bordetella pertussis
ggcgccaacccgccauc

SEQ ID NO: 2387724 - RNA, 17 nt, Bordetella pertussis
ggcgccaagcggcaggc

SEQ ID NO: 2387725 - RNA, 18 nt, Bordetella pertussis
ggcgccaagcggcaggcg

SEQ ID NO: 2387726 - RNA, 17 nt, Bordetella pertussis
ggcgccacagggccuga

SEQ ID NO: 2387727 - RNA, 18 nt, Bordetella pertussis
ggcgccacagggccugac

SEQ ID NO: 2387728 - RNA, 14 nt, Bordetella pertussis
ggcgccacaggugc

SEQ ID NO: 2387729 - RNA, 18 nt, Bordetella pertussis
ggcgccacaggugcgcgg

SEQ ID NO: 2387730 - RNA, 22 nt, Bordetella pertussis
ggcgccaccccguagcgcaucg

SEQ ID NO: 2387731 - RNA, 23 nt, Bordetella pertussis
ggcgccaccccguagcgcaucgc

SEQ ID NO: 2387732 - RNA, 19 nt, Bordetella pertussis
ggcgccaccuucgccgcgc

SEQ ID NO: 2387733 - RNA, 21 nt, Bordetella pertussis
ggcgccaccuucgccgcgcac

SEQ ID NO: 2387734 - RNA, 24 nt, Bordetella pertussis
ggcgccaccuucgccgcgcacagc

SEQ ID NO: 2387735 - RNA, 17 nt, Bordetella pertussis
ggcgccacgcagaaggc

SEQ ID NO: 2387736 - RNA, 12 nt, Bordetella pertussis
ggcgccacggcu

SEQ ID NO: 2387737 - RNA, 15 nt, Bordetella pertussis
ggcgccacggcuugc

SEQ ID NO: 2387738 - RNA, 12 nt, Bordetella pertussis
ggcgccacugcc

SEQ ID NO: 2387739 - RNA, 15 nt, Bordetella pertussis
ggcgccacugccagg

SEQ ID NO: 2387740 - RNA, 23 nt, Bordetella pertussis
ggcgccacugccaggcgccccac

SEQ ID NO: 2387741 - RNA, 13 nt, Bordetella pertussis
ggcgccagcagca

SEQ ID NO: 2387742 - RNA, 16 nt, Bordetella pertussis
ggcgccagcagcacgu

SEQ ID NO: 2387743 - RNA, 14 nt, Bordetella pertussis
ggcgccagcagcgg

SEQ ID NO: 2387744 - RNA, 15 nt, Bordetella pertussis
ggcgccagcagcggg

SEQ ID NO: 2387745 - RNA, 15 nt, Bordetella pertussis
ggcgccagcaugcgc

SEQ ID NO: 2387746 - RNA, 12 nt, Bordetella pertussis
ggcgccagcccg

SEQ ID NO: 2387747 - RNA, 17 nt, Bordetella pertussis
ggcgccagcccgcccgc

SEQ ID NO: 2387748 - RNA, 22 nt, Bordetella pertussis
ggcgccagcccgcccgcgagcg

SEQ ID NO: 2387749 - RNA, 19 nt, Bordetella pertussis
ggcgccagccgcuccagga

SEQ ID NO: 2387750 - RNA, 23 nt, Bordetella pertussis
ggcgccagcgccgcgucgagcgc

SEQ ID NO: 2387751 - RNA, 21 nt, Bordetella pertussis
ggcgccagcgcuucgggcagc

SEQ ID NO: 2387752 - RNA, 13 nt, Bordetella pertussis
ggcgccagcggca

SEQ ID NO: 2387753 - RNA, 14 nt, Bordetella pertussis
ggcgccagcggcau

SEQ ID NO: 2387754 - RNA, 23 nt, Bordetella pertussis
ggcgccagcggcauugcccaggu

SEQ ID NO: 2387755 - RNA, 13 nt, Bordetella pertussis
ggcgccagcugga

SEQ ID NO: 2387756 - RNA, 22 nt, Bordetella pertussis
ggcgccagcuggaccgccuggc

SEQ ID NO: 2387757 - RNA, 15 nt, Bordetella pertussis
ggcgccagcugggcg

SEQ ID NO: 2387758 - RNA, 11 nt, Bordetella pertussis
ggcgccaggcu

SEQ ID NO: 2387759 - RNA, 13 nt, Bordetella pertussis
ggcgccaggcuga

SEQ ID NO: 2387760 - RNA, 22 nt, Bordetella pertussis
ggcgccaggcugaaugccgccg

SEQ ID NO: 2387761 - RNA, 18 nt, Bordetella pertussis
ggcgccaguagcgccggc

SEQ ID NO: 2387762 - RNA, 19 nt, Bordetella pertussis
ggcgccaguagcgccggcu

SEQ ID NO: 2387763 - RNA, 12 nt, Bordetella pertussis
ggcgccaguccc

SEQ ID NO: 2387764 - RNA, 22 nt, Bordetella pertussis
ggcgccagucgcgcagcaccuc

SEQ ID NO: 2387765 - RNA, 14 nt, Bordetella pertussis
ggcgccaucaaugc

SEQ ID NO: 2387766 - RNA, 18 nt, Bordetella pertussis
ggcgccaucaaugccaau

SEQ ID NO: 2387767 - RNA, 16 nt, Bordetella pertussis
ggcgccaucgcgguau

SEQ ID NO: 2387768 - RNA, 16 nt, Bordetella pertussis
ggcgccaugaccacgu

SEQ ID NO: 2387769 - RNA, 16 nt, Bordetella pertussis
ggcgccaugaucgccg

SEQ ID NO: 2387770 - RNA, 17 nt, Bordetella pertussis
ggcgccaugaucgccgg

SEQ ID NO: 2387771 - RNA, 18 nt, Bordetella pertussis
ggcgccaugaucgccggc

SEQ ID NO: 2387772 - RNA, 14 nt, Bordetella pertussis
ggcgccaugccgcg

SEQ ID NO: 2387773 - RNA, 20 nt, Bordetella pertussis
ggcgccaugccgcgcccgcc

SEQ ID NO: 2387774 - RNA, 14 nt, Bordetella pertussis
ggcgccaugccggg

SEQ ID NO: 2387775 - RNA, 20 nt, Bordetella pertussis
ggcgccaugcgacagcccgg

SEQ ID NO: 2387776 - RNA, 17 nt, Bordetella pertussis
ggcgccaugcgcaccac

SEQ ID NO: 2387777 - RNA, 15 nt, Bordetella pertussis
ggcgccaugcgcccg

SEQ ID NO: 2387778 - RNA, 19 nt, Bordetella pertussis
ggcgccaugcgcccggcca

SEQ ID NO: 2387779 - RNA, 20 nt, Bordetella pertussis
ggcgccaugcgcccggccac

SEQ ID NO: 2387780 - RNA, 13 nt, Bordetella pertussis
ggcgccaugcugg

SEQ ID NO: 2387781 - RNA, 16 nt, Bordetella pertussis
ggcgccaugcuggccg

SEQ ID NO: 2387782 - RNA, 21 nt, Bordetella pertussis
ggcgccaugcuggccgccgcg

SEQ ID NO: 2387783 - RNA, 22 nt, Bordetella pertussis
ggcgccaugugcguugccagcc

SEQ ID NO: 2387784 - RNA, 14 nt, Bordetella pertussis
ggcgccauucuucg

SEQ ID NO: 2387785 - RNA, 19 nt, Bordetella pertussis
ggcgccauucuucgccgau

SEQ ID NO: 2387786 - RNA, 14 nt, Bordetella pertussis
ggcgcccacgccga

SEQ ID NO: 2387787 - RNA, 16 nt, Bordetella pertussis
ggcgcccacggccgca

SEQ ID NO: 2387788 - RNA, 11 nt, Bordetella pertussis
ggcgcccagcg

SEQ ID NO: 2387789 - RNA, 13 nt, Bordetella pertussis
ggcgcccagcgcc

SEQ ID NO: 2387790 - RNA, 15 nt, Bordetella pertussis
ggcgcccagcgccau

SEQ ID NO: 2387791 - RNA, 22 nt, Bordetella pertussis
ggcgcccagcgcgucggccagc

SEQ ID NO: 2387792 - RNA, 11 nt, Bordetella pertussis
ggcgcccagcu

SEQ ID NO: 2387793 - RNA, 13 nt, Bordetella pertussis
ggcgcccagcugg

SEQ ID NO: 2387794 - RNA, 16 nt, Bordetella pertussis
ggcgcccagcuggcgc

SEQ ID NO: 2387795 - RNA, 17 nt, Bordetella pertussis
ggcgcccagcuggcgcc

SEQ ID NO: 2387796 - RNA, 21 nt, Bordetella pertussis
ggcgcccagcuggcgccccuu

SEQ ID NO: 2387797 - RNA, 16 nt, Bordetella pertussis
ggcgcccaggcccagc

SEQ ID NO: 2387798 - RNA, 18 nt, Bordetella pertussis
ggcgcccaggcccagcgc

SEQ ID NO: 2387799 - RNA, 20 nt, Bordetella pertussis
ggcgcccaggcccagcgcgc

SEQ ID NO: 2387800 - RNA, 12 nt, Bordetella pertussis
ggcgcccaggua

SEQ ID NO: 2387801 - RNA, 18 nt, Bordetella pertussis
ggcgcccaucgcggucau

SEQ ID NO: 2387802 - RNA, 20 nt, Bordetella pertussis
ggcgccccaacgcggccagc

SEQ ID NO: 2387803 - RNA, 14 nt, Bordetella pertussis
ggcgccccacccgg

SEQ ID NO: 2387804 - RNA, 14 nt, Bordetella pertussis
ggcgccccaggcgu

SEQ ID NO: 2387805 - RNA, 17 nt, Bordetella pertussis
ggcgcccccagcagcga

SEQ ID NO: 2387806 - RNA, 18 nt, Bordetella pertussis
ggcgcccccgcggcgccc

SEQ ID NO: 2387807 - RNA, 17 nt, Bordetella pertussis
ggcgcccgacggcgccg

SEQ ID NO: 2387808 - RNA, 12 nt, Bordetella pertussis
ggcgcccgccga

SEQ ID NO: 2387809 - RNA, 18 nt, Bordetella pertussis
ggcgcccgccgccgggcg

SEQ ID NO: 2387810 - RNA, 19 nt, Bordetella pertussis
ggcgcccgccgccgggcgc

SEQ ID NO: 2387811 - RNA, 20 nt, Bordetella pertussis
ggcgcccgccgccgggcgcg

SEQ ID NO: 2387812 - RNA, 12 nt, Bordetella pertussis
ggcgcccgccug

SEQ ID NO: 2387813 - RNA, 13 nt, Bordetella pertussis
ggcgcccgccugc

SEQ ID NO: 2387814 - RNA, 23 nt, Bordetella pertussis
ggcgcccgccugcgccagccgcg

SEQ ID NO: 2387815 - RNA, 12 nt, Bordetella pertussis
ggcgcccgcgca

SEQ ID NO: 2387816 - RNA, 13 nt, Bordetella pertussis
ggcgcccgcggcc

SEQ ID NO: 2387817 - RNA, 12 nt, Bordetella pertussis
ggcgcccgcugc

SEQ ID NO: 2387818 - RNA, 22 nt, Bordetella pertussis
ggcgcccgcuucucacugcccg

SEQ ID NO: 2387819 - RNA, 16 nt, Bordetella pertussis
ggcgcccggcagccga

SEQ ID NO: 2387820 - RNA, 12 nt, Bordetella pertussis
ggcgcccggccg

SEQ ID NO: 2387821 - RNA, 15 nt, Bordetella pertussis
ggcgcccggccggcc

SEQ ID NO: 2387822 - RNA, 14 nt, Bordetella pertussis
ggcgcccggccugc

SEQ ID NO: 2387823 - RNA, 22 nt, Bordetella pertussis
ggcgcccggccugcgggcgccg

SEQ ID NO: 2387824 - RNA, 15 nt, Bordetella pertussis
ggcgcccggcggcgc

SEQ ID NO: 2387825 - RNA, 16 nt, Bordetella pertussis
ggcgcccggcggcgcg

SEQ ID NO: 2387826 - RNA, 18 nt, Bordetella pertussis
ggcgcccggcggcgcgcu

SEQ ID NO: 2387827 - RNA, 14 nt, Bordetella pertussis
ggcgcccggcguga

SEQ ID NO: 2387828 - RNA, 16 nt, Bordetella pertussis
ggcgcccggcgugacg

SEQ ID NO: 2387829 - RNA, 16 nt, Bordetella pertussis
ggcgcccgggcugccg

SEQ ID NO: 2387830 - RNA, 21 nt, Bordetella pertussis
ggcgcccggugcgcgcagggc

SEQ ID NO: 2387831 - RNA, 17 nt, Bordetella pertussis
ggcgcccgugcgcggcg

SEQ ID NO: 2387832 - RNA, 22 nt, Bordetella pertussis
ggcgcccucuuucgccgcgcgc

SEQ ID NO: 2387833 - RNA, 15 nt, Bordetella pertussis
ggcgcccugcagggc

SEQ ID NO: 2387834 - RNA, 17 nt, Bordetella pertussis
ggcgcccugcagggcau

SEQ ID NO: 2387835 - RNA, 13 nt, Bordetella pertussis
ggcgcccugcgcg

SEQ ID NO: 2387836 - RNA, 23 nt, Bordetella pertussis
ggcgcccuugaugccgucggcga

SEQ ID NO: 2387837 - RNA, 20 nt, Bordetella pertussis
ggcgccgaaauuggcgacgu

SEQ ID NO: 2387838 - RNA, 20 nt, Bordetella pertussis
ggcgccgaaggcggcgccgg

SEQ ID NO: 2387839 - RNA, 18 nt, Bordetella pertussis
ggcgccgacccugcccgg

SEQ ID NO: 2387840 - RNA, 22 nt, Bordetella pertussis
ggcgccgacccugcccggcagg

SEQ ID NO: 2387841 - RNA, 21 nt, Bordetella pertussis
ggcgccgaccgggccgaccag

SEQ ID NO: 2387842 - RNA, 23 nt, Bordetella pertussis
ggcgccgaccgggccgaccaggc

SEQ ID NO: 2387843 - RNA, 24 nt, Bordetella pertussis
ggcgccgacgaugccgcccacgcc

SEQ ID NO: 2387844 - RNA, 15 nt, Bordetella pertussis
ggcgccgacggcgcc

SEQ ID NO: 2387845 - RNA, 19 nt, Bordetella pertussis
ggcgccgacggcgcccugc

SEQ ID NO: 2387846 - RNA, 12 nt, Bordetella pertussis
ggcgccgagggc

SEQ ID NO: 2387847 - RNA, 17 nt, Bordetella pertussis
ggcgccgagggccgcgc

SEQ ID NO: 2387848 - RNA, 17 nt, Bordetella pertussis
ggcgccgaucagcaggu

SEQ ID NO: 2387849 - RNA, 22 nt, Bordetella pertussis
ggcgccgaucagcaggucggcg

SEQ ID NO: 2387850 - RNA, 16 nt, Bordetella pertussis
ggcgccgauccggcgc

SEQ ID NO: 2387851 - RNA, 17 nt, Bordetella pertussis
ggcgccgauccggcgca

SEQ ID NO: 2387852 - RNA, 18 nt, Bordetella pertussis
ggcgccgauccggcgcag

SEQ ID NO: 2387853 - RNA, 13 nt, Bordetella pertussis
ggcgccgauggcg

SEQ ID NO: 2387854 - RNA, 16 nt, Bordetella pertussis
ggcgccgauggcgccg

SEQ ID NO: 2387855 - RNA, 20 nt, Bordetella pertussis
ggcgccgauggcgccgcugu

SEQ ID NO: 2387856 - RNA, 23 nt, Bordetella pertussis
ggcgccgauggcgccgcugucgc

SEQ ID NO: 2387857 - RNA, 19 nt, Bordetella pertussis
ggcgccgauuucgccgccg

SEQ ID NO: 2387858 - RNA, 19 nt, Bordetella pertussis
ggcgccgcaacgccgggcc

SEQ ID NO: 2387859 - RNA, 17 nt, Bordetella pertussis
ggcgccgcacaucgucg

SEQ ID NO: 2387860 - RNA, 21 nt, Bordetella pertussis
ggcgccgcacaucgucgacgu

SEQ ID NO: 2387861 - RNA, 15 nt, Bordetella pertussis
ggcgccgcacccgau

SEQ ID NO: 2387862 - RNA, 12 nt, Bordetella pertussis
ggcgccgcacgc

SEQ ID NO: 2387863 - RNA, 14 nt, Bordetella pertussis
ggcgccgcacgccg

SEQ ID NO: 2387864 - RNA, 16 nt, Bordetella pertussis
ggcgccgcacgccggu

SEQ ID NO: 2387865 - RNA, 19 nt, Bordetella pertussis
ggcgccgcacgccggucgc

SEQ ID NO: 2387866 - RNA, 20 nt, Bordetella pertussis
ggcgccgcagugcgcgcgcc

SEQ ID NO: 2387867 - RNA, 21 nt, Bordetella pertussis
ggcgccgcauuuccucgacca

SEQ ID NO: 2387868 - RNA, 23 nt, Bordetella pertussis
ggcgccgccccgucaucgggugc

SEQ ID NO: 2387869 - RNA, 17 nt, Bordetella pertussis
ggcgccgccgcccggca

SEQ ID NO: 2387870 - RNA, 12 nt, Bordetella pertussis
ggcgccgccggc

SEQ ID NO: 2387871 - RNA, 15 nt, Bordetella pertussis
ggcgccgccggccau

SEQ ID NO: 2387872 - RNA, 17 nt, Bordetella pertussis
ggcgccgccggccauca

SEQ ID NO: 2387873 - RNA, 18 nt, Bordetella pertussis
ggcgccgccggccaucag

SEQ ID NO: 2387874 - RNA, 13 nt, Bordetella pertussis
ggcgccgccggcg

SEQ ID NO: 2387875 - RNA, 16 nt, Bordetella pertussis
ggcgccgccggguuuc

SEQ ID NO: 2387876 - RNA, 18 nt, Bordetella pertussis
ggcgccgccgugcgcggg

SEQ ID NO: 2387877 - RNA, 21 nt, Bordetella pertussis
ggcgccgccgugcgcgggcgc

SEQ ID NO: 2387878 - RNA, 22 nt, Bordetella pertussis
ggcgccgccgugcgcgggcgcg

SEQ ID NO: 2387879 - RNA, 16 nt, Bordetella pertussis
ggcgccgccucaggcc

SEQ ID NO: 2387880 - RNA, 20 nt, Bordetella pertussis
ggcgccgccucaggccggcg

SEQ ID NO: 2387881 - RNA, 11 nt, Bordetella pertussis
ggcgccgcgca

SEQ ID NO: 2387882 - RNA, 14 nt, Bordetella pertussis
ggcgccgcgcacgc

SEQ ID NO: 2387883 - RNA, 18 nt, Bordetella pertussis
ggcgccgcgcacgcacug

SEQ ID NO: 2387884 - RNA, 13 nt, Bordetella pertussis
ggcgccgcgcccc

SEQ ID NO: 2387885 - RNA, 13 nt, Bordetella pertussis
ggcgccgcgcccg

SEQ ID NO: 2387886 - RNA, 22 nt, Bordetella pertussis
ggcgccgcgcccgcuugcggcc

SEQ ID NO: 2387887 - RNA, 16 nt, Bordetella pertussis
ggcgccgcgcccggcc

SEQ ID NO: 2387888 - RNA, 17 nt, Bordetella pertussis
ggcgccgcgcccggccg

SEQ ID NO: 2387889 - RNA, 20 nt, Bordetella pertussis
ggcgccgcgcccggccggcc

SEQ ID NO: 2387890 - RNA, 22 nt, Bordetella pertussis
ggcgccgcgcccguccacggcc

SEQ ID NO: 2387891 - RNA, 12 nt, Bordetella pertussis
ggcgccgcgccg

SEQ ID NO: 2387892 - RNA, 15 nt, Bordetella pertussis
ggcgccgcgccgccg

SEQ ID NO: 2387893 - RNA, 13 nt, Bordetella pertussis
ggcgccgcgccgg

SEQ ID NO: 2387894 - RNA, 16 nt, Bordetella pertussis
ggcgccgcgccggggc

SEQ ID NO: 2387895 - RNA, 11 nt, Bordetella pertussis
ggcgccgcgcg

SEQ ID NO: 2387896 - RNA, 14 nt, Bordetella pertussis
ggcgccgcgcgccg

SEQ ID NO: 2387897 - RNA, 19 nt, Bordetella pertussis
ggcgccgcgcgccgcggcc

SEQ ID NO: 2387898 - RNA, 16 nt, Bordetella pertussis
ggcgccgcgcgcggcc

SEQ ID NO: 2387899 - RNA, 13 nt, Bordetella pertussis
ggcgccgcgcgcu

SEQ ID NO: 2387900 - RNA, 23 nt, Bordetella pertussis
ggcgccgcgcgcuuucagguggg

SEQ ID NO: 2387901 - RNA, 20 nt, Bordetella pertussis
ggcgccgcgcggucgccauc

SEQ ID NO: 2387902 - RNA, 14 nt, Bordetella pertussis
ggcgccgcgcucgc

SEQ ID NO: 2387903 - RNA, 18 nt, Bordetella pertussis
ggcgccgcgcucgcgcca

SEQ ID NO: 2387904 - RNA, 21 nt, Bordetella pertussis
ggcgccgcgcucgcgccaggc

SEQ ID NO: 2387905 - RNA, 14 nt, Bordetella pertussis
ggcgccgcgcugau

SEQ ID NO: 2387906 - RNA, 22 nt, Bordetella pertussis
ggcgccgcggaggcgaaauaca

SEQ ID NO: 2387907 - RNA, 14 nt, Bordetella pertussis
ggcgccgcggccgg

SEQ ID NO: 2387908 - RNA, 14 nt, Bordetella pertussis
ggcgccgcggcggc

SEQ ID NO: 2387909 - RNA, 13 nt, Bordetella pertussis
ggcgccgcggggc

SEQ ID NO: 2387910 - RNA, 13 nt, Bordetella pertussis
ggcgccgcguccg

SEQ ID NO: 2387911 - RNA, 17 nt, Bordetella pertussis
ggcgccgcguccggcgc

SEQ ID NO: 2387912 - RNA, 22 nt, Bordetella pertussis
ggcgccgcguccggcgcccgcc

SEQ ID NO: 2387913 - RNA, 23 nt, Bordetella pertussis
ggcgccgcguccggcgcccgccg

SEQ ID NO: 2387914 - RNA, 20 nt, Bordetella pertussis
ggcgccgcguucacgccggc

SEQ ID NO: 2387915 - RNA, 13 nt, Bordetella pertussis
ggcgccgcucagc

SEQ ID NO: 2387916 - RNA, 14 nt, Bordetella pertussis
ggcgccgcuggcca

SEQ ID NO: 2387917 - RNA, 17 nt, Bordetella pertussis
ggcgccggaucggccgg

SEQ ID NO: 2387918 - RNA, 11 nt, Bordetella pertussis
ggcgccggcca

SEQ ID NO: 2387919 - RNA, 13 nt, Bordetella pertussis
ggcgccggccacc

SEQ ID NO: 2387920 - RNA, 14 nt, Bordetella pertussis
ggcgccggccagcg

SEQ ID NO: 2387921 - RNA, 13 nt, Bordetella pertussis
ggcgccggccagg

SEQ ID NO: 2387922 - RNA, 14 nt, Bordetella pertussis
ggcgccggccagga

SEQ ID NO: 2387923 - RNA, 15 nt, Bordetella pertussis
ggcgccggccaggcc

SEQ ID NO: 2387924 - RNA, 13 nt, Bordetella pertussis
ggcgccggccgcc

SEQ ID NO: 2387925 - RNA, 14 nt, Bordetella pertussis
ggcgccggccgccc

SEQ ID NO: 2387926 - RNA, 14 nt, Bordetella pertussis
ggcgccggccgcgc

SEQ ID NO: 2387927 - RNA, 16 nt, Bordetella pertussis
ggcgccggccgcgcgc

SEQ ID NO: 2387928 - RNA, 17 nt, Bordetella pertussis
ggcgccggccgcgcgcg

SEQ ID NO: 2387929 - RNA, 19 nt, Bordetella pertussis
ggcgccggccgcgcgcgcc

SEQ ID NO: 2387930 - RNA, 13 nt, Bordetella pertussis
ggcgccggccuca

SEQ ID NO: 2387931 - RNA, 15 nt, Bordetella pertussis
ggcgccggccuccag

SEQ ID NO: 2387932 - RNA, 17 nt, Bordetella pertussis
ggcgccggccuccagca

SEQ ID NO: 2387933 - RNA, 20 nt, Bordetella pertussis
ggcgccggccuccagcaucg

SEQ ID NO: 2387934 - RNA, 21 nt, Bordetella pertussis
ggcgccggccuccagcaucgc

SEQ ID NO: 2387935 - RNA, 18 nt, Bordetella pertussis
ggcgccggcgacgccgcg

SEQ ID NO: 2387936 - RNA, 13 nt, Bordetella pertussis
ggcgccggcgccc

SEQ ID NO: 2387937 - RNA, 21 nt, Bordetella pertussis
ggcgccggcgcccggcagccg

SEQ ID NO: 2387938 - RNA, 14 nt, Bordetella pertussis
ggcgccggcgccgg

SEQ ID NO: 2387939 - RNA, 15 nt, Bordetella pertussis
ggcgccggcgcgccg

SEQ ID NO: 2387940 - RNA, 14 nt, Bordetella pertussis
ggcgccggcggccu

SEQ ID NO: 2387941 - RNA, 17 nt, Bordetella pertussis
ggcgccggcggccuccg

SEQ ID NO: 2387942 - RNA, 13 nt, Bordetella pertussis
ggcgccggcggcg

SEQ ID NO: 2387943 - RNA, 15 nt, Bordetella pertussis
ggcgccggcggcgau

SEQ ID NO: 2387944 - RNA, 15 nt, Bordetella pertussis
ggcgccggcggcgcg

SEQ ID NO: 2387945 - RNA, 14 nt, Bordetella pertussis
ggcgccggcgguaa

SEQ ID NO: 2387946 - RNA, 20 nt, Bordetella pertussis
ggcgccggcgucacgcggcc

SEQ ID NO: 2387947 - RNA, 19 nt, Bordetella pertussis
ggcgccggcuucgucaugg

SEQ ID NO: 2387948 - RNA, 14 nt, Bordetella pertussis
ggcgccgggcagcc

SEQ ID NO: 2387949 - RNA, 15 nt, Bordetella pertussis
ggcgccgggcagccc

SEQ ID NO: 2387950 - RNA, 21 nt, Bordetella pertussis
ggcgccgggcagcccgcgcac

SEQ ID NO: 2387951 - RNA, 12 nt, Bordetella pertussis
ggcgccgggccg

SEQ ID NO: 2387952 - RNA, 14 nt, Bordetella pertussis
ggcgccgggcgacg

SEQ ID NO: 2387953 - RNA, 15 nt, Bordetella pertussis
ggcgccgggcgacgg

SEQ ID NO: 2387954 - RNA, 19 nt, Bordetella pertussis
ggcgccgggcggaucgccg

SEQ ID NO: 2387955 - RNA, 13 nt, Bordetella pertussis
ggcgccgggcugg

SEQ ID NO: 2387956 - RNA, 14 nt, Bordetella pertussis
ggcgccgggcuggu

SEQ ID NO: 2387957 - RNA, 16 nt, Bordetella pertussis
ggcgccgggcuggugc

SEQ ID NO: 2387958 - RNA, 22 nt, Bordetella pertussis
ggcgccggguggguucgggcgu

SEQ ID NO: 2387959 - RNA, 18 nt, Bordetella pertussis
ggcgccgguccagcgccc

SEQ ID NO: 2387960 - RNA, 18 nt, Bordetella pertussis
ggcgccggugaccgccag

SEQ ID NO: 2387961 - RNA, 20 nt, Bordetella pertussis
ggcgccggugaccgccagca

SEQ ID NO: 2387962 - RNA, 22 nt, Bordetella pertussis
ggcgccggugaccgccagcagg

SEQ ID NO: 2387963 - RNA, 20 nt, Bordetella pertussis
ggcgccggugcgcggcgccc

SEQ ID NO: 2387964 - RNA, 20 nt, Bordetella pertussis
ggcgccguccagcgcggcau

SEQ ID NO: 2387965 - RNA, 12 nt, Bordetella pertussis
ggcgccgucgaa

SEQ ID NO: 2387966 - RNA, 17 nt, Bordetella pertussis
ggcgccgucgaagccgg

SEQ ID NO: 2387967 - RNA, 21 nt, Bordetella pertussis
ggcgccgucgaagccggcgcc

SEQ ID NO: 2387968 - RNA, 15 nt, Bordetella pertussis
ggcgccgucgcgcug

SEQ ID NO: 2387969 - RNA, 16 nt, Bordetella pertussis
ggcgccgucgcgcugu

SEQ ID NO: 2387970 - RNA, 19 nt, Bordetella pertussis
ggcgccgucuucgguggcc

SEQ ID NO: 2387971 - RNA, 13 nt, Bordetella pertussis
ggcgccgugcccg

SEQ ID NO: 2387972 - RNA, 14 nt, Bordetella pertussis
ggcgccgugcugga

SEQ ID NO: 2387973 - RNA, 19 nt, Bordetella pertussis
ggcgccgugcuggaggugc

SEQ ID NO: 2387974 - RNA, 18 nt, Bordetella pertussis
ggcgccguuccugcagcg

SEQ ID NO: 2387975 - RNA, 22 nt, Bordetella pertussis
ggcgccguucgucgcgcagcag

SEQ ID NO: 2387976 - RNA, 23 nt, Bordetella pertussis
ggcgccguucgucgcgcagcagg

SEQ ID NO: 2387977 - RNA, 20 nt, Bordetella pertussis
ggcgccguuuucagcgcagg

SEQ ID NO: 2387978 - RNA, 21 nt, Bordetella pertussis
ggcgccguuuucagcgcaggc

SEQ ID NO: 2387979 - RNA, 22 nt, Bordetella pertussis
ggcgccguuuucagcgcaggcu

SEQ ID NO: 2387980 - RNA, 23 nt, Bordetella pertussis
ggcgccguuuucagcgcaggcug

SEQ ID NO: 2387981 - RNA, 20 nt, Bordetella pertussis
ggcgccguuuuuuucguugc

SEQ ID NO: 2387982 - RNA, 21 nt, Bordetella pertussis
ggcgccuacggcggcggccau

SEQ ID NO: 2387983 - RNA, 21 nt, Bordetella pertussis
ggcgccuauugcgacgccgcc

SEQ ID NO: 2387984 - RNA, 22 nt, Bordetella pertussis
ggcgccuauugcgacgccgccg

SEQ ID NO: 2387985 - RNA, 23 nt, Bordetella pertussis
ggcgccucgaacguccgccccau

SEQ ID NO: 2387986 - RNA, 15 nt, Bordetella pertussis
ggcgccucgguccag

SEQ ID NO: 2387987 - RNA, 23 nt, Bordetella pertussis
ggcgccucguccugcaggcggcg

SEQ ID NO: 2387988 - RNA, 19 nt, Bordetella pertussis
ggcgccugagccgauacag

SEQ ID NO: 2387989 - RNA, 14 nt, Bordetella pertussis
ggcgccugccccgc

SEQ ID NO: 2387990 - RNA, 15 nt, Bordetella pertussis
ggcgccugccccgcc

SEQ ID NO: 2387991 - RNA, 17 nt, Bordetella pertussis
ggcgccugccccggcag

SEQ ID NO: 2387992 - RNA, 19 nt, Bordetella pertussis
ggcgccugccgcaucccgc

SEQ ID NO: 2387993 - RNA, 12 nt, Bordetella pertussis
ggcgccugcgcg

SEQ ID NO: 2387994 - RNA, 21 nt, Bordetella pertussis
ggcgccugcgcgcgcuggggc

SEQ ID NO: 2387995 - RNA, 16 nt, Bordetella pertussis
ggcgccugcggcaggc

SEQ ID NO: 2387996 - RNA, 22 nt, Bordetella pertussis
ggcgccugcggcaggccgcagc

SEQ ID NO: 2387997 - RNA, 16 nt, Bordetella pertussis
ggcgccugcggcaugg

SEQ ID NO: 2387998 - RNA, 12 nt, Bordetella pertussis
ggcgccugcggg

SEQ ID NO: 2387999 - RNA, 17 nt, Bordetella pertussis
ggcgccugcggggccgc

SEQ ID NO: 2388000 - RNA, 18 nt, Bordetella pertussis
ggcgccugcucacgcccc

SEQ ID NO: 2388001 - RNA, 12 nt, Bordetella pertussis
ggcgccuggccc

SEQ ID NO: 2388002 - RNA, 13 nt, Bordetella pertussis
ggcgccuggccgc

SEQ ID NO: 2388003 - RNA, 17 nt, Bordetella pertussis
ggcgccuggccgcccag

SEQ ID NO: 2388004 - RNA, 23 nt, Bordetella pertussis
ggcgccuggccguagcguuggcg

SEQ ID NO: 2388005 - RNA, 13 nt, Bordetella pertussis
ggcgccuggcgca

SEQ ID NO: 2388006 - RNA, 13 nt, Bordetella pertussis
ggcgccuggcugc

SEQ ID NO: 2388007 - RNA, 18 nt, Bordetella pertussis
ggcgccuggggcgggcgg

SEQ ID NO: 2388008 - RNA, 23 nt, Bordetella pertussis
ggcgccuggggcgggcgggcgca

SEQ ID NO: 2388009 - RNA, 16 nt, Bordetella pertussis
ggcgccuggggcgugc

SEQ ID NO: 2388010 - RNA, 18 nt, Bordetella pertussis
ggcgccuggucgcgcgcc

SEQ ID NO: 2388011 - RNA, 15 nt, Bordetella pertussis
ggcgccuguccccgc

SEQ ID NO: 2388012 - RNA, 17 nt, Bordetella pertussis
ggcgccuguccccgcag

SEQ ID NO: 2388013 - RNA, 16 nt, Bordetella pertussis
ggcgccuuccggcagc

SEQ ID NO: 2388014 - RNA, 19 nt, Bordetella pertussis
ggcgccuuccggcagcggc

SEQ ID NO: 2388015 - RNA, 21 nt, Bordetella pertussis
ggcgccuuccggcagcggcca

SEQ ID NO: 2388016 - RNA, 23 nt, Bordetella pertussis
ggcgccuuccggcagcggccagc

SEQ ID NO: 2388017 - RNA, 15 nt, Bordetella pertussis
ggcgccuucgaacuc

SEQ ID NO: 2388018 - RNA, 22 nt, Bordetella pertussis
ggcgccuucgaucuucucgccg

SEQ ID NO: 2388019 - RNA, 14 nt, Bordetella pertussis
ggcgccuucggcgc

SEQ ID NO: 2388020 - RNA, 15 nt, Bordetella pertussis
ggcgccuucggcgcg

SEQ ID NO: 2388021 - RNA, 16 nt, Bordetella pertussis
ggcgccuucggcgcgg

SEQ ID NO: 2388022 - RNA, 18 nt, Bordetella pertussis
ggcgccuucggcgcggcg

SEQ ID NO: 2388023 - RNA, 17 nt, Bordetella pertussis
ggcgccuugccgccgcg

SEQ ID NO: 2388024 - RNA, 21 nt, Bordetella pertussis
ggcgccuugccgccgcgcagg

SEQ ID NO: 2388025 - RNA, 18 nt, Bordetella pertussis
ggcgccuuggccugggcg

SEQ ID NO: 2388026 - RNA, 17 nt, Bordetella pertussis
ggcgcgaacaccggcag

SEQ ID NO: 2388027 - RNA, 19 nt, Bordetella pertussis
ggcgcgaacaccggcaggc

SEQ ID NO: 2388028 - RNA, 21 nt, Bordetella pertussis
ggcgcgaacaccggcaggccg

SEQ ID NO: 2388029 - RNA, 23 nt, Bordetella pertussis
ggcgcgaacaccggcaggccgcg

SEQ ID NO: 2388030 - RNA, 19 nt, Bordetella pertussis
ggcgcgaaccccuccggcg

SEQ ID NO: 2388031 - RNA, 16 nt, Bordetella pertussis
ggcgcgaacggcuuga

SEQ ID NO: 2388032 - RNA, 14 nt, Bordetella pertussis
ggcgcgacaggcgg

SEQ ID NO: 2388033 - RNA, 14 nt, Bordetella pertussis
ggcgcgacgccagc

SEQ ID NO: 2388034 - RNA, 18 nt, Bordetella pertussis
ggcgcgacgccagcgcgc

SEQ ID NO: 2388035 - RNA, 21 nt, Bordetella pertussis
ggcgcgacgccagcgcgccau

SEQ ID NO: 2388036 - RNA, 23 nt, Bordetella pertussis
ggcgcgacgccagcgcgccaugg

SEQ ID NO: 2388037 - RNA, 14 nt, Bordetella pertussis
ggcgcgacgccugc

SEQ ID NO: 2388038 - RNA, 15 nt, Bordetella pertussis
ggcgcgacgccugcg

SEQ ID NO: 2388039 - RNA, 21 nt, Bordetella pertussis
ggcgcgacgccugcgccaugg

SEQ ID NO: 2388040 - RNA, 13 nt, Bordetella pertussis
ggcgcgacgcgcu

SEQ ID NO: 2388041 - RNA, 20 nt, Bordetella pertussis
ggcgcgagcgaugcccugga

SEQ ID NO: 2388042 - RNA, 17 nt, Bordetella pertussis
ggcgcgagcgcacaggc

SEQ ID NO: 2388043 - RNA, 16 nt, Bordetella pertussis
ggcgcgagcgccgggc

SEQ ID NO: 2388044 - RNA, 17 nt, Bordetella pertussis
ggcgcgagcgccgggcg

SEQ ID NO: 2388045 - RNA, 18 nt, Bordetella pertussis
ggcgcgagcgccgggcgc

SEQ ID NO: 2388046 - RNA, 22 nt, Bordetella pertussis
ggcgcgagcgccgggcgccgcg

SEQ ID NO: 2388047 - RNA, 11 nt, Bordetella pertussis
ggcgcgagcgu

SEQ ID NO: 2388048 - RNA, 19 nt, Bordetella pertussis
ggcgcgaguauucacgccg

SEQ ID NO: 2388049 - RNA, 19 nt, Bordetella pertussis
ggcgcgauccuucgcggcc

SEQ ID NO: 2388050 - RNA, 16 nt, Bordetella pertussis
ggcgcgaugggccugc

SEQ ID NO: 2388051 - RNA, 21 nt, Bordetella pertussis
ggcgcgauggucaccacccgc

SEQ ID NO: 2388052 - RNA, 22 nt, Bordetella pertussis
ggcgcgcaaaccgacgcggcca

SEQ ID NO: 2388053 - RNA, 17 nt, Bordetella pertussis
ggcgcgcaacacgcgcg

SEQ ID NO: 2388054 - RNA, 17 nt, Bordetella pertussis
ggcgcgcaaccaggggc

SEQ ID NO: 2388055 - RNA, 21 nt, Bordetella pertussis
ggcgcgcaaccaggggcggcg

SEQ ID NO: 2388056 - RNA, 21 nt, Bordetella pertussis
ggcgcgcaagguggcgguggu

SEQ ID NO: 2388057 - RNA, 14 nt, Bordetella pertussis
ggcgcgcacaagcg

SEQ ID NO: 2388058 - RNA, 17 nt, Bordetella pertussis
ggcgcgcacaagcgcga

SEQ ID NO: 2388059 - RNA, 19 nt, Bordetella pertussis
ggcgcgcacacuggccagc

SEQ ID NO: 2388060 - RNA, 20 nt, Bordetella pertussis
ggcgcgcacacuggccagca

SEQ ID NO: 2388061 - RNA, 16 nt, Bordetella pertussis
ggcgcgcaccagcccg

SEQ ID NO: 2388062 - RNA, 20 nt, Bordetella pertussis
ggcgcgcaccagcccgcccg

SEQ ID NO: 2388063 - RNA, 21 nt, Bordetella pertussis
ggcgcgcaccagcccgcccgc

SEQ ID NO: 2388064 - RNA, 18 nt, Bordetella pertussis
ggcgcgcaccugggaggg

SEQ ID NO: 2388065 - RNA, 20 nt, Bordetella pertussis
ggcgcgcaccugggaggggc

SEQ ID NO: 2388066 - RNA, 21 nt, Bordetella pertussis
ggcgcgcagauugcgcucggu

SEQ ID NO: 2388067 - RNA, 13 nt, Bordetella pertussis
ggcgcgcagcaca

SEQ ID NO: 2388068 - RNA, 19 nt, Bordetella pertussis
ggcgcgcagcacauagggc

SEQ ID NO: 2388069 - RNA, 13 nt, Bordetella pertussis
ggcgcgcagcacg

SEQ ID NO: 2388070 - RNA, 16 nt, Bordetella pertussis
ggcgcgcagcacgccg

SEQ ID NO: 2388071 - RNA, 18 nt, Bordetella pertussis
ggcgcgcagcacgccgau

SEQ ID NO: 2388072 - RNA, 14 nt, Bordetella pertussis
ggcgcgcagcagac

SEQ ID NO: 2388073 - RNA, 16 nt, Bordetella pertussis
ggcgcgcagcagacgc

SEQ ID NO: 2388074 - RNA, 14 nt, Bordetella pertussis
ggcgcgcagcagcg

SEQ ID NO: 2388075 - RNA, 15 nt, Bordetella pertussis
ggcgcgcagcagcgc

SEQ ID NO: 2388076 - RNA, 14 nt, Bordetella pertussis
ggcgcgcagcaggc

SEQ ID NO: 2388077 - RNA, 17 nt, Bordetella pertussis
ggcgcgcagcaggccca

SEQ ID NO: 2388078 - RNA, 22 nt, Bordetella pertussis
ggcgcgcagcgccugcaggcgg

SEQ ID NO: 2388079 - RNA, 16 nt, Bordetella pertussis
ggcgcgcagcgcgacc

SEQ ID NO: 2388080 - RNA, 22 nt, Bordetella pertussis
ggcgcgcagcgcgaccgggcaa

SEQ ID NO: 2388081 - RNA, 19 nt, Bordetella pertussis
ggcgcgcaggccucgcccg

SEQ ID NO: 2388082 - RNA, 13 nt, Bordetella pertussis
ggcgcgcaggcgg

SEQ ID NO: 2388083 - RNA, 17 nt, Bordetella pertussis
ggcgcgcaggcgggccu

SEQ ID NO: 2388084 - RNA, 21 nt, Bordetella pertussis
ggcgcgcaguugcgucuccag

SEQ ID NO: 2388085 - RNA, 22 nt, Bordetella pertussis
ggcgcgcaguuguucgcgcaac

SEQ ID NO: 2388086 - RNA, 16 nt, Bordetella pertussis
ggcgcgcaucggcgcc

SEQ ID NO: 2388087 - RNA, 17 nt, Bordetella pertussis
ggcgcgcaucggcgccg

SEQ ID NO: 2388088 - RNA, 18 nt, Bordetella pertussis
ggcgcgcaucggcgccga

SEQ ID NO: 2388089 - RNA, 20 nt, Bordetella pertussis
ggcgcgcaucggcgccgagc

SEQ ID NO: 2388090 - RNA, 21 nt, Bordetella pertussis
ggcgcgcaucggcgccgagca

SEQ ID NO: 2388091 - RNA, 18 nt, Bordetella pertussis
ggcgcgcaucgucaggca

SEQ ID NO: 2388092 - RNA, 23 nt, Bordetella pertussis
ggcgcgcaucgucaggcaggcgc

SEQ ID NO: 2388093 - RNA, 17 nt, Bordetella pertussis
ggcgcgccaccggucgc

SEQ ID NO: 2388094 - RNA, 19 nt, Bordetella pertussis
ggcgcgccaccggucgccg

SEQ ID NO: 2388095 - RNA, 14 nt, Bordetella pertussis
ggcgcgccagcccg

SEQ ID NO: 2388096 - RNA, 20 nt, Bordetella pertussis
ggcgcgccagcccgccgcug

SEQ ID NO: 2388097 - RNA, 13 nt, Bordetella pertussis
ggcgcgccagccg

SEQ ID NO: 2388098 - RNA, 14 nt, Bordetella pertussis
ggcgcgccagccgc

SEQ ID NO: 2388099 - RNA, 15 nt, Bordetella pertussis
ggcgcgccagccgcg

SEQ ID NO: 2388100 - RNA, 16 nt, Bordetella pertussis
ggcgcgccagccgcgc

SEQ ID NO: 2388101 - RNA, 23 nt, Bordetella pertussis
ggcgcgccagccgcgcgaacauc

SEQ ID NO: 2388102 - RNA, 15 nt, Bordetella pertussis
ggcgcgccagcgcgg

SEQ ID NO: 2388103 - RNA, 18 nt, Bordetella pertussis
ggcgcgccagcgcggcca

SEQ ID NO: 2388104 - RNA, 20 nt, Bordetella pertussis
ggcgcgccagcgcggccagc

SEQ ID NO: 2388105 - RNA, 21 nt, Bordetella pertussis
ggcgcgccagcgcggccagcg

SEQ ID NO: 2388106 - RNA, 17 nt, Bordetella pertussis
ggcgcgccaggaagcgc

SEQ ID NO: 2388107 - RNA, 12 nt, Bordetella pertussis
ggcgcgccaggc

SEQ ID NO: 2388108 - RNA, 14 nt, Bordetella pertussis
ggcgcgccaggcga

SEQ ID NO: 2388109 - RNA, 23 nt, Bordetella pertussis
ggcgcgccaggcgauggccggga

SEQ ID NO: 2388110 - RNA, 12 nt, Bordetella pertussis
ggcgcgccaucc

SEQ ID NO: 2388111 - RNA, 23 nt, Bordetella pertussis
ggcgcgccauccugaacgccgcg

SEQ ID NO: 2388112 - RNA, 15 nt, Bordetella pertussis
ggcgcgcccagcccc

SEQ ID NO: 2388113 - RNA, 16 nt, Bordetella pertussis
ggcgcgcccagccccg

SEQ ID NO: 2388114 - RNA, 17 nt, Bordetella pertussis
ggcgcgcccagccccgc

SEQ ID NO: 2388115 - RNA, 22 nt, Bordetella pertussis
ggcgcgcccagcggcaggcugg

SEQ ID NO: 2388116 - RNA, 23 nt, Bordetella pertussis
ggcgcgcccagcggcaggcuggc

SEQ ID NO: 2388117 - RNA, 13 nt, Bordetella pertussis
ggcgcgcccaggg

SEQ ID NO: 2388118 - RNA, 17 nt, Bordetella pertussis
ggcgcgcccgcaggcgg

SEQ ID NO: 2388119 - RNA, 21 nt, Bordetella pertussis
ggcgcgcccgcaggcggcggc

SEQ ID NO: 2388120 - RNA, 22 nt, Bordetella pertussis
ggcgcgcccgcaggcggcggcc

SEQ ID NO: 2388121 - RNA, 14 nt, Bordetella pertussis
ggcgcgcccgccac

SEQ ID NO: 2388122 - RNA, 22 nt, Bordetella pertussis
ggcgcgcccgccgcgucggcgc

SEQ ID NO: 2388123 - RNA, 15 nt, Bordetella pertussis
ggcgcgcccgccuuc

SEQ ID NO: 2388124 - RNA, 22 nt, Bordetella pertussis
ggcgcgcccgcguacagcccga

SEQ ID NO: 2388125 - RNA, 13 nt, Bordetella pertussis
ggcgcgcccggcg

SEQ ID NO: 2388126 - RNA, 14 nt, Bordetella pertussis
ggcgcgcccggcga

SEQ ID NO: 2388127 - RNA, 16 nt, Bordetella pertussis
ggcgcgcccggcgcgc

SEQ ID NO: 2388128 - RNA, 15 nt, Bordetella pertussis
ggcgcgcccuugccg

SEQ ID NO: 2388129 - RNA, 14 nt, Bordetella pertussis
ggcgcgccgcccgc

SEQ ID NO: 2388130 - RNA, 22 nt, Bordetella pertussis
ggcgcgccgcccgcuucuuccu

SEQ ID NO: 2388131 - RNA, 13 nt, Bordetella pertussis
ggcgcgccgccuc

SEQ ID NO: 2388132 - RNA, 13 nt, Bordetella pertussis
ggcgcgccgcggc

SEQ ID NO: 2388133 - RNA, 20 nt, Bordetella pertussis
ggcgcgccgcggcgggcuug

SEQ ID NO: 2388134 - RNA, 18 nt, Bordetella pertussis
ggcgcgccgcugcagcgc

SEQ ID NO: 2388135 - RNA, 19 nt, Bordetella pertussis
ggcgcgccgcugcagcgcu

SEQ ID NO: 2388136 - RNA, 22 nt, Bordetella pertussis
ggcgcgccgcugcagcgcuggu

SEQ ID NO: 2388137 - RNA, 23 nt, Bordetella pertussis
ggcgcgccggaacauggcgguga

SEQ ID NO: 2388138 - RNA, 13 nt, Bordetella pertussis
ggcgcgccggccg

SEQ ID NO: 2388139 - RNA, 18 nt, Bordetella pertussis
ggcgcgccggccgccagc

SEQ ID NO: 2388140 - RNA, 23 nt, Bordetella pertussis
ggcgcgccggccgccagcaaggc

SEQ ID NO: 2388141 - RNA, 15 nt, Bordetella pertussis
ggcgcgccggccugc

SEQ ID NO: 2388142 - RNA, 18 nt, Bordetella pertussis
ggcgcgccggccugcgcc

SEQ ID NO: 2388143 - RNA, 21 nt, Bordetella pertussis
ggcgcgccggccugcgccggg

SEQ ID NO: 2388144 - RNA, 23 nt, Bordetella pertussis
ggcgcgccggccugcgccgggcg

SEQ ID NO: 2388145 - RNA, 12 nt, Bordetella pertussis
ggcgcgccggcg

SEQ ID NO: 2388146 - RNA, 17 nt, Bordetella pertussis
ggcgcgccgggccggcg

SEQ ID NO: 2388147 - RNA, 19 nt, Bordetella pertussis
ggcgcgccgggccggcggg

SEQ ID NO: 2388148 - RNA, 20 nt, Bordetella pertussis
ggcgcgccgggccggcgggc

SEQ ID NO: 2388149 - RNA, 22 nt, Bordetella pertussis
ggcgcgccgucgcuggggcgca

SEQ ID NO: 2388150 - RNA, 15 nt, Bordetella pertussis
ggcgcgccguggcug

SEQ ID NO: 2388151 - RNA, 20 nt, Bordetella pertussis
ggcgcgccuccagcuccagc

SEQ ID NO: 2388152 - RNA, 16 nt, Bordetella pertussis
ggcgcgccucggcgcg

SEQ ID NO: 2388153 - RNA, 14 nt, Bordetella pertussis
ggcgcgccuggcgc

SEQ ID NO: 2388154 - RNA, 15 nt, Bordetella pertussis
ggcgcgccuggcgcg

SEQ ID NO: 2388155 - RNA, 19 nt, Bordetella pertussis
ggcgcgccuggcgcgccca

SEQ ID NO: 2388156 - RNA, 18 nt, Bordetella pertussis
ggcgcgccuuacgcggcg

SEQ ID NO: 2388157 - RNA, 18 nt, Bordetella pertussis
ggcgcgccuucggcaggc

SEQ ID NO: 2388158 - RNA, 21 nt, Bordetella pertussis
ggcgcgccuucggcaggcgcc

SEQ ID NO: 2388159 - RNA, 16 nt, Bordetella pertussis
ggcgcgcgcaagccgc

SEQ ID NO: 2388160 - RNA, 18 nt, Bordetella pertussis
ggcgcgcgcaagccgccg

SEQ ID NO: 2388161 - RNA, 19 nt, Bordetella pertussis
ggcgcgcgcaagccgccgc

SEQ ID NO: 2388162 - RNA, 13 nt, Bordetella pertussis
ggcgcgcgcacgc

SEQ ID NO: 2388163 - RNA, 15 nt, Bordetella pertussis
ggcgcgcgcaggcgc

SEQ ID NO: 2388164 - RNA, 18 nt, Bordetella pertussis
ggcgcgcgcaucggccgg

SEQ ID NO: 2388165 - RNA, 13 nt, Bordetella pertussis
ggcgcgcgcaugc

SEQ ID NO: 2388166 - RNA, 16 nt, Bordetella pertussis
ggcgcgcgcaugcccg

SEQ ID NO: 2388167 - RNA, 14 nt, Bordetella pertussis
ggcgcgcgccagcg

SEQ ID NO: 2388168 - RNA, 18 nt, Bordetella pertussis
ggcgcgcgccagcggcug

SEQ ID NO: 2388169 - RNA, 13 nt, Bordetella pertussis
ggcgcgcgccagg

SEQ ID NO: 2388170 - RNA, 14 nt, Bordetella pertussis
ggcgcgcgccaggc

SEQ ID NO: 2388171 - RNA, 18 nt, Bordetella pertussis
ggcgcgcgccaggcccag

SEQ ID NO: 2388172 - RNA, 21 nt, Bordetella pertussis
ggcgcgcgccaggcccagggc

SEQ ID NO: 2388173 - RNA, 22 nt, Bordetella pertussis
ggcgcgcgccagggcgccgcgg

SEQ ID NO: 2388174 - RNA, 22 nt, Bordetella pertussis
ggcgcgcgccaucgacgggcgg

SEQ ID NO: 2388175 - RNA, 12 nt, Bordetella pertussis
ggcgcgcgccca

SEQ ID NO: 2388176 - RNA, 22 nt, Bordetella pertussis
ggcgcgcgcccaggccagccag

SEQ ID NO: 2388177 - RNA, 14 nt, Bordetella pertussis
ggcgcgcgccgagg

SEQ ID NO: 2388178 - RNA, 16 nt, Bordetella pertussis
ggcgcgcgccgaugcg

SEQ ID NO: 2388179 - RNA, 21 nt, Bordetella pertussis
ggcgcgcgccgaugcgccagg

SEQ ID NO: 2388180 - RNA, 14 nt, Bordetella pertussis
ggcgcgcgccgcgc

SEQ ID NO: 2388181 - RNA, 21 nt, Bordetella pertussis
ggcgcgcgccgcgccggggcg

SEQ ID NO: 2388182 - RNA, 14 nt, Bordetella pertussis
ggcgcgcgccggcg

SEQ ID NO: 2388183 - RNA, 16 nt, Bordetella pertussis
ggcgcgcgccggcggc

SEQ ID NO: 2388184 - RNA, 20 nt, Bordetella pertussis
ggcgcgcgccggcggccugc

SEQ ID NO: 2388185 - RNA, 14 nt, Bordetella pertussis
ggcgcgcgccggcu

SEQ ID NO: 2388186 - RNA, 17 nt, Bordetella pertussis
ggcgcgcgccggcucga

SEQ ID NO: 2388187 - RNA, 23 nt, Bordetella pertussis
ggcgcgcgccugcagcacggcca

SEQ ID NO: 2388188 - RNA, 20 nt, Bordetella pertussis
ggcgcgcgccugcucgaccu

SEQ ID NO: 2388189 - RNA, 20 nt, Bordetella pertussis
ggcgcgcgcgacuccaccgg

SEQ ID NO: 2388190 - RNA, 15 nt, Bordetella pertussis
ggcgcgcgcgcgccg

SEQ ID NO: 2388191 - RNA, 16 nt, Bordetella pertussis
ggcgcgcgcgcgccgc

SEQ ID NO: 2388192 - RNA, 18 nt, Bordetella pertussis
ggcgcgcgcgcgccgcac

SEQ ID NO: 2388193 - RNA, 15 nt, Bordetella pertussis
ggcgcgcgcggccag

SEQ ID NO: 2388194 - RNA, 13 nt, Bordetella pertussis
ggcgcgcgcggcg

SEQ ID NO: 2388195 - RNA, 17 nt, Bordetella pertussis
ggcgcgcgcggcgccgc

SEQ ID NO: 2388196 - RNA, 19 nt, Bordetella pertussis
ggcgcgcgcggcgccuggg

SEQ ID NO: 2388197 - RNA, 20 nt, Bordetella pertussis
ggcgcgcgcguacagccggg

SEQ ID NO: 2388198 - RNA, 21 nt, Bordetella pertussis
ggcgcgcgcguacagccgggu

SEQ ID NO: 2388199 - RNA, 19 nt, Bordetella pertussis
ggcgcgcgcugcacggccu

SEQ ID NO: 2388200 - RNA, 15 nt, Bordetella pertussis
ggcgcgcggcagggc

SEQ ID NO: 2388201 - RNA, 14 nt, Bordetella pertussis
ggcgcgcggccucg

SEQ ID NO: 2388202 - RNA, 21 nt, Bordetella pertussis
ggcgcgcggcguugcggcgcc

SEQ ID NO: 2388203 - RNA, 13 nt, Bordetella pertussis
ggcgcgcggcugg

SEQ ID NO: 2388204 - RNA, 18 nt, Bordetella pertussis
ggcgcgcggcuggggcug

SEQ ID NO: 2388205 - RNA, 20 nt, Bordetella pertussis
ggcgcgcgggaagcugucgg

SEQ ID NO: 2388206 - RNA, 14 nt, Bordetella pertussis
ggcgcgcgggcccu

SEQ ID NO: 2388207 - RNA, 14 nt, Bordetella pertussis
ggcgcgcgggggug

SEQ ID NO: 2388208 - RNA, 15 nt, Bordetella pertussis
ggcgcgcgggggugc

SEQ ID NO: 2388209 - RNA, 23 nt, Bordetella pertussis
ggcgcgcgggggugcgcgacagc

SEQ ID NO: 2388210 - RNA, 17 nt, Bordetella pertussis
ggcgcgcgugcugggcc

SEQ ID NO: 2388211 - RNA, 18 nt, Bordetella pertussis
ggcgcgcgugcugggcca

SEQ ID NO: 2388212 - RNA, 17 nt, Bordetella pertussis
ggcgcgcguugaccgcc

SEQ ID NO: 2388213 - RNA, 16 nt, Bordetella pertussis
ggcgcgcucagcgcca

SEQ ID NO: 2388214 - RNA, 18 nt, Bordetella pertussis
ggcgcgcucagcgccauc

SEQ ID NO: 2388215 - RNA, 23 nt, Bordetella pertussis
ggcgcgcucagcgccaucaucgc

SEQ ID NO: 2388216 - RNA, 21 nt, Bordetella pertussis
ggcgcgcucaggccgccggcg

SEQ ID NO: 2388217 - RNA, 17 nt, Bordetella pertussis
ggcgcgcucgcugccgg

SEQ ID NO: 2388218 - RNA, 22 nt, Bordetella pertussis
ggcgcgcucgcugccggcgucc

SEQ ID NO: 2388219 - RNA, 13 nt, Bordetella pertussis
ggcgcgcucggcg

SEQ ID NO: 2388220 - RNA, 16 nt, Bordetella pertussis
ggcgcgcucggcgccg

SEQ ID NO: 2388221 - RNA, 17 nt, Bordetella pertussis
ggcgcgcucggcgccgg

SEQ ID NO: 2388222 - RNA, 13 nt, Bordetella pertussis
ggcgcgcucuccg

SEQ ID NO: 2388223 - RNA, 13 nt, Bordetella pertussis
ggcgcgcugccca

SEQ ID NO: 2388224 - RNA, 16 nt, Bordetella pertussis
ggcgcgcugcccagcc

SEQ ID NO: 2388225 - RNA, 16 nt, Bordetella pertussis
ggcgcgcuggaggccu

SEQ ID NO: 2388226 - RNA, 12 nt, Bordetella pertussis
ggcgcgcuggcg

SEQ ID NO: 2388227 - RNA, 13 nt, Bordetella pertussis
ggcgcgcuggcgc

SEQ ID NO: 2388228 - RNA, 20 nt, Bordetella pertussis
ggcgcgcuggcgcucgggcg

SEQ ID NO: 2388229 - RNA, 22 nt, Bordetella pertussis
ggcgcgcuggcgcucgggcgcg

SEQ ID NO: 2388230 - RNA, 16 nt, Bordetella pertussis
ggcgcgcuguucauca

SEQ ID NO: 2388231 - RNA, 16 nt, Bordetella pertussis
ggcgcgcuucagugcu

SEQ ID NO: 2388232 - RNA, 23 nt, Bordetella pertussis
ggcgcgcuucuuggcgaccaggc

SEQ ID NO: 2388233 - RNA, 20 nt, Bordetella pertussis
ggcgcgcuugagcggcucgc

SEQ ID NO: 2388234 - RNA, 21 nt, Bordetella pertussis
ggcgcgcuugagcggcucgcc

SEQ ID NO: 2388235 - RNA, 22 nt, Bordetella pertussis
ggcgcgcuugagcggcucgccu

SEQ ID NO: 2388236 - RNA, 20 nt, Bordetella pertussis
ggcgcggaacagccugguca

SEQ ID NO: 2388237 - RNA, 22 nt, Bordetella pertussis
ggcgcggaacagccuggucagg

SEQ ID NO: 2388238 - RNA, 23 nt, Bordetella pertussis
ggcgcggaccugcucgagcggcg

SEQ ID NO: 2388239 - RNA, 20 nt, Bordetella pertussis
ggcgcggaucaugggcucgc

SEQ ID NO: 2388240 - RNA, 21 nt, Bordetella pertussis
ggcgcggaucaugggcucgcg

SEQ ID NO: 2388241 - RNA, 19 nt, Bordetella pertussis
ggcgcggaucgugcgccac

SEQ ID NO: 2388242 - RNA, 20 nt, Bordetella pertussis
ggcgcggaugaccugcgcca

SEQ ID NO: 2388243 - RNA, 22 nt, Bordetella pertussis
ggcgcggaugaccugcgccagg

SEQ ID NO: 2388244 - RNA, 18 nt, Bordetella pertussis
ggcgcggauugaugucgc

SEQ ID NO: 2388245 - RNA, 23 nt, Bordetella pertussis
ggcgcggauugaugucgcgcacc

SEQ ID NO: 2388246 - RNA, 19 nt, Bordetella pertussis
ggcgcggauuucgcgaugc

SEQ ID NO: 2388247 - RNA, 15 nt, Bordetella pertussis
ggcgcggcagccugg

SEQ ID NO: 2388248 - RNA, 12 nt, Bordetella pertussis
ggcgcggcaggc

SEQ ID NO: 2388249 - RNA, 14 nt, Bordetella pertussis
ggcgcggcaggcgg

SEQ ID NO: 2388250 - RNA, 18 nt, Bordetella pertussis
ggcgcggcagugggcggu

SEQ ID NO: 2388251 - RNA, 16 nt, Bordetella pertussis
ggcgcggcauggcgcc

SEQ ID NO: 2388252 - RNA, 18 nt, Bordetella pertussis
ggcgcggcauggcgccgc

SEQ ID NO: 2388253 - RNA, 19 nt, Bordetella pertussis
ggcgcggcauggcgccgcg

SEQ ID NO: 2388254 - RNA, 23 nt, Bordetella pertussis
ggcgcggccaaccccgagggcgc

SEQ ID NO: 2388255 - RNA, 14 nt, Bordetella pertussis
ggcgcggccagcag

SEQ ID NO: 2388256 - RNA, 14 nt, Bordetella pertussis
ggcgcggccagggu

SEQ ID NO: 2388257 - RNA, 21 nt, Bordetella pertussis
ggcgcggccagggucaggggc

SEQ ID NO: 2388258 - RNA, 15 nt, Bordetella pertussis
ggcgcggccccaugc

SEQ ID NO: 2388259 - RNA, 14 nt, Bordetella pertussis
ggcgcggcccgcca

SEQ ID NO: 2388260 - RNA, 14 nt, Bordetella pertussis
ggcgcggcccggcg

SEQ ID NO: 2388261 - RNA, 15 nt, Bordetella pertussis
ggcgcggccgccagc

SEQ ID NO: 2388262 - RNA, 17 nt, Bordetella pertussis
ggcgcggccgccgcccg

SEQ ID NO: 2388263 - RNA, 12 nt, Bordetella pertussis
ggcgcggccggg

SEQ ID NO: 2388264 - RNA, 16 nt, Bordetella pertussis
ggcgcggccuucccaa

SEQ ID NO: 2388265 - RNA, 23 nt, Bordetella pertussis
ggcgcggcgaucggcccgggcgu

SEQ ID NO: 2388266 - RNA, 20 nt, Bordetella pertussis
ggcgcggcgauugcggcccg

SEQ ID NO: 2388267 - RNA, 18 nt, Bordetella pertussis
ggcgcggcgcaggccugc

SEQ ID NO: 2388268 - RNA, 20 nt, Bordetella pertussis
ggcgcggcgcaggccugcgg

SEQ ID NO: 2388269 - RNA, 22 nt, Bordetella pertussis
ggcgcggcgcaggccugcggcg

SEQ ID NO: 2388270 - RNA, 18 nt, Bordetella pertussis
ggcgcggcgcauuggcca

SEQ ID NO: 2388271 - RNA, 12 nt, Bordetella pertussis
ggcgcggcgcca

SEQ ID NO: 2388272 - RNA, 17 nt, Bordetella pertussis
ggcgcggcgccagcgcc

SEQ ID NO: 2388273 - RNA, 13 nt, Bordetella pertussis
ggcgcggcgccau

SEQ ID NO: 2388274 - RNA, 14 nt, Bordetella pertussis
ggcgcggcgccaug

SEQ ID NO: 2388275 - RNA, 12 nt, Bordetella pertussis
ggcgcggcgccc

SEQ ID NO: 2388276 - RNA, 13 nt, Bordetella pertussis
ggcgcggcgcccg

SEQ ID NO: 2388277 - RNA, 14 nt, Bordetella pertussis
ggcgcggcgcccgc

SEQ ID NO: 2388278 - RNA, 17 nt, Bordetella pertussis
ggcgcggcgcccgccug

SEQ ID NO: 2388279 - RNA, 13 nt, Bordetella pertussis
ggcgcggcgccgc

SEQ ID NO: 2388280 - RNA, 12 nt, Bordetella pertussis
ggcgcggcgccu

SEQ ID NO: 2388281 - RNA, 14 nt, Bordetella pertussis
ggcgcggcgccugc

SEQ ID NO: 2388282 - RNA, 15 nt, Bordetella pertussis
ggcgcggcgcgcgcc

SEQ ID NO: 2388283 - RNA, 17 nt, Bordetella pertussis
ggcgcggcgcgugccag

SEQ ID NO: 2388284 - RNA, 24 nt, Bordetella pertussis
ggcgcggcgcuacgccgccgaugg

SEQ ID NO: 2388285 - RNA, 13 nt, Bordetella pertussis
ggcgcggcggcca

SEQ ID NO: 2388286 - RNA, 14 nt, Bordetella pertussis
ggcgcggcggccag

SEQ ID NO: 2388287 - RNA, 17 nt, Bordetella pertussis
ggcgcggcggccaggcg

SEQ ID NO: 2388288 - RNA, 15 nt, Bordetella pertussis
ggcgcggcggccugg

SEQ ID NO: 2388289 - RNA, 12 nt, Bordetella pertussis
ggcgcggcggcg

SEQ ID NO: 2388290 - RNA, 13 nt, Bordetella pertussis
ggcgcggcggcgu

SEQ ID NO: 2388291 - RNA, 16 nt, Bordetella pertussis
ggcgcggcgggcgcug

SEQ ID NO: 2388292 - RNA, 17 nt, Bordetella pertussis
ggcgcggcgggcgcugg

SEQ ID NO: 2388293 - RNA, 13 nt, Bordetella pertussis
ggcgcggcgggcu

SEQ ID NO: 2388294 - RNA, 18 nt, Bordetella pertussis
ggcgcggcgggcucagcc

SEQ ID NO: 2388295 - RNA, 19 nt, Bordetella pertussis
ggcgcggcgguccucgccg

SEQ ID NO: 2388296 - RNA, 20 nt, Bordetella pertussis
ggcgcggcgguccucgccgg

SEQ ID NO: 2388297 - RNA, 21 nt, Bordetella pertussis
ggcgcggcggugccugucccc

SEQ ID NO: 2388298 - RNA, 15 nt, Bordetella pertussis
ggcgcggcgguggcg

SEQ ID NO: 2388299 - RNA, 14 nt, Bordetella pertussis
ggcgcggcgucgaa

SEQ ID NO: 2388300 - RNA, 15 nt, Bordetella pertussis
ggcgcggcgucgaug

SEQ ID NO: 2388301 - RNA, 17 nt, Bordetella pertussis
ggcgcggcucgccggcc

SEQ ID NO: 2388302 - RNA, 20 nt, Bordetella pertussis
ggcgcggcucgccggccgcg

SEQ ID NO: 2388303 - RNA, 17 nt, Bordetella pertussis
ggcgcggcugcccucgg

SEQ ID NO: 2388304 - RNA, 13 nt, Bordetella pertussis
ggcgcggcugcga

SEQ ID NO: 2388305 - RNA, 15 nt, Bordetella pertussis
ggcgcggcugcuggg

SEQ ID NO: 2388306 - RNA, 17 nt, Bordetella pertussis
ggcgcggcugcugggca

SEQ ID NO: 2388307 - RNA, 17 nt, Bordetella pertussis
ggcgcggcuuucgccgg

SEQ ID NO: 2388308 - RNA, 23 nt, Bordetella pertussis
ggcgcgggaaaugauaguccugc

SEQ ID NO: 2388309 - RNA, 18 nt, Bordetella pertussis
ggcgcgggcacucggcca

SEQ ID NO: 2388310 - RNA, 14 nt, Bordetella pertussis
ggcgcgggccagcu

SEQ ID NO: 2388311 - RNA, 13 nt, Bordetella pertussis
ggcgcgggcgaug

SEQ ID NO: 2388312 - RNA, 17 nt, Bordetella pertussis
ggcgcgggcgcaggcgu

SEQ ID NO: 2388313 - RNA, 13 nt, Bordetella pertussis
ggcgcgggcggcc

SEQ ID NO: 2388314 - RNA, 19 nt, Bordetella pertussis
ggcgcgggcggucggcgcg

SEQ ID NO: 2388315 - RNA, 15 nt, Bordetella pertussis
ggcgcgggcugucgc

SEQ ID NO: 2388316 - RNA, 15 nt, Bordetella pertussis
ggcgcggggcaccgg

SEQ ID NO: 2388317 - RNA, 23 nt, Bordetella pertussis
ggcgcggguaggcaaagcgcagc

SEQ ID NO: 2388318 - RNA, 21 nt, Bordetella pertussis
ggcgcgggucuugagcggccc

SEQ ID NO: 2388319 - RNA, 16 nt, Bordetella pertussis
ggcgcggguggccgga

SEQ ID NO: 2388320 - RNA, 18 nt, Bordetella pertussis
ggcgcgguagcgccccuc

SEQ ID NO: 2388321 - RNA, 16 nt, Bordetella pertussis
ggcgcgguauggccgc

SEQ ID NO: 2388322 - RNA, 17 nt, Bordetella pertussis
ggcgcgguauggccgcc

SEQ ID NO: 2388323 - RNA, 19 nt, Bordetella pertussis
ggcgcgguauggccgccca

SEQ ID NO: 2388324 - RNA, 21 nt, Bordetella pertussis
ggcgcgguauggccgcccagc

SEQ ID NO: 2388325 - RNA, 19 nt, Bordetella pertussis
ggcgcgguauucgcugcug

SEQ ID NO: 2388326 - RNA, 16 nt, Bordetella pertussis
ggcgcggucagcauga

SEQ ID NO: 2388327 - RNA, 23 nt, Bordetella pertussis
ggcgcgguccacgcccuggcugg

SEQ ID NO: 2388328 - RNA, 19 nt, Bordetella pertussis
ggcgcgguccacgcgggca

SEQ ID NO: 2388329 - RNA, 14 nt, Bordetella pertussis
ggcgcgguccagca

SEQ ID NO: 2388330 - RNA, 20 nt, Bordetella pertussis
ggcgcgguccagcaaggcgu

SEQ ID NO: 2388331 - RNA, 14 nt, Bordetella pertussis
ggcgcggucgacga

SEQ ID NO: 2388332 - RNA, 15 nt, Bordetella pertussis
ggcgcggucggcggg

SEQ ID NO: 2388333 - RNA, 16 nt, Bordetella pertussis
ggcgcggucggcgggc

SEQ ID NO: 2388334 - RNA, 14 nt, Bordetella pertussis
ggcgcggucuuggc

SEQ ID NO: 2388335 - RNA, 16 nt, Bordetella pertussis
ggcgcggugcgcacca

SEQ ID NO: 2388336 - RNA, 18 nt, Bordetella pertussis
ggcgcggugcgcaccagg

SEQ ID NO: 2388337 - RNA, 19 nt, Bordetella pertussis
ggcgcggugcgcaccaggc

SEQ ID NO: 2388338 - RNA, 13 nt, Bordetella pertussis
ggcgcgguggcca

SEQ ID NO: 2388339 - RNA, 14 nt, Bordetella pertussis
ggcgcgguggccau

SEQ ID NO: 2388340 - RNA, 16 nt, Bordetella pertussis
ggcgcgguggccaugc

SEQ ID NO: 2388341 - RNA, 19 nt, Bordetella pertussis
ggcgcgguggccaugcugg

SEQ ID NO: 2388342 - RNA, 23 nt, Bordetella pertussis
ggcgcgguggccaugcugggcgg

SEQ ID NO: 2388343 - RNA, 21 nt, Bordetella pertussis
ggcgcgguugguuugcggcgc

SEQ ID NO: 2388344 - RNA, 22 nt, Bordetella pertussis
ggcgcgguugguuugcggcgcg

SEQ ID NO: 2388345 - RNA, 21 nt, Bordetella pertussis
ggcgcguaauaguggucgccg

SEQ ID NO: 2388346 - RNA, 20 nt, Bordetella pertussis
ggcgcguaugacgcgcugau

SEQ ID NO: 2388347 - RNA, 19 nt, Bordetella pertussis
ggcgcgucacaaagacggc

SEQ ID NO: 2388348 - RNA, 15 nt, Bordetella pertussis
ggcgcgucaggccgg

SEQ ID NO: 2388349 - RNA, 16 nt, Bordetella pertussis
ggcgcgucaggccggg

SEQ ID NO: 2388350 - RNA, 22 nt, Bordetella pertussis
ggcgcguccaagcagacccgcg

SEQ ID NO: 2388351 - RNA, 15 nt, Bordetella pertussis
ggcgcguccacgccg

SEQ ID NO: 2388352 - RNA, 18 nt, Bordetella pertussis
ggcgcguccacgccgugg

SEQ ID NO: 2388353 - RNA, 20 nt, Bordetella pertussis
ggcgcguccacgccguggcg

SEQ ID NO: 2388354 - RNA, 14 nt, Bordetella pertussis
ggcgcgucgccgcg

SEQ ID NO: 2388355 - RNA, 15 nt, Bordetella pertussis
ggcgcgucgccgcgc

SEQ ID NO: 2388356 - RNA, 17 nt, Bordetella pertussis
ggcgcgucgccgcgccg

SEQ ID NO: 2388357 - RNA, 13 nt, Bordetella pertussis
ggcgcgucgccgg

SEQ ID NO: 2388358 - RNA, 15 nt, Bordetella pertussis
ggcgcgucgccggcg

SEQ ID NO: 2388359 - RNA, 19 nt, Bordetella pertussis
ggcgcgucgccggcgauga

SEQ ID NO: 2388360 - RNA, 20 nt, Bordetella pertussis
ggcgcgucgcgcgaucaggc

SEQ ID NO: 2388361 - RNA, 14 nt, Bordetella pertussis
ggcgcgucgcgcgc

SEQ ID NO: 2388362 - RNA, 15 nt, Bordetella pertussis
ggcgcgucgcgcgcc

SEQ ID NO: 2388363 - RNA, 17 nt, Bordetella pertussis
ggcgcgucgcgcgccag

SEQ ID NO: 2388364 - RNA, 18 nt, Bordetella pertussis
ggcgcgucgcgcgccagg

SEQ ID NO: 2388365 - RNA, 20 nt, Bordetella pertussis
ggcgcgucgcgcgccaggcg

SEQ ID NO: 2388366 - RNA, 18 nt, Bordetella pertussis
ggcgcgucgcgcggcggc

SEQ ID NO: 2388367 - RNA, 13 nt, Bordetella pertussis
ggcgcgucggcgc

SEQ ID NO: 2388368 - RNA, 14 nt, Bordetella pertussis
ggcgcgucggcgcg

SEQ ID NO: 2388369 - RNA, 22 nt, Bordetella pertussis
ggcgcgucuggaggacgagcgg

SEQ ID NO: 2388370 - RNA, 17 nt, Bordetella pertussis
ggcgcgugccagcaggu

SEQ ID NO: 2388371 - RNA, 15 nt, Bordetella pertussis
ggcgcgugcgcgcgc

SEQ ID NO: 2388372 - RNA, 22 nt, Bordetella pertussis
ggcgcgugcggaugcagcagcg

SEQ ID NO: 2388373 - RNA, 19 nt, Bordetella pertussis
ggcgcgugcucaucggcag

SEQ ID NO: 2388374 - RNA, 21 nt, Bordetella pertussis
ggcgcgugcucaucggcaggc

SEQ ID NO: 2388375 - RNA, 15 nt, Bordetella pertussis
ggcgcgugcuggcgc

SEQ ID NO: 2388376 - RNA, 22 nt, Bordetella pertussis
ggcgcgugcuggcgcagcagcg

SEQ ID NO: 2388377 - RNA, 18 nt, Bordetella pertussis
ggcgcguggccacggcgu

SEQ ID NO: 2388378 - RNA, 20 nt, Bordetella pertussis
ggcgcguggccacggcgucg

SEQ ID NO: 2388379 - RNA, 14 nt, Bordetella pertussis
ggcgcguggcccgc

SEQ ID NO: 2388380 - RNA, 16 nt, Bordetella pertussis
ggcgcguggccgccac

SEQ ID NO: 2388381 - RNA, 14 nt, Bordetella pertussis
ggcgcguggcgccc

SEQ ID NO: 2388382 - RNA, 14 nt, Bordetella pertussis
ggcgcgugggcagg

SEQ ID NO: 2388383 - RNA, 14 nt, Bordetella pertussis
ggcgcguucagcag

SEQ ID NO: 2388384 - RNA, 19 nt, Bordetella pertussis
ggcgcguucagcagcaggc

SEQ ID NO: 2388385 - RNA, 21 nt, Bordetella pertussis
ggcgcguucagcagcaggccc

SEQ ID NO: 2388386 - RNA, 13 nt, Bordetella pertussis
ggcgcguucgccg

SEQ ID NO: 2388387 - RNA, 19 nt, Bordetella pertussis
ggcgcguucgccgcagccg

SEQ ID NO: 2388388 - RNA, 20 nt, Bordetella pertussis
ggcgcguucgccgcagccgu

SEQ ID NO: 2388389 - RNA, 18 nt, Bordetella pertussis
ggcgcguucucagccgcc

SEQ ID NO: 2388390 - RNA, 20 nt, Bordetella pertussis
ggcgcguucucagccgcccg

SEQ ID NO: 2388391 - RNA, 21 nt, Bordetella pertussis
ggcgcguucucagccgcccgc

SEQ ID NO: 2388392 - RNA, 23 nt, Bordetella pertussis
ggcgcguucucagccgcccgccg

SEQ ID NO: 2388393 - RNA, 17 nt, Bordetella pertussis
ggcgcguugcgcaucgc

SEQ ID NO: 2388394 - RNA, 16 nt, Bordetella pertussis
ggcgcguugcgcuugc

SEQ ID NO: 2388395 - RNA, 17 nt, Bordetella pertussis
ggcgcguuucggucagg

SEQ ID NO: 2388396 - RNA, 19 nt, Bordetella pertussis
ggcgcguuuucgcuggcgg

SEQ ID NO: 2388397 - RNA, 22 nt, Bordetella pertussis
ggcgcuacagggugccgcgccg

SEQ ID NO: 2388398 - RNA, 22 nt, Bordetella pertussis
ggcgcucagccgugccgcgcgc

SEQ ID NO: 2388399 - RNA, 24 nt, Bordetella pertussis
ggcgcucagccgugccgcgcgcac

SEQ ID NO: 2388400 - RNA, 16 nt, Bordetella pertussis
ggcgcucagcgcgccg

SEQ ID NO: 2388401 - RNA, 20 nt, Bordetella pertussis
ggcgcuccagcaccugcacc

SEQ ID NO: 2388402 - RNA, 19 nt, Bordetella pertussis
ggcgcuccaugcggcggcg

SEQ ID NO: 2388403 - RNA, 14 nt, Bordetella pertussis
ggcgcuccucgcgc

SEQ ID NO: 2388404 - RNA, 17 nt, Bordetella pertussis
ggcgcuccucgcgcgcg

SEQ ID NO: 2388405 - RNA, 14 nt, Bordetella pertussis
ggcgcucgaaaaag

SEQ ID NO: 2388406 - RNA, 20 nt, Bordetella pertussis
ggcgcucgaaaaagcccugc

SEQ ID NO: 2388407 - RNA, 18 nt, Bordetella pertussis
ggcgcucgaaggcgccga

SEQ ID NO: 2388408 - RNA, 19 nt, Bordetella pertussis
ggcgcucgagcgccugcag

SEQ ID NO: 2388409 - RNA, 24 nt, Bordetella pertussis
ggcgcucgaucggauagcggugca

SEQ ID NO: 2388410 - RNA, 13 nt, Bordetella pertussis
gcucgacgcgcug

SEQ ID NO: 2388411 - RNA, 17 nt, Bordetella pertussis
gcucgacuucgucgggc

SEQ ID NO: 2388412 - RNA, 21 nt, Bordetella pertussis
gcucgacuucgucgggcucgg

SEQ ID NO: 2388413 - RNA, 14 nt, Bordetella pertussis
gcucgagcaucugg

SEQ ID NO: 2388414 - RNA, 16 nt, Bordetella pertussis
gcucgagcaugcgggc

SEQ ID NO: 2388415 - RNA, 13 nt, Bordetella pertussis
gcucgagcgccug

SEQ ID NO: 2388416 - RNA, 15 nt, Bordetella pertussis
gcucgagcgcggcgc

SEQ ID NO: 2388417 - RNA, 14 nt, Bordetella pertussis
gcucgagcggcgga

SEQ ID NO: 2388418 - RNA, 19 nt, Bordetella pertussis
gcucgagcuccugcucgau

SEQ ID NO: 2388419 - RNA, 15 nt, Bordetella pertussis
gcucgagcuggcugg

SEQ ID NO: 2388420 - RNA, 19 nt, Bordetella pertussis
gcucgagcuggcuggccag

SEQ ID NO: 2388421 - RNA, 21 nt, Bordetella pertussis
gcucgagcuggcuggccagcg

SEQ ID NO: 2388422 - RNA, 14 nt, Bordetella pertussis
gcucgaggccaggc

SEQ ID NO: 2388423 - RNA, 14 nt, Bordetella pertussis
gcucgaggcgcugg

SEQ ID NO: 2388424 - RNA, 15 nt, Bordetella pertussis
gcucgaggcgcuggc

SEQ ID NO: 2388425 - RNA, 22 nt, Bordetella pertussis
gcucgaggcgcuggcguccagc

SEQ ID NO: 2388426 - RNA, 22 nt, Bordetella pertussis
gcucgaggugcacgugggcacg

SEQ ID NO: 2388427 - RNA, 18 nt, Bordetella pertussis
gcucgaucaagggguggc

SEQ ID NO: 2388428 - RNA, 16 nt, Bordetella pertussis
gcucgaucaggcgcuc

SEQ ID NO: 2388429 - RNA, 17 nt, Bordetella pertussis
gcucgaucaggcgcucc

SEQ ID NO: 2388430 - RNA, 19 nt, Bordetella pertussis
gcucgaucaggcgcuccau

SEQ ID NO: 2388431 - RNA, 16 nt, Bordetella pertussis
gcucgaucggauagcg

SEQ ID NO: 2388432 - RNA, 22 nt, Bordetella pertussis
gcucgaucuucucgacggcgcg

SEQ ID NO: 2388433 - RNA, 17 nt, Bordetella pertussis
gcucgaugaccagcagc

SEQ ID NO: 2388434 - RNA, 21 nt, Bordetella pertussis
gcucgaugcaauagcgcccgc

SEQ ID NO: 2388435 - RNA, 15 nt, Bordetella pertussis
gcucgaugccggccu

SEQ ID NO: 2388436 - RNA, 22 nt, Bordetella pertussis
gcucgaugccggccucggccau

SEQ ID NO: 2388437 - RNA, 12 nt, Bordetella pertussis
gcucgaugcgcc

SEQ ID NO: 2388438 - RNA, 15 nt, Bordetella pertussis
gcucgaugcgccagu

SEQ ID NO: 2388439 - RNA, 15 nt, Bordetella pertussis
gcucgauggcuucgc

SEQ ID NO: 2388440 - RNA, 21 nt, Bordetella pertussis
gcucgauggcuucgcgcacau

SEQ ID NO: 2388441 - RNA, 23 nt, Bordetella pertussis
gcucgauggcuucgcgcacaucc

SEQ ID NO: 2388442 - RNA, 16 nt, Bordetella pertussis
gcucgcaggccugcug

SEQ ID NO: 2388443 - RNA, 22 nt, Bordetella pertussis
gcucgcaggccugcugcagcgu

SEQ ID NO: 2388444 - RNA, 19 nt, Bordetella pertussis
gcucgcccacauagcggcc

SEQ ID NO: 2388445 - RNA, 20 nt, Bordetella pertussis
gcucgcccacauagcggccg

SEQ ID NO: 2388446 - RNA, 21 nt, Bordetella pertussis
gcucgcccacauagcggccgg

SEQ ID NO: 2388447 - RNA, 22 nt, Bordetella pertussis
gcucgcccacauagcggccggc

SEQ ID NO: 2388448 - RNA, 13 nt, Bordetella pertussis
gcucgcccagcac

SEQ ID NO: 2388449 - RNA, 18 nt, Bordetella pertussis
gcucgcccagcaccucga

SEQ ID NO: 2388450 - RNA, 16 nt, Bordetella pertussis
gcucgcccagccgccu

SEQ ID NO: 2388451 - RNA, 17 nt, Bordetella pertussis
gcucgcccagccgccug

SEQ ID NO: 2388452 - RNA, 20 nt, Bordetella pertussis
gcucgcccagccgccugagc

SEQ ID NO: 2388453 - RNA, 20 nt, Bordetella pertussis
gcucgccccggcgcgcagcg

SEQ ID NO: 2388454 - RNA, 13 nt, Bordetella pertussis
gcucgcccggcca

SEQ ID NO: 2388455 - RNA, 21 nt, Bordetella pertussis
gcucgcccucgcgccaccaug

SEQ ID NO: 2388456 - RNA, 16 nt, Bordetella pertussis
gcucgcccuugagcac

SEQ ID NO: 2388457 - RNA, 17 nt, Bordetella pertussis
gcucgccgagccgggcc

SEQ ID NO: 2388458 - RNA, 13 nt, Bordetella pertussis
gcucgccgcgcac

SEQ ID NO: 2388459 - RNA, 17 nt, Bordetella pertussis
gcucgccgcgcacgggc

SEQ ID NO: 2388460 - RNA, 20 nt, Bordetella pertussis
gcucgccgcgcgacagccgc

SEQ ID NO: 2388461 - RNA, 18 nt, Bordetella pertussis
gcucgccgcuccggcaug

SEQ ID NO: 2388462 - RNA, 13 nt, Bordetella pertussis
gcucgccggccag

SEQ ID NO: 2388463 - RNA, 15 nt, Bordetella pertussis
gcucgccggccagcg

SEQ ID NO: 2388464 - RNA, 17 nt, Bordetella pertussis
gcucgccggccagcgcg

SEQ ID NO: 2388465 - RNA, 14 nt, Bordetella pertussis
gcucgccggcgaug

SEQ ID NO: 2388466 - RNA, 18 nt, Bordetella pertussis
gcucgccggcgauggcgu

SEQ ID NO: 2388467 - RNA, 15 nt, Bordetella pertussis
gcucgccggcgccgc

SEQ ID NO: 2388468 - RNA, 18 nt, Bordetella pertussis
gcucgccggcgccgcccc

SEQ ID NO: 2388469 - RNA, 13 nt, Bordetella pertussis
gcucgccggcgcg

SEQ ID NO: 2388470 - RNA, 14 nt, Bordetella pertussis
gcucgccggcgcgc

SEQ ID NO: 2388471 - RNA, 15 nt, Bordetella pertussis
gcucgccggcgcgca

SEQ ID NO: 2388472 - RNA, 15 nt, Bordetella pertussis
gcucgccgucgacgc

SEQ ID NO: 2388473 - RNA, 17 nt, Bordetella pertussis
gcucgccgucgacgccg

SEQ ID NO: 2388474 - RNA, 17 nt, Bordetella pertussis
gcucgccuccccaggcc

SEQ ID NO: 2388475 - RNA, 17 nt, Bordetella pertussis
gcucgccucgaugaagg

SEQ ID NO: 2388476 - RNA, 18 nt, Bordetella pertussis
gcucgccucgaugaaggu

SEQ ID NO: 2388477 - RNA, 18 nt, Bordetella pertussis
gcucgccuucgcgaucca

SEQ ID NO: 2388478 - RNA, 20 nt, Bordetella pertussis
gcucgccuucgcgauccagc

SEQ ID NO: 2388479 - RNA, 23 nt, Bordetella pertussis
gcucgcgcaacgcaugcgcgauc

SEQ ID NO: 2388480 - RNA, 14 nt, Bordetella pertussis
gcucgcgcacagcg

SEQ ID NO: 2388481 - RNA, 16 nt, Bordetella pertussis
gcucgcgcacagcgcg

SEQ ID NO: 2388482 - RNA, 20 nt, Bordetella pertussis
gcucgcgcacagcgcgcaac

SEQ ID NO: 2388483 - RNA, 21 nt, Bordetella pertussis
gcucgcgcagcguggcggcga

SEQ ID NO: 2388484 - RNA, 18 nt, Bordetella pertussis
gcucgcgcaugucccgca

SEQ ID NO: 2388485 - RNA, 13 nt, Bordetella pertussis
gcucgcgccaggc

SEQ ID NO: 2388486 - RNA, 14 nt, Bordetella pertussis
gcucgcgccaggcc

SEQ ID NO: 2388487 - RNA, 15 nt, Bordetella pertussis
gcucgcgccaggccc

SEQ ID NO: 2388488 - RNA, 23 nt, Bordetella pertussis
gcucgcgccaggccccgccgggc

SEQ ID NO: 2388489 - RNA, 21 nt, Bordetella pertussis
gcucgcgcccaucucggccgc

SEQ ID NO: 2388490 - RNA, 16 nt, Bordetella pertussis
gcucgcgcgcaguccu

SEQ ID NO: 2388491 - RNA, 17 nt, Bordetella pertussis
gcucgcgcgcgcgggcg

SEQ ID NO: 2388492 - RNA, 19 nt, Bordetella pertussis
gcucgcgcgcgcgggcgcg

SEQ ID NO: 2388493 - RNA, 21 nt, Bordetella pertussis
gcucgcgcgcgcgggcgcgca

SEQ ID NO: 2388494 - RNA, 15 nt, Bordetella pertussis
gcucgcgcgcgugcu

SEQ ID NO: 2388495 - RNA, 23 nt, Bordetella pertussis
gcucgcgcgcgugcucgcgcaac

SEQ ID NO: 2388496 - RNA, 17 nt, Bordetella pertussis
gcucgcgcucgcccggc

SEQ ID NO: 2388497 - RNA, 16 nt, Bordetella pertussis
gcucgcgcucggccag

SEQ ID NO: 2388498 - RNA, 18 nt, Bordetella pertussis
gcucgcgcugcgcgccgc

SEQ ID NO: 2388499 - RNA, 11 nt, Bordetella pertussis
gcucgcggccc

SEQ ID NO: 2388500 - RNA, 18 nt, Bordetella pertussis
gcucgcgggugcgcagca

SEQ ID NO: 2388501 - RNA, 19 nt, Bordetella pertussis
gcgucgauggagucgguca

SEQ ID NO: 2388502 - RNA, 18 nt, Bordetella pertussis
gcgucgauggcguacagc

SEQ ID NO: 2388503 - RNA, 20 nt, Bordetella pertussis
gcgucgauggcguacagcag

SEQ ID NO: 2388504 - RNA, 18 nt, Bordetella pertussis
gcgucgauuucgucgagc

SEQ ID NO: 2388505 - RNA, 19 nt, Bordetella pertussis
gcgucgcacuggguggcca

SEQ ID NO: 2388506 - RNA, 23 nt, Bordetella pertussis
gcgucgcacuggguggccagcgc

SEQ ID NO: 2388507 - RNA, 19 nt, Bordetella pertussis
gcgucgcccggggcggcgu

SEQ ID NO: 2388508 - RNA, 16 nt, Bordetella pertussis
gcgucgccgcgcacga

SEQ ID NO: 2388509 - RNA, 15 nt, Bordetella pertussis
gcgucgccgcgccgu

SEQ ID NO: 2388510 - RNA, 15 nt, Bordetella pertussis
gcugcagcgcugguu

SEQ ID NO: 2388511 - RNA, 21 nt, Bordetella pertussis
gcugcagcgucuggcacgcuu

SEQ ID NO: 2388512 - RNA, 23 nt, Bordetella pertussis
gcugcagcgugauggggccgggc

SEQ ID NO: 2388513 - RNA, 21 nt, Bordetella pertussis
gcugcagcugcuugcccaggc

SEQ ID NO: 2388514 - RNA, 17 nt, Bordetella pertussis
gcugcagcuugcgcgcc

SEQ ID NO: 2388515 - RNA, 16 nt, Bordetella pertussis
gcugcaggaaguccuu

SEQ ID NO: 2388516 - RNA, 21 nt, Bordetella pertussis
gcugcaggaaguccuucagcc

SEQ ID NO: 2388517 - RNA, 16 nt, Bordetella pertussis
gcugcaggaucgcggc

SEQ ID NO: 2388518 - RNA, 17 nt, Bordetella pertussis
gcugcaggaucgcggcc

SEQ ID NO: 2388519 - RNA, 20 nt, Bordetella pertussis
ggccugcuuggcgcgcagca

SEQ ID NO: 2388520 - RNA, 21 nt, Bordetella pertussis
ggccuggaagcuggccagcgg

SEQ ID NO: 2388521 - RNA, 13 nt, Bordetella pertussis
ggccuggaccuga

SEQ ID NO: 2388522 - RNA, 18 nt, Bordetella pertussis
ggccuggaccugagccag

SEQ ID NO: 2388523 - RNA, 24 nt, Bordetella pertussis
ggccuggaccugagccaggcgccc

SEQ ID NO: 2388524 - RNA, 14 nt, Bordetella pertussis
ggccuggaggccga

SEQ ID NO: 2388525 - RNA, 19 nt, Bordetella pertussis
ggccuggaggccgagcgcg

SEQ ID NO: 2388526 - RNA, 19 nt, Bordetella pertussis
ggccuggaugugcaggccg

SEQ ID NO: 2388527 - RNA, 20 nt, Bordetella pertussis
ggccuggaugugcaggccga

SEQ ID NO: 2388528 - RNA, 22 nt, Bordetella pertussis
ggccuggcacaucggcccuggc

SEQ ID NO: 2388529 - RNA, 21 nt, Bordetella pertussis
ggccuggcccagcuccagcug

SEQ ID NO: 2388530 - RNA, 23 nt, Bordetella pertussis
ggccuggcccagcuccagcuggc

SEQ ID NO: 2388531 - RNA, 17 nt, Bordetella pertussis
ggccuggccccaggcgc

SEQ ID NO: 2388532 - RNA, 18 nt, Bordetella pertussis
ggccuggccccaggcgcc

SEQ ID NO: 2388533 - RNA, 16 nt, Bordetella pertussis
ggccuggccccgcgcg

SEQ ID NO: 2388534 - RNA, 17 nt, Bordetella pertussis
ggccuggccgccggcgg

SEQ ID NO: 2388535 - RNA, 14 nt, Bordetella pertussis
ggccuggccgcgcg

SEQ ID NO: 2388536 - RNA, 14 nt, Bordetella pertussis
ggccuggccugcgc

SEQ ID NO: 2388537 - RNA, 17 nt, Bordetella pertussis
ggccuggcgcgcaucgg

SEQ ID NO: 2388538 - RNA, 18 nt, Bordetella pertussis
ggccuggcgcgcaucggc

SEQ ID NO: 2388539 - RNA, 23 nt, Bordetella pertussis
ggccuggcgcgcaucggcgccga

SEQ ID NO: 2388540 - RNA, 15 nt, Bordetella pertussis
ggccuggcgcgcggc

SEQ ID NO: 2388541 - RNA, 20 nt, Bordetella pertussis
ggccuggcggaucucggcca

SEQ ID NO: 2388542 - RNA, 19 nt, Bordetella pertussis
ggccuggcgguaugcggcg

SEQ ID NO: 2388543 - RNA, 21 nt, Bordetella pertussis
ggccuggcgguaugcggcgcc

SEQ ID NO: 2388544 - RNA, 16 nt, Bordetella pertussis
ggccuggcguaugccc

SEQ ID NO: 2388545 - RNA, 18 nt, Bordetella pertussis
ggccuggcucaggccugc

SEQ ID NO: 2388546 - RNA, 19 nt, Bordetella pertussis
ggccuggcuuggcggccag

SEQ ID NO: 2388547 - RNA, 20 nt, Bordetella pertussis
ggccuggcuuggcggccagg

SEQ ID NO: 2388548 - RNA, 21 nt, Bordetella pertussis
ggccuggcuuggcggccagga

SEQ ID NO: 2388549 - RNA, 13 nt, Bordetella pertussis
ggccugggcgcgg

SEQ ID NO: 2388550 - RNA, 18 nt, Bordetella pertussis
ggccugggcgcgguccag

SEQ ID NO: 2388551 - RNA, 13 nt, Bordetella pertussis
ggccugggcggcg

SEQ ID NO: 2388552 - RNA, 15 nt, Bordetella pertussis
ggccugggcggcgcg

SEQ ID NO: 2388553 - RNA, 14 nt, Bordetella pertussis
ggccugggcggcgg

SEQ ID NO: 2388554 - RNA, 15 nt, Bordetella pertussis
ggccugggcggcggc

SEQ ID NO: 2388555 - RNA, 19 nt, Bordetella pertussis
ggccugggcggcggcgaug

SEQ ID NO: 2388556 - RNA, 21 nt, Bordetella pertussis
ggccugggcgggccguugcgc

SEQ ID NO: 2388557 - RNA, 17 nt, Bordetella pertussis
ggccuggggacgggcgc

SEQ ID NO: 2388558 - RNA, 23 nt, Bordetella pertussis
ggccugggugcgguaggcgcccg

SEQ ID NO: 2388559 - RNA, 16 nt, Bordetella pertussis
ggccuggguggccagc

SEQ ID NO: 2388560 - RNA, 14 nt, Bordetella pertussis
ggccuggguggccu

SEQ ID NO: 2388561 - RNA, 16 nt, Bordetella pertussis
ggccuggguggccugg

SEQ ID NO: 2388562 - RNA, 15 nt, Bordetella pertussis
ggccuggucagcgcc

SEQ ID NO: 2388563 - RNA, 17 nt, Bordetella pertussis
ggccuggucagcgccga

SEQ ID NO: 2388564 - RNA, 22 nt, Bordetella pertussis
ggccuggucaugacgggcggcg

SEQ ID NO: 2388565 - RNA, 19 nt, Bordetella pertussis
ggccuggucgagcgggcgc

SEQ ID NO: 2388566 - RNA, 23 nt, Bordetella pertussis
ggccuggucggggucggccacca

SEQ ID NO: 2388567 - RNA, 19 nt, Bordetella pertussis
ggccuggugcccgacgccg

SEQ ID NO: 2388568 - RNA, 16 nt, Bordetella pertussis
ggccugguuggccgcc

SEQ ID NO: 2388569 - RNA, 18 nt, Bordetella pertussis
ggccugguuggccgccug

SEQ ID NO: 2388570 - RNA, 19 nt, Bordetella pertussis
ggccugucacaccccacca

SEQ ID NO: 2388571 - RNA, 21 nt, Bordetella pertussis
ggccugucacaccccaccacg

SEQ ID NO: 2388572 - RNA, 16 nt, Bordetella pertussis
ggccugucugguggcg

SEQ ID NO: 2388573 - RNA, 20 nt, Bordetella pertussis
ggccugucugguggcgaucc

SEQ ID NO: 2388574 - RNA, 15 nt, Bordetella pertussis
ggccuucaccuugcc

SEQ ID NO: 2388575 - RNA, 21 nt, Bordetella pertussis
ggccuucagguucaugaccau

SEQ ID NO: 2388576 - RNA, 19 nt, Bordetella pertussis
ggccuuccaaguugcucau

SEQ ID NO: 2388577 - RNA, 13 nt, Bordetella pertussis
ggccuuccugcug

SEQ ID NO: 2388578 - RNA, 14 nt, Bordetella pertussis
ggccuuccugcuga

SEQ ID NO: 2388579 - RNA, 20 nt, Bordetella pertussis
ggccuucgacguccagcccg

SEQ ID NO: 2388580 - RNA, 14 nt, Bordetella pertussis
ggccuucgcugccc

SEQ ID NO: 2388581 - RNA, 14 nt, Bordetella pertussis
ggccuucggcggcg

SEQ ID NO: 2388582 - RNA, 15 nt, Bordetella pertussis
ggccuucggcggcgc

SEQ ID NO: 2388583 - RNA, 22 nt, Bordetella pertussis
ggccuucuugucgcuggagaac

SEQ ID NO: 2388584 - RNA, 14 nt, Bordetella pertussis
ggccuugacggcgc

SEQ ID NO: 2388585 - RNA, 21 nt, Bordetella pertussis
ggccuugagcaucugcggcac

SEQ ID NO: 2388586 - RNA, 17 nt, Bordetella pertussis
ggccuugcaugcgccgc

SEQ ID NO: 2388587 - RNA, 19 nt, Bordetella pertussis
ggccuugccgccgccgcgc

SEQ ID NO: 2388588 - RNA, 23 nt, Bordetella pertussis
ggccuugccgccgccgcgcgcgg

SEQ ID NO: 2388589 - RNA, 22 nt, Bordetella pertussis
ggccuugccgguggacggccag

SEQ ID NO: 2388590 - RNA, 14 nt, Bordetella pertussis
ggccuugcgggccg

SEQ ID NO: 2388591 - RNA, 15 nt, Bordetella pertussis
ggccuugcucgccca

SEQ ID NO: 2388592 - RNA, 23 nt, Bordetella pertussis
ggccuugcugaaccugcuggccg

SEQ ID NO: 2388593 - RNA, 13 nt, Bordetella pertussis
ggccuuggcaucg

SEQ ID NO: 2388594 - RNA, 17 nt, Bordetella pertussis
ggccuuggccagcagcg

SEQ ID NO: 2388595 - RNA, 13 nt, Bordetella pertussis
ggccuuggccugg

SEQ ID NO: 2388596 - RNA, 16 nt, Bordetella pertussis
ggccuuggccugggcc

SEQ ID NO: 2388597 - RNA, 13 nt, Bordetella pertussis
ggccuuggccuug

SEQ ID NO: 2388598 - RNA, 15 nt, Bordetella pertussis
ggccuuggccuuggc

SEQ ID NO: 2388599 - RNA, 22 nt, Bordetella pertussis
ggccuuggccuuggcggccccg

SEQ ID NO: 2388600 - RNA, 12 nt, Bordetella pertussis
ggccuuggcggc

SEQ ID NO: 2388601 - RNA, 13 nt, Bordetella pertussis
ggccuuggcggcc

SEQ ID NO: 2388602 - RNA, 19 nt, Bordetella pertussis
ggccuuggcggccccgcgu

SEQ ID NO: 2388603 - RNA, 18 nt, Bordetella pertussis
ggccuugggcgcggcggc

SEQ ID NO: 2388604 - RNA, 16 nt, Bordetella pertussis
ggccuugugcgccagc

SEQ ID NO: 2388605 - RNA, 19 nt, Bordetella pertussis
ggccuugugcgccagcgcg

SEQ ID NO: 2388606 - RNA, 14 nt, Bordetella pertussis
ggccuugugcgccg

SEQ ID NO: 2388607 - RNA, 20 nt, Bordetella pertussis
ggccuuucucaaggccgaau

SEQ ID NO: 2388608 - RNA, 15 nt, Bordetella pertussis
ggccuuugcggcagg

SEQ ID NO: 2388609 - RNA, 21 nt, Bordetella pertussis
ggccuuuuuuugcggcacggc

SEQ ID NO: 2388610 - RNA, 23 nt, Bordetella pertussis
ggcgaaaccggugaucagcaggc

SEQ ID NO: 2388611 - RNA, 17 nt, Bordetella pertussis
ggcgaaagcgucggcuu

SEQ ID NO: 2388612 - RNA, 18 nt, Bordetella pertussis
ggcgaaaggcaccgagca

SEQ ID NO: 2388613 - RNA, 14 nt, Bordetella pertussis
ggcgaaauggugcg

SEQ ID NO: 2388614 - RNA, 17 nt, Bordetella pertussis
ggcgaaauggugcggcc

SEQ ID NO: 2388615 - RNA, 18 nt, Bordetella pertussis
ggcgaaauggugcggcca

SEQ ID NO: 2388616 - RNA, 21 nt, Bordetella pertussis
ggcgaaauggugcggccauga

SEQ ID NO: 2388617 - RNA, 14 nt, Bordetella pertussis
ggcgaacagcgcgu

SEQ ID NO: 2388618 - RNA, 20 nt, Bordetella pertussis
ggcgaacaguugcaccagug

SEQ ID NO: 2388619 - RNA, 16 nt, Bordetella pertussis
ggcgaacauggccgag

SEQ ID NO: 2388620 - RNA, 17 nt, Bordetella pertussis
ggcgaacauggccgaga

SEQ ID NO: 2388621 - RNA, 15 nt, Bordetella pertussis
ggcgaaccgcggcgc

SEQ ID NO: 2388622 - RNA, 18 nt, Bordetella pertussis
ggcgaaccgcggcgcagg

SEQ ID NO: 2388623 - RNA, 19 nt, Bordetella pertussis
ggcgaaccgcggcgcaggu

SEQ ID NO: 2388624 - RNA, 13 nt, Bordetella pertussis
ggcgaaccuggcg

SEQ ID NO: 2388625 - RNA, 19 nt, Bordetella pertussis
ggcgaacgggguggccggc

SEQ ID NO: 2388626 - RNA, 19 nt, Bordetella pertussis
ggcgaacgugcgcgccagc

SEQ ID NO: 2388627 - RNA, 20 nt, Bordetella pertussis
ggcgaacgugcgcgccagcu

SEQ ID NO: 2388628 - RNA, 17 nt, Bordetella pertussis
ggcgaacguggccugcu

SEQ ID NO: 2388629 - RNA, 15 nt, Bordetella pertussis
ggcgaacugcucgug

SEQ ID NO: 2388630 - RNA, 23 nt, Bordetella pertussis
ggcgaacugggcgucguccugca

SEQ ID NO: 2388631 - RNA, 22 nt, Bordetella pertussis
ggcgaagaacaccgccgcgccg

SEQ ID NO: 2388632 - RNA, 20 nt, Bordetella pertussis
ggcgaagagccguacucgau

SEQ ID NO: 2388633 - RNA, 18 nt, Bordetella pertussis
ggcgcucgccccggcgcg

SEQ ID NO: 2388634 - RNA, 12 nt, Bordetella pertussis
ggcgcucgcccu

SEQ ID NO: 2388635 - RNA, 22 nt, Bordetella pertussis
ggcgcucgcccucgcgccacca

SEQ ID NO: 2388636 - RNA, 16 nt, Bordetella pertussis
ggcgcucgcgcaccgc

SEQ ID NO: 2388637 - RNA, 19 nt, Bordetella pertussis
ggcgcucgcgcaccgcaug

SEQ ID NO: 2388638 - RNA, 14 nt, Bordetella pertussis
ggcgcucgcgccca

SEQ ID NO: 2388639 - RNA, 17 nt, Bordetella pertussis
ggcgcucgcgcgccagc

SEQ ID NO: 2388640 - RNA, 14 nt, Bordetella pertussis
ggcgcucgcgcugc

SEQ ID NO: 2388641 - RNA, 15 nt, Bordetella pertussis
ggcgcucgcgggugc

SEQ ID NO: 2388642 - RNA, 15 nt, Bordetella pertussis
ggcgcucggccagcg

SEQ ID NO: 2388643 - RNA, 15 nt, Bordetella pertussis
ggcgcucggccucga

SEQ ID NO: 2388644 - RNA, 14 nt, Bordetella pertussis
ggcgcugacgccga

SEQ ID NO: 2388645 - RNA, 14 nt, Bordetella pertussis
ggcgcugaugccgu

SEQ ID NO: 2388646 - RNA, 16 nt, Bordetella pertussis
ggcgcugcacgcagcg

SEQ ID NO: 2388647 - RNA, 12 nt, Bordetella pertussis
ggcgcugcagcg

SEQ ID NO: 2388648 - RNA, 13 nt, Bordetella pertussis
ggcgcugcagcgc

SEQ ID NO: 2388649 - RNA, 19 nt, Bordetella pertussis
ggcgcugccgaccagcacg

SEQ ID NO: 2388650 - RNA, 22 nt, Bordetella pertussis
ggcgcugccgggguccuuggag

SEQ ID NO: 2388651 - RNA, 16 nt, Bordetella pertussis
ggcgcugcgcagcagg

SEQ ID NO: 2388652 - RNA, 18 nt, Bordetella pertussis
ggcgcugcgcagcagggc

SEQ ID NO: 2388653 - RNA, 16 nt, Bordetella pertussis
ggcgcugcgccggcgg

SEQ ID NO: 2388654 - RNA, 12 nt, Bordetella pertussis
ggcgcugcgcga

SEQ ID NO: 2388655 - RNA, 14 nt, Bordetella pertussis
ggcgcugcggucgc

SEQ ID NO: 2388656 - RNA, 19 nt, Bordetella pertussis
ggcgcugcggucgcgaucg

SEQ ID NO: 2388657 - RNA, 17 nt, Bordetella pertussis
ggcgcugcucgaaacgc

SEQ ID NO: 2388658 - RNA, 19 nt, Bordetella pertussis
ggcgcugcugcuggcugcc

SEQ ID NO: 2388659 - RNA, 14 nt, Bordetella pertussis
ggcgcugcuggccg

SEQ ID NO: 2388660 - RNA, 20 nt, Bordetella pertussis
ggcgcugcuggccggccagc

SEQ ID NO: 2388661 - RNA, 19 nt, Bordetella pertussis
ggcgcugcugucgcgcgac

SEQ ID NO: 2388662 - RNA, 20 nt, Bordetella pertussis
ggcgcuggauggcucgggca

SEQ ID NO: 2388663 - RNA, 22 nt, Bordetella pertussis
ggcgcuggauggcucgggcagc

SEQ ID NO: 2388664 - RNA, 23 nt, Bordetella pertussis
ggcgcuggauggcucgggcagca

SEQ ID NO: 2388665 - RNA, 14 nt, Bordetella pertussis
ggcgcuggccgcca

SEQ ID NO: 2388666 - RNA, 15 nt, Bordetella pertussis
ggcgcuggccgccau

SEQ ID NO: 2388667 - RNA, 21 nt, Bordetella pertussis
ggcgcuggccgcccgcggccu

SEQ ID NO: 2388668 - RNA, 14 nt, Bordetella pertussis
ggcgcuggccggcg

SEQ ID NO: 2388669 - RNA, 17 nt, Bordetella pertussis
ggcgcuggccugccgcg

SEQ ID NO: 2388670 - RNA, 21 nt, Bordetella pertussis
ggcgcuggccugccgcgccga

SEQ ID NO: 2388671 - RNA, 14 nt, Bordetella pertussis
ggcgcuggccuggc

SEQ ID NO: 2388672 - RNA, 18 nt, Bordetella pertussis
ggcgcuggccuggccgcc

SEQ ID NO: 2388673 - RNA, 19 nt, Bordetella pertussis
ggcgcuggccuggccgccg

SEQ ID NO: 2388674 - RNA, 20 nt, Bordetella pertussis
ggcgcuggccuggccgccgg

SEQ ID NO: 2388675 - RNA, 21 nt, Bordetella pertussis
ggcgcuggccuggccgccggc

SEQ ID NO: 2388676 - RNA, 22 nt, Bordetella pertussis
ggcgcuggccuggccgccggcg

SEQ ID NO: 2388677 - RNA, 14 nt, Bordetella pertussis
ggcgcuggcgaaga

SEQ ID NO: 2388678 - RNA, 19 nt, Bordetella pertussis
ggcgcuggcgcauggcugg

SEQ ID NO: 2388679 - RNA, 17 nt, Bordetella pertussis
ggcgcuggcgccgcgcg

SEQ ID NO: 2388680 - RNA, 21 nt, Bordetella pertussis
ggcgcuggcgccgcgcgccau

SEQ ID NO: 2388681 - RNA, 12 nt, Bordetella pertussis
ggcgcuggcgcg

SEQ ID NO: 2388682 - RNA, 16 nt, Bordetella pertussis
ggcgcuggcgcgcggc

SEQ ID NO: 2388683 - RNA, 18 nt, Bordetella pertussis
ggcgcuggcgcgcggcug

SEQ ID NO: 2388684 - RNA, 13 nt, Bordetella pertussis
ggcgcuggcggcu

SEQ ID NO: 2388685 - RNA, 18 nt, Bordetella pertussis
ggcgcuggcguucagcgg

SEQ ID NO: 2388686 - RNA, 22 nt, Bordetella pertussis
ggcgcuggcguucagcgggcgc

SEQ ID NO: 2388687 - RNA, 23 nt, Bordetella pertussis
ggcgcuggcguucagcgggcgcg

SEQ ID NO: 2388688 - RNA, 22 nt, Bordetella pertussis
ggcgcuggcuggacgcgcgcgg

SEQ ID NO: 2388689 - RNA, 24 nt, Bordetella pertussis
ggcgcuggcuggacgcgcgcggcg

SEQ ID NO: 2388690 - RNA, 18 nt, Bordetella pertussis
ggcgcugggcaggcuggc

SEQ ID NO: 2388691 - RNA, 22 nt, Bordetella pertussis
ggcgcugggcaggcuggcgcgg

SEQ ID NO: 2388692 - RNA, 16 nt, Bordetella pertussis
ggcgcuggggaagcgc

SEQ ID NO: 2388693 - RNA, 17 nt, Bordetella pertussis
ggcgcuggggaagcgcu

SEQ ID NO: 2388694 - RNA, 19 nt, Bordetella pertussis
ggcgcuggucaaccuggug

SEQ ID NO: 2388695 - RNA, 20 nt, Bordetella pertussis
ggcgcuggucaaccuggugu

SEQ ID NO: 2388696 - RNA, 16 nt, Bordetella pertussis
ggcgcuguccggcgcu

SEQ ID NO: 2388697 - RNA, 18 nt, Bordetella pertussis
ggcgcuguccggcgcucg

SEQ ID NO: 2388698 - RNA, 21 nt, Bordetella pertussis
ggcgcuguccggcgcucgccc

SEQ ID NO: 2388699 - RNA, 12 nt, Bordetella pertussis
ggcgcugugcaa

SEQ ID NO: 2388700 - RNA, 24 nt, Bordetella pertussis
ggcgcuguucgauacggccacgca

SEQ ID NO: 2388701 - RNA, 22 nt, Bordetella pertussis
ggcgcuguuggccggcgcgccc

SEQ ID NO: 2388702 - RNA, 23 nt, Bordetella pertussis
ggcgcuguuggccggcgcgcccu

SEQ ID NO: 2388703 - RNA, 18 nt, Bordetella pertussis
ggcgcuguuggccgucgc

SEQ ID NO: 2388704 - RNA, 20 nt, Bordetella pertussis
ggcgcuguuucccuuccugg

SEQ ID NO: 2388705 - RNA, 23 nt, Bordetella pertussis
ggcgcuguuucccuuccuggcca

SEQ ID NO: 2388706 - RNA, 19 nt, Bordetella pertussis
ggcgcuguuuccgggccug

SEQ ID NO: 2388707 - RNA, 20 nt, Bordetella pertussis
ggcgcuguuuccgggccugg

SEQ ID NO: 2388708 - RNA, 18 nt, Bordetella pertussis
ggcgcuuaccgcgccggc

SEQ ID NO: 2388709 - RNA, 23 nt, Bordetella pertussis
ggcgcuucgucggccgccagcca

SEQ ID NO: 2388710 - RNA, 23 nt, Bordetella pertussis
ggcgcuugcgcagggcgggcggu

SEQ ID NO: 2388711 - RNA, 20 nt, Bordetella pertussis
ggcgcuuggcccugcagcgg

SEQ ID NO: 2388712 - RNA, 17 nt, Bordetella pertussis
ggcgcuuuccgagccgg

SEQ ID NO: 2388713 - RNA, 23 nt, Bordetella pertussis
ggcgcuuuccgagccggugggcg

SEQ ID NO: 2388714 - RNA, 22 nt, Bordetella pertussis
ggcggaaaacagcaccagcaug

SEQ ID NO: 2388715 - RNA, 12 nt, Bordetella pertussis
ggcggaaucuug

SEQ ID NO: 2388716 - RNA, 18 nt, Bordetella pertussis
ggcggacacgcaugcagg

SEQ ID NO: 2388717 - RNA, 12 nt, Bordetella pertussis
ggcggacacgcc

SEQ ID NO: 2388718 - RNA, 14 nt, Bordetella pertussis
ggcggacacgcccu

SEQ ID NO: 2388719 - RNA, 17 nt, Bordetella pertussis
ggcggacgauggccugu

SEQ ID NO: 2388720 - RNA, 16 nt, Bordetella pertussis
ggcggacugcgccgca

SEQ ID NO: 2388721 - RNA, 18 nt, Bordetella pertussis
ggcggacuggccgcgccg

SEQ ID NO: 2388722 - RNA, 16 nt, Bordetella pertussis
ggcggaucacccagcg

SEQ ID NO: 2388723 - RNA, 20 nt, Bordetella pertussis
ggcggaucgaacgccucggg

SEQ ID NO: 2388724 - RNA, 22 nt, Bordetella pertussis
ggcggaucgaacgccucgggcg

SEQ ID NO: 2388725 - RNA, 15 nt, Bordetella pertussis
ggcggaucucggcca

SEQ ID NO: 2388726 - RNA, 18 nt, Bordetella pertussis
ggcggaucucggccagca

SEQ ID NO: 2388727 - RNA, 23 nt, Bordetella pertussis
ggcggaucucggccagcagcgcc

SEQ ID NO: 2388728 - RNA, 17 nt, Bordetella pertussis
ggcggaucuucccgcca

SEQ ID NO: 2388729 - RNA, 19 nt, Bordetella pertussis
ggcggaucuucccgccaug

SEQ ID NO: 2388730 - RNA, 15 nt, Bordetella pertussis
ggcggauucaggcga

SEQ ID NO: 2388731 - RNA, 16 nt, Bordetella pertussis
ggcggauuugcucgcg

SEQ ID NO: 2388732 - RNA, 23 nt, Bordetella pertussis
ggcggcaaaaaaaaccgcgcgcc

SEQ ID NO: 2388733 - RNA, 24 nt, Bordetella pertussis
ggcggcaaaaaaaaccgcgcgccg

SEQ ID NO: 2388734 - RNA, 18 nt, Bordetella pertussis
ggcggcaaagucggggcg

SEQ ID NO: 2388735 - RNA, 21 nt, Bordetella pertussis
ggcggcaaagucggggcgccg

SEQ ID NO: 2388736 - RNA, 23 nt, Bordetella pertussis
ggcggcaaagucggggcgccggu

SEQ ID NO: 2388737 - RNA, 17 nt, Bordetella pertussis
ggcggcaacgugcaggc

SEQ ID NO: 2388738 - RNA, 14 nt, Bordetella pertussis
ggcggcaagcagcc

SEQ ID NO: 2388739 - RNA, 15 nt, Bordetella pertussis
ggcggcaagcggcgu

SEQ ID NO: 2388740 - RNA, 18 nt, Bordetella pertussis
ggcggcaagcggcguggg

SEQ ID NO: 2388741 - RNA, 21 nt, Bordetella pertussis
ggcggcaagcggcguggggcc

SEQ ID NO: 2388742 - RNA, 14 nt, Bordetella pertussis
ggcggcaauuucgc

SEQ ID NO: 2388743 - RNA, 14 nt, Bordetella pertussis
ggcggcaccagcag

SEQ ID NO: 2388744 - RNA, 19 nt, Bordetella pertussis
ggcggcaccagcaggccgg

SEQ ID NO: 2388745 - RNA, 19 nt, Bordetella pertussis
ggcggcaccauugccggcg

SEQ ID NO: 2388746 - RNA, 21 nt, Bordetella pertussis
ggcggcaccauugccggcgcg

SEQ ID NO: 2388747 - RNA, 21 nt, Bordetella pertussis
ggcgggcccgcaucgcgcgcc

SEQ ID NO: 2388748 - RNA, 22 nt, Bordetella pertussis
ggcgggcccgcaucgcgcgccg

SEQ ID NO: 2388749 - RNA, 12 nt, Bordetella pertussis
ggcgggccgagg

SEQ ID NO: 2388750 - RNA, 13 nt, Bordetella pertussis
ggcgggccgaggc

SEQ ID NO: 2388751 - RNA, 13 nt, Bordetella pertussis
ggcgggccgcaug

SEQ ID NO: 2388752 - RNA, 12 nt, Bordetella pertussis
ggcgggccgcgc

SEQ ID NO: 2388753 - RNA, 13 nt, Bordetella pertussis
ggcgggccgcgcc

SEQ ID NO: 2388754 - RNA, 12 nt, Bordetella pertussis
ggcgggccggcu

SEQ ID NO: 2388755 - RNA, 20 nt, Bordetella pertussis
ggcgggccguugcgccugcc

SEQ ID NO: 2388756 - RNA, 21 nt, Bordetella pertussis
ggcgggccugggcgucgagcg

SEQ ID NO: 2388757 - RNA, 22 nt, Bordetella pertussis
ggcgggcgagaucagccaccgg

SEQ ID NO: 2388758 - RNA, 16 nt, Bordetella pertussis
ggcgggcgccgcgccc

SEQ ID NO: 2388759 - RNA, 20 nt, Bordetella pertussis
ggcgggcgccugcggcaggc

SEQ ID NO: 2388760 - RNA, 24 nt, Bordetella pertussis
ggcgggcgccugcggcaggccgca

SEQ ID NO: 2388761 - RNA, 13 nt, Bordetella pertussis
ggcgggcgcugcg

SEQ ID NO: 2388762 - RNA, 13 nt, Bordetella pertussis
ggcgggcgcuggc

SEQ ID NO: 2388763 - RNA, 23 nt, Bordetella pertussis
ggcgggcggccggcgcgucgccg

SEQ ID NO: 2388764 - RNA, 13 nt, Bordetella pertussis
ggcgggcggcgcc

SEQ ID NO: 2388765 - RNA, 15 nt, Bordetella pertussis
ggcgggcggcgccag

SEQ ID NO: 2388766 - RNA, 23 nt, Bordetella pertussis
ggcgggcgugaugccgaccaggc

SEQ ID NO: 2388767 - RNA, 17 nt, Bordetella pertussis
ggcgggcgugcggaugg

SEQ ID NO: 2388768 - RNA, 18 nt, Bordetella pertussis
ggcgggcuagcugugaac

SEQ ID NO: 2388769 - RNA, 12 nt, Bordetella pertussis
ggcgggcucagc

SEQ ID NO: 2388770 - RNA, 14 nt, Bordetella pertussis
ggcgggcucagccc

SEQ ID NO: 2388771 - RNA, 15 nt, Bordetella pertussis
ggcgggcucgagcug

SEQ ID NO: 2388772 - RNA, 15 nt, Bordetella pertussis
ggcgggcucggcgcc

SEQ ID NO: 2388773 - RNA, 16 nt, Bordetella pertussis
ggcgggcucggcgccg

SEQ ID NO: 2388774 - RNA, 14 nt, Bordetella pertussis
ggcgggcuggucgc

SEQ ID NO: 2388775 - RNA, 17 nt, Bordetella pertussis
ggcggggaauucgaccg

SEQ ID NO: 2388776 - RNA, 11 nt, Bordetella pertussis
ggcggggacag

SEQ ID NO: 2388777 - RNA, 16 nt, Bordetella pertussis
ggcggggacaggcgcc

SEQ ID NO: 2388778 - RNA, 12 nt, Bordetella pertussis
ggcggggccaca

SEQ ID NO: 2388779 - RNA, 14 nt, Bordetella pertussis
ggcggggcgcauca

SEQ ID NO: 2388780 - RNA, 21 nt, Bordetella pertussis
ggcggggcgcgccgggccuag

SEQ ID NO: 2388781 - RNA, 19 nt, Bordetella pertussis
ggcggggcguucgacgggc

SEQ ID NO: 2388782 - RNA, 15 nt, Bordetella pertussis
ggcggggcuggcgcg

SEQ ID NO: 2388783 - RNA, 22 nt, Bordetella pertussis
ggcggggcuggcgcggcuggcg

SEQ ID NO: 2388784 - RNA, 15 nt, Bordetella pertussis
ggcgggggacgcccg

SEQ ID NO: 2388785 - RNA, 17 nt, Bordetella pertussis
ggcgggguuggccgcca

SEQ ID NO: 2388786 - RNA, 15 nt, Bordetella pertussis
ggcgggucggcgaac

SEQ ID NO: 2388787 - RNA, 16 nt, Bordetella pertussis
ggcgggucggcgaaca

SEQ ID NO: 2388788 - RNA, 19 nt, Bordetella pertussis
ggcgggugcugcagcgcac

SEQ ID NO: 2388789 - RNA, 20 nt, Bordetella pertussis
ggcgggugcugcagcgcacc

SEQ ID NO: 2388790 - RNA, 20 nt, Bordetella pertussis
ggcggguucagucgucgccg

SEQ ID NO: 2388791 - RNA, 22 nt, Bordetella pertussis
ggcggguucgcuggggcugccg

SEQ ID NO: 2388792 - RNA, 18 nt, Bordetella pertussis
ggcggguugugcccgccc

SEQ ID NO: 2388793 - RNA, 17 nt, Bordetella pertussis
ggcggguuucucggccu

SEQ ID NO: 2388794 - RNA, 22 nt, Bordetella pertussis
ggcgguaagcguccgcgcgccg

SEQ ID NO: 2388795 - RNA, 19 nt, Bordetella pertussis
ggcgguacaggccggcggc

SEQ ID NO: 2388796 - RNA, 20 nt, Bordetella pertussis
ggcgguacaggccggcggcg

SEQ ID NO: 2388797 - RNA, 16 nt, Bordetella pertussis
ggcgguaccaggccga

SEQ ID NO: 2388798 - RNA, 17 nt, Bordetella pertussis
ggcgguaugcggcgccc

SEQ ID NO: 2388799 - RNA, 18 nt, Bordetella pertussis
ggcggucaaugcggcggc

SEQ ID NO: 2388800 - RNA, 19 nt, Bordetella pertussis
ggcggucaaugcggcggcg

SEQ ID NO: 2388801 - RNA, 22 nt, Bordetella pertussis
ggcggucaaugcggcggcgcug

SEQ ID NO: 2388802 - RNA, 23 nt, Bordetella pertussis
ggcggucaaugcggcggcgcugg

SEQ ID NO: 2388803 - RNA, 12 nt, Bordetella pertussis
ggcggucacgcc

SEQ ID NO: 2388804 - RNA, 15 nt, Bordetella pertussis
ggcggucacgccgau

SEQ ID NO: 2388805 - RNA, 20 nt, Bordetella pertussis
ggcggucauagacggcgucg

SEQ ID NO: 2388806 - RNA, 16 nt, Bordetella pertussis
ggcgguccacagcccg

SEQ ID NO: 2388807 - RNA, 18 nt, Bordetella pertussis
ggcgguccgguucgccca

SEQ ID NO: 2388808 - RNA, 17 nt, Bordetella pertussis
ggcgguccugcugaucc

SEQ ID NO: 2388809 - RNA, 17 nt, Bordetella pertussis
ggcgguccugguugaag

SEQ ID NO: 2388810 - RNA, 15 nt, Bordetella pertussis
ggcggucgaggcgca

SEQ ID NO: 2388811 - RNA, 14 nt, Bordetella pertussis
ggcggucgcgcugg

SEQ ID NO: 2388812 - RNA, 17 nt, Bordetella pertussis
ggcggucgcgcuggccc

SEQ ID NO: 2388813 - RNA, 13 nt, Bordetella pertussis
ggcggucggcgcg

SEQ ID NO: 2388814 - RNA, 21 nt, Bordetella pertussis
ggcggucuccgguucggcgcg

SEQ ID NO: 2388815 - RNA, 23 nt, Bordetella pertussis
ggcggucuguuuuuuugggggcc

SEQ ID NO: 2388816 - RNA, 22 nt, Bordetella pertussis
ggcggucuucacauagcccggc

SEQ ID NO: 2388817 - RNA, 22 nt, Bordetella pertussis
ggcggucuucgaugcuggcgcg

SEQ ID NO: 2388818 - RNA, 16 nt, Bordetella pertussis
ggcggugaccaccagg

SEQ ID NO: 2388819 - RNA, 17 nt, Bordetella pertussis
ggcggugaccaccaggc

SEQ ID NO: 2388820 - RNA, 18 nt, Bordetella pertussis
ggcggugaccaccaggcc

SEQ ID NO: 2388821 - RNA, 21 nt, Bordetella pertussis
ggcggugaccaccaggccgcc

SEQ ID NO: 2388822 - RNA, 17 nt, Bordetella pertussis
ggcggugaccaugcgca

SEQ ID NO: 2388823 - RNA, 16 nt, Bordetella pertussis
ggcggugaucugcucg

SEQ ID NO: 2388824 - RNA, 16 nt, Bordetella pertussis
ggcggugaugucgccg

SEQ ID NO: 2388825 - RNA, 17 nt, Bordetella pertussis
ggcggugaugucgccgg

SEQ ID NO: 2388826 - RNA, 15 nt, Bordetella pertussis
ggcggugccgcgcac

SEQ ID NO: 2388827 - RNA, 16 nt, Bordetella pertussis
ggcggugcgccgcaug

SEQ ID NO: 2388828 - RNA, 20 nt, Bordetella pertussis
ggcggugcgcucgaagcgca

SEQ ID NO: 2388829 - RNA, 18 nt, Bordetella pertussis
ggcggugcucgaggugca

SEQ ID NO: 2388830 - RNA, 21 nt, Bordetella pertussis
ggcggugcugaacgccucggg

SEQ ID NO: 2388831 - RNA, 13 nt, Bordetella pertussis
ggcgguggccagc

SEQ ID NO: 2388832 - RNA, 16 nt, Bordetella pertussis
ggcgguggccagcgug

SEQ ID NO: 2388833 - RNA, 21 nt, Bordetella pertussis
ggcgguggccgcgcaugccag

SEQ ID NO: 2388834 - RNA, 13 nt, Bordetella pertussis
ggcgguggccucg

SEQ ID NO: 2388835 - RNA, 15 nt, Bordetella pertussis
ggcgguggcuuggcg

SEQ ID NO: 2388836 - RNA, 16 nt, Bordetella pertussis
ggcgguggcuuggcgc

SEQ ID NO: 2388837 - RNA, 19 nt, Bordetella pertussis
ggcgguggucaucgaugcg

SEQ ID NO: 2388838 - RNA, 23 nt, Bordetella pertussis
ggcgguggucaucgaugcgccgc

SEQ ID NO: 2388839 - RNA, 20 nt, Bordetella pertussis
ggcgguguagaccaccagca

SEQ ID NO: 2388840 - RNA, 21 nt, Bordetella pertussis
ggcgguguagaccaccagcag

SEQ ID NO: 2388841 - RNA, 15 nt, Bordetella pertussis
ggcgguguucgcguc

SEQ ID NO: 2388842 - RNA, 20 nt, Bordetella pertussis
ggcgguuccagccuggcaau

SEQ ID NO: 2388843 - RNA, 23 nt, Bordetella pertussis
ggcgguucguccucgucggccau

SEQ ID NO: 2388844 - RNA, 22 nt, Bordetella pertussis
ggcgguuguugcccaccgccag

SEQ ID NO: 2388845 - RNA, 16 nt, Bordetella pertussis
ggcgguuucggccggg

SEQ ID NO: 2388846 - RNA, 20 nt, Bordetella pertussis
ggcgguuuuucuuuggccgc

SEQ ID NO: 2388847 - RNA, 15 nt, Bordetella pertussis
ggcguaaggccgccg

SEQ ID NO: 2388848 - RNA, 17 nt, Bordetella pertussis
ggcguaaggccgccggc

SEQ ID NO: 2388849 - RNA, 16 nt, Bordetella pertussis
ggcguaaggcugcagc

SEQ ID NO: 2388850 - RNA, 17 nt, Bordetella pertussis
ggcguaauagcuggcgg

SEQ ID NO: 2388851 - RNA, 17 nt, Bordetella pertussis
ggcguaauugggcuggu

SEQ ID NO: 2388852 - RNA, 23 nt, Bordetella pertussis
ggcguaauugggcugguagggga

SEQ ID NO: 2388853 - RNA, 18 nt, Bordetella pertussis
ggcguaccaggcagccgg

SEQ ID NO: 2388854 - RNA, 15 nt, Bordetella pertussis
ggcguaccgguccag

SEQ ID NO: 2388855 - RNA, 15 nt, Bordetella pertussis
ggcguacggcgcggu

SEQ ID NO: 2388856 - RNA, 14 nt, Bordetella pertussis
ggcguacggcugca

SEQ ID NO: 2388857 - RNA, 17 nt, Bordetella pertussis
ggcguacuggcgcggcg

SEQ ID NO: 2388858 - RNA, 21 nt, Bordetella pertussis
ggcguagaaagccagugccuc

SEQ ID NO: 2388859 - RNA, 17 nt, Bordetella pertussis
ggcguagaccaccugcu

SEQ ID NO: 2388860 - RNA, 18 nt, Bordetella pertussis
ggcguagagcagugugcc

SEQ ID NO: 2388861 - RNA, 13 nt, Bordetella pertussis
ggcguagagcgcc

SEQ ID NO: 2388862 - RNA, 12 nt, Bordetella pertussis
ggcggcaccgcg

SEQ ID NO: 2388863 - RNA, 16 nt, Bordetella pertussis
ggcggcacgcgcgccg

SEQ ID NO: 2388864 - RNA, 14 nt, Bordetella pertussis
ggcggcacgcugcg

SEQ ID NO: 2388865 - RNA, 17 nt, Bordetella pertussis
ggcggcacgcugcgcag

SEQ ID NO: 2388866 - RNA, 22 nt, Bordetella pertussis
ggcggcacgcugcgcaggcgcg

SEQ ID NO: 2388867 - RNA, 15 nt, Bordetella pertussis
ggcggcacgguggcg

SEQ ID NO: 2388868 - RNA, 23 nt, Bordetella pertussis
ggcggcagccggccauggccgcc

SEQ ID NO: 2388869 - RNA, 18 nt, Bordetella pertussis
ggcggcagcuugaccgcc

SEQ ID NO: 2388870 - RNA, 13 nt, Bordetella pertussis
ggcggcaggcgcc

SEQ ID NO: 2388871 - RNA, 14 nt, Bordetella pertussis
ggcggcaggcgccg

SEQ ID NO: 2388872 - RNA, 13 nt, Bordetella pertussis
ggcggcaggucgc

SEQ ID NO: 2388873 - RNA, 19 nt, Bordetella pertussis
ggcggcaggucgcgcgacg

SEQ ID NO: 2388874 - RNA, 22 nt, Bordetella pertussis
ggcggcaggugcgccagcacgg

SEQ ID NO: 2388875 - RNA, 16 nt, Bordetella pertussis
ggcggcaugcgccagc

SEQ ID NO: 2388876 - RNA, 21 nt, Bordetella pertussis
ggcggcaugcgccagccagcg

SEQ ID NO: 2388877 - RNA, 18 nt, Bordetella pertussis
ggcggccaccaccaggcc

SEQ ID NO: 2388878 - RNA, 20 nt, Bordetella pertussis
ggcggccaccaccaggccca

SEQ ID NO: 2388879 - RNA, 17 nt, Bordetella pertussis
ggcggccacgaccggcu

SEQ ID NO: 2388880 - RNA, 13 nt, Bordetella pertussis
ggcggccagcagc

SEQ ID NO: 2388881 - RNA, 16 nt, Bordetella pertussis
ggcggccagcagcggc

SEQ ID NO: 2388882 - RNA, 17 nt, Bordetella pertussis
ggcggccagcaugcugg

SEQ ID NO: 2388883 - RNA, 15 nt, Bordetella pertussis
ggcggccagcgcgca

SEQ ID NO: 2388884 - RNA, 23 nt, Bordetella pertussis
ggcggccagcuugaccgccagca

SEQ ID NO: 2388885 - RNA, 21 nt, Bordetella pertussis
ggcggccagcuuguagcggcc

SEQ ID NO: 2388886 - RNA, 14 nt, Bordetella pertussis
ggcggccaggccga

SEQ ID NO: 2388887 - RNA, 17 nt, Bordetella pertussis
ggcggccaggccggcga

SEQ ID NO: 2388888 - RNA, 17 nt, Bordetella pertussis
ggcggccaggccggcgc

SEQ ID NO: 2388889 - RNA, 18 nt, Bordetella pertussis
ggcggccaggccggcgcg

SEQ ID NO: 2388890 - RNA, 19 nt, Bordetella pertussis
ggcggccaggccggggccg

SEQ ID NO: 2388891 - RNA, 12 nt, Bordetella pertussis
ggcggccaggcg

SEQ ID NO: 2388892 - RNA, 13 nt, Bordetella pertussis
ggcggccaggcgc

SEQ ID NO: 2388893 - RNA, 14 nt, Bordetella pertussis
ggcggccaggcgcg

SEQ ID NO: 2388894 - RNA, 15 nt, Bordetella pertussis
ggcggccaggcgcgc

SEQ ID NO: 2388895 - RNA, 17 nt, Bordetella pertussis
ggcggccaggcgcgccg

SEQ ID NO: 2388896 - RNA, 14 nt, Bordetella pertussis
ggcggccaggcgua

SEQ ID NO: 2388897 - RNA, 21 nt, Bordetella pertussis
ggcggccaggcucugggcgga

SEQ ID NO: 2388898 - RNA, 22 nt, Bordetella pertussis
ggcggccagggaaggggcggcu

SEQ ID NO: 2388899 - RNA, 22 nt, Bordetella pertussis
ggcggccagggccugcgggccg

SEQ ID NO: 2388900 - RNA, 16 nt, Bordetella pertussis
ggcggccaucgccaug

SEQ ID NO: 2388901 - RNA, 18 nt, Bordetella pertussis
ggcggccaucgccauggc

SEQ ID NO: 2388902 - RNA, 22 nt, Bordetella pertussis
ggcggccaugacggccauccgg

SEQ ID NO: 2388903 - RNA, 17 nt, Bordetella pertussis
ggcggccaugcccaggc

SEQ ID NO: 2388904 - RNA, 21 nt, Bordetella pertussis
ggcggccaugcccaggcccag

SEQ ID NO: 2388905 - RNA, 23 nt, Bordetella pertussis
ggcggccaugccgucaccggcua

SEQ ID NO: 2388906 - RNA, 15 nt, Bordetella pertussis
ggcggcccacagcgc

SEQ ID NO: 2388907 - RNA, 22 nt, Bordetella pertussis
ggcggcccagcggcaaaguagu

SEQ ID NO: 2388908 - RNA, 23 nt, Bordetella pertussis
ggcggcccaggcguccaggcugc

SEQ ID NO: 2388909 - RNA, 17 nt, Bordetella pertussis
ggcggcccauucgccca

SEQ ID NO: 2388910 - RNA, 14 nt, Bordetella pertussis
ggcggcccggcggc

SEQ ID NO: 2388911 - RNA, 14 nt, Bordetella pertussis
ggcggccgaagcgc

SEQ ID NO: 2388912 - RNA, 23 nt, Bordetella pertussis
ggcggccgacagcuugcgcuggc

SEQ ID NO: 2388913 - RNA, 14 nt, Bordetella pertussis
ggcggccgaccagc

SEQ ID NO: 2388914 - RNA, 15 nt, Bordetella pertussis
ggcggccgaccagca

SEQ ID NO: 2388915 - RNA, 17 nt, Bordetella pertussis
ggcggccgaccagcacg

SEQ ID NO: 2388916 - RNA, 18 nt, Bordetella pertussis
ggcggccgacgggcggcu

SEQ ID NO: 2388917 - RNA, 21 nt, Bordetella pertussis
ggcggccgacgggcggcugcu

SEQ ID NO: 2388918 - RNA, 23 nt, Bordetella pertussis
ggcggccgacgggcggcugcugg

SEQ ID NO: 2388919 - RNA, 14 nt, Bordetella pertussis
ggcggccgccagcg

SEQ ID NO: 2388920 - RNA, 19 nt, Bordetella pertussis
ggcggccgccagcgccaug

SEQ ID NO: 2388921 - RNA, 12 nt, Bordetella pertussis
ggcggccgccca

SEQ ID NO: 2388922 - RNA, 14 nt, Bordetella pertussis
ggcggccgcccagc

SEQ ID NO: 2388923 - RNA, 18 nt, Bordetella pertussis
ggcggccgccugcgccga

SEQ ID NO: 2388924 - RNA, 21 nt, Bordetella pertussis
ggcggccgccugcgccgaggc

SEQ ID NO: 2388925 - RNA, 12 nt, Bordetella pertussis
ggcggccgccuu

SEQ ID NO: 2388926 - RNA, 20 nt, Bordetella pertussis
ggcggccgcgggcgugcugg

SEQ ID NO: 2388927 - RNA, 20 nt, Bordetella pertussis
ggcggccgcguccagcgcgc

SEQ ID NO: 2388928 - RNA, 13 nt, Bordetella pertussis
ggcggccggcagg

SEQ ID NO: 2388929 - RNA, 14 nt, Bordetella pertussis
ggcggccggcaggc

SEQ ID NO: 2388930 - RNA, 16 nt, Bordetella pertussis
ggcggccggcaggccg

SEQ ID NO: 2388931 - RNA, 23 nt, Bordetella pertussis
ggcggccggcaggccggccagca

SEQ ID NO: 2388932 - RNA, 15 nt, Bordetella pertussis
ggcggccggccagcc

SEQ ID NO: 2388933 - RNA, 14 nt, Bordetella pertussis
ggcggccgggcgua

SEQ ID NO: 2388934 - RNA, 15 nt, Bordetella pertussis
ggcggccgggcguac

SEQ ID NO: 2388935 - RNA, 21 nt, Bordetella pertussis
ggcggccggggccgcccuggu

SEQ ID NO: 2388936 - RNA, 14 nt, Bordetella pertussis
ggcggccggucagg

SEQ ID NO: 2388937 - RNA, 19 nt, Bordetella pertussis
ggcggccuaucaccugggc

SEQ ID NO: 2388938 - RNA, 15 nt, Bordetella pertussis
ggcggccuccagcag

SEQ ID NO: 2388939 - RNA, 17 nt, Bordetella pertussis
ggcggccuccagcaggg

SEQ ID NO: 2388940 - RNA, 15 nt, Bordetella pertussis
ggcggccuccgcgca

SEQ ID NO: 2388941 - RNA, 16 nt, Bordetella pertussis
ggcggccuccgcgcac

SEQ ID NO: 2388942 - RNA, 15 nt, Bordetella pertussis
ggcggccuccggcag

SEQ ID NO: 2388943 - RNA, 19 nt, Bordetella pertussis
ggcggccucgacggccgcc

SEQ ID NO: 2388944 - RNA, 20 nt, Bordetella pertussis
ggcggccucgacggccgccg

SEQ ID NO: 2388945 - RNA, 17 nt, Bordetella pertussis
ggcggccucgggcaacu

SEQ ID NO: 2388946 - RNA, 22 nt, Bordetella pertussis
ggcggccugcacggugggcagc

SEQ ID NO: 2388947 - RNA, 23 nt, Bordetella pertussis
ggcggccugcacggugggcagca

SEQ ID NO: 2388948 - RNA, 14 nt, Bordetella pertussis
ggcggccugcaggc

SEQ ID NO: 2388949 - RNA, 17 nt, Bordetella pertussis
ggcggccugcaggccgu

SEQ ID NO: 2388950 - RNA, 13 nt, Bordetella pertussis
ggcggccugcgcc

SEQ ID NO: 2388951 - RNA, 14 nt, Bordetella pertussis
ggcggccugcgccg

SEQ ID NO: 2388952 - RNA, 17 nt, Bordetella pertussis
ggcggccugcgccggca

SEQ ID NO: 2388953 - RNA, 19 nt, Bordetella pertussis
ggcggccugcgccggcaug

SEQ ID NO: 2388954 - RNA, 20 nt, Bordetella pertussis
ggcggccugcuuggcagccu

SEQ ID NO: 2388955 - RNA, 12 nt, Bordetella pertussis
ggcggccuggcc

SEQ ID NO: 2388956 - RNA, 16 nt, Bordetella pertussis
ggcggccuggccgcgc

SEQ ID NO: 2388957 - RNA, 17 nt, Bordetella pertussis
ggcggccuggccgcgcg

SEQ ID NO: 2388958 - RNA, 19 nt, Bordetella pertussis
ggcggccuggccgcgcgcc

SEQ ID NO: 2388959 - RNA, 22 nt, Bordetella pertussis
ggcggccuggccgcgcgccugc

SEQ ID NO: 2388960 - RNA, 14 nt, Bordetella pertussis
ggcggccugggcca

SEQ ID NO: 2388961 - RNA, 16 nt, Bordetella pertussis
ggcggccugggccaug

SEQ ID NO: 2388962 - RNA, 17 nt, Bordetella pertussis
ggcggccugggccaugg

SEQ ID NO: 2388963 - RNA, 19 nt, Bordetella pertussis
ggcggccugggcgggccgu

SEQ ID NO: 2388964 - RNA, 22 nt, Bordetella pertussis
ggcggccuucaugaucuggccg

SEQ ID NO: 2388965 - RNA, 18 nt, Bordetella pertussis
ggcggccuugccggccac

SEQ ID NO: 2388966 - RNA, 20 nt, Bordetella pertussis
ggcggccuugcgggccggcu

SEQ ID NO: 2388967 - RNA, 22 nt, Bordetella pertussis
ggcggccuugcgggccggcugg

SEQ ID NO: 2388968 - RNA, 21 nt, Bordetella pertussis
ggcggccuuggccgcagccgg

SEQ ID NO: 2388969 - RNA, 22 nt, Bordetella pertussis
ggcggccuuggccgcagccggc

SEQ ID NO: 2388970 - RNA, 17 nt, Bordetella pertussis
ggcggccuuugcgcgcu

SEQ ID NO: 2388971 - RNA, 22 nt, Bordetella pertussis
ggcggcgaacacgucgcgggcg

SEQ ID NO: 2388972 - RNA, 23 nt, Bordetella pertussis
ggcggcgaacacgucgcgggcga

SEQ ID NO: 2388973 - RNA, 14 nt, Bordetella pertussis
ggcggcgaccggcg

SEQ ID NO: 2388974 - RNA, 23 nt, Bordetella pertussis
ggcggcgacgaacccgggcguga

SEQ ID NO: 2388975 - RNA, 17 nt, Bordetella pertussis
ggcggcgacgcagcacg

SEQ ID NO: 2388976 - RNA, 16 nt, Bordetella pertussis
ggcggcgacggcgucg

SEQ ID NO: 2388977 - RNA, 21 nt, Bordetella pertussis
ggcggcgacggcgucggccug

SEQ ID NO: 2388978 - RNA, 16 nt, Bordetella pertussis
ggcggcgagcgcggcg

SEQ ID NO: 2388979 - RNA, 18 nt, Bordetella pertussis
ggcggcgagcgcggcgcg

SEQ ID NO: 2388980 - RNA, 12 nt, Bordetella pertussis
ggcggcgagcug

SEQ ID NO: 2388981 - RNA, 14 nt, Bordetella pertussis
ggcggcgagcuggc

SEQ ID NO: 2388982 - RNA, 16 nt, Bordetella pertussis
ggcggcgagcuggccc

SEQ ID NO: 2388983 - RNA, 14 nt, Bordetella pertussis
ggcggcgagggcgu

SEQ ID NO: 2388984 - RNA, 17 nt, Bordetella pertussis
ggcggcgagggcgucgu

SEQ ID NO: 2388985 - RNA, 12 nt, Bordetella pertussis
ggcggcgcagca

SEQ ID NO: 2388986 - RNA, 13 nt, Bordetella pertussis
ggcggcgcagccg

SEQ ID NO: 2388987 - RNA, 15 nt, Bordetella pertussis
ggcggcgcagcgccc

SEQ ID NO: 2388988 - RNA, 21 nt, Bordetella pertussis
ggcggcgcaggaugcgcuggc

SEQ ID NO: 2388989 - RNA, 14 nt, Bordetella pertussis
ggcggcgcaggcca

SEQ ID NO: 2388990 - RNA, 15 nt, Bordetella pertussis
ggcggcgcaucagcg

SEQ ID NO: 2388991 - RNA, 18 nt, Bordetella pertussis
ggcggcgcaucagcgcgc

SEQ ID NO: 2388992 - RNA, 14 nt, Bordetella pertussis
ggcggcgccagcgg

SEQ ID NO: 2388993 - RNA, 14 nt, Bordetella pertussis
ggcggcgcccauca

SEQ ID NO: 2388994 - RNA, 20 nt, Bordetella pertussis
ggcggcgcccauuccgagcg

SEQ ID NO: 2388995 - RNA, 13 nt, Bordetella pertussis
ggcggcgccggcc

SEQ ID NO: 2388996 - RNA, 12 nt, Bordetella pertussis
ggcggcgccugg

SEQ ID NO: 2388997 - RNA, 16 nt, Bordetella pertussis
ggcggcgccuggucgc

SEQ ID NO: 2388998 - RNA, 21 nt, Bordetella pertussis
ggcggcgccuggucgcgcgcc

SEQ ID NO: 2388999 - RNA, 19 nt, Bordetella pertussis
ggcggcgcgaacggcagcu

SEQ ID NO: 2389000 - RNA, 12 nt, Bordetella pertussis
ggcggcgcgccc

SEQ ID NO: 2389001 - RNA, 16 nt, Bordetella pertussis
ggcggcgcgcccagcg

SEQ ID NO: 2389002 - RNA, 13 nt, Bordetella pertussis
ggcggcgcgcccg

SEQ ID NO: 2389003 - RNA, 15 nt, Bordetella pertussis
ggcggcgcgcgcgcc

SEQ ID NO: 2389004 - RNA, 15 nt, Bordetella pertussis
ggcggcgcgcucucc

SEQ ID NO: 2389005 - RNA, 14 nt, Bordetella pertussis
ggcggcgcgcuugg

SEQ ID NO: 2389006 - RNA, 15 nt, Bordetella pertussis
ggcggcgcgcuuggu

SEQ ID NO: 2389007 - RNA, 12 nt, Bordetella pertussis
ggcggcgcggcg

SEQ ID NO: 2389008 - RNA, 14 nt, Bordetella pertussis
ggcggcgcggcgcc

SEQ ID NO: 2389009 - RNA, 14 nt, Bordetella pertussis
ggcggcgcggcgcu

SEQ ID NO: 2389010 - RNA, 17 nt, Bordetella pertussis
ggcggcgcggcgcuggc

SEQ ID NO: 2389011 - RNA, 19 nt, Bordetella pertussis
ggcggcgcggcgcuggcgc

SEQ ID NO: 2389012 - RNA, 14 nt, Bordetella pertussis
ggcggcgcgggcgg

SEQ ID NO: 2389013 - RNA, 17 nt, Bordetella pertussis
ggcggcgcggucagcau

SEQ ID NO: 2389014 - RNA, 18 nt, Bordetella pertussis
ggcggcgcggucagcaug

SEQ ID NO: 2389015 - RNA, 22 nt, Bordetella pertussis
ggcggcgcucaucaucgcgcug

SEQ ID NO: 2389016 - RNA, 16 nt, Bordetella pertussis
ggcggcgcucgaaggc

SEQ ID NO: 2389017 - RNA, 19 nt, Bordetella pertussis
ggcggcgcuggccugccgc

SEQ ID NO: 2389018 - RNA, 23 nt, Bordetella pertussis
ggcggcgcuggcgaugcgggcca

SEQ ID NO: 2389019 - RNA, 14 nt, Bordetella pertussis
ggcggcggcaugcu

SEQ ID NO: 2389020 - RNA, 21 nt, Bordetella pertussis
ggcggcggccacgaccggcuc

SEQ ID NO: 2389021 - RNA, 14 nt, Bordetella pertussis
ggcggcggccaucg

SEQ ID NO: 2389022 - RNA, 12 nt, Bordetella pertussis
ggcggcggccuc

SEQ ID NO: 2389023 - RNA, 12 nt, Bordetella pertussis
ggcggcggcgcg

SEQ ID NO: 2389024 - RNA, 13 nt, Bordetella pertussis
ggcggcggcgucg

SEQ ID NO: 2389025 - RNA, 14 nt, Bordetella pertussis
ggcggcggcgucgc

SEQ ID NO: 2389026 - RNA, 13 nt, Bordetella pertussis
ggcggcgggcggc

SEQ ID NO: 2389027 - RNA, 13 nt, Bordetella pertussis
ggcggcgggcugc

SEQ ID NO: 2389028 - RNA, 22 nt, Bordetella pertussis
ggcggcgggucaaguccggcgc

SEQ ID NO: 2389029 - RNA, 23 nt, Bordetella pertussis
ggcggcgggucaaguccggcgcc

SEQ ID NO: 2389030 - RNA, 13 nt, Bordetella pertussis
ggcggcggguggc

SEQ ID NO: 2389031 - RNA, 14 nt, Bordetella pertussis
ggcggcggguggcg

SEQ ID NO: 2389032 - RNA, 21 nt, Bordetella pertussis
ggcggcgguagcgcucgucca

SEQ ID NO: 2389033 - RNA, 15 nt, Bordetella pertussis
ggcggcggugccagc

SEQ ID NO: 2389034 - RNA, 16 nt, Bordetella pertussis
ggcggcggugccagcg

SEQ ID NO: 2389035 - RNA, 22 nt, Bordetella pertussis
ggcggcgguuucuuccagcagg

SEQ ID NO: 2389036 - RNA, 15 nt, Bordetella pertussis
ggcggcguagagcgc

SEQ ID NO: 2389037 - RNA, 18 nt, Bordetella pertussis
ggcggcguagagcgccgc

SEQ ID NO: 2389038 - RNA, 15 nt, Bordetella pertussis
ggcggcgucaaugcc

SEQ ID NO: 2389039 - RNA, 13 nt, Bordetella pertussis
ggcggcgucgccg

SEQ ID NO: 2389040 - RNA, 20 nt, Bordetella pertussis
ggcggcgucgcuggcagccu

SEQ ID NO: 2389041 - RNA, 21 nt, Bordetella pertussis
ggcggcgucgcuggcagccuu

SEQ ID NO: 2389042 - RNA, 15 nt, Bordetella pertussis
ggcggcgucggcgcc

SEQ ID NO: 2389043 - RNA, 20 nt, Bordetella pertussis
ggcggcgucuucgcgggaau

SEQ ID NO: 2389044 - RNA, 12 nt, Bordetella pertussis
ggcggcgugccc

SEQ ID NO: 2389045 - RNA, 21 nt, Bordetella pertussis
ggcggcgugcccugcggcgcg

SEQ ID NO: 2389046 - RNA, 16 nt, Bordetella pertussis
ggcggcgugcgccugc

SEQ ID NO: 2389047 - RNA, 19 nt, Bordetella pertussis
ggcggcgugcgccugcugg

SEQ ID NO: 2389048 - RNA, 22 nt, Bordetella pertussis
ggcggcguuccugggcacgccg

SEQ ID NO: 2389049 - RNA, 14 nt, Bordetella pertussis
ggcggcuaggcgca

SEQ ID NO: 2389050 - RNA, 23 nt, Bordetella pertussis
ggcggcuaggcgcagcaggccag

SEQ ID NO: 2389051 - RNA, 13 nt, Bordetella pertussis
ggcggcucggccc

SEQ ID NO: 2389052 - RNA, 16 nt, Bordetella pertussis
ggcggcucggcccuag

SEQ ID NO: 2389053 - RNA, 14 nt, Bordetella pertussis
ggcggcugaagaag

SEQ ID NO: 2389054 - RNA, 12 nt, Bordetella pertussis
ggcggcugccag

SEQ ID NO: 2389055 - RNA, 14 nt, Bordetella pertussis
ggcggcugccagug

SEQ ID NO: 2389056 - RNA, 20 nt, Bordetella pertussis
ggcggcugcccaccuugcgc

SEQ ID NO: 2389057 - RNA, 17 nt, Bordetella pertussis
ggcggcugcccgggcug

SEQ ID NO: 2389058 - RNA, 18 nt, Bordetella pertussis
ggcggcugcccgggcugc

SEQ ID NO: 2389059 - RNA, 21 nt, Bordetella pertussis
ggcggcuggucaacucgcccg

SEQ ID NO: 2389060 - RNA, 22 nt, Bordetella pertussis
ggcggcuggugccgacggcgcg

SEQ ID NO: 2389061 - RNA, 20 nt, Bordetella pertussis
ggcggcuguagucgccgcug

SEQ ID NO: 2389062 - RNA, 21 nt, Bordetella pertussis
ggcggcuguagucgccgcugc

SEQ ID NO: 2389063 - RNA, 12 nt, Bordetella pertussis
ggcggcugucgg

SEQ ID NO: 2389064 - RNA, 17 nt, Bordetella pertussis
ggcggcugucgggcggc

SEQ ID NO: 2389065 - RNA, 18 nt, Bordetella pertussis
ggcggcugucgggcggcg

SEQ ID NO: 2389066 - RNA, 20 nt, Bordetella pertussis
ggcggcuuccuggucacccg

SEQ ID NO: 2389067 - RNA, 17 nt, Bordetella pertussis
ggcggcuucgcgcagca

SEQ ID NO: 2389068 - RNA, 20 nt, Bordetella pertussis
ggcggcuucggccgucagca

SEQ ID NO: 2389069 - RNA, 22 nt, Bordetella pertussis
ggcggcuucggccgucagcagc

SEQ ID NO: 2389070 - RNA, 22 nt, Bordetella pertussis
ggcggcuugccgucgaccgcga

SEQ ID NO: 2389071 - RNA, 15 nt, Bordetella pertussis
ggcggcuuucauggg

SEQ ID NO: 2389072 - RNA, 22 nt, Bordetella pertussis
ggcggcuuucaugggccugggc

SEQ ID NO: 2389073 - RNA, 15 nt, Bordetella pertussis
ggcgggaacaggcac

SEQ ID NO: 2389074 - RNA, 23 nt, Bordetella pertussis
ggcgggaaugucccacaggcgcg

SEQ ID NO: 2389075 - RNA, 18 nt, Bordetella pertussis
ggcgggaccgugccgccg

SEQ ID NO: 2389076 - RNA, 14 nt, Bordetella pertussis
ggcgggacgcaggc

SEQ ID NO: 2389077 - RNA, 17 nt, Bordetella pertussis
ggcgggacggccauuca

SEQ ID NO: 2389078 - RNA, 19 nt, Bordetella pertussis
ggcgggacuguaccgcgcg

SEQ ID NO: 2389079 - RNA, 22 nt, Bordetella pertussis
ggcgggacuuagaaguccaugc

SEQ ID NO: 2389080 - RNA, 14 nt, Bordetella pertussis
ggcgggcaccaugc

SEQ ID NO: 2389081 - RNA, 15 nt, Bordetella pertussis
ggcgggcaccaugcg

SEQ ID NO: 2389082 - RNA, 22 nt, Bordetella pertussis
ggcgggcacgagaucgccuggg

SEQ ID NO: 2389083 - RNA, 12 nt, Bordetella pertussis
ggcgggcagcgg

SEQ ID NO: 2389084 - RNA, 17 nt, Bordetella pertussis
ggcgggcaggcuccaca

SEQ ID NO: 2389085 - RNA, 15 nt, Bordetella pertussis
ggcgggcaucgccca

SEQ ID NO: 2389086 - RNA, 17 nt, Bordetella pertussis
ggcgggcaucgcccacc

SEQ ID NO: 2389087 - RNA, 20 nt, Bordetella pertussis
ggcgggcaucgcccaccaug

SEQ ID NO: 2389088 - RNA, 19 nt, Bordetella pertussis
ggcgggcaugacgaccgcg

SEQ ID NO: 2389089 - RNA, 20 nt, Bordetella pertussis
ggcgggcaugacgaccgcga

SEQ ID NO: 2389090 - RNA, 22 nt, Bordetella pertussis
ggcgggcaugacgaccgcgacc

SEQ ID NO: 2389091 - RNA, 23 nt, Bordetella pertussis
ggcgggccagguauucggcggug

SEQ ID NO: 2389092 - RNA, 17 nt, Bordetella pertussis
ggcgggccccgcagggc

SEQ ID NO: 2389093 - RNA, 23 nt, Bordetella pertussis
ggcguagcccuuguggccgccga

SEQ ID NO: 2389094 - RNA, 19 nt, Bordetella pertussis
ggcguagccggugcgcagc

SEQ ID NO: 2389095 - RNA, 20 nt, Bordetella pertussis
ggcguagccggugcgcagca

SEQ ID NO: 2389096 - RNA, 23 nt, Bordetella pertussis
ggcguagccggugcgcagcacca

SEQ ID NO: 2389097 - RNA, 15 nt, Bordetella pertussis
ggcguagcucagccu

SEQ ID NO: 2389098 - RNA, 14 nt, Bordetella pertussis
ggcguagcugcgcc

SEQ ID NO: 2389099 - RNA, 17 nt, Bordetella pertussis
ggcguagcugcgccgca

SEQ ID NO: 2389100 - RNA, 14 nt, Bordetella pertussis
ggcguaggcggccu

SEQ ID NO: 2389101 - RNA, 17 nt, Bordetella pertussis
ggcguaguagcccaggc

SEQ ID NO: 2389102 - RNA, 19 nt, Bordetella pertussis
ggcguaguagcccaggccc

SEQ ID NO: 2389103 - RNA, 16 nt, Bordetella pertussis
ggcguaguaggcggug

SEQ ID NO: 2389104 - RNA, 14 nt, Bordetella pertussis
ggcguagucguugc

SEQ ID NO: 2389105 - RNA, 22 nt, Bordetella pertussis
ggcguagucguugccggccagc

SEQ ID NO: 2389106 - RNA, 20 nt, Bordetella pertussis
ggcguaucgagguuuccgcc

SEQ ID NO: 2389107 - RNA, 14 nt, Bordetella pertussis
ggcguauggcccgc

SEQ ID NO: 2389108 - RNA, 17 nt, Bordetella pertussis
ggcguauggcccgccac

SEQ ID NO: 2389109 - RNA, 18 nt, Bordetella pertussis
ggcgucaaaccaagcagg

SEQ ID NO: 2389110 - RNA, 21 nt, Bordetella pertussis
ggcgucaaaccaagcagggac

SEQ ID NO: 2389111 - RNA, 21 nt, Bordetella pertussis
ggcgucaagccagcggcgcgg

SEQ ID NO: 2389112 - RNA, 23 nt, Bordetella pertussis
ggcgucaagccagcggcgcggcg

SEQ ID NO: 2389113 - RNA, 15 nt, Bordetella pertussis
ggcgucaaugccagu

SEQ ID NO: 2389114 - RNA, 20 nt, Bordetella pertussis
ggcgucaaugccagucgccg

SEQ ID NO: 2389115 - RNA, 21 nt, Bordetella pertussis
ggcgucaaugccagucgccgc

SEQ ID NO: 2389116 - RNA, 13 nt, Bordetella pertussis
ggcgucaccggcg

SEQ ID NO: 2389117 - RNA, 15 nt, Bordetella pertussis
ggcgucaccggcgag

SEQ ID NO: 2389118 - RNA, 17 nt, Bordetella pertussis
ggcgucaccggcgagcc

SEQ ID NO: 2389119 - RNA, 21 nt, Bordetella pertussis
ggcgucaccggcgagccgaug

SEQ ID NO: 2389120 - RNA, 14 nt, Bordetella pertussis
ggcgucacgcggcc

SEQ ID NO: 2389121 - RNA, 13 nt, Bordetella pertussis
ggcgucagcgccc

SEQ ID NO: 2389122 - RNA, 24 nt, Bordetella pertussis
ggcgucagcgcccaaucgggcagc

SEQ ID NO: 2389123 - RNA, 20 nt, Bordetella pertussis
ggcgucaucggcgcgcagca

SEQ ID NO: 2389124 - RNA, 16 nt, Bordetella pertussis
ggcgucaugcgcuugu

SEQ ID NO: 2389125 - RNA, 18 nt, Bordetella pertussis
ggcguccaccgccgaugc

SEQ ID NO: 2389126 - RNA, 17 nt, Bordetella pertussis
ggcguccaccuugacgc

SEQ ID NO: 2389127 - RNA, 15 nt, Bordetella pertussis
ggcguccacggcauc

SEQ ID NO: 2389128 - RNA, 23 nt, Bordetella pertussis
ggcguccacggcaucggccagca

SEQ ID NO: 2389129 - RNA, 15 nt, Bordetella pertussis
ggcguccagcagcag

SEQ ID NO: 2389130 - RNA, 17 nt, Bordetella pertussis
ggcguccagcagcagga

SEQ ID NO: 2389131 - RNA, 16 nt, Bordetella pertussis
ggcguccagccugccc

SEQ ID NO: 2389132 - RNA, 11 nt, Bordetella pertussis
ggcguccaggc

SEQ ID NO: 2389133 - RNA, 14 nt, Bordetella pertussis
ggcguccaggcgcg

SEQ ID NO: 2389134 - RNA, 17 nt, Bordetella pertussis
ggcguccaggcgcgcca

SEQ ID NO: 2389135 - RNA, 18 nt, Bordetella pertussis
ggcguccaggcgcgccag

SEQ ID NO: 2389136 - RNA, 18 nt, Bordetella pertussis
ggcguccaggcugccggc

SEQ ID NO: 2389137 - RNA, 11 nt, Bordetella pertussis
ggcguccaggu

SEQ ID NO: 2389138 - RNA, 15 nt, Bordetella pertussis
ggcguccagguuggg

SEQ ID NO: 2389139 - RNA, 18 nt, Bordetella pertussis
ggcguccaugcagguggc

SEQ ID NO: 2389140 - RNA, 22 nt, Bordetella pertussis
ggcguccauuagggcccagcug

SEQ ID NO: 2389141 - RNA, 13 nt, Bordetella pertussis
ggcgucccaggcc

SEQ ID NO: 2389142 - RNA, 14 nt, Bordetella pertussis
ggcgucccaggcca

SEQ ID NO: 2389143 - RNA, 21 nt, Bordetella pertussis
ggcguccgauaucccauggga

SEQ ID NO: 2389144 - RNA, 14 nt, Bordetella pertussis
ggcguccgcgucgc

SEQ ID NO: 2389145 - RNA, 19 nt, Bordetella pertussis
ggcguccgcgucgccgccg

SEQ ID NO: 2389146 - RNA, 19 nt, Bordetella pertussis
ggcguccggccccaggaug

SEQ ID NO: 2389147 - RNA, 13 nt, Bordetella pertussis
ggcguccugccgc

SEQ ID NO: 2389148 - RNA, 16 nt, Bordetella pertussis
ggcguccugcggcggc

SEQ ID NO: 2389149 - RNA, 17 nt, Bordetella pertussis
ggcgucgaaacgcugcg

SEQ ID NO: 2389150 - RNA, 23 nt, Bordetella pertussis
ggcgucgaaacgcugcgcgaugc

SEQ ID NO: 2389151 - RNA, 16 nt, Bordetella pertussis
ggcgucgaaggccgcc

SEQ ID NO: 2389152 - RNA, 18 nt, Bordetella pertussis
ggcgucgaaggccgccgg

SEQ ID NO: 2389153 - RNA, 16 nt, Bordetella pertussis
ggcgucgaaggcggcc

SEQ ID NO: 2389154 - RNA, 18 nt, Bordetella pertussis
ggcgucgaaggcggccgg

SEQ ID NO: 2389155 - RNA, 20 nt, Bordetella pertussis
ggcgucgaaggcggccggca

SEQ ID NO: 2389156 - RNA, 20 nt, Bordetella pertussis
ggcgucgaaugcacgggcgc

SEQ ID NO: 2389157 - RNA, 23 nt, Bordetella pertussis
ggcgucgaaugcacgggcgcugc

SEQ ID NO: 2389158 - RNA, 17 nt, Bordetella pertussis
ggcgucgaccgccaugc

SEQ ID NO: 2389159 - RNA, 18 nt, Bordetella pertussis
ggcgucgaccgcgggcgc

SEQ ID NO: 2389160 - RNA, 13 nt, Bordetella pertussis
ggcgucgagcggc

SEQ ID NO: 2389161 - RNA, 16 nt, Bordetella pertussis
ggcgucgaucggcgcg

SEQ ID NO: 2389162 - RNA, 19 nt, Bordetella pertussis
ggcgucgaucuucgccugc

SEQ ID NO: 2389163 - RNA, 22 nt, Bordetella pertussis
ggcgucgaucuucgccugcaug

SEQ ID NO: 2389164 - RNA, 20 nt, Bordetella pertussis
ggcgucgauguccuucucuu

SEQ ID NO: 2389165 - RNA, 16 nt, Bordetella pertussis
ggcgucgcccggggcg

SEQ ID NO: 2389166 - RNA, 14 nt, Bordetella pertussis
ggcgucgccgcgca

SEQ ID NO: 2389167 - RNA, 14 nt, Bordetella pertussis
ggcgucgccggcca

SEQ ID NO: 2389168 - RNA, 15 nt, Bordetella pertussis
ggcgucgccggccag

SEQ ID NO: 2389169 - RNA, 22 nt, Bordetella pertussis
ggcgucgcgcuguucgggcgcg

SEQ ID NO: 2389170 - RNA, 15 nt, Bordetella pertussis
ggcgucgcggcguau

SEQ ID NO: 2389171 - RNA, 19 nt, Bordetella pertussis
ggcgucgcucugcgcggca

SEQ ID NO: 2389172 - RNA, 17 nt, Bordetella pertussis
ggcgucgcugcuggcgg

SEQ ID NO: 2389173 - RNA, 18 nt, Bordetella pertussis
ggcgucgcugcuggcggc

SEQ ID NO: 2389174 - RNA, 19 nt, Bordetella pertussis
ggcgucgcugcuggcggcg

SEQ ID NO: 2389175 - RNA, 23 nt, Bordetella pertussis
ggcgucgcugcuggcggcgcugg

SEQ ID NO: 2389176 - RNA, 15 nt, Bordetella pertussis
ggcgucggccacguc

SEQ ID NO: 2389177 - RNA, 14 nt, Bordetella pertussis
ggcgucggccagcg

SEQ ID NO: 2389178 - RNA, 15 nt, Bordetella pertussis
ggcgucggccaggcc

SEQ ID NO: 2389179 - RNA, 20 nt, Bordetella pertussis
ggcgucggccauggcgcugu

SEQ ID NO: 2389180 - RNA, 14 nt, Bordetella pertussis
ggcgucggccgcgc

SEQ ID NO: 2389181 - RNA, 18 nt, Bordetella pertussis
ggcgucggccugguccgc

SEQ ID NO: 2389182 - RNA, 17 nt, Bordetella pertussis
ggcgucggcgcccggcg

SEQ ID NO: 2389183 - RNA, 18 nt, Bordetella pertussis
ggcgucggcgcccggcgc

SEQ ID NO: 2389184 - RNA, 14 nt, Bordetella pertussis
ggcgucgggcagca

SEQ ID NO: 2389185 - RNA, 16 nt, Bordetella pertussis
ggcgucgggcagcagg

SEQ ID NO: 2389186 - RNA, 16 nt, Bordetella pertussis
ggcgucgggcaguugc

SEQ ID NO: 2389187 - RNA, 22 nt, Bordetella pertussis
ggcgucgggcaguugcuggcgg

SEQ ID NO: 2389188 - RNA, 23 nt, Bordetella pertussis
ggcgucgggcaguugcuggcggc

SEQ ID NO: 2389189 - RNA, 15 nt, Bordetella pertussis
ggcgucgggggcggc

SEQ ID NO: 2389190 - RNA, 16 nt, Bordetella pertussis
ggcgucgggggcggcc

SEQ ID NO: 2389191 - RNA, 18 nt, Bordetella pertussis
ggcgucgggggcggccgg

SEQ ID NO: 2389192 - RNA, 18 nt, Bordetella pertussis
ggcgucggugccguccag

SEQ ID NO: 2389193 - RNA, 17 nt, Bordetella pertussis
ggcgucguccguggccg

SEQ ID NO: 2389194 - RNA, 20 nt, Bordetella pertussis
ggcgucguccguggccggcg

SEQ ID NO: 2389195 - RNA, 15 nt, Bordetella pertussis
ggcgucguccugcag

SEQ ID NO: 2389196 - RNA, 19 nt, Bordetella pertussis
ggcgucguccugcagcagg

SEQ ID NO: 2389197 - RNA, 21 nt, Bordetella pertussis
ggcgucgucgccgucgcccug

SEQ ID NO: 2389198 - RNA, 16 nt, Bordetella pertussis
ggcgucgucgcggucc

SEQ ID NO: 2389199 - RNA, 13 nt, Bordetella pertussis
ggcgucguggggc

SEQ ID NO: 2389200 - RNA, 16 nt, Bordetella pertussis
ggcgucguggggcgcg

SEQ ID NO: 2389201 - RNA, 15 nt, Bordetella pertussis
ggcgucguuggccgc

SEQ ID NO: 2389202 - RNA, 23 nt, Bordetella pertussis
ggcgucugcccgugcgugcgccu

SEQ ID NO: 2389203 - RNA, 16 nt, Bordetella pertussis
ggcgucugguacaaca

SEQ ID NO: 2389204 - RNA, 17 nt, Bordetella pertussis
ggcgugaaaggccagcg

SEQ ID NO: 2389205 - RNA, 23 nt, Bordetella pertussis
ggcgugaacgccccggccgaucg

SEQ ID NO: 2389206 - RNA, 13 nt, Bordetella pertussis
ggcgugaccagcu

SEQ ID NO: 2389207 - RNA, 16 nt, Bordetella pertussis
ggcgugaccagcugca

SEQ ID NO: 2389208 - RNA, 17 nt, Bordetella pertussis
ggcgugaccagcugcac

SEQ ID NO: 2389209 - RNA, 18 nt, Bordetella pertussis
ggcgugaccgcgacgcgc

SEQ ID NO: 2389210 - RNA, 16 nt, Bordetella pertussis
ggcgugacgcgcgggu

SEQ ID NO: 2389211 - RNA, 13 nt, Bordetella pertussis
ggcgugacgcuga

SEQ ID NO: 2389212 - RNA, 17 nt, Bordetella pertussis
ggcgugacguugccgcg

SEQ ID NO: 2389213 - RNA, 20 nt, Bordetella pertussis
ggcgugacguugccgcgcgc

SEQ ID NO: 2389214 - RNA, 13 nt, Bordetella pertussis
ggcgugagcgcca

SEQ ID NO: 2389215 - RNA, 16 nt, Bordetella pertussis
ggcgugaugcccaggc

SEQ ID NO: 2389216 - RNA, 18 nt, Bordetella pertussis
ggcgugaugcccaggccc

SEQ ID NO: 2389217 - RNA, 19 nt, Bordetella pertussis
ggcgugaugccgaccaggc

SEQ ID NO: 2389218 - RNA, 22 nt, Bordetella pertussis
ggcgugauggacgccggguugc

SEQ ID NO: 2389219 - RNA, 22 nt, Bordetella pertussis
ggcgugcacgcguaugcccugc

SEQ ID NO: 2389220 - RNA, 20 nt, Bordetella pertussis
ggcgugcagagcaccacggc

SEQ ID NO: 2389221 - RNA, 23 nt, Bordetella pertussis
ggcgugcagagcaccacggcgcg

SEQ ID NO: 2389222 - RNA, 21 nt, Bordetella pertussis
ggcgugcagcaagcccaccgg

SEQ ID NO: 2389223 - RNA, 16 nt, Bordetella pertussis
ggcgugcagcagguag

SEQ ID NO: 2389224 - RNA, 21 nt, Bordetella pertussis
ggcgugcagccauucggccag

SEQ ID NO: 2389225 - RNA, 14 nt, Bordetella pertussis
ggcgugcaggccgg

SEQ ID NO: 2389226 - RNA, 22 nt, Bordetella pertussis
ggcgugcagguacgccaugcga

SEQ ID NO: 2389227 - RNA, 14 nt, Bordetella pertussis
ggcgugccaggugu

SEQ ID NO: 2389228 - RNA, 19 nt, Bordetella pertussis
ggcgugccauggacgccgg

SEQ ID NO: 2389229 - RNA, 13 nt, Bordetella pertussis
ggcgugcccaggg

SEQ ID NO: 2389230 - RNA, 21 nt, Bordetella pertussis
ggcgugccgcgcaggucggcg

SEQ ID NO: 2389231 - RNA, 21 nt, Bordetella pertussis
ggcgugccugcuuguacaggc

SEQ ID NO: 2389232 - RNA, 13 nt, Bordetella pertussis
ggcgugcgcgacc

SEQ ID NO: 2389233 - RNA, 23 nt, Bordetella pertussis
ggcgugcgcgaccuccggcaaca

SEQ ID NO: 2389234 - RNA, 15 nt, Bordetella pertussis
ggcgugcgcgggcgc

SEQ ID NO: 2389235 - RNA, 16 nt, Bordetella pertussis
ggcgugcgcgggcgcc

SEQ ID NO: 2389236 - RNA, 19 nt, Bordetella pertussis
ggcgugcgcuggcugggcc

SEQ ID NO: 2389237 - RNA, 15 nt, Bordetella pertussis
ggcgugcgcuugcgc

SEQ ID NO: 2389238 - RNA, 20 nt, Bordetella pertussis
ggcgugcgcuugcgcauggc

SEQ ID NO: 2389239 - RNA, 22 nt, Bordetella pertussis
ggcgugcugcgcguggccauca

SEQ ID NO: 2389240 - RNA, 20 nt, Bordetella pertussis
ggcgugcugcggcugaucac

SEQ ID NO: 2389241 - RNA, 14 nt, Bordetella pertussis
ggcgugcuugccgc

SEQ ID NO: 2389242 - RNA, 17 nt, Bordetella pertussis
ggcgugcuugccgccgg

SEQ ID NO: 2389243 - RNA, 22 nt, Bordetella pertussis
ggcgugcuugccgccggacggc

SEQ ID NO: 2389244 - RNA, 17 nt, Bordetella pertussis
ggcguggcaggugcggc

SEQ ID NO: 2389245 - RNA, 21 nt, Bordetella pertussis
ggcguggcaggugcggccgca

SEQ ID NO: 2389246 - RNA, 18 nt, Bordetella pertussis
ggcguggccgcagucagg

SEQ ID NO: 2389247 - RNA, 14 nt, Bordetella pertussis
ggcguggcgcaggg

SEQ ID NO: 2389248 - RNA, 15 nt, Bordetella pertussis
ggcguggcgcagggu

SEQ ID NO: 2389249 - RNA, 15 nt, Bordetella pertussis
ggcguggcgccgacc

SEQ ID NO: 2389250 - RNA, 14 nt, Bordetella pertussis
ggcguggcgcgccc

SEQ ID NO: 2389251 - RNA, 15 nt, Bordetella pertussis
ggcguggcgcgcccg

SEQ ID NO: 2389252 - RNA, 15 nt, Bordetella pertussis
ggcguggcgcgcgcc

SEQ ID NO: 2389253 - RNA, 19 nt, Bordetella pertussis
ggcguggcggccaggccgg

SEQ ID NO: 2389254 - RNA, 18 nt, Bordetella pertussis
ggcguggcggggcguucg

SEQ ID NO: 2389255 - RNA, 15 nt, Bordetella pertussis
ggcguggcgucgugg

SEQ ID NO: 2389256 - RNA, 13 nt, Bordetella pertussis
ggcguggcuggcg

SEQ ID NO: 2389257 - RNA, 15 nt, Bordetella pertussis
ggcguggcuggcguc

SEQ ID NO: 2389258 - RNA, 18 nt, Bordetella pertussis
ggcguggggagcgcggcc

SEQ ID NO: 2389259 - RNA, 20 nt, Bordetella pertussis
ggcguggggagcgcggcccg

SEQ ID NO: 2389260 - RNA, 16 nt, Bordetella pertussis
ggcguggggccggccg

SEQ ID NO: 2389261 - RNA, 23 nt, Bordetella pertussis
ggcguggggccggccgcgcgcgc

SEQ ID NO: 2389262 - RNA, 20 nt, Bordetella pertussis
ggcgugguacgacgagcgca

SEQ ID NO: 2389263 - RNA, 20 nt, Bordetella pertussis
ggcgugguaucgcgccagcg

SEQ ID NO: 2389264 - RNA, 22 nt, Bordetella pertussis
ggcguggucaucgauggccacg

SEQ ID NO: 2389265 - RNA, 23 nt, Bordetella pertussis
ggcguggucaucgauggccacga

SEQ ID NO: 2389266 - RNA, 16 nt, Bordetella pertussis
ggcguguccagcggcg

SEQ ID NO: 2389267 - RNA, 18 nt, Bordetella pertussis
ggcguguccgccguagcg

SEQ ID NO: 2389268 - RNA, 19 nt, Bordetella pertussis
ggcgugucuccgggcggga

SEQ ID NO: 2389269 - RNA, 15 nt, Bordetella pertussis
ggcgugugcccagca

SEQ ID NO: 2389270 - RNA, 21 nt, Bordetella pertussis
ggcguucagcgggcgcgcccg

SEQ ID NO: 2389271 - RNA, 22 nt, Bordetella pertussis
ggcguucgacgggcaggcccag

SEQ ID NO: 2389272 - RNA, 20 nt, Bordetella pertussis
ggcguucgcggugggcagcg

SEQ ID NO: 2389273 - RNA, 14 nt, Bordetella pertussis
ggcguucggcaccg

SEQ ID NO: 2389274 - RNA, 18 nt, Bordetella pertussis
ggcguucugcagcgcggu

SEQ ID NO: 2389275 - RNA, 19 nt, Bordetella pertussis
ggcguucuggucagccgug

SEQ ID NO: 2389276 - RNA, 16 nt, Bordetella pertussis
ggcguugaaggcgaug

SEQ ID NO: 2389277 - RNA, 21 nt, Bordetella pertussis
ggcguugacguggcugagcca

SEQ ID NO: 2389278 - RNA, 22 nt, Bordetella pertussis
ggcguugacguggcugagccau

SEQ ID NO: 2389279 - RNA, 20 nt, Bordetella pertussis
ggcguugccgaagcgucggc

SEQ ID NO: 2389280 - RNA, 18 nt, Bordetella pertussis
ggcguugcggcagcggcc

SEQ ID NO: 2389281 - RNA, 16 nt, Bordetella pertussis
ggcguugcggcgccau

SEQ ID NO: 2389282 - RNA, 17 nt, Bordetella pertussis
ggcguuggccgggucgc

SEQ ID NO: 2389283 - RNA, 23 nt, Bordetella pertussis
ggcguuggccgggucgcgcagca

SEQ ID NO: 2389284 - RNA, 22 nt, Bordetella pertussis
ggcguuugcccuucgcggcugg

SEQ ID NO: 2389285 - RNA, 17 nt, Bordetella pertussis
ggcuaccacguggucug

SEQ ID NO: 2389286 - RNA, 14 nt, Bordetella pertussis
ggcuacgacccgcu

SEQ ID NO: 2389287 - RNA, 14 nt, Bordetella pertussis
ggcuacgaccugaa

SEQ ID NO: 2389288 - RNA, 14 nt, Bordetella pertussis
ggcuaggcgcagca

SEQ ID NO: 2389289 - RNA, 21 nt, Bordetella pertussis
ggcuaggcgcagcaggccagg

SEQ ID NO: 2389290 - RNA, 17 nt, Bordetella pertussis
ggcuauaccgggcuggu

SEQ ID NO: 2389291 - RNA, 21 nt, Bordetella pertussis
ggcuauaccgucguccucggc

SEQ ID NO: 2389292 - RNA, 17 nt, Bordetella pertussis
ggcuaucguggcuggcg

SEQ ID NO: 2389293 - RNA, 17 nt, Bordetella pertussis
ggcucagcccgccuggc

SEQ ID NO: 2389294 - RNA, 12 nt, Bordetella pertussis
ggcucagcccgg

SEQ ID NO: 2389295 - RNA, 13 nt, Bordetella pertussis
ggcucaggccagc

SEQ ID NO: 2389296 - RNA, 14 nt, Bordetella pertussis
ggcucaggcgcgga

SEQ ID NO: 2389297 - RNA, 16 nt, Bordetella pertussis
ggcucaggcggccagg

SEQ ID NO: 2389298 - RNA, 18 nt, Bordetella pertussis
ggcucaggcggccagggc

SEQ ID NO: 2389299 - RNA, 15 nt, Bordetella pertussis
ggcucauucggcgcg

SEQ ID NO: 2389300 - RNA, 18 nt, Bordetella pertussis
ggcuccagcucagcagcg

SEQ ID NO: 2389301 - RNA, 20 nt, Bordetella pertussis
ggcuccagcucagcagcgcc

SEQ ID NO: 2389302 - RNA, 21 nt, Bordetella pertussis
ggcuccagcucagcagcgcca

SEQ ID NO: 2389303 - RNA, 16 nt, Bordetella pertussis
ggcuccaggcugagcg

SEQ ID NO: 2389304 - RNA, 22 nt, Bordetella pertussis
ggcuccaggcugagcgugacgu

SEQ ID NO: 2389305 - RNA, 18 nt, Bordetella pertussis
ggcuccaguggugcuccc

SEQ ID NO: 2389306 - RNA, 14 nt, Bordetella pertussis
ggcucccaccggug

SEQ ID NO: 2389307 - RNA, 16 nt, Bordetella pertussis
ggcucccaccggugcg

SEQ ID NO: 2389308 - RNA, 14 nt, Bordetella pertussis
ggcucccgcgccau

SEQ ID NO: 2389309 - RNA, 17 nt, Bordetella pertussis
ggcuccgaagggcugcg

SEQ ID NO: 2389310 - RNA, 22 nt, Bordetella pertussis
ggcuccgagggacaccgcaggu

SEQ ID NO: 2389311 - RNA, 17 nt, Bordetella pertussis
ggcuccgauagcggcgc

SEQ ID NO: 2389312 - RNA, 21 nt, Bordetella pertussis
ggcuccgauagcggcgccgcu

SEQ ID NO: 2389313 - RNA, 15 nt, Bordetella pertussis
ggcuccggcuugccg

SEQ ID NO: 2389314 - RNA, 20 nt, Bordetella pertussis
ggcuccggcuugccgaaggu

SEQ ID NO: 2389315 - RNA, 22 nt, Bordetella pertussis
ggcuccggcuugccgaaggugc

SEQ ID NO: 2389316 - RNA, 21 nt, Bordetella pertussis
ggcuccggucguggccagcgu

SEQ ID NO: 2389317 - RNA, 21 nt, Bordetella pertussis
ggcuccguuccgaugcuggug

SEQ ID NO: 2389318 - RNA, 21 nt, Bordetella pertussis
ggcuccugugggggcgcggcg

SEQ ID NO: 2389319 - RNA, 19 nt, Bordetella pertussis
ggcucgaaguacagcuuga

SEQ ID NO: 2389320 - RNA, 13 nt, Bordetella pertussis
ggcucgaccgccg

SEQ ID NO: 2389321 - RNA, 15 nt, Bordetella pertussis
ggcucgagcaagggc

SEQ ID NO: 2389322 - RNA, 14 nt, Bordetella pertussis
gggccauggcaggg

SEQ ID NO: 2389323 - RNA, 15 nt, Bordetella pertussis
gggccauggcagggc

SEQ ID NO: 2389324 - RNA, 16 nt, Bordetella pertussis
gggccauguggcgcag

SEQ ID NO: 2389325 - RNA, 17 nt, Bordetella pertussis
gggccauguggcgcagc

SEQ ID NO: 2389326 - RNA, 20 nt, Bordetella pertussis
gggcccacaugccgugccag

SEQ ID NO: 2389327 - RNA, 23 nt, Bordetella pertussis
gggccccagcaucugccccagcu

SEQ ID NO: 2389328 - RNA, 17 nt, Bordetella pertussis
gggccccuccggcgccg

SEQ ID NO: 2389329 - RNA, 21 nt, Bordetella pertussis
gggccccuccggcgccgccuc

SEQ ID NO: 2389330 - RNA, 17 nt, Bordetella pertussis
gggccccucgcggggcc

SEQ ID NO: 2389331 - RNA, 21 nt, Bordetella pertussis
gggcccgcgccgacggcggcg

SEQ ID NO: 2389332 - RNA, 13 nt, Bordetella pertussis
gggcccgcgggcg

SEQ ID NO: 2389333 - RNA, 16 nt, Bordetella pertussis
gggcccggccacggcc

SEQ ID NO: 2389334 - RNA, 22 nt, Bordetella pertussis
gggcccggccacggccgggccu

SEQ ID NO: 2389335 - RNA, 13 nt, Bordetella pertussis
gggcccgggcagg

SEQ ID NO: 2389336 - RNA, 14 nt, Bordetella pertussis
gggcccgggcaggc

SEQ ID NO: 2389337 - RNA, 14 nt, Bordetella pertussis
gggcccgggcgcgc

SEQ ID NO: 2389338 - RNA, 17 nt, Bordetella pertussis
gggcccgggcgcgcugu

SEQ ID NO: 2389339 - RNA, 16 nt, Bordetella pertussis
gggcccgucgcgccag

SEQ ID NO: 2389340 - RNA, 17 nt, Bordetella pertussis
gggcccgucgcgccagg

SEQ ID NO: 2389341 - RNA, 21 nt, Bordetella pertussis
gggcccgucgcgccaggccgg

SEQ ID NO: 2389342 - RNA, 23 nt, Bordetella pertussis
gggcccgucgcgccaggccggcg

SEQ ID NO: 2389343 - RNA, 16 nt, Bordetella pertussis
gggccgaccaggccgg

SEQ ID NO: 2389344 - RNA, 23 nt, Bordetella pertussis
gggccgaccaggccggcggcggg

SEQ ID NO: 2389345 - RNA, 22 nt, Bordetella pertussis
gggccgacggccucggccagga

SEQ ID NO: 2389346 - RNA, 13 nt, Bordetella pertussis
gggccgagccgga

SEQ ID NO: 2389347 - RNA, 14 nt, Bordetella pertussis
gggccgagccggau

SEQ ID NO: 2389348 - RNA, 15 nt, Bordetella pertussis
gggccgagcgcgcca

SEQ ID NO: 2389349 - RNA, 19 nt, Bordetella pertussis
gggccgagcgcgccagcac

SEQ ID NO: 2389350 - RNA, 13 nt, Bordetella pertussis
gggccgaggcuuc

SEQ ID NO: 2389351 - RNA, 17 nt, Bordetella pertussis
gggccgaggcuucgaug

SEQ ID NO: 2389352 - RNA, 23 nt, Bordetella pertussis
gggccgaggcuucgauggcggcg

SEQ ID NO: 2389353 - RNA, 21 nt, Bordetella pertussis
gggccgaguuggcagaguggc

SEQ ID NO: 2389354 - RNA, 20 nt, Bordetella pertussis
gggccgaugaagacgccguc

SEQ ID NO: 2389355 - RNA, 15 nt, Bordetella pertussis
gggccgauggucagc

SEQ ID NO: 2389356 - RNA, 22 nt, Bordetella pertussis
gggccgcaagcaagccccaggc

SEQ ID NO: 2389357 - RNA, 23 nt, Bordetella pertussis
gggccgcaagcaagccccaggca

SEQ ID NO: 2389358 - RNA, 16 nt, Bordetella pertussis
gggccgcacgcgcggc

SEQ ID NO: 2389359 - RNA, 21 nt, Bordetella pertussis
gggccgcacgcgcggcagcgc

SEQ ID NO: 2389360 - RNA, 22 nt, Bordetella pertussis
gggccgcacgcgcggcagcgcc

SEQ ID NO: 2389361 - RNA, 14 nt, Bordetella pertussis
gggccgcagcaccu

SEQ ID NO: 2389362 - RNA, 16 nt, Bordetella pertussis
gggccgcagcgaacgg

SEQ ID NO: 2389363 - RNA, 14 nt, Bordetella pertussis
gggccgccagcacc

SEQ ID NO: 2389364 - RNA, 12 nt, Bordetella pertussis
gggccgccaggg

SEQ ID NO: 2389365 - RNA, 20 nt, Bordetella pertussis
gggccgcccagcaccuuggc

SEQ ID NO: 2389366 - RNA, 13 nt, Bordetella pertussis
gggccgcccaguc

SEQ ID NO: 2389367 - RNA, 21 nt, Bordetella pertussis
gggccgcccagucguccagca

SEQ ID NO: 2389368 - RNA, 17 nt, Bordetella pertussis
gggccgccgcgcccagc

SEQ ID NO: 2389369 - RNA, 21 nt, Bordetella pertussis
gggccgccgcgcccagccgcg

SEQ ID NO: 2389370 - RNA, 13 nt, Bordetella pertussis
gggccgccugcug

SEQ ID NO: 2389371 - RNA, 14 nt, Bordetella pertussis
gggccgccugcugg

SEQ ID NO: 2389372 - RNA, 20 nt, Bordetella pertussis
gggccgccugcugggccgcg

SEQ ID NO: 2389373 - RNA, 22 nt, Bordetella pertussis
gggccgcgaccacggucuggcg

SEQ ID NO: 2389374 - RNA, 17 nt, Bordetella pertussis
gggccgcgagcaugcgc

SEQ ID NO: 2389375 - RNA, 17 nt, Bordetella pertussis
gggccgcgcccacagga

SEQ ID NO: 2389376 - RNA, 13 nt, Bordetella pertussis
gggccgcgccggc

SEQ ID NO: 2389377 - RNA, 14 nt, Bordetella pertussis
gggccgcgccggcu

SEQ ID NO: 2389378 - RNA, 20 nt, Bordetella pertussis
gggccgcgcgauccuggggc

SEQ ID NO: 2389379 - RNA, 13 nt, Bordetella pertussis
gggccgcgcgcgg

SEQ ID NO: 2389380 - RNA, 13 nt, Bordetella pertussis
gggccgcgcugga

SEQ ID NO: 2389381 - RNA, 21 nt, Bordetella pertussis
gggccgcggacgaagccuagg

SEQ ID NO: 2389382 - RNA, 15 nt, Bordetella pertussis
gggccgcggcgagcu

SEQ ID NO: 2389383 - RNA, 21 nt, Bordetella pertussis
gggccgcggcgagcucggcau

SEQ ID NO: 2389384 - RNA, 23 nt, Bordetella pertussis
gggccgcuaggccuugccgccgc

SEQ ID NO: 2389385 - RNA, 14 nt, Bordetella pertussis
gggccgcuggcccg

SEQ ID NO: 2389386 - RNA, 13 nt, Bordetella pertussis
gggccgcuggucg

SEQ ID NO: 2389387 - RNA, 14 nt, Bordetella pertussis
gggccgcugguggc

SEQ ID NO: 2389388 - RNA, 16 nt, Bordetella pertussis
gggccgcuguugagga

SEQ ID NO: 2389389 - RNA, 18 nt, Bordetella pertussis
gggccggcgaugaagucg

SEQ ID NO: 2389390 - RNA, 21 nt, Bordetella pertussis
gggccggcgaugaagucgcgg

SEQ ID NO: 2389391 - RNA, 12 nt, Bordetella pertussis
gggccggcgcca

SEQ ID NO: 2389392 - RNA, 13 nt, Bordetella pertussis
gggccggcgccag

SEQ ID NO: 2389393 - RNA, 20 nt, Bordetella pertussis
gggccggcgccagcauccgg

SEQ ID NO: 2389394 - RNA, 22 nt, Bordetella pertussis
gggccggcgcgccgcgccgccc

SEQ ID NO: 2389395 - RNA, 19 nt, Bordetella pertussis
gggccggcgcgcgcaggcg

SEQ ID NO: 2389396 - RNA, 16 nt, Bordetella pertussis
gggccggcggcagccg

SEQ ID NO: 2389397 - RNA, 22 nt, Bordetella pertussis
gggccggcucauucggcgcgcu

SEQ ID NO: 2389398 - RNA, 13 nt, Bordetella pertussis
gggccggcugggc

SEQ ID NO: 2389399 - RNA, 14 nt, Bordetella pertussis
gggccggcugggcg

SEQ ID NO: 2389400 - RNA, 17 nt, Bordetella pertussis
gggccggcugggcggcc

SEQ ID NO: 2389401 - RNA, 14 nt, Bordetella pertussis
gggccgggccggcg

SEQ ID NO: 2389402 - RNA, 17 nt, Bordetella pertussis
gggccgggccggcgggc

SEQ ID NO: 2389403 - RNA, 18 nt, Bordetella pertussis
gggccgggccggcgggcg

SEQ ID NO: 2389404 - RNA, 12 nt, Bordetella pertussis
gggccgggcgcc

SEQ ID NO: 2389405 - RNA, 13 nt, Bordetella pertussis
gggccgggcgcca

SEQ ID NO: 2389406 - RNA, 16 nt, Bordetella pertussis
gggccgggcgccaggc

SEQ ID NO: 2389407 - RNA, 17 nt, Bordetella pertussis
gggccgguccgcucgag

SEQ ID NO: 2389408 - RNA, 18 nt, Bordetella pertussis
gggccggucgcgauccgg

SEQ ID NO: 2389409 - RNA, 16 nt, Bordetella pertussis
gggccgguuucggccu

SEQ ID NO: 2389410 - RNA, 19 nt, Bordetella pertussis
gggccgucgccgcgcggcg

SEQ ID NO: 2389411 - RNA, 13 nt, Bordetella pertussis
gggccgucgugcg

SEQ ID NO: 2389412 - RNA, 21 nt, Bordetella pertussis
gggccgucgugcgccuggcgg

SEQ ID NO: 2389413 - RNA, 23 nt, Bordetella pertussis
gggccgucuacaggcccagcgcc

SEQ ID NO: 2389414 - RNA, 16 nt, Bordetella pertussis
gggccgugcgccgggc

SEQ ID NO: 2389415 - RNA, 17 nt, Bordetella pertussis
gggccgugcgccgggcg

SEQ ID NO: 2389416 - RNA, 14 nt, Bordetella pertussis
gggccuagcccggc

SEQ ID NO: 2389417 - RNA, 18 nt, Bordetella pertussis
gggccuagcccggcgcca

SEQ ID NO: 2389418 - RNA, 18 nt, Bordetella pertussis
gggccuccucggucgggg

SEQ ID NO: 2389419 - RNA, 12 nt, Bordetella pertussis
gggccuccugca

SEQ ID NO: 2389420 - RNA, 14 nt, Bordetella pertussis
gggccuccugcagc

SEQ ID NO: 2389421 - RNA, 23 nt, Bordetella pertussis
gggccuccugcagcaggucgguc

SEQ ID NO: 2389422 - RNA, 19 nt, Bordetella pertussis
gggccucgaagcccggcag

SEQ ID NO: 2389423 - RNA, 15 nt, Bordetella pertussis
gggccucgcgggccu

SEQ ID NO: 2389424 - RNA, 15 nt, Bordetella pertussis
gggccucggccagcu

SEQ ID NO: 2389425 - RNA, 22 nt, Bordetella pertussis
gggccucggccagcugggccag

SEQ ID NO: 2389426 - RNA, 22 nt, Bordetella pertussis
gggccugcaguucggccgccag

SEQ ID NO: 2389427 - RNA, 18 nt, Bordetella pertussis
gggccugcccauggccug

SEQ ID NO: 2389428 - RNA, 16 nt, Bordetella pertussis
gggccugccgcgcgua

SEQ ID NO: 2389429 - RNA, 19 nt, Bordetella pertussis
gggccugcgggccgggcag

SEQ ID NO: 2389430 - RNA, 20 nt, Bordetella pertussis
gggccugcugucgcugggau

SEQ ID NO: 2389431 - RNA, 18 nt, Bordetella pertussis
gggccuggaagcuggcca

SEQ ID NO: 2389432 - RNA, 19 nt, Bordetella pertussis
gggccuggaagcuggccag

SEQ ID NO: 2389433 - RNA, 17 nt, Bordetella pertussis
gggccuggaucgggggg

SEQ ID NO: 2389434 - RNA, 12 nt, Bordetella pertussis
gggccuggcaga

SEQ ID NO: 2389435 - RNA, 21 nt, Bordetella pertussis
gggccuggcagaugcgcgcca

SEQ ID NO: 2389436 - RNA, 24 nt, Bordetella pertussis
gggccuggcagaugcgcgccaggc

SEQ ID NO: 2389437 - RNA, 18 nt, Bordetella pertussis
gggccuuggccagcagcg

SEQ ID NO: 2389438 - RNA, 17 nt, Bordetella pertussis
gggccuuugcggcaggg

SEQ ID NO: 2389439 - RNA, 20 nt, Bordetella pertussis
gggcgaaacggccagcguca

SEQ ID NO: 2389440 - RNA, 19 nt, Bordetella pertussis
gggcgaaccgcggcgcagg

SEQ ID NO: 2389441 - RNA, 14 nt, Bordetella pertussis
gggcgaacuggucg

SEQ ID NO: 2389442 - RNA, 14 nt, Bordetella pertussis
gggcgaagccacgg

SEQ ID NO: 2389443 - RNA, 18 nt, Bordetella pertussis
gggcgaagccacggcccg

SEQ ID NO: 2389444 - RNA, 13 nt, Bordetella pertussis
gggcgaagcgcgc

SEQ ID NO: 2389445 - RNA, 15 nt, Bordetella pertussis
gggcgaagcgcgccu

SEQ ID NO: 2389446 - RNA, 19 nt, Bordetella pertussis
gggcgaagcggaccugguc

SEQ ID NO: 2389447 - RNA, 19 nt, Bordetella pertussis
gggcgaaggccagcgccuc

SEQ ID NO: 2389448 - RNA, 21 nt, Bordetella pertussis
gggcgaagucauguagcggcc

SEQ ID NO: 2389449 - RNA, 15 nt, Bordetella pertussis
gggcgacaggcgcgc

SEQ ID NO: 2389450 - RNA, 16 nt, Bordetella pertussis
gggcgaccccggaggg

SEQ ID NO: 2389451 - RNA, 19 nt, Bordetella pertussis
gggcgacggcggcguggac

SEQ ID NO: 2389452 - RNA, 13 nt, Bordetella pertussis
gggcgacuccagc

SEQ ID NO: 2389453 - RNA, 15 nt, Bordetella pertussis
gggcgacuccagccc

SEQ ID NO: 2389454 - RNA, 16 nt, Bordetella pertussis
gggcgacuccagcccg

SEQ ID NO: 2389455 - RNA, 14 nt, Bordetella pertussis
gggcgacugcagca

SEQ ID NO: 2389456 - RNA, 17 nt, Bordetella pertussis
gggcgagcgcagccgcu

SEQ ID NO: 2389457 - RNA, 20 nt, Bordetella pertussis
gggcgagcgcagccgcucca

SEQ ID NO: 2389458 - RNA, 17 nt, Bordetella pertussis
gggcgagcgggccgguc

SEQ ID NO: 2389459 - RNA, 16 nt, Bordetella pertussis
gggcgaggcggggcug

SEQ ID NO: 2389460 - RNA, 14 nt, Bordetella pertussis
gggcgagguagggc

SEQ ID NO: 2389461 - RNA, 15 nt, Bordetella pertussis
gggcgagguagggcg

SEQ ID NO: 2389462 - RNA, 15 nt, Bordetella pertussis
gggcgaggucagccc

SEQ ID NO: 2389463 - RNA, 16 nt, Bordetella pertussis
gggcgaucagcaccgc

SEQ ID NO: 2389464 - RNA, 18 nt, Bordetella pertussis
gggcgaucuucagcacca

SEQ ID NO: 2389465 - RNA, 22 nt, Bordetella pertussis
gggcgaugaccggcaagcgcuc

SEQ ID NO: 2389466 - RNA, 15 nt, Bordetella pertussis
gggcgaugccgcaga

SEQ ID NO: 2389467 - RNA, 15 nt, Bordetella pertussis
gggcgaugcggcggc

SEQ ID NO: 2389468 - RNA, 20 nt, Bordetella pertussis
gggcgaugcggcggccgaag

SEQ ID NO: 2389469 - RNA, 13 nt, Bordetella pertussis
gggcgauggcgcg

SEQ ID NO: 2389470 - RNA, 21 nt, Bordetella pertussis
gggcgaugucgucaucccuug

SEQ ID NO: 2389471 - RNA, 18 nt, Bordetella pertussis
gggcgauuugccgcagcc

SEQ ID NO: 2389472 - RNA, 20 nt, Bordetella pertussis
gggcgauuugccgcagcccg

SEQ ID NO: 2389473 - RNA, 13 nt, Bordetella pertussis
gggcgcaacgccg

SEQ ID NO: 2389474 - RNA, 15 nt, Bordetella pertussis
gggcgcaagccagca

SEQ ID NO: 2389475 - RNA, 14 nt, Bordetella pertussis
gggcgcaagcgcgc

SEQ ID NO: 2389476 - RNA, 21 nt, Bordetella pertussis
gggcgcaaguguggcgcaccg

SEQ ID NO: 2389477 - RNA, 20 nt, Bordetella pertussis
gggcgcaccggcacgcgcca

SEQ ID NO: 2389478 - RNA, 17 nt, Bordetella pertussis
gggcgcacgccgcgccg

SEQ ID NO: 2389479 - RNA, 24 nt, Bordetella pertussis
gggcgcauagcgaaagccgauacc

SEQ ID NO: 2389480 - RNA, 14 nt, Bordetella pertussis
gggcgccagcagcg

SEQ ID NO: 2389481 - RNA, 19 nt, Bordetella pertussis
gggcgccagcagcgggcug

SEQ ID NO: 2389482 - RNA, 13 nt, Bordetella pertussis
gggcgccaggcug

SEQ ID NO: 2389483 - RNA, 21 nt, Bordetella pertussis
gggcgccaggcugaaugccgc

SEQ ID NO: 2389484 - RNA, 20 nt, Bordetella pertussis
gggcgcccagcgcgucggcc

SEQ ID NO: 2389485 - RNA, 19 nt, Bordetella pertussis
gggcgccccaacgcggcca

SEQ ID NO: 2389486 - RNA, 16 nt, Bordetella pertussis
gggcgcccgcgcgcga

SEQ ID NO: 2389487 - RNA, 20 nt, Bordetella pertussis
gggcgccgacgaugccgccc

SEQ ID NO: 2389488 - RNA, 20 nt, Bordetella pertussis
gggcgccgagggccgcgcga

SEQ ID NO: 2389489 - RNA, 22 nt, Bordetella pertussis
gggcgccgcgccggggcggcgc

SEQ ID NO: 2389490 - RNA, 21 nt, Bordetella pertussis
gggcgccgcggggguggacgc

SEQ ID NO: 2389491 - RNA, 13 nt, Bordetella pertussis
gggcgccggcgua

SEQ ID NO: 2389492 - RNA, 12 nt, Bordetella pertussis
gggcgccgggcg

SEQ ID NO: 2389493 - RNA, 18 nt, Bordetella pertussis
gggcgccuacacgguggc

SEQ ID NO: 2389494 - RNA, 22 nt, Bordetella pertussis
gggcgccucguccugcaggcgg

SEQ ID NO: 2389495 - RNA, 17 nt, Bordetella pertussis
gggcgccugcggcaggc

SEQ ID NO: 2389496 - RNA, 16 nt, Bordetella pertussis
gggcgccuggcugcaa

SEQ ID NO: 2389497 - RNA, 17 nt, Bordetella pertussis
gggcgccuugccgccgc

SEQ ID NO: 2389498 - RNA, 20 nt, Bordetella pertussis
gggcgccuugccgccgcgca

SEQ ID NO: 2389499 - RNA, 13 nt, Bordetella pertussis
gggcgcgacgcca

SEQ ID NO: 2389500 - RNA, 21 nt, Bordetella pertussis
gggcgcgacgccagcgcgcca

SEQ ID NO: 2389501 - RNA, 22 nt, Bordetella pertussis
gggcgcgacgccagcgcgccau

SEQ ID NO: 2389502 - RNA, 18 nt, Bordetella pertussis
gggcgcgaugggccugcc

SEQ ID NO: 2389503 - RNA, 20 nt, Bordetella pertussis
gggcgcgaugggccugccca

SEQ ID NO: 2389504 - RNA, 24 nt, Bordetella pertussis
gggcgcgaugggccugcccauggc

SEQ ID NO: 2389505 - RNA, 15 nt, Bordetella pertussis
gggcgcgcagcaggc

SEQ ID NO: 2389506 - RNA, 13 nt, Bordetella pertussis
gggcgcgcccagc

SEQ ID NO: 2389507 - RNA, 15 nt, Bordetella pertussis
gggcgcgcccagccc

SEQ ID NO: 2389508 - RNA, 17 nt, Bordetella pertussis
gggcgcgcccagccccg

SEQ ID NO: 2389509 - RNA, 13 nt, Bordetella pertussis
gggcgcgcccggc

SEQ ID NO: 2389510 - RNA, 15 nt, Bordetella pertussis
gggcgcgccgcggcg

SEQ ID NO: 2389511 - RNA, 20 nt, Bordetella pertussis
gggcgcgccgcugcagcgcu

SEQ ID NO: 2389512 - RNA, 21 nt, Bordetella pertussis
gggcgcgccgcugcagcgcug

SEQ ID NO: 2389513 - RNA, 12 nt, Bordetella pertussis
gggcgcgcgcca

SEQ ID NO: 2389514 - RNA, 16 nt, Bordetella pertussis
gggcgcgcgcccaggc

SEQ ID NO: 2389515 - RNA, 17 nt, Bordetella pertussis
gggcgcgcucagcgcca

SEQ ID NO: 2389516 - RNA, 12 nt, Bordetella pertussis
gggcgcgcugcc

SEQ ID NO: 2389517 - RNA, 16 nt, Bordetella pertussis
gggcgcgcugcccagc

SEQ ID NO: 2389518 - RNA, 18 nt, Bordetella pertussis
gggcgcggaacagccugg

SEQ ID NO: 2389519 - RNA, 20 nt, Bordetella pertussis
gggcgcggaucaugggcucg

SEQ ID NO: 2389520 - RNA, 16 nt, Bordetella pertussis
gggcgcggcauggcgc

SEQ ID NO: 2389521 - RNA, 17 nt, Bordetella pertussis
gggcgcggccaggcgcu

SEQ ID NO: 2389522 - RNA, 16 nt, Bordetella pertussis
gggcgcggccaggguc

SEQ ID NO: 2389523 - RNA, 20 nt, Bordetella pertussis
gggcgcggccagggucaggg

SEQ ID NO: 2389524 - RNA, 13 nt, Bordetella pertussis
gggcgcggcccgg

SEQ ID NO: 2389525 - RNA, 14 nt, Bordetella pertussis
gggcgcggcccggc

SEQ ID NO: 2389526 - RNA, 13 nt, Bordetella pertussis
gggcgcggccggu

SEQ ID NO: 2389527 - RNA, 16 nt, Bordetella pertussis
gggcgcggccggugga

SEQ ID NO: 2389528 - RNA, 12 nt, Bordetella pertussis
gggcgcggcgcc

SEQ ID NO: 2389529 - RNA, 13 nt, Bordetella pertussis
gggcgcggcgccg

SEQ ID NO: 2389530 - RNA, 21 nt, Bordetella pertussis
gggcgcggcgcgcgccgaggu

SEQ ID NO: 2389531 - RNA, 12 nt, Bordetella pertussis
gggcgcggcggc

SEQ ID NO: 2389532 - RNA, 13 nt, Bordetella pertussis
gggcgcggcggcc

SEQ ID NO: 2389533 - RNA, 14 nt, Bordetella pertussis
gggcgcggcggccu

SEQ ID NO: 2389534 - RNA, 16 nt, Bordetella pertussis
gggcgcggcggccugg

SEQ ID NO: 2389535 - RNA, 17 nt, Bordetella pertussis
gggcgcggcggcguucc

SEQ ID NO: 2389536 - RNA, 15 nt, Bordetella pertussis
gggcgcggcgguggc

SEQ ID NO: 2389537 - RNA, 15 nt, Bordetella pertussis
gggcgcgggagcccg

SEQ ID NO: 2389538 - RNA, 15 nt, Bordetella pertussis
gggcgcgggccagcu

SEQ ID NO: 2389539 - RNA, 14 nt, Bordetella pertussis
gggcgcgggcuguc

SEQ ID NO: 2389540 - RNA, 18 nt, Bordetella pertussis
gggcgcgggcugucgcag

SEQ ID NO: 2389541 - RNA, 17 nt, Bordetella pertussis
gggcgcggugcgcacca

SEQ ID NO: 2389542 - RNA, 23 nt, Bordetella pertussis
gggcgcguaguagucgguggccu

SEQ ID NO: 2389543 - RNA, 15 nt, Bordetella pertussis
gggcgcguccaagca

SEQ ID NO: 2389544 - RNA, 16 nt, Bordetella pertussis
gggcgcucgagcgccu

SEQ ID NO: 2389545 - RNA, 18 nt, Bordetella pertussis
gggcgcucgagcgccugc

SEQ ID NO: 2389546 - RNA, 18 nt, Bordetella pertussis
gggcgcugcacgcagcgc

SEQ ID NO: 2389547 - RNA, 19 nt, Bordetella pertussis
gggcgcugcacgcagcgca

SEQ ID NO: 2389548 - RNA, 21 nt, Bordetella pertussis
gggcgcugcacgcagcgcagg

SEQ ID NO: 2389549 - RNA, 14 nt, Bordetella pertussis
gggcgcugcccagg

SEQ ID NO: 2389550 - RNA, 18 nt, Bordetella pertussis
gggcgcugcccaggaugg

SEQ ID NO: 2389551 - RNA, 20 nt, Bordetella pertussis
gggcgcugccugccggccgg

SEQ ID NO: 2389552 - RNA, 15 nt, Bordetella pertussis
gggcgcugcgccggc

SEQ ID NO: 2389553 - RNA, 16 nt, Bordetella pertussis
gggcgcugcgccggcg

SEQ ID NO: 2389554 - RNA, 16 nt, Bordetella pertussis
gggcgcuggcgcgcgg

SEQ ID NO: 2389555 - RNA, 20 nt, Bordetella pertussis
gggcgcuggcgcgcggcugg

SEQ ID NO: 2389556 - RNA, 13 nt, Bordetella pertussis
gggcgcuucgucg

SEQ ID NO: 2389557 - RNA, 22 nt, Bordetella pertussis
gggcgcuugccguagcgcgugg

SEQ ID NO: 2389558 - RNA, 21 nt, Bordetella pertussis
gggcgcuuggcccugcagcgg

SEQ ID NO: 2389559 - RNA, 18 nt, Bordetella pertussis
gggcggaaaacagcacca

SEQ ID NO: 2389560 - RNA, 20 nt, Bordetella pertussis
gggcggaaaacagcaccagc

SEQ ID NO: 2389561 - RNA, 12 nt, Bordetella pertussis
gggcggaucguc

SEQ ID NO: 2389562 - RNA, 19 nt, Bordetella pertussis
gggcggaugagcaggccgg

SEQ ID NO: 2389563 - RNA, 23 nt, Bordetella pertussis
gggcggaugagcaggccgggucg

SEQ ID NO: 2389564 - RNA, 18 nt, Bordetella pertussis
gggcggcaucucgcggcg

SEQ ID NO: 2389565 - RNA, 19 nt, Bordetella pertussis
gggcggccacgcgccgccc

SEQ ID NO: 2389566 - RNA, 17 nt, Bordetella pertussis
gggcggccacggcggug

SEQ ID NO: 2389567 - RNA, 18 nt, Bordetella pertussis
gggcggccacggcgguga

SEQ ID NO: 2389568 - RNA, 14 nt, Bordetella pertussis
gggcggccaggccg

SEQ ID NO: 2389569 - RNA, 13 nt, Bordetella pertussis
gggcggcccgcau

SEQ ID NO: 2389570 - RNA, 13 nt, Bordetella pertussis
gggcggcccggcg

SEQ ID NO: 2389571 - RNA, 16 nt, Bordetella pertussis
gggcggcccggcggca

SEQ ID NO: 2389572 - RNA, 13 nt, Bordetella pertussis
gggcggccgggag

SEQ ID NO: 2389573 - RNA, 17 nt, Bordetella pertussis
gggcggccgggagccug

SEQ ID NO: 2389574 - RNA, 18 nt, Bordetella pertussis
gggcggccgggagccugu

SEQ ID NO: 2389575 - RNA, 12 nt, Bordetella pertussis
gggcggccgggg

SEQ ID NO: 2389576 - RNA, 21 nt, Bordetella pertussis
gggcggccuaucaccugggca

SEQ ID NO: 2389577 - RNA, 12 nt, Bordetella pertussis
gggcggccuggg

SEQ ID NO: 2389578 - RNA, 18 nt, Bordetella pertussis
gggcggccuuggccgcag

SEQ ID NO: 2389579 - RNA, 21 nt, Bordetella pertussis
gggcggcgauuugagcagcgu

SEQ ID NO: 2389580 - RNA, 23 nt, Bordetella pertussis
gggcggcgcagucgcgcacgaag

SEQ ID NO: 2389581 - RNA, 20 nt, Bordetella pertussis
gggcggcgccuggucgcgcg

SEQ ID NO: 2389582 - RNA, 16 nt, Bordetella pertussis
gggcggcgcgcccagc

SEQ ID NO: 2389583 - RNA, 14 nt, Bordetella pertussis
gggcggcgcggcca

SEQ ID NO: 2389584 - RNA, 16 nt, Bordetella pertussis
gggcggcgcggccaac

SEQ ID NO: 2389585 - RNA, 18 nt, Bordetella pertussis
gggcggcgcggccaaccc

SEQ ID NO: 2389586 - RNA, 14 nt, Bordetella pertussis
gggcggcgcgggcg

SEQ ID NO: 2389587 - RNA, 11 nt, Bordetella pertussis
gggcggcggca

SEQ ID NO: 2389588 - RNA, 12 nt, Bordetella pertussis
gggcggcgggca

SEQ ID NO: 2389589 - RNA, 20 nt, Bordetella pertussis
gggcggcgucgaucggcgcg

SEQ ID NO: 2389590 - RNA, 16 nt, Bordetella pertussis
gggcggcuaggcgcag

SEQ ID NO: 2389591 - RNA, 20 nt, Bordetella pertussis
gggcggcuaggcgcagcagg

SEQ ID NO: 2389592 - RNA, 17 nt, Bordetella pertussis
gggcggcucggcccuag

SEQ ID NO: 2389593 - RNA, 15 nt, Bordetella pertussis
gggcggcugccagug

SEQ ID NO: 2389594 - RNA, 12 nt, Bordetella pertussis
gggcggcugccg

SEQ ID NO: 2389595 - RNA, 15 nt, Bordetella pertussis
gggcgggcgggcgca

SEQ ID NO: 2389596 - RNA, 13 nt, Bordetella pertussis
gggcggggcguga

SEQ ID NO: 2389597 - RNA, 16 nt, Bordetella pertussis
gggcggguucguggcu

SEQ ID NO: 2389598 - RNA, 19 nt, Bordetella pertussis
gggcggguugugcccgccc

SEQ ID NO: 2389599 - RNA, 16 nt, Bordetella pertussis
gggcggucaaugcggc

SEQ ID NO: 2389600 - RNA, 22 nt, Bordetella pertussis
gggcggucggcgcggcgccguc

SEQ ID NO: 2389601 - RNA, 14 nt, Bordetella pertussis
gggcggugcggccu

SEQ ID NO: 2389602 - RNA, 17 nt, Bordetella pertussis
gggcggugggcagcgcg

SEQ ID NO: 2389603 - RNA, 16 nt, Bordetella pertussis
gggcgguugcgcugcu

SEQ ID NO: 2389604 - RNA, 21 nt, Bordetella pertussis
gggcguagcucagccugguag

SEQ ID NO: 2389605 - RNA, 20 nt, Bordetella pertussis
gggcgucaccggcgagccga

SEQ ID NO: 2389606 - RNA, 16 nt, Bordetella pertussis
gggcgucaucggcgcg

SEQ ID NO: 2389607 - RNA, 16 nt, Bordetella pertussis
gggcguccaccgccga

SEQ ID NO: 2389608 - RNA, 21 nt, Bordetella pertussis
gggcgucgaaggcggccggca

SEQ ID NO: 2389609 - RNA, 14 nt, Bordetella pertussis
gggcgucgcggcgu

SEQ ID NO: 2389610 - RNA, 13 nt, Bordetella pertussis
gggcgucgcugcu

SEQ ID NO: 2389611 - RNA, 17 nt, Bordetella pertussis
gggcgucgcugcuggcg

SEQ ID NO: 2389612 - RNA, 17 nt, Bordetella pertussis
gggcgucguagcccucg

SEQ ID NO: 2389613 - RNA, 22 nt, Bordetella pertussis
gggcgucguccugcagcagggu

SEQ ID NO: 2389614 - RNA, 14 nt, Bordetella pertussis
gggcgucgucgccg

SEQ ID NO: 2389615 - RNA, 16 nt, Bordetella pertussis
gggcgucgucgcgguc

SEQ ID NO: 2389616 - RNA, 23 nt, Bordetella pertussis
gggcgucugcccgcgguccagca

SEQ ID NO: 2389617 - RNA, 13 nt, Bordetella pertussis
gggcgucugcucg

SEQ ID NO: 2389618 - RNA, 16 nt, Bordetella pertussis
gggcgucugcucgccg

SEQ ID NO: 2389619 - RNA, 19 nt, Bordetella pertussis
gggcgucugcucgccguuc

SEQ ID NO: 2389620 - RNA, 21 nt, Bordetella pertussis
gggcgugaaaggccagcggcg

SEQ ID NO: 2389621 - RNA, 13 nt, Bordetella pertussis
gggcgugagcagg

SEQ ID NO: 2389622 - RNA, 18 nt, Bordetella pertussis
gggcgugagcaggcgccu

SEQ ID NO: 2389623 - RNA, 14 nt, Bordetella pertussis
gggcgugagcgccu

SEQ ID NO: 2389624 - RNA, 14 nt, Bordetella pertussis
gggcgugaugccga

SEQ ID NO: 2389625 - RNA, 15 nt, Bordetella pertussis
gggcgugcgggacgg

SEQ ID NO: 2389626 - RNA, 23 nt, Bordetella pertussis
gggcguggcgucguggggcgcgg

SEQ ID NO: 2389627 - RNA, 14 nt, Bordetella pertussis
gggcguggugcuga

SEQ ID NO: 2389628 - RNA, 13 nt, Bordetella pertussis
gggcguucgacgg

SEQ ID NO: 2389629 - RNA, 19 nt, Bordetella pertussis
gggcguucgacgggcaggc

SEQ ID NO: 2389630 - RNA, 20 nt, Bordetella pertussis
gggcguuuuugcguccggcg

SEQ ID NO: 2389631 - RNA, 14 nt, Bordetella pertussis
gggcucagcccgcc

SEQ ID NO: 2389632 - RNA, 15 nt, Bordetella pertussis
gggcuccucgcccga

SEQ ID NO: 2389633 - RNA, 19 nt, Bordetella pertussis
gggcuccugugggggcgcg

SEQ ID NO: 2389634 - RNA, 20 nt, Bordetella pertussis
gggcucgaugaccagcagcg

SEQ ID NO: 2389635 - RNA, 13 nt, Bordetella pertussis
gggcucgcgcccg

SEQ ID NO: 2389636 - RNA, 21 nt, Bordetella pertussis
gggcucgcgcccgagcgccac

SEQ ID NO: 2389637 - RNA, 17 nt, Bordetella pertussis
gggcucgcgcgagccca

SEQ ID NO: 2389638 - RNA, 22 nt, Bordetella pertussis
gggcucgcgcgcgcgggcgcgc

SEQ ID NO: 2389639 - RNA, 12 nt, Bordetella pertussis
gggcucggccac

SEQ ID NO: 2389640 - RNA, 14 nt, Bordetella pertussis
gggcucggccaggu

SEQ ID NO: 2389641 - RNA, 14 nt, Bordetella pertussis
gggcucgugcagca

SEQ ID NO: 2389642 - RNA, 16 nt, Bordetella pertussis
gggcucgugcagcagg

SEQ ID NO: 2389643 - RNA, 18 nt, Bordetella pertussis
gggcucuucgacagcgcg

SEQ ID NO: 2389644 - RNA, 14 nt, Bordetella pertussis
gggcugauccgcac

SEQ ID NO: 2389645 - RNA, 19 nt, Bordetella pertussis
gggcugaucuugaugcggc

SEQ ID NO: 2389646 - RNA, 23 nt, Bordetella pertussis
gggcugcacgauguugccgccgg

SEQ ID NO: 2389647 - RNA, 23 nt, Bordetella pertussis
gggcugcaugcucuggcacacca

SEQ ID NO: 2389648 - RNA, 19 nt, Bordetella pertussis
gggcugccauuccagcucc

SEQ ID NO: 2389649 - RNA, 20 nt, Bordetella pertussis
gggcugccauuccagcuccg

SEQ ID NO: 2389650 - RNA, 16 nt, Bordetella pertussis
gggcugcccucgcccg

SEQ ID NO: 2389651 - RNA, 19 nt, Bordetella pertussis
gggcugccguagcccaggu

SEQ ID NO: 2389652 - RNA, 17 nt, Bordetella pertussis
gggcugcgacaggcgca

SEQ ID NO: 2389653 - RNA, 18 nt, Bordetella pertussis
gggcugcgacaggcgcag

SEQ ID NO: 2389654 - RNA, 15 nt, Bordetella pertussis
gggcugcgugcggga

SEQ ID NO: 2389655 - RNA, 21 nt, Bordetella pertussis
gggcugcgugcgggacaggca

SEQ ID NO: 2389656 - RNA, 23 nt, Bordetella pertussis
gggcugcugcccgaagcgcagca

SEQ ID NO: 2389657 - RNA, 22 nt, Bordetella pertussis
gggcuggagaacgagccggccg

SEQ ID NO: 2389658 - RNA, 16 nt, Bordetella pertussis
gggcuggauccggcgc

SEQ ID NO: 2389659 - RNA, 15 nt, Bordetella pertussis
gggcuggccagcugg

SEQ ID NO: 2389660 - RNA, 16 nt, Bordetella pertussis
gggcuggccagcuggc

SEQ ID NO: 2389661 - RNA, 13 nt, Bordetella pertussis
gggcuggccgccg

SEQ ID NO: 2389662 - RNA, 22 nt, Bordetella pertussis
gggcuggccgccgcggccucgg

SEQ ID NO: 2389663 - RNA, 19 nt, Bordetella pertussis
gggcuggccgccugcugcg

SEQ ID NO: 2389664 - RNA, 16 nt, Bordetella pertussis
gggcuggcgcggcugg

SEQ ID NO: 2389665 - RNA, 12 nt, Bordetella pertussis
gggcugggccga

SEQ ID NO: 2389666 - RNA, 16 nt, Bordetella pertussis
gggcuggucgcgccgg

SEQ ID NO: 2389667 - RNA, 14 nt, Bordetella pertussis
gggcuggucgggcg

SEQ ID NO: 2389668 - RNA, 15 nt, Bordetella pertussis
gggcuggucgggcgu

SEQ ID NO: 2389669 - RNA, 12 nt, Bordetella pertussis
gggcugguggug

SEQ ID NO: 2389670 - RNA, 22 nt, Bordetella pertussis
gggcuguauagaugcgcggggc

SEQ ID NO: 2389671 - RNA, 10 nt, Bordetella pertussis
gggcugucgc

SEQ ID NO: 2389672 - RNA, 18 nt, Bordetella pertussis
gggcugucgcagucgggg

SEQ ID NO: 2389673 - RNA, 14 nt, Bordetella pertussis
gggcugucgcgcgc

SEQ ID NO: 2389674 - RNA, 15 nt, Bordetella pertussis
gggcugucgcgcuac

SEQ ID NO: 2389675 - RNA, 19 nt, Bordetella pertussis
gggcuguucgcgcagcagg

SEQ ID NO: 2389676 - RNA, 23 nt, Bordetella pertussis
gggcuguucguagucgagccagg

SEQ ID NO: 2389677 - RNA, 18 nt, Bordetella pertussis
gggcuugccggugcucgg

SEQ ID NO: 2389678 - RNA, 20 nt, Bordetella pertussis
gggcuugcggcgcuggcugg

SEQ ID NO: 2389679 - RNA, 16 nt, Bordetella pertussis
gggcuuugacgccggc

SEQ ID NO: 2389680 - RNA, 17 nt, Bordetella pertussis
gggcuuugacgccggcu

SEQ ID NO: 2389681 - RNA, 14 nt, Bordetella pertussis
gggcuuuuuccugu

SEQ ID NO: 2389682 - RNA, 22 nt, Bordetella pertussis
gggcuuuuuccuguucggccac

SEQ ID NO: 2389683 - RNA, 14 nt, Bordetella pertussis
gggcuuuuugccuu

SEQ ID NO: 2389684 - RNA, 15 nt, Bordetella pertussis
gggcuuuuugccuug

SEQ ID NO: 2389685 - RNA, 20 nt, Bordetella pertussis
gggcuuuuugccuuggggcg

SEQ ID NO: 2389686 - RNA, 15 nt, Bordetella pertussis
gggcuuuuuugccuu

SEQ ID NO: 2389687 - RNA, 16 nt, Bordetella pertussis
gggcuuuuuugccuug

SEQ ID NO: 2389688 - RNA, 21 nt, Bordetella pertussis
gggcuuuuuugccuuggggcg

SEQ ID NO: 2389689 - RNA, 13 nt, Bordetella pertussis
ggggaagccgccg

SEQ ID NO: 2389690 - RNA, 13 nt, Bordetella pertussis
ggggacaggcacc

SEQ ID NO: 2389691 - RNA, 16 nt, Bordetella pertussis
ggggacaggcacccug

SEQ ID NO: 2389692 - RNA, 19 nt, Bordetella pertussis
ggggacaggcacccugccc

SEQ ID NO: 2389693 - RNA, 14 nt, Bordetella pertussis
ggggacaggcaccu

SEQ ID NO: 2389694 - RNA, 22 nt, Bordetella pertussis
ggggacaggcacgccgggguug

SEQ ID NO: 2389695 - RNA, 13 nt, Bordetella pertussis
ggggacaggcgcc

SEQ ID NO: 2389696 - RNA, 19 nt, Bordetella pertussis
ggggacgccggcgggcagg

SEQ ID NO: 2389697 - RNA, 22 nt, Bordetella pertussis
ggggacgccggcgggcaggcgg

SEQ ID NO: 2389698 - RNA, 13 nt, Bordetella pertussis
ggggacuggcucc

SEQ ID NO: 2389699 - RNA, 11 nt, Bordetella pertussis
ggggagccugc

SEQ ID NO: 2389700 - RNA, 23 nt, Bordetella pertussis
ggggagcgacccguggcccgggu

SEQ ID NO: 2389701 - RNA, 19 nt, Bordetella pertussis
ggggaucaccagcccggcg

SEQ ID NO: 2389702 - RNA, 12 nt, Bordetella pertussis
ggggaugacggg

SEQ ID NO: 2389703 - RNA, 13 nt, Bordetella pertussis
ggggaugacgggc

SEQ ID NO: 2389704 - RNA, 21 nt, Bordetella pertussis
ggggauggcuuccugcggcac

SEQ ID NO: 2389705 - RNA, 13 nt, Bordetella pertussis
ggggcaaccggcc

SEQ ID NO: 2389706 - RNA, 19 nt, Bordetella pertussis
ggggcaacgacgcaggcgc

SEQ ID NO: 2389707 - RNA, 21 nt, Bordetella pertussis
ggggcaacgacgcaggcgccg

SEQ ID NO: 2389708 - RNA, 12 nt, Bordetella pertussis
ggggcacccagg

SEQ ID NO: 2389709 - RNA, 13 nt, Bordetella pertussis
ggggcacccaggc

SEQ ID NO: 2389710 - RNA, 21 nt, Bordetella pertussis
ggggcagccauccucgcccag

SEQ ID NO: 2389711 - RNA, 15 nt, Bordetella pertussis
ggggcaggaagccgg

SEQ ID NO: 2389712 - RNA, 17 nt, Bordetella pertussis
ggggcaggacgccggcg

SEQ ID NO: 2389713 - RNA, 22 nt, Bordetella pertussis
ggggcaggacgccggcgccggc

SEQ ID NO: 2389714 - RNA, 23 nt, Bordetella pertussis
ggggcaggcacuggcgcggcgcu

SEQ ID NO: 2389715 - RNA, 14 nt, Bordetella pertussis
ggggcaggccuggu

SEQ ID NO: 2389716 - RNA, 17 nt, Bordetella pertussis
ggggcaggccuggucga

SEQ ID NO: 2389717 - RNA, 22 nt, Bordetella pertussis
ggggcaggccuggucgagcggg

SEQ ID NO: 2389718 - RNA, 12 nt, Bordetella pertussis
ggggcaggcgca

SEQ ID NO: 2389719 - RNA, 19 nt, Bordetella pertussis
ggggcaggcgcagcggcgg

SEQ ID NO: 2389720 - RNA, 13 nt, Bordetella pertussis
ggggcaggcugga

SEQ ID NO: 2389721 - RNA, 21 nt, Bordetella pertussis
ggggcaggcuggaagucagcc

SEQ ID NO: 2389722 - RNA, 14 nt, Bordetella pertussis
ggggcauggcgccg

SEQ ID NO: 2389723 - RNA, 22 nt, Bordetella pertussis
ggggccacauggucgcccagca

SEQ ID NO: 2389724 - RNA, 17 nt, Bordetella pertussis
ggggccagccuggcgcc

SEQ ID NO: 2389725 - RNA, 13 nt, Bordetella pertussis
ggggccaggcgca

SEQ ID NO: 2389726 - RNA, 20 nt, Bordetella pertussis
ggggcccuugugcguuggcg

SEQ ID NO: 2389727 - RNA, 22 nt, Bordetella pertussis
ggggcccuugugcugccaugcc

SEQ ID NO: 2389728 - RNA, 14 nt, Bordetella pertussis
ggggccgagcgugc

SEQ ID NO: 2389729 - RNA, 13 nt, Bordetella pertussis
ggggccgcagcug

SEQ ID NO: 2389730 - RNA, 15 nt, Bordetella pertussis
ggggccgccaacgcc

SEQ ID NO: 2389731 - RNA, 13 nt, Bordetella pertussis
ggggccgcccagc

SEQ ID NO: 2389732 - RNA, 14 nt, Bordetella pertussis
ggggccgcccagca

SEQ ID NO: 2389733 - RNA, 13 nt, Bordetella pertussis
ggggccgcccugc

SEQ ID NO: 2389734 - RNA, 17 nt, Bordetella pertussis
ggggccgcccuggucau

SEQ ID NO: 2389735 - RNA, 16 nt, Bordetella pertussis
ggggccgcgccguucu

SEQ ID NO: 2389736 - RNA, 14 nt, Bordetella pertussis
ggggccgcgcgcca

SEQ ID NO: 2389737 - RNA, 11 nt, Bordetella pertussis
ggggccgcggc

SEQ ID NO: 2389738 - RNA, 22 nt, Bordetella pertussis
ggggccggccgcgcgcgccagg

SEQ ID NO: 2389739 - RNA, 13 nt, Bordetella pertussis
ggggccggcgccg

SEQ ID NO: 2389740 - RNA, 15 nt, Bordetella pertussis
ggggccggcgcgccg

SEQ ID NO: 2389741 - RNA, 19 nt, Bordetella pertussis
ggggccgggccggcgggcg

SEQ ID NO: 2389742 - RNA, 16 nt, Bordetella pertussis
ggggccgggcgccagg

SEQ ID NO: 2389743 - RNA, 18 nt, Bordetella pertussis
ggggccgggcgccaggcu

SEQ ID NO: 2389744 - RNA, 13 nt, Bordetella pertussis
ggggccgucgccg

SEQ ID NO: 2389745 - RNA, 17 nt, Bordetella pertussis
ggggccuuugcggcagg

SEQ ID NO: 2389746 - RNA, 12 nt, Bordetella pertussis
ggggcgagcgca

SEQ ID NO: 2389747 - RNA, 16 nt, Bordetella pertussis
ggggcgagcgcagccg

SEQ ID NO: 2389748 - RNA, 15 nt, Bordetella pertussis
ggggcgagcgggccg

SEQ ID NO: 2389749 - RNA, 16 nt, Bordetella pertussis
ggggcgagcgggccgg

SEQ ID NO: 2389750 - RNA, 19 nt, Bordetella pertussis
ggggcgaugucgucauccc

SEQ ID NO: 2389751 - RNA, 12 nt, Bordetella pertussis
ggggcgcaccgg

SEQ ID NO: 2389752 - RNA, 13 nt, Bordetella pertussis
ggggcgcaccggc

SEQ ID NO: 2389753 - RNA, 14 nt, Bordetella pertussis
ggggcgcaccggca

SEQ ID NO: 2389754 - RNA, 23 nt, Bordetella pertussis
ggggcgcaucaugaggcggcggu

SEQ ID NO: 2389755 - RNA, 12 nt, Bordetella pertussis
ggggcgcccagc

SEQ ID NO: 2389756 - RNA, 13 nt, Bordetella pertussis
ggggcgcccagcg

SEQ ID NO: 2389757 - RNA, 20 nt, Bordetella pertussis
ggggcgcgagaggguguugc

SEQ ID NO: 2389758 - RNA, 14 nt, Bordetella pertussis
ggggcgcgccgcgg

SEQ ID NO: 2389759 - RNA, 14 nt, Bordetella pertussis
ggggcgcuggucga

SEQ ID NO: 2389760 - RNA, 22 nt, Bordetella pertussis
ggggcggaugagcaggccgggu

SEQ ID NO: 2389761 - RNA, 13 nt, Bordetella pertussis
ggggcggcccagc

SEQ ID NO: 2389762 - RNA, 12 nt, Bordetella pertussis
ggggcggcgccu

SEQ ID NO: 2389763 - RNA, 14 nt, Bordetella pertussis
ggggcggcucggcc

SEQ ID NO: 2389764 - RNA, 14 nt, Bordetella pertussis
ggggcgggcgcugc

SEQ ID NO: 2389765 - RNA, 20 nt, Bordetella pertussis
ggggcggucaaugcggcggc

SEQ ID NO: 2389766 - RNA, 15 nt, Bordetella pertussis
ggggcguagcucagc

SEQ ID NO: 2389767 - RNA, 16 nt, Bordetella pertussis
ggggcguagcucagcc

SEQ ID NO: 2389768 - RNA, 14 nt, Bordetella pertussis
ggggcgucgcugcu

SEQ ID NO: 2389769 - RNA, 21 nt, Bordetella pertussis
ggggcgucgcugcuggcggcg

SEQ ID NO: 2389770 - RNA, 20 nt, Bordetella pertussis
ggggcgugcccuugagcgug

SEQ ID NO: 2389771 - RNA, 23 nt, Bordetella pertussis
ggggcgugcccuugagcgugggc

SEQ ID NO: 2389772 - RNA, 15 nt, Bordetella pertussis
ggggcguggccgcag

SEQ ID NO: 2389773 - RNA, 17 nt, Bordetella pertussis
ggggcuccaggaacacc

SEQ ID NO: 2389774 - RNA, 19 nt, Bordetella pertussis
ggggcucgcgcccgagcgc

SEQ ID NO: 2389775 - RNA, 12 nt, Bordetella pertussis
ggggcucggcca

SEQ ID NO: 2389776 - RNA, 13 nt, Bordetella pertussis
ggggcucggccag

SEQ ID NO: 2389777 - RNA, 19 nt, Bordetella pertussis
ggggcugccgugaggcagc

SEQ ID NO: 2389778 - RNA, 18 nt, Bordetella pertussis
ggggcuggcauggcgguc

SEQ ID NO: 2389779 - RNA, 20 nt, Bordetella pertussis
ggggcuggccgccgcggccu

SEQ ID NO: 2389780 - RNA, 17 nt, Bordetella pertussis
ggggcuguaccuggcga

SEQ ID NO: 2389781 - RNA, 21 nt, Bordetella pertussis
ggggcuuuuuguugcgcgccg

SEQ ID NO: 2389782 - RNA, 23 nt, Bordetella pertussis
ggggcuuuuuguugcgcgccgua

SEQ ID NO: 2389783 - RNA, 11 nt, Bordetella pertussis
gggggacaggc

SEQ ID NO: 2389784 - RNA, 12 nt, Bordetella pertussis
gggggacuggca

SEQ ID NO: 2389785 - RNA, 14 nt, Bordetella pertussis
gggggacuggcacc

SEQ ID NO: 2389786 - RNA, 16 nt, Bordetella pertussis
gggggacuggcacccg

SEQ ID NO: 2389787 - RNA, 15 nt, Bordetella pertussis
gggggacuggcaccg

SEQ ID NO: 2389788 - RNA, 14 nt, Bordetella pertussis
gggggauuggugcc

SEQ ID NO: 2389789 - RNA, 16 nt, Bordetella pertussis
gggggcaggccgcggu

SEQ ID NO: 2389790 - RNA, 19 nt, Bordetella pertussis
gggggcauggcgccgcgcg

SEQ ID NO: 2389791 - RNA, 12 nt, Bordetella pertussis
gggggcgagcgg

SEQ ID NO: 2389792 - RNA, 13 nt, Bordetella pertussis
gggggcgagcggg

SEQ ID NO: 2389793 - RNA, 23 nt, Bordetella pertussis
gggggcgccccaacgcggccagc

SEQ ID NO: 2389794 - RNA, 20 nt, Bordetella pertussis
gggggcgguaccguccuggc

SEQ ID NO: 2389795 - RNA, 15 nt, Bordetella pertussis
gggggcguugcggug

SEQ ID NO: 2389796 - RNA, 13 nt, Bordetella pertussis
gggggucaggccg

SEQ ID NO: 2389797 - RNA, 19 nt, Bordetella pertussis
gggggucaggccguuggcg

SEQ ID NO: 2389798 - RNA, 20 nt, Bordetella pertussis
gggggucagggccgcccagu

SEQ ID NO: 2389799 - RNA, 20 nt, Bordetella pertussis
gggggucgaucauggccagc

SEQ ID NO: 2389800 - RNA, 18 nt, Bordetella pertussis
gggggucuggcaccugcc

SEQ ID NO: 2389801 - RNA, 15 nt, Bordetella pertussis
ggggguggcggccgu

SEQ ID NO: 2389802 - RNA, 19 nt, Bordetella pertussis
ggggguucgugggcgagcg

SEQ ID NO: 2389803 - RNA, 20 nt, Bordetella pertussis
ggggguucgugggcgagcgu

SEQ ID NO: 2389804 - RNA, 11 nt, Bordetella pertussis
ggggguuggcc

SEQ ID NO: 2389805 - RNA, 14 nt, Bordetella pertussis
gggguaggcgcggu

SEQ ID NO: 2389806 - RNA, 13 nt, Bordetella pertussis
ggggucagcgccg

SEQ ID NO: 2389807 - RNA, 14 nt, Bordetella pertussis
ggggucagcgccgg

SEQ ID NO: 2389808 - RNA, 18 nt, Bordetella pertussis
ggggucagcgccggcacg

SEQ ID NO: 2389809 - RNA, 13 nt, Bordetella pertussis
ggggucaggccgu

SEQ ID NO: 2389810 - RNA, 18 nt, Bordetella pertussis
ggggucaggccguuggcg

SEQ ID NO: 2389811 - RNA, 22 nt, Bordetella pertussis
ggggucaggccguuggcgcgcc

SEQ ID NO: 2389812 - RNA, 22 nt, Bordetella pertussis
gggguccagcaaaugggccgca

SEQ ID NO: 2389813 - RNA, 19 nt, Bordetella pertussis
ggggucgaucauggccagc

SEQ ID NO: 2389814 - RNA, 18 nt, Bordetella pertussis
ggggucgccgggcagcgg

SEQ ID NO: 2389815 - RNA, 16 nt, Bordetella pertussis
ggggucgggccgcgcg

SEQ ID NO: 2389816 - RNA, 22 nt, Bordetella pertussis
ggggugauggcgaaacuggccg

SEQ ID NO: 2389817 - RNA, 23 nt, Bordetella pertussis
ggggugccaucgauaugggcggc

SEQ ID NO: 2389818 - RNA, 12 nt, Bordetella pertussis
ggggugccuguc

SEQ ID NO: 2389819 - RNA, 21 nt, Bordetella pertussis
ggggugcuccugccaggcgcc

SEQ ID NO: 2389820 - RNA, 13 nt, Bordetella pertussis
gggguggccggcg

SEQ ID NO: 2389821 - RNA, 16 nt, Bordetella pertussis
gggguggccggcgcgc

SEQ ID NO: 2389822 - RNA, 21 nt, Bordetella pertussis
gggguucuguccggcgcuggc

SEQ ID NO: 2389823 - RNA, 22 nt, Bordetella pertussis
gggguugggaucgcgccaggcg

SEQ ID NO: 2389824 - RNA, 23 nt, Bordetella pertussis
gggguugggaucgcgccaggcgu

SEQ ID NO: 2389825 - RNA, 22 nt, Bordetella pertussis
gggguuuuuuuuugggaaggcc

SEQ ID NO: 2389826 - RNA, 15 nt, Bordetella pertussis
ggguacgacggccgg

SEQ ID NO: 2389827 - RNA, 19 nt, Bordetella pertussis
ggguagcggaugcggggga

SEQ ID NO: 2389828 - RNA, 21 nt, Bordetella pertussis
ggguagcggaugcgggggaug

SEQ ID NO: 2389829 - RNA, 22 nt, Bordetella pertussis
ggguagucggccaccaggccgu

SEQ ID NO: 2389830 - RNA, 17 nt, Bordetella pertussis
ggguaucgucgaccugg

SEQ ID NO: 2389831 - RNA, 14 nt, Bordetella pertussis
gggucaaggcgcgg

SEQ ID NO: 2389832 - RNA, 15 nt, Bordetella pertussis
gggucaaggcgcggc

SEQ ID NO: 2389833 - RNA, 18 nt, Bordetella pertussis
gggucaaggcggggcucc

SEQ ID NO: 2389834 - RNA, 13 nt, Bordetella pertussis
gggucagcccgcc

SEQ ID NO: 2389835 - RNA, 16 nt, Bordetella pertussis
gggucagcccgccauc

SEQ ID NO: 2389836 - RNA, 21 nt, Bordetella pertussis
gggucagcggccggcccgugc

SEQ ID NO: 2389837 - RNA, 19 nt, Bordetella pertussis
gggucagguuagccagugc

SEQ ID NO: 2389838 - RNA, 20 nt, Bordetella pertussis
gggucaucgagguggcgggc

SEQ ID NO: 2389839 - RNA, 22 nt, Bordetella pertussis
gggucaugaugucggccaggga

SEQ ID NO: 2389840 - RNA, 19 nt, Bordetella pertussis
ggguccagcaaaugggccg

SEQ ID NO: 2389841 - RNA, 14 nt, Bordetella pertussis
ggguccagcacgcc

SEQ ID NO: 2389842 - RNA, 17 nt, Bordetella pertussis
ggguccagccccacgcc

SEQ ID NO: 2389843 - RNA, 18 nt, Bordetella pertussis
gggucccaaccagggccg

SEQ ID NO: 2389844 - RNA, 15 nt, Bordetella pertussis
ggguccggccgcgca

SEQ ID NO: 2389845 - RNA, 14 nt, Bordetella pertussis
ggguccugaggcca

SEQ ID NO: 2389846 - RNA, 17 nt, Bordetella pertussis
ggguccugaggccaggc

SEQ ID NO: 2389847 - RNA, 18 nt, Bordetella pertussis
gggucgaguugcgcgcca

SEQ ID NO: 2389848 - RNA, 21 nt, Bordetella pertussis
gggucgaguugcgcgccauga

SEQ ID NO: 2389849 - RNA, 15 nt, Bordetella pertussis
gggucgccgggcagc

SEQ ID NO: 2389850 - RNA, 15 nt, Bordetella pertussis
gggucgccgguggug

SEQ ID NO: 2389851 - RNA, 15 nt, Bordetella pertussis
gggucgcgcagcagg

SEQ ID NO: 2389852 - RNA, 17 nt, Bordetella pertussis
gggucgcuguagcgcag

SEQ ID NO: 2389853 - RNA, 20 nt, Bordetella pertussis
gggucgcuguagcgcagccc

SEQ ID NO: 2389854 - RNA, 16 nt, Bordetella pertussis
gggucggccugccacc

SEQ ID NO: 2389855 - RNA, 17 nt, Bordetella pertussis
gggucgggcgucugccc

SEQ ID NO: 2389856 - RNA, 19 nt, Bordetella pertussis
gggucggucugcgugcgcg

SEQ ID NO: 2389857 - RNA, 16 nt, Bordetella pertussis
gggucguacgagccga

SEQ ID NO: 2389858 - RNA, 18 nt, Bordetella pertussis
gggucgucccagcgcacg

SEQ ID NO: 2389859 - RNA, 21 nt, Bordetella pertussis
gggucuaucccccgcggagga

SEQ ID NO: 2389860 - RNA, 16 nt, Bordetella pertussis
gggucugcaggccgaa

SEQ ID NO: 2389861 - RNA, 16 nt, Bordetella pertussis
gggucugccccauggc

SEQ ID NO: 2389862 - RNA, 20 nt, Bordetella pertussis
gggucugcuggucgcgggcc

SEQ ID NO: 2389863 - RNA, 13 nt, Bordetella pertussis
gggucuggcggcc

SEQ ID NO: 2389864 - RNA, 16 nt, Bordetella pertussis
gggucuggcggccggu

SEQ ID NO: 2389865 - RNA, 19 nt, Bordetella pertussis
gggugaagccaagcagggc

SEQ ID NO: 2389866 - RNA, 13 nt, Bordetella pertussis
gggugaccauguc

SEQ ID NO: 2389867 - RNA, 16 nt, Bordetella pertussis
gggugaccuggcgcgc

SEQ ID NO: 2389868 - RNA, 20 nt, Bordetella pertussis
gggugaccuuggucgggucc

SEQ ID NO: 2389869 - RNA, 15 nt, Bordetella pertussis
gggugacgcuggagc

SEQ ID NO: 2389870 - RNA, 18 nt, Bordetella pertussis
gggugaucacggccguca

SEQ ID NO: 2389871 - RNA, 17 nt, Bordetella pertussis
gggugaucugcgccauc

SEQ ID NO: 2389872 - RNA, 22 nt, Bordetella pertussis
gggugccaguccccugcgggga

SEQ ID NO: 2389873 - RNA, 23 nt, Bordetella pertussis
gggugccaucgauaugggcggcc

SEQ ID NO: 2389874 - RNA, 15 nt, Bordetella pertussis
gggugccccgccgga

SEQ ID NO: 2389875 - RNA, 19 nt, Bordetella pertussis
gggugccuguccccgcgga

SEQ ID NO: 2389876 - RNA, 20 nt, Bordetella pertussis
gggugccuguccccgcgggg

SEQ ID NO: 2389877 - RNA, 13 nt, Bordetella pertussis
gggugcgaggcga

SEQ ID NO: 2389878 - RNA, 20 nt, Bordetella pertussis
gggugcgccaaucggcguug

SEQ ID NO: 2389879 - RNA, 17 nt, Bordetella pertussis
gggugcgccgccggccu

SEQ ID NO: 2389880 - RNA, 22 nt, Bordetella pertussis
gggugcgccugcagcgccgccu

SEQ ID NO: 2389881 - RNA, 23 nt, Bordetella pertussis
gggugcggcgccacugccaggcg

SEQ ID NO: 2389882 - RNA, 21 nt, Bordetella pertussis
gggugcuccugccaggcgccg

SEQ ID NO: 2389883 - RNA, 15 nt, Bordetella pertussis
gggugcuguucaggc

SEQ ID NO: 2389884 - RNA, 20 nt, Bordetella pertussis
ggguggaaaugccggcggcg

SEQ ID NO: 2389885 - RNA, 19 nt, Bordetella pertussis
ggguggagaauucggcgcg

SEQ ID NO: 2389886 - RNA, 21 nt, Bordetella pertussis
ggguggcauugacgcccacgc

SEQ ID NO: 2389887 - RNA, 15 nt, Bordetella pertussis
ggguggccacgccca

SEQ ID NO: 2389888 - RNA, 14 nt, Bordetella pertussis
ggguggccagcgcc

SEQ ID NO: 2389889 - RNA, 13 nt, Bordetella pertussis
ggguggccggcgc

SEQ ID NO: 2389890 - RNA, 15 nt, Bordetella pertussis
ggguggccucgcccu

SEQ ID NO: 2389891 - RNA, 13 nt, Bordetella pertussis
ggguggcgccggc

SEQ ID NO: 2389892 - RNA, 14 nt, Bordetella pertussis
ggguggcgccguuc

SEQ ID NO: 2389893 - RNA, 13 nt, Bordetella pertussis
ggguggcgggcgc

SEQ ID NO: 2389894 - RNA, 13 nt, Bordetella pertussis
ggguggcggggcg

SEQ ID NO: 2389895 - RNA, 14 nt, Bordetella pertussis
ggguggcggggcgc

SEQ ID NO: 2389896 - RNA, 15 nt, Bordetella pertussis
ggguggcugcgcagg

SEQ ID NO: 2389897 - RNA, 12 nt, Bordetella pertussis
gggugggcgcgc

SEQ ID NO: 2389898 - RNA, 12 nt, Bordetella pertussis
gggugggcggca

SEQ ID NO: 2389899 - RNA, 17 nt, Bordetella pertussis
ggguguagucgcggccg

SEQ ID NO: 2389900 - RNA, 18 nt, Bordetella pertussis
gggugucgcuccucccca

SEQ ID NO: 2389901 - RNA, 21 nt, Bordetella pertussis
gggugucggccagggcggcga

SEQ ID NO: 2389902 - RNA, 15 nt, Bordetella pertussis
ggguguggccaugca

SEQ ID NO: 2389903 - RNA, 22 nt, Bordetella pertussis
ggguucagucgucgccgaagca

SEQ ID NO: 2389904 - RNA, 21 nt, Bordetella pertussis
ggguuccugcccauggcaagc

SEQ ID NO: 2389905 - RNA, 17 nt, Bordetella pertussis
ggguucgccgcugucgc

SEQ ID NO: 2389906 - RNA, 12 nt, Bordetella pertussis
ggguucgggcau

SEQ ID NO: 2389907 - RNA, 17 nt, Bordetella pertussis
ggguucgugggcgagcg

SEQ ID NO: 2389908 - RNA, 13 nt, Bordetella pertussis
ggguugcccggca

SEQ ID NO: 2389909 - RNA, 15 nt, Bordetella pertussis
ggguugcccggcagg

SEQ ID NO: 2389910 - RNA, 18 nt, Bordetella pertussis
ggguugccgggauccacg

SEQ ID NO: 2389911 - RNA, 15 nt, Bordetella pertussis
ggguugucgcccacc

SEQ ID NO: 2389912 - RNA, 20 nt, Bordetella pertussis
ggguuguggccguggcggcc

SEQ ID NO: 2389913 - RNA, 16 nt, Bordetella pertussis
ggguugugggccguca

SEQ ID NO: 2389914 - RNA, 16 nt, Bordetella pertussis
ggguuuccagcccgug

SEQ ID NO: 2389915 - RNA, 17 nt, Bordetella pertussis
ggguuuccagcccgugg

SEQ ID NO: 2389916 - RNA, 21 nt, Bordetella pertussis
ggguuuuuuuuugggaaggcc

SEQ ID NO: 2389917 - RNA, 16 nt, Bordetella pertussis
gguaaagaccuuggga

SEQ ID NO: 2389918 - RNA, 14 nt, Bordetella pertussis
gguaaagggcgcgg

SEQ ID NO: 2389919 - RNA, 19 nt, Bordetella pertussis
gguacagccaggccagcag

SEQ ID NO: 2389920 - RNA, 17 nt, Bordetella pertussis
gguacagccccagcgcc

SEQ ID NO: 2389921 - RNA, 22 nt, Bordetella pertussis
gguacagccccagcgccagcgu

SEQ ID NO: 2389922 - RNA, 14 nt, Bordetella pertussis
gguacagcgcgccc

SEQ ID NO: 2389923 - RNA, 12 nt, Bordetella pertussis
gguacaggccgc

SEQ ID NO: 2389924 - RNA, 23 nt, Bordetella pertussis
gguacaggccggcggcgagcgcg

SEQ ID NO: 2389925 - RNA, 14 nt, Bordetella pertussis
gguacaggcugccg

SEQ ID NO: 2389926 - RNA, 21 nt, Bordetella pertussis
gguacaucauccccagcgccg

SEQ ID NO: 2389927 - RNA, 21 nt, Bordetella pertussis
gguaccacaguucggccagcg

SEQ ID NO: 2389928 - RNA, 23 nt, Bordetella pertussis
gguaccacaguucggccagcggc

SEQ ID NO: 2389929 - RNA, 15 nt, Bordetella pertussis
gguaccaggcggcga

SEQ ID NO: 2389930 - RNA, 17 nt, Bordetella pertussis
gguacccaugcggggcg

SEQ ID NO: 2389931 - RNA, 14 nt, Bordetella pertussis
gguacgacgagcgc

SEQ ID NO: 2389932 - RNA, 23 nt, Bordetella pertussis
gguacgacggccggggcccgcgg

SEQ ID NO: 2389933 - RNA, 15 nt, Bordetella pertussis
gguacgccggccuga

SEQ ID NO: 2389934 - RNA, 15 nt, Bordetella pertussis
gguacgccugcaccg

SEQ ID NO: 2389935 - RNA, 15 nt, Bordetella pertussis
gguacggcaucccga

SEQ ID NO: 2389936 - RNA, 19 nt, Bordetella pertussis
gguacguggccccaggcgu

SEQ ID NO: 2389937 - RNA, 20 nt, Bordetella pertussis
gguacguggccccaggcgug

SEQ ID NO: 2389938 - RNA, 21 nt, Bordetella pertussis
gguacguggccccaggcguga

SEQ ID NO: 2389939 - RNA, 22 nt, Bordetella pertussis
gguagaccacgcgcugcgcgcc

SEQ ID NO: 2389940 - RNA, 15 nt, Bordetella pertussis
gguagaucagcgcgu

SEQ ID NO: 2389941 - RNA, 13 nt, Bordetella pertussis
gguagcaggcgcg

SEQ ID NO: 2389942 - RNA, 16 nt, Bordetella pertussis
gguagcaggcgcgcuc

SEQ ID NO: 2389943 - RNA, 21 nt, Bordetella pertussis
gguagccggcgacguggcgcu

SEQ ID NO: 2389944 - RNA, 14 nt, Bordetella pertussis
gguagccgggucug

SEQ ID NO: 2389945 - RNA, 15 nt, Bordetella pertussis
gguagcgcacgcacc

SEQ ID NO: 2389946 - RNA, 18 nt, Bordetella pertussis
gguagcgcacgcaccgcg

SEQ ID NO: 2389947 - RNA, 13 nt, Bordetella pertussis
gguagcgcgcagc

SEQ ID NO: 2389948 - RNA, 12 nt, Bordetella pertussis
gguagcgcucgu

SEQ ID NO: 2389949 - RNA, 15 nt, Bordetella pertussis
gguagcgcugggcgc

SEQ ID NO: 2389950 - RNA, 16 nt, Bordetella pertussis
gguagcgcugggcgcc

SEQ ID NO: 2389951 - RNA, 20 nt, Bordetella pertussis
gguagcgcugggcgccagca

SEQ ID NO: 2389952 - RNA, 15 nt, Bordetella pertussis
gguagcgguccagcu

SEQ ID NO: 2389953 - RNA, 17 nt, Bordetella pertussis
gguagcgguccagcugc

SEQ ID NO: 2389954 - RNA, 14 nt, Bordetella pertussis
gguaggcaaagcgc

SEQ ID NO: 2389955 - RNA, 17 nt, Bordetella pertussis
gguaggcaaagcgcagc

SEQ ID NO: 2389956 - RNA, 15 nt, Bordetella pertussis
gguaggcgagcaggu

SEQ ID NO: 2389957 - RNA, 18 nt, Bordetella pertussis
gguaggcgcccgacggcg

SEQ ID NO: 2389958 - RNA, 22 nt, Bordetella pertussis
gguaggcgcccgacggcgcgcc

SEQ ID NO: 2389959 - RNA, 15 nt, Bordetella pertussis
gguaggcgggacugg

SEQ ID NO: 2389960 - RNA, 14 nt, Bordetella pertussis
gguagggcagcagg

SEQ ID NO: 2389961 - RNA, 15 nt, Bordetella pertussis
gguagggcagcaggu

SEQ ID NO: 2389962 - RNA, 12 nt, Bordetella pertussis
gguaggggaugc

SEQ ID NO: 2389963 - RNA, 18 nt, Bordetella pertussis
gguagguggacacgccca

SEQ ID NO: 2389964 - RNA, 16 nt, Bordetella pertussis
gguaguaaucgcgcgc

SEQ ID NO: 2389965 - RNA, 15 nt, Bordetella pertussis
gguagucggccacca

SEQ ID NO: 2389966 - RNA, 17 nt, Bordetella pertussis
gguagucggccaccagg

SEQ ID NO: 2389967 - RNA, 22 nt, Bordetella pertussis
gguagugcaaggugaacgauuu

SEQ ID NO: 2389968 - RNA, 20 nt, Bordetella pertussis
gguagugcaggccgcgcagc

SEQ ID NO: 2389969 - RNA, 14 nt, Bordetella pertussis
gguagugcggcgcc

SEQ ID NO: 2389970 - RNA, 16 nt, Bordetella pertussis
gguauccacguagcgc

SEQ ID NO: 2389971 - RNA, 20 nt, Bordetella pertussis
gguauccacguagcgcacga

SEQ ID NO: 2389972 - RNA, 11 nt, Bordetella pertussis
gguauccgcgc

SEQ ID NO: 2389973 - RNA, 17 nt, Bordetella pertussis
gguaucgucgaccugga

SEQ ID NO: 2389974 - RNA, 23 nt, Bordetella pertussis
gguaucuguccccgcggggacag

SEQ ID NO: 2389975 - RNA, 16 nt, Bordetella pertussis
gguaugaccggcgcgg

SEQ ID NO: 2389976 - RNA, 20 nt, Bordetella pertussis
gguaugaccggcgcggccug

SEQ ID NO: 2389977 - RNA, 23 nt, Bordetella pertussis
gguaugcacgaugccgucgccgc

SEQ ID NO: 2389978 - RNA, 23 nt, Bordetella pertussis
gguaugcggcgcccaggcccagc

SEQ ID NO: 2389979 - RNA, 22 nt, Bordetella pertussis
gguauggcggcaacgugcaggc

SEQ ID NO: 2389980 - RNA, 18 nt, Bordetella pertussis
gguauguauggcggucgc

SEQ ID NO: 2389981 - RNA, 22 nt, Bordetella pertussis
gguauucgcugcuggccgcggu

SEQ ID NO: 2389982 - RNA, 18 nt, Bordetella pertussis
gguauugacccccgccgu

SEQ ID NO: 2389983 - RNA, 13 nt, Bordetella pertussis
gguauugcggggc

SEQ ID NO: 2389984 - RNA, 23 nt, Bordetella pertussis
gguauugcggggcggcguacagg

SEQ ID NO: 2389985 - RNA, 22 nt, Bordetella pertussis
ggucaaccugguguucggcacc

SEQ ID NO: 2389986 - RNA, 16 nt, Bordetella pertussis
ggucaacucgcccgau

SEQ ID NO: 2389987 - RNA, 13 nt, Bordetella pertussis
ggucaagcggcug

SEQ ID NO: 2389988 - RNA, 15 nt, Bordetella pertussis
ggucaagcggcugcc

SEQ ID NO: 2389989 - RNA, 14 nt, Bordetella pertussis
ggucaaggcgcggc

SEQ ID NO: 2389990 - RNA, 15 nt, Bordetella pertussis
ggucaagggcggcca

SEQ ID NO: 2389991 - RNA, 16 nt, Bordetella pertussis
ggucaaguccggcgcc

SEQ ID NO: 2389992 - RNA, 23 nt, Bordetella pertussis
ggucaauccgcccguugcggcgc

SEQ ID NO: 2389993 - RNA, 14 nt, Bordetella pertussis
ggucaaugcggcgg

SEQ ID NO: 2389994 - RNA, 20 nt, Bordetella pertussis
ggucaccacgccuucgagca

SEQ ID NO: 2389995 - RNA, 16 nt, Bordetella pertussis
ggucacccgccgcacc

SEQ ID NO: 2389996 - RNA, 17 nt, Bordetella pertussis
ggucacccggcgcaugc

SEQ ID NO: 2389997 - RNA, 20 nt, Bordetella pertussis
ggucacgacgggugaggcga

SEQ ID NO: 2389998 - RNA, 16 nt, Bordetella pertussis
ggucacgaucuggccg

SEQ ID NO: 2389999 - RNA, 18 nt, Bordetella pertussis
ggucacgaucuggccgau

SEQ ID NO: 2390000 - RNA, 14 nt, Bordetella pertussis
ggucacgcccaggc

SEQ ID NO: 2390001 - RNA, 20 nt, Bordetella pertussis
ggucacgcugguggccacca

SEQ ID NO: 2390002 - RNA, 11 nt, Bordetella pertussis
ggucacggccu

SEQ ID NO: 2390003 - RNA, 16 nt, Bordetella pertussis
ggucacggccucggca

SEQ ID NO: 2390004 - RNA, 14 nt, Bordetella pertussis
ggucacgggcgaug

SEQ ID NO: 2390005 - RNA, 18 nt, Bordetella pertussis
ggucacggucuggcccac

SEQ ID NO: 2390006 - RNA, 14 nt, Bordetella pertussis
ggucacguccaguc

SEQ ID NO: 2390007 - RNA, 21 nt, Bordetella pertussis
ggucacguucgaccugccgcc

SEQ ID NO: 2390008 - RNA, 18 nt, Bordetella pertussis
ggucacugccgaaacgcu

SEQ ID NO: 2390009 - RNA, 21 nt, Bordetella pertussis
ggucacugccgaaacgcuggc

SEQ ID NO: 2390010 - RNA, 23 nt, Bordetella pertussis
ggucagaacgacgaucugguccu

SEQ ID NO: 2390011 - RNA, 16 nt, Bordetella pertussis
ggucagcaccucggcg

SEQ ID NO: 2390012 - RNA, 19 nt, Bordetella pertussis
ggucagcaccucggcgccc

SEQ ID NO: 2390013 - RNA, 22 nt, Bordetella pertussis
ggucagcaccucggcgcccagc

SEQ ID NO: 2390014 - RNA, 19 nt, Bordetella pertussis
ggucagcacuugccggccg

SEQ ID NO: 2390015 - RNA, 14 nt, Bordetella pertussis
ggucagcagcaugc

SEQ ID NO: 2390016 - RNA, 17 nt, Bordetella pertussis
ggucagcagggcgccga

SEQ ID NO: 2390017 - RNA, 19 nt, Bordetella pertussis
ggucagcagggcgccgacg

SEQ ID NO: 2390018 - RNA, 20 nt, Bordetella pertussis
ggucagcagggcgccgacga

SEQ ID NO: 2390019 - RNA, 22 nt, Bordetella pertussis
ggucagcaugaagcugcccagc

SEQ ID NO: 2390020 - RNA, 15 nt, Bordetella pertussis
ggucagcccaggcgg

SEQ ID NO: 2390021 - RNA, 18 nt, Bordetella pertussis
ggucagcccaggcgggcg

SEQ ID NO: 2390022 - RNA, 19 nt, Bordetella pertussis
ggucagcccgccaucgcgc

SEQ ID NO: 2390023 - RNA, 20 nt, Bordetella pertussis
ggucagcccgccaucgcgca

SEQ ID NO: 2390024 - RNA, 13 nt, Bordetella pertussis
ggucagcccggcg

SEQ ID NO: 2390025 - RNA, 16 nt, Bordetella pertussis
ggucagcccggcggcc

SEQ ID NO: 2390026 - RNA, 15 nt, Bordetella pertussis
ggucagccugggcgc

SEQ ID NO: 2390027 - RNA, 16 nt, Bordetella pertussis
ggucagccugggcgcc

SEQ ID NO: 2390028 - RNA, 22 nt, Bordetella pertussis
ggucagccuugcuccggcguga

SEQ ID NO: 2390029 - RNA, 15 nt, Bordetella pertussis
ggucagcgccagggu

SEQ ID NO: 2390030 - RNA, 17 nt, Bordetella pertussis
ggucagcgccagggugc

SEQ ID NO: 2390031 - RNA, 15 nt, Bordetella pertussis
ggucagcgccgacga

SEQ ID NO: 2390032 - RNA, 16 nt, Bordetella pertussis
ggucagcgccuugccg

SEQ ID NO: 2390033 - RNA, 19 nt, Bordetella pertussis
ggucagcgccuugccgccg

SEQ ID NO: 2390034 - RNA, 13 nt, Bordetella pertussis
ggucagcgcggcg

SEQ ID NO: 2390035 - RNA, 19 nt, Bordetella pertussis
ggucagcgcggcgccggcc

SEQ ID NO: 2390036 - RNA, 16 nt, Bordetella pertussis
ggucagcggccggccc

SEQ ID NO: 2390037 - RNA, 17 nt, Bordetella pertussis
ggucagcgugucgccga

SEQ ID NO: 2390038 - RNA, 23 nt, Bordetella pertussis
ggucagcucgucgccgcuggaca

SEQ ID NO: 2390039 - RNA, 19 nt, Bordetella pertussis
ggucagcuggaacgcgccg

SEQ ID NO: 2390040 - RNA, 19 nt, Bordetella pertussis
ggucagcuugccgcccagg

SEQ ID NO: 2390041 - RNA, 20 nt, Bordetella pertussis
ggucagcuugccgcccaggu

SEQ ID NO: 2390042 - RNA, 14 nt, Bordetella pertussis
ggucaggacgacga

SEQ ID NO: 2390043 - RNA, 20 nt, Bordetella pertussis
ggucaggaugcgcgccaggc

SEQ ID NO: 2390044 - RNA, 23 nt, Bordetella pertussis
ggucaggcccacgccgccgaagu

SEQ ID NO: 2390045 - RNA, 13 nt, Bordetella pertussis
ggucaggccgccg

SEQ ID NO: 2390046 - RNA, 11 nt, Bordetella pertussis
ggucaggccgu

SEQ ID NO: 2390047 - RNA, 16 nt, Bordetella pertussis
ggucaggccguuggcg

SEQ ID NO: 2390048 - RNA, 21 nt, Bordetella pertussis
ggucaggccguuggcgcgccu

SEQ ID NO: 2390049 - RNA, 14 nt, Bordetella pertussis
ggucagggccgccc

SEQ ID NO: 2390050 - RNA, 16 nt, Bordetella pertussis
ggucagggcgaagcgc

SEQ ID NO: 2390051 - RNA, 18 nt, Bordetella pertussis
ggucagggcgaagcgcgc

SEQ ID NO: 2390052 - RNA, 14 nt, Bordetella pertussis
ggucaggggcaggc

SEQ ID NO: 2390053 - RNA, 16 nt, Bordetella pertussis
ggucaggucgcugccc

SEQ ID NO: 2390054 - RNA, 20 nt, Bordetella pertussis
ggucaggucgcugcccagca

SEQ ID NO: 2390055 - RNA, 21 nt, Bordetella pertussis
ggucaggucgcugcccagcau

SEQ ID NO: 2390056 - RNA, 20 nt, Bordetella pertussis
ggucaguccgcccagccagg

SEQ ID NO: 2390057 - RNA, 23 nt, Bordetella pertussis
ggucaguccgcccagccaggcgc

SEQ ID NO: 2390058 - RNA, 17 nt, Bordetella pertussis
ggucagucgggacggcg

SEQ ID NO: 2390059 - RNA, 22 nt, Bordetella pertussis
ggucaucagcacgaucuggcgc

SEQ ID NO: 2390060 - RNA, 20 nt, Bordetella pertussis
ggucaucgaugcgccgcacc

SEQ ID NO: 2390061 - RNA, 21 nt, Bordetella pertussis
ggucaucgaugcgccgcacca

SEQ ID NO: 2390062 - RNA, 12 nt, Bordetella pertussis
ggucaucgccag

SEQ ID NO: 2390063 - RNA, 14 nt, Bordetella pertussis
ggucaucgccaggc

SEQ ID NO: 2390064 - RNA, 13 nt, Bordetella pertussis
ggucaucgcgacc

SEQ ID NO: 2390065 - RNA, 19 nt, Bordetella pertussis
ggucaugacgggcggcggc

SEQ ID NO: 2390066 - RNA, 16 nt, Bordetella pertussis
ggucaugcccuccucg

SEQ ID NO: 2390067 - RNA, 20 nt, Bordetella pertussis
ggucaugcccuccucggcca

SEQ ID NO: 2390068 - RNA, 22 nt, Bordetella pertussis
ggucaugcccuccucggccagg

SEQ ID NO: 2390069 - RNA, 17 nt, Bordetella pertussis
ggucaugccgaacagca

SEQ ID NO: 2390070 - RNA, 14 nt, Bordetella pertussis
ggucauguccagcg

SEQ ID NO: 2390071 - RNA, 16 nt, Bordetella pertussis
ggucauguccagcgcc

SEQ ID NO: 2390072 - RNA, 20 nt, Bordetella pertussis
ggucauguccagcgccaggc

SEQ ID NO: 2390073 - RNA, 14 nt, Bordetella pertussis
ggucauugaccugc

SEQ ID NO: 2390074 - RNA, 14 nt, Bordetella pertussis
gguccacagcccgg

SEQ ID NO: 2390075 - RNA, 15 nt, Bordetella pertussis
gguccacagcccggc

SEQ ID NO: 2390076 - RNA, 19 nt, Bordetella pertussis
gguccacauccgcgcugcu

SEQ ID NO: 2390077 - RNA, 21 nt, Bordetella pertussis
gguccacauccgcgcugcugc

SEQ ID NO: 2390078 - RNA, 16 nt, Bordetella pertussis
gguccaccaccuucag

SEQ ID NO: 2390079 - RNA, 17 nt, Bordetella pertussis
gguccaccaccuucagg

SEQ ID NO: 2390080 - RNA, 21 nt, Bordetella pertussis
gguccaccaccuucagggcgc

SEQ ID NO: 2390081 - RNA, 16 nt, Bordetella pertussis
gguccaccucgucguc

SEQ ID NO: 2390082 - RNA, 17 nt, Bordetella pertussis
gguccacgaugcccaug

SEQ ID NO: 2390083 - RNA, 20 nt, Bordetella pertussis
gguccacgcccuggcuggcg

SEQ ID NO: 2390084 - RNA, 22 nt, Bordetella pertussis
gguccacgcccuggcuggcggc

SEQ ID NO: 2390085 - RNA, 23 nt, Bordetella pertussis
gguccacgccggguugcggcgga

SEQ ID NO: 2390086 - RNA, 16 nt, Bordetella pertussis
gguccacggcauggcc

SEQ ID NO: 2390087 - RNA, 21 nt, Bordetella pertussis
gguccacggcauggccagcuu

SEQ ID NO: 2390088 - RNA, 14 nt, Bordetella pertussis
gguccacggcggcg

SEQ ID NO: 2390089 - RNA, 15 nt, Bordetella pertussis
gguccacguggcgac

SEQ ID NO: 2390090 - RNA, 20 nt, Bordetella pertussis
gguccagcaaaugggccgca

SEQ ID NO: 2390091 - RNA, 14 nt, Bordetella pertussis
gguccagcaccagg

SEQ ID NO: 2390092 - RNA, 16 nt, Bordetella pertussis
gguccagcaccagggc

SEQ ID NO: 2390093 - RNA, 21 nt, Bordetella pertussis
gguccagcacggcgaggaugc

SEQ ID NO: 2390094 - RNA, 17 nt, Bordetella pertussis
gguccagccccugcccg

SEQ ID NO: 2390095 - RNA, 19 nt, Bordetella pertussis
gguccagcugcgcgcgagc

SEQ ID NO: 2390096 - RNA, 23 nt, Bordetella pertussis
gguccaggcccgaaacgcgcagc

SEQ ID NO: 2390097 - RNA, 14 nt, Bordetella pertussis
gguccaggccuggg

SEQ ID NO: 2390098 - RNA, 20 nt, Bordetella pertussis
gguccaggcgcgcaaggugg

SEQ ID NO: 2390099 - RNA, 23 nt, Bordetella pertussis
gguccaggcgguuggccuugacg

SEQ ID NO: 2390100 - RNA, 17 nt, Bordetella pertussis
gguccaguacaccaggu

SEQ ID NO: 2390101 - RNA, 19 nt, Bordetella pertussis
gguccaugaacgccgcgcc

SEQ ID NO: 2390102 - RNA, 22 nt, Bordetella pertussis
gguccaugcgaaagcggccagc

SEQ ID NO: 2390103 - RNA, 11 nt, Bordetella pertussis
gguccauggug

SEQ ID NO: 2390104 - RNA, 16 nt, Bordetella pertussis
gguccaugucggccga

SEQ ID NO: 2390105 - RNA, 13 nt, Bordetella pertussis
ggucccaaccagg

SEQ ID NO: 2390106 - RNA, 16 nt, Bordetella pertussis
ggucccaaccagggcc

SEQ ID NO: 2390107 - RNA, 13 nt, Bordetella pertussis
ggucccgcgucug

SEQ ID NO: 2390108 - RNA, 16 nt, Bordetella pertussis
ggucccuggcccuggc

SEQ ID NO: 2390109 - RNA, 14 nt, Bordetella pertussis
gguccgccgcgacc

SEQ ID NO: 2390110 - RNA, 23 nt, Bordetella pertussis
gguccgccgcgaccaccagcacc

SEQ ID NO: 2390111 - RNA, 17 nt, Bordetella pertussis
gguccgccggcacgcgc

SEQ ID NO: 2390112 - RNA, 19 nt, Bordetella pertussis
gguccgcucgaggccaggc

SEQ ID NO: 2390113 - RNA, 22 nt, Bordetella pertussis
gguccgcucgaggccaggcuga

SEQ ID NO: 2390114 - RNA, 20 nt, Bordetella pertussis
gguccgggccauccguccgc

SEQ ID NO: 2390115 - RNA, 16 nt, Bordetella pertussis
gguccggggcgggcgc

SEQ ID NO: 2390116 - RNA, 19 nt, Bordetella pertussis
gguccggggcgggcgcggu

SEQ ID NO: 2390117 - RNA, 14 nt, Bordetella pertussis
gguccggucgcgcg

SEQ ID NO: 2390118 - RNA, 17 nt, Bordetella pertussis
gguccggucgcgcgugc

SEQ ID NO: 2390119 - RNA, 18 nt, Bordetella pertussis
gguccggucgcgcgugca

SEQ ID NO: 2390120 - RNA, 14 nt, Bordetella pertussis
gguccgugaagccg

SEQ ID NO: 2390121 - RNA, 14 nt, Bordetella pertussis
gguccguggcggcc

SEQ ID NO: 2390122 - RNA, 20 nt, Bordetella pertussis
gguccguguucgacgcggcc

SEQ ID NO: 2390123 - RNA, 23 nt, Bordetella pertussis
gguccuaaauugccgcgaggcgc

SEQ ID NO: 2390124 - RNA, 16 nt, Bordetella pertussis
gguccugaggccaggc

SEQ ID NO: 2390125 - RNA, 11 nt, Bordetella pertussis
gguccugcuga

SEQ ID NO: 2390126 - RNA, 20 nt, Bordetella pertussis
gguccuggcggccgcccagc

SEQ ID NO: 2390127 - RNA, 19 nt, Bordetella pertussis
gguccugguaucccucgcc

SEQ ID NO: 2390128 - RNA, 18 nt, Bordetella pertussis
gguccuuggaguucuucu

SEQ ID NO: 2390129 - RNA, 20 nt, Bordetella pertussis
ggucgaagcacugcaggcca

SEQ ID NO: 2390130 - RNA, 23 nt, Bordetella pertussis
ggucgaagcacugcaggccaucg

SEQ ID NO: 2390131 - RNA, 18 nt, Bordetella pertussis
ggucgacauagacgcgca

SEQ ID NO: 2390132 - RNA, 21 nt, Bordetella pertussis
ggucgacauagacgcgcagcg

SEQ ID NO: 2390133 - RNA, 16 nt, Bordetella pertussis
ggucgaccagcagccg

SEQ ID NO: 2390134 - RNA, 17 nt, Bordetella pertussis
ggucgaccagcagccgg

SEQ ID NO: 2390135 - RNA, 20 nt, Bordetella pertussis
ggucgacccacuugagcagc

SEQ ID NO: 2390136 - RNA, 21 nt, Bordetella pertussis
ggucgacccacuugagcagcg

SEQ ID NO: 2390137 - RNA, 21 nt, Bordetella pertussis
ggucgaccugcuugcccagca

SEQ ID NO: 2390138 - RNA, 12 nt, Bordetella pertussis
ggucgacgccgg

SEQ ID NO: 2390139 - RNA, 14 nt, Bordetella pertussis
ggucgacgccggcg

SEQ ID NO: 2390140 - RNA, 17 nt, Bordetella pertussis
ggucgacgccggcgacg

SEQ ID NO: 2390141 - RNA, 14 nt, Bordetella pertussis
ggucgagaccagca

SEQ ID NO: 2390142 - RNA, 17 nt, Bordetella pertussis
ggucgagaccagcagcg

SEQ ID NO: 2390143 - RNA, 18 nt, Bordetella pertussis
ggucgagaccagcagcgg

SEQ ID NO: 2390144 - RNA, 18 nt, Bordetella pertussis
ggucgagagccugggcgc

SEQ ID NO: 2390145 - RNA, 20 nt, Bordetella pertussis
ggucgagagccugggcgcgc

SEQ ID NO: 2390146 - RNA, 18 nt, Bordetella pertussis
ggucgagcgccugcgcca

SEQ ID NO: 2390147 - RNA, 15 nt, Bordetella pertussis
ggucgagcgcucgcu

SEQ ID NO: 2390148 - RNA, 17 nt, Bordetella pertussis
ggucgagcgcucgcuca

SEQ ID NO: 2390149 - RNA, 16 nt, Bordetella pertussis
ggucgagcgggcgcca

SEQ ID NO: 2390150 - RNA, 18 nt, Bordetella pertussis
ggucgagcgggcgccaga

SEQ ID NO: 2390151 - RNA, 21 nt, Bordetella pertussis
ggucgaggcgcaguccagcgu

SEQ ID NO: 2390152 - RNA, 17 nt, Bordetella pertussis
ggucgagguccugcucg

SEQ ID NO: 2390153 - RNA, 22 nt, Bordetella pertussis
ggucgaguagaaguaggcggcc

SEQ ID NO: 2390154 - RNA, 16 nt, Bordetella pertussis
ggucgaucagccccug

SEQ ID NO: 2390155 - RNA, 17 nt, Bordetella pertussis
ggucgaucagggcgcgg

SEQ ID NO: 2390156 - RNA, 20 nt, Bordetella pertussis
ggucgaucauggccagccgc

SEQ ID NO: 2390157 - RNA, 15 nt, Bordetella pertussis
ggucgaucgcaucgc

SEQ ID NO: 2390158 - RNA, 21 nt, Bordetella pertussis
ggucgaucgucuugaccagca

SEQ ID NO: 2390159 - RNA, 22 nt, Bordetella pertussis
ggucgaucgucuugaccagcag

SEQ ID NO: 2390160 - RNA, 18 nt, Bordetella pertussis
ggucgaucucgggauagg

SEQ ID NO: 2390161 - RNA, 21 nt, Bordetella pertussis
ggucgaugaagcccgagcggc

SEQ ID NO: 2390162 - RNA, 21 nt, Bordetella pertussis
ggucgaugaccucgcgcugca

SEQ ID NO: 2390163 - RNA, 14 nt, Bordetella pertussis
ggucgaugccggcg

SEQ ID NO: 2390164 - RNA, 16 nt, Bordetella pertussis
ggucgaugccggcggc

SEQ ID NO: 2390165 - RNA, 21 nt, Bordetella pertussis
ggucgaugccggcggccugca

SEQ ID NO: 2390166 - RNA, 22 nt, Bordetella pertussis
ggucgauggggucgggccgcgc

SEQ ID NO: 2390167 - RNA, 15 nt, Bordetella pertussis
ggucgauguccagcg

SEQ ID NO: 2390168 - RNA, 22 nt, Bordetella pertussis
ggucgauguccagcgccagcag

SEQ ID NO: 2390169 - RNA, 12 nt, Bordetella pertussis
ggucgcacgaca

SEQ ID NO: 2390170 - RNA, 19 nt, Bordetella pertussis
ggucgcagucccaguccgg

SEQ ID NO: 2390171 - RNA, 18 nt, Bordetella pertussis
ggucgcauuggccgccgc

SEQ ID NO: 2390172 - RNA, 22 nt, Bordetella pertussis
ggucgcauuggccgccgccacc

SEQ ID NO: 2390173 - RNA, 19 nt, Bordetella pertussis
ggucgccagcacgcgcagc

SEQ ID NO: 2390174 - RNA, 20 nt, Bordetella pertussis
ggucgccagcacgcgcagcu

SEQ ID NO: 2390175 - RNA, 13 nt, Bordetella pertussis
ggucgccagcagg

SEQ ID NO: 2390176 - RNA, 14 nt, Bordetella pertussis
ggucgccagcaggc

SEQ ID NO: 2390177 - RNA, 16 nt, Bordetella pertussis
ggucgccagcaggccc

SEQ ID NO: 2390178 - RNA, 23 nt, Bordetella pertussis
ggucgccagcaggcccugggcga

SEQ ID NO: 2390179 - RNA, 23 nt, Bordetella pertussis
ggucgcccaacccggcgaggccg

SEQ ID NO: 2390180 - RNA, 23 nt, Bordetella pertussis
ggucgcccagcagauaccggcau

SEQ ID NO: 2390181 - RNA, 13 nt, Bordetella pertussis
ggucgcccgccgc

SEQ ID NO: 2390182 - RNA, 14 nt, Bordetella pertussis
ggucgcccgccgcg

SEQ ID NO: 2390183 - RNA, 22 nt, Bordetella pertussis
ggucgcccuugggcucgucgac

SEQ ID NO: 2390184 - RNA, 23 nt, Bordetella pertussis
ggucgcccuugggcucgucgacg

SEQ ID NO: 2390185 - RNA, 12 nt, Bordetella pertussis
ggucgccgcggg

SEQ ID NO: 2390186 - RNA, 22 nt, Bordetella pertussis
ggucgccgcgggcaaagcccag

SEQ ID NO: 2390187 - RNA, 23 nt, Bordetella pertussis
ggucgccgcgggcaaagcccagc

SEQ ID NO: 2390188 - RNA, 13 nt, Bordetella pertussis
ggucgccggcgca

SEQ ID NO: 2390189 - RNA, 14 nt, Bordetella pertussis
ggucgccggcgcaa

SEQ ID NO: 2390190 - RNA, 15 nt, Bordetella pertussis
ggucgccggcgcaac

SEQ ID NO: 2390191 - RNA, 13 nt, Bordetella pertussis
ggucgccgggcag

SEQ ID NO: 2390192 - RNA, 15 nt, Bordetella pertussis
ggucgccgggcagcg

SEQ ID NO: 2390193 - RNA, 18 nt, Bordetella pertussis
ggucgccgggcagcgggc

SEQ ID NO: 2390194 - RNA, 18 nt, Bordetella pertussis
ggucgccguacucgccgg

SEQ ID NO: 2390195 - RNA, 17 nt, Bordetella pertussis
ggucgccguccaggcgc

SEQ ID NO: 2390196 - RNA, 17 nt, Bordetella pertussis
ggucgccguucuggcug

SEQ ID NO: 2390197 - RNA, 16 nt, Bordetella pertussis
ggucgccguucuggug

SEQ ID NO: 2390198 - RNA, 19 nt, Bordetella pertussis
ggucgccuguaucagcgcc

SEQ ID NO: 2390199 - RNA, 19 nt, Bordetella pertussis
ggucgcgaccaccgugaua

SEQ ID NO: 2390200 - RNA, 18 nt, Bordetella pertussis
ggucgcgaccucggcggc

SEQ ID NO: 2390201 - RNA, 19 nt, Bordetella pertussis
ggucgcgaccucggcggcg

SEQ ID NO: 2390202 - RNA, 20 nt, Bordetella pertussis
ggucgcgaccucggcggcgu

SEQ ID NO: 2390203 - RNA, 17 nt, Bordetella pertussis
ggucgcgaucgucgacc

SEQ ID NO: 2390204 - RNA, 12 nt, Bordetella pertussis
ggucgcgcaccu

SEQ ID NO: 2390205 - RNA, 22 nt, Bordetella pertussis
ggucgcgcaccuguucggcggc

SEQ ID NO: 2390206 - RNA, 12 nt, Bordetella pertussis
ggucgcgcagca

SEQ ID NO: 2390207 - RNA, 16 nt, Bordetella pertussis
ggucgcgcagcugccu

SEQ ID NO: 2390208 - RNA, 15 nt, Bordetella pertussis
ggucgcgcccgccgu

SEQ ID NO: 2390209 - RNA, 14 nt, Bordetella pertussis
ggucgcgcgccugc

SEQ ID NO: 2390210 - RNA, 15 nt, Bordetella pertussis
ggucgcgcuggguca

SEQ ID NO: 2390211 - RNA, 22 nt, Bordetella pertussis
ggucgcggcacgaaaagccgcg

SEQ ID NO: 2390212 - RNA, 17 nt, Bordetella pertussis
ggucgcggccgaggcca

SEQ ID NO: 2390213 - RNA, 16 nt, Bordetella pertussis
ggucgcggugcgccac

SEQ ID NO: 2390214 - RNA, 15 nt, Bordetella pertussis
ggucgcugcccagca

SEQ ID NO: 2390215 - RNA, 21 nt, Bordetella pertussis
ggucgcugcccagcauggggu

SEQ ID NO: 2390216 - RNA, 13 nt, Bordetella pertussis
ggucgcuggcgcc

SEQ ID NO: 2390217 - RNA, 14 nt, Bordetella pertussis
ggucgcuggcgccg

SEQ ID NO: 2390218 - RNA, 22 nt, Bordetella pertussis
ggucgcuguacuuguccaucgc

SEQ ID NO: 2390219 - RNA, 14 nt, Bordetella pertussis
ggucgcuguagcgc

SEQ ID NO: 2390220 - RNA, 17 nt, Bordetella pertussis
ggucgcuguagcgcagc

SEQ ID NO: 2390221 - RNA, 18 nt, Bordetella pertussis
ggucgcuguagcgcagcc

SEQ ID NO: 2390222 - RNA, 23 nt, Bordetella pertussis
ggucggaaacacguccagcgccg

SEQ ID NO: 2390223 - RNA, 16 nt, Bordetella pertussis
ggucggagucggcgcc

SEQ ID NO: 2390224 - RNA, 20 nt, Bordetella pertussis
ggucggauagaguucggcgc

SEQ ID NO: 2390225 - RNA, 21 nt, Bordetella pertussis
ggucggauagaguucggcgcg

SEQ ID NO: 2390226 - RNA, 21 nt, Bordetella pertussis
ggucggcaaugacauccucgg

SEQ ID NO: 2390227 - RNA, 20 nt, Bordetella pertussis
ggucggcacgucgggcagga

SEQ ID NO: 2390228 - RNA, 19 nt, Bordetella pertussis
ggucggcauggccaggaag

SEQ ID NO: 2390229 - RNA, 13 nt, Bordetella pertussis
ggucggccagcgu

SEQ ID NO: 2390230 - RNA, 14 nt, Bordetella pertussis
ggucggccgcgccg

SEQ ID NO: 2390231 - RNA, 15 nt, Bordetella pertussis
ggucggccggcagcg

SEQ ID NO: 2390232 - RNA, 21 nt, Bordetella pertussis
ggucggccggcagcggcgcca

SEQ ID NO: 2390233 - RNA, 14 nt, Bordetella pertussis
ggucggccucggcg

SEQ ID NO: 2390234 - RNA, 20 nt, Bordetella pertussis
ggucggccucggcgaagugc

SEQ ID NO: 2390235 - RNA, 22 nt, Bordetella pertussis
ggucggccugccaccagcgcgc

SEQ ID NO: 2390236 - RNA, 19 nt, Bordetella pertussis
ggucggcgaccgugcgcca

SEQ ID NO: 2390237 - RNA, 14 nt, Bordetella pertussis
ggucggcgaugcgc

SEQ ID NO: 2390238 - RNA, 20 nt, Bordetella pertussis
ggucggcgaugcgcggggcc

SEQ ID NO: 2390239 - RNA, 15 nt, Bordetella pertussis
ggucggcgccgaggc

SEQ ID NO: 2390240 - RNA, 13 nt, Bordetella pertussis
ggucggcgcggca

SEQ ID NO: 2390241 - RNA, 13 nt, Bordetella pertussis
ggucggcgcggcc

SEQ ID NO: 2390242 - RNA, 15 nt, Bordetella pertussis
ggucggcggccagcg

SEQ ID NO: 2390243 - RNA, 17 nt, Bordetella pertussis
ggucggcggccagcgcg

SEQ ID NO: 2390244 - RNA, 21 nt, Bordetella pertussis
ggucggcggccagcgcgcaac

SEQ ID NO: 2390245 - RNA, 14 nt, Bordetella pertussis
ggucggcgucgucg

SEQ ID NO: 2390246 - RNA, 13 nt, Bordetella pertussis
ggucggcugaugc

SEQ ID NO: 2390247 - RNA, 18 nt, Bordetella pertussis
ggucgggauaguccagca

SEQ ID NO: 2390248 - RNA, 21 nt, Bordetella pertussis
ggucgggcaguccuucagcuu

SEQ ID NO: 2390249 - RNA, 18 nt, Bordetella pertussis
ggucggggcaggccuggu

SEQ ID NO: 2390250 - RNA, 18 nt, Bordetella pertussis
ggucggggucggccacca

SEQ ID NO: 2390251 - RNA, 19 nt, Bordetella pertussis
ggucggguaaagcggugcu

SEQ ID NO: 2390252 - RNA, 13 nt, Bordetella pertussis
ggucggguccagc

SEQ ID NO: 2390253 - RNA, 17 nt, Bordetella pertussis
ggucggguccagcacgc

SEQ ID NO: 2390254 - RNA, 14 nt, Bordetella pertussis
ggucggucgccugu

SEQ ID NO: 2390255 - RNA, 21 nt, Bordetella pertussis
ggucggucugcgugcgcggcg

SEQ ID NO: 2390256 - RNA, 23 nt, Bordetella pertussis
ggucggugcacacgccuucggcg

SEQ ID NO: 2390257 - RNA, 15 nt, Bordetella pertussis
ggucggugccgccga

SEQ ID NO: 2390258 - RNA, 15 nt, Bordetella pertussis
ggucguacagcgccu

SEQ ID NO: 2390259 - RNA, 17 nt, Bordetella pertussis
ggucguacagcgccugc

SEQ ID NO: 2390260 - RNA, 17 nt, Bordetella pertussis
ggucgucagcacgcccu

SEQ ID NO: 2390261 - RNA, 18 nt, Bordetella pertussis
ggucguccaauucgagca

SEQ ID NO: 2390262 - RNA, 23 nt, Bordetella pertussis
ggucguccaauucgagcaggcgc

SEQ ID NO: 2390263 - RNA, 15 nt, Bordetella pertussis
ggucgucccagcgca

SEQ ID NO: 2390264 - RNA, 22 nt, Bordetella pertussis
ggucgucccagcgcacgcagcg

SEQ ID NO: 2390265 - RNA, 23 nt, Bordetella pertussis
ggucgucccagcgcacgcagcgc

SEQ ID NO: 2390266 - RNA, 18 nt, Bordetella pertussis
ggucgucggccacgcccu

SEQ ID NO: 2390267 - RNA, 18 nt, Bordetella pertussis
ggucguggcugaccagca

SEQ ID NO: 2390268 - RNA, 21 nt, Bordetella pertussis
ggucguguagcugugaacugu

SEQ ID NO: 2390269 - RNA, 18 nt, Bordetella pertussis
ggucguuguggcaggcgu

SEQ ID NO: 2390270 - RNA, 19 nt, Bordetella pertussis
ggucguuguggcaggcguc

SEQ ID NO: 2390271 - RNA, 22 nt, Bordetella pertussis
ggucguuguggcaggcgucggc

SEQ ID NO: 2390272 - RNA, 22 nt, Bordetella pertussis
ggucuccagcgcgucggccagg

SEQ ID NO: 2390273 - RNA, 22 nt, Bordetella pertussis
ggucucccccucggccugcgcg

SEQ ID NO: 2390274 - RNA, 21 nt, Bordetella pertussis
ggucuccgguucggcgcggcg

SEQ ID NO: 2390275 - RNA, 19 nt, Bordetella pertussis
ggucucguagaccggcacc

SEQ ID NO: 2390276 - RNA, 21 nt, Bordetella pertussis
ggucucguuccagaugcgcag

SEQ ID NO: 2390277 - RNA, 16 nt, Bordetella pertussis
ggucugcacgaggcgc

SEQ ID NO: 2390278 - RNA, 17 nt, Bordetella pertussis
ggucugcacgccgggcg

SEQ ID NO: 2390279 - RNA, 20 nt, Bordetella pertussis
ggucugcaggcucuggcuga

SEQ ID NO: 2390280 - RNA, 22 nt, Bordetella pertussis
ggucugccaguccauccagcgg

SEQ ID NO: 2390281 - RNA, 13 nt, Bordetella pertussis
ggucugccccaug

SEQ ID NO: 2390282 - RNA, 13 nt, Bordetella pertussis
ggucugccgcuga

SEQ ID NO: 2390283 - RNA, 20 nt, Bordetella pertussis
ggucugcgcgaugagcuggc

SEQ ID NO: 2390284 - RNA, 19 nt, Bordetella pertussis
ggucugcuggucgcgggcc

SEQ ID NO: 2390285 - RNA, 21 nt, Bordetella pertussis
ggucuggcccacgcgcacgac

SEQ ID NO: 2390286 - RNA, 14 nt, Bordetella pertussis
ggucuggccggccg

SEQ ID NO: 2390287 - RNA, 22 nt, Bordetella pertussis
ggucugggccagcaggcucagc

SEQ ID NO: 2390288 - RNA, 15 nt, Bordetella pertussis
ggucuuccaggcgca

SEQ ID NO: 2390289 - RNA, 16 nt, Bordetella pertussis
ggucuuccgguacgcg

SEQ ID NO: 2390290 - RNA, 18 nt, Bordetella pertussis
ggucuucgagcgcgagca

SEQ ID NO: 2390291 - RNA, 16 nt, Bordetella pertussis
ggucuucgaugcuggc

SEQ ID NO: 2390292 - RNA, 20 nt, Bordetella pertussis
ggucuucgaugcuggcgcgg

SEQ ID NO: 2390293 - RNA, 13 nt, Bordetella pertussis
ggucuucgggcgu

SEQ ID NO: 2390294 - RNA, 15 nt, Bordetella pertussis
ggucuucgggcgugc

SEQ ID NO: 2390295 - RNA, 20 nt, Bordetella pertussis
ggucuugagcggcccgggcg

SEQ ID NO: 2390296 - RNA, 12 nt, Bordetella pertussis
ggucuugccgcc

SEQ ID NO: 2390297 - RNA, 12 nt, Bordetella pertussis
ggucuugccgcg

SEQ ID NO: 2390298 - RNA, 16 nt, Bordetella pertussis
ggucuugccgcgcagc

SEQ ID NO: 2390299 - RNA, 18 nt, Bordetella pertussis
ggugaaacagcagcgggc

SEQ ID NO: 2390300 - RNA, 20 nt, Bordetella pertussis
ggugaaacagcaucagcggc

SEQ ID NO: 2390301 - RNA, 20 nt, Bordetella pertussis
ggugaaagccgccggcgcgc

SEQ ID NO: 2390302 - RNA, 22 nt, Bordetella pertussis
ggugaaauagccaugcggacgc

SEQ ID NO: 2390303 - RNA, 21 nt, Bordetella pertussis
ggugaaaucccccgccacggc

SEQ ID NO: 2390304 - RNA, 16 nt, Bordetella pertussis
ggugaacaccagggug

SEQ ID NO: 2390305 - RNA, 19 nt, Bordetella pertussis
ggugaacaccaggguggcg

SEQ ID NO: 2390306 - RNA, 13 nt, Bordetella pertussis
ggugaacgacagc

SEQ ID NO: 2390307 - RNA, 16 nt, Bordetella pertussis
ggugaacgacagcgac

SEQ ID NO: 2390308 - RNA, 19 nt, Bordetella pertussis
ggugaacgccaccaggccg

SEQ ID NO: 2390309 - RNA, 16 nt, Bordetella pertussis
ggugaacggccccgcc

SEQ ID NO: 2390310 - RNA, 20 nt, Bordetella pertussis
ggugaagcccucgucgcggc

SEQ ID NO: 2390311 - RNA, 21 nt, Bordetella pertussis
ggugaagcccucgucgcggcc

SEQ ID NO: 2390312 - RNA, 22 nt, Bordetella pertussis
ggugaagcccucgucgcggccg

SEQ ID NO: 2390313 - RNA, 13 nt, Bordetella pertussis
ggugaccaccagg

SEQ ID NO: 2390314 - RNA, 14 nt, Bordetella pertussis
ggugaccgccagca

SEQ ID NO: 2390315 - RNA, 13 nt, Bordetella pertussis
ggugaccggcgug

SEQ ID NO: 2390316 - RNA, 16 nt, Bordetella pertussis
ggugaccggggcgucc

SEQ ID NO: 2390317 - RNA, 17 nt, Bordetella pertussis
ggugaccggggcgucca

SEQ ID NO: 2390318 - RNA, 21 nt, Bordetella pertussis
ggugaccggggcguccaccgc

SEQ ID NO: 2390319 - RNA, 17 nt, Bordetella pertussis
ggugacgcuggagcgcg

SEQ ID NO: 2390320 - RNA, 19 nt, Bordetella pertussis
ggugacgcuggagcgcggc

SEQ ID NO: 2390321 - RNA, 14 nt, Bordetella pertussis
ggugacgggcuggg

SEQ ID NO: 2390322 - RNA, 16 nt, Bordetella pertussis
ggugacgggcugggcc

SEQ ID NO: 2390323 - RNA, 13 nt, Bordetella pertussis
ggugacguugacc

SEQ ID NO: 2390324 - RNA, 16 nt, Bordetella pertussis
ggugagcaagcgcugg

SEQ ID NO: 2390325 - RNA, 19 nt, Bordetella pertussis
ggugagcaagcgcuggaug

SEQ ID NO: 2390326 - RNA, 22 nt, Bordetella pertussis
ggugagcggcacgacgucgucg

SEQ ID NO: 2390327 - RNA, 14 nt, Bordetella pertussis
ggugaggcgacggu

SEQ ID NO: 2390328 - RNA, 16 nt, Bordetella pertussis
ggugagggccacgcgc

SEQ ID NO: 2390329 - RNA, 18 nt, Bordetella pertussis
ggugaggggccagccugg

SEQ ID NO: 2390330 - RNA, 22 nt, Bordetella pertussis
ggugagggugaccaugucgccg

SEQ ID NO: 2390331 - RNA, 14 nt, Bordetella pertussis
ggugauaaggcuca

SEQ ID NO: 2390332 - RNA, 20 nt, Bordetella pertussis
ggugauccacugcagcaguu

SEQ ID NO: 2390333 - RNA, 21 nt, Bordetella pertussis
ggugaucgaguaggccggcac

SEQ ID NO: 2390334 - RNA, 14 nt, Bordetella pertussis
ggugaucguccuga

SEQ ID NO: 2390335 - RNA, 16 nt, Bordetella pertussis
ggugaugauggccagg

SEQ ID NO: 2390336 - RNA, 17 nt, Bordetella pertussis
ggugaugauggccaggu

SEQ ID NO: 2390337 - RNA, 15 nt, Bordetella pertussis
ggugaugcgcgcggc

SEQ ID NO: 2390338 - RNA, 20 nt, Bordetella pertussis
ggugaugcgcgcggccagcg

SEQ ID NO: 2390339 - RNA, 15 nt, Bordetella pertussis
ggugaugcggcgcgc

SEQ ID NO: 2390340 - RNA, 17 nt, Bordetella pertussis
ggugaugcggcgcgccg

SEQ ID NO: 2390341 - RNA, 22 nt, Bordetella pertussis
ggugauggauuucgaccgcaug

SEQ ID NO: 2390342 - RNA, 17 nt, Bordetella pertussis
ggugauggugucgaagc

SEQ ID NO: 2390343 - RNA, 18 nt, Bordetella pertussis
ggugauggugucgaagcc

SEQ ID NO: 2390344 - RNA, 20 nt, Bordetella pertussis
ggugauguacgcaucggcgc

SEQ ID NO: 2390345 - RNA, 16 nt, Bordetella pertussis
ggugauguccugcagg

SEQ ID NO: 2390346 - RNA, 17 nt, Bordetella pertussis
ggugauguccugcaggc

SEQ ID NO: 2390347 - RNA, 22 nt, Bordetella pertussis
ggugcaagcggccggccugcgg

SEQ ID NO: 2390348 - RNA, 18 nt, Bordetella pertussis
ggugcaauaacgccacuu

SEQ ID NO: 2390349 - RNA, 13 nt, Bordetella pertussis
ggugcacgccgau

SEQ ID NO: 2390350 - RNA, 13 nt, Bordetella pertussis
ggugcacgugggc

SEQ ID NO: 2390351 - RNA, 19 nt, Bordetella pertussis
ggugcacgugggcacgccg

SEQ ID NO: 2390352 - RNA, 13 nt, Bordetella pertussis
ggugcagcccagc

SEQ ID NO: 2390353 - RNA, 19 nt, Bordetella pertussis
ggugcagcccagcaccacg

SEQ ID NO: 2390354 - RNA, 15 nt, Bordetella pertussis
ggugcagccgccgca

SEQ ID NO: 2390355 - RNA, 13 nt, Bordetella pertussis
ggugcagcggcuc

SEQ ID NO: 2390356 - RNA, 24 nt, Bordetella pertussis
ggugcagcuucuugaacucggcca

SEQ ID NO: 2390357 - RNA, 23 nt, Bordetella pertussis
ggugcaggggccgcacgcgcggc

SEQ ID NO: 2390358 - RNA, 17 nt, Bordetella pertussis
ggugcagguccggucgc

SEQ ID NO: 2390359 - RNA, 16 nt, Bordetella pertussis
ggugcaucggccggcg

SEQ ID NO: 2390360 - RNA, 17 nt, Bordetella pertussis
ggugcaucggccggcgg

SEQ ID NO: 2390361 - RNA, 15 nt, Bordetella pertussis
ggugcauucguccag

SEQ ID NO: 2390362 - RNA, 17 nt, Bordetella pertussis
ggugccagucccccugc

SEQ ID NO: 2390363 - RNA, 15 nt, Bordetella pertussis
ggugccaguccccgc

SEQ ID NO: 2390364 - RNA, 14 nt, Bordetella pertussis
ggugccaguccccu

SEQ ID NO: 2390365 - RNA, 19 nt, Bordetella pertussis
ggugccaguccccugcggg

SEQ ID NO: 2390366 - RNA, 21 nt, Bordetella pertussis
ggugccagucuccaggcucag

SEQ ID NO: 2390367 - RNA, 22 nt, Bordetella pertussis
ggugccaucgauaugggcggcc

SEQ ID NO: 2390368 - RNA, 19 nt, Bordetella pertussis
ggugcccagcgagcggggc

SEQ ID NO: 2390369 - RNA, 22 nt, Bordetella pertussis
ggugcccaguucgcggccggcc

SEQ ID NO: 2390370 - RNA, 22 nt, Bordetella pertussis
ggugccccacgccgaugccgcg

SEQ ID NO: 2390371 - RNA, 17 nt, Bordetella pertussis
ggugccccaugcgcggu

SEQ ID NO: 2390372 - RNA, 15 nt, Bordetella pertussis
ggugccccggccucg

SEQ ID NO: 2390373 - RNA, 19 nt, Bordetella pertussis
ggugccccggccucgcggc

SEQ ID NO: 2390374 - RNA, 21 nt, Bordetella pertussis
ggugccccggccucgcggcgc

SEQ ID NO: 2390375 - RNA, 22 nt, Bordetella pertussis
ggugccccggccucgcggcgcg

SEQ ID NO: 2390376 - RNA, 13 nt, Bordetella pertussis
ggugcccguagca

SEQ ID NO: 2390377 - RNA, 15 nt, Bordetella pertussis
ggugccgacggcgcg

SEQ ID NO: 2390378 - RNA, 16 nt, Bordetella pertussis
ggugccgacggcgcgg

SEQ ID NO: 2390379 - RNA, 23 nt, Bordetella pertussis
ggugccgagcagaugcgacuggc

SEQ ID NO: 2390380 - RNA, 14 nt, Bordetella pertussis
ggugccgcagacgg

SEQ ID NO: 2390381 - RNA, 19 nt, Bordetella pertussis
ggugccgcccaccgugacc

SEQ ID NO: 2390382 - RNA, 12 nt, Bordetella pertussis
ggugccgccgag

SEQ ID NO: 2390383 - RNA, 14 nt, Bordetella pertussis
ggugccgccgagca

SEQ ID NO: 2390384 - RNA, 16 nt, Bordetella pertussis
ggugccgccgcccgac

SEQ ID NO: 2390385 - RNA, 16 nt, Bordetella pertussis
ggugccgccggcgcgg

SEQ ID NO: 2390386 - RNA, 23 nt, Bordetella pertussis
ggugccgccggcgcggcugcugg

SEQ ID NO: 2390387 - RNA, 15 nt, Bordetella pertussis
ggugccgccuggcca

SEQ ID NO: 2390388 - RNA, 16 nt, Bordetella pertussis
ggugccgccuggccag

SEQ ID NO: 2390389 - RNA, 16 nt, Bordetella pertussis
ggugccgccuucgccg

SEQ ID NO: 2390390 - RNA, 14 nt, Bordetella pertussis
ggugccgcgcacga

SEQ ID NO: 2390391 - RNA, 16 nt, Bordetella pertussis
ggugccgcgcaggccc

SEQ ID NO: 2390392 - RNA, 18 nt, Bordetella pertussis
ggugccgcgcgcggccgg

SEQ ID NO: 2390393 - RNA, 20 nt, Bordetella pertussis
ggugccgcgcgcggccggca

SEQ ID NO: 2390394 - RNA, 21 nt, Bordetella pertussis
ggugccgcguaugcggcagca

SEQ ID NO: 2390395 - RNA, 23 nt, Bordetella pertussis
ggugccgcguaugcggcagcagg

SEQ ID NO: 2390396 - RNA, 15 nt, Bordetella pertussis
ggugccggaaaaugc

SEQ ID NO: 2390397 - RNA, 14 nt, Bordetella pertussis
ggugccggccagcc

SEQ ID NO: 2390398 - RNA, 15 nt, Bordetella pertussis
ggugccggcggugau

SEQ ID NO: 2390399 - RNA, 13 nt, Bordetella pertussis
ggugccgguugcg

SEQ ID NO: 2390400 - RNA, 23 nt, Bordetella pertussis
ggugccguaauccgugguggggc

SEQ ID NO: 2390401 - RNA, 17 nt, Bordetella pertussis
ggugccguccagcgcgg

SEQ ID NO: 2390402 - RNA, 18 nt, Bordetella pertussis
ggugccguccggcaccuc

SEQ ID NO: 2390403 - RNA, 19 nt, Bordetella pertussis
ggugccguucccgccgggc

SEQ ID NO: 2390404 - RNA, 21 nt, Bordetella pertussis
ggugccguucccgccgggcuc

SEQ ID NO: 2390405 - RNA, 13 nt, Bordetella pertussis
ggugccguucggc

SEQ ID NO: 2390406 - RNA, 16 nt, Bordetella pertussis
ggugccguucggccag

SEQ ID NO: 2390407 - RNA, 17 nt, Bordetella pertussis
ggugccguucggccagc

SEQ ID NO: 2390408 - RNA, 20 nt, Bordetella pertussis
ggugccguucggccagcgcg

SEQ ID NO: 2390409 - RNA, 21 nt, Bordetella pertussis
ggugccguucggccagcgcgc

SEQ ID NO: 2390410 - RNA, 23 nt, Bordetella pertussis
ggugccguucggccagcgcgcgg

SEQ ID NO: 2390411 - RNA, 13 nt, Bordetella pertussis
ggugccugccccu

SEQ ID NO: 2390412 - RNA, 21 nt, Bordetella pertussis
ggugccugcuugcaggaagcg

SEQ ID NO: 2390413 - RNA, 13 nt, Bordetella pertussis
ggugccuggcucc

SEQ ID NO: 2390414 - RNA, 21 nt, Bordetella pertussis
ggugccugucccaaccgggac

SEQ ID NO: 2390415 - RNA, 15 nt, Bordetella pertussis
ggugccuguccccac

SEQ ID NO: 2390416 - RNA, 14 nt, Bordetella pertussis
ggugccuguccccc

SEQ ID NO: 2390417 - RNA, 15 nt, Bordetella pertussis
ggugccuguccccga

SEQ ID NO: 2390418 - RNA, 21 nt, Bordetella pertussis
ggugccuguccccgcagggac

SEQ ID NO: 2390419 - RNA, 20 nt, Bordetella pertussis
ggugccuguccccgcgggga

SEQ ID NO: 2390420 - RNA, 15 nt, Bordetella pertussis
ggugccugucccugc

SEQ ID NO: 2390421 - RNA, 18 nt, Bordetella pertussis
ggugccugucccugcggg

SEQ ID NO: 2390422 - RNA, 21 nt, Bordetella pertussis
ggugccugucccugcgggggc

SEQ ID NO: 2390423 - RNA, 18 nt, Bordetella pertussis
ggugccuguccuccccgc

SEQ ID NO: 2390424 - RNA, 24 nt, Bordetella pertussis
ggugccugugcccgcagagggagc

SEQ ID NO: 2390425 - RNA, 17 nt, Bordetella pertussis
ggugccuugcggcgccg

SEQ ID NO: 2390426 - RNA, 16 nt, Bordetella pertussis
ggugcgauagcgccgc

SEQ ID NO: 2390427 - RNA, 19 nt, Bordetella pertussis
ggugcgcacgauggggccg

SEQ ID NO: 2390428 - RNA, 20 nt, Bordetella pertussis
ggugcgcagcacaugggcgc

SEQ ID NO: 2390429 - RNA, 17 nt, Bordetella pertussis
ggugcgcagcaccagca

SEQ ID NO: 2390430 - RNA, 21 nt, Bordetella pertussis
ggugcgcagccgggcugccgg

SEQ ID NO: 2390431 - RNA, 13 nt, Bordetella pertussis
ggugcgcaggggc

SEQ ID NO: 2390432 - RNA, 20 nt, Bordetella pertussis
ggugcgccaaucggcguuga

SEQ ID NO: 2390433 - RNA, 15 nt, Bordetella pertussis
ggugcgccagcacgg

SEQ ID NO: 2390434 - RNA, 17 nt, Bordetella pertussis
ggugcgccgcaugcggc

SEQ ID NO: 2390435 - RNA, 20 nt, Bordetella pertussis
ggugcgccgcaugcggcggc

SEQ ID NO: 2390436 - RNA, 15 nt, Bordetella pertussis
ggugcgccgccgccg

SEQ ID NO: 2390437 - RNA, 15 nt, Bordetella pertussis
ggugcgccgccggcc

SEQ ID NO: 2390438 - RNA, 19 nt, Bordetella pertussis
ggugcgccgccggccugcu

SEQ ID NO: 2390439 - RNA, 19 nt, Bordetella pertussis
ggugcgccugcagcgccgc

SEQ ID NO: 2390440 - RNA, 18 nt, Bordetella pertussis
ggugcgcgcagggcggcc

SEQ ID NO: 2390441 - RNA, 20 nt, Bordetella pertussis
ggugcgcgccacggcgucgc

SEQ ID NO: 2390442 - RNA, 13 nt, Bordetella pertussis
ggugcgcgccagg

SEQ ID NO: 2390443 - RNA, 14 nt, Bordetella pertussis
ggugcgcgccaggu

SEQ ID NO: 2390444 - RNA, 16 nt, Bordetella pertussis
ggugcgcgcgcccacc

SEQ ID NO: 2390445 - RNA, 16 nt, Bordetella pertussis
ggugcgcgcggccgag

SEQ ID NO: 2390446 - RNA, 23 nt, Bordetella pertussis
ggugcgcgcggccgaggucggcg

SEQ ID NO: 2390447 - RNA, 19 nt, Bordetella pertussis
ggugcgcggcuugcagcgg

SEQ ID NO: 2390448 - RNA, 19 nt, Bordetella pertussis
ggugcgcgugggcacccgg

SEQ ID NO: 2390449 - RNA, 16 nt, Bordetella pertussis
ggugcgcucgaagcgc

SEQ ID NO: 2390450 - RNA, 16 nt, Bordetella pertussis
ggugcggccgguggcg

SEQ ID NO: 2390451 - RNA, 15 nt, Bordetella pertussis
ggugcggccucggcg

SEQ ID NO: 2390452 - RNA, 11 nt, Bordetella pertussis
ggugcggcggc

SEQ ID NO: 2390453 - RNA, 20 nt, Bordetella pertussis
ggugcgggcaaacggcggca

SEQ ID NO: 2390454 - RNA, 19 nt, Bordetella pertussis
ggugcgggugggcgcgccg

SEQ ID NO: 2390455 - RNA, 18 nt, Bordetella pertussis
ggugcgguaggcgcccga

SEQ ID NO: 2390456 - RNA, 19 nt, Bordetella pertussis
ggugcgguaggcgcccgac

SEQ ID NO: 2390457 - RNA, 15 nt, Bordetella pertussis
ggugcggucagucgg

SEQ ID NO: 2390458 - RNA, 16 nt, Bordetella pertussis
ggugcgguugcgaggc

SEQ ID NO: 2390459 - RNA, 18 nt, Bordetella pertussis
ggugcucaguuucuucgg

SEQ ID NO: 2390460 - RNA, 14 nt, Bordetella pertussis
ggugcuccugccag

SEQ ID NO: 2390461 - RNA, 17 nt, Bordetella pertussis
ggugcuccugccaggcg

SEQ ID NO: 2390462 - RNA, 23 nt, Bordetella pertussis
ggugcucggccagcgcgcgccag

SEQ ID NO: 2390463 - RNA, 15 nt, Bordetella pertussis
ggugcucuggcccgc

SEQ ID NO: 2390464 - RNA, 14 nt, Bordetella pertussis
ggugcugagacggc

SEQ ID NO: 2390465 - RNA, 22 nt, Bordetella pertussis
ggugcugcccugcaugaccgcc

SEQ ID NO: 2390466 - RNA, 17 nt, Bordetella pertussis
ggugcugccgccgaugu

SEQ ID NO: 2390467 - RNA, 15 nt, Bordetella pertussis
ggugcugcugggcgc

SEQ ID NO: 2390468 - RNA, 13 nt, Bordetella pertussis
ggugcuggccgaa

SEQ ID NO: 2390469 - RNA, 19 nt, Bordetella pertussis
ggugcugggcggcgggcac

SEQ ID NO: 2390470 - RNA, 22 nt, Bordetella pertussis
ggugcuggugccgcuggcggcc

SEQ ID NO: 2390471 - RNA, 16 nt, Bordetella pertussis
ggugcuggugcuggug

SEQ ID NO: 2390472 - RNA, 14 nt, Bordetella pertussis
gguggacacgccca

SEQ ID NO: 2390473 - RNA, 19 nt, Bordetella pertussis
gguggacagcgccagcccg

SEQ ID NO: 2390474 - RNA, 22 nt, Bordetella pertussis
gguggacagcgccagcccgcug

SEQ ID NO: 2390475 - RNA, 22 nt, Bordetella pertussis
gguggacaggaacuccggcggc

SEQ ID NO: 2390476 - RNA, 22 nt, Bordetella pertussis
gguggaccugccguucgcgcug

SEQ ID NO: 2390477 - RNA, 20 nt, Bordetella pertussis
gguggacgccaagaccgcgg

SEQ ID NO: 2390478 - RNA, 14 nt, Bordetella pertussis
gguggacggccagc

SEQ ID NO: 2390479 - RNA, 20 nt, Bordetella pertussis
gguggagaauucggcgcgua

SEQ ID NO: 2390480 - RNA, 12 nt, Bordetella pertussis
gguggagcgcgg

SEQ ID NO: 2390481 - RNA, 16 nt, Bordetella pertussis
gguggagcgcggcgcu

SEQ ID NO: 2390482 - RNA, 15 nt, Bordetella pertussis
gguggaggacgccga

SEQ ID NO: 2390483 - RNA, 22 nt, Bordetella pertussis
gguggaucgacgagaugccgau

SEQ ID NO: 2390484 - RNA, 15 nt, Bordetella pertussis
gguggcacaucagcg

SEQ ID NO: 2390485 - RNA, 14 nt, Bordetella pertussis
gguggccaccagcc

SEQ ID NO: 2390486 - RNA, 12 nt, Bordetella pertussis
gguggccagcag

SEQ ID NO: 2390487 - RNA, 17 nt, Bordetella pertussis
gguggccagccaggcgg

SEQ ID NO: 2390488 - RNA, 13 nt, Bordetella pertussis
gguggccagcccg

SEQ ID NO: 2390489 - RNA, 13 nt, Bordetella pertussis
gguggccagcgcc

SEQ ID NO: 2390490 - RNA, 13 nt, Bordetella pertussis
gguggccaguucc

SEQ ID NO: 2390491 - RNA, 17 nt, Bordetella pertussis
gguggccaugcugggcg

SEQ ID NO: 2390492 - RNA, 17 nt, Bordetella pertussis
gguggccauggacagca

SEQ ID NO: 2390493 - RNA, 20 nt, Bordetella pertussis
gguggcccgcaccgggcggc

SEQ ID NO: 2390494 - RNA, 21 nt, Bordetella pertussis
gguggcccgcaccgggcggcc

SEQ ID NO: 2390495 - RNA, 19 nt, Bordetella pertussis
gguggccgcuccagagcgc

SEQ ID NO: 2390496 - RNA, 22 nt, Bordetella pertussis
gguggccgcuccagagcgcgca

SEQ ID NO: 2390497 - RNA, 16 nt, Bordetella pertussis
gguggccgcuucggcg

SEQ ID NO: 2390498 - RNA, 18 nt, Bordetella pertussis
gguggccggaucgagcgc

SEQ ID NO: 2390499 - RNA, 13 nt, Bordetella pertussis
gguggccggcgcg

SEQ ID NO: 2390500 - RNA, 16 nt, Bordetella pertussis
gguggccggcgcgcgg

SEQ ID NO: 2390501 - RNA, 22 nt, Bordetella pertussis
gguggccucguccacgucgucg

SEQ ID NO: 2390502 - RNA, 23 nt, Bordetella pertussis
gguggcgauccauguggccagcu

SEQ ID NO: 2390503 - RNA, 17 nt, Bordetella pertussis
gguggcgcccggcggcg

SEQ ID NO: 2390504 - RNA, 14 nt, Bordetella pertussis
gguggcgccggcca

SEQ ID NO: 2390505 - RNA, 13 nt, Bordetella pertussis
gguggcgcgcaac

SEQ ID NO: 2390506 - RNA, 14 nt, Bordetella pertussis
gguggcggacaggc

SEQ ID NO: 2390507 - RNA, 18 nt, Bordetella pertussis
gguggcggccgucggggc

SEQ ID NO: 2390508 - RNA, 17 nt, Bordetella pertussis
gguggcggccguuggcg

SEQ ID NO: 2390509 - RNA, 12 nt, Bordetella pertussis
gguggcggcggg

SEQ ID NO: 2390510 - RNA, 15 nt, Bordetella pertussis
gguggcggcggguca

SEQ ID NO: 2390511 - RNA, 15 nt, Bordetella pertussis
gguggcgggcgccug

SEQ ID NO: 2390512 - RNA, 23 nt, Bordetella pertussis
gguggcguaguagcccaggccca

SEQ ID NO: 2390513 - RNA, 15 nt, Bordetella pertussis
gguggcgugcagcag

SEQ ID NO: 2390514 - RNA, 13 nt, Bordetella pertussis
gguggcuggugcc

SEQ ID NO: 2390515 - RNA, 16 nt, Bordetella pertussis
ggugggaaucggcacc

SEQ ID NO: 2390516 - RNA, 19 nt, Bordetella pertussis
ggugggcaccucggggugc

SEQ ID NO: 2390517 - RNA, 23 nt, Bordetella pertussis
ggugggcacgcgcuugaggcugg

SEQ ID NO: 2390518 - RNA, 12 nt, Bordetella pertussis
ggugggcagcag

SEQ ID NO: 2390519 - RNA, 16 nt, Bordetella pertussis
ggugggcagcggcauc

SEQ ID NO: 2390520 - RNA, 23 nt, Bordetella pertussis
ggugggcaggucgggcagggugg

SEQ ID NO: 2390521 - RNA, 17 nt, Bordetella pertussis
ggugggccacucgaugg

SEQ ID NO: 2390522 - RNA, 23 nt, Bordetella pertussis
ggugggccacucgaugggcgcgc

SEQ ID NO: 2390523 - RNA, 23 nt, Bordetella pertussis
ggugggccgagcccgcgucggcg

SEQ ID NO: 2390524 - RNA, 16 nt, Bordetella pertussis
ggugggcgacgcggcg

SEQ ID NO: 2390525 - RNA, 19 nt, Bordetella pertussis
ggugggcgcgccgcgacgc

SEQ ID NO: 2390526 - RNA, 16 nt, Bordetella pertussis
gguggggccgggcucg

SEQ ID NO: 2390527 - RNA, 15 nt, Bordetella pertussis
gguggggcuggccgc

SEQ ID NO: 2390528 - RNA, 16 nt, Bordetella pertussis
gguggggcuggccgcc

SEQ ID NO: 2390529 - RNA, 14 nt, Bordetella pertussis
ggugggucucggcg

SEQ ID NO: 2390530 - RNA, 17 nt, Bordetella pertussis
ggugggucucggcgucg

SEQ ID NO: 2390531 - RNA, 22 nt, Bordetella pertussis
ggugguagaccgggucgggcgu

SEQ ID NO: 2390532 - RNA, 20 nt, Bordetella pertussis
gguggucuuccaggcgcagg

SEQ ID NO: 2390533 - RNA, 15 nt, Bordetella pertussis
gguggugaccacggc

SEQ ID NO: 2390534 - RNA, 13 nt, Bordetella pertussis
gguggugcagcgg

SEQ ID NO: 2390535 - RNA, 19 nt, Bordetella pertussis
gguggugcagcggcagcau

SEQ ID NO: 2390536 - RNA, 20 nt, Bordetella pertussis
gguggugcagcggcagcaug

SEQ ID NO: 2390537 - RNA, 17 nt, Bordetella pertussis
gguggugccgcgcacga

SEQ ID NO: 2390538 - RNA, 13 nt, Bordetella pertussis
gguggugccugcu

SEQ ID NO: 2390539 - RNA, 12 nt, Bordetella pertussis
gguggugcgccu

SEQ ID NO: 2390540 - RNA, 14 nt, Bordetella pertussis
gguggugcugggcg

SEQ ID NO: 2390541 - RNA, 13 nt, Bordetella pertussis
gguggugucggcg

SEQ ID NO: 2390542 - RNA, 17 nt, Bordetella pertussis
gguguacagccgccugg

SEQ ID NO: 2390543 - RNA, 20 nt, Bordetella pertussis
gguguaccgggccgacgcgc

SEQ ID NO: 2390544 - RNA, 23 nt, Bordetella pertussis
gguguagaagaacagcagauggc

SEQ ID NO: 2390545 - RNA, 20 nt, Bordetella pertussis
gguguccuggucggcgcggc

SEQ ID NO: 2390546 - RNA, 13 nt, Bordetella pertussis
ggugucgaacagc

SEQ ID NO: 2390547 - RNA, 23 nt, Bordetella pertussis
ggugucgaagccgugcucgugcg

SEQ ID NO: 2390548 - RNA, 23 nt, Bordetella pertussis
ggugucgaugggguagucggcca

SEQ ID NO: 2390549 - RNA, 17 nt, Bordetella pertussis
ggugucgccgcccaugc

SEQ ID NO: 2390550 - RNA, 11 nt, Bordetella pertussis
ggugucgccgu

SEQ ID NO: 2390551 - RNA, 18 nt, Bordetella pertussis
ggugucgcucccccaugc

SEQ ID NO: 2390552 - RNA, 19 nt, Bordetella pertussis
ggugucggccagggcggcg

SEQ ID NO: 2390553 - RNA, 14 nt, Bordetella pertussis
ggugucggcggcca

SEQ ID NO: 2390554 - RNA, 16 nt, Bordetella pertussis
ggugucggcggccagc

SEQ ID NO: 2390555 - RNA, 14 nt, Bordetella pertussis
gguguucgagccgg

SEQ ID NO: 2390556 - RNA, 14 nt, Bordetella pertussis
gguguucgcgcacc

SEQ ID NO: 2390557 - RNA, 18 nt, Bordetella pertussis
gguguucgcgcaccagcg

SEQ ID NO: 2390558 - RNA, 21 nt, Bordetella pertussis
gguguugaccaccacgcuggc

SEQ ID NO: 2390559 - RNA, 17 nt, Bordetella pertussis
gguguugccgaggucgc

SEQ ID NO: 2390560 - RNA, 22 nt, Bordetella pertussis
gguuaacgaaucgcugccuucg

SEQ ID NO: 2390561 - RNA, 17 nt, Bordetella pertussis
gguuauuuccggccgca

SEQ ID NO: 2390562 - RNA, 14 nt, Bordetella pertussis
gguucaaccggcgu

SEQ ID NO: 2390563 - RNA, 20 nt, Bordetella pertussis
gguucaucgggccggcggca

SEQ ID NO: 2390564 - RNA, 21 nt, Bordetella pertussis
gguucaugacguccggcgggc

SEQ ID NO: 2390565 - RNA, 14 nt, Bordetella pertussis
gguuccagccuggc

SEQ ID NO: 2390566 - RNA, 16 nt, Bordetella pertussis
gguuccugcccauggc

SEQ ID NO: 2390567 - RNA, 20 nt, Bordetella pertussis
gguucgaauccucucgcccc

SEQ ID NO: 2390568 - RNA, 22 nt, Bordetella pertussis
gguucgaugaccugggccuggu

SEQ ID NO: 2390569 - RNA, 19 nt, Bordetella pertussis
gguucgauguaguagccgc

SEQ ID NO: 2390570 - RNA, 21 nt, Bordetella pertussis
gguucgcccaccaccagcggc

SEQ ID NO: 2390571 - RNA, 19 nt, Bordetella pertussis
gguucgccgugcagggcca

SEQ ID NO: 2390572 - RNA, 18 nt, Bordetella pertussis
gguucggucgacgacggc

SEQ ID NO: 2390573 - RNA, 17 nt, Bordetella pertussis
gguucugcgcguccugg

SEQ ID NO: 2390574 - RNA, 16 nt, Bordetella pertussis
gguucuguccggcgcu

SEQ ID NO: 2390575 - RNA, 16 nt, Bordetella pertussis
gguugagcagcaccug

SEQ ID NO: 2390576 - RNA, 13 nt, Bordetella pertussis
gguugagcgccag

SEQ ID NO: 2390577 - RNA, 14 nt, Bordetella pertussis
gguugagucuggag

SEQ ID NO: 2390578 - RNA, 19 nt, Bordetella pertussis
gguugaucagggccgccag

SEQ ID NO: 2390579 - RNA, 13 nt, Bordetella pertussis
gguugcagcgcgc

SEQ ID NO: 2390580 - RNA, 18 nt, Bordetella pertussis
gguugcaggaugcgcggc

SEQ ID NO: 2390581 - RNA, 16 nt, Bordetella pertussis
gguugcaggccaggcu

SEQ ID NO: 2390582 - RNA, 21 nt, Bordetella pertussis
gguugccaagauggcccaggg

SEQ ID NO: 2390583 - RNA, 17 nt, Bordetella pertussis
gguugccgaaggguugc

SEQ ID NO: 2390584 - RNA, 14 nt, Bordetella pertussis
gguugcgaggcggc

SEQ ID NO: 2390585 - RNA, 21 nt, Bordetella pertussis
gguugcgccagcuugcgcgcc

SEQ ID NO: 2390586 - RNA, 13 nt, Bordetella pertussis
gguugcgcgccag

SEQ ID NO: 2390587 - RNA, 13 nt, Bordetella pertussis
gguugcgcgccga

SEQ ID NO: 2390588 - RNA, 14 nt, Bordetella pertussis
gguugcgcugcugu

SEQ ID NO: 2390589 - RNA, 21 nt, Bordetella pertussis
gguugcggcggacacgcaugc

SEQ ID NO: 2390590 - RNA, 17 nt, Bordetella pertussis
gguugcgguaguucagc

SEQ ID NO: 2390591 - RNA, 18 nt, Bordetella pertussis
gguuggccacaucaucga

SEQ ID NO: 2390592 - RNA, 18 nt, Bordetella pertussis
gguuggccacgaagcgca

SEQ ID NO: 2390593 - RNA, 20 nt, Bordetella pertussis
gguuggcgaugcucacgccc

SEQ ID NO: 2390594 - RNA, 17 nt, Bordetella pertussis
gguugggaucgcgccag

SEQ ID NO: 2390595 - RNA, 21 nt, Bordetella pertussis
gguugggcaccaccaccgccc

SEQ ID NO: 2390596 - RNA, 22 nt, Bordetella pertussis
gguugggcaccaccaccgcccg

SEQ ID NO: 2390597 - RNA, 21 nt, Bordetella pertussis
gguuggucgucagcgccgcga

SEQ ID NO: 2390598 - RNA, 22 nt, Bordetella pertussis
gguuguauugcaugaccgccgg

SEQ ID NO: 2390599 - RNA, 18 nt, Bordetella pertussis
gguuguccgaaccacccg

SEQ ID NO: 2390600 - RNA, 22 nt, Bordetella pertussis
gguugucggcgccacaggugcg

SEQ ID NO: 2390601 - RNA, 23 nt, Bordetella pertussis
gguugugcccgcccggggugugc

SEQ ID NO: 2390602 - RNA, 22 nt, Bordetella pertussis
gguuguggccguggcggccaca

SEQ ID NO: 2390603 - RNA, 21 nt, Bordetella pertussis
gguuuagcgcguaucgaauuc

SEQ ID NO: 2390604 - RNA, 17 nt, Bordetella pertussis
gguuucaaagucgacgu

SEQ ID NO: 2390605 - RNA, 23 nt, Bordetella pertussis
gguuucggccugcaggcccagca

SEQ ID NO: 2390606 - RNA, 13 nt, Bordetella pertussis
gguuucucggccu

SEQ ID NO: 2390607 - RNA, 20 nt, Bordetella pertussis
gguuucucggccuugggcgc

SEQ ID NO: 2390608 - RNA, 16 nt, Bordetella pertussis
gguuucuugcugcugu

SEQ ID NO: 2390609 - RNA, 19 nt, Bordetella pertussis
gguuuuccacagccaggcc

SEQ ID NO: 2390610 - RNA, 24 nt, Bordetella pertussis
gguuuuucauuggagcucgcucag

SEQ ID NO: 2390611 - RNA, 21 nt, Bordetella pertussis
guaaagccgcacgcccgccug

SEQ ID NO: 2390612 - RNA, 18 nt, Bordetella pertussis
guaaccgacgcagcgcac

SEQ ID NO: 2390613 - RNA, 18 nt, Bordetella pertussis
guaagcaccagguugcau

SEQ ID NO: 2390614 - RNA, 22 nt, Bordetella pertussis
guaagcccacucacgcaaggcc

SEQ ID NO: 2390615 - RNA, 19 nt, Bordetella pertussis
guaagcgcuggacgcccug

SEQ ID NO: 2390616 - RNA, 22 nt, Bordetella pertussis
guaaggccgccggccaccagcg

SEQ ID NO: 2390617 - RNA, 18 nt, Bordetella pertussis
guaaggcgcuugcgcagg

SEQ ID NO: 2390618 - RNA, 21 nt, Bordetella pertussis
guaaggcgcuugcgcagggcg

SEQ ID NO: 2390619 - RNA, 17 nt, Bordetella pertussis
guaagugcccaggcccg

SEQ ID NO: 2390620 - RNA, 18 nt, Bordetella pertussis
guaaucgaagccgggcgg

SEQ ID NO: 2390621 - RNA, 15 nt, Bordetella pertussis
guaaucgcccggcgc

SEQ ID NO: 2390622 - RNA, 14 nt, Bordetella pertussis
guacacggccagca

SEQ ID NO: 2390623 - RNA, 16 nt, Bordetella pertussis
guacacggccagcacg

SEQ ID NO: 2390624 - RNA, 17 nt, Bordetella pertussis
guacacggccagcacgu

SEQ ID NO: 2390625 - RNA, 12 nt, Bordetella pertussis
guacagcagcag

SEQ ID NO: 2390626 - RNA, 17 nt, Bordetella pertussis
guacagcagcagcacgg

SEQ ID NO: 2390627 - RNA, 18 nt, Bordetella pertussis
guacagcagcagcacggc

SEQ ID NO: 2390628 - RNA, 19 nt, Bordetella pertussis
guacagcagcagcacggcc

SEQ ID NO: 2390629 - RNA, 22 nt, Bordetella pertussis
guacagccaggccagcagcucg

SEQ ID NO: 2390630 - RNA, 16 nt, Bordetella pertussis
guacagccccagcgcc

SEQ ID NO: 2390631 - RNA, 17 nt, Bordetella pertussis
guacagccccagcgcca

SEQ ID NO: 2390632 - RNA, 16 nt, Bordetella pertussis
guacagcccgaacaga

SEQ ID NO: 2390633 - RNA, 13 nt, Bordetella pertussis
guacagccgccug

SEQ ID NO: 2390634 - RNA, 13 nt, Bordetella pertussis
guacagccgcggc

SEQ ID NO: 2390635 - RNA, 22 nt, Bordetella pertussis
guacagcuugagaguguugacg

SEQ ID NO: 2390636 - RNA, 20 nt, Bordetella pertussis
guacaggcacucgguaucgu

SEQ ID NO: 2390637 - RNA, 14 nt, Bordetella pertussis
guacaggcgcggca

SEQ ID NO: 2390638 - RNA, 22 nt, Bordetella pertussis
guacaggcugccgucggccagc

SEQ ID NO: 2390639 - RNA, 14 nt, Bordetella pertussis
guacaggugcuggg

SEQ ID NO: 2390640 - RNA, 22 nt, Bordetella pertussis
guacaucauccccagcgccgcc

SEQ ID NO: 2390641 - RNA, 14 nt, Bordetella pertussis
guaccaagccugcu

SEQ ID NO: 2390642 - RNA, 22 nt, Bordetella pertussis
guaccacaguucggccagcggc

SEQ ID NO: 2390643 - RNA, 17 nt, Bordetella pertussis
guaccacgcgaacacgc

SEQ ID NO: 2390644 - RNA, 17 nt, Bordetella pertussis
guaccagcccagcccgc

SEQ ID NO: 2390645 - RNA, 15 nt, Bordetella pertussis
guaccaggcagccgg

SEQ ID NO: 2390646 - RNA, 16 nt, Bordetella pertussis
guaccaggcgcugacc

SEQ ID NO: 2390647 - RNA, 15 nt, Bordetella pertussis
guaccaggugcgcau

SEQ ID NO: 2390648 - RNA, 19 nt, Bordetella pertussis
guacccaugcggggcggcg

SEQ ID NO: 2390649 - RNA, 21 nt, Bordetella pertussis
guacccaugcggggcggcggg

SEQ ID NO: 2390650 - RNA, 14 nt, Bordetella pertussis
guaccccagcaugu

SEQ ID NO: 2390651 - RNA, 14 nt, Bordetella pertussis
guacccgcgccggc

SEQ ID NO: 2390652 - RNA, 18 nt, Bordetella pertussis
guacccgcgccggcggca

SEQ ID NO: 2390653 - RNA, 17 nt, Bordetella pertussis
guacccggugcagcgug

SEQ ID NO: 2390654 - RNA, 20 nt, Bordetella pertussis
guacccggugcagcguggcg

SEQ ID NO: 2390655 - RNA, 17 nt, Bordetella pertussis
guaccgccacaccgcug

SEQ ID NO: 2390656 - RNA, 16 nt, Bordetella pertussis
guaccgggccgacgcg

SEQ ID NO: 2390657 - RNA, 20 nt, Bordetella pertussis
guaccgguagcccgcgugga

SEQ ID NO: 2390658 - RNA, 15 nt, Bordetella pertussis
guaccguccuggcag

SEQ ID NO: 2390659 - RNA, 18 nt, Bordetella pertussis
guaccguccuggcaguca

SEQ ID NO: 2390660 - RNA, 15 nt, Bordetella pertussis
guaccguucgcugcc

SEQ ID NO: 2390661 - RNA, 20 nt, Bordetella pertussis
guaccugcagcaggcgcacc

SEQ ID NO: 2390662 - RNA, 12 nt, Bordetella pertussis
guaccugcuggu

SEQ ID NO: 2390663 - RNA, 16 nt, Bordetella pertussis
guacgacagcaagggc

SEQ ID NO: 2390664 - RNA, 18 nt, Bordetella pertussis
guacgacagcucggggaa

SEQ ID NO: 2390665 - RNA, 20 nt, Bordetella pertussis
guacgacgagcgcaccaugg

SEQ ID NO: 2390666 - RNA, 13 nt, Bordetella pertussis
guacgacggccgg

SEQ ID NO: 2390667 - RNA, 17 nt, Bordetella pertussis
guacgacggggugccug

SEQ ID NO: 2390668 - RNA, 21 nt, Bordetella pertussis
guacgacgucuugcugccguc

SEQ ID NO: 2390669 - RNA, 13 nt, Bordetella pertussis
guacgagcggcgg

SEQ ID NO: 2390670 - RNA, 14 nt, Bordetella pertussis
guacgagcggcggc

SEQ ID NO: 2390671 - RNA, 20 nt, Bordetella pertussis
guacgaggcauacaggcugu

SEQ ID NO: 2390672 - RNA, 15 nt, Bordetella pertussis
guacgagugcaggcc

SEQ ID NO: 2390673 - RNA, 16 nt, Bordetella pertussis
guacgagugcaggccc

SEQ ID NO: 2390674 - RNA, 17 nt, Bordetella pertussis
guacgagugcaggcccg

SEQ ID NO: 2390675 - RNA, 21 nt, Bordetella pertussis
guacgauagcggaugaugggc

SEQ ID NO: 2390676 - RNA, 20 nt, Bordetella pertussis
guacgaucaggcggcgcggc

SEQ ID NO: 2390677 - RNA, 18 nt, Bordetella pertussis
guacgcaccgccgccggc

SEQ ID NO: 2390678 - RNA, 15 nt, Bordetella pertussis
guacgcaucggcgcc

SEQ ID NO: 2390679 - RNA, 16 nt, Bordetella pertussis
guacgcaucggcgccg

SEQ ID NO: 2390680 - RNA, 15 nt, Bordetella pertussis
guacgccaucgacgc

SEQ ID NO: 2390681 - RNA, 23 nt, Bordetella pertussis
guacgccaugcgauacagcuugg

SEQ ID NO: 2390682 - RNA, 14 nt, Bordetella pertussis
guacgcccagcugg

SEQ ID NO: 2390683 - RNA, 15 nt, Bordetella pertussis
guacgcccagcuggg

SEQ ID NO: 2390684 - RNA, 13 nt, Bordetella pertussis
guacgcccggccg

SEQ ID NO: 2390685 - RNA, 22 nt, Bordetella pertussis
guacgccgaacaagguccaggc

SEQ ID NO: 2390686 - RNA, 12 nt, Bordetella pertussis
guacgccggccu

SEQ ID NO: 2390687 - RNA, 17 nt, Bordetella pertussis
guacgccggccugacgc

SEQ ID NO: 2390688 - RNA, 20 nt, Bordetella pertussis
guacgccggccugacgcgca

SEQ ID NO: 2390689 - RNA, 19 nt, Bordetella pertussis
guacgcgcaguccgcacag

SEQ ID NO: 2390690 - RNA, 12 nt, Bordetella pertussis
guacgcgggcau

SEQ ID NO: 2390691 - RNA, 18 nt, Bordetella pertussis
guacgcgugggcggcggc

SEQ ID NO: 2390692 - RNA, 18 nt, Bordetella pertussis
guacgcuuaucgcggcgc

SEQ ID NO: 2390693 - RNA, 19 nt, Bordetella pertussis
guacgcuuaucgcggcgcg

SEQ ID NO: 2390694 - RNA, 16 nt, Bordetella pertussis
guacggcccuggucua

SEQ ID NO: 2390695 - RNA, 15 nt, Bordetella pertussis
guacggccggcuccg

SEQ ID NO: 2390696 - RNA, 16 nt, Bordetella pertussis
guacguaccaggccgu

SEQ ID NO: 2390697 - RNA, 15 nt, Bordetella pertussis
guacguggcgcggcu

SEQ ID NO: 2390698 - RNA, 23 nt, Bordetella pertussis
guacuccuaucuuucgggcgcgg

SEQ ID NO: 2390699 - RNA, 15 nt, Bordetella pertussis
guacucgccgucgaa

SEQ ID NO: 2390700 - RNA, 20 nt, Bordetella pertussis
guacucgccgucgaaacacg

SEQ ID NO: 2390701 - RNA, 22 nt, Bordetella pertussis
guacucgccguugucgacgauc

SEQ ID NO: 2390702 - RNA, 17 nt, Bordetella pertussis
guacucgcgcggguccu

SEQ ID NO: 2390703 - RNA, 12 nt, Bordetella pertussis
guacucggccag

SEQ ID NO: 2390704 - RNA, 22 nt, Bordetella pertussis
gcgccgcgcucgcgccaggccc

SEQ ID NO: 2390705 - RNA, 12 nt, Bordetella pertussis
gcgccgcgcuga

SEQ ID NO: 2390706 - RNA, 14 nt, Bordetella pertussis
gcgccgcgcugauc

SEQ ID NO: 2390707 - RNA, 19 nt, Bordetella pertussis
gcgccgcgcuucgucggcg

SEQ ID NO: 2390708 - RNA, 12 nt, Bordetella pertussis
gcgccgcggccg

SEQ ID NO: 2390709 - RNA, 14 nt, Bordetella pertussis
gcgccgcggccggg

SEQ ID NO: 2390710 - RNA, 12 nt, Bordetella pertussis
gcgccgcggcgc

SEQ ID NO: 2390711 - RNA, 16 nt, Bordetella pertussis
gcgccgcggcgcugga

SEQ ID NO: 2390712 - RNA, 13 nt, Bordetella pertussis
gcgccgcggcggc

SEQ ID NO: 2390713 - RNA, 19 nt, Bordetella pertussis
gcgccgcggcggcgagggc

SEQ ID NO: 2390714 - RNA, 14 nt, Bordetella pertussis
gcgccgcggcgucc

SEQ ID NO: 2390715 - RNA, 14 nt, Bordetella pertussis
gcgccgcgucaacu

SEQ ID NO: 2390716 - RNA, 16 nt, Bordetella pertussis
gcgccgcguccggcgc

SEQ ID NO: 2390717 - RNA, 18 nt, Bordetella pertussis
gcgccgcguccggcgccc

SEQ ID NO: 2390718 - RNA, 18 nt, Bordetella pertussis
gcgccgcgucgagcgcga

SEQ ID NO: 2390719 - RNA, 16 nt, Bordetella pertussis
gcgccgcgucuucggc

SEQ ID NO: 2390720 - RNA, 17 nt, Bordetella pertussis
gcgccgcgugguggcgc

SEQ ID NO: 2390721 - RNA, 19 nt, Bordetella pertussis
gcgccgcgugguggcgcag

SEQ ID NO: 2390722 - RNA, 20 nt, Bordetella pertussis
gcgccgcguucacgccggcg

SEQ ID NO: 2390723 - RNA, 23 nt, Bordetella pertussis
gcgccgcguucacgccggcgcgc

SEQ ID NO: 2390724 - RNA, 15 nt, Bordetella pertussis
gcgccgcuacagcgu

SEQ ID NO: 2390725 - RNA, 21 nt, Bordetella pertussis
gcgccgcuacagcgucacggc

SEQ ID NO: 2390726 - RNA, 22 nt, Bordetella pertussis
gcgccgcuacagcgucacggca

SEQ ID NO: 2390727 - RNA, 14 nt, Bordetella pertussis
gcgccgcuacgcgg

SEQ ID NO: 2390728 - RNA, 18 nt, Bordetella pertussis
gcgccgcuacgcggcguc

SEQ ID NO: 2390729 - RNA, 13 nt, Bordetella pertussis
gcgccgcucagcg

SEQ ID NO: 2390730 - RNA, 14 nt, Bordetella pertussis
gcgccgcucagcgc

SEQ ID NO: 2390731 - RNA, 16 nt, Bordetella pertussis
gcgccgcucagcgcgg

SEQ ID NO: 2390732 - RNA, 24 nt, Bordetella pertussis
gcgccgcucagcgcggcgcggcca

SEQ ID NO: 2390733 - RNA, 19 nt, Bordetella pertussis
gcgccgcucgacgucgccc

SEQ ID NO: 2390734 - RNA, 18 nt, Bordetella pertussis
gcgccgcucuuggcgugu

SEQ ID NO: 2390735 - RNA, 14 nt, Bordetella pertussis
gcgccgcugcagcg

SEQ ID NO: 2390736 - RNA, 16 nt, Bordetella pertussis
gcgccgcugcagcgcu

SEQ ID NO: 2390737 - RNA, 13 nt, Bordetella pertussis
gcgccgcuggcca

SEQ ID NO: 2390738 - RNA, 13 nt, Bordetella pertussis
gcgccgcuggcgg

SEQ ID NO: 2390739 - RNA, 14 nt, Bordetella pertussis
gcgccgcuggcggc

SEQ ID NO: 2390740 - RNA, 17 nt, Bordetella pertussis
gcgccgcuggcggccgc

SEQ ID NO: 2390741 - RNA, 19 nt, Bordetella pertussis
gcgccgcuggcggccgcgg

SEQ ID NO: 2390742 - RNA, 13 nt, Bordetella pertussis
gcgccgcuggcgu

SEQ ID NO: 2390743 - RNA, 18 nt, Bordetella pertussis
gcgccgcuggcguccagg

SEQ ID NO: 2390744 - RNA, 21 nt, Bordetella pertussis
gcgccgcuguggacgccgccg

SEQ ID NO: 2390745 - RNA, 22 nt, Bordetella pertussis
gcgccgcuguggacgccgccgg

SEQ ID NO: 2390746 - RNA, 18 nt, Bordetella pertussis
gcgccgcuguugcccacc

SEQ ID NO: 2390747 - RNA, 22 nt, Bordetella pertussis
gcgccgcuguugcccaccagcc

SEQ ID NO: 2390748 - RNA, 20 nt, Bordetella pertussis
gcgccgcuuccaccgucugg

SEQ ID NO: 2390749 - RNA, 21 nt, Bordetella pertussis
gcgccgcuuccaccgucuggc

SEQ ID NO: 2390750 - RNA, 14 nt, Bordetella pertussis
gcgccgcuuccggc

SEQ ID NO: 2390751 - RNA, 15 nt, Bordetella pertussis
gcgccgcuuccggca

SEQ ID NO: 2390752 - RNA, 22 nt, Bordetella pertussis
gcgauggacacgaugaacgcgc

SEQ ID NO: 2390753 - RNA, 13 nt, Bordetella pertussis
gcgauggccacgc

SEQ ID NO: 2390754 - RNA, 13 nt, Bordetella pertussis
gcgauggcccggu

SEQ ID NO: 2390755 - RNA, 23 nt, Bordetella pertussis
gcgauggcccgguaggccacgcg

SEQ ID NO: 2390756 - RNA, 13 nt, Bordetella pertussis
gcgauggccgcca

SEQ ID NO: 2390757 - RNA, 20 nt, Bordetella pertussis
gcgauggccgggagcggcca

SEQ ID NO: 2390758 - RNA, 21 nt, Bordetella pertussis
gcgauggccgggagcggccag

SEQ ID NO: 2390759 - RNA, 12 nt, Bordetella pertussis
gcgauggcgcgc

SEQ ID NO: 2390760 - RNA, 14 nt, Bordetella pertussis
gcgauggcgcgcgc

SEQ ID NO: 2390761 - RNA, 17 nt, Bordetella pertussis
gcgauggcgcgcgccac

SEQ ID NO: 2390762 - RNA, 16 nt, Bordetella pertussis
gcgauggcgcggccgg

SEQ ID NO: 2390763 - RNA, 12 nt, Bordetella pertussis
gcgauggcggca

SEQ ID NO: 2390764 - RNA, 19 nt, Bordetella pertussis
gcgauggcguugcgcacca

SEQ ID NO: 2390765 - RNA, 18 nt, Bordetella pertussis
gcgaugggcaccugcuug

SEQ ID NO: 2390766 - RNA, 14 nt, Bordetella pertussis
gcgaugggccugcc

SEQ ID NO: 2390767 - RNA, 15 nt, Bordetella pertussis
gcgaugggccugccc

SEQ ID NO: 2390768 - RNA, 16 nt, Bordetella pertussis
gcgaugggccugccca

SEQ ID NO: 2390769 - RNA, 17 nt, Bordetella pertussis
gcgauggucaccacccg

SEQ ID NO: 2390770 - RNA, 21 nt, Bordetella pertussis
gcgauguaggccagguucugg

SEQ ID NO: 2390771 - RNA, 15 nt, Bordetella pertussis
gcgauguccagcucc

SEQ ID NO: 2390772 - RNA, 18 nt, Bordetella pertussis
gcgauguccagcuccagc

SEQ ID NO: 2390773 - RNA, 19 nt, Bordetella pertussis
gcgauguccagcuccagcg

SEQ ID NO: 2390774 - RNA, 22 nt, Bordetella pertussis
gcgaugucgaauuccgggacgc

SEQ ID NO: 2390775 - RNA, 14 nt, Bordetella pertussis
gcgaugucgcgcgc

SEQ ID NO: 2390776 - RNA, 22 nt, Bordetella pertussis
gcgaugucgucaucccuugagc

SEQ ID NO: 2390777 - RNA, 15 nt, Bordetella pertussis
gcgauguggcgcgcc

SEQ ID NO: 2390778 - RNA, 16 nt, Bordetella pertussis
gcgauguggcgcgcca

SEQ ID NO: 2390779 - RNA, 22 nt, Bordetella pertussis
gcgauguucaggccggcccgcc

SEQ ID NO: 2390780 - RNA, 18 nt, Bordetella pertussis
gcgauguucggaugcgcg

SEQ ID NO: 2390781 - RNA, 22 nt, Bordetella pertussis
gcgauguucggaugcgcguugc

SEQ ID NO: 2390782 - RNA, 17 nt, Bordetella pertussis
gcgauucccuggcgcgc

SEQ ID NO: 2390783 - RNA, 15 nt, Bordetella pertussis
gcgauucgcgcuuga

SEQ ID NO: 2390784 - RNA, 23 nt, Bordetella pertussis
gcgauugaguucgcgcgccggca

SEQ ID NO: 2390785 - RNA, 14 nt, Bordetella pertussis
gcgauugcaggugg

SEQ ID NO: 2390786 - RNA, 23 nt, Bordetella pertussis
gcgauugcagguggccagcccgg

SEQ ID NO: 2390787 - RNA, 15 nt, Bordetella pertussis
gcgauugcgccagcg

SEQ ID NO: 2390788 - RNA, 23 nt, Bordetella pertussis
gcgauugcggcccgcggccuugg

SEQ ID NO: 2390789 - RNA, 16 nt, Bordetella pertussis
gcgauuugccgcagcc

SEQ ID NO: 2390790 - RNA, 21 nt, Bordetella pertussis
gcgcaaaagcaacaaccgcgc

SEQ ID NO: 2390791 - RNA, 16 nt, Bordetella pertussis
gcgcaaaccacgucgg

SEQ ID NO: 2390792 - RNA, 23 nt, Bordetella pertussis
gcgcaaacgggggcaggccgcgg

SEQ ID NO: 2390793 - RNA, 13 nt, Bordetella pertussis
gcgcaacccggcc

SEQ ID NO: 2390794 - RNA, 21 nt, Bordetella pertussis
gcgcaacccggccucgcugcg

SEQ ID NO: 2390795 - RNA, 12 nt, Bordetella pertussis
gcgcaaccggcc

SEQ ID NO: 2390796 - RNA, 22 nt, Bordetella pertussis
gcgcaacgcaugcgcgaucucg

SEQ ID NO: 2390797 - RNA, 13 nt, Bordetella pertussis
gcgcaacgccgcc

SEQ ID NO: 2390798 - RNA, 15 nt, Bordetella pertussis
gcgcaacgccggccg

SEQ ID NO: 2390799 - RNA, 17 nt, Bordetella pertussis
gcgcaacgccggccgcc

SEQ ID NO: 2390800 - RNA, 14 nt, Bordetella pertussis
gcgcaacgccgggu

SEQ ID NO: 2390801 - RNA, 12 nt, Bordetella pertussis
gcgcaacgcgcg

SEQ ID NO: 2390802 - RNA, 14 nt, Bordetella pertussis
gcgcaacgggccga

SEQ ID NO: 2390803 - RNA, 14 nt, Bordetella pertussis
gcgcaacuccagca

SEQ ID NO: 2390804 - RNA, 16 nt, Bordetella pertussis
gcgcaacucggccacc

SEQ ID NO: 2390805 - RNA, 17 nt, Bordetella pertussis
gcgcaagacgcggcagg

SEQ ID NO: 2390806 - RNA, 13 nt, Bordetella pertussis
gcgcaagaucugg

SEQ ID NO: 2390807 - RNA, 14 nt, Bordetella pertussis
gcgcaagaucugga

SEQ ID NO: 2390808 - RNA, 16 nt, Bordetella pertussis
gcgcaagcaccgccug

SEQ ID NO: 2390809 - RNA, 20 nt, Bordetella pertussis
gcgcaagcaccgccugcugc

SEQ ID NO: 2390810 - RNA, 20 nt, Bordetella pertussis
gcgcaagcagggaugccggu

SEQ ID NO: 2390811 - RNA, 12 nt, Bordetella pertussis
gcgcaagccagc

SEQ ID NO: 2390812 - RNA, 14 nt, Bordetella pertussis
gcgcaagcccaggc

SEQ ID NO: 2390813 - RNA, 15 nt, Bordetella pertussis
gcgcaagcccaggcg

SEQ ID NO: 2390814 - RNA, 19 nt, Bordetella pertussis
gcgcaagcccaggcggccc

SEQ ID NO: 2390815 - RNA, 23 nt, Bordetella pertussis
gcgcaagcccaggcggcccagcg

SEQ ID NO: 2390816 - RNA, 17 nt, Bordetella pertussis
gcgcaagccgcccgcgg

SEQ ID NO: 2390817 - RNA, 19 nt, Bordetella pertussis
gcgcaagccgcccgcggcg

SEQ ID NO: 2390818 - RNA, 13 nt, Bordetella pertussis
gcgcaagccgccg

SEQ ID NO: 2390819 - RNA, 15 nt, Bordetella pertussis
gcgcaagccgccgcc

SEQ ID NO: 2390820 - RNA, 16 nt, Bordetella pertussis
gcgcaagccgccgccc

SEQ ID NO: 2390821 - RNA, 14 nt, Bordetella pertussis
gcgcaagccgcugg

SEQ ID NO: 2390822 - RNA, 15 nt, Bordetella pertussis
gcgcaagccggccgc

SEQ ID NO: 2390823 - RNA, 16 nt, Bordetella pertussis
gcgcaagccggccgcg

SEQ ID NO: 2390824 - RNA, 19 nt, Bordetella pertussis
gcgcaagccggccgcgccg

SEQ ID NO: 2390825 - RNA, 15 nt, Bordetella pertussis
gcgcaagcgcgccga

SEQ ID NO: 2390826 - RNA, 17 nt, Bordetella pertussis
gcgcaagcgcgccgaca

SEQ ID NO: 2390827 - RNA, 15 nt, Bordetella pertussis
gcgcaagcggcccca

SEQ ID NO: 2390828 - RNA, 16 nt, Bordetella pertussis
gcgcaagcggccccag

SEQ ID NO: 2390829 - RNA, 18 nt, Bordetella pertussis
gcgcaaggacgcguccuc

SEQ ID NO: 2390830 - RNA, 21 nt, Bordetella pertussis
gcgcaaggcaugcgccagcgc

SEQ ID NO: 2390831 - RNA, 14 nt, Bordetella pertussis
gcgcaaggcggccc

SEQ ID NO: 2390832 - RNA, 22 nt, Bordetella pertussis
gcgcaaggcggcccggccgccg

SEQ ID NO: 2390833 - RNA, 14 nt, Bordetella pertussis
gcgcaaggcgggcu

SEQ ID NO: 2390834 - RNA, 23 nt, Bordetella pertussis
gcgcaaggcgggcuggucgcgcc

SEQ ID NO: 2390835 - RNA, 14 nt, Bordetella pertussis
gcgcaaggcgucgg

SEQ ID NO: 2390836 - RNA, 13 nt, Bordetella pertussis
gcgcaagguggcg

SEQ ID NO: 2390837 - RNA, 23 nt, Bordetella pertussis
gcgcaagguggcggugguggcca

SEQ ID NO: 2390838 - RNA, 17 nt, Bordetella pertussis
gcgcaaguucaucaucg

SEQ ID NO: 2390839 - RNA, 16 nt, Bordetella pertussis
gcgcaauacgccgccg

SEQ ID NO: 2390840 - RNA, 14 nt, Bordetella pertussis
gcgcaaugcgcggc

SEQ ID NO: 2390841 - RNA, 19 nt, Bordetella pertussis
gcgcaauggacacagcggc

SEQ ID NO: 2390842 - RNA, 20 nt, Bordetella pertussis
gcgcaauggacacagcggcg

SEQ ID NO: 2390843 - RNA, 16 nt, Bordetella pertussis
gcgcaauugcuucugg

SEQ ID NO: 2390844 - RNA, 15 nt, Bordetella pertussis
gcgcacaccaucagc

SEQ ID NO: 2390845 - RNA, 17 nt, Bordetella pertussis
gcgcacaccaucagcug

SEQ ID NO: 2390846 - RNA, 20 nt, Bordetella pertussis
gcgcacacuggccagcaagc

SEQ ID NO: 2390847 - RNA, 22 nt, Bordetella pertussis
gcgcacagcauggccaccaggu

SEQ ID NO: 2390848 - RNA, 14 nt, Bordetella pertussis
gcgcacagcgcggc

SEQ ID NO: 2390849 - RNA, 15 nt, Bordetella pertussis
gcgcacagcgcggcg

SEQ ID NO: 2390850 - RNA, 16 nt, Bordetella pertussis
gcgcacaggcgcucgc

SEQ ID NO: 2390851 - RNA, 14 nt, Bordetella pertussis
gcgcacaggcggcg

SEQ ID NO: 2390852 - RNA, 15 nt, Bordetella pertussis
gcgcacaggcggcgc

SEQ ID NO: 2390853 - RNA, 15 nt, Bordetella pertussis
gcgcacagggcgucg

SEQ ID NO: 2390854 - RNA, 16 nt, Bordetella pertussis
gcgcacagggcgucgc

SEQ ID NO: 2390855 - RNA, 14 nt, Bordetella pertussis
gcgcacauccagcc

SEQ ID NO: 2390856 - RNA, 15 nt, Bordetella pertussis
gcgcacauccagccg

SEQ ID NO: 2390857 - RNA, 17 nt, Bordetella pertussis
gcgcacauuggaguagu

SEQ ID NO: 2390858 - RNA, 20 nt, Bordetella pertussis
gcgcaccaaucuugccaggc

SEQ ID NO: 2390859 - RNA, 16 nt, Bordetella pertussis
gcgcaccaccuggcug

SEQ ID NO: 2390860 - RNA, 15 nt, Bordetella pertussis
gcgcaccagcccgcc

SEQ ID NO: 2390861 - RNA, 20 nt, Bordetella pertussis
gcgcaccagcccgcccgcgc

SEQ ID NO: 2390862 - RNA, 22 nt, Bordetella pertussis
gcgcaccagcccgcccgcgccc

SEQ ID NO: 2390863 - RNA, 11 nt, Bordetella pertussis
gcgcaccagcg

SEQ ID NO: 2390864 - RNA, 19 nt, Bordetella pertussis
gcgcaccagcgaggcggca

SEQ ID NO: 2390865 - RNA, 14 nt, Bordetella pertussis
gcgcaccagcgcgc

SEQ ID NO: 2390866 - RNA, 15 nt, Bordetella pertussis
gcgcaccagcgcgcc

SEQ ID NO: 2390867 - RNA, 16 nt, Bordetella pertussis
gcgcaccagcgcgccg

SEQ ID NO: 2390868 - RNA, 20 nt, Bordetella pertussis
gcgcaccagcgcgccgauca

SEQ ID NO: 2390869 - RNA, 17 nt, Bordetella pertussis
gcgcaccagcuuggccu

SEQ ID NO: 2390870 - RNA, 22 nt, Bordetella pertussis
gcgcaccaggcccaugaaggcg

SEQ ID NO: 2390871 - RNA, 14 nt, Bordetella pertussis
gcgcaccaggccug

SEQ ID NO: 2390872 - RNA, 14 nt, Bordetella pertussis
gcgccggccuugcc

SEQ ID NO: 2390873 - RNA, 16 nt, Bordetella pertussis
gcgccggcgacgccgc

SEQ ID NO: 2390874 - RNA, 12 nt, Bordetella pertussis
gcgccggcgcau

SEQ ID NO: 2390875 - RNA, 14 nt, Bordetella pertussis
gcgccggcgcauga

SEQ ID NO: 2390876 - RNA, 19 nt, Bordetella pertussis
gcgccggcgcaugagccgg

SEQ ID NO: 2390877 - RNA, 21 nt, Bordetella pertussis
gcgccggcgcaugagccggca

SEQ ID NO: 2390878 - RNA, 15 nt, Bordetella pertussis
gcgccggcgcccggc

SEQ ID NO: 2390879 - RNA, 18 nt, Bordetella pertussis
gcgccggcgcccggcagc

SEQ ID NO: 2390880 - RNA, 12 nt, Bordetella pertussis
gcgccggcgccg

SEQ ID NO: 2390881 - RNA, 16 nt, Bordetella pertussis
gcgccggcgccgggca

SEQ ID NO: 2390882 - RNA, 14 nt, Bordetella pertussis
gcgccggcgccguu

SEQ ID NO: 2390883 - RNA, 13 nt, Bordetella pertussis
gcgccggcgccuu

SEQ ID NO: 2390884 - RNA, 16 nt, Bordetella pertussis
gcgccggcgccuuggc

SEQ ID NO: 2390885 - RNA, 19 nt, Bordetella pertussis
gcgccggcgcgcgaucucg

SEQ ID NO: 2390886 - RNA, 15 nt, Bordetella pertussis
gcgccggcgcgcgcu

SEQ ID NO: 2390887 - RNA, 14 nt, Bordetella pertussis
gcgccggcgcggcg

SEQ ID NO: 2390888 - RNA, 15 nt, Bordetella pertussis
gcgccggcgcggcgg

SEQ ID NO: 2390889 - RNA, 17 nt, Bordetella pertussis
gcgccggcgcggcgguc

SEQ ID NO: 2390890 - RNA, 18 nt, Bordetella pertussis
gcgccggcgcggcggucc

SEQ ID NO: 2390891 - RNA, 14 nt, Bordetella pertussis
gcgccggcgcgucc

SEQ ID NO: 2390892 - RNA, 12 nt, Bordetella pertussis
gcgccggcggca

SEQ ID NO: 2390893 - RNA, 13 nt, Bordetella pertussis
gcgccggcggcaa

SEQ ID NO: 2390894 - RNA, 22 nt, Bordetella pertussis
gcgccggcggcaagguagccga

SEQ ID NO: 2390895 - RNA, 18 nt, Bordetella pertussis
gcgccggcggcaccgcgc

SEQ ID NO: 2390896 - RNA, 19 nt, Bordetella pertussis
gcgccggcggcaccgcgca

SEQ ID NO: 2390897 - RNA, 21 nt, Bordetella pertussis
gcgccggcggcaccgcgcagc

SEQ ID NO: 2390898 - RNA, 23 nt, Bordetella pertussis
gcgccggcggcaccgcgcagccc

SEQ ID NO: 2390899 - RNA, 15 nt, Bordetella pertussis
gcgccggcggccucc

SEQ ID NO: 2390900 - RNA, 16 nt, Bordetella pertussis
gcgccggcggccugca

SEQ ID NO: 2390901 - RNA, 17 nt, Bordetella pertussis
gcgccggcggccugcag

SEQ ID NO: 2390902 - RNA, 13 nt, Bordetella pertussis
gcgccggcggcga

SEQ ID NO: 2390903 - RNA, 22 nt, Bordetella pertussis
gcgccggcggcgaugcgggcca

SEQ ID NO: 2390904 - RNA, 13 nt, Bordetella pertussis
gcgccggcggcgc

SEQ ID NO: 2390905 - RNA, 15 nt, Bordetella pertussis
gcgccggcggcgguc

SEQ ID NO: 2390906 - RNA, 17 nt, Bordetella pertussis
gcgccggcggcggucag

SEQ ID NO: 2390907 - RNA, 20 nt, Bordetella pertussis
gcgccggcgggcgcugccug

SEQ ID NO: 2390908 - RNA, 13 nt, Bordetella pertussis
gcgccggcguagu

SEQ ID NO: 2390909 - RNA, 13 nt, Bordetella pertussis
gcgccggcgucca

SEQ ID NO: 2390910 - RNA, 19 nt, Bordetella pertussis
gcgccggcuaccgcgccau

SEQ ID NO: 2390911 - RNA, 14 nt, Bordetella pertussis
gcgccggcucccgc

SEQ ID NO: 2390912 - RNA, 22 nt, Bordetella pertussis
gcgccggcucgaacaggcuggc

SEQ ID NO: 2390913 - RNA, 17 nt, Bordetella pertussis
gcgccggcucguacggc

SEQ ID NO: 2390914 - RNA, 22 nt, Bordetella pertussis
gcgccggcugaauuggcgccca

SEQ ID NO: 2390915 - RNA, 12 nt, Bordetella pertussis
gcgccggcuggc

SEQ ID NO: 2390916 - RNA, 20 nt, Bordetella pertussis
gcgccggcuugcgccagcca

SEQ ID NO: 2390917 - RNA, 15 nt, Bordetella pertussis
gcgccgggaucggcg

SEQ ID NO: 2390918 - RNA, 14 nt, Bordetella pertussis
gcgccgggcagccc

SEQ ID NO: 2390919 - RNA, 15 nt, Bordetella pertussis
gcgccgggcagcccg

SEQ ID NO: 2390920 - RNA, 17 nt, Bordetella pertussis
gcgccgggcagcccgcg

SEQ ID NO: 2390921 - RNA, 18 nt, Bordetella pertussis
gcgccgggcagcccgcgc

SEQ ID NO: 2390922 - RNA, 14 nt, Bordetella pertussis
gcgccgggccacga

SEQ ID NO: 2390923 - RNA, 15 nt, Bordetella pertussis
gcgccgggccagacc

SEQ ID NO: 2390924 - RNA, 15 nt, Bordetella pertussis
gcgccgggcccggcc

SEQ ID NO: 2390925 - RNA, 13 nt, Bordetella pertussis
gcgccgggccgcu

SEQ ID NO: 2390926 - RNA, 22 nt, Bordetella pertussis
gcgccgggccgcuaggccuugc

SEQ ID NO: 2390927 - RNA, 14 nt, Bordetella pertussis
gcgccgggccuagc

SEQ ID NO: 2390928 - RNA, 15 nt, Bordetella pertussis
gcgccgggcgacggc

SEQ ID NO: 2390929 - RNA, 14 nt, Bordetella pertussis
gcgccgggcgccgc

SEQ ID NO: 2390930 - RNA, 18 nt, Bordetella pertussis
gcgccgggcgccgcgccc

SEQ ID NO: 2390931 - RNA, 15 nt, Bordetella pertussis
gcgccgggcgcgccg

SEQ ID NO: 2390932 - RNA, 17 nt, Bordetella pertussis
gcgccgggcgcgccggc

SEQ ID NO: 2390933 - RNA, 13 nt, Bordetella pertussis
gcgccgggcgcgg

SEQ ID NO: 2390934 - RNA, 15 nt, Bordetella pertussis
gcgccgggcgcggcc

SEQ ID NO: 2390935 - RNA, 13 nt, Bordetella pertussis
gcgccgggcggau

SEQ ID NO: 2390936 - RNA, 18 nt, Bordetella pertussis
gcgccgggcgggucggcg

SEQ ID NO: 2390937 - RNA, 22 nt, Bordetella pertussis
gcgccgggcguuuuugcguccg

SEQ ID NO: 2390938 - RNA, 19 nt, Bordetella pertussis
gcgccgggcuggugcgccg

SEQ ID NO: 2390939 - RNA, 14 nt, Bordetella pertussis
gcgccggggcgccg

SEQ ID NO: 2390940 - RNA, 17 nt, Bordetella pertussis
gcgccggggcgccggug

SEQ ID NO: 2390941 - RNA, 15 nt, Bordetella pertussis
gcgccggggcggcgc

SEQ ID NO: 2390942 - RNA, 16 nt, Bordetella pertussis
gcgccggggcggcgca

SEQ ID NO: 2390943 - RNA, 17 nt, Bordetella pertussis
gcgccggggcggcgcag

SEQ ID NO: 2390944 - RNA, 21 nt, Bordetella pertussis
gcgccggggcggcggcgcccg

SEQ ID NO: 2390945 - RNA, 16 nt, Bordetella pertussis
gcgccggggcggcucg

SEQ ID NO: 2390946 - RNA, 17 nt, Bordetella pertussis
gcgccggggcggcucgg

SEQ ID NO: 2390947 - RNA, 18 nt, Bordetella pertussis
gcgccggggcggcucggc

SEQ ID NO: 2390948 - RNA, 18 nt, Bordetella pertussis
gcgccggggcguggccgc

SEQ ID NO: 2390949 - RNA, 16 nt, Bordetella pertussis
gcgccggggggcgcac

SEQ ID NO: 2390950 - RNA, 20 nt, Bordetella pertussis
gcgccggggggcgcacgccg

SEQ ID NO: 2390951 - RNA, 22 nt, Bordetella pertussis
gcgccggggggcgcacgccgcg

SEQ ID NO: 2390952 - RNA, 23 nt, Bordetella pertussis
gcgccggggggcgcacgccgcgc

SEQ ID NO: 2390953 - RNA, 14 nt, Bordetella pertussis
gcgccgggguggga

SEQ ID NO: 2390954 - RNA, 18 nt, Bordetella pertussis
gcgccggguccggccgcg

SEQ ID NO: 2390955 - RNA, 19 nt, Bordetella pertussis
gcgccggguccggccgcgc

SEQ ID NO: 2390956 - RNA, 20 nt, Bordetella pertussis
gcgccggguccggccgcgca

SEQ ID NO: 2390957 - RNA, 21 nt, Bordetella pertussis
gcgccggguggguucgggcgu

SEQ ID NO: 2390958 - RNA, 22 nt, Bordetella pertussis
gcgccggucacgcugguggcca

SEQ ID NO: 2390959 - RNA, 14 nt, Bordetella pertussis
gcgccggucaggcg

SEQ ID NO: 2390960 - RNA, 20 nt, Bordetella pertussis
gcgccggucaugcaccugca

SEQ ID NO: 2390961 - RNA, 15 nt, Bordetella pertussis
gcgccgguccagcgc

SEQ ID NO: 2390962 - RNA, 18 nt, Bordetella pertussis
gcgccgguccagcgcccg

SEQ ID NO: 2390963 - RNA, 19 nt, Bordetella pertussis
gcgccgguccagcgcccga

SEQ ID NO: 2390964 - RNA, 15 nt, Bordetella pertussis
gcgccgguccgacgg

SEQ ID NO: 2390965 - RNA, 14 nt, Bordetella pertussis
gcgccggucgccgc

SEQ ID NO: 2390966 - RNA, 17 nt, Bordetella pertussis
gcgccggucguggucga

SEQ ID NO: 2390967 - RNA, 14 nt, Bordetella pertussis
gcgccggucugggc

SEQ ID NO: 2390968 - RNA, 18 nt, Bordetella pertussis
gcgccggucugggcgcgg

SEQ ID NO: 2390969 - RNA, 16 nt, Bordetella pertussis
gcgccggugaccgcca

SEQ ID NO: 2390970 - RNA, 17 nt, Bordetella pertussis
gcgccggugaccgccag

SEQ ID NO: 2390971 - RNA, 19 nt, Bordetella pertussis
gcgccggugcgcggcgccc

SEQ ID NO: 2390972 - RNA, 15 nt, Bordetella pertussis
gcgccgguggccagc

SEQ ID NO: 2390973 - RNA, 15 nt, Bordetella pertussis
gcgccgguguccacg

SEQ ID NO: 2390974 - RNA, 17 nt, Bordetella pertussis
gcgccggugucggccca

SEQ ID NO: 2390975 - RNA, 18 nt, Bordetella pertussis
gcgccggugucggcccac

SEQ ID NO: 2390976 - RNA, 18 nt, Bordetella pertussis
gcgccgguucgacgcuga

SEQ ID NO: 2390977 - RNA, 15 nt, Bordetella pertussis
gcgccguacagccgc

SEQ ID NO: 2390978 - RNA, 18 nt, Bordetella pertussis
gcgccguacagccgcggc

SEQ ID NO: 2390979 - RNA, 15 nt, Bordetella pertussis
gcgccguaccagcgc

SEQ ID NO: 2390980 - RNA, 21 nt, Bordetella pertussis
gcgccguaccagcgcgaacgc

SEQ ID NO: 2390981 - RNA, 22 nt, Bordetella pertussis
gcgccguaccagcgcgaacgcc

SEQ ID NO: 2390982 - RNA, 15 nt, Bordetella pertussis
gcgccguaccugcag

SEQ ID NO: 2390983 - RNA, 13 nt, Bordetella pertussis
gcgccgucagcag

SEQ ID NO: 2390984 - RNA, 15 nt, Bordetella pertussis
gcgccgucagcagcg

SEQ ID NO: 2390985 - RNA, 18 nt, Bordetella pertussis
gcgccgucagcagcgcgg

SEQ ID NO: 2390986 - RNA, 23 nt, Bordetella pertussis
gcgccgucagcagcgcggcgccg

SEQ ID NO: 2390987 - RNA, 14 nt, Bordetella pertussis
gcgccguccagcgc

SEQ ID NO: 2390988 - RNA, 15 nt, Bordetella pertussis
gcgccguccaguccc

SEQ ID NO: 2390989 - RNA, 22 nt, Bordetella pertussis
gcgccguccgcaucgcgcaagg

SEQ ID NO: 2390990 - RNA, 24 nt, Bordetella pertussis
gcgccguccgcaucgcgcaagggc

SEQ ID NO: 2390991 - RNA, 15 nt, Bordetella pertussis
gcgccguccucaggc

SEQ ID NO: 2390992 - RNA, 21 nt, Bordetella pertussis
gcgccgucgaacuccugcagc

SEQ ID NO: 2390993 - RNA, 15 nt, Bordetella pertussis
gcgccgucgaagccg

SEQ ID NO: 2390994 - RNA, 16 nt, Bordetella pertussis
gcgccgucgaagccgg

SEQ ID NO: 2390995 - RNA, 21 nt, Bordetella pertussis
gcgccgucgaucccaucgcgc

SEQ ID NO: 2390996 - RNA, 24 nt, Bordetella pertussis
gcgccgucgaucccaucgcgcguc

SEQ ID NO: 2390997 - RNA, 14 nt, Bordetella pertussis
gcgccgucgcgcug

SEQ ID NO: 2390998 - RNA, 16 nt, Bordetella pertussis
gcgccgucgcuggggc

SEQ ID NO: 2390999 - RNA, 19 nt, Bordetella pertussis
gcgccgucgcuggggcgca

SEQ ID NO: 2391000 - RNA, 19 nt, Bordetella pertussis
gcgccgucgggggccggcu

SEQ ID NO: 2391001 - RNA, 15 nt, Bordetella pertussis
gcgccgucugcgccg

SEQ ID NO: 2391002 - RNA, 22 nt, Bordetella pertussis
gcgccgucugcgccgccgcgug

SEQ ID NO: 2391003 - RNA, 20 nt, Bordetella pertussis
gcgccgucugugcgccccgc

SEQ ID NO: 2391004 - RNA, 21 nt, Bordetella pertussis
gcgccgucugugcgccccgcu

SEQ ID NO: 2391005 - RNA, 17 nt, Bordetella pertussis
gcgccgucuucgguggc

SEQ ID NO: 2391006 - RNA, 20 nt, Bordetella pertussis
gcgccgugaaugcgccuggc

SEQ ID NO: 2391007 - RNA, 17 nt, Bordetella pertussis
gcgccgugacguugagc

SEQ ID NO: 2391008 - RNA, 18 nt, Bordetella pertussis
gcgccgugacguugagcg

SEQ ID NO: 2391009 - RNA, 21 nt, Bordetella pertussis
gcgccgugacguugagcgccg

SEQ ID NO: 2391010 - RNA, 15 nt, Bordetella pertussis
gcgccgugcagacgg

SEQ ID NO: 2391011 - RNA, 20 nt, Bordetella pertussis
gcgccgugcagacggcggcu

SEQ ID NO: 2391012 - RNA, 22 nt, Bordetella pertussis
gcgccgugcagacggcggcugg

SEQ ID NO: 2391013 - RNA, 15 nt, Bordetella pertussis
gcgccgugcccggcg

SEQ ID NO: 2391014 - RNA, 16 nt, Bordetella pertussis
gcgccgugcccggcgg

SEQ ID NO: 2391015 - RNA, 13 nt, Bordetella pertussis
gcgccgugcugga

SEQ ID NO: 2391016 - RNA, 14 nt, Bordetella pertussis
gcgccguggugcug

SEQ ID NO: 2391017 - RNA, 15 nt, Bordetella pertussis
gcgccguggugcuga

SEQ ID NO: 2391018 - RNA, 22 nt, Bordetella pertussis
gcgccguucagggacgggccag

SEQ ID NO: 2391019 - RNA, 23 nt, Bordetella pertussis
gcgccguucaugcgucgaacggc

SEQ ID NO: 2391020 - RNA, 18 nt, Bordetella pertussis
gcgccguuccugcagcgu

SEQ ID NO: 2391021 - RNA, 17 nt, Bordetella pertussis
gcgccguucggaguagu

SEQ ID NO: 2391022 - RNA, 23 nt, Bordetella pertussis
gcgccguucggaguaguugucgu

SEQ ID NO: 2391023 - RNA, 18 nt, Bordetella pertussis
gcgccguucgucgcgcag

SEQ ID NO: 2391024 - RNA, 21 nt, Bordetella pertussis
gcgccguucgucgcgcagcag

SEQ ID NO: 2391025 - RNA, 18 nt, Bordetella pertussis
gcgccguucucaggccga

SEQ ID NO: 2391026 - RNA, 20 nt, Bordetella pertussis
gcgccguugcgggcugcgcg

SEQ ID NO: 2391027 - RNA, 16 nt, Bordetella pertussis
gcgccuacacgguggc

SEQ ID NO: 2391028 - RNA, 24 nt, Bordetella pertussis
gcgccuacagcagcggcucgagcg

SEQ ID NO: 2391029 - RNA, 23 nt, Bordetella pertussis
gcgccuacaguuccaccugcaug

SEQ ID NO: 2391030 - RNA, 15 nt, Bordetella pertussis
gcgccuaccggcgcc

SEQ ID NO: 2391031 - RNA, 16 nt, Bordetella pertussis
gcgccuaccggcgccg

SEQ ID NO: 2391032 - RNA, 20 nt, Bordetella pertussis
gcgccuaccggcgccgacgc

SEQ ID NO: 2391033 - RNA, 16 nt, Bordetella pertussis
gcgccuacggcggcgg

SEQ ID NO: 2391034 - RNA, 18 nt, Bordetella pertussis
gcgccuacggcggcggcc

SEQ ID NO: 2391035 - RNA, 20 nt, Bordetella pertussis
gcgccuacggcggcggccau

SEQ ID NO: 2391036 - RNA, 17 nt, Bordetella pertussis
gcgccuauaucgacggc

SEQ ID NO: 2391037 - RNA, 19 nt, Bordetella pertussis
gcgccuauaucgacggcgc

SEQ ID NO: 2391038 - RNA, 20 nt, Bordetella pertussis
gcgccuauaucgacggcgcc

SEQ ID NO: 2391039 - RNA, 21 nt, Bordetella pertussis
gcgccuauaucgacggcgccu

SEQ ID NO: 2391040 - RNA, 19 nt, Bordetella pertussis
gcgccuauugcgacgccgc

SEQ ID NO: 2391041 - RNA, 17 nt, Bordetella pertussis
gcgccuccagcuccagc

SEQ ID NO: 2391042 - RNA, 18 nt, Bordetella pertussis
gcgccuccagcuccagcg

SEQ ID NO: 2391043 - RNA, 21 nt, Bordetella pertussis
gcgccuccagcuccagcgcgc

SEQ ID NO: 2391044 - RNA, 22 nt, Bordetella pertussis
gcgccucgaacguccgccccau

SEQ ID NO: 2391045 - RNA, 14 nt, Bordetella pertussis
gcgccucgaagauc

SEQ ID NO: 2391046 - RNA, 17 nt, Bordetella pertussis
gcgccucgaugauggcg

SEQ ID NO: 2391047 - RNA, 19 nt, Bordetella pertussis
gcgccucgaugauggcguc

SEQ ID NO: 2391048 - RNA, 20 nt, Bordetella pertussis
gcgccucgaugauggcgucc

SEQ ID NO: 2391049 - RNA, 15 nt, Bordetella pertussis
gcgccucgcaucggc

SEQ ID NO: 2391050 - RNA, 14 nt, Bordetella pertussis
gcgccucgcgacgg

SEQ ID NO: 2391051 - RNA, 15 nt, Bordetella pertussis
gcgccucgcgacggc

SEQ ID NO: 2391052 - RNA, 17 nt, Bordetella pertussis
gcgccucgcgcuccaug

SEQ ID NO: 2391053 - RNA, 22 nt, Bordetella pertussis
gcgccucgcgcuccaugggcgu

SEQ ID NO: 2391054 - RNA, 17 nt, Bordetella pertussis
gcgccucggacgccugg

SEQ ID NO: 2391055 - RNA, 21 nt, Bordetella pertussis
gcgccucggacgccuggcgcg

SEQ ID NO: 2391056 - RNA, 14 nt, Bordetella pertussis
gcgccucggcggau

SEQ ID NO: 2391057 - RNA, 15 nt, Bordetella pertussis
gcgccucgguccagc

SEQ ID NO: 2391058 - RNA, 16 nt, Bordetella pertussis
gcgccucgguccagcg

SEQ ID NO: 2391059 - RNA, 19 nt, Bordetella pertussis
gcgccucguccucggugcu

SEQ ID NO: 2391060 - RNA, 17 nt, Bordetella pertussis
gcgccucguccugcagg

SEQ ID NO: 2391061 - RNA, 19 nt, Bordetella pertussis
gcgccugacccagucgcag

SEQ ID NO: 2391062 - RNA, 18 nt, Bordetella pertussis
gcgccugagccgauacag

SEQ ID NO: 2391063 - RNA, 12 nt, Bordetella pertussis
gcgccugagcug

SEQ ID NO: 2391064 - RNA, 14 nt, Bordetella pertussis
gcgccugagcugcc

SEQ ID NO: 2391065 - RNA, 16 nt, Bordetella pertussis
gcgccugagcugccag

SEQ ID NO: 2391066 - RNA, 18 nt, Bordetella pertussis
gcgccugcagcacggcca

SEQ ID NO: 2391067 - RNA, 18 nt, Bordetella pertussis
gcgccugcagcagcgugg

SEQ ID NO: 2391068 - RNA, 14 nt, Bordetella pertussis
gcgccugcagcgcc

SEQ ID NO: 2391069 - RNA, 16 nt, Bordetella pertussis
gcgccugcagcgccgc

SEQ ID NO: 2391070 - RNA, 18 nt, Bordetella pertussis
gcgccugcagcgccgccu

SEQ ID NO: 2391071 - RNA, 13 nt, Bordetella pertussis
gcgccugcagcgu

SEQ ID NO: 2391072 - RNA, 23 nt, Bordetella pertussis
gcgccugcauccggcccagcgcc

SEQ ID NO: 2391073 - RNA, 14 nt, Bordetella pertussis
gcgccugcaugcca

SEQ ID NO: 2391074 - RNA, 22 nt, Bordetella pertussis
gcgccugcaugccauagucgcg

SEQ ID NO: 2391075 - RNA, 23 nt, Bordetella pertussis
gcgccugcaugccauagucgcgc

SEQ ID NO: 2391076 - RNA, 20 nt, Bordetella pertussis
gcgccugcauguccagcggc

SEQ ID NO: 2391077 - RNA, 16 nt, Bordetella pertussis
gcgccugcccaggcca

SEQ ID NO: 2391078 - RNA, 17 nt, Bordetella pertussis
gcgccugcccaggccag

SEQ ID NO: 2391079 - RNA, 18 nt, Bordetella pertussis
gcgccugcccaggccagc

SEQ ID NO: 2391080 - RNA, 19 nt, Bordetella pertussis
gcgccugcccaggccagcg

SEQ ID NO: 2391081 - RNA, 23 nt, Bordetella pertussis
gcgccugcccaggccagcgccgc

SEQ ID NO: 2391082 - RNA, 16 nt, Bordetella pertussis
gcgccugccccgccug

SEQ ID NO: 2391083 - RNA, 14 nt, Bordetella pertussis
gcgccugccccggc

SEQ ID NO: 2391084 - RNA, 16 nt, Bordetella pertussis
gcgccugccccggcag

SEQ ID NO: 2391085 - RNA, 21 nt, Bordetella pertussis
gcgccugccccggcagagaca

SEQ ID NO: 2391086 - RNA, 20 nt, Bordetella pertussis
gcgccugcccgcaacgccgc

SEQ ID NO: 2391087 - RNA, 21 nt, Bordetella pertussis
gcgccugcccgcaacgccgcc

SEQ ID NO: 2391088 - RNA, 12 nt, Bordetella pertussis
gcgccugcccug

SEQ ID NO: 2391089 - RNA, 23 nt, Bordetella pertussis
gcgccugccgaucgugcacgccc

SEQ ID NO: 2391090 - RNA, 16 nt, Bordetella pertussis
gcgccugccgcauccc

SEQ ID NO: 2391091 - RNA, 13 nt, Bordetella pertussis
gcgccugccgcgu

SEQ ID NO: 2391092 - RNA, 17 nt, Bordetella pertussis
gcgccugccgcgugccc

SEQ ID NO: 2391093 - RNA, 21 nt, Bordetella pertussis
gcgccugccgcgugcccgcgu

SEQ ID NO: 2391094 - RNA, 23 nt, Bordetella pertussis
gcgccugccgcgugcccgcgucc

SEQ ID NO: 2391095 - RNA, 19 nt, Bordetella pertussis
gcgccugccugccgagcgc

SEQ ID NO: 2391096 - RNA, 23 nt, Bordetella pertussis
gcgccugcgagagauagcccagc

SEQ ID NO: 2391097 - RNA, 21 nt, Bordetella pertussis
gcgccugcgccaccuggcgcc

SEQ ID NO: 2391098 - RNA, 22 nt, Bordetella pertussis
gcgccugcgccaccuggcgccc

SEQ ID NO: 2391099 - RNA, 14 nt, Bordetella pertussis
gcgccugcgccacg

SEQ ID NO: 2391100 - RNA, 22 nt, Bordetella pertussis
gcgccugcgccauguggcgacg

SEQ ID NO: 2391101 - RNA, 11 nt, Bordetella pertussis
gcgcgcccagc

SEQ ID NO: 2391102 - RNA, 21 nt, Bordetella pertussis
gcgcgcccagccccgcggccg

SEQ ID NO: 2391103 - RNA, 22 nt, Bordetella pertussis
gcgcgcccagccccgcggccgc

SEQ ID NO: 2391104 - RNA, 12 nt, Bordetella pertussis
gcgcgcccagcg

SEQ ID NO: 2391105 - RNA, 16 nt, Bordetella pertussis
gcgcgcccagcgcgcc

SEQ ID NO: 2391106 - RNA, 18 nt, Bordetella pertussis
gcgcgcccagcggcaggc

SEQ ID NO: 2391107 - RNA, 14 nt, Bordetella pertussis
gcgcgcccaggcca

SEQ ID NO: 2391108 - RNA, 18 nt, Bordetella pertussis
gcgcgcccaggccagcca

SEQ ID NO: 2391109 - RNA, 23 nt, Bordetella pertussis
gcgcgcccaggccagccaggugc

SEQ ID NO: 2391110 - RNA, 19 nt, Bordetella pertussis
gcgcgcccaggggccggcg

SEQ ID NO: 2391111 - RNA, 13 nt, Bordetella pertussis
gcgcgcccccacg

SEQ ID NO: 2391112 - RNA, 14 nt, Bordetella pertussis
gcgcgcccccacgc

SEQ ID NO: 2391113 - RNA, 16 nt, Bordetella pertussis
gcgcgcccccacgccg

SEQ ID NO: 2391114 - RNA, 23 nt, Bordetella pertussis
gcgcgcccccagcgccgucagca

SEQ ID NO: 2391115 - RNA, 21 nt, Bordetella pertussis
gcgcgccccgcuucgggccgg

SEQ ID NO: 2391116 - RNA, 22 nt, Bordetella pertussis
gcgcgccccgcuucgggccgga

SEQ ID NO: 2391117 - RNA, 12 nt, Bordetella pertussis
gcgcgcccgagg

SEQ ID NO: 2391118 - RNA, 15 nt, Bordetella pertussis
gcgcgcccgaggcgc

SEQ ID NO: 2391119 - RNA, 13 nt, Bordetella pertussis
gcgcgcccgcacg

SEQ ID NO: 2391120 - RNA, 15 nt, Bordetella pertussis
gcgcgcccgccccgc

SEQ ID NO: 2391121 - RNA, 14 nt, Bordetella pertussis
gcgcgcccgccgcg

SEQ ID NO: 2391122 - RNA, 12 nt, Bordetella pertussis
gcgcgcccgcgu

SEQ ID NO: 2391123 - RNA, 13 nt, Bordetella pertussis
gcgcgcccgcgua

SEQ ID NO: 2391124 - RNA, 21 nt, Bordetella pertussis
gcgcgcccgcuugggccgcgc

SEQ ID NO: 2391125 - RNA, 15 nt, Bordetella pertussis
gcgcgcccggcgaaa

SEQ ID NO: 2391126 - RNA, 24 nt, Bordetella pertussis
gcgcgcccggcgaaagcgucggcu

SEQ ID NO: 2391127 - RNA, 17 nt, Bordetella pertussis
gcgcgcccggcgcgccu

SEQ ID NO: 2391128 - RNA, 21 nt, Bordetella pertussis
gcgcgcccucguugacgccga

SEQ ID NO: 2391129 - RNA, 14 nt, Bordetella pertussis
gcgcgccgaagcgc

SEQ ID NO: 2391130 - RNA, 19 nt, Bordetella pertussis
gcgcgccgaagcgcaggcc

SEQ ID NO: 2391131 - RNA, 19 nt, Bordetella pertussis
gcgcgccgacaggaaggcg

SEQ ID NO: 2391132 - RNA, 21 nt, Bordetella pertussis
gcgcgccgacaggaaggcgag

SEQ ID NO: 2391133 - RNA, 17 nt, Bordetella pertussis
gcgcgccgacgcuucgu

SEQ ID NO: 2391134 - RNA, 14 nt, Bordetella pertussis
gcgcgccgaucacc

SEQ ID NO: 2391135 - RNA, 16 nt, Bordetella pertussis
gcgcgccgaugcgcca

SEQ ID NO: 2391136 - RNA, 18 nt, Bordetella pertussis
gcgcgccgaugcgccagg

SEQ ID NO: 2391137 - RNA, 10 nt, Bordetella pertussis
gcgcgccgca

SEQ ID NO: 2391138 - RNA, 13 nt, Bordetella pertussis
gcgcgccgcagcg

SEQ ID NO: 2391139 - RNA, 19 nt, Bordetella pertussis
gcgcgccgcagcguggcgu

SEQ ID NO: 2391140 - RNA, 13 nt, Bordetella pertussis
gcgcgccgcauca

SEQ ID NO: 2391141 - RNA, 18 nt, Bordetella pertussis
gcgcgccgcccaccacca

SEQ ID NO: 2391142 - RNA, 15 nt, Bordetella pertussis
gcgcgccgccgcccg

SEQ ID NO: 2391143 - RNA, 13 nt, Bordetella pertussis
gcgcgccgccgcg

SEQ ID NO: 2391144 - RNA, 13 nt, Bordetella pertussis
gcgcgccgccggc

SEQ ID NO: 2391145 - RNA, 15 nt, Bordetella pertussis
gcgcgccgccgggcc

SEQ ID NO: 2391146 - RNA, 13 nt, Bordetella pertussis
gcgcgccgccggu

SEQ ID NO: 2391147 - RNA, 15 nt, Bordetella pertussis
gcgcgccgccggugc

SEQ ID NO: 2391148 - RNA, 23 nt, Bordetella pertussis
gcgcgccgccggugcaccaggcc

SEQ ID NO: 2391149 - RNA, 12 nt, Bordetella pertussis
gcgcgccgccgu

SEQ ID NO: 2391150 - RNA, 18 nt, Bordetella pertussis
gcgcgccgccucagcccg

SEQ ID NO: 2391151 - RNA, 10 nt, Bordetella pertussis
gcgcgccgcg

SEQ ID NO: 2391152 - RNA, 18 nt, Bordetella pertussis
gcgcgccgcgauggcgcc

SEQ ID NO: 2391153 - RNA, 21 nt, Bordetella pertussis
gcgcgccgcgauggcgccggc

SEQ ID NO: 2391154 - RNA, 22 nt, Bordetella pertussis
gcgcgccgcgauggcgccggcc

SEQ ID NO: 2391155 - RNA, 23 nt, Bordetella pertussis
gcgcgccgcgauggcgccggcca

SEQ ID NO: 2391156 - RNA, 12 nt, Bordetella pertussis
gcgcgccgcgcc

SEQ ID NO: 2391157 - RNA, 13 nt, Bordetella pertussis
gcgcgccgcgccg

SEQ ID NO: 2391158 - RNA, 16 nt, Bordetella pertussis
gcgcgccgcgccgggg

SEQ ID NO: 2391159 - RNA, 14 nt, Bordetella pertussis
gcgcgccgcgcgca

SEQ ID NO: 2391160 - RNA, 16 nt, Bordetella pertussis
gcgcgccgcgcgcacg

SEQ ID NO: 2391161 - RNA, 15 nt, Bordetella pertussis
gcgcgccgcgcgcgg

SEQ ID NO: 2391162 - RNA, 15 nt, Bordetella pertussis
gcgcgccgcgcugcc

SEQ ID NO: 2391163 - RNA, 13 nt, Bordetella pertussis
gcgcgccgcggcg

SEQ ID NO: 2391164 - RNA, 15 nt, Bordetella pertussis
gcgcgccgcggcggg

SEQ ID NO: 2391165 - RNA, 14 nt, Bordetella pertussis
gcgcgccgcgggcu

SEQ ID NO: 2391166 - RNA, 12 nt, Bordetella pertussis
gcgcgccgcugc

SEQ ID NO: 2391167 - RNA, 16 nt, Bordetella pertussis
gcgcgccgcugcagcg

SEQ ID NO: 2391168 - RNA, 12 nt, Bordetella pertussis
gcgcgccgcugu

SEQ ID NO: 2391169 - RNA, 21 nt, Bordetella pertussis
gcgcgccgcuuucucccgccg

SEQ ID NO: 2391170 - RNA, 18 nt, Bordetella pertussis
gcgcgccggaacauggcg

SEQ ID NO: 2391171 - RNA, 18 nt, Bordetella pertussis
gcgcgccggcagggcggc

SEQ ID NO: 2391172 - RNA, 23 nt, Bordetella pertussis
gcgcgccggcagggcggccaggc

SEQ ID NO: 2391173 - RNA, 15 nt, Bordetella pertussis
gcgcgccggcauggu

SEQ ID NO: 2391174 - RNA, 21 nt, Bordetella pertussis
gcgcgccggcauuucgcuggg

SEQ ID NO: 2391175 - RNA, 12 nt, Bordetella pertussis
gcgcgccggcca

SEQ ID NO: 2391176 - RNA, 13 nt, Bordetella pertussis
gcgcgccggccag

SEQ ID NO: 2391177 - RNA, 15 nt, Bordetella pertussis
gcgcgccggccagcg

SEQ ID NO: 2391178 - RNA, 14 nt, Bordetella pertussis
gcgcgccggccagg

SEQ ID NO: 2391179 - RNA, 23 nt, Bordetella pertussis
gcgcgccggccagggccaccacg

SEQ ID NO: 2391180 - RNA, 12 nt, Bordetella pertussis
gcgcgccggccg

SEQ ID NO: 2391181 - RNA, 15 nt, Bordetella pertussis
gcgcgccggccgcca

SEQ ID NO: 2391182 - RNA, 18 nt, Bordetella pertussis
gcgcgccggccgccagca

SEQ ID NO: 2391183 - RNA, 18 nt, Bordetella pertussis
gcgcgccggccgcggggc

SEQ ID NO: 2391184 - RNA, 18 nt, Bordetella pertussis
gcgcgccggccugcgccg

SEQ ID NO: 2391185 - RNA, 21 nt, Bordetella pertussis
gcgcgccggccugcgccgggc

SEQ ID NO: 2391186 - RNA, 11 nt, Bordetella pertussis
gcgcgccggcg

SEQ ID NO: 2391187 - RNA, 14 nt, Bordetella pertussis
gcgcgccggcgccg

SEQ ID NO: 2391188 - RNA, 15 nt, Bordetella pertussis
gcgcgccggcgccgg

SEQ ID NO: 2391189 - RNA, 16 nt, Bordetella pertussis
gcgcgccggcgccggc

SEQ ID NO: 2391190 - RNA, 20 nt, Bordetella pertussis
gcgcgccggcgccuuggccu

SEQ ID NO: 2391191 - RNA, 23 nt, Bordetella pertussis
gcgcgccggcgccuuggccuggg

SEQ ID NO: 2391192 - RNA, 20 nt, Bordetella pertussis
gcgcgccggcgcucgcgcac

SEQ ID NO: 2391193 - RNA, 17 nt, Bordetella pertussis
gcgcgccggcggccugc

SEQ ID NO: 2391194 - RNA, 23 nt, Bordetella pertussis
gcgcgccggcggccugcaggccg

SEQ ID NO: 2391195 - RNA, 14 nt, Bordetella pertussis
gcgcgccggcgggc

SEQ ID NO: 2391196 - RNA, 19 nt, Bordetella pertussis
gcgcgccggcucgaacagg

SEQ ID NO: 2391197 - RNA, 22 nt, Bordetella pertussis
gcgcgccggcucgaacaggcug

SEQ ID NO: 2391198 - RNA, 13 nt, Bordetella pertussis
gcgcgccgggcca

SEQ ID NO: 2391199 - RNA, 16 nt, Bordetella pertussis
gcgcgcaaugcgcggc

SEQ ID NO: 2391200 - RNA, 17 nt, Bordetella pertussis
gcgcgcaaugcgcggcg

SEQ ID NO: 2391201 - RNA, 19 nt, Bordetella pertussis
gcgcgcaaugcgcggcgcu

SEQ ID NO: 2391202 - RNA, 21 nt, Bordetella pertussis
gcgcgcaaugcgcggcgcuca

SEQ ID NO: 2391203 - RNA, 16 nt, Bordetella pertussis
gcgcgcacaagcgcga

SEQ ID NO: 2391204 - RNA, 19 nt, Bordetella pertussis
gcgcgcacacuggccagca

SEQ ID NO: 2391205 - RNA, 17 nt, Bordetella pertussis
gcgcgcaccagcccgcc

SEQ ID NO: 2391206 - RNA, 16 nt, Bordetella pertussis
gcgcgcaccaugggcg

SEQ ID NO: 2391207 - RNA, 13 nt, Bordetella pertussis
gcgcgcaccggcu

SEQ ID NO: 2391208 - RNA, 20 nt, Bordetella pertussis
gcgcgcaccugggaggggcc

SEQ ID NO: 2391209 - RNA, 18 nt, Bordetella pertussis
gcgcgcacgcgcucgggc

SEQ ID NO: 2391210 - RNA, 19 nt, Bordetella pertussis
gcgcgcacgcgcucgggca

SEQ ID NO: 2391211 - RNA, 14 nt, Bordetella pertussis
gcgcgcacggcgcc

SEQ ID NO: 2391212 - RNA, 17 nt, Bordetella pertussis
gcgcgcacggcgcccug

SEQ ID NO: 2391213 - RNA, 15 nt, Bordetella pertussis
gcgcgcacgggcgag

SEQ ID NO: 2391214 - RNA, 23 nt, Bordetella pertussis
gcgcgcacgggcgaggcggggcu

SEQ ID NO: 2391215 - RNA, 13 nt, Bordetella pertussis
gcgcgcacgugga

SEQ ID NO: 2391216 - RNA, 13 nt, Bordetella pertussis
gcgcgcagacgcg

SEQ ID NO: 2391217 - RNA, 14 nt, Bordetella pertussis
gcgcgcagacgcga

SEQ ID NO: 2391218 - RNA, 23 nt, Bordetella pertussis
gcgcgcagauugcgcucggucau

SEQ ID NO: 2391219 - RNA, 14 nt, Bordetella pertussis
gcgcgcagcacaua

SEQ ID NO: 2391220 - RNA, 13 nt, Bordetella pertussis
gcgcgcagcacgc

SEQ ID NO: 2391221 - RNA, 12 nt, Bordetella pertussis
gcgcgcagcagc

SEQ ID NO: 2391222 - RNA, 13 nt, Bordetella pertussis
gcgcgcagcagcg

SEQ ID NO: 2391223 - RNA, 15 nt, Bordetella pertussis
gcgcgcagcaggccc

SEQ ID NO: 2391224 - RNA, 16 nt, Bordetella pertussis
gcgcgcagcaggccca

SEQ ID NO: 2391225 - RNA, 23 nt, Bordetella pertussis
gcgcgcagcaggcccaugccgcg

SEQ ID NO: 2391226 - RNA, 15 nt, Bordetella pertussis
gcgcgcagccaggua

SEQ ID NO: 2391227 - RNA, 13 nt, Bordetella pertussis
gcgcgcagccgcg

SEQ ID NO: 2391228 - RNA, 13 nt, Bordetella pertussis
gcgcgcagcgcga

SEQ ID NO: 2391229 - RNA, 15 nt, Bordetella pertussis
gcgcgcagcgcgccg

SEQ ID NO: 2391230 - RNA, 21 nt, Bordetella pertussis
gcgcgcagcucccccacgccg

SEQ ID NO: 2391231 - RNA, 23 nt, Bordetella pertussis
gcgcgcagcucccccacgccgcc

SEQ ID NO: 2391232 - RNA, 18 nt, Bordetella pertussis
gcgcgcaggcaguuggcg

SEQ ID NO: 2391233 - RNA, 13 nt, Bordetella pertussis
gcgcgcaggccuc

SEQ ID NO: 2391234 - RNA, 17 nt, Bordetella pertussis
gcgcgcaggcgggccuc

SEQ ID NO: 2391235 - RNA, 13 nt, Bordetella pertussis
gcgcgcgccggcc

SEQ ID NO: 2391236 - RNA, 14 nt, Bordetella pertussis
gcgcgcgccggccg

SEQ ID NO: 2391237 - RNA, 15 nt, Bordetella pertussis
gcgcgcgccggcggc

SEQ ID NO: 2391238 - RNA, 13 nt, Bordetella pertussis
gcgcgcgccugcu

SEQ ID NO: 2391239 - RNA, 15 nt, Bordetella pertussis
gcgcgcgccugcucg

SEQ ID NO: 2391240 - RNA, 14 nt, Bordetella pertussis
gcgcgcgcgaggcg

SEQ ID NO: 2391241 - RNA, 14 nt, Bordetella pertussis
gcgcgcgcgcagca

SEQ ID NO: 2391242 - RNA, 13 nt, Bordetella pertussis
gcgcgcgcgccga

SEQ ID NO: 2391243 - RNA, 15 nt, Bordetella pertussis
gcgcgcgcgccgcac

SEQ ID NO: 2391244 - RNA, 14 nt, Bordetella pertussis
gcgcgcgcgcgcgg

SEQ ID NO: 2391245 - RNA, 17 nt, Bordetella pertussis
gcgcgcgcgcgcgggcg

SEQ ID NO: 2391246 - RNA, 14 nt, Bordetella pertussis
gcgcgcgcgcggau

SEQ ID NO: 2391247 - RNA, 14 nt, Bordetella pertussis
gcgcgcgcgcgggc

SEQ ID NO: 2391248 - RNA, 15 nt, Bordetella pertussis
gcgcgcgcgcgggcg

SEQ ID NO: 2391249 - RNA, 12 nt, Bordetella pertussis
gcgcgcgcggcc

SEQ ID NO: 2391250 - RNA, 15 nt, Bordetella pertussis
gcgcgcugcacggcc

SEQ ID NO: 2391251 - RNA, 15 nt, Bordetella pertussis
gcgcgcugcccagcc

SEQ ID NO: 2391252 - RNA, 12 nt, Bordetella pertussis
gcgcgcuggcgc

SEQ ID NO: 2391253 - RNA, 14 nt, Bordetella pertussis
gcgcgcuggcgccc

SEQ ID NO: 2391254 - RNA, 14 nt, Bordetella pertussis
gcgcgcuggcgcuc

SEQ ID NO: 2391255 - RNA, 18 nt, Bordetella pertussis
gcgcgcuggcgcucgggc

SEQ ID NO: 2391256 - RNA, 21 nt, Bordetella pertussis
gcgcgcuggcugugcccgccc

SEQ ID NO: 2391257 - RNA, 21 nt, Bordetella pertussis
gcgcgcuggggcugucgcgcu

SEQ ID NO: 2391258 - RNA, 12 nt, Bordetella pertussis
gcgcgcuggucg

SEQ ID NO: 2391259 - RNA, 13 nt, Bordetella pertussis
gcgcgcuguucau

SEQ ID NO: 2391260 - RNA, 13 nt, Bordetella pertussis
gcgcgcuucaggc

SEQ ID NO: 2391261 - RNA, 17 nt, Bordetella pertussis
gcgcgcuucaggcgccg

SEQ ID NO: 2391262 - RNA, 19 nt, Bordetella pertussis
gcgcgcuuccucgaccagg

SEQ ID NO: 2391263 - RNA, 16 nt, Bordetella pertussis
gcgcgcuucgagccgg

SEQ ID NO: 2391264 - RNA, 17 nt, Bordetella pertussis
gcgcgcuucgagccggu

SEQ ID NO: 2391265 - RNA, 19 nt, Bordetella pertussis
gcgcgcuucgagccgguac

SEQ ID NO: 2391266 - RNA, 17 nt, Bordetella pertussis
gcgcgcuucuuggcgac

SEQ ID NO: 2391267 - RNA, 19 nt, Bordetella pertussis
gcgcgcuucuuggcgacca

SEQ ID NO: 2391268 - RNA, 21 nt, Bordetella pertussis
gcgcgcuucuuggcgaccagg

SEQ ID NO: 2391269 - RNA, 21 nt, Bordetella pertussis
gcgcgcuugaacuccgcggcg

SEQ ID NO: 2391270 - RNA, 23 nt, Bordetella pertussis
gcgcgcuugaacuccgcggcguc

SEQ ID NO: 2391271 - RNA, 16 nt, Bordetella pertussis
gcgcgcuuggucagca

SEQ ID NO: 2391272 - RNA, 18 nt, Bordetella pertussis
gcgcgcuuucaggugggc

SEQ ID NO: 2391273 - RNA, 22 nt, Bordetella pertussis
gcgcgcuuucaggugggcgaug

SEQ ID NO: 2391274 - RNA, 20 nt, Bordetella pertussis
gcgcggaacagccuggucag

SEQ ID NO: 2391275 - RNA, 13 nt, Bordetella pertussis
gcgcuggcgucca

SEQ ID NO: 2391276 - RNA, 22 nt, Bordetella pertussis
gcgcuggcguccagccugcccg

SEQ ID NO: 2391277 - RNA, 23 nt, Bordetella pertussis
gcgcuggcguccagccugcccgg

SEQ ID NO: 2391278 - RNA, 12 nt, Bordetella pertussis
gcgcuggcugga

SEQ ID NO: 2391279 - RNA, 16 nt, Bordetella pertussis
gcgcuggcuggacgcg

SEQ ID NO: 2391280 - RNA, 18 nt, Bordetella pertussis
gcgcuggcuggacgcgcg

SEQ ID NO: 2391281 - RNA, 19 nt, Bordetella pertussis
gcgcuggcuggacgcgcgc

SEQ ID NO: 2391282 - RNA, 22 nt, Bordetella pertussis
gcgcuggcuggacgcgcgcggc

SEQ ID NO: 2391283 - RNA, 13 nt, Bordetella pertussis
gcgcucgcgcagg

SEQ ID NO: 2391284 - RNA, 13 nt, Bordetella pertussis
gcgcucgcgccag

SEQ ID NO: 2391285 - RNA, 19 nt, Bordetella pertussis
gcgcucgcgccaggccccg

SEQ ID NO: 2391286 - RNA, 15 nt, Bordetella pertussis
gcgcucgcgcgccag

SEQ ID NO: 2391287 - RNA, 15 nt, Bordetella pertussis
gcgcucgcgcucggc

SEQ ID NO: 2391288 - RNA, 18 nt, Bordetella pertussis
gcgcucgcgcucggccag

SEQ ID NO: 2391289 - RNA, 19 nt, Bordetella pertussis
gcgcucgcgcucggccagc

SEQ ID NO: 2391290 - RNA, 14 nt, Bordetella pertussis
gcgcucgcugccgg

SEQ ID NO: 2391291 - RNA, 15 nt, Bordetella pertussis
gcgcucgcugccggc

SEQ ID NO: 2391292 - RNA, 16 nt, Bordetella pertussis
gcgcucgcugccggcg

SEQ ID NO: 2391293 - RNA, 14 nt, Bordetella pertussis
gcgcucggacgccg

SEQ ID NO: 2391294 - RNA, 15 nt, Bordetella pertussis
gcgcucggacgccgc

SEQ ID NO: 2391295 - RNA, 16 nt, Bordetella pertussis
gcgcucggacgccgcg

SEQ ID NO: 2391296 - RNA, 18 nt, Bordetella pertussis
gcgcucggacgccgcgcg

SEQ ID NO: 2391297 - RNA, 19 nt, Bordetella pertussis
gcgcucggagggcuccagg

SEQ ID NO: 2391298 - RNA, 16 nt, Bordetella pertussis
gcgcucggccacgcuc

SEQ ID NO: 2391299 - RNA, 12 nt, Bordetella pertussis
gcgcucggccag

SEQ ID NO: 2391300 - RNA, 14 nt, Bordetella pertussis
gcgcucggccagca

SEQ ID NO: 2391301 - RNA, 15 nt, Bordetella pertussis
gcgcucggccagcau

SEQ ID NO: 2391302 - RNA, 14 nt, Bordetella pertussis
gcgcucggccagcg

SEQ ID NO: 2391303 - RNA, 15 nt, Bordetella pertussis
gcgcucggccagcgc

SEQ ID NO: 2391304 - RNA, 21 nt, Bordetella pertussis
gcgcucggccagcgcgcggcc

SEQ ID NO: 2391305 - RNA, 12 nt, Bordetella pertussis
gcgcucggccuc

SEQ ID NO: 2391306 - RNA, 18 nt, Bordetella pertussis
gcgcucggccucggucag

SEQ ID NO: 2391307 - RNA, 14 nt, Bordetella pertussis
gcgcucggccuugc

SEQ ID NO: 2391308 - RNA, 22 nt, Bordetella pertussis
gcgcucggcgccgggcuggugc

SEQ ID NO: 2391309 - RNA, 12 nt, Bordetella pertussis
gcgcucggcgcu

SEQ ID NO: 2391310 - RNA, 12 nt, Bordetella pertussis
gcgcucgggcag

SEQ ID NO: 2391311 - RNA, 13 nt, Bordetella pertussis
gcgcucgggcgcg

SEQ ID NO: 2391312 - RNA, 14 nt, Bordetella pertussis
gcgcucgggcgcgg

SEQ ID NO: 2391313 - RNA, 15 nt, Bordetella pertussis
gcgcucgggcgcggc

SEQ ID NO: 2391314 - RNA, 16 nt, Bordetella pertussis
gcgcucgggcgcggca

SEQ ID NO: 2391315 - RNA, 14 nt, Bordetella pertussis
gcgcucgggcucgc

SEQ ID NO: 2391316 - RNA, 17 nt, Bordetella pertussis
gcgcucgguguggaugg

SEQ ID NO: 2391317 - RNA, 18 nt, Bordetella pertussis
gcgcucguccaugccggc

SEQ ID NO: 2391318 - RNA, 20 nt, Bordetella pertussis
gcgcucguccaugccggcca

SEQ ID NO: 2391319 - RNA, 21 nt, Bordetella pertussis
gcgcucguccaugccggccau

SEQ ID NO: 2391320 - RNA, 13 nt, Bordetella pertussis
gcgcucgucgggg

SEQ ID NO: 2391321 - RNA, 13 nt, Bordetella pertussis
gcgcucguugcgc

SEQ ID NO: 2391322 - RNA, 22 nt, Bordetella pertussis
gcgcucuugguggugccugcuu

SEQ ID NO: 2391323 - RNA, 15 nt, Bordetella pertussis
gcgcugaccugcacg

SEQ ID NO: 2391324 - RNA, 16 nt, Bordetella pertussis
gcgcugaccugcacga

SEQ ID NO: 2391325 - RNA, 19 nt, Bordetella pertussis
gcgcugaccugcacgaugg

SEQ ID NO: 2391326 - RNA, 21 nt, Bordetella pertussis
gcgcugaccugcacgauggcg

SEQ ID NO: 2391327 - RNA, 17 nt, Bordetella pertussis
gcgcugaugcgcggcgg

SEQ ID NO: 2391328 - RNA, 18 nt, Bordetella pertussis
gcgcugcaauugcgcggc

SEQ ID NO: 2391329 - RNA, 20 nt, Bordetella pertussis
gcgcugcacgcagcgcagga

SEQ ID NO: 2391330 - RNA, 13 nt, Bordetella pertussis
gcgcugcacggcc

SEQ ID NO: 2391331 - RNA, 20 nt, Bordetella pertussis
gcgcugcagaucaucgagca

SEQ ID NO: 2391332 - RNA, 22 nt, Bordetella pertussis
gcgcugcagcaauccaucguga

SEQ ID NO: 2391333 - RNA, 13 nt, Bordetella pertussis
gcgcugcagcaug

SEQ ID NO: 2391334 - RNA, 12 nt, Bordetella pertussis
gcgcugcagcca

SEQ ID NO: 2391335 - RNA, 14 nt, Bordetella pertussis
gcgcugcagcgcag

SEQ ID NO: 2391336 - RNA, 15 nt, Bordetella pertussis
gcgcugcagcgcagg

SEQ ID NO: 2391337 - RNA, 16 nt, Bordetella pertussis
gcgcugcagcgcagga

SEQ ID NO: 2391338 - RNA, 18 nt, Bordetella pertussis
gcgcugcaggaucgcggc

SEQ ID NO: 2391339 - RNA, 20 nt, Bordetella pertussis
gcgcugcaggaucgcggcca

SEQ ID NO: 2391340 - RNA, 21 nt, Bordetella pertussis
gcgcugcaggaucgcggccag

SEQ ID NO: 2391341 - RNA, 23 nt, Bordetella pertussis
gcgcugcaggaucgcggccagcg

SEQ ID NO: 2391342 - RNA, 12 nt, Bordetella pertussis
gcgcugcaggcg

SEQ ID NO: 2391343 - RNA, 15 nt, Bordetella pertussis
gcgcugcaggcgucc

SEQ ID NO: 2391344 - RNA, 18 nt, Bordetella pertussis
gcgcugcaggcgucccgg

SEQ ID NO: 2391345 - RNA, 22 nt, Bordetella pertussis
gcgcugcauacgccgcugaugg

SEQ ID NO: 2391346 - RNA, 15 nt, Bordetella pertussis
gcgcugcaugcccca

SEQ ID NO: 2391347 - RNA, 15 nt, Bordetella pertussis
gcgcugcccaccgcc

SEQ ID NO: 2391348 - RNA, 16 nt, Bordetella pertussis
gcgcugcccaccgccg

SEQ ID NO: 2391349 - RNA, 23 nt, Bordetella pertussis
gcgcugcccaccgccguggccgg

SEQ ID NO: 2391350 - RNA, 20 nt, Bordetella pertussis
gcgcugcccgucgcuggcgc

SEQ ID NO: 2391351 - RNA, 9 nt, Bordetella pertussis
gcgcugccg

SEQ ID NO: 2391352 - RNA, 24 nt, Bordetella pertussis
gcgcugccugaaaccgcaggcaag

SEQ ID NO: 2391353 - RNA, 14 nt, Bordetella pertussis
gcgcugccugccgg

SEQ ID NO: 2391354 - RNA, 17 nt, Bordetella pertussis
gcgcugccugccggccg

SEQ ID NO: 2391355 - RNA, 18 nt, Bordetella pertussis
gcgcugccugccggccgg

SEQ ID NO: 2391356 - RNA, 19 nt, Bordetella pertussis
gcgcugccugccggccggc

SEQ ID NO: 2391357 - RNA, 20 nt, Bordetella pertussis
gcgcugccugccggccggcc

SEQ ID NO: 2391358 - RNA, 19 nt, Bordetella pertussis
gcgcugcgacagcagcaug

SEQ ID NO: 2391359 - RNA, 16 nt, Bordetella pertussis
gcgcugcgagccgccg

SEQ ID NO: 2391360 - RNA, 23 nt, Bordetella pertussis
gcgcggcgcagcccagcgcgaug

SEQ ID NO: 2391361 - RNA, 12 nt, Bordetella pertussis
gcgcggcgcagg

SEQ ID NO: 2391362 - RNA, 15 nt, Bordetella pertussis
gcgcggcgcaggccu

SEQ ID NO: 2391363 - RNA, 17 nt, Bordetella pertussis
gcgcggcgcaggccugc

SEQ ID NO: 2391364 - RNA, 13 nt, Bordetella pertussis
gcgcggcgccaug

SEQ ID NO: 2391365 - RNA, 14 nt, Bordetella pertussis
gcgcggcgccaugc

SEQ ID NO: 2391366 - RNA, 19 nt, Bordetella pertussis
gcgcggcgccaugccgcgc

SEQ ID NO: 2391367 - RNA, 21 nt, Bordetella pertussis
gcgcggcgccaugccgcgccc

SEQ ID NO: 2391368 - RNA, 17 nt, Bordetella pertussis
gcgcggcgcccccgcgg

SEQ ID NO: 2391369 - RNA, 14 nt, Bordetella pertussis
gcgcggcgcccgcc

SEQ ID NO: 2391370 - RNA, 16 nt, Bordetella pertussis
gcgcggcgcccgccug

SEQ ID NO: 2391371 - RNA, 15 nt, Bordetella pertussis
gcgcggcgccggccg

SEQ ID NO: 2391372 - RNA, 12 nt, Bordetella pertussis
gcgcggcgccgu

SEQ ID NO: 2391373 - RNA, 15 nt, Bordetella pertussis
gcgcggcgccgucca

SEQ ID NO: 2391374 - RNA, 18 nt, Bordetella pertussis
gcgcggcgccguccagcg

SEQ ID NO: 2391375 - RNA, 12 nt, Bordetella pertussis
gcgcggcgccug

SEQ ID NO: 2391376 - RNA, 17 nt, Bordetella pertussis
gcgcggcgccugcgcgc

SEQ ID NO: 2391377 - RNA, 19 nt, Bordetella pertussis
gcgcggcgccugcgcgcgc

SEQ ID NO: 2391378 - RNA, 22 nt, Bordetella pertussis
gcgcggcgccuggggcgugccc

SEQ ID NO: 2391379 - RNA, 12 nt, Bordetella pertussis
gcgcggcgcgcc

SEQ ID NO: 2391380 - RNA, 13 nt, Bordetella pertussis
gcgcggcgcgccg

SEQ ID NO: 2391381 - RNA, 16 nt, Bordetella pertussis
gcgcggcgcgccgucc

SEQ ID NO: 2391382 - RNA, 13 nt, Bordetella pertussis
gcgcggcgcgcga

SEQ ID NO: 2391383 - RNA, 14 nt, Bordetella pertussis
gcgcggcgcgcgcc

SEQ ID NO: 2391384 - RNA, 18 nt, Bordetella pertussis
gcgcggcgcgcgccaggg

SEQ ID NO: 2391385 - RNA, 15 nt, Bordetella pertussis
gcgcggcgcgcgccg

SEQ ID NO: 2391386 - RNA, 16 nt, Bordetella pertussis
gcgcggcgcgcgccga

SEQ ID NO: 2391387 - RNA, 15 nt, Bordetella pertussis
gcgcggcgcgcgcgc

SEQ ID NO: 2391388 - RNA, 20 nt, Bordetella pertussis
gcgcggcgcgcgcgcgcagc

SEQ ID NO: 2391389 - RNA, 14 nt, Bordetella pertussis
gcgcggcgcgcugg

SEQ ID NO: 2391390 - RNA, 14 nt, Bordetella pertussis
gcgcggcgcggcca

SEQ ID NO: 2391391 - RNA, 15 nt, Bordetella pertussis
gcgcggcgcggccag

SEQ ID NO: 2391392 - RNA, 15 nt, Bordetella pertussis
gcgcggcgcggcugg

SEQ ID NO: 2391393 - RNA, 18 nt, Bordetella pertussis
gcgcggcgcggcuggcga

SEQ ID NO: 2391394 - RNA, 14 nt, Bordetella pertussis
gcgcggcgcgucgc

SEQ ID NO: 2391395 - RNA, 15 nt, Bordetella pertussis
gcgcggcgcgucgcg

SEQ ID NO: 2391396 - RNA, 19 nt, Bordetella pertussis
gcgcggcgcgucgcgcgcc

SEQ ID NO: 2391397 - RNA, 14 nt, Bordetella pertussis
gcgcggcgcgugcc

SEQ ID NO: 2391398 - RNA, 15 nt, Bordetella pertussis
gcgcggcgcugcacg

SEQ ID NO: 2391399 - RNA, 23 nt, Bordetella pertussis
gcgcggcgcugcacgcggccgcg

SEQ ID NO: 2391400 - RNA, 23 nt, Bordetella pertussis
gcgcggcgcuggcgccgcgcgcc

SEQ ID NO: 2391401 - RNA, 13 nt, Bordetella pertussis
gcgcggcggacug

SEQ ID NO: 2391402 - RNA, 18 nt, Bordetella pertussis
gcgcggcggacugcgccg

SEQ ID NO: 2391403 - RNA, 16 nt, Bordetella pertussis
gcgcggcggccaggcg

SEQ ID NO: 2391404 - RNA, 14 nt, Bordetella pertussis
gcgcggcggccaug

SEQ ID NO: 2391405 - RNA, 22 nt, Bordetella pertussis
gcgcggcggccaugcccaggcc

SEQ ID NO: 2391406 - RNA, 15 nt, Bordetella pertussis
gcgcggcggccuggg

SEQ ID NO: 2391407 - RNA, 13 nt, Bordetella pertussis
gcgcggcggccuu

SEQ ID NO: 2391408 - RNA, 19 nt, Bordetella pertussis
gcgcggcggcgaccggcgc

SEQ ID NO: 2391409 - RNA, 12 nt, Bordetella pertussis
gcgcggcggcgg

SEQ ID NO: 2391410 - RNA, 21 nt, Bordetella pertussis
gcgcggcggcggaucgaacgc

SEQ ID NO: 2391411 - RNA, 22 nt, Bordetella pertussis
gcgcggcggcggaucgaacgcc

SEQ ID NO: 2391412 - RNA, 17 nt, Bordetella pertussis
gcgcggcggcggccaug

SEQ ID NO: 2391413 - RNA, 13 nt, Bordetella pertussis
gcgcggcggcgug

SEQ ID NO: 2391414 - RNA, 14 nt, Bordetella pertussis
gcgcggcggcguga

SEQ ID NO: 2391415 - RNA, 16 nt, Bordetella pertussis
gcgcggcgggcgcugg

SEQ ID NO: 2391416 - RNA, 19 nt, Bordetella pertussis
gcgcggcgggcgcuggcgc

SEQ ID NO: 2391417 - RNA, 15 nt, Bordetella pertussis
gcgcggcgggcggcg

SEQ ID NO: 2391418 - RNA, 21 nt, Bordetella pertussis
gcgcggcgggcggcgcggcca

SEQ ID NO: 2391419 - RNA, 14 nt, Bordetella pertussis
gcgcggcgggcuca

SEQ ID NO: 2391420 - RNA, 24 nt, Bordetella pertussis
gcgcggcgggcucgagcuggcugg

SEQ ID NO: 2391421 - RNA, 17 nt, Bordetella pertussis
gcgcggcgggugccgcg

SEQ ID NO: 2391422 - RNA, 21 nt, Bordetella pertussis
gcgcggcguguagagcugcgg

SEQ ID NO: 2391423 - RNA, 17 nt, Bordetella pertussis
gcgcggcucgccgcgca

SEQ ID NO: 2391424 - RNA, 17 nt, Bordetella pertussis
gcgcggcucgccggccg

SEQ ID NO: 2391425 - RNA, 22 nt, Bordetella pertussis
gcgcggcugcccucggucagcg

SEQ ID NO: 2391426 - RNA, 16 nt, Bordetella pertussis
gcgcggcugcugggca

SEQ ID NO: 2391427 - RNA, 18 nt, Bordetella pertussis
gcgcggcugcugggcaug

SEQ ID NO: 2391428 - RNA, 14 nt, Bordetella pertussis
gcgcggcuggauga

SEQ ID NO: 2391429 - RNA, 15 nt, Bordetella pertussis
gcgcggcuggcgaug

SEQ ID NO: 2391430 - RNA, 17 nt, Bordetella pertussis
gcgcggcuggggcugcu

SEQ ID NO: 2391431 - RNA, 23 nt, Bordetella pertussis
gcgcggcuggggcugcugggccg

SEQ ID NO: 2391432 - RNA, 18 nt, Bordetella pertussis
gcgcggcugggucggcgu

SEQ ID NO: 2391433 - RNA, 22 nt, Bordetella pertussis
gcgcggcuugcagcggacggcg

SEQ ID NO: 2391434 - RNA, 18 nt, Bordetella pertussis
gcgcggcuugguugucgc

SEQ ID NO: 2391435 - RNA, 22 nt, Bordetella pertussis
gcgcggcuuuuucucggccucg

SEQ ID NO: 2391436 - RNA, 19 nt, Bordetella pertussis
gcgcgggaagcgcucgcgc

SEQ ID NO: 2391437 - RNA, 22 nt, Bordetella pertussis
gcgcgggaagcgcucgcgcagg

SEQ ID NO: 2391438 - RNA, 13 nt, Bordetella pertussis
gcgcgggagcccg

SEQ ID NO: 2391439 - RNA, 14 nt, Bordetella pertussis
gcgcgggagcccgc

SEQ ID NO: 2391440 - RNA, 19 nt, Bordetella pertussis
gcgcgggcacucggccaug

SEQ ID NO: 2391441 - RNA, 15 nt, Bordetella pertussis
gcgcgggcccuggcg

SEQ ID NO: 2391442 - RNA, 21 nt, Bordetella pertussis
gcgcgggcgauuugccgcagc

SEQ ID NO: 2391443 - RNA, 13 nt, Bordetella pertussis
gcgcgggcgcaca

SEQ ID NO: 2391444 - RNA, 12 nt, Bordetella pertussis
gcgcgggcgcca

SEQ ID NO: 2391445 - RNA, 13 nt, Bordetella pertussis
gcgcgggcgcgca

SEQ ID NO: 2391446 - RNA, 14 nt, Bordetella pertussis
gcgcgggcgcgccg

SEQ ID NO: 2391447 - RNA, 14 nt, Bordetella pertussis
gcgcgggcgcggca

SEQ ID NO: 2391448 - RNA, 16 nt, Bordetella pertussis
gcgcgggcgcggcagg

SEQ ID NO: 2391449 - RNA, 13 nt, Bordetella pertussis
gcgcgggcggccc

SEQ ID NO: 2391450 - RNA, 15 nt, Bordetella pertussis
gcgcgggcggcccgc

SEQ ID NO: 2391451 - RNA, 13 nt, Bordetella pertussis
gcgcgggcggccu

SEQ ID NO: 2391452 - RNA, 17 nt, Bordetella pertussis
gcgcgggcggcuaggcg

SEQ ID NO: 2391453 - RNA, 19 nt, Bordetella pertussis
gcgcgggcggcuaggcgca

SEQ ID NO: 2391454 - RNA, 18 nt, Bordetella pertussis
gcgcgggcggucggcgcg

SEQ ID NO: 2391455 - RNA, 20 nt, Bordetella pertussis
gcgcgggcggucggcgcggc

SEQ ID NO: 2391456 - RNA, 21 nt, Bordetella pertussis
gcgcgggcggucggcgcggcg

SEQ ID NO: 2391457 - RNA, 22 nt, Bordetella pertussis
gcgcgggcggucggcgcggcgc

SEQ ID NO: 2391458 - RNA, 15 nt, Bordetella pertussis
gcgcgggcugucgca

SEQ ID NO: 2391459 - RNA, 12 nt, Bordetella pertussis
gcgcggggcacc

SEQ ID NO: 2391460 - RNA, 16 nt, Bordetella pertussis
gcgcggggcaggccga

SEQ ID NO: 2391461 - RNA, 14 nt, Bordetella pertussis
gcgcggggccaggc

SEQ ID NO: 2391462 - RNA, 15 nt, Bordetella pertussis
gcgcggggccaggcg

SEQ ID NO: 2391463 - RNA, 14 nt, Bordetella pertussis
gcgcggggccgguc

SEQ ID NO: 2391464 - RNA, 19 nt, Bordetella pertussis
gcgcggggccgguccgcuc

SEQ ID NO: 2391465 - RNA, 13 nt, Bordetella pertussis
gcgcgggggugcg

SEQ ID NO: 2391466 - RNA, 14 nt, Bordetella pertussis
gcgcgggggugcgc

SEQ ID NO: 2391467 - RNA, 18 nt, Bordetella pertussis
gcgcggguaaugccggug

SEQ ID NO: 2391468 - RNA, 23 nt, Bordetella pertussis
gcgcggguaggcaaagcgcagca

SEQ ID NO: 2391469 - RNA, 16 nt, Bordetella pertussis
gcgcggguccaggccc

SEQ ID NO: 2391470 - RNA, 17 nt, Bordetella pertussis
gcgcggguccaggcccg

SEQ ID NO: 2391471 - RNA, 22 nt, Bordetella pertussis
gcgcggguccggcgugccaugg

SEQ ID NO: 2391472 - RNA, 20 nt, Bordetella pertussis
gcgcggguccuugccgggcu

SEQ ID NO: 2391473 - RNA, 23 nt, Bordetella pertussis
gcgcggguggccggaucgagcgc

SEQ ID NO: 2391474 - RNA, 16 nt, Bordetella pertussis
gcgcgguacgcaccgc

SEQ ID NO: 2391475 - RNA, 21 nt, Bordetella pertussis
gcgcgguacgcaccgccgccg

SEQ ID NO: 2391476 - RNA, 11 nt, Bordetella pertussis
gcgcuggcugu

SEQ ID NO: 2391477 - RNA, 20 nt, Bordetella pertussis
gcgcugggcaggcuggcgcg

SEQ ID NO: 2391478 - RNA, 14 nt, Bordetella pertussis
gcgcugggcauggg

SEQ ID NO: 2391479 - RNA, 18 nt, Bordetella pertussis
gcgcugggcaugggcggc

SEQ ID NO: 2391480 - RNA, 14 nt, Bordetella pertussis
gcgcugggcgcauu

SEQ ID NO: 2391481 - RNA, 22 nt, Bordetella pertussis
gcgcugggcgcauuggcccugc

SEQ ID NO: 2391482 - RNA, 20 nt, Bordetella pertussis
gcgcugggcgguugcgcugc

SEQ ID NO: 2391483 - RNA, 21 nt, Bordetella pertussis
gcgcugggcgguugcgcugcu

SEQ ID NO: 2391484 - RNA, 13 nt, Bordetella pertussis
gcgcugggcgugg

SEQ ID NO: 2391485 - RNA, 18 nt, Bordetella pertussis
gcgcugggcguggcgcgc

SEQ ID NO: 2391486 - RNA, 20 nt, Bordetella pertussis
gcgcugggcguggcgcgcgu

SEQ ID NO: 2391487 - RNA, 23 nt, Bordetella pertussis
gcgcugggcguggcgcgcgugcu

SEQ ID NO: 2391488 - RNA, 15 nt, Bordetella pertussis
gcgcuggggcagcag

SEQ ID NO: 2391489 - RNA, 14 nt, Bordetella pertussis
gcgcuggggcagga

SEQ ID NO: 2391490 - RNA, 18 nt, Bordetella pertussis
gcgcuggggcaggacgcc

SEQ ID NO: 2391491 - RNA, 22 nt, Bordetella pertussis
gcgcuggggcaggacgccggcg

SEQ ID NO: 2391492 - RNA, 16 nt, Bordetella pertussis
gcgcuggggcugucgc

SEQ ID NO: 2391493 - RNA, 20 nt, Bordetella pertussis
gcgcuggggcugucgcgcua

SEQ ID NO: 2391494 - RNA, 17 nt, Bordetella pertussis
gcgcugggucaggucgc

SEQ ID NO: 2391495 - RNA, 18 nt, Bordetella pertussis
gcgcugggucaggucgcu

SEQ ID NO: 2391496 - RNA, 23 nt, Bordetella pertussis
gcgcugggucaggucgcugccca

SEQ ID NO: 2391497 - RNA, 22 nt, Bordetella pertussis
gcgcuggguguagucgcggccg

SEQ ID NO: 2391498 - RNA, 20 nt, Bordetella pertussis
gcgcugguaaagggcgcgga

SEQ ID NO: 2391499 - RNA, 21 nt, Bordetella pertussis
gcgcugguaaagggcgcggau

SEQ ID NO: 2391500 - RNA, 23 nt, Bordetella pertussis
gcgcugguaaagggcgcggaugu

SEQ ID NO: 2391501 - RNA, 17 nt, Bordetella pertussis
gcgcugguaguaggcca

SEQ ID NO: 2391502 - RNA, 16 nt, Bordetella pertussis
gcgcuggucgcgcagc

SEQ ID NO: 2391503 - RNA, 19 nt, Bordetella pertussis
gcgcuggucgcgcagcacg

SEQ ID NO: 2391504 - RNA, 20 nt, Bordetella pertussis
gcgcuggucgcgcagcacga

SEQ ID NO: 2391505 - RNA, 21 nt, Bordetella pertussis
gcgcuggucgggaugccccgc

SEQ ID NO: 2391506 - RNA, 17 nt, Bordetella pertussis
gcgcuguaggcgccggc

SEQ ID NO: 2391507 - RNA, 20 nt, Bordetella pertussis
gcgcuguaggcgccggcgcc

SEQ ID NO: 2391508 - RNA, 22 nt, Bordetella pertussis
gcgcuguaggcgccggcgccgg

SEQ ID NO: 2391509 - RNA, 14 nt, Bordetella pertussis
gcgcuguccggcgc

SEQ ID NO: 2391510 - RNA, 21 nt, Bordetella pertussis
gcgcuguucgauacggccacg

SEQ ID NO: 2391511 - RNA, 23 nt, Bordetella pertussis
gcgcuguucgauacggccacgca

SEQ ID NO: 2391512 - RNA, 22 nt, Bordetella pertussis
gcgcuguucggcgaugcgggcg

SEQ ID NO: 2391513 - RNA, 17 nt, Bordetella pertussis
gcgcuguugcuccaggc

SEQ ID NO: 2391514 - RNA, 17 nt, Bordetella pertussis
gcgcuguuggccggcgc

SEQ ID NO: 2391515 - RNA, 23 nt, Bordetella pertussis
gcgcuguuggccggcgcgcccuu

SEQ ID NO: 2391516 - RNA, 16 nt, Bordetella pertussis
gcgcuguuggccgucg

SEQ ID NO: 2391517 - RNA, 18 nt, Bordetella pertussis
gcgcuguuuccgggccug

SEQ ID NO: 2391518 - RNA, 20 nt, Bordetella pertussis
gcgcuguuuccgggccuggc

SEQ ID NO: 2391519 - RNA, 17 nt, Bordetella pertussis
gcgcuuaccgcgccggc

SEQ ID NO: 2391520 - RNA, 18 nt, Bordetella pertussis
gcgcuuaccgcgccggcu

SEQ ID NO: 2391521 - RNA, 22 nt, Bordetella pertussis
gcgcuucacccuggaugccaug

SEQ ID NO: 2391522 - RNA, 21 nt, Bordetella pertussis
gcgcuucagugcucgggcugc

SEQ ID NO: 2391523 - RNA, 13 nt, Bordetella pertussis
gcgcuuccaggag

SEQ ID NO: 2391524 - RNA, 18 nt, Bordetella pertussis
gcgcuuccucgaccaggu

SEQ ID NO: 2391525 - RNA, 21 nt, Bordetella pertussis
gcgcuuccucgaccaggucca

SEQ ID NO: 2391526 - RNA, 14 nt, Bordetella pertussis
gcgcuucgggcagc

SEQ ID NO: 2391527 - RNA, 21 nt, Bordetella pertussis
gcgcuucgucggccgccagcc

SEQ ID NO: 2391528 - RNA, 23 nt, Bordetella pertussis
gcgcuucgugcagcgcgugggcc

SEQ ID NO: 2391529 - RNA, 22 nt, Bordetella pertussis
gcgcuucugccagacggccagc

SEQ ID NO: 2391530 - RNA, 16 nt, Bordetella pertussis
gcgcuucuuggcgacc

SEQ ID NO: 2391531 - RNA, 20 nt, Bordetella pertussis
gcgcuucuuggcgaccaggc

SEQ ID NO: 2391532 - RNA, 21 nt, Bordetella pertussis
gcgcuugaaaugcguggcgug

SEQ ID NO: 2391533 - RNA, 22 nt, Bordetella pertussis
gcgcuugaacuccgcggcgucg

SEQ ID NO: 2391534 - RNA, 16 nt, Bordetella pertussis
gcgcuugagcggcucg

SEQ ID NO: 2391535 - RNA, 21 nt, Bordetella pertussis
gcgcuugagcggcucgccucc

SEQ ID NO: 2391536 - RNA, 19 nt, Bordetella pertussis
gcgcuugccgaccuccagg

SEQ ID NO: 2391537 - RNA, 14 nt, Bordetella pertussis
gcgcuugccugacg

SEQ ID NO: 2391538 - RNA, 19 nt, Bordetella pertussis
gcgcuugcgcagggcgggc

SEQ ID NO: 2391539 - RNA, 20 nt, Bordetella pertussis
gcgcuugcgcauggccgguu

SEQ ID NO: 2391540 - RNA, 15 nt, Bordetella pertussis
gcgcuugcgcgccac

SEQ ID NO: 2391541 - RNA, 15 nt, Bordetella pertussis
gcgcuugcggccguc

SEQ ID NO: 2391542 - RNA, 16 nt, Bordetella pertussis
gcgcuuggaccccgug

SEQ ID NO: 2391543 - RNA, 15 nt, Bordetella pertussis
gcgcuuggccagcug

SEQ ID NO: 2391544 - RNA, 18 nt, Bordetella pertussis
gcgcuuggccagcuggcg

SEQ ID NO: 2391545 - RNA, 20 nt, Bordetella pertussis
gcgcuuggccagcuggcgcg

SEQ ID NO: 2391546 - RNA, 16 nt, Bordetella pertussis
gcgcuuggcccugcag

SEQ ID NO: 2391547 - RNA, 19 nt, Bordetella pertussis
gcgcuuggcccugcagcgg

SEQ ID NO: 2391548 - RNA, 15 nt, Bordetella pertussis
gcgcuuggcguagcc

SEQ ID NO: 2391549 - RNA, 20 nt, Bordetella pertussis
gcgcuugugcgucggcucgg

SEQ ID NO: 2391550 - RNA, 18 nt, Bordetella pertussis
gcgcuuuuccccgcccag

SEQ ID NO: 2391551 - RNA, 20 nt, Bordetella pertussis
gcgcuuuuccccgcccagcg

SEQ ID NO: 2391552 - RNA, 18 nt, Bordetella pertussis
gcgcuuuuuucuccagcg

SEQ ID NO: 2391553 - RNA, 19 nt, Bordetella pertussis
gcggaaaacagcaccagca

SEQ ID NO: 2391554 - RNA, 22 nt, Bordetella pertussis
gcggaaaacagcaccagcaugc

SEQ ID NO: 2391555 - RNA, 14 nt, Bordetella pertussis
gcggaaagcuggcg

SEQ ID NO: 2391556 - RNA, 21 nt, Bordetella pertussis
gcggaaauccguaguccagca

SEQ ID NO: 2391557 - RNA, 23 nt, Bordetella pertussis
gcggaaauccguaguccagcagc

SEQ ID NO: 2391558 - RNA, 16 nt, Bordetella pertussis
gcggaacagccugguc

SEQ ID NO: 2391559 - RNA, 20 nt, Bordetella pertussis
gcggaagucgggcaccagca

SEQ ID NO: 2391560 - RNA, 20 nt, Bordetella pertussis
gcggaaugcggcgacagggc

SEQ ID NO: 2391561 - RNA, 23 nt, Bordetella pertussis
gcggaaugcggcgacagggcguc

SEQ ID NO: 2391562 - RNA, 18 nt, Bordetella pertussis
gcggaauggggcccgcau

SEQ ID NO: 2391563 - RNA, 18 nt, Bordetella pertussis
gcggaauguugccgaaga

SEQ ID NO: 2391564 - RNA, 22 nt, Bordetella pertussis
gcggacacgcccuggccguaca

SEQ ID NO: 2391565 - RNA, 22 nt, Bordetella pertussis
gcggacacugacguggauggcu

SEQ ID NO: 2391566 - RNA, 21 nt, Bordetella pertussis
gcggacagaugccguccuggc

SEQ ID NO: 2391567 - RNA, 13 nt, Bordetella pertussis
gcggaccacacga

SEQ ID NO: 2391568 - RNA, 23 nt, Bordetella pertussis
gcggaccagcgguugcgccagcu

SEQ ID NO: 2391569 - RNA, 16 nt, Bordetella pertussis
gcggacccaggccucg

SEQ ID NO: 2391570 - RNA, 21 nt, Bordetella pertussis
gcggacccaguucggccgcca

SEQ ID NO: 2391571 - RNA, 16 nt, Bordetella pertussis
gcggacgauggccugu

SEQ ID NO: 2391572 - RNA, 22 nt, Bordetella pertussis
gcggacgauguagaucuggcgc

SEQ ID NO: 2391573 - RNA, 13 nt, Bordetella pertussis
gcggacgccagcc

SEQ ID NO: 2391574 - RNA, 14 nt, Bordetella pertussis
gcggacgccagccc

SEQ ID NO: 2391575 - RNA, 18 nt, Bordetella pertussis
gcggacgccagcccuggg

SEQ ID NO: 2391576 - RNA, 20 nt, Bordetella pertussis
gcggacgccagcccugggug

SEQ ID NO: 2391577 - RNA, 17 nt, Bordetella pertussis
gcggacgccauggcggc

SEQ ID NO: 2391578 - RNA, 19 nt, Bordetella pertussis
gcggacgccauggcggcgg

SEQ ID NO: 2391579 - RNA, 22 nt, Bordetella pertussis
gcggacgccauggcggcggcca

SEQ ID NO: 2391580 - RNA, 14 nt, Bordetella pertussis
gcggacgggccagg

SEQ ID NO: 2391581 - RNA, 17 nt, Bordetella pertussis
gcggacgggccaggccg

SEQ ID NO: 2391582 - RNA, 14 nt, Bordetella pertussis
gcggacgguagcgc

SEQ ID NO: 2391583 - RNA, 17 nt, Bordetella pertussis
gcggacgguagcgcacg

SEQ ID NO: 2391584 - RNA, 13 nt, Bordetella pertussis
gcggacuggccgc

SEQ ID NO: 2391585 - RNA, 15 nt, Bordetella pertussis
gcggacuggccgcgc

SEQ ID NO: 2391586 - RNA, 18 nt, Bordetella pertussis
gcggacuggccgcgccgc

SEQ ID NO: 2391587 - RNA, 15 nt, Bordetella pertussis
gcggacuucgcccgg

SEQ ID NO: 2391588 - RNA, 21 nt, Bordetella pertussis
gcggacuucgcuuucgguggc

SEQ ID NO: 2391589 - RNA, 23 nt, Bordetella pertussis
gcgccugcgccauguggcgacgc

SEQ ID NO: 2391590 - RNA, 14 nt, Bordetella pertussis
gcgccugcgcgccg

SEQ ID NO: 2391591 - RNA, 16 nt, Bordetella pertussis
gcgccugcgcgccgcc

SEQ ID NO: 2391592 - RNA, 14 nt, Bordetella pertussis
gcgccugcgcgcgc

SEQ ID NO: 2391593 - RNA, 15 nt, Bordetella pertussis
gcgccugcgcgcgcu

SEQ ID NO: 2391594 - RNA, 14 nt, Bordetella pertussis
gcgccugcgcgcgg

SEQ ID NO: 2391595 - RNA, 14 nt, Bordetella pertussis
gcgccugcgcggcc

SEQ ID NO: 2391596 - RNA, 16 nt, Bordetella pertussis
gcgccugcgcggccuc

SEQ ID NO: 2391597 - RNA, 13 nt, Bordetella pertussis
gcgccugcggcag

SEQ ID NO: 2391598 - RNA, 14 nt, Bordetella pertussis
gcgccugcggcagg

SEQ ID NO: 2391599 - RNA, 15 nt, Bordetella pertussis
gcgccugcggcaggc

SEQ ID NO: 2391600 - RNA, 18 nt, Bordetella pertussis
gcgccugcggcaggccgc

SEQ ID NO: 2391601 - RNA, 13 nt, Bordetella pertussis
gcgccugcggggc

SEQ ID NO: 2391602 - RNA, 17 nt, Bordetella pertussis
gcgccugcggggccgcu

SEQ ID NO: 2391603 - RNA, 18 nt, Bordetella pertussis
gcgccugcgucguugccc

SEQ ID NO: 2391604 - RNA, 14 nt, Bordetella pertussis
gcgccugcucacgc

SEQ ID NO: 2391605 - RNA, 19 nt, Bordetella pertussis
gcgccugcucacgccccgc

SEQ ID NO: 2391606 - RNA, 21 nt, Bordetella pertussis
gcgccugcucgaccugcucgg

SEQ ID NO: 2391607 - RNA, 21 nt, Bordetella pertussis
gcgccugcuggucggcguggu

SEQ ID NO: 2391608 - RNA, 14 nt, Bordetella pertussis
gcgccuggaccugg

SEQ ID NO: 2391609 - RNA, 17 nt, Bordetella pertussis
gcgccuggaccuggacg

SEQ ID NO: 2391610 - RNA, 22 nt, Bordetella pertussis
gcgccuggaccuggacgagggc

SEQ ID NO: 2391611 - RNA, 23 nt, Bordetella pertussis
gcgccuggaccuggacgagggcc

SEQ ID NO: 2391612 - RNA, 13 nt, Bordetella pertussis
gcgccuggcccag

SEQ ID NO: 2391613 - RNA, 18 nt, Bordetella pertussis
gcgccuggcccagaucug

SEQ ID NO: 2391614 - RNA, 20 nt, Bordetella pertussis
gcgccuggcccagaucugcc

SEQ ID NO: 2391615 - RNA, 13 nt, Bordetella pertussis
gcgccuggccgcc

SEQ ID NO: 2391616 - RNA, 15 nt, Bordetella pertussis
gcgccuggccgccca

SEQ ID NO: 2391617 - RNA, 18 nt, Bordetella pertussis
gcgccuggccgcccagcg

SEQ ID NO: 2391618 - RNA, 19 nt, Bordetella pertussis
gcgccuggccgcccagcgc

SEQ ID NO: 2391619 - RNA, 14 nt, Bordetella pertussis
gcgccuggccgcgc

SEQ ID NO: 2391620 - RNA, 12 nt, Bordetella pertussis
gcgccuggccgu

SEQ ID NO: 2391621 - RNA, 12 nt, Bordetella pertussis
gcgccuggcgca

SEQ ID NO: 2391622 - RNA, 19 nt, Bordetella pertussis
gcgccuggcgcaugacggc

SEQ ID NO: 2391623 - RNA, 21 nt, Bordetella pertussis
gcgccuggcgcaugacggcgu

SEQ ID NO: 2391624 - RNA, 23 nt, Bordetella pertussis
gcgccuggcgcaugacggcgucg

SEQ ID NO: 2391625 - RNA, 17 nt, Bordetella pertussis
gcgccuggcgcgcccac

SEQ ID NO: 2391626 - RNA, 14 nt, Bordetella pertussis
gcgccuggcggcug

SEQ ID NO: 2391627 - RNA, 15 nt, Bordetella pertussis
gcgccuggcggcugg

SEQ ID NO: 2391628 - RNA, 23 nt, Bordetella pertussis
gcgccuggcggcugucgggcggc

SEQ ID NO: 2391629 - RNA, 14 nt, Bordetella pertussis
gcgccuggcgggcc

SEQ ID NO: 2391630 - RNA, 14 nt, Bordetella pertussis
gcgccuggcugagg

SEQ ID NO: 2391631 - RNA, 13 nt, Bordetella pertussis
gcgccugggccuu

SEQ ID NO: 2391632 - RNA, 14 nt, Bordetella pertussis
gcgccugggccuuc

SEQ ID NO: 2391633 - RNA, 13 nt, Bordetella pertussis
gcgccugggcggc

SEQ ID NO: 2391634 - RNA, 16 nt, Bordetella pertussis
gcgccugggcggccac

SEQ ID NO: 2391635 - RNA, 15 nt, Bordetella pertussis
gcgccugggcggcgc

SEQ ID NO: 2391636 - RNA, 16 nt, Bordetella pertussis
gcgccugggcggcgca

SEQ ID NO: 2391637 - RNA, 22 nt, Bordetella pertussis
gcgccugggcggcgcagucgcg

SEQ ID NO: 2391638 - RNA, 23 nt, Bordetella pertussis
gcgccugggcggcgcagucgcgc

SEQ ID NO: 2391639 - RNA, 24 nt, Bordetella pertussis
gcgccugggcggcgcagucgcgca

SEQ ID NO: 2391640 - RNA, 17 nt, Bordetella pertussis
gcgccuggggcgggcgg

SEQ ID NO: 2391641 - RNA, 17 nt, Bordetella pertussis
gcgccuggggcgugccc

SEQ ID NO: 2391642 - RNA, 23 nt, Bordetella pertussis
gcgccuggggcgugcccuugagc

SEQ ID NO: 2391643 - RNA, 15 nt, Bordetella pertussis
gcgccugguacgaca

SEQ ID NO: 2391644 - RNA, 17 nt, Bordetella pertussis
gcgccugguacgacagc

SEQ ID NO: 2391645 - RNA, 15 nt, Bordetella pertussis
gcgccuggucgcgcg

SEQ ID NO: 2391646 - RNA, 18 nt, Bordetella pertussis
gcgccuggucgcgcgccu

SEQ ID NO: 2391647 - RNA, 15 nt, Bordetella pertussis
gcgccugucccaggc

SEQ ID NO: 2391648 - RNA, 18 nt, Bordetella pertussis
gcgccugucccaggcgcu

SEQ ID NO: 2391649 - RNA, 20 nt, Bordetella pertussis
gcgccuguccccgcugcggc

SEQ ID NO: 2391650 - RNA, 21 nt, Bordetella pertussis
gcgccuguccccgcugcggca

SEQ ID NO: 2391651 - RNA, 16 nt, Bordetella pertussis
gcgccuuacgcggcgc

SEQ ID NO: 2391652 - RNA, 17 nt, Bordetella pertussis
gcgccuuacgcggcgcg

SEQ ID NO: 2391653 - RNA, 20 nt, Bordetella pertussis
gcgccuuacuccggcugcuu

SEQ ID NO: 2391654 - RNA, 18 nt, Bordetella pertussis
gcgccuuacuucuugcgc

SEQ ID NO: 2391655 - RNA, 23 nt, Bordetella pertussis
gcgccuuacuuguacgacgucuu

SEQ ID NO: 2391656 - RNA, 13 nt, Bordetella pertussis
gcgccuuccggca

SEQ ID NO: 2391657 - RNA, 22 nt, Bordetella pertussis
gcgccuuccggcagcggccagc

SEQ ID NO: 2391658 - RNA, 16 nt, Bordetella pertussis
gcgccuucgaggccgg

SEQ ID NO: 2391659 - RNA, 17 nt, Bordetella pertussis
gcgccuucgaggccggc

SEQ ID NO: 2391660 - RNA, 17 nt, Bordetella pertussis
gcgccuucggcaggcgc

SEQ ID NO: 2391661 - RNA, 21 nt, Bordetella pertussis
gcgccuucggcaggcgccggc

SEQ ID NO: 2391662 - RNA, 15 nt, Bordetella pertussis
gcgccuucggcgcgc

SEQ ID NO: 2391663 - RNA, 17 nt, Bordetella pertussis
gcgccuucggcgcgcac

SEQ ID NO: 2391664 - RNA, 19 nt, Bordetella pertussis
gcgccuugaaccccggcug

SEQ ID NO: 2391665 - RNA, 20 nt, Bordetella pertussis
gcgccuugaaccccggcugc

SEQ ID NO: 2391666 - RNA, 22 nt, Bordetella pertussis
gcgccuugaaccccggcugcgc

SEQ ID NO: 2391667 - RNA, 18 nt, Bordetella pertussis
gcgcgaaggugcggauca

SEQ ID NO: 2391668 - RNA, 21 nt, Bordetella pertussis
gcgcgaaguaccagcgcacgu

SEQ ID NO: 2391669 - RNA, 15 nt, Bordetella pertussis
gcgcgaaguggccac

SEQ ID NO: 2391670 - RNA, 21 nt, Bordetella pertussis
gcgcgaaugcguguuccagcg

SEQ ID NO: 2391671 - RNA, 22 nt, Bordetella pertussis
gcgcgaaugcguguuccagcgc

SEQ ID NO: 2391672 - RNA, 23 nt, Bordetella pertussis
gcgcgaaugcguguuccagcgcc

SEQ ID NO: 2391673 - RNA, 23 nt, Bordetella pertussis
gcgcgaauuuuucuuccaguucg

SEQ ID NO: 2391674 - RNA, 14 nt, Bordetella pertussis
gcgcgacagcacca

SEQ ID NO: 2391675 - RNA, 15 nt, Bordetella pertussis
gcgcgacagcaggcc

SEQ ID NO: 2391676 - RNA, 17 nt, Bordetella pertussis
gcgcgacagcaggccgg

SEQ ID NO: 2391677 - RNA, 22 nt, Bordetella pertussis
gcgcgacagcaggccggucagg

SEQ ID NO: 2391678 - RNA, 18 nt, Bordetella pertussis
gcgcgacagccgcgccag

SEQ ID NO: 2391679 - RNA, 21 nt, Bordetella pertussis
gcgcgacagccgcgccagcgc

SEQ ID NO: 2391680 - RNA, 14 nt, Bordetella pertussis
gcgcgacaggcccg

SEQ ID NO: 2391681 - RNA, 20 nt, Bordetella pertussis
gcgcgacaggcccgcggccg

SEQ ID NO: 2391682 - RNA, 22 nt, Bordetella pertussis
gcgcgacaggcggugcgcgcgg

SEQ ID NO: 2391683 - RNA, 19 nt, Bordetella pertussis
gcgcgaccacgaccuuggc

SEQ ID NO: 2391684 - RNA, 18 nt, Bordetella pertussis
gcgcgaccacuggcagac

SEQ ID NO: 2391685 - RNA, 14 nt, Bordetella pertussis
gcgcgaccaggcug

SEQ ID NO: 2391686 - RNA, 14 nt, Bordetella pertussis
gcgcgaccgccgcg

SEQ ID NO: 2391687 - RNA, 13 nt, Bordetella pertussis
gcgcgaccgccuc

SEQ ID NO: 2391688 - RNA, 18 nt, Bordetella pertussis
gcgcgaccgccuccagcg

SEQ ID NO: 2391689 - RNA, 15 nt, Bordetella pertussis
gcgcgaccgcgcggc

SEQ ID NO: 2391690 - RNA, 19 nt, Bordetella pertussis
gcgcgaccgcgcggcgcug

SEQ ID NO: 2391691 - RNA, 14 nt, Bordetella pertussis
gcgcgaccuccggc

SEQ ID NO: 2391692 - RNA, 15 nt, Bordetella pertussis
gcgcgaccuccggca

SEQ ID NO: 2391693 - RNA, 23 nt, Bordetella pertussis
gcgcgaccucgggacggcccugc

SEQ ID NO: 2391694 - RNA, 14 nt, Bordetella pertussis
gcgcgaccugcgcg

SEQ ID NO: 2391695 - RNA, 22 nt, Bordetella pertussis
gcgcgaccugcgcgaccgccgc

SEQ ID NO: 2391696 - RNA, 14 nt, Bordetella pertussis
gcgcgacgacagcg

SEQ ID NO: 2391697 - RNA, 17 nt, Bordetella pertussis
gcgcgacgacagcggcg

SEQ ID NO: 2391698 - RNA, 14 nt, Bordetella pertussis
gcgcgacgccagcg

SEQ ID NO: 2391699 - RNA, 15 nt, Bordetella pertussis
gcgcgacgccagcgc

SEQ ID NO: 2391700 - RNA, 15 nt, Bordetella pertussis
gcgcgacgccguggu

SEQ ID NO: 2391701 - RNA, 17 nt, Bordetella pertussis
gcgcgacgccugcgcca

SEQ ID NO: 2391702 - RNA, 13 nt, Bordetella pertussis
gcgcgacgcgcuu

SEQ ID NO: 2391703 - RNA, 24 nt, Bordetella pertussis
gcgcgacgcgcuugacguccagcg

SEQ ID NO: 2391704 - RNA, 12 nt, Bordetella pertussis
gcgcgacgcgua

SEQ ID NO: 2391705 - RNA, 17 nt, Bordetella pertussis
gcgcgacggcgccggcc

SEQ ID NO: 2391706 - RNA, 20 nt, Bordetella pertussis
gcgcgacgugucggccacca

SEQ ID NO: 2391707 - RNA, 15 nt, Bordetella pertussis
gcgcgacuccaccgg

SEQ ID NO: 2391708 - RNA, 17 nt, Bordetella pertussis
gcgcgacuccaccggcg

SEQ ID NO: 2391709 - RNA, 20 nt, Bordetella pertussis
gcgcgacuccaccggcguca

SEQ ID NO: 2391710 - RNA, 17 nt, Bordetella pertussis
gcgcgacuggcccaggc

SEQ ID NO: 2391711 - RNA, 18 nt, Bordetella pertussis
gcgcgacuggcccaggcg

SEQ ID NO: 2391712 - RNA, 13 nt, Bordetella pertussis
gcggcagcagcga

SEQ ID NO: 2391713 - RNA, 15 nt, Bordetella pertussis
gcggcagcagcgaga

SEQ ID NO: 2391714 - RNA, 13 nt, Bordetella pertussis
gcggcagcaggcg

SEQ ID NO: 2391715 - RNA, 12 nt, Bordetella pertussis
gcggcagcaggg

SEQ ID NO: 2391716 - RNA, 16 nt, Bordetella pertussis
gcggcagcagggccac

SEQ ID NO: 2391717 - RNA, 18 nt, Bordetella pertussis
gcggcagcagggccacgc

SEQ ID NO: 2391718 - RNA, 15 nt, Bordetella pertussis
gcggcagcauggcgc

SEQ ID NO: 2391719 - RNA, 16 nt, Bordetella pertussis
gcggcagcauggcgcg

SEQ ID NO: 2391720 - RNA, 13 nt, Bordetella pertussis
gcggcagccaggu

SEQ ID NO: 2391721 - RNA, 20 nt, Bordetella pertussis
gcggcagccagguggcgaug

SEQ ID NO: 2391722 - RNA, 20 nt, Bordetella pertussis
gcggcagcccggcacgucgg

SEQ ID NO: 2391723 - RNA, 14 nt, Bordetella pertussis
gcggcagccggcca

SEQ ID NO: 2391724 - RNA, 16 nt, Bordetella pertussis
gcggcagccggccaug

SEQ ID NO: 2391725 - RNA, 14 nt, Bordetella pertussis
gcggcagcgcaccg

SEQ ID NO: 2391726 - RNA, 13 nt, Bordetella pertussis
gcggcagcgccgc

SEQ ID NO: 2391727 - RNA, 15 nt, Bordetella pertussis
gcggcagcgccgggu

SEQ ID NO: 2391728 - RNA, 12 nt, Bordetella pertussis
gcggcagcgcga

SEQ ID NO: 2391729 - RNA, 17 nt, Bordetella pertussis
gcggcagcgcgaacggc

SEQ ID NO: 2391730 - RNA, 14 nt, Bordetella pertussis
gcggcagcgcgcag

SEQ ID NO: 2391731 - RNA, 16 nt, Bordetella pertussis
gcggcagcgcgcagga

SEQ ID NO: 2391732 - RNA, 13 nt, Bordetella pertussis
gcggcagcggccc

SEQ ID NO: 2391733 - RNA, 23 nt, Bordetella pertussis
gcggcagcucgcgcugcgcgccg

SEQ ID NO: 2391734 - RNA, 23 nt, Bordetella pertussis
gcggcagcucggcgaagccgcag

SEQ ID NO: 2391735 - RNA, 18 nt, Bordetella pertussis
gcggcaggccccggcccg

SEQ ID NO: 2391736 - RNA, 19 nt, Bordetella pertussis
gcggcaggccccggcccgg

SEQ ID NO: 2391737 - RNA, 14 nt, Bordetella pertussis
gcggcaggccgcag

SEQ ID NO: 2391738 - RNA, 23 nt, Bordetella pertussis
gcggcaggccgcagcgggcccgu

SEQ ID NO: 2391739 - RNA, 13 nt, Bordetella pertussis
gcggcaggccgcg

SEQ ID NO: 2391740 - RNA, 14 nt, Bordetella pertussis
gcggcaggccgcgc

SEQ ID NO: 2391741 - RNA, 17 nt, Bordetella pertussis
gcggcaggccgcgccac

SEQ ID NO: 2391742 - RNA, 14 nt, Bordetella pertussis
gcggcaggcggcug

SEQ ID NO: 2391743 - RNA, 16 nt, Bordetella pertussis
gcggcaggcggcugac

SEQ ID NO: 2391744 - RNA, 20 nt, Bordetella pertussis
gcggcagggccuccugcagc

SEQ ID NO: 2391745 - RNA, 15 nt, Bordetella pertussis
gcggcaggucgcgcg

SEQ ID NO: 2391746 - RNA, 13 nt, Bordetella pertussis
gcggcaggucggu

SEQ ID NO: 2391747 - RNA, 19 nt, Bordetella pertussis
gcggcaggugcgccagcac

SEQ ID NO: 2391748 - RNA, 23 nt, Bordetella pertussis
gcggcaggugcgccagcacggca

SEQ ID NO: 2391749 - RNA, 18 nt, Bordetella pertussis
gcggcagguucugcgcgu

SEQ ID NO: 2391750 - RNA, 19 nt, Bordetella pertussis
gcggcagguucugcgcguc

SEQ ID NO: 2391751 - RNA, 21 nt, Bordetella pertussis
gcggcagguucugcgcguccu

SEQ ID NO: 2391752 - RNA, 23 nt, Bordetella pertussis
gcggcagguugaaguugcucggc

SEQ ID NO: 2391753 - RNA, 14 nt, Bordetella pertussis
gcggcagugggcgg

SEQ ID NO: 2391754 - RNA, 16 nt, Bordetella pertussis
gcggcauagcccaggc

SEQ ID NO: 2391755 - RNA, 18 nt, Bordetella pertussis
gcggcauagcccaggccg

SEQ ID NO: 2391756 - RNA, 22 nt, Bordetella pertussis
gcggcauagcccaggccgccgg

SEQ ID NO: 2391757 - RNA, 23 nt, Bordetella pertussis
gcggcauagcccaggccgccggc

SEQ ID NO: 2391758 - RNA, 16 nt, Bordetella pertussis
gcggcaucacgccggu

SEQ ID NO: 2391759 - RNA, 18 nt, Bordetella pertussis
gcggcaucgacaugcccg

SEQ ID NO: 2391760 - RNA, 20 nt, Bordetella pertussis
gcggcaucgacaugcccgcc

SEQ ID NO: 2391761 - RNA, 23 nt, Bordetella pertussis
gcggcaucgacaugcccgccggc

SEQ ID NO: 2391762 - RNA, 21 nt, Bordetella pertussis
gcggcaucgagaaaccagccg

SEQ ID NO: 2391763 - RNA, 22 nt, Bordetella pertussis
gcggcaucgagaaaccagccgc

SEQ ID NO: 2391764 - RNA, 23 nt, Bordetella pertussis
gcggcaucgagaaaccagccgcc

SEQ ID NO: 2391765 - RNA, 24 nt, Bordetella pertussis
gcggcaucguucaggcgcauggug

SEQ ID NO: 2391766 - RNA, 17 nt, Bordetella pertussis
gcggcaucucgcggcgg

SEQ ID NO: 2391767 - RNA, 18 nt, Bordetella pertussis
gcggcaucucgcggcggu

SEQ ID NO: 2391768 - RNA, 18 nt, Bordetella pertussis
gcggcaucuugccuuggc

SEQ ID NO: 2391769 - RNA, 20 nt, Bordetella pertussis
gcggcaucuugccuuggcga

SEQ ID NO: 2391770 - RNA, 14 nt, Bordetella pertussis
gcggcaugcgccag

SEQ ID NO: 2391771 - RNA, 15 nt, Bordetella pertussis
gcggcaugcgccagc

SEQ ID NO: 2391772 - RNA, 16 nt, Bordetella pertussis
gcggcaugcgccagcc

SEQ ID NO: 2391773 - RNA, 13 nt, Bordetella pertussis
gcggcaugcuggu

SEQ ID NO: 2391774 - RNA, 18 nt, Bordetella pertussis
gcggcaugcugguugggc

SEQ ID NO: 2391775 - RNA, 13 nt, Bordetella pertussis
gcggcauggcgcc

SEQ ID NO: 2391776 - RNA, 19 nt, Bordetella pertussis
gcggcauggcgccgcgccg

SEQ ID NO: 2391777 - RNA, 15 nt, Bordetella pertussis
gcggcauucagcgcu

SEQ ID NO: 2391778 - RNA, 18 nt, Bordetella pertussis
gcggccaaccccgagggc

SEQ ID NO: 2391779 - RNA, 19 nt, Bordetella pertussis
gcggccaaccccgagggcg

SEQ ID NO: 2391780 - RNA, 21 nt, Bordetella pertussis
gcggccaaccccgagggcgcg

SEQ ID NO: 2391781 - RNA, 14 nt, Bordetella pertussis
gcggccacaacccu

SEQ ID NO: 2391782 - RNA, 13 nt, Bordetella pertussis
gcggccaccacca

SEQ ID NO: 2391783 - RNA, 15 nt, Bordetella pertussis
gcggccaccaccagg

SEQ ID NO: 2391784 - RNA, 17 nt, Bordetella pertussis
gcggccaccaccaggcc

SEQ ID NO: 2391785 - RNA, 13 nt, Bordetella pertussis
gcggccaccaggc

SEQ ID NO: 2391786 - RNA, 14 nt, Bordetella pertussis
gcggccaccaggcu

SEQ ID NO: 2391787 - RNA, 15 nt, Bordetella pertussis
gcggccaccaggcug

SEQ ID NO: 2391788 - RNA, 16 nt, Bordetella pertussis
gcggccaccaggcuga

SEQ ID NO: 2391789 - RNA, 17 nt, Bordetella pertussis
gcggccacccugccgug

SEQ ID NO: 2391790 - RNA, 16 nt, Bordetella pertussis
gcggccacgcgccgcc

SEQ ID NO: 2391791 - RNA, 14 nt, Bordetella pertussis
gcggccacggccug

SEQ ID NO: 2391792 - RNA, 17 nt, Bordetella pertussis
gcggccacggccugccc

SEQ ID NO: 2391793 - RNA, 21 nt, Bordetella pertussis
gcggccacggccugcccgggc

SEQ ID NO: 2391794 - RNA, 22 nt, Bordetella pertussis
gcggccacggccugcccgggcg

SEQ ID NO: 2391795 - RNA, 18 nt, Bordetella pertussis
gcggccagcaagcgcgcc

SEQ ID NO: 2391796 - RNA, 22 nt, Bordetella pertussis
gcggccagcaagcgcgccauga

SEQ ID NO: 2391797 - RNA, 13 nt, Bordetella pertussis
gcggccagcaccg

SEQ ID NO: 2391798 - RNA, 14 nt, Bordetella pertussis
gcggccagcaccgg

SEQ ID NO: 2391799 - RNA, 19 nt, Bordetella pertussis
gcggccagcaccggccgcc

SEQ ID NO: 2391800 - RNA, 12 nt, Bordetella pertussis
gcggccagcagc

SEQ ID NO: 2391801 - RNA, 14 nt, Bordetella pertussis
gcggccagcagcgg

SEQ ID NO: 2391802 - RNA, 19 nt, Bordetella pertussis
gcggccagcagcggcaggu

SEQ ID NO: 2391803 - RNA, 16 nt, Bordetella pertussis
gcggccagcaugcugg

SEQ ID NO: 2391804 - RNA, 14 nt, Bordetella pertussis
gcggccagccacgc

SEQ ID NO: 2391805 - RNA, 17 nt, Bordetella pertussis
gcggccagccacgccgg

SEQ ID NO: 2391806 - RNA, 19 nt, Bordetella pertussis
gcggccagccacgccggcg

SEQ ID NO: 2391807 - RNA, 13 nt, Bordetella pertussis
gcggccagccggc

SEQ ID NO: 2391808 - RNA, 19 nt, Bordetella pertussis
gcggccagccggcgcgcca

SEQ ID NO: 2391809 - RNA, 22 nt, Bordetella pertussis
gcggccagccggguggucgcgc

SEQ ID NO: 2391810 - RNA, 15 nt, Bordetella pertussis
gcggccagccugccg

SEQ ID NO: 2391811 - RNA, 18 nt, Bordetella pertussis
gcggccagccugccgcgg

SEQ ID NO: 2391812 - RNA, 13 nt, Bordetella pertussis
gcggccagcgccg

SEQ ID NO: 2391813 - RNA, 19 nt, Bordetella pertussis
gcggccagcgccgcgccgg

SEQ ID NO: 2391814 - RNA, 14 nt, Bordetella pertussis
gcggccagcgccgg

SEQ ID NO: 2391815 - RNA, 22 nt, Bordetella pertussis
gcggccagcgccggcgcgcgcu

SEQ ID NO: 2391816 - RNA, 13 nt, Bordetella pertussis
gcggccagcgcgc

SEQ ID NO: 2391817 - RNA, 14 nt, Bordetella pertussis
gcggccagcgcggc

SEQ ID NO: 2391818 - RNA, 15 nt, Bordetella pertussis
gcggccagcgcggcg

SEQ ID NO: 2391819 - RNA, 17 nt, Bordetella pertussis
gcggccagcgcggcggc

SEQ ID NO: 2391820 - RNA, 23 nt, Bordetella pertussis
gcggccagcgcggcggcagcgcg

SEQ ID NO: 2391821 - RNA, 15 nt, Bordetella pertussis
gcggccagcgcggug

SEQ ID NO: 2391822 - RNA, 13 nt, Bordetella pertussis
gcggccagcggca

SEQ ID NO: 2391823 - RNA, 18 nt, Bordetella pertussis
gcggccagcggcaggggc

SEQ ID NO: 2391824 - RNA, 19 nt, Bordetella pertussis
gcggccagcucggcggccg

SEQ ID NO: 2391825 - RNA, 20 nt, Bordetella pertussis
gcggccagcucggcggccgc

SEQ ID NO: 2391826 - RNA, 21 nt, Bordetella pertussis
gcggccagcucggcggccgcc

SEQ ID NO: 2391827 - RNA, 17 nt, Bordetella pertussis
gcggccaggaucgcggc

SEQ ID NO: 2391828 - RNA, 23 nt, Bordetella pertussis
gcggccaggaucgcggccagccg

SEQ ID NO: 2391829 - RNA, 17 nt, Bordetella pertussis
gcggccaggcccaugcc

SEQ ID NO: 2391830 - RNA, 18 nt, Bordetella pertussis
gcggccaggcccaugccg

SEQ ID NO: 2391831 - RNA, 12 nt, Bordetella pertussis
gcggccaggccg

SEQ ID NO: 2391832 - RNA, 13 nt, Bordetella pertussis
gcggccaggccgg

SEQ ID NO: 2391833 - RNA, 14 nt, Bordetella pertussis
gcggccaggccggc

SEQ ID NO: 2391834 - RNA, 15 nt, Bordetella pertussis
gcggccaggccggcg

SEQ ID NO: 2391835 - RNA, 23 nt, Bordetella pertussis
gcggccaggccggcgcgccggcc

SEQ ID NO: 2391836 - RNA, 16 nt, Bordetella pertussis
gcggccaggccggugg

SEQ ID NO: 2391837 - RNA, 18 nt, Bordetella pertussis
gcggccaggccggugggc

SEQ ID NO: 2391838 - RNA, 11 nt, Bordetella pertussis
gcggccaggcg

SEQ ID NO: 2391839 - RNA, 14 nt, Bordetella pertussis
gcggccaggcgcgc

SEQ ID NO: 2391840 - RNA, 16 nt, Bordetella pertussis
gcggccaggcgcgccg

SEQ ID NO: 2391841 - RNA, 20 nt, Bordetella pertussis
gcggccaggcgcgccgcgau

SEQ ID NO: 2391842 - RNA, 17 nt, Bordetella pertussis
gcggccaggcgcucagc

SEQ ID NO: 2391843 - RNA, 18 nt, Bordetella pertussis
gcggccaggcgcucagcg

SEQ ID NO: 2391844 - RNA, 21 nt, Bordetella pertussis
gcggccaggcucugggcggag

SEQ ID NO: 2391845 - RNA, 11 nt, Bordetella pertussis
gcggccagggc

SEQ ID NO: 2391846 - RNA, 13 nt, Bordetella pertussis
gcggccagggcaa

SEQ ID NO: 2391847 - RNA, 15 nt, Bordetella pertussis
gcggccagggccugc

SEQ ID NO: 2391848 - RNA, 16 nt, Bordetella pertussis
gcggccagggccugcg

SEQ ID NO: 2391849 - RNA, 12 nt, Bordetella pertussis
gcggccagggcu

SEQ ID NO: 2391850 - RNA, 18 nt, Bordetella pertussis
gcggccagggucaggggc

SEQ ID NO: 2391851 - RNA, 22 nt, Bordetella pertussis
gcggccagggucaggggcaggu

SEQ ID NO: 2391852 - RNA, 21 nt, Bordetella pertussis
gcggccaggucggcgucgucg

SEQ ID NO: 2391853 - RNA, 12 nt, Bordetella pertussis
gcggccaucgcc

SEQ ID NO: 2391854 - RNA, 16 nt, Bordetella pertussis
gcggccaucgccgcca

SEQ ID NO: 2391855 - RNA, 17 nt, Bordetella pertussis
gcggccaucgccgccac

SEQ ID NO: 2391856 - RNA, 13 nt, Bordetella pertussis
gcggccaucgggc

SEQ ID NO: 2391857 - RNA, 18 nt, Bordetella pertussis
gcggccaucuuggugcgc

SEQ ID NO: 2391858 - RNA, 22 nt, Bordetella pertussis
gcggccaucuuggugcgcgcca

SEQ ID NO: 2391859 - RNA, 23 nt, Bordetella pertussis
gcggccaucuuggugcgcgccag

SEQ ID NO: 2391860 - RNA, 24 nt, Bordetella pertussis
gcggccaucuuggugcgcgccagg

SEQ ID NO: 2391861 - RNA, 15 nt, Bordetella pertussis
gcggccaugacggcc

SEQ ID NO: 2391862 - RNA, 16 nt, Bordetella pertussis
gcggccaugacggcca

SEQ ID NO: 2391863 - RNA, 18 nt, Bordetella pertussis
gcggccaugauacccaug

SEQ ID NO: 2391864 - RNA, 18 nt, Bordetella pertussis
gcggccaugcccaggccc

SEQ ID NO: 2391865 - RNA, 15 nt, Bordetella pertussis
gcggccaugccgacg

SEQ ID NO: 2391866 - RNA, 16 nt, Bordetella pertussis
gcggccaugcgccgcu

SEQ ID NO: 2391867 - RNA, 21 nt, Bordetella pertussis
gcggccaugcggugcgccgcg

SEQ ID NO: 2391868 - RNA, 14 nt, Bordetella pertussis
gcggcccacccggc

SEQ ID NO: 2391869 - RNA, 14 nt, Bordetella pertussis
gcggcccacggcca

SEQ ID NO: 2391870 - RNA, 15 nt, Bordetella pertussis
gcggcccacggccag

SEQ ID NO: 2391871 - RNA, 16 nt, Bordetella pertussis
gcggcccacggccagc

SEQ ID NO: 2391872 - RNA, 19 nt, Bordetella pertussis
gcggcccacggccagcacu

SEQ ID NO: 2391873 - RNA, 14 nt, Bordetella pertussis
gcggcccagccgcu

SEQ ID NO: 2391874 - RNA, 16 nt, Bordetella pertussis
gcggcccagccgcucg

SEQ ID NO: 2391875 - RNA, 20 nt, Bordetella pertussis
gcggcccagccgcucggcca

SEQ ID NO: 2391876 - RNA, 22 nt, Bordetella pertussis
gcggcccagccgcucggccacg

SEQ ID NO: 2391877 - RNA, 16 nt, Bordetella pertussis
gcggcccagcgcggcg

SEQ ID NO: 2391878 - RNA, 22 nt, Bordetella pertussis
gcggcccagcgcggcggccaug

SEQ ID NO: 2391879 - RNA, 19 nt, Bordetella pertussis
gcggcccagcggcaaagua

SEQ ID NO: 2391880 - RNA, 14 nt, Bordetella pertussis
gcggcccagcgugg

SEQ ID NO: 2391881 - RNA, 18 nt, Bordetella pertussis
gcggcccagcguggcggu

SEQ ID NO: 2391882 - RNA, 12 nt, Bordetella pertussis
gcggcccaggcg

SEQ ID NO: 2391883 - RNA, 18 nt, Bordetella pertussis
gcggcccaggcguccagg

SEQ ID NO: 2391884 - RNA, 19 nt, Bordetella pertussis
gcggcccaggcguccaggc

SEQ ID NO: 2391885 - RNA, 15 nt, Bordetella pertussis
gcggcccaucgugcg

SEQ ID NO: 2391886 - RNA, 21 nt, Bordetella pertussis
gcggcccaucgugcgcgaucu

SEQ ID NO: 2391887 - RNA, 13 nt, Bordetella pertussis
gcggccccaggua

SEQ ID NO: 2391888 - RNA, 18 nt, Bordetella pertussis
gcggccccagguagacca

SEQ ID NO: 2391889 - RNA, 19 nt, Bordetella pertussis
gcggccccagguagaccac

SEQ ID NO: 2391890 - RNA, 18 nt, Bordetella pertussis
gcggccccagucgcugcu

SEQ ID NO: 2391891 - RNA, 21 nt, Bordetella pertussis
gcggccccagucgcugcucga

SEQ ID NO: 2391892 - RNA, 22 nt, Bordetella pertussis
gcggccccggcaccaucgccgc

SEQ ID NO: 2391893 - RNA, 16 nt, Bordetella pertussis
gcggccccggccgccc

SEQ ID NO: 2391894 - RNA, 22 nt, Bordetella pertussis
gcggccccggcucccgcgccau

SEQ ID NO: 2391895 - RNA, 14 nt, Bordetella pertussis
gcggcccgccacgc

SEQ ID NO: 2391896 - RNA, 15 nt, Bordetella pertussis
gcggcccgccagggc

SEQ ID NO: 2391897 - RNA, 18 nt, Bordetella pertussis
gcggcccgccagggcguu

SEQ ID NO: 2391898 - RNA, 12 nt, Bordetella pertussis
gcggcccgccga

SEQ ID NO: 2391899 - RNA, 19 nt, Bordetella pertussis
gcggcccgccgacugggcu

SEQ ID NO: 2391900 - RNA, 19 nt, Bordetella pertussis
gcggcccgcggccuugguc

SEQ ID NO: 2391901 - RNA, 17 nt, Bordetella pertussis
gcggcccgcuccaggcg

SEQ ID NO: 2391902 - RNA, 14 nt, Bordetella pertussis
gcggcccggccgca

SEQ ID NO: 2391903 - RNA, 15 nt, Bordetella pertussis
gcggcccggccgccg

SEQ ID NO: 2391904 - RNA, 15 nt, Bordetella pertussis
gcggcccggcggcaa

SEQ ID NO: 2391905 - RNA, 18 nt, Bordetella pertussis
gcggcccggcgucggguc

SEQ ID NO: 2391906 - RNA, 21 nt, Bordetella pertussis
gcggcccgggcgagauggcgu

SEQ ID NO: 2391907 - RNA, 22 nt, Bordetella pertussis
gcggcccgggcgagauggcgug

SEQ ID NO: 2391908 - RNA, 15 nt, Bordetella pertussis
gcggcccugggccag

SEQ ID NO: 2391909 - RNA, 16 nt, Bordetella pertussis
gcggcccugggccagc

SEQ ID NO: 2391910 - RNA, 21 nt, Bordetella pertussis
gcggcccuggucgucgcggcc

SEQ ID NO: 2391911 - RNA, 13 nt, Bordetella pertussis
gcggcccuguucg

SEQ ID NO: 2391912 - RNA, 22 nt, Bordetella pertussis
gcggccgacagcuugcgcuggc

SEQ ID NO: 2391913 - RNA, 13 nt, Bordetella pertussis
gcggccgaccagc

SEQ ID NO: 2391914 - RNA, 16 nt, Bordetella pertussis
gcggccgaccagcacg

SEQ ID NO: 2391915 - RNA, 17 nt, Bordetella pertussis
gcggccgaccagcacga

SEQ ID NO: 2391916 - RNA, 18 nt, Bordetella pertussis
gcggccgaccagcacgau

SEQ ID NO: 2391917 - RNA, 23 nt, Bordetella pertussis
gcggccgaccagcacgauccagc

SEQ ID NO: 2391918 - RNA, 18 nt, Bordetella pertussis
gcggccgacgggcggcug

SEQ ID NO: 2391919 - RNA, 15 nt, Bordetella pertussis
gcggccgagcgggcc

SEQ ID NO: 2391920 - RNA, 18 nt, Bordetella pertussis
gcggccgagcgggccagc

SEQ ID NO: 2391921 - RNA, 19 nt, Bordetella pertussis
gcggccgagcgggccagcg

SEQ ID NO: 2391922 - RNA, 21 nt, Bordetella pertussis
gcggccgagcgggccagcgcg

SEQ ID NO: 2391923 - RNA, 11 nt, Bordetella pertussis
gcggccgagcu

SEQ ID NO: 2391924 - RNA, 13 nt, Bordetella pertussis
gcggccgagcucc

SEQ ID NO: 2391925 - RNA, 15 nt, Bordetella pertussis
gcggccgaggccagc

SEQ ID NO: 2391926 - RNA, 16 nt, Bordetella pertussis
gcggccgaggccagcg

SEQ ID NO: 2391927 - RNA, 21 nt, Bordetella pertussis
gcggccgaggccagcgugccc

SEQ ID NO: 2391928 - RNA, 14 nt, Bordetella pertussis
gcggccgauagccg

SEQ ID NO: 2391929 - RNA, 17 nt, Bordetella pertussis
gcggccgauagccguga

SEQ ID NO: 2391930 - RNA, 19 nt, Bordetella pertussis
gcggccgauagccgugacc

SEQ ID NO: 2391931 - RNA, 22 nt, Bordetella pertussis
gcggccgauguuuuccugggau

SEQ ID NO: 2391932 - RNA, 14 nt, Bordetella pertussis
gcggccgcagcagu

SEQ ID NO: 2391933 - RNA, 15 nt, Bordetella pertussis
gcggccgccacccag

SEQ ID NO: 2391934 - RNA, 12 nt, Bordetella pertussis
gcggccgccagc

SEQ ID NO: 2391935 - RNA, 14 nt, Bordetella pertussis
gcggccgcccacgg

SEQ ID NO: 2391936 - RNA, 14 nt, Bordetella pertussis
gcggccgcccagca

SEQ ID NO: 2391937 - RNA, 20 nt, Bordetella pertussis
gcggccgcccagcagauggc

SEQ ID NO: 2391938 - RNA, 22 nt, Bordetella pertussis
gcggccgcccccagcgcgccug

SEQ ID NO: 2391939 - RNA, 15 nt, Bordetella pertussis
gcggccgccgccagc

SEQ ID NO: 2391940 - RNA, 13 nt, Bordetella pertussis
gcggccgccgccc

SEQ ID NO: 2391941 - RNA, 16 nt, Bordetella pertussis
gcggccgccgcccgcc

SEQ ID NO: 2391942 - RNA, 17 nt, Bordetella pertussis
gcggccgccgcccgccu

SEQ ID NO: 2391943 - RNA, 18 nt, Bordetella pertussis
gcggccgccgcccgccuc

SEQ ID NO: 2391944 - RNA, 20 nt, Bordetella pertussis
gcggccgccggcggcgccgg

SEQ ID NO: 2391945 - RNA, 17 nt, Bordetella pertussis
gcggccgccugcgccga

SEQ ID NO: 2391946 - RNA, 21 nt, Bordetella pertussis
gcggccgccugcgccgaggcg

SEQ ID NO: 2391947 - RNA, 13 nt, Bordetella pertussis
gcggccgcgcacc

SEQ ID NO: 2391948 - RNA, 14 nt, Bordetella pertussis
gcggccgcgcaccu

SEQ ID NO: 2391949 - RNA, 22 nt, Bordetella pertussis
gcggccgcgcaccugcugcggc

SEQ ID NO: 2391950 - RNA, 13 nt, Bordetella pertussis
gcggccgcgcccg

SEQ ID NO: 2391951 - RNA, 13 nt, Bordetella pertussis
gcggccgcgcgcu

SEQ ID NO: 2391952 - RNA, 22 nt, Bordetella pertussis
gcggccgcgcgcuucaggcgcc

SEQ ID NO: 2391953 - RNA, 14 nt, Bordetella pertussis
gcggccgcgcgggc

SEQ ID NO: 2391954 - RNA, 17 nt, Bordetella pertussis
gcggccgcgcgggcggc

SEQ ID NO: 2391955 - RNA, 20 nt, Bordetella pertussis
gcggccgcgcgggcggcccg

SEQ ID NO: 2391956 - RNA, 13 nt, Bordetella pertussis
gcggccgcgcugg

SEQ ID NO: 2391957 - RNA, 18 nt, Bordetella pertussis
gcggccgcgcuggcgcug

SEQ ID NO: 2391958 - RNA, 21 nt, Bordetella pertussis
gcggccgcgcuggcgcuggcc

SEQ ID NO: 2391959 - RNA, 13 nt, Bordetella pertussis
gcggccgcgggca

SEQ ID NO: 2391960 - RNA, 16 nt, Bordetella pertussis
gcggccgcgggccgcu

SEQ ID NO: 2391961 - RNA, 19 nt, Bordetella pertussis
gcggccgcgggccgcuggu

SEQ ID NO: 2391962 - RNA, 13 nt, Bordetella pertussis
gcggccgcgggcg

SEQ ID NO: 2391963 - RNA, 19 nt, Bordetella pertussis
gcggccgcgggcggcgcgc

SEQ ID NO: 2391964 - RNA, 21 nt, Bordetella pertussis
gcggccgcgggcggcgcgccc

SEQ ID NO: 2391965 - RNA, 23 nt, Bordetella pertussis
gcggccgcgggcggcgcgcccag

SEQ ID NO: 2391966 - RNA, 18 nt, Bordetella pertussis
gcggccgcgggcgugcug

SEQ ID NO: 2391967 - RNA, 21 nt, Bordetella pertussis
gcggccgcgggcgugcuggca

SEQ ID NO: 2391968 - RNA, 24 nt, Bordetella pertussis
gcggccgcgggcgugcuggcacug

SEQ ID NO: 2391969 - RNA, 22 nt, Bordetella pertussis
gcggccgcggucagccagagcg

SEQ ID NO: 2391970 - RNA, 12 nt, Bordetella pertussis
gcggccgcguca

SEQ ID NO: 2391971 - RNA, 14 nt, Bordetella pertussis
gcggccgcguccag

SEQ ID NO: 2391972 - RNA, 15 nt, Bordetella pertussis
gcggccgcguccagc

SEQ ID NO: 2391973 - RNA, 21 nt, Bordetella pertussis
gcggccgcguccagcgcgcgg

SEQ ID NO: 2391974 - RNA, 13 nt, Bordetella pertussis
gcggccgcgucga

SEQ ID NO: 2391975 - RNA, 22 nt, Bordetella pertussis
gcggccgcgucgaucagcgcgg

SEQ ID NO: 2391976 - RNA, 14 nt, Bordetella pertussis
gcggccgcgucggc

SEQ ID NO: 2391977 - RNA, 16 nt, Bordetella pertussis
gcggccgcgucggccu

SEQ ID NO: 2391978 - RNA, 17 nt, Bordetella pertussis
gcggccgcgucggccuc

SEQ ID NO: 2391979 - RNA, 13 nt, Bordetella pertussis
gcggccgcugccg

SEQ ID NO: 2391980 - RNA, 15 nt, Bordetella pertussis
gcggccgcugccgcg

SEQ ID NO: 2391981 - RNA, 20 nt, Bordetella pertussis
gcggccgcugccgcgcgccg

SEQ ID NO: 2391982 - RNA, 20 nt, Bordetella pertussis
gcggccgcuugucgaugacg

SEQ ID NO: 2391983 - RNA, 14 nt, Bordetella pertussis
gcggccggacaggg

SEQ ID NO: 2391984 - RNA, 16 nt, Bordetella pertussis
gcggccggaggccgcc

SEQ ID NO: 2391985 - RNA, 18 nt, Bordetella pertussis
gcggccggaggccgccca

SEQ ID NO: 2391986 - RNA, 19 nt, Bordetella pertussis
gcggccggaggccgcccac

SEQ ID NO: 2391987 - RNA, 13 nt, Bordetella pertussis
gcggccggcacgc

SEQ ID NO: 2391988 - RNA, 15 nt, Bordetella pertussis
gcggccggcacgccc

SEQ ID NO: 2391989 - RNA, 17 nt, Bordetella pertussis
gcggccggcacgcccag

SEQ ID NO: 2391990 - RNA, 16 nt, Bordetella pertussis
gcggccggcacgccga

SEQ ID NO: 2391991 - RNA, 20 nt, Bordetella pertussis
gcggccggcaggccggccag

SEQ ID NO: 2391992 - RNA, 14 nt, Bordetella pertussis
gcggccggccagcc

SEQ ID NO: 2391993 - RNA, 15 nt, Bordetella pertussis
gcggccggccagcca

SEQ ID NO: 2391994 - RNA, 11 nt, Bordetella pertussis
gcggccggccc

SEQ ID NO: 2391995 - RNA, 19 nt, Bordetella pertussis
gcggccggcccgugcgcaa

SEQ ID NO: 2391996 - RNA, 17 nt, Bordetella pertussis
gcggccggccgcgccca

SEQ ID NO: 2391997 - RNA, 12 nt, Bordetella pertussis
gcggccggccgg

SEQ ID NO: 2391998 - RNA, 14 nt, Bordetella pertussis
gcggccggccgggu

SEQ ID NO: 2391999 - RNA, 23 nt, Bordetella pertussis
gcggccggccggguugucgccca

SEQ ID NO: 2392000 - RNA, 13 nt, Bordetella pertussis
gcggccggccugc

SEQ ID NO: 2392001 - RNA, 14 nt, Bordetella pertussis
gcggccggccugcg

SEQ ID NO: 2392002 - RNA, 14 nt, Bordetella pertussis
gcggccggccugcu

SEQ ID NO: 2392003 - RNA, 13 nt, Bordetella pertussis
gcggccggcgcag

SEQ ID NO: 2392004 - RNA, 12 nt, Bordetella pertussis
gcggccggcgcg

SEQ ID NO: 2392005 - RNA, 15 nt, Bordetella pertussis
gcggccggcgcgccg

SEQ ID NO: 2392006 - RNA, 16 nt, Bordetella pertussis
gcggccggcgcgccgg

SEQ ID NO: 2392007 - RNA, 20 nt, Bordetella pertussis
gcggccggcgcgccggccug

SEQ ID NO: 2392008 - RNA, 14 nt, Bordetella pertussis
gcggccggcgcgcg

SEQ ID NO: 2392009 - RNA, 17 nt, Bordetella pertussis
gcggccggcgcgcgcga

SEQ ID NO: 2392010 - RNA, 15 nt, Bordetella pertussis
gcggccggcgcugau

SEQ ID NO: 2392011 - RNA, 13 nt, Bordetella pertussis
gcggccggcggcg

SEQ ID NO: 2392012 - RNA, 16 nt, Bordetella pertussis
gcggccggcggcgccg

SEQ ID NO: 2392013 - RNA, 23 nt, Bordetella pertussis
gcggccggcucguaggcgagguc

SEQ ID NO: 2392014 - RNA, 22 nt, Bordetella pertussis
gcggccggcugcaccagcgcgc

SEQ ID NO: 2392015 - RNA, 22 nt, Bordetella pertussis
gcggccggcuugcgcaagccgg

SEQ ID NO: 2392016 - RNA, 16 nt, Bordetella pertussis
gcggccgggagccugu

SEQ ID NO: 2392017 - RNA, 16 nt, Bordetella pertussis
gcggccgggcacaccg

SEQ ID NO: 2392018 - RNA, 20 nt, Bordetella pertussis
gcggccgggcuaucccaacc

SEQ ID NO: 2392019 - RNA, 16 nt, Bordetella pertussis
gcggccgggcucaggc

SEQ ID NO: 2392020 - RNA, 17 nt, Bordetella pertussis
gcggccgggcuuccagu

SEQ ID NO: 2392021 - RNA, 12 nt, Bordetella pertussis
gcggccggggcc

SEQ ID NO: 2392022 - RNA, 15 nt, Bordetella pertussis
gcggccggggccgcc

SEQ ID NO: 2392023 - RNA, 16 nt, Bordetella pertussis
gcggccggggccgccc

SEQ ID NO: 2392024 - RNA, 17 nt, Bordetella pertussis
gcggccggggccgcccu

SEQ ID NO: 2392025 - RNA, 19 nt, Bordetella pertussis
gcggccggggccgcccugc

SEQ ID NO: 2392026 - RNA, 18 nt, Bordetella pertussis
gcggccggguggccgcgg

SEQ ID NO: 2392027 - RNA, 21 nt, Bordetella pertussis
gcggccgguaucgacgcgcgu

SEQ ID NO: 2392028 - RNA, 21 nt, Bordetella pertussis
gcggccggucagggaggcugu

SEQ ID NO: 2392029 - RNA, 20 nt, Bordetella pertussis
gcggccggugaucuugccga

SEQ ID NO: 2392030 - RNA, 12 nt, Bordetella pertussis
gcggccgguggc

SEQ ID NO: 2392031 - RNA, 15 nt, Bordetella pertussis
gcggccgucaccgcc

SEQ ID NO: 2392032 - RNA, 15 nt, Bordetella pertussis
gcggccgucaggcgu

SEQ ID NO: 2392033 - RNA, 16 nt, Bordetella pertussis
gcggccguccaaaaca

SEQ ID NO: 2392034 - RNA, 20 nt, Bordetella pertussis
gcggccgucgaccgacagca

SEQ ID NO: 2392035 - RNA, 17 nt, Bordetella pertussis
gcggccgucgccgccca

SEQ ID NO: 2392036 - RNA, 19 nt, Bordetella pertussis
gcggccgucgccuucggcg

SEQ ID NO: 2392037 - RNA, 13 nt, Bordetella pertussis
gcggccgucggcg

SEQ ID NO: 2392038 - RNA, 15 nt, Bordetella pertussis
gcggccgucggcgcu

SEQ ID NO: 2392039 - RNA, 18 nt, Bordetella pertussis
gcggccgucggcgcuggc

SEQ ID NO: 2392040 - RNA, 20 nt, Bordetella pertussis
gcggccgucggcgcuggcgc

SEQ ID NO: 2392041 - RNA, 18 nt, Bordetella pertussis
gcggccgucgugcagcgu

SEQ ID NO: 2392042 - RNA, 22 nt, Bordetella pertussis
gcggccgucgugcagcgugggc

SEQ ID NO: 2392043 - RNA, 23 nt, Bordetella pertussis
gcggccgugccucaacuggccgg

SEQ ID NO: 2392044 - RNA, 16 nt, Bordetella pertussis
gcggccgugcgccagc

SEQ ID NO: 2392045 - RNA, 19 nt, Bordetella pertussis
gcggccgugcgccagcgcc

SEQ ID NO: 2392046 - RNA, 20 nt, Bordetella pertussis
gcggccgugcgccagcgcca

SEQ ID NO: 2392047 - RNA, 15 nt, Bordetella pertussis
gcggccguggaggcg

SEQ ID NO: 2392048 - RNA, 17 nt, Bordetella pertussis
gcggccguggaggcggc

SEQ ID NO: 2392049 - RNA, 18 nt, Bordetella pertussis
gcggccguggcggccugc

SEQ ID NO: 2392050 - RNA, 19 nt, Bordetella pertussis
gcggccguguucgagcagg

SEQ ID NO: 2392051 - RNA, 22 nt, Bordetella pertussis
gcggccguguucgagcaggcgc

SEQ ID NO: 2392052 - RNA, 17 nt, Bordetella pertussis
gcggccguugcuccagc

SEQ ID NO: 2392053 - RNA, 21 nt, Bordetella pertussis
gcggccguugcuccagccagg

SEQ ID NO: 2392054 - RNA, 22 nt, Bordetella pertussis
gcggccguugcuccagccaggc

SEQ ID NO: 2392055 - RNA, 23 nt, Bordetella pertussis
gcggccguugcuccagccaggcg

SEQ ID NO: 2392056 - RNA, 18 nt, Bordetella pertussis
gcggccguuggcgauggc

SEQ ID NO: 2392057 - RNA, 19 nt, Bordetella pertussis
gcggccguuggcgauggcg

SEQ ID NO: 2392058 - RNA, 18 nt, Bordetella pertussis
gcggccuaucaccugggc

SEQ ID NO: 2392059 - RNA, 19 nt, Bordetella pertussis
gcggcuguagucgccgcug

SEQ ID NO: 2392060 - RNA, 20 nt, Bordetella pertussis
gcggcuguagucgccgcugc

SEQ ID NO: 2392061 - RNA, 21 nt, Bordetella pertussis
gcggcuguagucgccgcugcc

SEQ ID NO: 2392062 - RNA, 14 nt, Bordetella pertussis
gcggcugucgggcg

SEQ ID NO: 2392063 - RNA, 19 nt, Bordetella pertussis
gcggcuucaggcgcgcggc

SEQ ID NO: 2392064 - RNA, 14 nt, Bordetella pertussis
gcggcuucaugccg

SEQ ID NO: 2392065 - RNA, 19 nt, Bordetella pertussis
gcggcuucaugccggcguu

SEQ ID NO: 2392066 - RNA, 21 nt, Bordetella pertussis
gcggcuuccuggucacccggc

SEQ ID NO: 2392067 - RNA, 14 nt, Bordetella pertussis
gcggcuucgcccgg

SEQ ID NO: 2392068 - RNA, 15 nt, Bordetella pertussis
gcggcuucgcgcagc

SEQ ID NO: 2392069 - RNA, 16 nt, Bordetella pertussis
gcggcuucgcgcagca

SEQ ID NO: 2392070 - RNA, 15 nt, Bordetella pertussis
gcggcuucggccguc

SEQ ID NO: 2392071 - RNA, 21 nt, Bordetella pertussis
gcggcuugcagcggacggcgc

SEQ ID NO: 2392072 - RNA, 18 nt, Bordetella pertussis
gcggcuugccgcggcgcg

SEQ ID NO: 2392073 - RNA, 19 nt, Bordetella pertussis
gcggcuugccgcggcgcgg

SEQ ID NO: 2392074 - RNA, 20 nt, Bordetella pertussis
gcggcuugccgcggcgcggc

SEQ ID NO: 2392075 - RNA, 14 nt, Bordetella pertussis
gcggcuugccgucg

SEQ ID NO: 2392076 - RNA, 15 nt, Bordetella pertussis
gcggcuugccgucga

SEQ ID NO: 2392077 - RNA, 15 nt, Bordetella pertussis
gcggcuugcgguccg

SEQ ID NO: 2392078 - RNA, 20 nt, Bordetella pertussis
gcggcuugggcccggcguag

SEQ ID NO: 2392079 - RNA, 16 nt, Bordetella pertussis
gcggcuugguugucgc

SEQ ID NO: 2392080 - RNA, 20 nt, Bordetella pertussis
gcggcuuucaugggccuggg

SEQ ID NO: 2392081 - RNA, 24 nt, Bordetella pertussis
gcggcuuucaugggccugggcgcc

SEQ ID NO: 2392082 - RNA, 14 nt, Bordetella pertussis
gcggcuuucgccgg

SEQ ID NO: 2392083 - RNA, 16 nt, Bordetella pertussis
gcgggaacaggcaccg

SEQ ID NO: 2392084 - RNA, 15 nt, Bordetella pertussis
gcgggaagcgcucgc

SEQ ID NO: 2392085 - RNA, 17 nt, Bordetella pertussis
gcgggaagcgcucgcgc

SEQ ID NO: 2392086 - RNA, 21 nt, Bordetella pertussis
gcgggaagcgcucgcgcaggc

SEQ ID NO: 2392087 - RNA, 22 nt, Bordetella pertussis
gcgggaagcgcucgcgcaggcg

SEQ ID NO: 2392088 - RNA, 18 nt, Bordetella pertussis
gcgggaaugauuccgcug

SEQ ID NO: 2392089 - RNA, 21 nt, Bordetella pertussis
gcgggaaugauuccgcuggcg

SEQ ID NO: 2392090 - RNA, 22 nt, Bordetella pertussis
gcgggaaugauuccgcuggcga

SEQ ID NO: 2392091 - RNA, 15 nt, Bordetella pertussis
gcgggacaggcgcca

SEQ ID NO: 2392092 - RNA, 13 nt, Bordetella pertussis
gcgggacgcaggc

SEQ ID NO: 2392093 - RNA, 23 nt, Bordetella pertussis
gcgggacggccaggggcagcucg

SEQ ID NO: 2392094 - RNA, 21 nt, Bordetella pertussis
gcgggagaucuguaccgccgg

SEQ ID NO: 2392095 - RNA, 17 nt, Bordetella pertussis
gcgggaggaagggugcg

SEQ ID NO: 2392096 - RNA, 22 nt, Bordetella pertussis
gcgggaggaagggugcggcgcc

SEQ ID NO: 2392097 - RNA, 23 nt, Bordetella pertussis
gcgggaggaagggugcggcgcca

SEQ ID NO: 2392098 - RNA, 20 nt, Bordetella pertussis
gcgggaggcuuugggggggc

SEQ ID NO: 2392099 - RNA, 12 nt, Bordetella pertussis
gcgggaggugcc

SEQ ID NO: 2392100 - RNA, 14 nt, Bordetella pertussis
gcgggaggugccgc

SEQ ID NO: 2392101 - RNA, 14 nt, Bordetella pertussis
gcgggaucugcaug

SEQ ID NO: 2392102 - RNA, 18 nt, Bordetella pertussis
gcgggauggucgcggccg

SEQ ID NO: 2392103 - RNA, 18 nt, Bordetella pertussis
gcgggauucugcugcaug

SEQ ID NO: 2392104 - RNA, 17 nt, Bordetella pertussis
gcgggcaaagcccagca

SEQ ID NO: 2392105 - RNA, 20 nt, Bordetella pertussis
gcgggcaacuucaccgucga

SEQ ID NO: 2392106 - RNA, 23 nt, Bordetella pertussis
gcgggcaauuuuguugauggcga

SEQ ID NO: 2392107 - RNA, 19 nt, Bordetella pertussis
gcgggcacaacccgcccgg

SEQ ID NO: 2392108 - RNA, 14 nt, Bordetella pertussis
gcgggcaccaugcg

SEQ ID NO: 2392109 - RNA, 17 nt, Bordetella pertussis
gcgggcaccaugcgcga

SEQ ID NO: 2392110 - RNA, 17 nt, Bordetella pertussis
gcgggcacgagaucgcc

SEQ ID NO: 2392111 - RNA, 15 nt, Bordetella pertussis
gcgggcagcauggcg

SEQ ID NO: 2392112 - RNA, 16 nt, Bordetella pertussis
gcgggcagcauggcgc

SEQ ID NO: 2392113 - RNA, 17 nt, Bordetella pertussis
gcgggcagcauggcgcc

SEQ ID NO: 2392114 - RNA, 15 nt, Bordetella pertussis
gcgggcagcggcgac

SEQ ID NO: 2392115 - RNA, 19 nt, Bordetella pertussis
gcgggcaggcgggccaggc

SEQ ID NO: 2392116 - RNA, 16 nt, Bordetella pertussis
gcgggcaggcuccaca

SEQ ID NO: 2392117 - RNA, 19 nt, Bordetella pertussis
gcgggcagggcgggggacg

SEQ ID NO: 2392118 - RNA, 20 nt, Bordetella pertussis
gcgggcagggcgggggacgc

SEQ ID NO: 2392119 - RNA, 14 nt, Bordetella pertussis
gcgggcagugcgcc

SEQ ID NO: 2392120 - RNA, 16 nt, Bordetella pertussis
gcgggcaucgcccacc

SEQ ID NO: 2392121 - RNA, 19 nt, Bordetella pertussis
gcgggcaucgcccaccaug

SEQ ID NO: 2392122 - RNA, 17 nt, Bordetella pertussis
gcgggcaucgcccugcu

SEQ ID NO: 2392123 - RNA, 21 nt, Bordetella pertussis
gcgggcaugacgaccgcgacc

SEQ ID NO: 2392124 - RNA, 12 nt, Bordetella pertussis
gcgggccacgcc

SEQ ID NO: 2392125 - RNA, 21 nt, Bordetella pertussis
gcgggccacugcgccugggcg

SEQ ID NO: 2392126 - RNA, 21 nt, Bordetella pertussis
gcgggccagcagaaugccgcc

SEQ ID NO: 2392127 - RNA, 13 nt, Bordetella pertussis
gcgggccagcgcg

SEQ ID NO: 2392128 - RNA, 12 nt, Bordetella pertussis
gcgggccaggcc

SEQ ID NO: 2392129 - RNA, 14 nt, Bordetella pertussis
gcgggccaggccgg

SEQ ID NO: 2392130 - RNA, 15 nt, Bordetella pertussis
gcgggccaggccggc

SEQ ID NO: 2392131 - RNA, 19 nt, Bordetella pertussis
gcgggccaggccggcccag

SEQ ID NO: 2392132 - RNA, 21 nt, Bordetella pertussis
gcgggccagguauucggcggu

SEQ ID NO: 2392133 - RNA, 17 nt, Bordetella pertussis
gcgggccccgcagggcc

SEQ ID NO: 2392134 - RNA, 20 nt, Bordetella pertussis
gcgggccccgcagggcccgc

SEQ ID NO: 2392135 - RNA, 21 nt, Bordetella pertussis
gcgggccccgcagggcccgca

SEQ ID NO: 2392136 - RNA, 16 nt, Bordetella pertussis
gcgggcccgacagcgc

SEQ ID NO: 2392137 - RNA, 16 nt, Bordetella pertussis
gcgggcccgcaucgcg

SEQ ID NO: 2392138 - RNA, 19 nt, Bordetella pertussis
gcgggcccgcaucgcgcgc

SEQ ID NO: 2392139 - RNA, 22 nt, Bordetella pertussis
gcgggcccgcucggccagcagu

SEQ ID NO: 2392140 - RNA, 15 nt, Bordetella pertussis
gcgggcccgucgcgc

SEQ ID NO: 2392141 - RNA, 17 nt, Bordetella pertussis
gcgggcccgucgcgcca

SEQ ID NO: 2392142 - RNA, 20 nt, Bordetella pertussis
gcgggcccgucgcgccaggc

SEQ ID NO: 2392143 - RNA, 23 nt, Bordetella pertussis
gcgggcccgucgcgccaggccgg

SEQ ID NO: 2392144 - RNA, 17 nt, Bordetella pertussis
gcgggcccuggcguucg

SEQ ID NO: 2392145 - RNA, 16 nt, Bordetella pertussis
gcgggccgcacagcuc

SEQ ID NO: 2392146 - RNA, 13 nt, Bordetella pertussis
gcgggccgcagca

SEQ ID NO: 2392147 - RNA, 19 nt, Bordetella pertussis
gcgggccgcagcauggcgc

SEQ ID NO: 2392148 - RNA, 18 nt, Bordetella pertussis
gcgggccgcgccgcggca

SEQ ID NO: 2392149 - RNA, 14 nt, Bordetella pertussis
gcgggccgcgcugg

SEQ ID NO: 2392150 - RNA, 15 nt, Bordetella pertussis
gcgggccgcgcugga

SEQ ID NO: 2392151 - RNA, 18 nt, Bordetella pertussis
gcgggccgcgcuggaaga

SEQ ID NO: 2392152 - RNA, 14 nt, Bordetella pertussis
gcgggccgcugguc

SEQ ID NO: 2392153 - RNA, 23 nt, Bordetella pertussis
gcgggccggaaacgcggucaccg

SEQ ID NO: 2392154 - RNA, 16 nt, Bordetella pertussis
gcgggccggcaccacg

SEQ ID NO: 2392155 - RNA, 14 nt, Bordetella pertussis
gcgggccggcgcgc

SEQ ID NO: 2392156 - RNA, 14 nt, Bordetella pertussis
gcgggccggcucgg

SEQ ID NO: 2392157 - RNA, 17 nt, Bordetella pertussis
gcgggccggcugggcgg

SEQ ID NO: 2392158 - RNA, 13 nt, Bordetella pertussis
gcgggccgggcag

SEQ ID NO: 2392159 - RNA, 14 nt, Bordetella pertussis
gcgggccgggcagg

SEQ ID NO: 2392160 - RNA, 15 nt, Bordetella pertussis
gcgggccgggcaggc

SEQ ID NO: 2392161 - RNA, 17 nt, Bordetella pertussis
gcgggccgggcaggccg

SEQ ID NO: 2392162 - RNA, 18 nt, Bordetella pertussis
gcgggccguugcgccugc

SEQ ID NO: 2392163 - RNA, 20 nt, Bordetella pertussis
gcgggccuacuucggcagcu

SEQ ID NO: 2392164 - RNA, 19 nt, Bordetella pertussis
gcgggccuacuugccggcg

SEQ ID NO: 2392165 - RNA, 21 nt, Bordetella pertussis
gcgggccuacuugccggcgcu

SEQ ID NO: 2392166 - RNA, 23 nt, Bordetella pertussis
gcgggccuacuugccggcgcuca

SEQ ID NO: 2392167 - RNA, 20 nt, Bordetella pertussis
gcgggccucgaagcccggca

SEQ ID NO: 2392168 - RNA, 12 nt, Bordetella pertussis
gcgggccugcag

SEQ ID NO: 2392169 - RNA, 14 nt, Bordetella pertussis
gcgggccugcagca

SEQ ID NO: 2392170 - RNA, 16 nt, Bordetella pertussis
gcgggccugcagcaug

SEQ ID NO: 2392171 - RNA, 13 nt, Bordetella pertussis
gcgggccugccgc

SEQ ID NO: 2392172 - RNA, 14 nt, Bordetella pertussis
gcgggccuggcgga

SEQ ID NO: 2392173 - RNA, 16 nt, Bordetella pertussis
gcgggccugggcgucg

SEQ ID NO: 2392174 - RNA, 20 nt, Bordetella pertussis
gcgggccugggcgucgagcg

SEQ ID NO: 2392175 - RNA, 19 nt, Bordetella pertussis
gcgggccuuggccagcagc

SEQ ID NO: 2392176 - RNA, 15 nt, Bordetella pertussis
gcgggcgacauugcg

SEQ ID NO: 2392177 - RNA, 21 nt, Bordetella pertussis
gcgggcgaggacuacgcggug

SEQ ID NO: 2392178 - RNA, 20 nt, Bordetella pertussis
gcgggcgauuucgucaucgg

SEQ ID NO: 2392179 - RNA, 17 nt, Bordetella pertussis
gcgggcgcaagccagca

SEQ ID NO: 2392180 - RNA, 23 nt, Bordetella pertussis
gcgggcgcaaguguggcgcaccg

SEQ ID NO: 2392181 - RNA, 12 nt, Bordetella pertussis
gcgggcgcaccu

SEQ ID NO: 2392182 - RNA, 17 nt, Bordetella pertussis
gcgggcgcagcgccgcu

SEQ ID NO: 2392183 - RNA, 15 nt, Bordetella pertussis
gcgggcgccaucgcg

SEQ ID NO: 2392184 - RNA, 15 nt, Bordetella pertussis
gcgggcgcccggccg

SEQ ID NO: 2392185 - RNA, 16 nt, Bordetella pertussis
gcgggcgcccggccgg

SEQ ID NO: 2392186 - RNA, 19 nt, Bordetella pertussis
gcgggcgcccggccggccu

SEQ ID NO: 2392187 - RNA, 16 nt, Bordetella pertussis
gcgggcgccgcgcacg

SEQ ID NO: 2392188 - RNA, 17 nt, Bordetella pertussis
gcgggcgccgcgcacgc

SEQ ID NO: 2392189 - RNA, 15 nt, Bordetella pertussis
gcgggcgccgcgccc

SEQ ID NO: 2392190 - RNA, 13 nt, Bordetella pertussis
gcgggcgccgcgg

SEQ ID NO: 2392191 - RNA, 17 nt, Bordetella pertussis
gcgggcgccggcgcccg

SEQ ID NO: 2392192 - RNA, 18 nt, Bordetella pertussis
gcgggcgccggcgcccgg

SEQ ID NO: 2392193 - RNA, 16 nt, Bordetella pertussis
gcgggcgccugcggca

SEQ ID NO: 2392194 - RNA, 18 nt, Bordetella pertussis
gcgggcgccugcggcagg

SEQ ID NO: 2392195 - RNA, 16 nt, Bordetella pertussis
gcgggcgcgcagcgcg

SEQ ID NO: 2392196 - RNA, 12 nt, Bordetella pertussis
gcgggcgcgccc

SEQ ID NO: 2392197 - RNA, 19 nt, Bordetella pertussis
gcgggcgcgccgucgcugg

SEQ ID NO: 2392198 - RNA, 12 nt, Bordetella pertussis
gcgggcgcgcuu

SEQ ID NO: 2392199 - RNA, 15 nt, Bordetella pertussis
gcgggcgcggcaggc

SEQ ID NO: 2392200 - RNA, 24 nt, Bordetella pertussis
gcgggcgcggcauggcgccgcgcc

SEQ ID NO: 2392201 - RNA, 13 nt, Bordetella pertussis
gcgggcgcgggcu

SEQ ID NO: 2392202 - RNA, 18 nt, Bordetella pertussis
gcgggcgcgggcugucgc

SEQ ID NO: 2392203 - RNA, 21 nt, Bordetella pertussis
gcgggcgcgguauucgcugcu

SEQ ID NO: 2392204 - RNA, 22 nt, Bordetella pertussis
gcgggcgcgguauucgcugcug

SEQ ID NO: 2392205 - RNA, 23 nt, Bordetella pertussis
gcgggcgcgguauucgcugcugg

SEQ ID NO: 2392206 - RNA, 13 nt, Bordetella pertussis
gcgggcgcugccu

SEQ ID NO: 2392207 - RNA, 19 nt, Bordetella pertussis
gcgggcgcugcgcgaacgc

SEQ ID NO: 2392208 - RNA, 20 nt, Bordetella pertussis
gcgggcgcuggcgcgcggcu

SEQ ID NO: 2392209 - RNA, 19 nt, Bordetella pertussis
gcgggcgcuucgucggccg

SEQ ID NO: 2392210 - RNA, 20 nt, Bordetella pertussis
gcgggcggccacgcgccgcc

SEQ ID NO: 2392211 - RNA, 24 nt, Bordetella pertussis
gcgggcggccgacgggcggcugcu

SEQ ID NO: 2392212 - RNA, 16 nt, Bordetella pertussis
gcgggcggccugggag

SEQ ID NO: 2392213 - RNA, 15 nt, Bordetella pertussis
gcgggcggcgccagc

SEQ ID NO: 2392214 - RNA, 16 nt, Bordetella pertussis
gcgggcggcgccagcg

SEQ ID NO: 2392215 - RNA, 14 nt, Bordetella pertussis
gcgggcggcgcgcc

SEQ ID NO: 2392216 - RNA, 15 nt, Bordetella pertussis
gcgggcggcgcgccc

SEQ ID NO: 2392217 - RNA, 16 nt, Bordetella pertussis
gcgggcggcgcgccca

SEQ ID NO: 2392218 - RNA, 22 nt, Bordetella pertussis
gcgggcggcgcgcccagcggca

SEQ ID NO: 2392219 - RNA, 16 nt, Bordetella pertussis
gcgggcggcgcggcca

SEQ ID NO: 2392220 - RNA, 12 nt, Bordetella pertussis
gcgggcggcggc

SEQ ID NO: 2392221 - RNA, 20 nt, Bordetella pertussis
gcgggcggcuaggcgcagca

SEQ ID NO: 2392222 - RNA, 16 nt, Bordetella pertussis
gcgggcggcugcccgg

SEQ ID NO: 2392223 - RNA, 16 nt, Bordetella pertussis
gcgggcgggccgcgga

SEQ ID NO: 2392224 - RNA, 20 nt, Bordetella pertussis
gcgggcggucggcgcggcgc

SEQ ID NO: 2392225 - RNA, 16 nt, Bordetella pertussis
gcgggcggugcggccu

SEQ ID NO: 2392226 - RNA, 17 nt, Bordetella pertussis
gcgggcggugcggccuc

SEQ ID NO: 2392227 - RNA, 18 nt, Bordetella pertussis
gcgggcgugaugccgacc

SEQ ID NO: 2392228 - RNA, 19 nt, Bordetella pertussis
gcgggcgugaugccgacca

SEQ ID NO: 2392229 - RNA, 23 nt, Bordetella pertussis
gcgggcgugaugccgaccaggcc

SEQ ID NO: 2392230 - RNA, 17 nt, Bordetella pertussis
gcgggcucggcgccggc

SEQ ID NO: 2392231 - RNA, 18 nt, Bordetella pertussis
gcgggcugaugcaggccu

SEQ ID NO: 2392232 - RNA, 15 nt, Bordetella pertussis
gcgggcugcgcgggu

SEQ ID NO: 2392233 - RNA, 16 nt, Bordetella pertussis
gcgggcugcgcggguc

SEQ ID NO: 2392234 - RNA, 20 nt, Bordetella pertussis
gcgggcugcgcggguccggc

SEQ ID NO: 2392235 - RNA, 12 nt, Bordetella pertussis
gcgggcuggcca

SEQ ID NO: 2392236 - RNA, 15 nt, Bordetella pertussis
gcgggcuggccagcg

SEQ ID NO: 2392237 - RNA, 12 nt, Bordetella pertussis
gcgggcuggcgu

SEQ ID NO: 2392238 - RNA, 16 nt, Bordetella pertussis
gcgggcuggggcaggc

SEQ ID NO: 2392239 - RNA, 21 nt, Bordetella pertussis
gcgggcuugcugccccccgag

SEQ ID NO: 2392240 - RNA, 23 nt, Bordetella pertussis
gcgggcuugucgcugcgcauggc

SEQ ID NO: 2392241 - RNA, 22 nt, Bordetella pertussis
gcgggcuuguuuuccaucagcu

SEQ ID NO: 2392242 - RNA, 12 nt, Bordetella pertussis
gcggggacaggc

SEQ ID NO: 2392243 - RNA, 15 nt, Bordetella pertussis
gcggggacaggcaca

SEQ ID NO: 2392244 - RNA, 18 nt, Bordetella pertussis
gcggggacaggcacacca

SEQ ID NO: 2392245 - RNA, 22 nt, Bordetella pertussis
gcggggacaggcacccaugaac

SEQ ID NO: 2392246 - RNA, 23 nt, Bordetella pertussis
gcggggacaggcaccccgucaug

SEQ ID NO: 2392247 - RNA, 18 nt, Bordetella pertussis
gcggggacaggcacccug

SEQ ID NO: 2392248 - RNA, 19 nt, Bordetella pertussis
gcggggacaggcacccugu

SEQ ID NO: 2392249 - RNA, 17 nt, Bordetella pertussis
gcggggacaggcaccga

SEQ ID NO: 2392250 - RNA, 18 nt, Bordetella pertussis
gcggggacaggcaccgcc

SEQ ID NO: 2392251 - RNA, 22 nt, Bordetella pertussis
gcggggacaggcaccgccgcac

SEQ ID NO: 2392252 - RNA, 18 nt, Bordetella pertussis
gcggggacaggcucccgc

SEQ ID NO: 2392253 - RNA, 20 nt, Bordetella pertussis
gcggggacaggcucccgcug

SEQ ID NO: 2392254 - RNA, 23 nt, Bordetella pertussis
gcggggacaggcucccgcuggcg

SEQ ID NO: 2392255 - RNA, 12 nt, Bordetella pertussis
gcggggacuggc

SEQ ID NO: 2392256 - RNA, 21 nt, Bordetella pertussis
gcggggacuggcaccaggauu

SEQ ID NO: 2392257 - RNA, 22 nt, Bordetella pertussis
gcggggacuggcaccaggauuc

SEQ ID NO: 2392258 - RNA, 18 nt, Bordetella pertussis
gcggggauguuccggcug

SEQ ID NO: 2392259 - RNA, 19 nt, Bordetella pertussis
gcggggauguuccggcugg

SEQ ID NO: 2392260 - RNA, 13 nt, Bordetella pertussis
gcggggcaccgga

SEQ ID NO: 2392261 - RNA, 14 nt, Bordetella pertussis
gcggggcaggccga

SEQ ID NO: 2392262 - RNA, 17 nt, Bordetella pertussis
gcggggcaggccgaugu

SEQ ID NO: 2392263 - RNA, 16 nt, Bordetella pertussis
gcggggccaggcgcag

SEQ ID NO: 2392264 - RNA, 17 nt, Bordetella pertussis
gcggggccgcgccggcu

SEQ ID NO: 2392265 - RNA, 22 nt, Bordetella pertussis
gcggggccgcuucggccugcgc

SEQ ID NO: 2392266 - RNA, 16 nt, Bordetella pertussis
gcggggccgugacgug

SEQ ID NO: 2392267 - RNA, 14 nt, Bordetella pertussis
gcggggcgcccagc

SEQ ID NO: 2392268 - RNA, 15 nt, Bordetella pertussis
gcggggcgcccagcg

SEQ ID NO: 2392269 - RNA, 22 nt, Bordetella pertussis
gcggggcgcguuuucgcuggcg

SEQ ID NO: 2392270 - RNA, 19 nt, Bordetella pertussis
gcggggcggcaggucgcgc

SEQ ID NO: 2392271 - RNA, 13 nt, Bordetella pertussis
gcggggcggcggg

SEQ ID NO: 2392272 - RNA, 16 nt, Bordetella pertussis
gcggggcgugagcagg

SEQ ID NO: 2392273 - RNA, 17 nt, Bordetella pertussis
gcggggcuggccagcug

SEQ ID NO: 2392274 - RNA, 14 nt, Bordetella pertussis
gcggggcuggcgcg

SEQ ID NO: 2392275 - RNA, 17 nt, Bordetella pertussis
gcggggcuggcgcggcu

SEQ ID NO: 2392276 - RNA, 15 nt, Bordetella pertussis
gcgggggacgcccgc

SEQ ID NO: 2392277 - RNA, 16 nt, Bordetella pertussis
gcgggggacgcccgcc

SEQ ID NO: 2392278 - RNA, 21 nt, Bordetella pertussis
gcgggggacgcccgcccgcug

SEQ ID NO: 2392279 - RNA, 12 nt, Bordetella pertussis
gcgggggcaggc

SEQ ID NO: 2392280 - RNA, 12 nt, Bordetella pertussis
gcgggggugcgc

SEQ ID NO: 2392281 - RNA, 14 nt, Bordetella pertussis
gcgggggugcgcga

SEQ ID NO: 2392282 - RNA, 16 nt, Bordetella pertussis
gcggggucugcaggug

SEQ ID NO: 2392283 - RNA, 13 nt, Bordetella pertussis
gcggggugccugc

SEQ ID NO: 2392284 - RNA, 19 nt, Bordetella pertussis
gcgggguuggccgccagga

SEQ ID NO: 2392285 - RNA, 22 nt, Bordetella pertussis
gcgggguuggccgccaggacuu

SEQ ID NO: 2392286 - RNA, 18 nt, Bordetella pertussis
gcggguaaugccggugcg

SEQ ID NO: 2392287 - RNA, 17 nt, Bordetella pertussis
gcggguauucgaaggca

SEQ ID NO: 2392288 - RNA, 23 nt, Bordetella pertussis
gcggguauucgaaggcagcaccg

SEQ ID NO: 2392289 - RNA, 19 nt, Bordetella pertussis
gcggcgaugcacccaggcg

SEQ ID NO: 2392290 - RNA, 22 nt, Bordetella pertussis
gcggcgaugcacccaggcgccg

SEQ ID NO: 2392291 - RNA, 23 nt, Bordetella pertussis
gcggcgaugcacccaggcgccga

SEQ ID NO: 2392292 - RNA, 12 nt, Bordetella pertussis
gcggcgaugccc

SEQ ID NO: 2392293 - RNA, 21 nt, Bordetella pertussis
gcggcgaugccccaguccagg

SEQ ID NO: 2392294 - RNA, 14 nt, Bordetella pertussis
gcggcgaugccgcu

SEQ ID NO: 2392295 - RNA, 15 nt, Bordetella pertussis
gcggcgaugccgcug

SEQ ID NO: 2392296 - RNA, 18 nt, Bordetella pertussis
gcggcgaugccgcuggcg

SEQ ID NO: 2392297 - RNA, 15 nt, Bordetella pertussis
gcggcgaugccggcc

SEQ ID NO: 2392298 - RNA, 21 nt, Bordetella pertussis
gcggcgaugccggccagcagc

SEQ ID NO: 2392299 - RNA, 22 nt, Bordetella pertussis
gcggcgaugccggccagcagcg

SEQ ID NO: 2392300 - RNA, 16 nt, Bordetella pertussis
gcggcgaugcgggcca

SEQ ID NO: 2392301 - RNA, 19 nt, Bordetella pertussis
gcggcgauggucuggguga

SEQ ID NO: 2392302 - RNA, 19 nt, Bordetella pertussis
gcggcgauuucuacgccga

SEQ ID NO: 2392303 - RNA, 13 nt, Bordetella pertussis
gcggcgcaccagc

SEQ ID NO: 2392304 - RNA, 15 nt, Bordetella pertussis
gcggcgcaccagcga

SEQ ID NO: 2392305 - RNA, 23 nt, Bordetella pertussis
gcggcgcaccagcgaggcggcaa

SEQ ID NO: 2392306 - RNA, 17 nt, Bordetella pertussis
gcggcgcaccgacagca

SEQ ID NO: 2392307 - RNA, 23 nt, Bordetella pertussis
gcggcgcaccgacagcaagggca

SEQ ID NO: 2392308 - RNA, 14 nt, Bordetella pertussis
gcggcgcagcacca

SEQ ID NO: 2392309 - RNA, 20 nt, Bordetella pertussis
gcggcgcagcaucuugcgcc

SEQ ID NO: 2392310 - RNA, 23 nt, Bordetella pertussis
gcggcgcagcaucuugcgccgcu

SEQ ID NO: 2392311 - RNA, 18 nt, Bordetella pertussis
gcggcgcagcauuucggc

SEQ ID NO: 2392312 - RNA, 22 nt, Bordetella pertussis
gcggcgcagcauuucggcgccg

SEQ ID NO: 2392313 - RNA, 18 nt, Bordetella pertussis
gcggcgcagcccagcgcg

SEQ ID NO: 2392314 - RNA, 22 nt, Bordetella pertussis
gcggcgcagcccagcgcgaugu

SEQ ID NO: 2392315 - RNA, 14 nt, Bordetella pertussis
gcggcgcagccggc

SEQ ID NO: 2392316 - RNA, 15 nt, Bordetella pertussis
gcggcgcagccggcc

SEQ ID NO: 2392317 - RNA, 16 nt, Bordetella pertussis
gcggcgcagccggccg

SEQ ID NO: 2392318 - RNA, 15 nt, Bordetella pertussis
gcggcgcagcgcguc

SEQ ID NO: 2392319 - RNA, 17 nt, Bordetella pertussis
gcggcgcagcgcguccu

SEQ ID NO: 2392320 - RNA, 20 nt, Bordetella pertussis
gcggcgcaggaugcgcuggc

SEQ ID NO: 2392321 - RNA, 21 nt, Bordetella pertussis
gcggcgcaggaugcgcuggcc

SEQ ID NO: 2392322 - RNA, 16 nt, Bordetella pertussis
gcggcgcaggccagcg

SEQ ID NO: 2392323 - RNA, 17 nt, Bordetella pertussis
gcggcgcaggccagcgc

SEQ ID NO: 2392324 - RNA, 18 nt, Bordetella pertussis
gcggcgcaggccagcgcc

SEQ ID NO: 2392325 - RNA, 23 nt, Bordetella pertussis
gcggcgcaggccagcgccgcggu

SEQ ID NO: 2392326 - RNA, 16 nt, Bordetella pertussis
gcggcgcaggccgcgc

SEQ ID NO: 2392327 - RNA, 21 nt, Bordetella pertussis
gcggcgcaggccugcggcgau

SEQ ID NO: 2392328 - RNA, 16 nt, Bordetella pertussis
gcggcgcaggcgggcg

SEQ ID NO: 2392329 - RNA, 20 nt, Bordetella pertussis
gcggcgcagguccaccgcca

SEQ ID NO: 2392330 - RNA, 18 nt, Bordetella pertussis
gcggcgcagucgcgcacg

SEQ ID NO: 2392331 - RNA, 14 nt, Bordetella pertussis
gcggcgcaucagcg

SEQ ID NO: 2392332 - RNA, 17 nt, Bordetella pertussis
gcggcgcaucagcgcgc

SEQ ID NO: 2392333 - RNA, 18 nt, Bordetella pertussis
gcggcgcaucagcgcgcc

SEQ ID NO: 2392334 - RNA, 20 nt, Bordetella pertussis
gcggcgcaucagcgcgcccg

SEQ ID NO: 2392335 - RNA, 14 nt, Bordetella pertussis
gcggcgcaugcagc

SEQ ID NO: 2392336 - RNA, 14 nt, Bordetella pertussis
gcggcgcaugcugc

SEQ ID NO: 2392337 - RNA, 15 nt, Bordetella pertussis
gcggcgcauugccgu

SEQ ID NO: 2392338 - RNA, 22 nt, Bordetella pertussis
gcggcgcauugccgucggccgc

SEQ ID NO: 2392339 - RNA, 19 nt, Bordetella pertussis
gcggcgccacugccaggcg

SEQ ID NO: 2392340 - RNA, 12 nt, Bordetella pertussis
gcggcgccagcg

SEQ ID NO: 2392341 - RNA, 13 nt, Bordetella pertussis
gcggcgccagcgc

SEQ ID NO: 2392342 - RNA, 17 nt, Bordetella pertussis
gcggcgccagcgccccg

SEQ ID NO: 2392343 - RNA, 18 nt, Bordetella pertussis
gcggcgccagcgccccgg

SEQ ID NO: 2392344 - RNA, 16 nt, Bordetella pertussis
gcggcgccagcugggc

SEQ ID NO: 2392345 - RNA, 18 nt, Bordetella pertussis
gcggcgccagucgcgcag

SEQ ID NO: 2392346 - RNA, 16 nt, Bordetella pertussis
gcggcgccaugccgcg

SEQ ID NO: 2392347 - RNA, 21 nt, Bordetella pertussis
gcggcgccaugccgcgcccgc

SEQ ID NO: 2392348 - RNA, 21 nt, Bordetella pertussis
gcggcgccaugcgcaccaccg

SEQ ID NO: 2392349 - RNA, 24 nt, Bordetella pertussis
gcggcgccauucuucgccgaugcg

SEQ ID NO: 2392350 - RNA, 13 nt, Bordetella pertussis
gcggcgcccagcu

SEQ ID NO: 2392351 - RNA, 13 nt, Bordetella pertussis
gcggcgcccaggc

SEQ ID NO: 2392352 - RNA, 16 nt, Bordetella pertussis
gcggcgcccaggccca

SEQ ID NO: 2392353 - RNA, 15 nt, Bordetella pertussis
gcggcgcccaucagg

SEQ ID NO: 2392354 - RNA, 19 nt, Bordetella pertussis
gcggcgcccccgcggcgcc

SEQ ID NO: 2392355 - RNA, 13 nt, Bordetella pertussis
gcggcgcccgccu

SEQ ID NO: 2392356 - RNA, 20 nt, Bordetella pertussis
gcggcgcccgccugcguggc

SEQ ID NO: 2392357 - RNA, 14 nt, Bordetella pertussis
gcggcgcccgcgca

SEQ ID NO: 2392358 - RNA, 20 nt, Bordetella pertussis
gcggcgcccgcgcaugcaag

SEQ ID NO: 2392359 - RNA, 13 nt, Bordetella pertussis
gcggcgcccgcug

SEQ ID NO: 2392360 - RNA, 14 nt, Bordetella pertussis
gcggcgcccgcugc

SEQ ID NO: 2392361 - RNA, 18 nt, Bordetella pertussis
gcggcgcccggugcgcgc

SEQ ID NO: 2392362 - RNA, 12 nt, Bordetella pertussis
gcggcgccgaga

SEQ ID NO: 2392363 - RNA, 13 nt, Bordetella pertussis
gcggcgccgccgg

SEQ ID NO: 2392364 - RNA, 19 nt, Bordetella pertussis
gcggcgccgccggcggccu

SEQ ID NO: 2392365 - RNA, 13 nt, Bordetella pertussis
gcggcgccgcugg

SEQ ID NO: 2392366 - RNA, 15 nt, Bordetella pertussis
gcggcgccgcuggcc

SEQ ID NO: 2392367 - RNA, 19 nt, Bordetella pertussis
gcggcgccgcuggccacgu

SEQ ID NO: 2392368 - RNA, 19 nt, Bordetella pertussis
gcggcgccggaucggccgg

SEQ ID NO: 2392369 - RNA, 13 nt, Bordetella pertussis
gcggcgccggccg

SEQ ID NO: 2392370 - RNA, 14 nt, Bordetella pertussis
gcggcgccggccgc

SEQ ID NO: 2392371 - RNA, 20 nt, Bordetella pertussis
gcggcgccggugaccgccag

SEQ ID NO: 2392372 - RNA, 19 nt, Bordetella pertussis
gcggcgccggugcgcggcg

SEQ ID NO: 2392373 - RNA, 15 nt, Bordetella pertussis
gcggcgccguccagc

SEQ ID NO: 2392374 - RNA, 16 nt, Bordetella pertussis
gcggcgccguccagcg

SEQ ID NO: 2392375 - RNA, 14 nt, Bordetella pertussis
gcggcgccugccug

SEQ ID NO: 2392376 - RNA, 23 nt, Bordetella pertussis
gcggcgccugccugccgagcgcu

SEQ ID NO: 2392377 - RNA, 20 nt, Bordetella pertussis
gcggcgccugcgcgcgcugg

SEQ ID NO: 2392378 - RNA, 13 nt, Bordetella pertussis
gcggcgccugggc

SEQ ID NO: 2392379 - RNA, 15 nt, Bordetella pertussis
gcggcgccugggccu

SEQ ID NO: 2392380 - RNA, 23 nt, Bordetella pertussis
gcggcgccugggccuucuugucg

SEQ ID NO: 2392381 - RNA, 20 nt, Bordetella pertussis
gcggcgccugucccgcuggg

SEQ ID NO: 2392382 - RNA, 12 nt, Bordetella pertussis
gcggcgccuucg

SEQ ID NO: 2392383 - RNA, 21 nt, Bordetella pertussis
gcggcgcgaccugcgcgaccg

SEQ ID NO: 2392384 - RNA, 22 nt, Bordetella pertussis
gcggcgcgaccugcgcgaccgc

SEQ ID NO: 2392385 - RNA, 17 nt, Bordetella pertussis
gcggcgcgagcgcacag

SEQ ID NO: 2392386 - RNA, 16 nt, Bordetella pertussis
gcggcgcgcacgggcg

SEQ ID NO: 2392387 - RNA, 17 nt, Bordetella pertussis
gcggcgcgcacgggcga

SEQ ID NO: 2392388 - RNA, 18 nt, Bordetella pertussis
gcggcgcgcacgggcgag

SEQ ID NO: 2392389 - RNA, 20 nt, Bordetella pertussis
gcggcgcgccagcgcggcca

SEQ ID NO: 2392390 - RNA, 22 nt, Bordetella pertussis
gcggcgcgccagcgcggccagc

SEQ ID NO: 2392391 - RNA, 13 nt, Bordetella pertussis
gcggcgcgcccac

SEQ ID NO: 2392392 - RNA, 20 nt, Bordetella pertussis
gcggcgcgcccaccagggug

SEQ ID NO: 2392393 - RNA, 18 nt, Bordetella pertussis
gcggcgcgcccagcggca

SEQ ID NO: 2392394 - RNA, 12 nt, Bordetella pertussis
gcggcgcgcccg

SEQ ID NO: 2392395 - RNA, 13 nt, Bordetella pertussis
gcggcgcgcccgc

SEQ ID NO: 2392396 - RNA, 15 nt, Bordetella pertussis
gcggcgcgcccgccu

SEQ ID NO: 2392397 - RNA, 14 nt, Bordetella pertussis
gcggcgcgcgcagg

SEQ ID NO: 2392398 - RNA, 21 nt, Bordetella pertussis
gcggcgcgcgccagggcgccg

SEQ ID NO: 2392399 - RNA, 18 nt, Bordetella pertussis
gcggcgcgcgccguucag

SEQ ID NO: 2392400 - RNA, 13 nt, Bordetella pertussis
gcggcgcgcgccu

SEQ ID NO: 2392401 - RNA, 15 nt, Bordetella pertussis
gcggcgcgcgccugc

SEQ ID NO: 2392402 - RNA, 15 nt, Bordetella pertussis
gcggcgcgcgcggcg

SEQ ID NO: 2392403 - RNA, 21 nt, Bordetella pertussis
gcggcgcgcggaucgaaaccg

SEQ ID NO: 2392404 - RNA, 20 nt, Bordetella pertussis
gcggccuaucaccugggcaa

SEQ ID NO: 2392405 - RNA, 16 nt, Bordetella pertussis
gcggccuaugugcagg

SEQ ID NO: 2392406 - RNA, 19 nt, Bordetella pertussis
gcggccuaugugcaggcca

SEQ ID NO: 2392407 - RNA, 20 nt, Bordetella pertussis
gcggccuaugugcaggccac

SEQ ID NO: 2392408 - RNA, 17 nt, Bordetella pertussis
gcggccuauuuggcggc

SEQ ID NO: 2392409 - RNA, 18 nt, Bordetella pertussis
gcggccuauuuggcggcc

SEQ ID NO: 2392410 - RNA, 21 nt, Bordetella pertussis
gcggccuauuuggcggccugg

SEQ ID NO: 2392411 - RNA, 17 nt, Bordetella pertussis
gcggccuccgcgcacag

SEQ ID NO: 2392412 - RNA, 18 nt, Bordetella pertussis
gcggccuccgcgcacagc

SEQ ID NO: 2392413 - RNA, 22 nt, Bordetella pertussis
gcggccuccgcgcacagcgcgg

SEQ ID NO: 2392414 - RNA, 12 nt, Bordetella pertussis
gcggccuccggc

SEQ ID NO: 2392415 - RNA, 14 nt, Bordetella pertussis
gcggccuccggcag

SEQ ID NO: 2392416 - RNA, 15 nt, Bordetella pertussis
gcggccuccggcagg

SEQ ID NO: 2392417 - RNA, 23 nt, Bordetella pertussis
gcggccucgacgauggccggggc

SEQ ID NO: 2392418 - RNA, 15 nt, Bordetella pertussis
gcggccucgacggcc

SEQ ID NO: 2392419 - RNA, 20 nt, Bordetella pertussis
gcggccucgacggccgccgg

SEQ ID NO: 2392420 - RNA, 14 nt, Bordetella pertussis
gcggccucgccggc

SEQ ID NO: 2392421 - RNA, 19 nt, Bordetella pertussis
gcggccucgccggccuggc

SEQ ID NO: 2392422 - RNA, 20 nt, Bordetella pertussis
gcggccucgccggccuggcg

SEQ ID NO: 2392423 - RNA, 15 nt, Bordetella pertussis
gcggccucggccagc

SEQ ID NO: 2392424 - RNA, 20 nt, Bordetella pertussis
gcggccucggccagcuggga

SEQ ID NO: 2392425 - RNA, 16 nt, Bordetella pertussis
gcggccucggcgggcg

SEQ ID NO: 2392426 - RNA, 19 nt, Bordetella pertussis
gcggccucggcgggcggcg

SEQ ID NO: 2392427 - RNA, 17 nt, Bordetella pertussis
gcggccugcagaccagc

SEQ ID NO: 2392428 - RNA, 16 nt, Bordetella pertussis
gcggccugcaggccgu

SEQ ID NO: 2392429 - RNA, 15 nt, Bordetella pertussis
gcggccugcgccggc

SEQ ID NO: 2392430 - RNA, 20 nt, Bordetella pertussis
gcggccugcgccggcauggc

SEQ ID NO: 2392431 - RNA, 18 nt, Bordetella pertussis
gcggccugcgcgucccgg

SEQ ID NO: 2392432 - RNA, 21 nt, Bordetella pertussis
gcggccugcucgaaaugcgcg

SEQ ID NO: 2392433 - RNA, 16 nt, Bordetella pertussis
gcggccugcuuggcag

SEQ ID NO: 2392434 - RNA, 20 nt, Bordetella pertussis
gcggccugcuuggcagccuu

SEQ ID NO: 2392435 - RNA, 14 nt, Bordetella pertussis
gcggccuggaccug

SEQ ID NO: 2392436 - RNA, 17 nt, Bordetella pertussis
gcggccuggaccugagc

SEQ ID NO: 2392437 - RNA, 22 nt, Bordetella pertussis
gcggccuggaccugagccaggc

SEQ ID NO: 2392438 - RNA, 12 nt, Bordetella pertussis
gcggccuggccc

SEQ ID NO: 2392439 - RNA, 17 nt, Bordetella pertussis
gcggccuggccgcgcgc

SEQ ID NO: 2392440 - RNA, 15 nt, Bordetella pertussis
gcggccuggccgggg

SEQ ID NO: 2392441 - RNA, 20 nt, Bordetella pertussis
gcggccuggcgguaugcggc

SEQ ID NO: 2392442 - RNA, 22 nt, Bordetella pertussis
gcggccuggcgguaugcggcgc

SEQ ID NO: 2392443 - RNA, 14 nt, Bordetella pertussis
gcggccugggaggc

SEQ ID NO: 2392444 - RNA, 22 nt, Bordetella pertussis
gcggccugggaggcgcugaugc

SEQ ID NO: 2392445 - RNA, 14 nt, Bordetella pertussis
gcggccugggccau

SEQ ID NO: 2392446 - RNA, 19 nt, Bordetella pertussis
gcggccugggcggcgcgcu

SEQ ID NO: 2392447 - RNA, 20 nt, Bordetella pertussis
gcggccugggcggcgcgcuc

SEQ ID NO: 2392448 - RNA, 15 nt, Bordetella pertussis
gcggccugggcgggc

SEQ ID NO: 2392449 - RNA, 18 nt, Bordetella pertussis
gcggccuucaccccgcca

SEQ ID NO: 2392450 - RNA, 16 nt, Bordetella pertussis
gcggccuugccggugg

SEQ ID NO: 2392451 - RNA, 22 nt, Bordetella pertussis
gcggccuugccgguggacggcc

SEQ ID NO: 2392452 - RNA, 23 nt, Bordetella pertussis
gcggccuugccgguggacggcca

SEQ ID NO: 2392453 - RNA, 18 nt, Bordetella pertussis
gcggccuugcgggccggc

SEQ ID NO: 2392454 - RNA, 22 nt, Bordetella pertussis
gcggccuugcgggccggcuggg

SEQ ID NO: 2392455 - RNA, 15 nt, Bordetella pertussis
gcggccuuggccgca

SEQ ID NO: 2392456 - RNA, 20 nt, Bordetella pertussis
gcggccuuggccgcagccgg

SEQ ID NO: 2392457 - RNA, 21 nt, Bordetella pertussis
gcggccuuggccgcagccggc

SEQ ID NO: 2392458 - RNA, 17 nt, Bordetella pertussis
gcggccuuggucgcgac

SEQ ID NO: 2392459 - RNA, 19 nt, Bordetella pertussis
gcggccuuggucgcgaccu

SEQ ID NO: 2392460 - RNA, 23 nt, Bordetella pertussis
gcggccuuggucgcgaccucggc

SEQ ID NO: 2392461 - RNA, 17 nt, Bordetella pertussis
gcggccuugugcgccag

SEQ ID NO: 2392462 - RNA, 18 nt, Bordetella pertussis
gcggccuugugcgccagc

SEQ ID NO: 2392463 - RNA, 21 nt, Bordetella pertussis
gcggccuugugcgccagcgcg

SEQ ID NO: 2392464 - RNA, 22 nt, Bordetella pertussis
gcggccuugugcgccagcgcga

SEQ ID NO: 2392465 - RNA, 16 nt, Bordetella pertussis
gcggccuuugcgcgcu

SEQ ID NO: 2392466 - RNA, 18 nt, Bordetella pertussis
gcggccuuuuuuugcggc

SEQ ID NO: 2392467 - RNA, 21 nt, Bordetella pertussis
gcggccuuuuuuugcggcacg

SEQ ID NO: 2392468 - RNA, 23 nt, Bordetella pertussis
gcggccuuuuuuugcggcacggc

SEQ ID NO: 2392469 - RNA, 19 nt, Bordetella pertussis
gcggcgaaaugucgagcgc

SEQ ID NO: 2392470 - RNA, 21 nt, Bordetella pertussis
gcggcgaaaugucgagcgcga

SEQ ID NO: 2392471 - RNA, 20 nt, Bordetella pertussis
gcggcgaaccgcucagcccu

SEQ ID NO: 2392472 - RNA, 19 nt, Bordetella pertussis
gcggcgaaggcgcggcugc

SEQ ID NO: 2392473 - RNA, 18 nt, Bordetella pertussis
gcggcgacacccccaggg

SEQ ID NO: 2392474 - RNA, 19 nt, Bordetella pertussis
gcggcgacagggcgucguc

SEQ ID NO: 2392475 - RNA, 13 nt, Bordetella pertussis
gcggcgaccgcga

SEQ ID NO: 2392476 - RNA, 13 nt, Bordetella pertussis
gcggcgaccggcg

SEQ ID NO: 2392477 - RNA, 16 nt, Bordetella pertussis
gcggcgaccggcgccg

SEQ ID NO: 2392478 - RNA, 18 nt, Bordetella pertussis
gcggcgaccggcgccggc

SEQ ID NO: 2392479 - RNA, 22 nt, Bordetella pertussis
gcggcgacgaacccgggcguga

SEQ ID NO: 2392480 - RNA, 13 nt, Bordetella pertussis
gcggcgacgaugc

SEQ ID NO: 2392481 - RNA, 15 nt, Bordetella pertussis
gcggcgacgaugccg

SEQ ID NO: 2392482 - RNA, 19 nt, Bordetella pertussis
gcggcgacgaugccgcaga

SEQ ID NO: 2392483 - RNA, 19 nt, Bordetella pertussis
gcggcgacgcagcacggcu

SEQ ID NO: 2392484 - RNA, 16 nt, Bordetella pertussis
gcggcgacggcgccug

SEQ ID NO: 2392485 - RNA, 19 nt, Bordetella pertussis
gcggcgacggcgccuggcg

SEQ ID NO: 2392486 - RNA, 19 nt, Bordetella pertussis
gcggcgacggcgucggccu

SEQ ID NO: 2392487 - RNA, 20 nt, Bordetella pertussis
gcggcgacggcgucggccug

SEQ ID NO: 2392488 - RNA, 18 nt, Bordetella pertussis
gcggcgacucggcaucga

SEQ ID NO: 2392489 - RNA, 17 nt, Bordetella pertussis
gcggcgacugccccagc

SEQ ID NO: 2392490 - RNA, 23 nt, Bordetella pertussis
gcggcgacuucgccgaugaccag

SEQ ID NO: 2392491 - RNA, 17 nt, Bordetella pertussis
gcggcgagaugccgucg

SEQ ID NO: 2392492 - RNA, 19 nt, Bordetella pertussis
gcggcgagcaauccgucag

SEQ ID NO: 2392493 - RNA, 16 nt, Bordetella pertussis
gcggcgagcacggccu

SEQ ID NO: 2392494 - RNA, 17 nt, Bordetella pertussis
gcggcgagcacggccug

SEQ ID NO: 2392495 - RNA, 14 nt, Bordetella pertussis
gcggcgagccgaug

SEQ ID NO: 2392496 - RNA, 16 nt, Bordetella pertussis
gcggcgagcgccgcca

SEQ ID NO: 2392497 - RNA, 17 nt, Bordetella pertussis
gcggcgagcgccgccag

SEQ ID NO: 2392498 - RNA, 22 nt, Bordetella pertussis
gcggcgagcgccgccaggccgu

SEQ ID NO: 2392499 - RNA, 20 nt, Bordetella pertussis
gcggcgagcgcggcgcgcgc

SEQ ID NO: 2392500 - RNA, 18 nt, Bordetella pertussis
gcggcgaggcguccagcc

SEQ ID NO: 2392501 - RNA, 21 nt, Bordetella pertussis
gcggcgauacgcgccgccugg

SEQ ID NO: 2392502 - RNA, 12 nt, Bordetella pertussis
gcggcgauacgg

SEQ ID NO: 2392503 - RNA, 23 nt, Bordetella pertussis
gcggcgaucaacgugcgccaggc

SEQ ID NO: 2392504 - RNA, 17 nt, Bordetella pertussis
gcggcgaucacgccguc

SEQ ID NO: 2392505 - RNA, 18 nt, Bordetella pertussis
gcggcgaucacgccgucg

SEQ ID NO: 2392506 - RNA, 17 nt, Bordetella pertussis
gcggcgauccgccgcgg

SEQ ID NO: 2392507 - RNA, 18 nt, Bordetella pertussis
gcggcgauccgccgcggc

SEQ ID NO: 2392508 - RNA, 20 nt, Bordetella pertussis
gcggcgauccgccgcggcca

SEQ ID NO: 2392509 - RNA, 21 nt, Bordetella pertussis
gcggcgauccgccgcggccag

SEQ ID NO: 2392510 - RNA, 23 nt, Bordetella pertussis
gcggcgauccgccgcggccagcg

SEQ ID NO: 2392511 - RNA, 22 nt, Bordetella pertussis
gcggcgaucgaauggucggccu

SEQ ID NO: 2392512 - RNA, 16 nt, Bordetella pertussis
gcggcgaucucgcgcg

SEQ ID NO: 2392513 - RNA, 18 nt, Bordetella pertussis
gcggcgaucucgcgcgcg

SEQ ID NO: 2392514 - RNA, 23 nt, Bordetella pertussis
gcggcgaucucgcgcgcgcgguc

SEQ ID NO: 2392515 - RNA, 23 nt, Bordetella pertussis
gcggcgaucucgucgaccgccuc

SEQ ID NO: 2392516 - RNA, 18 nt, Bordetella pertussis
gcggcgaugcacccaggc

SEQ ID NO: 2392517 - RNA, 13 nt, Bordetella pertussis
gcggcgcgcugga

SEQ ID NO: 2392518 - RNA, 21 nt, Bordetella pertussis
gcggcgcgcuggacgucggug

SEQ ID NO: 2392519 - RNA, 18 nt, Bordetella pertussis
gcggcgcgcuggaggccu

SEQ ID NO: 2392520 - RNA, 15 nt, Bordetella pertussis
gcggcgcgcuugguc

SEQ ID NO: 2392521 - RNA, 18 nt, Bordetella pertussis
gcggcgcgcuuggucagc

SEQ ID NO: 2392522 - RNA, 12 nt, Bordetella pertussis
gcggcgcggcca

SEQ ID NO: 2392523 - RNA, 15 nt, Bordetella pertussis
gcggcgcggccagca

SEQ ID NO: 2392524 - RNA, 17 nt, Bordetella pertussis
gcggcgcggccagcagc

SEQ ID NO: 2392525 - RNA, 13 nt, Bordetella pertussis
gcggcgcggcccg

SEQ ID NO: 2392526 - RNA, 15 nt, Bordetella pertussis
gcggcgcggcccgcc

SEQ ID NO: 2392527 - RNA, 14 nt, Bordetella pertussis
gcggcgcggccggc

SEQ ID NO: 2392528 - RNA, 11 nt, Bordetella pertussis
gcggcgcggcg

SEQ ID NO: 2392529 - RNA, 15 nt, Bordetella pertussis
gcggcgcggcgcagg

SEQ ID NO: 2392530 - RNA, 18 nt, Bordetella pertussis
gcggcgcggcgcaggccu

SEQ ID NO: 2392531 - RNA, 16 nt, Bordetella pertussis
gcggcgcggcgccagc

SEQ ID NO: 2392532 - RNA, 18 nt, Bordetella pertussis
gcggcgcggcgcgugcca

SEQ ID NO: 2392533 - RNA, 13 nt, Bordetella pertussis
gcggcgcggcgcu

SEQ ID NO: 2392534 - RNA, 14 nt, Bordetella pertussis
gcggcgcggcgcug

SEQ ID NO: 2392535 - RNA, 15 nt, Bordetella pertussis
gcggcgcggcgcugg

SEQ ID NO: 2392536 - RNA, 16 nt, Bordetella pertussis
gcggcgcggcgcuggc

SEQ ID NO: 2392537 - RNA, 13 nt, Bordetella pertussis
gcggcgcggcugg

SEQ ID NO: 2392538 - RNA, 12 nt, Bordetella pertussis
gcggcgcgggcg

SEQ ID NO: 2392539 - RNA, 15 nt, Bordetella pertussis
gcggcgcgggcggcu

SEQ ID NO: 2392540 - RNA, 15 nt, Bordetella pertussis
gcggcgcggucagca

SEQ ID NO: 2392541 - RNA, 14 nt, Bordetella pertussis
gcggcgcggucggc

SEQ ID NO: 2392542 - RNA, 15 nt, Bordetella pertussis
gcggcgcguauccgc

SEQ ID NO: 2392543 - RNA, 19 nt, Bordetella pertussis
gcggcgcgucgcgcgccag

SEQ ID NO: 2392544 - RNA, 20 nt, Bordetella pertussis
gcggcgcgucgcgcgccagg

SEQ ID NO: 2392545 - RNA, 22 nt, Bordetella pertussis
gcggcgcgucgcgcgccaggcg

SEQ ID NO: 2392546 - RNA, 17 nt, Bordetella pertussis
gcggcgcguucagggcg

SEQ ID NO: 2392547 - RNA, 19 nt, Bordetella pertussis
gcggcgcguucgccgcagc

SEQ ID NO: 2392548 - RNA, 18 nt, Bordetella pertussis
gcggcgcuacgccgccga

SEQ ID NO: 2392549 - RNA, 23 nt, Bordetella pertussis
gcggcgcuacgccgccgauggcg

SEQ ID NO: 2392550 - RNA, 15 nt, Bordetella pertussis
gcggcgcucaucauc

SEQ ID NO: 2392551 - RNA, 16 nt, Bordetella pertussis
gcggcgcucaucaucg

SEQ ID NO: 2392552 - RNA, 22 nt, Bordetella pertussis
gcggcgcucgaaggcgccgacg

SEQ ID NO: 2392553 - RNA, 23 nt, Bordetella pertussis
gcggcgcucgaaggcgccgacgg

SEQ ID NO: 2392554 - RNA, 18 nt, Bordetella pertussis
gcggcgcugcacgcggcc

SEQ ID NO: 2392555 - RNA, 20 nt, Bordetella pertussis
gcggcgcugcacgcggccgc

SEQ ID NO: 2392556 - RNA, 23 nt, Bordetella pertussis
gcggcgcugcacgcggccgcgca

SEQ ID NO: 2392557 - RNA, 13 nt, Bordetella pertussis
gcggcgcugcugg

SEQ ID NO: 2392558 - RNA, 17 nt, Bordetella pertussis
gcggcgcugcuggccgg

SEQ ID NO: 2392559 - RNA, 18 nt, Bordetella pertussis
gcggcgcugcuggccggc

SEQ ID NO: 2392560 - RNA, 14 nt, Bordetella pertussis
gcggcgcuggccug

SEQ ID NO: 2392561 - RNA, 22 nt, Bordetella pertussis
gcggcgcuggccugccgcgccg

SEQ ID NO: 2392562 - RNA, 24 nt, Bordetella pertussis
gcggcgcuggccugccgcgccgac

SEQ ID NO: 2392563 - RNA, 13 nt, Bordetella pertussis
gcggcgcuggcga

SEQ ID NO: 2392564 - RNA, 18 nt, Bordetella pertussis
gcggcgcuggcgaagaac

SEQ ID NO: 2392565 - RNA, 14 nt, Bordetella pertussis
gcggcgcuggcgcc

SEQ ID NO: 2392566 - RNA, 16 nt, Bordetella pertussis
gcggcgcuggcgccgc

SEQ ID NO: 2392567 - RNA, 19 nt, Bordetella pertussis
gcggcgcuggcgccgcgcg

SEQ ID NO: 2392568 - RNA, 12 nt, Bordetella pertussis
gcggcgcuggcu

SEQ ID NO: 2392569 - RNA, 13 nt, Bordetella pertussis
gcggcgcuggcug

SEQ ID NO: 2392570 - RNA, 14 nt, Bordetella pertussis
gcggcgcuggucaa

SEQ ID NO: 2392571 - RNA, 18 nt, Bordetella pertussis
gcggcgcuuaccgcgccg

SEQ ID NO: 2392572 - RNA, 20 nt, Bordetella pertussis
gcggcgcuuaccgcgccggc

SEQ ID NO: 2392573 - RNA, 17 nt, Bordetella pertussis
gcggcgcuuggcguagc

SEQ ID NO: 2392574 - RNA, 14 nt, Bordetella pertussis
gcggcggaucgaac

SEQ ID NO: 2392575 - RNA, 14 nt, Bordetella pertussis
gcggcggauucagg

SEQ ID NO: 2392576 - RNA, 15 nt, Bordetella pertussis
gcggcggcaccagca

SEQ ID NO: 2392577 - RNA, 21 nt, Bordetella pertussis
gcggcggcaccagcaggccgg

SEQ ID NO: 2392578 - RNA, 20 nt, Bordetella pertussis
gcggcggcacgcgcgccggc

SEQ ID NO: 2392579 - RNA, 19 nt, Bordetella pertussis
gcggcggcaugcuggucau

SEQ ID NO: 2392580 - RNA, 20 nt, Bordetella pertussis
gcggcggcaugcuggucauc

SEQ ID NO: 2392581 - RNA, 13 nt, Bordetella pertussis
gcggcggccaggc

SEQ ID NO: 2392582 - RNA, 22 nt, Bordetella pertussis
gcggcggccaucgccauggcca

SEQ ID NO: 2392583 - RNA, 14 nt, Bordetella pertussis
gcggcggccgaagc

SEQ ID NO: 2392584 - RNA, 16 nt, Bordetella pertussis
gcggcggccggggccg

SEQ ID NO: 2392585 - RNA, 15 nt, Bordetella pertussis
gcggcggccuccagc

SEQ ID NO: 2392586 - RNA, 18 nt, Bordetella pertussis
gcggcggccuccagcagg

SEQ ID NO: 2392587 - RNA, 16 nt, Bordetella pertussis
gcggcggccugggcgg

SEQ ID NO: 2392588 - RNA, 15 nt, Bordetella pertussis
gcggcggccuugugc

SEQ ID NO: 2392589 - RNA, 22 nt, Bordetella pertussis
gcggcggccuugugcgccagcg

SEQ ID NO: 2392590 - RNA, 16 nt, Bordetella pertussis
gcggcggcgaccggcg

SEQ ID NO: 2392591 - RNA, 13 nt, Bordetella pertussis
gcggcggcgcgcg

SEQ ID NO: 2392592 - RNA, 14 nt, Bordetella pertussis
gcggcggcgcgcgc

SEQ ID NO: 2392593 - RNA, 22 nt, Bordetella pertussis
gcggcggcgcguucgccgcagc

SEQ ID NO: 2392594 - RNA, 14 nt, Bordetella pertussis
gcggcggcgcuggc

SEQ ID NO: 2392595 - RNA, 23 nt, Bordetella pertussis
gcggcggcgcuggccugccgcgc

SEQ ID NO: 2392596 - RNA, 13 nt, Bordetella pertussis
gcggcggcggcca

SEQ ID NO: 2392597 - RNA, 12 nt, Bordetella pertussis
gcggcggcgggc

SEQ ID NO: 2392598 - RNA, 13 nt, Bordetella pertussis
gcggcggcgggcg

SEQ ID NO: 2392599 - RNA, 18 nt, Bordetella pertussis
gcggcggcgucgcgcugu

SEQ ID NO: 2392600 - RNA, 15 nt, Bordetella pertussis
gcggcggcgugaacg

SEQ ID NO: 2392601 - RNA, 14 nt, Bordetella pertussis
gcggcggcguggcg

SEQ ID NO: 2392602 - RNA, 14 nt, Bordetella pertussis
gcggcggcguuccu

SEQ ID NO: 2392603 - RNA, 17 nt, Bordetella pertussis
gcggcggcugugggccu

SEQ ID NO: 2392604 - RNA, 18 nt, Bordetella pertussis
gcggcgggaccgugccgc

SEQ ID NO: 2392605 - RNA, 15 nt, Bordetella pertussis
gcggcgggacggcca

SEQ ID NO: 2392606 - RNA, 22 nt, Bordetella pertussis
gcggcgggacuguaccgcgcga

SEQ ID NO: 2392607 - RNA, 12 nt, Bordetella pertussis
gcggcgggcacg

SEQ ID NO: 2392608 - RNA, 23 nt, Bordetella pertussis
gcggcgggcacgagaucgccugg

SEQ ID NO: 2392609 - RNA, 14 nt, Bordetella pertussis
gcggcgggccccgc

SEQ ID NO: 2392610 - RNA, 23 nt, Bordetella pertussis
gcggcgggccccgcagggcccgc

SEQ ID NO: 2392611 - RNA, 13 nt, Bordetella pertussis
gcggcgggcgcug

SEQ ID NO: 2392612 - RNA, 19 nt, Bordetella pertussis
gcggcgggcgcuggcgcgc

SEQ ID NO: 2392613 - RNA, 14 nt, Bordetella pertussis
gcggcgggcggccg

SEQ ID NO: 2392614 - RNA, 14 nt, Bordetella pertussis
gcggcgggcggcgc

SEQ ID NO: 2392615 - RNA, 18 nt, Bordetella pertussis
gcggcgggcgugaugccg

SEQ ID NO: 2392616 - RNA, 13 nt, Bordetella pertussis
gcggcgggcucag

SEQ ID NO: 2392617 - RNA, 16 nt, Bordetella pertussis
gcggcgggcucagccc

SEQ ID NO: 2392618 - RNA, 20 nt, Bordetella pertussis
gcggcgggcucggcgccggc

SEQ ID NO: 2392619 - RNA, 23 nt, Bordetella pertussis
gcggcgggucaaguccggcgccg

SEQ ID NO: 2392620 - RNA, 14 nt, Bordetella pertussis
gcggcgggugccgc

SEQ ID NO: 2392621 - RNA, 18 nt, Bordetella pertussis
gcggcggguucgcagggc

SEQ ID NO: 2392622 - RNA, 18 nt, Bordetella pertussis
gcggcgguaccaggccga

SEQ ID NO: 2392623 - RNA, 14 nt, Bordetella pertussis
gcggcgguagcgcu

SEQ ID NO: 2392624 - RNA, 17 nt, Bordetella pertussis
gcggcgguagcgcucgu

SEQ ID NO: 2392625 - RNA, 20 nt, Bordetella pertussis
gcggcgguagcgcucgucca

SEQ ID NO: 2392626 - RNA, 13 nt, Bordetella pertussis
gcggcggucagcg

SEQ ID NO: 2392627 - RNA, 16 nt, Bordetella pertussis
gcggcggugccagcgc

SEQ ID NO: 2392628 - RNA, 17 nt, Bordetella pertussis
gcggcggugccagcgca

SEQ ID NO: 2392629 - RNA, 16 nt, Bordetella pertussis
gcggcggugccgccca

SEQ ID NO: 2392630 - RNA, 14 nt, Bordetella pertussis
gcggcggugccugu

SEQ ID NO: 2392631 - RNA, 22 nt, Bordetella pertussis
gcggcgguuucguagaugggca

SEQ ID NO: 2392632 - RNA, 16 nt, Bordetella pertussis
gcggcguaccggucca

SEQ ID NO: 2392633 - RNA, 15 nt, Bordetella pertussis
gcggucaaugcggcg

SEQ ID NO: 2392634 - RNA, 16 nt, Bordetella pertussis
gcggucaaugcggcgg

SEQ ID NO: 2392635 - RNA, 17 nt, Bordetella pertussis
gcggucaaugcggcggc

SEQ ID NO: 2392636 - RNA, 20 nt, Bordetella pertussis
gcggucaaugcggcggcgcu

SEQ ID NO: 2392637 - RNA, 23 nt, Bordetella pertussis
gcggucaaugcggcggcgcuggc

SEQ ID NO: 2392638 - RNA, 18 nt, Bordetella pertussis
gcggucacaucuguccug

SEQ ID NO: 2392639 - RNA, 23 nt, Bordetella pertussis
gcggucacaucuguccugauuca

SEQ ID NO: 2392640 - RNA, 22 nt, Bordetella pertussis
gcggucaccgagcugagcacca

SEQ ID NO: 2392641 - RNA, 14 nt, Bordetella pertussis
gcggucacgccgau

SEQ ID NO: 2392642 - RNA, 14 nt, Bordetella pertussis
gcggucagccagag

SEQ ID NO: 2392643 - RNA, 15 nt, Bordetella pertussis
gcggucagccagagc

SEQ ID NO: 2392644 - RNA, 14 nt, Bordetella pertussis
gcggucagcgcggc

SEQ ID NO: 2392645 - RNA, 15 nt, Bordetella pertussis
gcggucagcgcggcg

SEQ ID NO: 2392646 - RNA, 17 nt, Bordetella pertussis
gcggucagcgcggcgcc

SEQ ID NO: 2392647 - RNA, 20 nt, Bordetella pertussis
gcggucagcgcggcgccggc

SEQ ID NO: 2392648 - RNA, 17 nt, Bordetella pertussis
gcggucagcuggaacgc

SEQ ID NO: 2392649 - RNA, 18 nt, Bordetella pertussis
gcggucagucgggacggc

SEQ ID NO: 2392650 - RNA, 22 nt, Bordetella pertussis
gcggucagucgggacggcgcgg

SEQ ID NO: 2392651 - RNA, 17 nt, Bordetella pertussis
gcggucaucggcgacga

SEQ ID NO: 2392652 - RNA, 21 nt, Bordetella pertussis
gcggucaugccgaacagcaug

SEQ ID NO: 2392653 - RNA, 13 nt, Bordetella pertussis
gcgguccacagcc

SEQ ID NO: 2392654 - RNA, 16 nt, Bordetella pertussis
gcgguccacagcccgg

SEQ ID NO: 2392655 - RNA, 18 nt, Bordetella pertussis
gcgguccacagcccggcc

SEQ ID NO: 2392656 - RNA, 21 nt, Bordetella pertussis
gcgguccacgcccuggcuggc

SEQ ID NO: 2392657 - RNA, 17 nt, Bordetella pertussis
gcgguccacgccggguu

SEQ ID NO: 2392658 - RNA, 13 nt, Bordetella pertussis
gcgguccagcaag

SEQ ID NO: 2392659 - RNA, 20 nt, Bordetella pertussis
gcgguccagcaccagggcgc

SEQ ID NO: 2392660 - RNA, 13 nt, Bordetella pertussis
gcgguccagcacg

SEQ ID NO: 2392661 - RNA, 16 nt, Bordetella pertussis
gcgguccagccccugc

SEQ ID NO: 2392662 - RNA, 12 nt, Bordetella pertussis
gcgguccagcug

SEQ ID NO: 2392663 - RNA, 16 nt, Bordetella pertussis
gcgguccagcugcgcg

SEQ ID NO: 2392664 - RNA, 22 nt, Bordetella pertussis
gcggagccgcgcacacauggcg

SEQ ID NO: 2392665 - RNA, 14 nt, Bordetella pertussis
gcggagcgacggca

SEQ ID NO: 2392666 - RNA, 14 nt, Bordetella pertussis
gcggaggcggccgc

SEQ ID NO: 2392667 - RNA, 19 nt, Bordetella pertussis
gcggaggcggccgcgggcg

SEQ ID NO: 2392668 - RNA, 21 nt, Bordetella pertussis
gcggaggugucgccgcccaug

SEQ ID NO: 2392669 - RNA, 19 nt, Bordetella pertussis
gcggauacgaaaccaggcc

SEQ ID NO: 2392670 - RNA, 22 nt, Bordetella pertussis
gcggauacgaaaccaggccggg

SEQ ID NO: 2392671 - RNA, 15 nt, Bordetella pertussis
gcggauacgcgucau

SEQ ID NO: 2392672 - RNA, 19 nt, Bordetella pertussis
gcggauauucgucggccgc

SEQ ID NO: 2392673 - RNA, 14 nt, Bordetella pertussis
gcggaucaagcggc

SEQ ID NO: 2392674 - RNA, 16 nt, Bordetella pertussis
gcggaucaagcggccc

SEQ ID NO: 2392675 - RNA, 17 nt, Bordetella pertussis
gcggaucaagcggcccg

SEQ ID NO: 2392676 - RNA, 19 nt, Bordetella pertussis
gcggaucaagcggcccgcg

SEQ ID NO: 2392677 - RNA, 19 nt, Bordetella pertussis
gcggaucacccagcggcug

SEQ ID NO: 2392678 - RNA, 13 nt, Bordetella pertussis
gcggaucaugggc

SEQ ID NO: 2392679 - RNA, 13 nt, Bordetella pertussis
gcggauccagcca

SEQ ID NO: 2392680 - RNA, 15 nt, Bordetella pertussis
gcggauccagccaug

SEQ ID NO: 2392681 - RNA, 16 nt, Bordetella pertussis
gcggauccagcgaggc

SEQ ID NO: 2392682 - RNA, 22 nt, Bordetella pertussis
gcggaucgaaaccggcgcgcgc

SEQ ID NO: 2392683 - RNA, 14 nt, Bordetella pertussis
gcggaucgaacgcc

SEQ ID NO: 2392684 - RNA, 19 nt, Bordetella pertussis
gcggaucgccgggcaggca

SEQ ID NO: 2392685 - RNA, 14 nt, Bordetella pertussis
gcggaucgccggua

SEQ ID NO: 2392686 - RNA, 19 nt, Bordetella pertussis
gcggaucgccgguagcgcu

SEQ ID NO: 2392687 - RNA, 22 nt, Bordetella pertussis
gcggaucgccgguagcgcuggg

SEQ ID NO: 2392688 - RNA, 20 nt, Bordetella pertussis
gcggaucgucuacgcgaacc

SEQ ID NO: 2392689 - RNA, 17 nt, Bordetella pertussis
gcggaucucggccagca

SEQ ID NO: 2392690 - RNA, 18 nt, Bordetella pertussis
gcggaucucggccagcag

SEQ ID NO: 2392691 - RNA, 19 nt, Bordetella pertussis
gcggaucucggccagcagc

SEQ ID NO: 2392692 - RNA, 21 nt, Bordetella pertussis
gcggaucucggccagcagcgc

SEQ ID NO: 2392693 - RNA, 18 nt, Bordetella pertussis
gcggaucuucccgccaug

SEQ ID NO: 2392694 - RNA, 21 nt, Bordetella pertussis
gcggaucuucccgccauggga

SEQ ID NO: 2392695 - RNA, 19 nt, Bordetella pertussis
gcggaugaacgaccagcac

SEQ ID NO: 2392696 - RNA, 20 nt, Bordetella pertussis
gcggaugaacgaccagcacg

SEQ ID NO: 2392697 - RNA, 18 nt, Bordetella pertussis
gcggaugagcaggccggg

SEQ ID NO: 2392698 - RNA, 19 nt, Bordetella pertussis
gcggaugagcaggccgggu

SEQ ID NO: 2392699 - RNA, 18 nt, Bordetella pertussis
gcggaugaucgcgcagca

SEQ ID NO: 2392700 - RNA, 15 nt, Bordetella pertussis
gcggaugaugcggcg

SEQ ID NO: 2392701 - RNA, 14 nt, Bordetella pertussis
gcggaugcagcagc

SEQ ID NO: 2392702 - RNA, 13 nt, Bordetella pertussis
gcggaugccgccc

SEQ ID NO: 2392703 - RNA, 17 nt, Bordetella pertussis
gcggaugccguccacgc

SEQ ID NO: 2392704 - RNA, 18 nt, Bordetella pertussis
gcggaugccguccacgcc

SEQ ID NO: 2392705 - RNA, 22 nt, Bordetella pertussis
gcggaugccguccacgccgcgc

SEQ ID NO: 2392706 - RNA, 23 nt, Bordetella pertussis
gcggaugccguccacgccgcgcg

SEQ ID NO: 2392707 - RNA, 14 nt, Bordetella pertussis
gcggaugcgcgccu

SEQ ID NO: 2392708 - RNA, 15 nt, Bordetella pertussis
gcggauggucgagcg

SEQ ID NO: 2392709 - RNA, 17 nt, Bordetella pertussis
gcggauggucgagcgcc

SEQ ID NO: 2392710 - RNA, 23 nt, Bordetella pertussis
gcggauggucgagcgccugcgcc

SEQ ID NO: 2392711 - RNA, 21 nt, Bordetella pertussis
gcggaugucaguuuccaucgg

SEQ ID NO: 2392712 - RNA, 15 nt, Bordetella pertussis
gcggauugaccagcg

SEQ ID NO: 2392713 - RNA, 20 nt, Bordetella pertussis
gcggauugaccagcgcggcc

SEQ ID NO: 2392714 - RNA, 22 nt, Bordetella pertussis
gcggauugaccagcgcggccgu

SEQ ID NO: 2392715 - RNA, 16 nt, Bordetella pertussis
gcggauugaugucgcg

SEQ ID NO: 2392716 - RNA, 18 nt, Bordetella pertussis
gcggauugaugucgcgca

SEQ ID NO: 2392717 - RNA, 20 nt, Bordetella pertussis
gcggauugaugucgcgcacc

SEQ ID NO: 2392718 - RNA, 22 nt, Bordetella pertussis
gcggauugaugucgcgcaccgc

SEQ ID NO: 2392719 - RNA, 19 nt, Bordetella pertussis
gcggauugccguccuggcg

SEQ ID NO: 2392720 - RNA, 13 nt, Bordetella pertussis
gcggauuugcucg

SEQ ID NO: 2392721 - RNA, 19 nt, Bordetella pertussis
gcggauuugcuucaggucg

SEQ ID NO: 2392722 - RNA, 19 nt, Bordetella pertussis
gcggcaaaaaaaaccgcgc

SEQ ID NO: 2392723 - RNA, 21 nt, Bordetella pertussis
gcggcaaaaaaaaccgcgcgc

SEQ ID NO: 2392724 - RNA, 16 nt, Bordetella pertussis
gcggcaaaaugccgcg

SEQ ID NO: 2392725 - RNA, 20 nt, Bordetella pertussis
gcggcaaagucggggcgccg

SEQ ID NO: 2392726 - RNA, 14 nt, Bordetella pertussis
gcggcaaauggggc

SEQ ID NO: 2392727 - RNA, 20 nt, Bordetella pertussis
gcggcaaauggggcggccgg

SEQ ID NO: 2392728 - RNA, 14 nt, Bordetella pertussis
gcggcaagcagccg

SEQ ID NO: 2392729 - RNA, 15 nt, Bordetella pertussis
gcggcaagcagccgg

SEQ ID NO: 2392730 - RNA, 18 nt, Bordetella pertussis
gcggcaagccgcggcggu

SEQ ID NO: 2392731 - RNA, 12 nt, Bordetella pertussis
gcggcaagcggc

SEQ ID NO: 2392732 - RNA, 13 nt, Bordetella pertussis
gcggcaagcggcg

SEQ ID NO: 2392733 - RNA, 18 nt, Bordetella pertussis
gcggcaagguagccgaug

SEQ ID NO: 2392734 - RNA, 18 nt, Bordetella pertussis
gcggcaaguucgcugccg

SEQ ID NO: 2392735 - RNA, 16 nt, Bordetella pertussis
gcggcaauaucggcac

SEQ ID NO: 2392736 - RNA, 21 nt, Bordetella pertussis
gcggcaauaucggcacccgca

SEQ ID NO: 2392737 - RNA, 13 nt, Bordetella pertussis
gcggcaaugcgcg

SEQ ID NO: 2392738 - RNA, 16 nt, Bordetella pertussis
gcggcaaugcgcgcgc

SEQ ID NO: 2392739 - RNA, 22 nt, Bordetella pertussis
gcggcacaucggaauuggcggc

SEQ ID NO: 2392740 - RNA, 14 nt, Bordetella pertussis
gcggcaccagcagg

SEQ ID NO: 2392741 - RNA, 17 nt, Bordetella pertussis
gcggcaccagcaggccg

SEQ ID NO: 2392742 - RNA, 22 nt, Bordetella pertussis
gcggcaccauugccggcgcgca

SEQ ID NO: 2392743 - RNA, 16 nt, Bordetella pertussis
gcggcaccgcgcagcc

SEQ ID NO: 2392744 - RNA, 22 nt, Bordetella pertussis
gcggcaccgcgcagcccggcgu

SEQ ID NO: 2392745 - RNA, 14 nt, Bordetella pertussis
gcggcaccucggcc

SEQ ID NO: 2392746 - RNA, 18 nt, Bordetella pertussis
gcggcaccucggccgggg

SEQ ID NO: 2392747 - RNA, 15 nt, Bordetella pertussis
gcggcaccugcugcu

SEQ ID NO: 2392748 - RNA, 18 nt, Bordetella pertussis
gcggcacgaaaagccgcg

SEQ ID NO: 2392749 - RNA, 22 nt, Bordetella pertussis
gcggcacgaaaagccgcggccg

SEQ ID NO: 2392750 - RNA, 16 nt, Bordetella pertussis
gcggcacgaucggcgc

SEQ ID NO: 2392751 - RNA, 21 nt, Bordetella pertussis
gcggcacgaucggcgccuggc

SEQ ID NO: 2392752 - RNA, 23 nt, Bordetella pertussis
gcggcacgauuucgccgauccgg

SEQ ID NO: 2392753 - RNA, 14 nt, Bordetella pertussis
gcggcacgcacagc

SEQ ID NO: 2392754 - RNA, 13 nt, Bordetella pertussis
gcggcacgccggc

SEQ ID NO: 2392755 - RNA, 14 nt, Bordetella pertussis
gcggcacgccggcg

SEQ ID NO: 2392756 - RNA, 19 nt, Bordetella pertussis
gcggcacgccggcggccca

SEQ ID NO: 2392757 - RNA, 12 nt, Bordetella pertussis
gcggcacgcgcg

SEQ ID NO: 2392758 - RNA, 17 nt, Bordetella pertussis
gcggcacgcgcgccggc

SEQ ID NO: 2392759 - RNA, 18 nt, Bordetella pertussis
gcggcacgcugcgcaggc

SEQ ID NO: 2392760 - RNA, 14 nt, Bordetella pertussis
gcggcacgcugcug

SEQ ID NO: 2392761 - RNA, 16 nt, Bordetella pertussis
gcggcacggccggccu

SEQ ID NO: 2392762 - RNA, 17 nt, Bordetella pertussis
gcggcacggccggccug

SEQ ID NO: 2392763 - RNA, 19 nt, Bordetella pertussis
gcggcacggccggccugca

SEQ ID NO: 2392764 - RNA, 14 nt, Bordetella pertussis
gcggcacggcuggg

SEQ ID NO: 2392765 - RNA, 21 nt, Bordetella pertussis
gcggcacggcuggguucaggc

SEQ ID NO: 2392766 - RNA, 10 nt, Bordetella pertussis
gcggcacggg

SEQ ID NO: 2392767 - RNA, 20 nt, Bordetella pertussis
gcggcacgugccggauggcg

SEQ ID NO: 2392768 - RNA, 21 nt, Bordetella pertussis
gcggcacgugccggauggcgc

SEQ ID NO: 2392769 - RNA, 16 nt, Bordetella pertussis
gcggcacugaugcugg

SEQ ID NO: 2392770 - RNA, 20 nt, Bordetella pertussis
gcggcacugaugcuggucag

SEQ ID NO: 2392771 - RNA, 17 nt, Bordetella pertussis
gcggcagaaggcgacau

SEQ ID NO: 2392772 - RNA, 21 nt, Bordetella pertussis
gcggcagacgaucauccaggc

SEQ ID NO: 2392773 - RNA, 16 nt, Bordetella pertussis
gcggcagcacgauggc

SEQ ID NO: 2392774 - RNA, 13 nt, Bordetella pertussis
gcggcagcagcag

SEQ ID NO: 2392775 - RNA, 15 nt, Bordetella pertussis
gcggcagcagcagcg

SEQ ID NO: 2392776 - RNA, 17 nt, Bordetella pertussis
gcggcagcagcagcgcg

SEQ ID NO: 2392777 - RNA, 18 nt, Bordetella pertussis
gcggcagcagcagcgcgg

SEQ ID NO: 2392778 - RNA, 20 nt, Bordetella pertussis
gcggcagcagcagcgcgguc

SEQ ID NO: 2392779 - RNA, 19 nt, Bordetella pertussis
gcggcguacuggcgcggcg

SEQ ID NO: 2392780 - RNA, 22 nt, Bordetella pertussis
gcggcguacuggcgcggcggcc

SEQ ID NO: 2392781 - RNA, 15 nt, Bordetella pertussis
gcggcguagagcgcc

SEQ ID NO: 2392782 - RNA, 17 nt, Bordetella pertussis
gcggcguagagcgccgc

SEQ ID NO: 2392783 - RNA, 16 nt, Bordetella pertussis
gcggcguauaggccac

SEQ ID NO: 2392784 - RNA, 15 nt, Bordetella pertussis
gcggcguaucggggu

SEQ ID NO: 2392785 - RNA, 15 nt, Bordetella pertussis
gcggcguauggcgcg

SEQ ID NO: 2392786 - RNA, 16 nt, Bordetella pertussis
gcggcgucaggccguc

SEQ ID NO: 2392787 - RNA, 19 nt, Bordetella pertussis
gcggcguccgaauacgcca

SEQ ID NO: 2392788 - RNA, 12 nt, Bordetella pertussis
gcggcguccgcg

SEQ ID NO: 2392789 - RNA, 15 nt, Bordetella pertussis
gcggcguccgcgccg

SEQ ID NO: 2392790 - RNA, 16 nt, Bordetella pertussis
gcggcguccgcgccga

SEQ ID NO: 2392791 - RNA, 14 nt, Bordetella pertussis
gcggcguccugccg

SEQ ID NO: 2392792 - RNA, 15 nt, Bordetella pertussis
gcggcguccugccgc

SEQ ID NO: 2392793 - RNA, 19 nt, Bordetella pertussis
gcggcguccugccgcgacc

SEQ ID NO: 2392794 - RNA, 23 nt, Bordetella pertussis
gcggcgucgaaggccgccggacg

SEQ ID NO: 2392795 - RNA, 19 nt, Bordetella pertussis
gcggcgucgaccgcgggcg

SEQ ID NO: 2392796 - RNA, 20 nt, Bordetella pertussis
gcggcgucgaccgcgggcgc

SEQ ID NO: 2392797 - RNA, 19 nt, Bordetella pertussis
gcggcgucgacgcccgcgc

SEQ ID NO: 2392798 - RNA, 22 nt, Bordetella pertussis
gcggcgucgacgcccgcgccca

SEQ ID NO: 2392799 - RNA, 20 nt, Bordetella pertussis
gcggcgucgaucggcgcgcc

SEQ ID NO: 2392800 - RNA, 22 nt, Bordetella pertussis
gcggcgucgaucggcgcgcccg

SEQ ID NO: 2392801 - RNA, 23 nt, Bordetella pertussis
gcggcgucgaucggcgcgcccgc

SEQ ID NO: 2392802 - RNA, 14 nt, Bordetella pertussis
gcggcgucgccgcg

SEQ ID NO: 2392803 - RNA, 15 nt, Bordetella pertussis
gcggcgucgccgcgc

SEQ ID NO: 2392804 - RNA, 13 nt, Bordetella pertussis
gcggcgucgcgcu

SEQ ID NO: 2392805 - RNA, 21 nt, Bordetella pertussis
gcggcgucgcgcuguucgggc

SEQ ID NO: 2392806 - RNA, 15 nt, Bordetella pertussis
gcggcgucgcguccu

SEQ ID NO: 2392807 - RNA, 19 nt, Bordetella pertussis
gcggcgucgcuggcagccu

SEQ ID NO: 2392808 - RNA, 15 nt, Bordetella pertussis
gcggcgucggcgccc

SEQ ID NO: 2392809 - RNA, 16 nt, Bordetella pertussis
gcggcgugaacgcgca

SEQ ID NO: 2392810 - RNA, 14 nt, Bordetella pertussis
gcggcgugaccgcg

SEQ ID NO: 2392811 - RNA, 15 nt, Bordetella pertussis
gcggcgugaccgcga

SEQ ID NO: 2392812 - RNA, 15 nt, Bordetella pertussis
gcggcgugagcacga

SEQ ID NO: 2392813 - RNA, 18 nt, Bordetella pertussis
gcggcgugaugcccaggc

SEQ ID NO: 2392814 - RNA, 24 nt, Bordetella pertussis
gcggcgugcccugcggcgcggcca

SEQ ID NO: 2392815 - RNA, 16 nt, Bordetella pertussis
gcggcgugcgccugcu

SEQ ID NO: 2392816 - RNA, 17 nt, Bordetella pertussis
gcggcgugcgccugcug

SEQ ID NO: 2392817 - RNA, 20 nt, Bordetella pertussis
gcggcgugcgccugcugguc

SEQ ID NO: 2392818 - RNA, 16 nt, Bordetella pertussis
gcggcgugcgcgugca

SEQ ID NO: 2392819 - RNA, 15 nt, Bordetella pertussis
gcggcgugcggccca

SEQ ID NO: 2392820 - RNA, 16 nt, Bordetella pertussis
gcggcgugcggcccag

SEQ ID NO: 2392821 - RNA, 22 nt, Bordetella pertussis
gcggcgugcggcccagccgcuc

SEQ ID NO: 2392822 - RNA, 16 nt, Bordetella pertussis
gcggcguggccgugcu

SEQ ID NO: 2392823 - RNA, 22 nt, Bordetella pertussis
gcggcguggccgugcuggucau

SEQ ID NO: 2392824 - RNA, 13 nt, Bordetella pertussis
gcggcguggcgcc

SEQ ID NO: 2392825 - RNA, 16 nt, Bordetella pertussis
gcggcguggcgccgac

SEQ ID NO: 2392826 - RNA, 17 nt, Bordetella pertussis
gcggcguggcgccgacc

SEQ ID NO: 2392827 - RNA, 16 nt, Bordetella pertussis
gcggcguggcggccag

SEQ ID NO: 2392828 - RNA, 17 nt, Bordetella pertussis
gcggcguggcggccagg

SEQ ID NO: 2392829 - RNA, 18 nt, Bordetella pertussis
gcggcguggcggccaggc

SEQ ID NO: 2392830 - RNA, 19 nt, Bordetella pertussis
gcggcguggcggccaggcc

SEQ ID NO: 2392831 - RNA, 15 nt, Bordetella pertussis
gcggcguggcggggc

SEQ ID NO: 2392832 - RNA, 16 nt, Bordetella pertussis
gcggcguggcggggcg

SEQ ID NO: 2392833 - RNA, 14 nt, Bordetella pertussis
gcggcguggggccg

SEQ ID NO: 2392834 - RNA, 22 nt, Bordetella pertussis
gcggcguguagagcugcggcgc

SEQ ID NO: 2392835 - RNA, 17 nt, Bordetella pertussis
gcggcgugugcccagca

SEQ ID NO: 2392836 - RNA, 19 nt, Bordetella pertussis
gcggcgugugcccagcacc

SEQ ID NO: 2392837 - RNA, 18 nt, Bordetella pertussis
gcggcguuccugggcacg

SEQ ID NO: 2392838 - RNA, 20 nt, Bordetella pertussis
gcggcguuccugggcacgcc

SEQ ID NO: 2392839 - RNA, 22 nt, Bordetella pertussis
gcggcguuccugggcacgccgg

SEQ ID NO: 2392840 - RNA, 18 nt, Bordetella pertussis
gcggcguucugcagcgcg

SEQ ID NO: 2392841 - RNA, 17 nt, Bordetella pertussis
gcggcguugaccugguc

SEQ ID NO: 2392842 - RNA, 13 nt, Bordetella pertussis
gcggcguugcggc

SEQ ID NO: 2392843 - RNA, 15 nt, Bordetella pertussis
gcggcguugcggcgc

SEQ ID NO: 2392844 - RNA, 16 nt, Bordetella pertussis
gcggcguugcggcgcc

SEQ ID NO: 2392845 - RNA, 18 nt, Bordetella pertussis
gcggcguugcggcgccau

SEQ ID NO: 2392846 - RNA, 18 nt, Bordetella pertussis
gcggcguuguagccguag

SEQ ID NO: 2392847 - RNA, 14 nt, Bordetella pertussis
gcggcuaggcgcag

SEQ ID NO: 2392848 - RNA, 15 nt, Bordetella pertussis
gcggcucaggcgcgg

SEQ ID NO: 2392849 - RNA, 14 nt, Bordetella pertussis
gcggcuccagcuca

SEQ ID NO: 2392850 - RNA, 17 nt, Bordetella pertussis
gcggcuccagcucagca

SEQ ID NO: 2392851 - RNA, 20 nt, Bordetella pertussis
gcggcuccagcucagcagcg

SEQ ID NO: 2392852 - RNA, 22 nt, Bordetella pertussis
gcggcuccagcucagcagcgcc

SEQ ID NO: 2392853 - RNA, 15 nt, Bordetella pertussis
gcggcuccugcuggc

SEQ ID NO: 2392854 - RNA, 14 nt, Bordetella pertussis
gcggcucgacgccg

SEQ ID NO: 2392855 - RNA, 15 nt, Bordetella pertussis
gcggcucgacgccgu

SEQ ID NO: 2392856 - RNA, 18 nt, Bordetella pertussis
gcggcucgagcggcagca

SEQ ID NO: 2392857 - RNA, 19 nt, Bordetella pertussis
gcggcucgaggaaccagcc

SEQ ID NO: 2392858 - RNA, 14 nt, Bordetella pertussis
gcggcucgccgcgc

SEQ ID NO: 2392859 - RNA, 17 nt, Bordetella pertussis
gcggcucgccgcgcacg

SEQ ID NO: 2392860 - RNA, 18 nt, Bordetella pertussis
gcggcucgccgcgcacgg

SEQ ID NO: 2392861 - RNA, 21 nt, Bordetella pertussis
gcggcucgccgcgcacgggcg

SEQ ID NO: 2392862 - RNA, 14 nt, Bordetella pertussis
gcggcucgccggcc

SEQ ID NO: 2392863 - RNA, 22 nt, Bordetella pertussis
gcggcucgccuccccaggccag

SEQ ID NO: 2392864 - RNA, 22 nt, Bordetella pertussis
gcggcucuggaucgugcccagc

SEQ ID NO: 2392865 - RNA, 22 nt, Bordetella pertussis
gcggcugaagaagcccggcugc

SEQ ID NO: 2392866 - RNA, 23 nt, Bordetella pertussis
gcggcugaagaagcccggcugcu

SEQ ID NO: 2392867 - RNA, 17 nt, Bordetella pertussis
gcggcugaucaccgccg

SEQ ID NO: 2392868 - RNA, 23 nt, Bordetella pertussis
gcggcugcccaccuugcgcgcga

SEQ ID NO: 2392869 - RNA, 17 nt, Bordetella pertussis
gcggcugcccgggcugc

SEQ ID NO: 2392870 - RNA, 15 nt, Bordetella pertussis
gcggcugcccucggu

SEQ ID NO: 2392871 - RNA, 20 nt, Bordetella pertussis
gcggcugcccucggucagcg

SEQ ID NO: 2392872 - RNA, 13 nt, Bordetella pertussis
gcggcugccgaua

SEQ ID NO: 2392873 - RNA, 22 nt, Bordetella pertussis
gcggcugcgaaaggccgagcca

SEQ ID NO: 2392874 - RNA, 15 nt, Bordetella pertussis
gcggcugcgggccgg

SEQ ID NO: 2392875 - RNA, 16 nt, Bordetella pertussis
gcggcugcgggccggc

SEQ ID NO: 2392876 - RNA, 19 nt, Bordetella pertussis
gcggcugcuggaacggugc

SEQ ID NO: 2392877 - RNA, 22 nt, Bordetella pertussis
gcggcugcuggaacggugcgag

SEQ ID NO: 2392878 - RNA, 14 nt, Bordetella pertussis
gcggcugcuggccc

SEQ ID NO: 2392879 - RNA, 21 nt, Bordetella pertussis
gcggcuggccacuggccgcgc

SEQ ID NO: 2392880 - RNA, 15 nt, Bordetella pertussis
gcggcuggcgauggu

SEQ ID NO: 2392881 - RNA, 22 nt, Bordetella pertussis
gcggcuggcgaugguggauccg

SEQ ID NO: 2392882 - RNA, 15 nt, Bordetella pertussis
gcggcuggcgcggcc

SEQ ID NO: 2392883 - RNA, 13 nt, Bordetella pertussis
gcggcuggcuguu

SEQ ID NO: 2392884 - RNA, 15 nt, Bordetella pertussis
gcggcuggcuguucg

SEQ ID NO: 2392885 - RNA, 19 nt, Bordetella pertussis
gcggcuggggcugcugggc

SEQ ID NO: 2392886 - RNA, 21 nt, Bordetella pertussis
gcggcuggggcugcugggccg

SEQ ID NO: 2392887 - RNA, 18 nt, Bordetella pertussis
gcggcugggucggcguga

SEQ ID NO: 2392888 - RNA, 18 nt, Bordetella pertussis
gcggcugggugcggucag

SEQ ID NO: 2392889 - RNA, 15 nt, Bordetella pertussis
gcggcuggucgccgu

SEQ ID NO: 2392890 - RNA, 16 nt, Bordetella pertussis
gcggcuggucgccguc

SEQ ID NO: 2392891 - RNA, 20 nt, Bordetella pertussis
gcggcuggugccgacggcgc

SEQ ID NO: 2392892 - RNA, 17 nt, Bordetella pertussis
gcggcugguggugccgc

SEQ ID NO: 2392893 - RNA, 20 nt, Bordetella pertussis
gcggcugguggugccgcgca

SEQ ID NO: 2392894 - RNA, 19 nt, Bordetella pertussis
gcgguccagcugcgcgcga

SEQ ID NO: 2392895 - RNA, 15 nt, Bordetella pertussis
gcgguccaggaagcg

SEQ ID NO: 2392896 - RNA, 23 nt, Bordetella pertussis
gcgguccauggugaugcugucgc

SEQ ID NO: 2392897 - RNA, 15 nt, Bordetella pertussis
gcggucccgagcgcu

SEQ ID NO: 2392898 - RNA, 20 nt, Bordetella pertussis
gcgguccgaugucgaggauc

SEQ ID NO: 2392899 - RNA, 21 nt, Bordetella pertussis
gcgguccgaugucgaggauca

SEQ ID NO: 2392900 - RNA, 15 nt, Bordetella pertussis
gcgguccgcagcgcu

SEQ ID NO: 2392901 - RNA, 19 nt, Bordetella pertussis
gcgguccggggcgggcgcg

SEQ ID NO: 2392902 - RNA, 22 nt, Bordetella pertussis
gcgguccgguucgcccaccacc

SEQ ID NO: 2392903 - RNA, 19 nt, Bordetella pertussis
gcgguccguacgccacuuc

SEQ ID NO: 2392904 - RNA, 20 nt, Bordetella pertussis
gcgguccugaccggcggcgc

SEQ ID NO: 2392905 - RNA, 21 nt, Bordetella pertussis
gcgguccugaccggcggcgcu

SEQ ID NO: 2392906 - RNA, 21 nt, Bordetella pertussis
gcggucgaagaaggccuuggc

SEQ ID NO: 2392907 - RNA, 23 nt, Bordetella pertussis
gcggucgacgaaauagccgacca

SEQ ID NO: 2392908 - RNA, 14 nt, Bordetella pertussis
gcggucgaggcgca

SEQ ID NO: 2392909 - RNA, 16 nt, Bordetella pertussis
gcggucgaggcgcagu

SEQ ID NO: 2392910 - RNA, 17 nt, Bordetella pertussis
gcggucgaggcgcaguc

SEQ ID NO: 2392911 - RNA, 22 nt, Bordetella pertussis
gcggucgaggcgcaguccagcg

SEQ ID NO: 2392912 - RNA, 19 nt, Bordetella pertussis
gcggucgaugaagcccgag

SEQ ID NO: 2392913 - RNA, 22 nt, Bordetella pertussis
gcggucgaugaagcccgagcgg

SEQ ID NO: 2392914 - RNA, 20 nt, Bordetella pertussis
gcggucgaugaccagccagc

SEQ ID NO: 2392915 - RNA, 18 nt, Bordetella pertussis
gcggucgaugaccucgcg

SEQ ID NO: 2392916 - RNA, 19 nt, Bordetella pertussis
gcggucgaugaccucgcgc

SEQ ID NO: 2392917 - RNA, 18 nt, Bordetella pertussis
gcggucgaugcgcacgcc

SEQ ID NO: 2392918 - RNA, 17 nt, Bordetella pertussis
gcggucgauguccagcg

SEQ ID NO: 2392919 - RNA, 21 nt, Bordetella pertussis
gcggucgcauuggccgccgcc

SEQ ID NO: 2392920 - RNA, 22 nt, Bordetella pertussis
gcggucgcauuggccgccgcca

SEQ ID NO: 2392921 - RNA, 16 nt, Bordetella pertussis
gcggucgccaucggcc

SEQ ID NO: 2392922 - RNA, 21 nt, Bordetella pertussis
gcggucgccaucggccggccc

SEQ ID NO: 2392923 - RNA, 17 nt, Bordetella pertussis
gcggucgccgcggucgc

SEQ ID NO: 2392924 - RNA, 19 nt, Bordetella pertussis
gcggucgccgcggucgcag

SEQ ID NO: 2392925 - RNA, 18 nt, Bordetella pertussis
gcggucgccuugucgggg

SEQ ID NO: 2392926 - RNA, 13 nt, Bordetella pertussis
gcggucggccgcg

SEQ ID NO: 2392927 - RNA, 13 nt, Bordetella pertussis
gcggucggcgggc

SEQ ID NO: 2392928 - RNA, 21 nt, Bordetella pertussis
gcggucggugcaaugcccagu

SEQ ID NO: 2392929 - RNA, 15 nt, Bordetella pertussis
gcggucguagcggau

SEQ ID NO: 2392930 - RNA, 19 nt, Bordetella pertussis
gcggucuaccgaagccgag

SEQ ID NO: 2392931 - RNA, 20 nt, Bordetella pertussis
gcggucuccgguucggcgcg

SEQ ID NO: 2392932 - RNA, 23 nt, Bordetella pertussis
gcggucuccgguucggcgcggcg

SEQ ID NO: 2392933 - RNA, 21 nt, Bordetella pertussis
gcggucugggcgucccaggcc

SEQ ID NO: 2392934 - RNA, 15 nt, Bordetella pertussis
gcggucuggucuggc

SEQ ID NO: 2392935 - RNA, 16 nt, Bordetella pertussis
gcggucuggucuggca

SEQ ID NO: 2392936 - RNA, 23 nt, Bordetella pertussis
gcggucuucacauagcccggcgc

SEQ ID NO: 2392937 - RNA, 20 nt, Bordetella pertussis
gcggucuucgaugcuggcgc

SEQ ID NO: 2392938 - RNA, 16 nt, Bordetella pertussis
gcggucuugcgcugga

SEQ ID NO: 2392939 - RNA, 20 nt, Bordetella pertussis
gcggucuuucaccgacagga

SEQ ID NO: 2392940 - RNA, 13 nt, Bordetella pertussis
gcggugaaggcgc

SEQ ID NO: 2392941 - RNA, 17 nt, Bordetella pertussis
gcggugaaggcgcccgg

SEQ ID NO: 2392942 - RNA, 17 nt, Bordetella pertussis
gcggugaccaccaggcc

SEQ ID NO: 2392943 - RNA, 19 nt, Bordetella pertussis
gcggugaccaccaggccgc

SEQ ID NO: 2392944 - RNA, 20 nt, Bordetella pertussis
gcggugaccaccaggccgcc

SEQ ID NO: 2392945 - RNA, 22 nt, Bordetella pertussis
gcggugaccaccaggccgccua

SEQ ID NO: 2392946 - RNA, 16 nt, Bordetella pertussis
gcggugaccaugcgca

SEQ ID NO: 2392947 - RNA, 19 nt, Bordetella pertussis
gcggugaccaugcgcaccg

SEQ ID NO: 2392948 - RNA, 20 nt, Bordetella pertussis
gcggugaccaugcgcaccga

SEQ ID NO: 2392949 - RNA, 15 nt, Bordetella pertussis
gcggugaggcggccg

SEQ ID NO: 2392950 - RNA, 20 nt, Bordetella pertussis
gcggugaggcggccgggcgu

SEQ ID NO: 2392951 - RNA, 19 nt, Bordetella pertussis
gcggugaucugcucgccgc

SEQ ID NO: 2392952 - RNA, 21 nt, Bordetella pertussis
gcggugaucugcucgccgcgc

SEQ ID NO: 2392953 - RNA, 22 nt, Bordetella pertussis
gcggugaucugcucgccgcgcg

SEQ ID NO: 2392954 - RNA, 20 nt, Bordetella pertussis
gcggugcaggggccgcacgc

SEQ ID NO: 2392955 - RNA, 20 nt, Bordetella pertussis
gcggugcaucucggcaucgg

SEQ ID NO: 2392956 - RNA, 24 nt, Bordetella pertussis
gcggugcaucucggcaucggccac

SEQ ID NO: 2392957 - RNA, 15 nt, Bordetella pertussis
gcggugccccggccu

SEQ ID NO: 2392958 - RNA, 18 nt, Bordetella pertussis
gcggugccccggccucgc

SEQ ID NO: 2392959 - RNA, 16 nt, Bordetella pertussis
gcucaggucgaacagg

SEQ ID NO: 2392960 - RNA, 18 nt, Bordetella pertussis
gcucaggucgaacaggcu

SEQ ID NO: 2392961 - RNA, 15 nt, Bordetella pertussis
gcucagucggccugg

SEQ ID NO: 2392962 - RNA, 18 nt, Bordetella pertussis
gcucagucggccuggcgc

SEQ ID NO: 2392963 - RNA, 21 nt, Bordetella pertussis
gcucagucgggcagcgcccgc

SEQ ID NO: 2392964 - RNA, 22 nt, Bordetella pertussis
gcucaguugguagagcagcuca

SEQ ID NO: 2392965 - RNA, 16 nt, Bordetella pertussis
gcucaucaccagcagg

SEQ ID NO: 2392966 - RNA, 16 nt, Bordetella pertussis
gcucaucaucgcgcug

SEQ ID NO: 2392967 - RNA, 19 nt, Bordetella pertussis
gcucaucaucgcgcuggcg

SEQ ID NO: 2392968 - RNA, 14 nt, Bordetella pertussis
gcucauccaggcgc

SEQ ID NO: 2392969 - RNA, 16 nt, Bordetella pertussis
gcucaucggcaggccg

SEQ ID NO: 2392970 - RNA, 17 nt, Bordetella pertussis
gcucaucggcaggccgg

SEQ ID NO: 2392971 - RNA, 19 nt, Bordetella pertussis
gcucauggaggggcgcagg

SEQ ID NO: 2392972 - RNA, 21 nt, Bordetella pertussis
gcucauggaggggcgcaggca

SEQ ID NO: 2392973 - RNA, 18 nt, Bordetella pertussis
gcucauggcgcaugacga

SEQ ID NO: 2392974 - RNA, 18 nt, Bordetella pertussis
gcucauguugggggcgaa

SEQ ID NO: 2392975 - RNA, 22 nt, Bordetella pertussis
gcucauguugggggcgaagacg

SEQ ID NO: 2392976 - RNA, 15 nt, Bordetella pertussis
gcucauucggcgcgc

SEQ ID NO: 2392977 - RNA, 16 nt, Bordetella pertussis
gcucauucggcgcgcu

SEQ ID NO: 2392978 - RNA, 15 nt, Bordetella pertussis
gcuccacagccacug

SEQ ID NO: 2392979 - RNA, 21 nt, Bordetella pertussis
gcuccacagccacugcggccc

SEQ ID NO: 2392980 - RNA, 21 nt, Bordetella pertussis
gcuccaccaccaucugcgagc

SEQ ID NO: 2392981 - RNA, 17 nt, Bordetella pertussis
gcuccaccagcaccggc

SEQ ID NO: 2392982 - RNA, 21 nt, Bordetella pertussis
gcuccaccagcaccggcagcg

SEQ ID NO: 2392983 - RNA, 22 nt, Bordetella pertussis
gcuccaccagcaccggcagcgu

SEQ ID NO: 2392984 - RNA, 15 nt, Bordetella pertussis
gcuccaccgggcuga

SEQ ID NO: 2392985 - RNA, 14 nt, Bordetella pertussis
gcuccagaacgcgc

SEQ ID NO: 2392986 - RNA, 15 nt, Bordetella pertussis
gcuccagaacgcgcc

SEQ ID NO: 2392987 - RNA, 17 nt, Bordetella pertussis
gcuccagaacgcgccgu

SEQ ID NO: 2392988 - RNA, 14 nt, Bordetella pertussis
gcuccagagcgcgc

SEQ ID NO: 2392989 - RNA, 15 nt, Bordetella pertussis
gcuccagagcgcgca

SEQ ID NO: 2392990 - RNA, 16 nt, Bordetella pertussis
gcuccagagcgcgcac

SEQ ID NO: 2392991 - RNA, 14 nt, Bordetella pertussis
gcuccagccaggcg

SEQ ID NO: 2392992 - RNA, 14 nt, Bordetella pertussis
gcuccagccgcagg

SEQ ID NO: 2392993 - RNA, 15 nt, Bordetella pertussis
gcuccagccgggucg

SEQ ID NO: 2392994 - RNA, 13 nt, Bordetella pertussis
gcuccagcgcgcc

SEQ ID NO: 2392995 - RNA, 14 nt, Bordetella pertussis
gcuccagcgcgccg

SEQ ID NO: 2392996 - RNA, 15 nt, Bordetella pertussis
gcuccagcgcgccga

SEQ ID NO: 2392997 - RNA, 20 nt, Bordetella pertussis
gcuccagcgcgccgaagcgc

SEQ ID NO: 2392998 - RNA, 22 nt, Bordetella pertussis
gcuccagcgcuucgugcagcgc

SEQ ID NO: 2392999 - RNA, 18 nt, Bordetella pertussis
gcuccagcgucauggccu

SEQ ID NO: 2393000 - RNA, 22 nt, Bordetella pertussis
gcuccagcgucauggccuggcc

SEQ ID NO: 2393001 - RNA, 20 nt, Bordetella pertussis
gcuccagcucagcagcgcca

SEQ ID NO: 2393002 - RNA, 17 nt, Bordetella pertussis
gcuccagcuggcgcacc

SEQ ID NO: 2393003 - RNA, 21 nt, Bordetella pertussis
gcuccaggaaaaccuccuccg

SEQ ID NO: 2393004 - RNA, 17 nt, Bordetella pertussis
gcuccaggccgcccagc

SEQ ID NO: 2393005 - RNA, 13 nt, Bordetella pertussis
gcuccaggccggc

SEQ ID NO: 2393006 - RNA, 14 nt, Bordetella pertussis
gcuccaggccggca

SEQ ID NO: 2393007 - RNA, 20 nt, Bordetella pertussis
gcuccaggccggcaugcgcc

SEQ ID NO: 2393008 - RNA, 23 nt, Bordetella pertussis
gcuccaggccggcaugcgccggc

SEQ ID NO: 2393009 - RNA, 18 nt, Bordetella pertussis
gcuccagggcgucggcga

SEQ ID NO: 2393010 - RNA, 20 nt, Bordetella pertussis
gcuccagggcgucggcgacg

SEQ ID NO: 2393011 - RNA, 20 nt, Bordetella pertussis
gcuccaguacgaaggggcgg

SEQ ID NO: 2393012 - RNA, 16 nt, Bordetella pertussis
gcuccagucccgcacc

SEQ ID NO: 2393013 - RNA, 20 nt, Bordetella pertussis
gcuccagucccgcaccgggc

SEQ ID NO: 2393014 - RNA, 15 nt, Bordetella pertussis
gcuccaugcggcggc

SEQ ID NO: 2393015 - RNA, 17 nt, Bordetella pertussis
gcuccauggcgccggcg

SEQ ID NO: 2393016 - RNA, 18 nt, Bordetella pertussis
gcucccacgaacgccacg

SEQ ID NO: 2393017 - RNA, 23 nt, Bordetella pertussis
gcucccacgaacgccacgcccgu

SEQ ID NO: 2393018 - RNA, 22 nt, Bordetella pertussis
gcucccaggaaaucaggcgcau

SEQ ID NO: 2393019 - RNA, 21 nt, Bordetella pertussis
gcucccaguucugcagcgugc

SEQ ID NO: 2393020 - RNA, 13 nt, Bordetella pertussis
gcucccccacgcc

SEQ ID NO: 2393021 - RNA, 16 nt, Bordetella pertussis
gcucccccacgccgcc

SEQ ID NO: 2393022 - RNA, 21 nt, Bordetella pertussis
gcucccccacgccgccguagc

SEQ ID NO: 2393023 - RNA, 19 nt, Bordetella pertussis
gcucccccaugcggggaca

SEQ ID NO: 2393024 - RNA, 14 nt, Bordetella pertussis
gcuccccgggcacc

SEQ ID NO: 2393025 - RNA, 16 nt, Bordetella pertussis
gcuccccugcuaaggg

SEQ ID NO: 2393026 - RNA, 14 nt, Bordetella pertussis
gcucccgcgcugcc

SEQ ID NO: 2393027 - RNA, 16 nt, Bordetella pertussis
gcucccgcgcugccgc

SEQ ID NO: 2393028 - RNA, 20 nt, Bordetella pertussis
gcucccgcgcugccgcugca

SEQ ID NO: 2393029 - RNA, 17 nt, Bordetella pertussis
gcucccgcuggcggcac

SEQ ID NO: 2393030 - RNA, 15 nt, Bordetella pertussis
gcuccgacggcugga

SEQ ID NO: 2393031 - RNA, 16 nt, Bordetella pertussis
gcuccgauagcggcgc

SEQ ID NO: 2393032 - RNA, 19 nt, Bordetella pertussis
gcuccgauagcggcgccgc

SEQ ID NO: 2393033 - RNA, 21 nt, Bordetella pertussis
gcuccgauagcggcgccgcuu

SEQ ID NO: 2393034 - RNA, 21 nt, Bordetella pertussis
gcuccgauucucaccagcgca

SEQ ID NO: 2393035 - RNA, 13 nt, Bordetella pertussis
gcuccgccaugga

SEQ ID NO: 2393036 - RNA, 21 nt, Bordetella pertussis
gcuccgccauggaggcgcagc

SEQ ID NO: 2393037 - RNA, 22 nt, Bordetella pertussis
gcuccgccauggaggcgcagcg

SEQ ID NO: 2393038 - RNA, 19 nt, Bordetella pertussis
gcuccgccauugcgccguu

SEQ ID NO: 2393039 - RNA, 19 nt, Bordetella pertussis
gcuccgcuaucauccgcgc

SEQ ID NO: 2393040 - RNA, 12 nt, Bordetella pertussis
gcuccggcggca

SEQ ID NO: 2393041 - RNA, 18 nt, Bordetella pertussis
gcuccggcggcagcgcga

SEQ ID NO: 2393042 - RNA, 20 nt, Bordetella pertussis
gcuccggcggcagcgcgaac

SEQ ID NO: 2393043 - RNA, 22 nt, Bordetella pertussis
gcuccggcggcagcgcgaacgg

SEQ ID NO: 2393044 - RNA, 23 nt, Bordetella pertussis
gcuccggcggcagcgcgaacggc

SEQ ID NO: 2393045 - RNA, 19 nt, Bordetella pertussis
gcuccggcgugacguggcc

SEQ ID NO: 2393046 - RNA, 17 nt, Bordetella pertussis
gcuccggcugcgcgcgc

SEQ ID NO: 2393047 - RNA, 20 nt, Bordetella pertussis
gcuccggcugcgcgcgcagc

SEQ ID NO: 2393048 - RNA, 15 nt, Bordetella pertussis
gcuccgggucgagcg

SEQ ID NO: 2393049 - RNA, 20 nt, Bordetella pertussis
gcuccgggucgagcgccgaa

SEQ ID NO: 2393050 - RNA, 21 nt, Bordetella pertussis
gcuccgggucgagcgccgaag

SEQ ID NO: 2393051 - RNA, 17 nt, Bordetella pertussis
gcuccgguacgccugca

SEQ ID NO: 2393052 - RNA, 18 nt, Bordetella pertussis
gcuccgguacgccugcac

SEQ ID NO: 2393053 - RNA, 19 nt, Bordetella pertussis
gcuccgguacgccugcacc

SEQ ID NO: 2393054 - RNA, 18 nt, Bordetella pertussis
gcuccggucguggccagc

SEQ ID NO: 2393055 - RNA, 18 nt, Bordetella pertussis
gcuccguuccgaugcugg

SEQ ID NO: 2393056 - RNA, 13 nt, Bordetella pertussis
gcuccuccccaac

SEQ ID NO: 2393057 - RNA, 20 nt, Bordetella pertussis
gcuccuccccaacggggacg

SEQ ID NO: 2393058 - RNA, 17 nt, Bordetella pertussis
gcuccucgaccuggguc

SEQ ID NO: 2393059 - RNA, 14 nt, Bordetella pertussis
gcggugucgcaccg

SEQ ID NO: 2393060 - RNA, 15 nt, Bordetella pertussis
gcggugucgcaccgc

SEQ ID NO: 2393061 - RNA, 16 nt, Bordetella pertussis
gcggugucgcaccgca

SEQ ID NO: 2393062 - RNA, 22 nt, Bordetella pertussis
gcggugucggacaacugcgcga

SEQ ID NO: 2393063 - RNA, 17 nt, Bordetella pertussis
gcgguguucgagccgga

SEQ ID NO: 2393064 - RNA, 20 nt, Bordetella pertussis
gcgguucaggccccggccgg

SEQ ID NO: 2393065 - RNA, 14 nt, Bordetella pertussis
gcgguucagggugg

SEQ ID NO: 2393066 - RNA, 20 nt, Bordetella pertussis
gcgguucaggguggccgcga

SEQ ID NO: 2393067 - RNA, 18 nt, Bordetella pertussis
gcgguucgucagggccgc

SEQ ID NO: 2393068 - RNA, 22 nt, Bordetella pertussis
gcgguucgucagggccgcagca

SEQ ID NO: 2393069 - RNA, 20 nt, Bordetella pertussis
gcgguucguccucgucggcc

SEQ ID NO: 2393070 - RNA, 21 nt, Bordetella pertussis
gcgguucugggcccgaucgcc

SEQ ID NO: 2393071 - RNA, 22 nt, Bordetella pertussis
gcgguucugggcccgaucgccg

SEQ ID NO: 2393072 - RNA, 23 nt, Bordetella pertussis
gcgguucugggcccgaucgccgg

SEQ ID NO: 2393073 - RNA, 18 nt, Bordetella pertussis
gcgguugaaggcgaacgg

SEQ ID NO: 2393074 - RNA, 20 nt, Bordetella pertussis
gcgguugaucagggccgcca

SEQ ID NO: 2393075 - RNA, 22 nt, Bordetella pertussis
gcgguugcccgccccgugcacc

SEQ ID NO: 2393076 - RNA, 18 nt, Bordetella pertussis
gcgguugcgaggcggccu

SEQ ID NO: 2393077 - RNA, 16 nt, Bordetella pertussis
gcgguugcgccagcuu

SEQ ID NO: 2393078 - RNA, 17 nt, Bordetella pertussis
gcgguugcgccagcuug

SEQ ID NO: 2393079 - RNA, 20 nt, Bordetella pertussis
gcgguuggccuugacggcgc

SEQ ID NO: 2393080 - RNA, 22 nt, Bordetella pertussis
gcgguuggccuugacggcgcgg

SEQ ID NO: 2393081 - RNA, 19 nt, Bordetella pertussis
gcgguuggugucgcgcagc

SEQ ID NO: 2393082 - RNA, 19 nt, Bordetella pertussis
gcgguuguugcccaccgcc

SEQ ID NO: 2393083 - RNA, 14 nt, Bordetella pertussis
gcgguuucggccgg

SEQ ID NO: 2393084 - RNA, 19 nt, Bordetella pertussis
gcgguuucuuccagcaggg

SEQ ID NO: 2393085 - RNA, 22 nt, Bordetella pertussis
gcgguuucuuccagcagggcgg

SEQ ID NO: 2393086 - RNA, 20 nt, Bordetella pertussis
gcgguuugcaggaucuccgc

SEQ ID NO: 2393087 - RNA, 18 nt, Bordetella pertussis
gcgguuugguagcaggcg

SEQ ID NO: 2393088 - RNA, 22 nt, Bordetella pertussis
gcgguuugguagcaggcgcgcu

SEQ ID NO: 2393089 - RNA, 20 nt, Bordetella pertussis
gcgguuuuucuuuggccgcg

SEQ ID NO: 2393090 - RNA, 22 nt, Bordetella pertussis
gcgguuuuucuuuggccgcgcg

SEQ ID NO: 2393091 - RNA, 20 nt, Bordetella pertussis
gcgguuuuuucuugccggcc

SEQ ID NO: 2393092 - RNA, 15 nt, Bordetella pertussis
gcguaaggccgccgg

SEQ ID NO: 2393093 - RNA, 15 nt, Bordetella pertussis
gcguaauagcuggcg

SEQ ID NO: 2393094 - RNA, 21 nt, Bordetella pertussis
gcguaauaguggucgccggcg

SEQ ID NO: 2393095 - RNA, 20 nt, Bordetella pertussis
gcguacaacgccgcguccgc

SEQ ID NO: 2393096 - RNA, 13 nt, Bordetella pertussis
gcguacagcaggg

SEQ ID NO: 2393097 - RNA, 12 nt, Bordetella pertussis
gcguacagccgg

SEQ ID NO: 2393098 - RNA, 15 nt, Bordetella pertussis
gcguacaggugcugg

SEQ ID NO: 2393099 - RNA, 15 nt, Bordetella pertussis
gcguaccagcccagu

SEQ ID NO: 2393100 - RNA, 13 nt, Bordetella pertussis
gcguaccaggcag

SEQ ID NO: 2393101 - RNA, 14 nt, Bordetella pertussis
gcguaccaggcagc

SEQ ID NO: 2393102 - RNA, 15 nt, Bordetella pertussis
gcguaccaggcagcc

SEQ ID NO: 2393103 - RNA, 17 nt, Bordetella pertussis
gcguaccaggcagccgg

SEQ ID NO: 2393104 - RNA, 18 nt, Bordetella pertussis
gcguaccaggcagccggc

SEQ ID NO: 2393105 - RNA, 19 nt, Bordetella pertussis
gcguaccaggcagccggcc

SEQ ID NO: 2393106 - RNA, 22 nt, Bordetella pertussis
gcguaccaggcagccggccccg

SEQ ID NO: 2393107 - RNA, 14 nt, Bordetella pertussis
gcguaccucgguga

SEQ ID NO: 2393108 - RNA, 23 nt, Bordetella pertussis
gcguacgacggggugccuguccc

SEQ ID NO: 2393109 - RNA, 13 nt, Bordetella pertussis
gcguacgcugcug

SEQ ID NO: 2393110 - RNA, 22 nt, Bordetella pertussis
gcguacgcuuaucgcggcgcgg

SEQ ID NO: 2393111 - RNA, 17 nt, Bordetella pertussis
gcguacggcccuggucu

SEQ ID NO: 2393112 - RNA, 20 nt, Bordetella pertussis
gcguacggcgcggugccugu

SEQ ID NO: 2393113 - RNA, 16 nt, Bordetella pertussis
gcguacguaccaggcc

SEQ ID NO: 2393114 - RNA, 17 nt, Bordetella pertussis
gcguacguggcgcggcu

SEQ ID NO: 2393115 - RNA, 17 nt, Bordetella pertussis
gcguacugcugcaagga

SEQ ID NO: 2393116 - RNA, 14 nt, Bordetella pertussis
gcgucaggccgggc

SEQ ID NO: 2393117 - RNA, 17 nt, Bordetella pertussis
gcgucaggccgggcagc

SEQ ID NO: 2393118 - RNA, 18 nt, Bordetella pertussis
gcgucaggccgggcagcg

SEQ ID NO: 2393119 - RNA, 12 nt, Bordetella pertussis
gcgucaggccgu

SEQ ID NO: 2393120 - RNA, 14 nt, Bordetella pertussis
gcgucaggcgagcg

SEQ ID NO: 2393121 - RNA, 18 nt, Bordetella pertussis
gcgucaggcgagcgcggc

SEQ ID NO: 2393122 - RNA, 21 nt, Bordetella pertussis
gcgucaggcgagcgcggcggg

SEQ ID NO: 2393123 - RNA, 15 nt, Bordetella pertussis
gcgucaggggcaugc

SEQ ID NO: 2393124 - RNA, 20 nt, Bordetella pertussis
gcgucaggggcaugccggca

SEQ ID NO: 2393125 - RNA, 21 nt, Bordetella pertussis
gcgucauacgacgcggcaugc

SEQ ID NO: 2393126 - RNA, 21 nt, Bordetella pertussis
gcgucaugcgcaccuugucgc

SEQ ID NO: 2393127 - RNA, 15 nt, Bordetella pertussis
gcgucauggccuggc

SEQ ID NO: 2393128 - RNA, 18 nt, Bordetella pertussis
gcguccaagcagacccgc

SEQ ID NO: 2393129 - RNA, 22 nt, Bordetella pertussis
gcguccaagcagacccgcgccc

SEQ ID NO: 2393130 - RNA, 15 nt, Bordetella pertussis
gcguccaccaccagg

SEQ ID NO: 2393131 - RNA, 17 nt, Bordetella pertussis
gcguccaccaccaggcc

SEQ ID NO: 2393132 - RNA, 20 nt, Bordetella pertussis
gcguccaccaccaggccggc

SEQ ID NO: 2393133 - RNA, 14 nt, Bordetella pertussis
gcguccaccgccga

SEQ ID NO: 2393134 - RNA, 23 nt, Bordetella pertussis
gcguccaccuugacgcgcaggcc

SEQ ID NO: 2393135 - RNA, 20 nt, Bordetella pertussis
gcguccacgccguggcgcaa

SEQ ID NO: 2393136 - RNA, 15 nt, Bordetella pertussis
gcguccacgcgggug

SEQ ID NO: 2393137 - RNA, 21 nt, Bordetella pertussis
gcguccacgcggguggugcug

SEQ ID NO: 2393138 - RNA, 21 nt, Bordetella pertussis
gcguccacggcaucggccagc

SEQ ID NO: 2393139 - RNA, 23 nt, Bordetella pertussis
gcucgcgucuaucaggaucaccg

SEQ ID NO: 2393140 - RNA, 17 nt, Bordetella pertussis
gcucgcugaccggcgua

SEQ ID NO: 2393141 - RNA, 15 nt, Bordetella pertussis
gcucgcugccggcgu

SEQ ID NO: 2393142 - RNA, 17 nt, Bordetella pertussis
gcucgcugucgugccgc

SEQ ID NO: 2393143 - RNA, 14 nt, Bordetella pertussis
gcucggaccuggcc

SEQ ID NO: 2393144 - RNA, 15 nt, Bordetella pertussis
gcucggaccuggcca

SEQ ID NO: 2393145 - RNA, 17 nt, Bordetella pertussis
gcucggaccuggccagc

SEQ ID NO: 2393146 - RNA, 15 nt, Bordetella pertussis
gcucggacgccgcgc

SEQ ID NO: 2393147 - RNA, 19 nt, Bordetella pertussis
gcucggagggcuccaggcu

SEQ ID NO: 2393148 - RNA, 14 nt, Bordetella pertussis
gcucggcauggcga

SEQ ID NO: 2393149 - RNA, 22 nt, Bordetella pertussis
gcucggcauggcgaucgaacgc

SEQ ID NO: 2393150 - RNA, 23 nt, Bordetella pertussis
gcucggccaaggcauuggcgccg

SEQ ID NO: 2393151 - RNA, 11 nt, Bordetella pertussis
gcucggccacc

SEQ ID NO: 2393152 - RNA, 14 nt, Bordetella pertussis
gcucggccaccgcc

SEQ ID NO: 2393153 - RNA, 17 nt, Bordetella pertussis
gcucggccacgcgcaac

SEQ ID NO: 2393154 - RNA, 19 nt, Bordetella pertussis
gcucggccacgcgcugcug

SEQ ID NO: 2393155 - RNA, 12 nt, Bordetella pertussis
gcucggccagca

SEQ ID NO: 2393156 - RNA, 14 nt, Bordetella pertussis
gcgugaacuggucc

SEQ ID NO: 2393157 - RNA, 18 nt, Bordetella pertussis
gcgugaagcccauggcgu

SEQ ID NO: 2393158 - RNA, 14 nt, Bordetella pertussis
gcgugaaggucggc

SEQ ID NO: 2393159 - RNA, 18 nt, Bordetella pertussis
gcgugaaggucggcacga

SEQ ID NO: 2393160 - RNA, 14 nt, Bordetella pertussis
gcgugaagucggcc

SEQ ID NO: 2393161 - RNA, 17 nt, Bordetella pertussis
gcgugaccacgaucaug

SEQ ID NO: 2393162 - RNA, 18 nt, Bordetella pertussis
gcguugcagccacaggcc

SEQ ID NO: 2393163 - RNA, 12 nt, Bordetella pertussis
gcguugccggcc

SEQ ID NO: 2393164 - RNA, 13 nt, Bordetella pertussis
gcguugccggccu

SEQ ID NO: 2393165 - RNA, 17 nt, Bordetella pertussis
gcguugccggugcgcgu

SEQ ID NO: 2393166 - RNA, 16 nt, Bordetella pertussis
gcguugcgcaucgcgc

SEQ ID NO: 2393167 - RNA, 13 nt, Bordetella pertussis
gcguugcgcgacu

SEQ ID NO: 2393168 - RNA, 19 nt, Bordetella pertussis
gcguugcggcagcggccca

SEQ ID NO: 2393169 - RNA, 15 nt, Bordetella pertussis
gcguugcgguagcgc

SEQ ID NO: 2393170 - RNA, 23 nt, Bordetella pertussis
gcguuggcauggcgcgugcgcgc

SEQ ID NO: 2393171 - RNA, 14 nt, Bordetella pertussis
gcguuggcggccgg

SEQ ID NO: 2393172 - RNA, 18 nt, Bordetella pertussis
gcguuggucugcaaggug

SEQ ID NO: 2393173 - RNA, 13 nt, Bordetella pertussis
gcguugugccggc

SEQ ID NO: 2393174 - RNA, 18 nt, Bordetella pertussis
gcguugugccggcgcagg

SEQ ID NO: 2393175 - RNA, 16 nt, Bordetella pertussis
gcguuucccucggugc

SEQ ID NO: 2393176 - RNA, 22 nt, Bordetella pertussis
gcguuucgaugaauuccagcca

SEQ ID NO: 2393177 - RNA, 18 nt, Bordetella pertussis
gcguuucggucagggcga

SEQ ID NO: 2393178 - RNA, 17 nt, Bordetella pertussis
gcguuugcgcgcgcgcu

SEQ ID NO: 2393179 - RNA, 22 nt, Bordetella pertussis
gcguuuucuggccuuccugcug

SEQ ID NO: 2393180 - RNA, 14 nt, Bordetella pertussis
gcuacacccugcuc

SEQ ID NO: 2393181 - RNA, 15 nt, Bordetella pertussis
gcuacaccgugcugg

SEQ ID NO: 2393182 - RNA, 17 nt, Bordetella pertussis
gcuacaccgugcuggcc

SEQ ID NO: 2393183 - RNA, 17 nt, Bordetella pertussis
gcuacagcucgccggcg

SEQ ID NO: 2393184 - RNA, 13 nt, Bordetella pertussis
gcuacagggugcc

SEQ ID NO: 2393185 - RNA, 18 nt, Bordetella pertussis
gcuacagggugccgcgcc

SEQ ID NO: 2393186 - RNA, 16 nt, Bordetella pertussis
gcuaccaggcgcgcgc

SEQ ID NO: 2393187 - RNA, 20 nt, Bordetella pertussis
gcuacccccugaccggcggc

SEQ ID NO: 2393188 - RNA, 21 nt, Bordetella pertussis
gcuacccccugaccggcggcg

SEQ ID NO: 2393189 - RNA, 23 nt, Bordetella pertussis
gcuacccccugaccggcggcguc

SEQ ID NO: 2393190 - RNA, 14 nt, Bordetella pertussis
gcuaccccggcagc

SEQ ID NO: 2393191 - RNA, 15 nt, Bordetella pertussis
gcuacgacccgcuga

SEQ ID NO: 2393192 - RNA, 24 nt, Bordetella pertussis
gcuacgaccugaauccguaagcgc

SEQ ID NO: 2393193 - RNA, 20 nt, Bordetella pertussis
gcuacgacgagaucgcgccu

SEQ ID NO: 2393194 - RNA, 21 nt, Bordetella pertussis
gcuacgcauagguaucggccc

SEQ ID NO: 2393195 - RNA, 12 nt, Bordetella pertussis
gcuacgccgccg

SEQ ID NO: 2393196 - RNA, 16 nt, Bordetella pertussis
gcuacgccgccgaugg

SEQ ID NO: 2393197 - RNA, 20 nt, Bordetella pertussis
gcuacgcgggcuugcugccc

SEQ ID NO: 2393198 - RNA, 23 nt, Bordetella pertussis
gcuacggcaagguccaggcgcgc

SEQ ID NO: 2393199 - RNA, 15 nt, Bordetella pertussis
gcuacgggcgcugca

SEQ ID NO: 2393200 - RNA, 21 nt, Bordetella pertussis
gcuagagcggcguggcgccga

SEQ ID NO: 2393201 - RNA, 12 nt, Bordetella pertussis
gcuagccaccga

SEQ ID NO: 2393202 - RNA, 15 nt, Bordetella pertussis
gcuagcugugaacug

SEQ ID NO: 2393203 - RNA, 12 nt, Bordetella pertussis
gcuaggccuugc

SEQ ID NO: 2393204 - RNA, 13 nt, Bordetella pertussis
gcuaggcgcagca

SEQ ID NO: 2393205 - RNA, 17 nt, Bordetella pertussis
gcuaggcgcagcaggcc

SEQ ID NO: 2393206 - RNA, 16 nt, Bordetella pertussis
gcuauaccgggcuggu

SEQ ID NO: 2393207 - RNA, 16 nt, Bordetella pertussis
gcuauaccgucguccu

SEQ ID NO: 2393208 - RNA, 23 nt, Bordetella pertussis
gcuauaccgucguccucggcacg

SEQ ID NO: 2393209 - RNA, 16 nt, Bordetella pertussis
gcuaucauccgcgcau

SEQ ID NO: 2393210 - RNA, 22 nt, Bordetella pertussis
gcuaucguggcuggcgaggacc

SEQ ID NO: 2393211 - RNA, 17 nt, Bordetella pertussis
gcuaugcagcugcgcca

SEQ ID NO: 2393212 - RNA, 21 nt, Bordetella pertussis
gcuaugcaggcuuugcuggcc

SEQ ID NO: 2393213 - RNA, 18 nt, Bordetella pertussis
gcuaugcgggcuugcugc

SEQ ID NO: 2393214 - RNA, 19 nt, Bordetella pertussis
gcuaugcgggcuugcugcc

SEQ ID NO: 2393215 - RNA, 20 nt, Bordetella pertussis
gcuaugcgggcuugcugccc

SEQ ID NO: 2393216 - RNA, 16 nt, Bordetella pertussis
gcuaugggggcgagcg

SEQ ID NO: 2393217 - RNA, 22 nt, Bordetella pertussis
gcuaugggggcgagcgggccgg

SEQ ID NO: 2393218 - RNA, 13 nt, Bordetella pertussis
gcuauuuuucgac

SEQ ID NO: 2393219 - RNA, 17 nt, Bordetella pertussis
gcucaaccucgacgcgc

SEQ ID NO: 2393220 - RNA, 18 nt, Bordetella pertussis
gcucaaccucgacgcgca

SEQ ID NO: 2393221 - RNA, 18 nt, Bordetella pertussis
gcucaacgaagaacagcc

SEQ ID NO: 2393222 - RNA, 23 nt, Bordetella pertussis
gcucaacgaagaacagccgcugc

SEQ ID NO: 2393223 - RNA, 16 nt, Bordetella pertussis
gcucaauucggccuga

SEQ ID NO: 2393224 - RNA, 22 nt, Bordetella pertussis
gcucacagggucaaggcgcggc

SEQ ID NO: 2393225 - RNA, 16 nt, Bordetella pertussis
gcucaccgagggccgg

SEQ ID NO: 2393226 - RNA, 23 nt, Bordetella pertussis
gcucaccgagggccggacuggcg

SEQ ID NO: 2393227 - RNA, 22 nt, Bordetella pertussis
gcucacgcccagucccaggccg

SEQ ID NO: 2393228 - RNA, 22 nt, Bordetella pertussis
gcucacggggcugucgcgcgca

SEQ ID NO: 2393229 - RNA, 21 nt, Bordetella pertussis
gcucagcaccaggccgccggc

SEQ ID NO: 2393230 - RNA, 22 nt, Bordetella pertussis
gcucagcaccaggccgccggcc

SEQ ID NO: 2393231 - RNA, 17 nt, Bordetella pertussis
gcucagcagcaccggga

SEQ ID NO: 2393232 - RNA, 14 nt, Bordetella pertussis
gcucagcagcgcca

SEQ ID NO: 2393233 - RNA, 16 nt, Bordetella pertussis
gcucagcagcgccagg

SEQ ID NO: 2393234 - RNA, 19 nt, Bordetella pertussis
gcucagcagcgccagggcc

SEQ ID NO: 2393235 - RNA, 14 nt, Bordetella pertussis
gcucagcagggucg

SEQ ID NO: 2393236 - RNA, 22 nt, Bordetella pertussis
gcucagcagggucgagaccagc

SEQ ID NO: 2393237 - RNA, 16 nt, Bordetella pertussis
gcucagcccgccuggc

SEQ ID NO: 2393238 - RNA, 15 nt, Bordetella pertussis
gcucagcccggcgag

SEQ ID NO: 2393239 - RNA, 15 nt, Bordetella pertussis
gcucagcccuugacg

SEQ ID NO: 2393240 - RNA, 20 nt, Bordetella pertussis
gcucagccgugccgcgcgca

SEQ ID NO: 2393241 - RNA, 19 nt, Bordetella pertussis
gcucagccuugucgcgggc

SEQ ID NO: 2393242 - RNA, 23 nt, Bordetella pertussis
gcucagccuugucgcgggcagug

SEQ ID NO: 2393243 - RNA, 15 nt, Bordetella pertussis
gcucagcgacgcgcg

SEQ ID NO: 2393244 - RNA, 16 nt, Bordetella pertussis
gcucagcgacgcgcgc

SEQ ID NO: 2393245 - RNA, 17 nt, Bordetella pertussis
gcucagcgacgcgcgcc

SEQ ID NO: 2393246 - RNA, 18 nt, Bordetella pertussis
gcucagcgacgcgcgccg

SEQ ID NO: 2393247 - RNA, 20 nt, Bordetella pertussis
gcucagcgacgcgcgccggc

SEQ ID NO: 2393248 - RNA, 17 nt, Bordetella pertussis
gcucagcgccaucaucg

SEQ ID NO: 2393249 - RNA, 12 nt, Bordetella pertussis
gcucagcgcgcc

SEQ ID NO: 2393250 - RNA, 15 nt, Bordetella pertussis
gcucagcgcggcgcg

SEQ ID NO: 2393251 - RNA, 18 nt, Bordetella pertussis
gcucagcgcggcgcggcc

SEQ ID NO: 2393252 - RNA, 20 nt, Bordetella pertussis
gcucagcgcggcgcggccag

SEQ ID NO: 2393253 - RNA, 15 nt, Bordetella pertussis
gcucagcgggcugcu

SEQ ID NO: 2393254 - RNA, 22 nt, Bordetella pertussis
gcucagcuuggcguacggcugc

SEQ ID NO: 2393255 - RNA, 20 nt, Bordetella pertussis
gcucaggaaccagcggcugg

SEQ ID NO: 2393256 - RNA, 22 nt, Bordetella pertussis
gcucaggaaccagcggcuggcg

SEQ ID NO: 2393257 - RNA, 23 nt, Bordetella pertussis
gcucaggaaccagcggcuggcgg

SEQ ID NO: 2393258 - RNA, 18 nt, Bordetella pertussis
gcucaggauacgugcugc

SEQ ID NO: 2393259 - RNA, 16 nt, Bordetella pertussis
gcucaggccagcgacc

SEQ ID NO: 2393260 - RNA, 20 nt, Bordetella pertussis
gcucaggccagcgacccgca

SEQ ID NO: 2393261 - RNA, 14 nt, Bordetella pertussis
gcucaggccgccgg

SEQ ID NO: 2393262 - RNA, 15 nt, Bordetella pertussis
gcucaggccgccggc

SEQ ID NO: 2393263 - RNA, 17 nt, Bordetella pertussis
gcucaggccgcugggca

SEQ ID NO: 2393264 - RNA, 15 nt, Bordetella pertussis
gcucaggccugcacg

SEQ ID NO: 2393265 - RNA, 14 nt, Bordetella pertussis
gcucaggcgcggau

SEQ ID NO: 2393266 - RNA, 13 nt, Bordetella pertussis
gcucaggcggcca

SEQ ID NO: 2393267 - RNA, 16 nt, Bordetella pertussis
gcucaggcggccaggg

SEQ ID NO: 2393268 - RNA, 16 nt, Bordetella pertussis
gcucaggcugcgcguc

SEQ ID NO: 2393269 - RNA, 17 nt, Bordetella pertussis
gcucaggcugcgcgucg

SEQ ID NO: 2393270 - RNA, 22 nt, Bordetella pertussis
gcucaggcugcgcgucggcagg

SEQ ID NO: 2393271 - RNA, 16 nt, Bordetella pertussis
gcucagggggcgcccc

SEQ ID NO: 2393272 - RNA, 21 nt, Bordetella pertussis
gcucagggggcgccccaacgc

SEQ ID NO: 2393273 - RNA, 17 nt, Bordetella pertussis
gcucagguagaccacgc

SEQ ID NO: 2393274 - RNA, 22 nt, Bordetella pertussis
gcucagguagaccacgcgcugc

SEQ ID NO: 2393275 - RNA, 20 nt, Bordetella pertussis
gcugcugggccggcgcgcgc

SEQ ID NO: 2393276 - RNA, 14 nt, Bordetella pertussis
gcugcugggcgcca

SEQ ID NO: 2393277 - RNA, 15 nt, Bordetella pertussis
gcugcugggcgccau

SEQ ID NO: 2393278 - RNA, 14 nt, Bordetella pertussis
gcugcugugcgccg

SEQ ID NO: 2393279 - RNA, 17 nt, Bordetella pertussis
gcugcuguugcgcguga

SEQ ID NO: 2393280 - RNA, 22 nt, Bordetella pertussis
gcugcuguuggcguggcuggcg

SEQ ID NO: 2393281 - RNA, 14 nt, Bordetella pertussis
gcugcuugaccuug

SEQ ID NO: 2393282 - RNA, 17 nt, Bordetella pertussis
gcugcuugaccuuggcu

SEQ ID NO: 2393283 - RNA, 14 nt, Bordetella pertussis
gcugcuugcccagg

SEQ ID NO: 2393284 - RNA, 15 nt, Bordetella pertussis
gcugcuugcccaggc

SEQ ID NO: 2393285 - RNA, 18 nt, Bordetella pertussis
gcugcuugcccaggccgg

SEQ ID NO: 2393286 - RNA, 22 nt, Bordetella pertussis
gcugcuugcccaggccggcgcg

SEQ ID NO: 2393287 - RNA, 14 nt, Bordetella pertussis
gcugcuuucccugu

SEQ ID NO: 2393288 - RNA, 22 nt, Bordetella pertussis
gcuggaaacuaaaucgcggcuc

SEQ ID NO: 2393289 - RNA, 17 nt, Bordetella pertussis
gcuggaacaccaugccc

SEQ ID NO: 2393290 - RNA, 12 nt, Bordetella pertussis
gcuggaacgcgc

SEQ ID NO: 2393291 - RNA, 16 nt, Bordetella pertussis
gcuggaacgcgccgcu

SEQ ID NO: 2393292 - RNA, 23 nt, Bordetella pertussis
gcuggccaugccgucgcgcacca

SEQ ID NO: 2393293 - RNA, 14 nt, Bordetella pertussis
gcuggcccacgccc

SEQ ID NO: 2393294 - RNA, 18 nt, Bordetella pertussis
gcuggcccacucggugcg

SEQ ID NO: 2393295 - RNA, 19 nt, Bordetella pertussis
gcuggcccacucggugcgc

SEQ ID NO: 2393296 - RNA, 23 nt, Bordetella pertussis
gcuggcccacucggugcgcgcgc

SEQ ID NO: 2393297 - RNA, 17 nt, Bordetella pertussis
gcuggcccagcugggcg

SEQ ID NO: 2393298 - RNA, 17 nt, Bordetella pertussis
gcuggcccaggaaaccg

SEQ ID NO: 2393299 - RNA, 23 nt, Bordetella pertussis
gcuggcccaguucgcgcagcagc

SEQ ID NO: 2393300 - RNA, 14 nt, Bordetella pertussis
gcuggccccagaug

SEQ ID NO: 2393301 - RNA, 12 nt, Bordetella pertussis
gcuggcccgcgc

SEQ ID NO: 2393302 - RNA, 13 nt, Bordetella pertussis
gcuggcccggguu

SEQ ID NO: 2393303 - RNA, 13 nt, Bordetella pertussis
gcuggcccgucau

SEQ ID NO: 2393304 - RNA, 22 nt, Bordetella pertussis
gcuggcccgucaugggcggggc

SEQ ID NO: 2393305 - RNA, 12 nt, Bordetella pertussis
gcuggcccuggc

SEQ ID NO: 2393306 - RNA, 20 nt, Bordetella pertussis
gcuggccgaaccauugcagg

SEQ ID NO: 2393307 - RNA, 22 nt, Bordetella pertussis
gcuggccgaaccauugcagggu

SEQ ID NO: 2393308 - RNA, 18 nt, Bordetella pertussis
gcuggccgaucaccugca

SEQ ID NO: 2393309 - RNA, 22 nt, Bordetella pertussis
gcuggccgaucaccugcaggcc

SEQ ID NO: 2393310 - RNA, 19 nt, Bordetella pertussis
gcuggccgaucugcugggc

SEQ ID NO: 2393311 - RNA, 20 nt, Bordetella pertussis
gcuggccgaucugcugggcc

SEQ ID NO: 2393312 - RNA, 23 nt, Bordetella pertussis
gcuggccgaucugcugggccggg

SEQ ID NO: 2393313 - RNA, 23 nt, Bordetella pertussis
gcuggccgaugucgccgccugcg

SEQ ID NO: 2393314 - RNA, 16 nt, Bordetella pertussis
gcuggccgccauggcg

SEQ ID NO: 2393315 - RNA, 20 nt, Bordetella pertussis
gcuggccgccauggcgcugg

SEQ ID NO: 2393316 - RNA, 23 nt, Bordetella pertussis
gcuggccgccauggcgcuggcag

SEQ ID NO: 2393317 - RNA, 15 nt, Bordetella pertussis
gcuggccgcccgcgg

SEQ ID NO: 2393318 - RNA, 12 nt, Bordetella pertussis
gcuggccgccgc

SEQ ID NO: 2393319 - RNA, 14 nt, Bordetella pertussis
gcuggccgccgcgc

SEQ ID NO: 2393320 - RNA, 16 nt, Bordetella pertussis
gcuggccgccgcgcuc

SEQ ID NO: 2393321 - RNA, 13 nt, Bordetella pertussis
gcuggccgccggc

SEQ ID NO: 2393322 - RNA, 15 nt, Bordetella pertussis
gcuggccgccggcgc

SEQ ID NO: 2393323 - RNA, 18 nt, Bordetella pertussis
gcuggccgccggcgcggu

SEQ ID NO: 2393324 - RNA, 19 nt, Bordetella pertussis
gcuggccgccggcgcggug

SEQ ID NO: 2393325 - RNA, 15 nt, Bordetella pertussis
gcuggccgccugcug

SEQ ID NO: 2393326 - RNA, 14 nt, Bordetella pertussis
cgccguacugggca

SEQ ID NO: 2393327 - RNA, 15 nt, Bordetella pertussis
cgccguagccgcugc

SEQ ID NO: 2393328 - RNA, 18 nt, Bordetella pertussis
cgccguagccgcugcgcg

SEQ ID NO: 2393329 - RNA, 23 nt, Bordetella pertussis
cgccguagccgcugcgcgcggcc

SEQ ID NO: 2393330 - RNA, 15 nt, Bordetella pertussis
cgccguagcgcgcca

SEQ ID NO: 2393331 - RNA, 16 nt, Bordetella pertussis
cgccguagcgcgccag

SEQ ID NO: 2393332 - RNA, 23 nt, Bordetella pertussis
cgccguagcgcgccagccgcgcg

SEQ ID NO: 2393333 - RNA, 14 nt, Bordetella pertussis
cgccguaggacagc

SEQ ID NO: 2393334 - RNA, 21 nt, Bordetella pertussis
cgccguaggcuugcagcuugc

SEQ ID NO: 2393335 - RNA, 23 nt, Bordetella pertussis
cgccguauagcgguacucgcgcg

SEQ ID NO: 2393336 - RNA, 17 nt, Bordetella pertussis
cgccgucaacgcccagg

SEQ ID NO: 2393337 - RNA, 15 nt, Bordetella pertussis
cgccgucagcagcgc

SEQ ID NO: 2393338 - RNA, 14 nt, Bordetella pertussis
cgccgucagcucga

SEQ ID NO: 2393339 - RNA, 12 nt, Bordetella pertussis
cgccguccagcg

SEQ ID NO: 2393340 - RNA, 16 nt, Bordetella pertussis
cgccguccagcgcggc

SEQ ID NO: 2393341 - RNA, 18 nt, Bordetella pertussis
cgccguccagcgcggcau

SEQ ID NO: 2393342 - RNA, 22 nt, Bordetella pertussis
cgccguccagcgcggcaugccg

SEQ ID NO: 2393343 - RNA, 15 nt, Bordetella pertussis
cgccguccgagcccg

SEQ ID NO: 2393344 - RNA, 16 nt, Bordetella pertussis
cgccguccgcaucgcg

SEQ ID NO: 2393345 - RNA, 19 nt, Bordetella pertussis
cgccguccgcaucgcgcaa

SEQ ID NO: 2393346 - RNA, 21 nt, Bordetella pertussis
cgccguccgugagugcagcgc

SEQ ID NO: 2393347 - RNA, 22 nt, Bordetella pertussis
cgccguccgugagugcagcgcu

SEQ ID NO: 2393348 - RNA, 15 nt, Bordetella pertussis
cgccguccucaggcc

SEQ ID NO: 2393349 - RNA, 18 nt, Bordetella pertussis
cgccguccucaggcccgc

SEQ ID NO: 2393350 - RNA, 20 nt, Bordetella pertussis
cgccguccucaggcccgcgg

SEQ ID NO: 2393351 - RNA, 22 nt, Bordetella pertussis
cgccguccucaggcccgcggcg

SEQ ID NO: 2393352 - RNA, 20 nt, Bordetella pertussis
cgccgucgaagccggcgcca

SEQ ID NO: 2393353 - RNA, 13 nt, Bordetella pertussis
cgccgucgacgcc

SEQ ID NO: 2393354 - RNA, 14 nt, Bordetella pertussis
cgccgucgacgccg

SEQ ID NO: 2393355 - RNA, 15 nt, Bordetella pertussis
cgccgucgacgccga

SEQ ID NO: 2393356 - RNA, 15 nt, Bordetella pertussis
cgccgucgacgucgg

SEQ ID NO: 2393357 - RNA, 18 nt, Bordetella pertussis
cgccgucgacgucgguga

SEQ ID NO: 2393358 - RNA, 16 nt, Bordetella pertussis
cgccgucgagcauccc

SEQ ID NO: 2393359 - RNA, 22 nt, Bordetella pertussis
cgccgucgagcaucccggcgcu

SEQ ID NO: 2393360 - RNA, 18 nt, Bordetella pertussis
cgccgucgagcugcucga

SEQ ID NO: 2393361 - RNA, 24 nt, Bordetella pertussis
cgccgucgagcugcucgagcaugc

SEQ ID NO: 2393362 - RNA, 18 nt, Bordetella pertussis
cgccgucgaucccaucgc

SEQ ID NO: 2393363 - RNA, 15 nt, Bordetella pertussis
cgccgucgcccuggc

SEQ ID NO: 2393364 - RNA, 19 nt, Bordetella pertussis
cgccgucgcccuggcggcg

SEQ ID NO: 2393365 - RNA, 18 nt, Bordetella pertussis
cgccgucgcggaccuccu

SEQ ID NO: 2393366 - RNA, 15 nt, Bordetella pertussis
cgccgucggcauagc

SEQ ID NO: 2393367 - RNA, 19 nt, Bordetella pertussis
cgccgucggcauagcaguu

SEQ ID NO: 2393368 - RNA, 17 nt, Bordetella pertussis
cgccgucgggggccggc

SEQ ID NO: 2393369 - RNA, 18 nt, Bordetella pertussis
cgccgucgggggccggcu

SEQ ID NO: 2393370 - RNA, 24 nt, Bordetella pertussis
cgccgucgggggccggcucgcccc

SEQ ID NO: 2393371 - RNA, 20 nt, Bordetella pertussis
cgccgucguugacggggacg

SEQ ID NO: 2393372 - RNA, 16 nt, Bordetella pertussis
cgccgucugcgccgcc

SEQ ID NO: 2393373 - RNA, 20 nt, Bordetella pertussis
cgccgucugugcgccccgcu

SEQ ID NO: 2393374 - RNA, 18 nt, Bordetella pertussis
cgccgucuucgguggccc

SEQ ID NO: 2393375 - RNA, 18 nt, Bordetella pertussis
cgccgugaaugcgccugg

SEQ ID NO: 2393376 - RNA, 20 nt, Bordetella pertussis
cgccgugacguugagcgccg

SEQ ID NO: 2393377 - RNA, 21 nt, Bordetella pertussis
cgccgugacguugagcgccgg

SEQ ID NO: 2393378 - RNA, 20 nt, Bordetella pertussis
cgccgugacuucggccgcca

SEQ ID NO: 2393379 - RNA, 22 nt, Bordetella pertussis
cgccgugacuucggccgccagc

SEQ ID NO: 2393380 - RNA, 18 nt, Bordetella pertussis
cgccgugaugccgcccgc

SEQ ID NO: 2393381 - RNA, 17 nt, Bordetella pertussis
cgccgugcaggcccggg

SEQ ID NO: 2393382 - RNA, 13 nt, Bordetella pertussis
cgccgugcagggc

SEQ ID NO: 2393383 - RNA, 16 nt, Bordetella pertussis
cgccgugcccggcggg

SEQ ID NO: 2393384 - RNA, 16 nt, Bordetella pertussis
cgccgugccgggccug

SEQ ID NO: 2393385 - RNA, 18 nt, Bordetella pertussis
cgccgugcgagcacggcg

SEQ ID NO: 2393386 - RNA, 23 nt, Bordetella pertussis
cgccgugcgguucgucagggccg

SEQ ID NO: 2393387 - RNA, 14 nt, Bordetella pertussis
cgccgugcugaucg

SEQ ID NO: 2393388 - RNA, 16 nt, Bordetella pertussis
cgccgugcugaucgac

SEQ ID NO: 2393389 - RNA, 17 nt, Bordetella pertussis
cgccgugcugaucgaca

SEQ ID NO: 2393390 - RNA, 23 nt, Bordetella pertussis
cgccgugcugaucgacaugcugg

SEQ ID NO: 2393391 - RNA, 13 nt, Bordetella pertussis
cgccgugcuggag

SEQ ID NO: 2393392 - RNA, 14 nt, Bordetella pertussis
cgccgugcuggagg

SEQ ID NO: 2393393 - RNA, 20 nt, Bordetella pertussis
cgccgugcuggaggugccgu

SEQ ID NO: 2393394 - RNA, 15 nt, Bordetella pertussis
cgccgugcugggcgg

SEQ ID NO: 2393395 - RNA, 18 nt, Bordetella pertussis
cgccgugcugggcggcca

SEQ ID NO: 2393396 - RNA, 24 nt, Bordetella pertussis
cgccgugcuguaccucagccugcu

SEQ ID NO: 2393397 - RNA, 13 nt, Bordetella pertussis
cgccguggccaag

SEQ ID NO: 2393398 - RNA, 15 nt, Bordetella pertussis
cgccguggccaaggg

SEQ ID NO: 2393399 - RNA, 22 nt, Bordetella pertussis
cgccguggccaagggcgccgcg

SEQ ID NO: 2393400 - RNA, 20 nt, Bordetella pertussis
cgccguggcggguccacgug

SEQ ID NO: 2393401 - RNA, 19 nt, Bordetella pertussis
cgccguggcguugacggcc

SEQ ID NO: 2393402 - RNA, 20 nt, Bordetella pertussis
cgccguggcguugacggccc

SEQ ID NO: 2393403 - RNA, 23 nt, Bordetella pertussis
cgccguggcguugacggcccagc

SEQ ID NO: 2393404 - RNA, 21 nt, Bordetella pertussis
cgccguggcuggucacgucca

SEQ ID NO: 2393405 - RNA, 22 nt, Bordetella pertussis
cgccguggcuggucacguccag

SEQ ID NO: 2393406 - RNA, 18 nt, Bordetella pertussis
cgccguggugcugaccgg

SEQ ID NO: 2393407 - RNA, 19 nt, Bordetella pertussis
cgccguggugcugaccggc

SEQ ID NO: 2393408 - RNA, 22 nt, Bordetella pertussis
cgccguggugcugaccggcuuc

SEQ ID NO: 2393409 - RNA, 23 nt, Bordetella pertussis
cgccguggugcugaccggcuucc

SEQ ID NO: 2393410 - RNA, 19 nt, Bordetella pertussis
cgccguguuguccuggaca

SEQ ID NO: 2393411 - RNA, 13 nt, Bordetella pertussis
cgccguucaugcg

SEQ ID NO: 2393412 - RNA, 16 nt, Bordetella pertussis
cgccguuccugcagcg

SEQ ID NO: 2393413 - RNA, 17 nt, Bordetella pertussis
cgccguucgucgcgcag

SEQ ID NO: 2393414 - RNA, 19 nt, Bordetella pertussis
cgccguucgucgcgcagca

SEQ ID NO: 2393415 - RNA, 15 nt, Bordetella pertussis
cgccguucucaggcc

SEQ ID NO: 2393416 - RNA, 20 nt, Bordetella pertussis
cgccguucuggcugcgcgcc

SEQ ID NO: 2393417 - RNA, 21 nt, Bordetella pertussis
cgccguucuggcugcgcgccu

SEQ ID NO: 2393418 - RNA, 23 nt, Bordetella pertussis
cgccguucuggcugcgcgccugg

SEQ ID NO: 2393419 - RNA, 21 nt, Bordetella pertussis
cgccguucuucgaucgccugg

SEQ ID NO: 2393420 - RNA, 18 nt, Bordetella pertussis
cgccguugcggcccgccg

SEQ ID NO: 2393421 - RNA, 19 nt, Bordetella pertussis
cgccguugcgggcugcgcg

SEQ ID NO: 2393422 - RNA, 15 nt, Bordetella pertussis
cgccguugcucgcgc

SEQ ID NO: 2393423 - RNA, 19 nt, Bordetella pertussis
cgccguugcucgcgcgcag

SEQ ID NO: 2393424 - RNA, 15 nt, Bordetella pertussis
cgccguugucgacga

SEQ ID NO: 2393425 - RNA, 19 nt, Bordetella pertussis
cgccguuuccaccaucagc

SEQ ID NO: 2393426 - RNA, 18 nt, Bordetella pertussis
cgccuaccaggugggcgc

SEQ ID NO: 2393427 - RNA, 13 nt, Bordetella pertussis
cgccuaccggcgc

SEQ ID NO: 2393428 - RNA, 13 nt, Bordetella pertussis
cgccuacggcggc

SEQ ID NO: 2393429 - RNA, 14 nt, Bordetella pertussis
cgccuacggcggcg

SEQ ID NO: 2393430 - RNA, 18 nt, Bordetella pertussis
cgccuacggcggcggcca

SEQ ID NO: 2393431 - RNA, 21 nt, Bordetella pertussis
cgccuacggcggcggccaucg

SEQ ID NO: 2393432 - RNA, 13 nt, Bordetella pertussis
cgccuacuggcgc

SEQ ID NO: 2393433 - RNA, 15 nt, Bordetella pertussis
cgccuacuggcgcgc

SEQ ID NO: 2393434 - RNA, 16 nt, Bordetella pertussis
cgccuacuggcgcgcg

SEQ ID NO: 2393435 - RNA, 13 nt, Bordetella pertussis
cgccuagguguga

SEQ ID NO: 2393436 - RNA, 14 nt, Bordetella pertussis
cgccuauaucgacg

SEQ ID NO: 2393437 - RNA, 17 nt, Bordetella pertussis
cgccuauaucgacggcg

SEQ ID NO: 2393438 - RNA, 18 nt, Bordetella pertussis
cgccuauaucgacggcgc

SEQ ID NO: 2393439 - RNA, 17 nt, Bordetella pertussis
cgccuauugcgacgccg

SEQ ID NO: 2393440 - RNA, 23 nt, Bordetella pertussis
cgccugcgccggguccggccgcg

SEQ ID NO: 2393441 - RNA, 13 nt, Bordetella pertussis
cgccugcgcgccg

SEQ ID NO: 2393442 - RNA, 14 nt, Bordetella pertussis
cgccugcgcgccgc

SEQ ID NO: 2393443 - RNA, 19 nt, Bordetella pertussis
cgccugcgcgccgccucga

SEQ ID NO: 2393444 - RNA, 12 nt, Bordetella pertussis
cgccugcgcgcg

SEQ ID NO: 2393445 - RNA, 19 nt, Bordetella pertussis
cgccugcgcgcgguguucg

SEQ ID NO: 2393446 - RNA, 19 nt, Bordetella pertussis
cgccugcgcggccucguag

SEQ ID NO: 2393447 - RNA, 17 nt, Bordetella pertussis
cgccugcgcggcgaucg

SEQ ID NO: 2393448 - RNA, 13 nt, Bordetella pertussis
cgccugcggcaug

SEQ ID NO: 2393449 - RNA, 17 nt, Bordetella pertussis
cgccugcggcauggugu

SEQ ID NO: 2393450 - RNA, 14 nt, Bordetella pertussis
cgccugcggcgcgg

SEQ ID NO: 2393451 - RNA, 18 nt, Bordetella pertussis
cgccugcggcgcggccga

SEQ ID NO: 2393452 - RNA, 14 nt, Bordetella pertussis
cgccugcggggccg

SEQ ID NO: 2393453 - RNA, 17 nt, Bordetella pertussis
cgccugcgucguugccc

SEQ ID NO: 2393454 - RNA, 19 nt, Bordetella pertussis
cgccugcgucguugccccg

SEQ ID NO: 2393455 - RNA, 18 nt, Bordetella pertussis
cgccugcguggcgggccg

SEQ ID NO: 2393456 - RNA, 19 nt, Bordetella pertussis
cgccugcguggcgggccgc

SEQ ID NO: 2393457 - RNA, 23 nt, Bordetella pertussis
cgccugcguggcgggccgcgccg

SEQ ID NO: 2393458 - RNA, 14 nt, Bordetella pertussis
cgccugcucacgcc

SEQ ID NO: 2393459 - RNA, 18 nt, Bordetella pertussis
cgccugcucacgccccgc

SEQ ID NO: 2393460 - RNA, 15 nt, Bordetella pertussis
cgccugcucgaccug

SEQ ID NO: 2393461 - RNA, 16 nt, Bordetella pertussis
cgccugcucgaccugc

SEQ ID NO: 2393462 - RNA, 13 nt, Bordetella pertussis
cgccugcugcaug

SEQ ID NO: 2393463 - RNA, 16 nt, Bordetella pertussis
cgccugcugcgccguc

SEQ ID NO: 2393464 - RNA, 17 nt, Bordetella pertussis
cgccugcugcgccuggc

SEQ ID NO: 2393465 - RNA, 19 nt, Bordetella pertussis
cgccugcugcgccuggccg

SEQ ID NO: 2393466 - RNA, 15 nt, Bordetella pertussis
cgccugcugggccgc

SEQ ID NO: 2393467 - RNA, 18 nt, Bordetella pertussis
cgccugcugggccgcgcu

SEQ ID NO: 2393468 - RNA, 14 nt, Bordetella pertussis
cgccugcuggucgg

SEQ ID NO: 2393469 - RNA, 15 nt, Bordetella pertussis
cgccugcuggucggc

SEQ ID NO: 2393470 - RNA, 17 nt, Bordetella pertussis
cgccugcuggucggccu

SEQ ID NO: 2393471 - RNA, 19 nt, Bordetella pertussis
cgccugcuggucggccucg

SEQ ID NO: 2393472 - RNA, 13 nt, Bordetella pertussis
cgccuggaccggc

SEQ ID NO: 2393473 - RNA, 16 nt, Bordetella pertussis
cgccuggaccggcucc

SEQ ID NO: 2393474 - RNA, 21 nt, Bordetella pertussis
cgccuggaccggcuccggccg

SEQ ID NO: 2393475 - RNA, 20 nt, Bordetella pertussis
cgccuggaccugacccccga

SEQ ID NO: 2393476 - RNA, 16 nt, Bordetella pertussis
cgccuggacggcgagg

SEQ ID NO: 2393477 - RNA, 17 nt, Bordetella pertussis
cgccuggacggcgagga

SEQ ID NO: 2393478 - RNA, 19 nt, Bordetella pertussis
cgccuggacggcgaggagg

SEQ ID NO: 2393479 - RNA, 17 nt, Bordetella pertussis
cgccuggcacgacgugg

SEQ ID NO: 2393480 - RNA, 19 nt, Bordetella pertussis
cgccuggcacgacguggcc

SEQ ID NO: 2393481 - RNA, 21 nt, Bordetella pertussis
cgccuggcccacaucgucgcg

SEQ ID NO: 2393482 - RNA, 14 nt, Bordetella pertussis
cgccuggccgagcg

SEQ ID NO: 2393483 - RNA, 18 nt, Bordetella pertussis
cgccuggccgagcgcggc

SEQ ID NO: 2393484 - RNA, 19 nt, Bordetella pertussis
cgccuggccgagcgcggca

SEQ ID NO: 2393485 - RNA, 20 nt, Bordetella pertussis
cgccuggccgagcgcggcau

SEQ ID NO: 2393486 - RNA, 21 nt, Bordetella pertussis
cgccuggccgagcgcggcaug

SEQ ID NO: 2393487 - RNA, 13 nt, Bordetella pertussis
cgccuggccgccc

SEQ ID NO: 2393488 - RNA, 13 nt, Bordetella pertussis
cgccuggccggcu

SEQ ID NO: 2393489 - RNA, 23 nt, Bordetella pertussis
cgccuggccguagcguuggcggc

SEQ ID NO: 2393490 - RNA, 14 nt, Bordetella pertussis
cgccuggccuucgc

SEQ ID NO: 2393491 - RNA, 12 nt, Bordetella pertussis
cgccuggcgccg

SEQ ID NO: 2393492 - RNA, 15 nt, Bordetella pertussis
cgccuggcgcggccc

SEQ ID NO: 2393493 - RNA, 17 nt, Bordetella pertussis
cgccuggcgcggcccca

SEQ ID NO: 2393494 - RNA, 14 nt, Bordetella pertussis
cgccuggcggcugg

SEQ ID NO: 2393495 - RNA, 15 nt, Bordetella pertussis
cgccuggcgggccug

SEQ ID NO: 2393496 - RNA, 21 nt, Bordetella pertussis
cgccuggcgggccugggcguc

SEQ ID NO: 2393497 - RNA, 23 nt, Bordetella pertussis
cgccuggcgggccugggcgucga

SEQ ID NO: 2393498 - RNA, 14 nt, Bordetella pertussis
cgccuggcugcaag

SEQ ID NO: 2393499 - RNA, 21 nt, Bordetella pertussis
cgccuggcuucccgguccagg

SEQ ID NO: 2393500 - RNA, 16 nt, Bordetella pertussis
cgccugggcggccacg

SEQ ID NO: 2393501 - RNA, 22 nt, Bordetella pertussis
cgccuggggcgggcgcugcgcg

SEQ ID NO: 2393502 - RNA, 23 nt, Bordetella pertussis
cgccuggggcgggcgcugcgcga

SEQ ID NO: 2393503 - RNA, 18 nt, Bordetella pertussis
cgccuggggggucaacca

SEQ ID NO: 2393504 - RNA, 19 nt, Bordetella pertussis
cgccugggguaggcgcggu

SEQ ID NO: 2393505 - RNA, 15 nt, Bordetella pertussis
cgccuggucgacgcc

SEQ ID NO: 2393506 - RNA, 17 nt, Bordetella pertussis
cgccuggucgacgccgg

SEQ ID NO: 2393507 - RNA, 18 nt, Bordetella pertussis
cgccuggucgacgccggc

SEQ ID NO: 2393508 - RNA, 20 nt, Bordetella pertussis
cgccuggucgacgccggcga

SEQ ID NO: 2393509 - RNA, 21 nt, Bordetella pertussis
cgccuggucgacgccggcgac

SEQ ID NO: 2393510 - RNA, 14 nt, Bordetella pertussis
cgccuggucgcgcg

SEQ ID NO: 2393511 - RNA, 15 nt, Bordetella pertussis
cgccuggucgcuggc

SEQ ID NO: 2393512 - RNA, 17 nt, Bordetella pertussis
cgccuggucgcuggcgc

SEQ ID NO: 2393513 - RNA, 19 nt, Bordetella pertussis
cgccuggucgcuggcgccg

SEQ ID NO: 2393514 - RNA, 16 nt, Bordetella pertussis
cgccuguaucagcgcc

SEQ ID NO: 2393515 - RNA, 19 nt, Bordetella pertussis
cgccuguaucagcgccugc

SEQ ID NO: 2393516 - RNA, 21 nt, Bordetella pertussis
cgccuguaucagcgccugcag

SEQ ID NO: 2393517 - RNA, 17 nt, Bordetella pertussis
cgccuguaucugcgccg

SEQ ID NO: 2393518 - RNA, 19 nt, Bordetella pertussis
cgccuguccccgcugcggc

SEQ ID NO: 2393519 - RNA, 20 nt, Bordetella pertussis
cgccuguccccgcugggaca

SEQ ID NO: 2393520 - RNA, 15 nt, Bordetella pertussis
cgccugucccgcugg

SEQ ID NO: 2393521 - RNA, 20 nt, Bordetella pertussis
cgccugucccugaacguggc

SEQ ID NO: 2393522 - RNA, 16 nt, Bordetella pertussis
cgccugugccagcugg

SEQ ID NO: 2393523 - RNA, 19 nt, Bordetella pertussis
cgccugugccagcuggccc

SEQ ID NO: 2393524 - RNA, 17 nt, Bordetella pertussis
cgccuguuuuggcgcac

SEQ ID NO: 2393525 - RNA, 18 nt, Bordetella pertussis
cgccuguuuuggcgcacg

SEQ ID NO: 2393526 - RNA, 19 nt, Bordetella pertussis
cgccuguuuuggcgcacgc

SEQ ID NO: 2393527 - RNA, 21 nt, Bordetella pertussis
cgccuguuuuggcgcacgccg

SEQ ID NO: 2393528 - RNA, 22 nt, Bordetella pertussis
cgccuguuuuggcgcacgccgg

SEQ ID NO: 2393529 - RNA, 14 nt, Bordetella pertussis
cgccuuacgcggcg

SEQ ID NO: 2393530 - RNA, 21 nt, Bordetella pertussis
cgccuuacgcggcgcgcgccu

SEQ ID NO: 2393531 - RNA, 16 nt, Bordetella pertussis
cgccuucaccggcccc

SEQ ID NO: 2393532 - RNA, 17 nt, Bordetella pertussis
cgccuucagcgggccgg

SEQ ID NO: 2393533 - RNA, 20 nt, Bordetella pertussis
cgccuucagcgggccggcac

SEQ ID NO: 2393534 - RNA, 14 nt, Bordetella pertussis
cgccuuccggcagc

SEQ ID NO: 2393535 - RNA, 14 nt, Bordetella pertussis
cgccuuccggcccc

SEQ ID NO: 2393536 - RNA, 14 nt, Bordetella pertussis
cgccuuccgggcga

SEQ ID NO: 2393537 - RNA, 15 nt, Bordetella pertussis
cgccuuccugggcgc

SEQ ID NO: 2393538 - RNA, 19 nt, Bordetella pertussis
cgccuuccugggcgccggc

SEQ ID NO: 2393539 - RNA, 21 nt, Bordetella pertussis
cgccuuccugggcgccggcgg

SEQ ID NO: 2393540 - RNA, 20 nt, Bordetella pertussis
cgccuuccuugaacugcgcg

SEQ ID NO: 2393541 - RNA, 21 nt, Bordetella pertussis
cgccuuccuugaacugcgcgg

SEQ ID NO: 2393542 - RNA, 14 nt, Bordetella pertussis
cgccuucgagcacc

SEQ ID NO: 2393543 - RNA, 15 nt, Bordetella pertussis
cgccuucgagcacca

SEQ ID NO: 2393544 - RNA, 16 nt, Bordetella pertussis
cgccuucgaggccggc

SEQ ID NO: 2393545 - RNA, 22 nt, Bordetella pertussis
cgccuucgaucuucucgccgcg

SEQ ID NO: 2393546 - RNA, 16 nt, Bordetella pertussis
cgccuucgcgauccag

SEQ ID NO: 2393547 - RNA, 15 nt, Bordetella pertussis
cgccuucgcugacgc

SEQ ID NO: 2393548 - RNA, 13 nt, Bordetella pertussis
cgccuucggcagg

SEQ ID NO: 2393549 - RNA, 17 nt, Bordetella pertussis
cgccuucggcaggcgcc

SEQ ID NO: 2393550 - RNA, 18 nt, Bordetella pertussis
cgccuucggcaggcgccg

SEQ ID NO: 2393551 - RNA, 21 nt, Bordetella pertussis
cgccuucggcaggcgccggcu

SEQ ID NO: 2393552 - RNA, 15 nt, Bordetella pertussis
cgccuucggcgcgca

SEQ ID NO: 2393553 - RNA, 18 nt, Bordetella pertussis
cgccuucggcgcgcgccg

SEQ ID NO: 2393554 - RNA, 16 nt, Bordetella pertussis
cgccuucggcgcggcg

SEQ ID NO: 2393555 - RNA, 23 nt, Bordetella pertussis
cgcgcaaaccgacgcggccagcg

SEQ ID NO: 2393556 - RNA, 18 nt, Bordetella pertussis
cgcgcaacacgcgcgacg

SEQ ID NO: 2393557 - RNA, 22 nt, Bordetella pertussis
cgcgcaacacgcgcgacgccgu

SEQ ID NO: 2393558 - RNA, 14 nt, Bordetella pertussis
cgcgcaacaggucg

SEQ ID NO: 2393559 - RNA, 20 nt, Bordetella pertussis
cgcgcaacauggugaccggg

SEQ ID NO: 2393560 - RNA, 22 nt, Bordetella pertussis
cgcgcaacauggugaccggggc

SEQ ID NO: 2393561 - RNA, 18 nt, Bordetella pertussis
cgcgcaaccaggggcggc

SEQ ID NO: 2393562 - RNA, 14 nt, Bordetella pertussis
cgcgcaacgcaugc

SEQ ID NO: 2393563 - RNA, 16 nt, Bordetella pertussis
cgcgcaacgcaugcgc

SEQ ID NO: 2393564 - RNA, 16 nt, Bordetella pertussis
cgcgcaacgccggguc

SEQ ID NO: 2393565 - RNA, 19 nt, Bordetella pertussis
cgcgcaacucggccaccug

SEQ ID NO: 2393566 - RNA, 23 nt, Bordetella pertussis
cgcgcaagagcgugugucccggc

SEQ ID NO: 2393567 - RNA, 13 nt, Bordetella pertussis
cgcgcaagccgcc

SEQ ID NO: 2393568 - RNA, 14 nt, Bordetella pertussis
cgcgcaagccgccg

SEQ ID NO: 2393569 - RNA, 15 nt, Bordetella pertussis
cgcgcaagccgccgc

SEQ ID NO: 2393570 - RNA, 14 nt, Bordetella pertussis
cgcgcaagccgcug

SEQ ID NO: 2393571 - RNA, 15 nt, Bordetella pertussis
cgcgcaagccgcugg

SEQ ID NO: 2393572 - RNA, 14 nt, Bordetella pertussis
cgcgcaaggccugc

SEQ ID NO: 2393573 - RNA, 15 nt, Bordetella pertussis
cgcgcaaggccugcu

SEQ ID NO: 2393574 - RNA, 23 nt, Bordetella pertussis
cgcgcaaggccugcucgggcgcc

SEQ ID NO: 2393575 - RNA, 18 nt, Bordetella pertussis
cgcgcaaggcggcccggc

SEQ ID NO: 2393576 - RNA, 19 nt, Bordetella pertussis
cgcgcaaggcggcccggcc

SEQ ID NO: 2393577 - RNA, 13 nt, Bordetella pertussis
cgcgcaaggcggg

SEQ ID NO: 2393578 - RNA, 15 nt, Bordetella pertussis
cgcgcaaggcgggcu

SEQ ID NO: 2393579 - RNA, 18 nt, Bordetella pertussis
cgcgcaauacgccgccgg

SEQ ID NO: 2393580 - RNA, 19 nt, Bordetella pertussis
cgcgcaauacgccgccggc

SEQ ID NO: 2393581 - RNA, 21 nt, Bordetella pertussis
cgcgcaauacgccgccggcgc

SEQ ID NO: 2393582 - RNA, 20 nt, Bordetella pertussis
cgcgcaauacgugcgcgacg

SEQ ID NO: 2393583 - RNA, 13 nt, Bordetella pertussis
cgcgcaaugcgcg

SEQ ID NO: 2393584 - RNA, 16 nt, Bordetella pertussis
cgcgcacacuggccag

SEQ ID NO: 2393585 - RNA, 16 nt, Bordetella pertussis
cgcgcacagcauggcc

SEQ ID NO: 2393586 - RNA, 18 nt, Bordetella pertussis
cgcgcacagcauggccac

SEQ ID NO: 2393587 - RNA, 13 nt, Bordetella pertussis
cgcgcacagcccg

SEQ ID NO: 2393588 - RNA, 14 nt, Bordetella pertussis
cgcgcacagcccga

SEQ ID NO: 2393589 - RNA, 12 nt, Bordetella pertussis
cgcgcacagcgc

SEQ ID NO: 2393590 - RNA, 14 nt, Bordetella pertussis
cgcgcacagcgcgc

SEQ ID NO: 2393591 - RNA, 22 nt, Bordetella pertussis
cgcgcacaggucgccgaagggc

SEQ ID NO: 2393592 - RNA, 13 nt, Bordetella pertussis
cgcgcacauccag

SEQ ID NO: 2393593 - RNA, 15 nt, Bordetella pertussis
cgcgcacauccagcc

SEQ ID NO: 2393594 - RNA, 17 nt, Bordetella pertussis
cgcgcacauccagccga

SEQ ID NO: 2393595 - RNA, 14 nt, Bordetella pertussis
cgcgcaccaccugg

SEQ ID NO: 2393596 - RNA, 12 nt, Bordetella pertussis
cgcgcaccagcc

SEQ ID NO: 2393597 - RNA, 15 nt, Bordetella pertussis
cgcgcaccagcccgc

SEQ ID NO: 2393598 - RNA, 16 nt, Bordetella pertussis
cgcgcaccagcccgcc

SEQ ID NO: 2393599 - RNA, 18 nt, Bordetella pertussis
cgcgcaccagcccgcccg

SEQ ID NO: 2393600 - RNA, 12 nt, Bordetella pertussis
cgcgcaccagcu

SEQ ID NO: 2393601 - RNA, 13 nt, Bordetella pertussis
cgcgcaccaggcc

SEQ ID NO: 2393602 - RNA, 14 nt, Bordetella pertussis
cgcgcaccaggccu

SEQ ID NO: 2393603 - RNA, 18 nt, Bordetella pertussis
cgcgcaccaggccugccu

SEQ ID NO: 2393604 - RNA, 13 nt, Bordetella pertussis
cgcgcaccaggcg

SEQ ID NO: 2393605 - RNA, 14 nt, Bordetella pertussis
cgcgcaccaggcgc

SEQ ID NO: 2393606 - RNA, 20 nt, Bordetella pertussis
cgcgcaccaggucgcggugc

SEQ ID NO: 2393607 - RNA, 12 nt, Bordetella pertussis
cgcgcaccaucg

SEQ ID NO: 2393608 - RNA, 21 nt, Bordetella pertussis
cgcgcaccaucgccgagccgc

SEQ ID NO: 2393609 - RNA, 15 nt, Bordetella pertussis
cgcgcaccaugggcg

SEQ ID NO: 2393610 - RNA, 17 nt, Bordetella pertussis
cgcgcaccaugggcguc

SEQ ID NO: 2393611 - RNA, 14 nt, Bordetella pertussis
cgcgcacccaggcc

SEQ ID NO: 2393612 - RNA, 15 nt, Bordetella pertussis
cgcgcacccaggccc

SEQ ID NO: 2393613 - RNA, 17 nt, Bordetella pertussis
cgcgcacccgcaggccg

SEQ ID NO: 2393614 - RNA, 23 nt, Bordetella pertussis
cgcgcacccgcaggccguuggcc

SEQ ID NO: 2393615 - RNA, 20 nt, Bordetella pertussis
cgcgcaccgaggugccggcg

SEQ ID NO: 2393616 - RNA, 22 nt, Bordetella pertussis
cgcgcaccgaggugccggcggu

SEQ ID NO: 2393617 - RNA, 19 nt, Bordetella pertussis
cgcgcaccgcaugggccag

SEQ ID NO: 2393618 - RNA, 15 nt, Bordetella pertussis
cgcgcaccgccugcg

SEQ ID NO: 2393619 - RNA, 17 nt, Bordetella pertussis
cgcgcaccgccugcugc

SEQ ID NO: 2393620 - RNA, 13 nt, Bordetella pertussis
cgcgcaccggcuu

SEQ ID NO: 2393621 - RNA, 19 nt, Bordetella pertussis
cgcgcaccugcugcggcac

SEQ ID NO: 2393622 - RNA, 21 nt, Bordetella pertussis
cgcgcaccugggaggggccgg

SEQ ID NO: 2393623 - RNA, 13 nt, Bordetella pertussis
cgcgcaccugggc

SEQ ID NO: 2393624 - RNA, 19 nt, Bordetella pertussis
cgcgcaccuguucggcggc

SEQ ID NO: 2393625 - RNA, 20 nt, Bordetella pertussis
cgcgcaccuguucggcggcg

SEQ ID NO: 2393626 - RNA, 23 nt, Bordetella pertussis
cgcgcaccuguucggcggcgccc

SEQ ID NO: 2393627 - RNA, 22 nt, Bordetella pertussis
cgcgcacgacgucgcgcggauc

SEQ ID NO: 2393628 - RNA, 20 nt, Bordetella pertussis
cgcgcacgauggggcagcca

SEQ ID NO: 2393629 - RNA, 14 nt, Bordetella pertussis
cgcgcacgcccgcg

SEQ ID NO: 2393630 - RNA, 16 nt, Bordetella pertussis
cgcgcacgcccgcgac

SEQ ID NO: 2393631 - RNA, 17 nt, Bordetella pertussis
cgcgcacgcccgcgacg

SEQ ID NO: 2393632 - RNA, 18 nt, Bordetella pertussis
cgcgcacgcgcucgggca

SEQ ID NO: 2393633 - RNA, 13 nt, Bordetella pertussis
cgcgcacgcgcuu

SEQ ID NO: 2393634 - RNA, 17 nt, Bordetella pertussis
cgcgcacgcuggcaucg

SEQ ID NO: 2393635 - RNA, 14 nt, Bordetella pertussis
cgcgcacgcugggc

SEQ ID NO: 2393636 - RNA, 16 nt, Bordetella pertussis
cgcgcacgcugggcga

SEQ ID NO: 2393637 - RNA, 11 nt, Bordetella pertussis
cgcgcacggcc

SEQ ID NO: 2393638 - RNA, 15 nt, Bordetella pertussis
cgcgcacggccagca

SEQ ID NO: 2393639 - RNA, 18 nt, Bordetella pertussis
cgcgcacggccagcaucg

SEQ ID NO: 2393640 - RNA, 17 nt, Bordetella pertussis
cgcgcacggcgcccugc

SEQ ID NO: 2393641 - RNA, 12 nt, Bordetella pertussis
cgcgcacgggcg

SEQ ID NO: 2393642 - RNA, 18 nt, Bordetella pertussis
cgcgcacguggaccaggg

SEQ ID NO: 2393643 - RNA, 22 nt, Bordetella pertussis
cgcgcacuuguggaccgcgaag

SEQ ID NO: 2393644 - RNA, 19 nt, Bordetella pertussis
cgcgcagaaaccgccacag

SEQ ID NO: 2393645 - RNA, 20 nt, Bordetella pertussis
cgcgcagaaaccgccacagc

SEQ ID NO: 2393646 - RNA, 13 nt, Bordetella pertussis
cgcgcagacgcgc

SEQ ID NO: 2393647 - RNA, 19 nt, Bordetella pertussis
cgcgcagacgcgcucaggc

SEQ ID NO: 2393648 - RNA, 23 nt, Bordetella pertussis
cgcgcagacgcgcucaggcggug

SEQ ID NO: 2393649 - RNA, 16 nt, Bordetella pertussis
cgcgcagaucccaggc

SEQ ID NO: 2393650 - RNA, 17 nt, Bordetella pertussis
cgcgcagaucccaggcg

SEQ ID NO: 2393651 - RNA, 19 nt, Bordetella pertussis
cgcgcagaucccaggcgcu

SEQ ID NO: 2393652 - RNA, 23 nt, Bordetella pertussis
cgcgcagaucccaggcgcucagc

SEQ ID NO: 2393653 - RNA, 13 nt, Bordetella pertussis
cgcgcagcaaccc

SEQ ID NO: 2393654 - RNA, 20 nt, Bordetella pertussis
cgcgcagcaacccgcccggg

SEQ ID NO: 2393655 - RNA, 12 nt, Bordetella pertussis
cgcgcagcaagu

SEQ ID NO: 2393656 - RNA, 22 nt, Bordetella pertussis
cgcgcagcaauucaagccgcac

SEQ ID NO: 2393657 - RNA, 13 nt, Bordetella pertussis
cgcgcagcaccgc

SEQ ID NO: 2393658 - RNA, 17 nt, Bordetella pertussis
cgcgcagcaccgccagc

SEQ ID NO: 2393659 - RNA, 20 nt, Bordetella pertussis
cgcgcagcaccgccagcgcg

SEQ ID NO: 2393660 - RNA, 17 nt, Bordetella pertussis
cgcgcagcaccggcgug

SEQ ID NO: 2393661 - RNA, 23 nt, Bordetella pertussis
cgcgcagcaccggcgugagcgcc

SEQ ID NO: 2393662 - RNA, 12 nt, Bordetella pertussis
cgcgcagcaccu

SEQ ID NO: 2393663 - RNA, 14 nt, Bordetella pertussis
cgcgcagcacgaug

SEQ ID NO: 2393664 - RNA, 13 nt, Bordetella pertussis
cgcgcagcacgcc

SEQ ID NO: 2393665 - RNA, 14 nt, Bordetella pertussis
cgcgcagcacgccg

SEQ ID NO: 2393666 - RNA, 15 nt, Bordetella pertussis
cgcgcagcacgcugc

SEQ ID NO: 2393667 - RNA, 21 nt, Bordetella pertussis
cgcgcagcagacgcuucaggc

SEQ ID NO: 2393668 - RNA, 14 nt, Bordetella pertussis
cgcgcagcagcgca

SEQ ID NO: 2393669 - RNA, 16 nt, Bordetella pertussis
cgcgcagcagcgcaac

SEQ ID NO: 2393670 - RNA, 19 nt, Bordetella pertussis
cgcgcagcagcuugccgac

SEQ ID NO: 2393671 - RNA, 15 nt, Bordetella pertussis
cggccaggucggcgu

SEQ ID NO: 2393672 - RNA, 16 nt, Bordetella pertussis
cggccaggucggcguc

SEQ ID NO: 2393673 - RNA, 20 nt, Bordetella pertussis
cggccaggucggcgucgucg

SEQ ID NO: 2393674 - RNA, 22 nt, Bordetella pertussis
cggccaggucggcgucgucgug

SEQ ID NO: 2393675 - RNA, 12 nt, Bordetella pertussis
cggccaggugcg

SEQ ID NO: 2393676 - RNA, 20 nt, Bordetella pertussis
cggccaguacgucggacagg

SEQ ID NO: 2393677 - RNA, 21 nt, Bordetella pertussis
cggccaguacgucggacaggg

SEQ ID NO: 2393678 - RNA, 13 nt, Bordetella pertussis
cggccaguccacc

SEQ ID NO: 2393679 - RNA, 15 nt, Bordetella pertussis
cggccagucgcggug

SEQ ID NO: 2393680 - RNA, 16 nt, Bordetella pertussis
cggccaguggcgcggc

SEQ ID NO: 2393681 - RNA, 16 nt, Bordetella pertussis
cggccaguucgacgcc

SEQ ID NO: 2393682 - RNA, 20 nt, Bordetella pertussis
cggccaguucgacgcccaug

SEQ ID NO: 2393683 - RNA, 14 nt, Bordetella pertussis
cggccaucacgccg

SEQ ID NO: 2393684 - RNA, 15 nt, Bordetella pertussis
cggccaucacgccga

SEQ ID NO: 2393685 - RNA, 14 nt, Bordetella pertussis
cggccauccggcca

SEQ ID NO: 2393686 - RNA, 15 nt, Bordetella pertussis
cggccaucgccaugg

SEQ ID NO: 2393687 - RNA, 18 nt, Bordetella pertussis
cggccaucgccauggcca

SEQ ID NO: 2393688 - RNA, 13 nt, Bordetella pertussis
cggccaucgggcu

SEQ ID NO: 2393689 - RNA, 19 nt, Bordetella pertussis
cggccaucgggcugcggau

SEQ ID NO: 2393690 - RNA, 17 nt, Bordetella pertussis
cggccaucuuggugcgc

SEQ ID NO: 2393691 - RNA, 21 nt, Bordetella pertussis
cggccaucuuggugcgcgcca

SEQ ID NO: 2393692 - RNA, 14 nt, Bordetella pertussis
cggccaugcccagg

SEQ ID NO: 2393693 - RNA, 15 nt, Bordetella pertussis
cggccaugcccaggc

SEQ ID NO: 2393694 - RNA, 16 nt, Bordetella pertussis
cggccaugcccaggcc

SEQ ID NO: 2393695 - RNA, 17 nt, Bordetella pertussis
cggccaugcccaggccc

SEQ ID NO: 2393696 - RNA, 15 nt, Bordetella pertussis
cggccaugccgacgg

SEQ ID NO: 2393697 - RNA, 15 nt, Bordetella pertussis
cggccaugcgcgcca

SEQ ID NO: 2393698 - RNA, 17 nt, Bordetella pertussis
cggccaugcgcgccagc

SEQ ID NO: 2393699 - RNA, 16 nt, Bordetella pertussis
cggccaugcggugcgc

SEQ ID NO: 2393700 - RNA, 18 nt, Bordetella pertussis
cggccaugcggugcgccg

SEQ ID NO: 2393701 - RNA, 21 nt, Bordetella pertussis
cggccaugcggugcgccgcgu

SEQ ID NO: 2393702 - RNA, 14 nt, Bordetella pertussis
cggccaugcucagc

SEQ ID NO: 2393703 - RNA, 16 nt, Bordetella pertussis
cggccaugcucagcag

SEQ ID NO: 2393704 - RNA, 18 nt, Bordetella pertussis
cggccaugcucagcagca

SEQ ID NO: 2393705 - RNA, 20 nt, Bordetella pertussis
cggccauggcccuugccgcc

SEQ ID NO: 2393706 - RNA, 17 nt, Bordetella pertussis
cggccauggcggccggc

SEQ ID NO: 2393707 - RNA, 17 nt, Bordetella pertussis
cggccauggcggugaaa

SEQ ID NO: 2393708 - RNA, 17 nt, Bordetella pertussis
cggccauguagauggcc

SEQ ID NO: 2393709 - RNA, 22 nt, Bordetella pertussis
cggccauguagauggccgccuu

SEQ ID NO: 2393710 - RNA, 17 nt, Bordetella pertussis
cggcccaaggccccgcg

SEQ ID NO: 2393711 - RNA, 16 nt, Bordetella pertussis
cggcccacagcgcccc

SEQ ID NO: 2393712 - RNA, 20 nt, Bordetella pertussis
cggcccacgcugucggggug

SEQ ID NO: 2393713 - RNA, 15 nt, Bordetella pertussis
cggcccacggccagc

SEQ ID NO: 2393714 - RNA, 18 nt, Bordetella pertussis
cggcccacggccagcacu

SEQ ID NO: 2393715 - RNA, 15 nt, Bordetella pertussis
cggcccagcacgccg

SEQ ID NO: 2393716 - RNA, 18 nt, Bordetella pertussis
cggcccagcacgccgcgc

SEQ ID NO: 2393717 - RNA, 19 nt, Bordetella pertussis
cggcccagcacgccgcgcu

SEQ ID NO: 2393718 - RNA, 14 nt, Bordetella pertussis
cggcccagcaugcc

SEQ ID NO: 2393719 - RNA, 16 nt, Bordetella pertussis
cggcccagcaugccga

SEQ ID NO: 2393720 - RNA, 18 nt, Bordetella pertussis
cggcccagcaugccgaug

SEQ ID NO: 2393721 - RNA, 14 nt, Bordetella pertussis
cggcccagccgcuc

SEQ ID NO: 2393722 - RNA, 17 nt, Bordetella pertussis
cggcccagcgcggcggc

SEQ ID NO: 2393723 - RNA, 13 nt, Bordetella pertussis
cggcccagcggca

SEQ ID NO: 2393724 - RNA, 15 nt, Bordetella pertussis
cggcccagcggcaaa

SEQ ID NO: 2393725 - RNA, 18 nt, Bordetella pertussis
cggcccagcucuggucca

SEQ ID NO: 2393726 - RNA, 22 nt, Bordetella pertussis
cggcccagcucugguccaggcg

SEQ ID NO: 2393727 - RNA, 17 nt, Bordetella pertussis
cggcccaggauggcgcc

SEQ ID NO: 2393728 - RNA, 18 nt, Bordetella pertussis
cggcccaggauggcgcca

SEQ ID NO: 2393729 - RNA, 20 nt, Bordetella pertussis
cggcccaggauggcgccagc

SEQ ID NO: 2393730 - RNA, 22 nt, Bordetella pertussis
cggcccaggauggcgccagccc

SEQ ID NO: 2393731 - RNA, 13 nt, Bordetella pertussis
cggcccaggccgg

SEQ ID NO: 2393732 - RNA, 14 nt, Bordetella pertussis
cggcccaggccggg

SEQ ID NO: 2393733 - RNA, 13 nt, Bordetella pertussis
cggcccaggcgcg

SEQ ID NO: 2393734 - RNA, 14 nt, Bordetella pertussis
cggcccaggcgcgc

SEQ ID NO: 2393735 - RNA, 18 nt, Bordetella pertussis
cggcccaggcguccaggc

SEQ ID NO: 2393736 - RNA, 16 nt, Bordetella pertussis
cggcccaggucaucgc

SEQ ID NO: 2393737 - RNA, 17 nt, Bordetella pertussis
cggcccaggucaucgcc

SEQ ID NO: 2393738 - RNA, 14 nt, Bordetella pertussis
cggcccaguccagg

SEQ ID NO: 2393739 - RNA, 22 nt, Bordetella pertussis
cggcccaucuguacggccggcu

SEQ ID NO: 2393740 - RNA, 21 nt, Bordetella pertussis
cggcccauugcggcaccugcu

SEQ ID NO: 2393741 - RNA, 22 nt, Bordetella pertussis
cggcccauugcggcaccugcug

SEQ ID NO: 2393742 - RNA, 15 nt, Bordetella pertussis
cggccccaccuggcg

SEQ ID NO: 2393743 - RNA, 17 nt, Bordetella pertussis
cggccccaccuggcggu

SEQ ID NO: 2393744 - RNA, 20 nt, Bordetella pertussis
cggccccaggaugcgcaccg

SEQ ID NO: 2393745 - RNA, 15 nt, Bordetella pertussis
cggccccaggccggg

SEQ ID NO: 2393746 - RNA, 16 nt, Bordetella pertussis
cggccccaggccgggu

SEQ ID NO: 2393747 - RNA, 14 nt, Bordetella pertussis
cggccccagguaga

SEQ ID NO: 2393748 - RNA, 15 nt, Bordetella pertussis
cggccccagguagac

SEQ ID NO: 2393749 - RNA, 17 nt, Bordetella pertussis
cggccccagucgcugcu

SEQ ID NO: 2393750 - RNA, 18 nt, Bordetella pertussis
cggccccagucgcugcuc

SEQ ID NO: 2393751 - RNA, 18 nt, Bordetella pertussis
cggccccaugcgcggcac

SEQ ID NO: 2393752 - RNA, 14 nt, Bordetella pertussis
cggccccaugucga

SEQ ID NO: 2393753 - RNA, 14 nt, Bordetella pertussis
cggccccgccaggg

SEQ ID NO: 2393754 - RNA, 20 nt, Bordetella pertussis
cggccccgccagggcggggc

SEQ ID NO: 2393755 - RNA, 22 nt, Bordetella pertussis
cggccccgccagggcggggccg

SEQ ID NO: 2393756 - RNA, 15 nt, Bordetella pertussis
cggccccgcgucggc

SEQ ID NO: 2393757 - RNA, 18 nt, Bordetella pertussis
cggccccggccgcccccg

SEQ ID NO: 2393758 - RNA, 19 nt, Bordetella pertussis
cggccccggcucccgcgcc

SEQ ID NO: 2393759 - RNA, 20 nt, Bordetella pertussis
cggccccggcucccgcgcca

SEQ ID NO: 2393760 - RNA, 14 nt, Bordetella pertussis
cggccccguccuua

SEQ ID NO: 2393761 - RNA, 22 nt, Bordetella pertussis
cggccccguugucgccgcggcc

SEQ ID NO: 2393762 - RNA, 11 nt, Bordetella pertussis
cggcccgccac

SEQ ID NO: 2393763 - RNA, 16 nt, Bordetella pertussis
cggcccgccacgcagg

SEQ ID NO: 2393764 - RNA, 13 nt, Bordetella pertussis
cggcccgccaggg

SEQ ID NO: 2393765 - RNA, 15 nt, Bordetella pertussis
cggcccgccagggcg

SEQ ID NO: 2393766 - RNA, 17 nt, Bordetella pertussis
cggcccgcccgcccugg

SEQ ID NO: 2393767 - RNA, 16 nt, Bordetella pertussis
cggcccgccucgagcg

SEQ ID NO: 2393768 - RNA, 17 nt, Bordetella pertussis
cggcccgcgccagcgcc

SEQ ID NO: 2393769 - RNA, 13 nt, Bordetella pertussis
cggcccgcgcugu

SEQ ID NO: 2393770 - RNA, 13 nt, Bordetella pertussis
cggcccgcggccu

SEQ ID NO: 2393771 - RNA, 19 nt, Bordetella pertussis
cggcccgcggccuuggucg

SEQ ID NO: 2393772 - RNA, 13 nt, Bordetella pertussis
cggcccgcuccag

SEQ ID NO: 2393773 - RNA, 19 nt, Bordetella pertussis
cggcccgcuccaggcggcc

SEQ ID NO: 2393774 - RNA, 20 nt, Bordetella pertussis
cggcccgcuccaggcggcca

SEQ ID NO: 2393775 - RNA, 14 nt, Bordetella pertussis
cggcccggccaagc

SEQ ID NO: 2393776 - RNA, 12 nt, Bordetella pertussis
cggcccggccgc

SEQ ID NO: 2393777 - RNA, 15 nt, Bordetella pertussis
cggcccggcgccggu

SEQ ID NO: 2393778 - RNA, 18 nt, Bordetella pertussis
cggcccggcgccgguggg

SEQ ID NO: 2393779 - RNA, 15 nt, Bordetella pertussis
cggcccggcggcaaa

SEQ ID NO: 2393780 - RNA, 19 nt, Bordetella pertussis
cggcccggcgggccggcuc

SEQ ID NO: 2393781 - RNA, 12 nt, Bordetella pertussis
cggcccgggcga

SEQ ID NO: 2393782 - RNA, 19 nt, Bordetella pertussis
cggcccgggcgagauggcg

SEQ ID NO: 2393783 - RNA, 20 nt, Bordetella pertussis
cggcccgggcgagauggcgu

SEQ ID NO: 2393784 - RNA, 17 nt, Bordetella pertussis
cggcccgggcguggcgu

SEQ ID NO: 2393785 - RNA, 15 nt, Bordetella pertussis
cggcccgggugggcg

SEQ ID NO: 2393786 - RNA, 17 nt, Bordetella pertussis
cggcccgggugggcggc

SEQ ID NO: 2393787 - RNA, 21 nt, Bordetella pertussis
cggccaggccggcgcgccggc

SEQ ID NO: 2393788 - RNA, 13 nt, Bordetella pertussis
cggccaggccggg

SEQ ID NO: 2393789 - RNA, 15 nt, Bordetella pertussis
cggccaggccggggc

SEQ ID NO: 2393790 - RNA, 23 nt, Bordetella pertussis
cggccaggccggggccguggucg

SEQ ID NO: 2393791 - RNA, 13 nt, Bordetella pertussis
cggccaggccggu

SEQ ID NO: 2393792 - RNA, 14 nt, Bordetella pertussis
cggccaggccggug

SEQ ID NO: 2393793 - RNA, 16 nt, Bordetella pertussis
cggccaggccgguggg

SEQ ID NO: 2393794 - RNA, 13 nt, Bordetella pertussis
cggccaggcgcca

SEQ ID NO: 2393795 - RNA, 13 nt, Bordetella pertussis
cggccaggcgccg

SEQ ID NO: 2393796 - RNA, 15 nt, Bordetella pertussis
cggccaggcgccgcu

SEQ ID NO: 2393797 - RNA, 17 nt, Bordetella pertussis
cggccaggcgccgcuca

SEQ ID NO: 2393798 - RNA, 18 nt, Bordetella pertussis
cggccaggcgccgcucag

SEQ ID NO: 2393799 - RNA, 21 nt, Bordetella pertussis
cggccaggcgccgcucagcgc

SEQ ID NO: 2393800 - RNA, 17 nt, Bordetella pertussis
cggccaggcgccugagc

SEQ ID NO: 2393801 - RNA, 12 nt, Bordetella pertussis
cggccaggcgcg

SEQ ID NO: 2393802 - RNA, 13 nt, Bordetella pertussis
cggccaggcgcgc

SEQ ID NO: 2393803 - RNA, 22 nt, Bordetella pertussis
cggccaggcgcgccgcgauggc

SEQ ID NO: 2393804 - RNA, 16 nt, Bordetella pertussis
cggccaggcgcucagc

SEQ ID NO: 2393805 - RNA, 15 nt, Bordetella pertussis
cggccaggcgcugcg

SEQ ID NO: 2393806 - RNA, 16 nt, Bordetella pertussis
cggccaggcgcugcgc

SEQ ID NO: 2393807 - RNA, 12 nt, Bordetella pertussis
cggccaggcggg

SEQ ID NO: 2393808 - RNA, 16 nt, Bordetella pertussis
cggccaggcggggugg

SEQ ID NO: 2393809 - RNA, 22 nt, Bordetella pertussis
cggccaggcgggguggcacagc

SEQ ID NO: 2393810 - RNA, 14 nt, Bordetella pertussis
cggccaggcucugg

SEQ ID NO: 2393811 - RNA, 17 nt, Bordetella pertussis
cggccaggcucugggcg

SEQ ID NO: 2393812 - RNA, 19 nt, Bordetella pertussis
cggccagggaaggggcggc

SEQ ID NO: 2393813 - RNA, 15 nt, Bordetella pertussis
cggccagggaggcga

SEQ ID NO: 2393814 - RNA, 20 nt, Bordetella pertussis
cggccagggcaagcgcgucg

SEQ ID NO: 2393815 - RNA, 12 nt, Bordetella pertussis
cggccagggcca

SEQ ID NO: 2393816 - RNA, 15 nt, Bordetella pertussis
cggccagggccacca

SEQ ID NO: 2393817 - RNA, 17 nt, Bordetella pertussis
cggccagggccugcggg

SEQ ID NO: 2393818 - RNA, 20 nt, Bordetella pertussis
cggccagggccugcgggccg

SEQ ID NO: 2393819 - RNA, 21 nt, Bordetella pertussis
cggccagggccugcgggccgg

SEQ ID NO: 2393820 - RNA, 18 nt, Bordetella pertussis
cggccagggcgaugcggc

SEQ ID NO: 2393821 - RNA, 19 nt, Bordetella pertussis
cggccagggcgaugcggcg

SEQ ID NO: 2393822 - RNA, 21 nt, Bordetella pertussis
cggccagggcgaugcggcggc

SEQ ID NO: 2393823 - RNA, 13 nt, Bordetella pertussis
cggccagggcggc

SEQ ID NO: 2393824 - RNA, 19 nt, Bordetella pertussis
cggccagggcggcgacuuc

SEQ ID NO: 2393825 - RNA, 23 nt, Bordetella pertussis
cggccagggcggcgacuucgccg

SEQ ID NO: 2393826 - RNA, 20 nt, Bordetella pertussis
cggccaggggcagcucggug

SEQ ID NO: 2393827 - RNA, 14 nt, Bordetella pertussis
cggccaggggcgcu

SEQ ID NO: 2393828 - RNA, 15 nt, Bordetella pertussis
cggccaggggcgcug

SEQ ID NO: 2393829 - RNA, 16 nt, Bordetella pertussis
cggccaggggcgcugg

SEQ ID NO: 2393830 - RNA, 18 nt, Bordetella pertussis
cggccaggggcgcugguc

SEQ ID NO: 2393831 - RNA, 20 nt, Bordetella pertussis
cggccaggggcgcuggucga

SEQ ID NO: 2393832 - RNA, 18 nt, Bordetella pertussis
cggccagggucaggggca

SEQ ID NO: 2393833 - RNA, 19 nt, Bordetella pertussis
cggccagggugccccgccg

SEQ ID NO: 2393834 - RNA, 17 nt, Bordetella pertussis
cggccaggucgcgcauc

SEQ ID NO: 2393835 - RNA, 21 nt, Bordetella pertussis
cggccaggucgcgcaucaccu

SEQ ID NO: 2393836 - RNA, 14 nt, Bordetella pertussis
cggccaggucggcg

SEQ ID NO: 2393837 - RNA, 18 nt, Bordetella pertussis
cggccaggucggcggcca

SEQ ID NO: 2393838 - RNA, 20 nt, Bordetella pertussis
cggccaggucggcggccagc

SEQ ID NO: 2393839 - RNA, 18 nt, Bordetella pertussis
cggcccgggugggcggca

SEQ ID NO: 2393840 - RNA, 21 nt, Bordetella pertussis
cggcccgggugggcggcaucg

SEQ ID NO: 2393841 - RNA, 15 nt, Bordetella pertussis
cggcccggugcagcc

SEQ ID NO: 2393842 - RNA, 17 nt, Bordetella pertussis
cggcccggugcagccgc

SEQ ID NO: 2393843 - RNA, 19 nt, Bordetella pertussis
cggcccggugcagccgccg

SEQ ID NO: 2393844 - RNA, 22 nt, Bordetella pertussis
cggcccggugcagccgccgcag

SEQ ID NO: 2393845 - RNA, 23 nt, Bordetella pertussis
cggcccggugcagccgccgcagg

SEQ ID NO: 2393846 - RNA, 13 nt, Bordetella pertussis
cggcccguagcug

SEQ ID NO: 2393847 - RNA, 16 nt, Bordetella pertussis
cggcccgugccacggc

SEQ ID NO: 2393848 - RNA, 16 nt, Bordetella pertussis
cggcccgugcgcaacg

SEQ ID NO: 2393849 - RNA, 21 nt, Bordetella pertussis
cggcccguuggcaggccagca

SEQ ID NO: 2393850 - RNA, 13 nt, Bordetella pertussis
cggcccugcagga

SEQ ID NO: 2393851 - RNA, 17 nt, Bordetella pertussis
cggcccugccgcccugg

SEQ ID NO: 2393852 - RNA, 18 nt, Bordetella pertussis
cggcccugccgcccuggc

SEQ ID NO: 2393853 - RNA, 14 nt, Bordetella pertussis
cggcccuggcaagg

SEQ ID NO: 2393854 - RNA, 17 nt, Bordetella pertussis
cggcccugggccagcca

SEQ ID NO: 2393855 - RNA, 22 nt, Bordetella pertussis
cggcccugggccagccagcgcc

SEQ ID NO: 2393856 - RNA, 17 nt, Bordetella pertussis
cggcccugggcgcggcg

SEQ ID NO: 2393857 - RNA, 13 nt, Bordetella pertussis
cggcccuggucuu

SEQ ID NO: 2393858 - RNA, 19 nt, Bordetella pertussis
cggcccugucggccgaacc

SEQ ID NO: 2393859 - RNA, 18 nt, Bordetella pertussis
cggcccuguucgcgcggc

SEQ ID NO: 2393860 - RNA, 16 nt, Bordetella pertussis
cggcccuugcgcgaag

SEQ ID NO: 2393861 - RNA, 19 nt, Bordetella pertussis
cggcccuugcgcgaaggcc

SEQ ID NO: 2393862 - RNA, 21 nt, Bordetella pertussis
cggcccuugcgcgaaggccgc

SEQ ID NO: 2393863 - RNA, 23 nt, Bordetella pertussis
cggcccuugcgcgaaggccgccc

SEQ ID NO: 2393864 - RNA, 20 nt, Bordetella pertussis
cggccgaaaccgccgcggcu

SEQ ID NO: 2393865 - RNA, 21 nt, Bordetella pertussis
cggccgaaaccgccgcggcuu

SEQ ID NO: 2393866 - RNA, 23 nt, Bordetella pertussis
cggccgaaaccgccgcggcuugc

SEQ ID NO: 2393867 - RNA, 14 nt, Bordetella pertussis
cggccgaaccgcgc

SEQ ID NO: 2393868 - RNA, 15 nt, Bordetella pertussis
cggccgaaccgcgca

SEQ ID NO: 2393869 - RNA, 20 nt, Bordetella pertussis
cggccgaaccgcgcagccgc

SEQ ID NO: 2393870 - RNA, 16 nt, Bordetella pertussis
cggccgaagcgcaagc

SEQ ID NO: 2393871 - RNA, 13 nt, Bordetella pertussis
cggccgacagcuu

SEQ ID NO: 2393872 - RNA, 15 nt, Bordetella pertussis
cggccgacagguggu

SEQ ID NO: 2393873 - RNA, 12 nt, Bordetella pertussis
cggccgaccacu

SEQ ID NO: 2393874 - RNA, 13 nt, Bordetella pertussis
cggccgaccagca

SEQ ID NO: 2393875 - RNA, 14 nt, Bordetella pertussis
cggccgacccgcgg

SEQ ID NO: 2393876 - RNA, 20 nt, Bordetella pertussis
cggccgacccgcggcccuug

SEQ ID NO: 2393877 - RNA, 17 nt, Bordetella pertussis
cggccgaccggcgcgcg

SEQ ID NO: 2393878 - RNA, 19 nt, Bordetella pertussis
cggccgaccggcgcgcgcg

SEQ ID NO: 2393879 - RNA, 16 nt, Bordetella pertussis
cggccgacggcgcugg

SEQ ID NO: 2393880 - RNA, 22 nt, Bordetella pertussis
cggccgacgggcggcugcuggc

SEQ ID NO: 2393881 - RNA, 22 nt, Bordetella pertussis
cggccgacguggaccgcgcggu

SEQ ID NO: 2393882 - RNA, 19 nt, Bordetella pertussis
cggccgacucgaaacgggc

SEQ ID NO: 2393883 - RNA, 15 nt, Bordetella pertussis
cggccgacugcugua

SEQ ID NO: 2393884 - RNA, 23 nt, Bordetella pertussis
cggccgacugcuguacgacagca

SEQ ID NO: 2393885 - RNA, 19 nt, Bordetella pertussis
cggccgagaacgccgucgg

SEQ ID NO: 2393886 - RNA, 20 nt, Bordetella pertussis
cggccgagaacgccgucggg

SEQ ID NO: 2393887 - RNA, 23 nt, Bordetella pertussis
cggccgagaacgccgucggggug

SEQ ID NO: 2393888 - RNA, 13 nt, Bordetella pertussis
cggccgagcgggc

SEQ ID NO: 2393889 - RNA, 14 nt, Bordetella pertussis
cggccgagcgggcc

SEQ ID NO: 2393890 - RNA, 21 nt, Bordetella pertussis
cggccgagcgggccagcgcgg

SEQ ID NO: 2393891 - RNA, 23 nt, Bordetella pertussis
cggccgagcgggccagcgcggcc

SEQ ID NO: 2393892 - RNA, 14 nt, Bordetella pertussis
cggccgaggucggc

SEQ ID NO: 2393893 - RNA, 12 nt, Bordetella pertussis
cggccgauagcc

SEQ ID NO: 2393894 - RNA, 17 nt, Bordetella pertussis
cggccgauagccgcggc

SEQ ID NO: 2393895 - RNA, 17 nt, Bordetella pertussis
cggccucaaccgcgcgu

SEQ ID NO: 2393896 - RNA, 13 nt, Bordetella pertussis
cggccucagcggc

SEQ ID NO: 2393897 - RNA, 17 nt, Bordetella pertussis
cggccucagcggccgcu

SEQ ID NO: 2393898 - RNA, 13 nt, Bordetella pertussis
cggccucaucccg

SEQ ID NO: 2393899 - RNA, 20 nt, Bordetella pertussis
cggccucaucgagcgccugg

SEQ ID NO: 2393900 - RNA, 12 nt, Bordetella pertussis
cggccuccagca

SEQ ID NO: 2393901 - RNA, 16 nt, Bordetella pertussis
cggccucccgccgccc

SEQ ID NO: 2393902 - RNA, 18 nt, Bordetella pertussis
cggccucccgccgcccgg

SEQ ID NO: 2393903 - RNA, 14 nt, Bordetella pertussis
cggccucccggacc

SEQ ID NO: 2393904 - RNA, 19 nt, Bordetella pertussis
cggccucccgucgucgucc

SEQ ID NO: 2393905 - RNA, 12 nt, Bordetella pertussis
cggccuccgcgc

SEQ ID NO: 2393906 - RNA, 14 nt, Bordetella pertussis
cggccuccgcgcac

SEQ ID NO: 2393907 - RNA, 16 nt, Bordetella pertussis
cggccuccgcgcacag

SEQ ID NO: 2393908 - RNA, 13 nt, Bordetella pertussis
cggccuccgcgcc

SEQ ID NO: 2393909 - RNA, 14 nt, Bordetella pertussis
cggccuccgcgccg

SEQ ID NO: 2393910 - RNA, 14 nt, Bordetella pertussis
cggccucgacggcc

SEQ ID NO: 2393911 - RNA, 18 nt, Bordetella pertussis
cggccucgacggccgccg

SEQ ID NO: 2393912 - RNA, 11 nt, Bordetella pertussis
cggccucgccc

SEQ ID NO: 2393913 - RNA, 15 nt, Bordetella pertussis
cggccucgcccaugc

SEQ ID NO: 2393914 - RNA, 20 nt, Bordetella pertussis
cggccucgcccaugcgggcg

SEQ ID NO: 2393915 - RNA, 21 nt, Bordetella pertussis
cggccucgcccaugcgggcgu

SEQ ID NO: 2393916 - RNA, 16 nt, Bordetella pertussis
cggccucgccggccug

SEQ ID NO: 2393917 - RNA, 18 nt, Bordetella pertussis
cggccucgccggccuggc

SEQ ID NO: 2393918 - RNA, 16 nt, Bordetella pertussis
cggccucgcgcagggc

SEQ ID NO: 2393919 - RNA, 19 nt, Bordetella pertussis
cggccucgcgcagggcggc

SEQ ID NO: 2393920 - RNA, 21 nt, Bordetella pertussis
cggccucgcggcgcagcauga

SEQ ID NO: 2393921 - RNA, 15 nt, Bordetella pertussis
cggccucgcugcggg

SEQ ID NO: 2393922 - RNA, 16 nt, Bordetella pertussis
cggccucgcugcgggc

SEQ ID NO: 2393923 - RNA, 17 nt, Bordetella pertussis
cggccucggccagcugg

SEQ ID NO: 2393924 - RNA, 15 nt, Bordetella pertussis
cggccucggccagga

SEQ ID NO: 2393925 - RNA, 13 nt, Bordetella pertussis
cggccucggcggg

SEQ ID NO: 2393926 - RNA, 17 nt, Bordetella pertussis
cggccucggcgggcggc

SEQ ID NO: 2393927 - RNA, 20 nt, Bordetella pertussis
cggccucggcgggcggcgcc

SEQ ID NO: 2393928 - RNA, 18 nt, Bordetella pertussis
cggccucgguacuccuug

SEQ ID NO: 2393929 - RNA, 21 nt, Bordetella pertussis
cggccucggucaggguggaga

SEQ ID NO: 2393930 - RNA, 18 nt, Bordetella pertussis
cggccucggucucgugcg

SEQ ID NO: 2393931 - RNA, 16 nt, Bordetella pertussis
cggccucguaggccau

SEQ ID NO: 2393932 - RNA, 20 nt, Bordetella pertussis
cggccucguaguguucgaug

SEQ ID NO: 2393933 - RNA, 16 nt, Bordetella pertussis
cggccucuucgucgcc

SEQ ID NO: 2393934 - RNA, 20 nt, Bordetella pertussis
cggccugaaccaggccgcca

SEQ ID NO: 2393935 - RNA, 13 nt, Bordetella pertussis
cggccugacgcgc

SEQ ID NO: 2393936 - RNA, 22 nt, Bordetella pertussis
cggccugacgcgcaagcggccc

SEQ ID NO: 2393937 - RNA, 15 nt, Bordetella pertussis
cggccugacgggccu

SEQ ID NO: 2393938 - RNA, 20 nt, Bordetella pertussis
cggccugcaaugcggccagg

SEQ ID NO: 2393939 - RNA, 12 nt, Bordetella pertussis
cggccugcaccg

SEQ ID NO: 2393940 - RNA, 18 nt, Bordetella pertussis
cggccugcaccggcgcga

SEQ ID NO: 2393941 - RNA, 23 nt, Bordetella pertussis
cggccugcacggugggcagcagc

SEQ ID NO: 2393942 - RNA, 13 nt, Bordetella pertussis
cggccugcagacc

SEQ ID NO: 2393943 - RNA, 19 nt, Bordetella pertussis
cggccugcagaccagcacc

SEQ ID NO: 2393944 - RNA, 20 nt, Bordetella pertussis
cggccugcagaccagcaccg

SEQ ID NO: 2393945 - RNA, 14 nt, Bordetella pertussis
cggccugcaggccc

SEQ ID NO: 2393946 - RNA, 17 nt, Bordetella pertussis
cggccugcaggcccagc

SEQ ID NO: 2393947 - RNA, 18 nt, Bordetella pertussis
cggccugcaggcccagca

SEQ ID NO: 2393948 - RNA, 22 nt, Bordetella pertussis
cggccugcaggcccagcacgcg

SEQ ID NO: 2393949 - RNA, 23 nt, Bordetella pertussis
cggccugcaggcccagcacgcgc

SEQ ID NO: 2393950 - RNA, 18 nt, Bordetella pertussis
cggccugcaggugccgcc

SEQ ID NO: 2393951 - RNA, 21 nt, Bordetella pertussis
cggccugcaggugccgccggc

SEQ ID NO: 2393952 - RNA, 22 nt, Bordetella pertussis
cggccugcaugucguacaggcc

SEQ ID NO: 2393953 - RNA, 18 nt, Bordetella pertussis
cggccugccaccagcgcg

SEQ ID NO: 2393954 - RNA, 22 nt, Bordetella pertussis
cggccugccaccagcgcgccag

SEQ ID NO: 2393955 - RNA, 23 nt, Bordetella pertussis
cggccugccaccagcgcgccagc

SEQ ID NO: 2393956 - RNA, 14 nt, Bordetella pertussis
cggccugccaccga

SEQ ID NO: 2393957 - RNA, 15 nt, Bordetella pertussis
cggccugccagccug

SEQ ID NO: 2393958 - RNA, 21 nt, Bordetella pertussis
cggccugccagccugccacau

SEQ ID NO: 2393959 - RNA, 14 nt, Bordetella pertussis
cggccugcccgggc

SEQ ID NO: 2393960 - RNA, 15 nt, Bordetella pertussis
cggccugcccgggcg

SEQ ID NO: 2393961 - RNA, 16 nt, Bordetella pertussis
cggccugcccgggcgg

SEQ ID NO: 2393962 - RNA, 17 nt, Bordetella pertussis
cggccugcccgggcggg

SEQ ID NO: 2393963 - RNA, 19 nt, Bordetella pertussis
cggccugcccguucacgcg

SEQ ID NO: 2393964 - RNA, 14 nt, Bordetella pertussis
cggccugcgccacc

SEQ ID NO: 2393965 - RNA, 15 nt, Bordetella pertussis
cggccugcgccagcu

SEQ ID NO: 2393966 - RNA, 18 nt, Bordetella pertussis
cggccugcgccagcucca

SEQ ID NO: 2393967 - RNA, 20 nt, Bordetella pertussis
cggccugcgccggcauggcc

SEQ ID NO: 2393968 - RNA, 14 nt, Bordetella pertussis
cggccugcgccggg

SEQ ID NO: 2393969 - RNA, 16 nt, Bordetella pertussis
cggccugcgccgggcg

SEQ ID NO: 2393970 - RNA, 20 nt, Bordetella pertussis
cggccugcgccgggcgcggc

SEQ ID NO: 2393971 - RNA, 21 nt, Bordetella pertussis
cggccugcgccgggcgcggcc

SEQ ID NO: 2393972 - RNA, 17 nt, Bordetella pertussis
cggccugcgcgccgacc

SEQ ID NO: 2393973 - RNA, 20 nt, Bordetella pertussis
cggccugcgcgccgaccagg

SEQ ID NO: 2393974 - RNA, 18 nt, Bordetella pertussis
cggccugcggcucgagga

SEQ ID NO: 2393975 - RNA, 17 nt, Bordetella pertussis
cggccugcgggcgccgc

SEQ ID NO: 2393976 - RNA, 21 nt, Bordetella pertussis
cggccugcgggcugaugcagg

SEQ ID NO: 2393977 - RNA, 15 nt, Bordetella pertussis
cggccugcgucgcca

SEQ ID NO: 2393978 - RNA, 17 nt, Bordetella pertussis
cggccugcuccggcgug

SEQ ID NO: 2393979 - RNA, 19 nt, Bordetella pertussis
cggccugcucgaaaugcgc

SEQ ID NO: 2393980 - RNA, 16 nt, Bordetella pertussis
cggccugcucgcaggc

SEQ ID NO: 2393981 - RNA, 17 nt, Bordetella pertussis
cggccugcucgcaggcc

SEQ ID NO: 2393982 - RNA, 22 nt, Bordetella pertussis
cggccugcucgcaggccugcug

SEQ ID NO: 2393983 - RNA, 20 nt, Bordetella pertussis
cggccugcucgccggccagc

SEQ ID NO: 2393984 - RNA, 12 nt, Bordetella pertussis
cggccugcugca

SEQ ID NO: 2393985 - RNA, 14 nt, Bordetella pertussis
cggccugcuggugc

SEQ ID NO: 2393986 - RNA, 19 nt, Bordetella pertussis
cggccuggaacauggcccg

SEQ ID NO: 2393987 - RNA, 21 nt, Bordetella pertussis
cggccuggccccaggcgcccg

SEQ ID NO: 2393988 - RNA, 14 nt, Bordetella pertussis
cggccuggccccgc

SEQ ID NO: 2393989 - RNA, 15 nt, Bordetella pertussis
cggccuggccccgcg

SEQ ID NO: 2393990 - RNA, 16 nt, Bordetella pertussis
cggccuggccccgcgc

SEQ ID NO: 2393991 - RNA, 14 nt, Bordetella pertussis
cggccuggccgcgc

SEQ ID NO: 2393992 - RNA, 15 nt, Bordetella pertussis
cggccuggccgcgcg

SEQ ID NO: 2393993 - RNA, 16 nt, Bordetella pertussis
cggccuggccgcgcgc

SEQ ID NO: 2393994 - RNA, 18 nt, Bordetella pertussis
cggccuggccgcgcgccu

SEQ ID NO: 2393995 - RNA, 19 nt, Bordetella pertussis
cggccuggccgcgcgccug

SEQ ID NO: 2393996 - RNA, 21 nt, Bordetella pertussis
cggccuggccgcgcgccugcu

SEQ ID NO: 2393997 - RNA, 22 nt, Bordetella pertussis
cggccuggccggggaagccgcc

SEQ ID NO: 2393998 - RNA, 15 nt, Bordetella pertussis
cggccuggcgcgacg

SEQ ID NO: 2393999 - RNA, 16 nt, Bordetella pertussis
cggccuggcgcgcauc

SEQ ID NO: 2394000 - RNA, 19 nt, Bordetella pertussis
cggccuggcgcgcaucggc

SEQ ID NO: 2394001 - RNA, 22 nt, Bordetella pertussis
cggccuggcgcgcaucggcgcc

SEQ ID NO: 2394002 - RNA, 16 nt, Bordetella pertussis
cggccuggcgcgcggc

SEQ ID NO: 2394003 - RNA, 17 nt, Bordetella pertussis
cggccuggcgcgcggcc

SEQ ID NO: 2394004 - RNA, 16 nt, Bordetella pertussis
cggccuggcgcuccuc

SEQ ID NO: 2394005 - RNA, 19 nt, Bordetella pertussis
cggccuggcgcuccucgcg

SEQ ID NO: 2394006 - RNA, 16 nt, Bordetella pertussis
cggccuggcgggccga

SEQ ID NO: 2394007 - RNA, 22 nt, Bordetella pertussis
cggccuggcgguaugcggcgcc

SEQ ID NO: 2394008 - RNA, 16 nt, Bordetella pertussis
cggccugggaggcgcu

SEQ ID NO: 2394009 - RNA, 18 nt, Bordetella pertussis
cggccugggaggcgcuga

SEQ ID NO: 2394010 - RNA, 12 nt, Bordetella pertussis
cggccugggcca

SEQ ID NO: 2394011 - RNA, 17 nt, Bordetella pertussis
cggccugggccauggcc

SEQ ID NO: 2394012 - RNA, 17 nt, Bordetella pertussis
cggccugggcgcgaugg

SEQ ID NO: 2394013 - RNA, 12 nt, Bordetella pertussis
cggccugggcgg

SEQ ID NO: 2394014 - RNA, 13 nt, Bordetella pertussis
cggccugggcggc

SEQ ID NO: 2394015 - RNA, 17 nt, Bordetella pertussis
cggccugggcggcgcgc

SEQ ID NO: 2394016 - RNA, 18 nt, Bordetella pertussis
cggccugggcggcgcgcu

SEQ ID NO: 2394017 - RNA, 17 nt, Bordetella pertussis
cggccuggggacgggcg

SEQ ID NO: 2394018 - RNA, 19 nt, Bordetella pertussis
cggccuggggacgggcgca

SEQ ID NO: 2394019 - RNA, 23 nt, Bordetella pertussis
cggccuggucaugacgggcggcg

SEQ ID NO: 2394020 - RNA, 20 nt, Bordetella pertussis
cggccuguucgcggugucgc

SEQ ID NO: 2394021 - RNA, 19 nt, Bordetella pertussis
cggccuguucggacgcacc

SEQ ID NO: 2394022 - RNA, 15 nt, Bordetella pertussis
cggccuucaccccgc

SEQ ID NO: 2394023 - RNA, 23 nt, Bordetella pertussis
cggccuucaugaucuggccgacc

SEQ ID NO: 2394024 - RNA, 14 nt, Bordetella pertussis
cggccuucggcggc

SEQ ID NO: 2394025 - RNA, 16 nt, Bordetella pertussis
cggccuucggcggcgc

SEQ ID NO: 2394026 - RNA, 14 nt, Bordetella pertussis
cggccuucugcgcc

SEQ ID NO: 2394027 - RNA, 17 nt, Bordetella pertussis
cggccuucugcgccagc

SEQ ID NO: 2394028 - RNA, 15 nt, Bordetella pertussis
cggccuugcaugcgc

SEQ ID NO: 2394029 - RNA, 20 nt, Bordetella pertussis
cggccuugccgguggacggc

SEQ ID NO: 2394030 - RNA, 13 nt, Bordetella pertussis
cggccuugcgggc

SEQ ID NO: 2394031 - RNA, 17 nt, Bordetella pertussis
cggccuugcgggccggc

SEQ ID NO: 2394032 - RNA, 18 nt, Bordetella pertussis
cggccuugcgggccggcu

SEQ ID NO: 2394033 - RNA, 19 nt, Bordetella pertussis
cggccuugcgggccggcug

SEQ ID NO: 2394034 - RNA, 22 nt, Bordetella pertussis
cggccuugcgggccggcugggc

SEQ ID NO: 2394035 - RNA, 20 nt, Bordetella pertussis
cggccuugcugaaccugcug

SEQ ID NO: 2394036 - RNA, 22 nt, Bordetella pertussis
cggccuugcugaaccugcuggc

SEQ ID NO: 2394037 - RNA, 24 nt, Bordetella pertussis
cggccuugcugaaccugcuggccg

SEQ ID NO: 2394038 - RNA, 20 nt, Bordetella pertussis
cggccuuggccauguccugg

SEQ ID NO: 2394039 - RNA, 23 nt, Bordetella pertussis
cggccuuggccauguccuggcag

SEQ ID NO: 2394040 - RNA, 14 nt, Bordetella pertussis
cggccuuggccgca

SEQ ID NO: 2394041 - RNA, 16 nt, Bordetella pertussis
cggccuuggccgcagc

SEQ ID NO: 2394042 - RNA, 19 nt, Bordetella pertussis
cggccuuggccgcagccgg

SEQ ID NO: 2394043 - RNA, 20 nt, Bordetella pertussis
cggccuuggccgcagccggc

SEQ ID NO: 2394044 - RNA, 22 nt, Bordetella pertussis
cggccuuggccuuggcggcccc

SEQ ID NO: 2394045 - RNA, 15 nt, Bordetella pertussis
cggccuugugcgcca

SEQ ID NO: 2394046 - RNA, 19 nt, Bordetella pertussis
cggccuuuuuuugcggcac

SEQ ID NO: 2394047 - RNA, 23 nt, Bordetella pertussis
cggccuuuuuuugcggcacggcu

SEQ ID NO: 2394048 - RNA, 19 nt, Bordetella pertussis
cggcgaaagcgucggcuuc

SEQ ID NO: 2394049 - RNA, 17 nt, Bordetella pertussis
cggcgaaaugucgagcg

SEQ ID NO: 2394050 - RNA, 22 nt, Bordetella pertussis
cggcgaacacgucgcgggcgau

SEQ ID NO: 2394051 - RNA, 13 nt, Bordetella pertussis
cggcgaacagcgc

SEQ ID NO: 2394052 - RNA, 19 nt, Bordetella pertussis
cggcgaaccgcucagcccu

SEQ ID NO: 2394053 - RNA, 23 nt, Bordetella pertussis
cggcgaacgacagaccguagcgc

SEQ ID NO: 2394054 - RNA, 17 nt, Bordetella pertussis
cggcgaacugggcgucg

SEQ ID NO: 2394055 - RNA, 22 nt, Bordetella pertussis
cggcgaacugggcgucguccug

SEQ ID NO: 2394056 - RNA, 17 nt, Bordetella pertussis
cggcgaagagccguacu

SEQ ID NO: 2394057 - RNA, 13 nt, Bordetella pertussis
cggcgaagccgca

SEQ ID NO: 2394058 - RNA, 16 nt, Bordetella pertussis
cggcgaagccgcagcg

SEQ ID NO: 2394059 - RNA, 23 nt, Bordetella pertussis
cggcgaagccgcagcggcagcgc

SEQ ID NO: 2394060 - RNA, 13 nt, Bordetella pertussis
cggcgaagccggc

SEQ ID NO: 2394061 - RNA, 15 nt, Bordetella pertussis
cggcgaagccggcac

SEQ ID NO: 2394062 - RNA, 20 nt, Bordetella pertussis
cggcgaagccggcacgccug

SEQ ID NO: 2394063 - RNA, 19 nt, Bordetella pertussis
cggcgaagccuucuucugc

SEQ ID NO: 2394064 - RNA, 16 nt, Bordetella pertussis
cggcgaagccuugcgc

SEQ ID NO: 2394065 - RNA, 20 nt, Bordetella pertussis
cggcgaagccuugcgcggcc

SEQ ID NO: 2394066 - RNA, 21 nt, Bordetella pertussis
cggcgaagccuugcgcggcca

SEQ ID NO: 2394067 - RNA, 16 nt, Bordetella pertussis
cggcgaagcuguccuu

SEQ ID NO: 2394068 - RNA, 15 nt, Bordetella pertussis
cggcgaaguccugca

SEQ ID NO: 2394069 - RNA, 20 nt, Bordetella pertussis
cggcgaagugcccgcuggcc

SEQ ID NO: 2394070 - RNA, 17 nt, Bordetella pertussis
cggcgacacccccaggg

SEQ ID NO: 2394071 - RNA, 17 nt, Bordetella pertussis
cggcgaccaccgauccg

SEQ ID NO: 2394072 - RNA, 14 nt, Bordetella pertussis
cggcgaccaggccc

SEQ ID NO: 2394073 - RNA, 16 nt, Bordetella pertussis
cggcgcggcgggcgcu

SEQ ID NO: 2394074 - RNA, 19 nt, Bordetella pertussis
cggcgcggcggugccuguc

SEQ ID NO: 2394075 - RNA, 13 nt, Bordetella pertussis
cggcgcgggcgca

SEQ ID NO: 2394076 - RNA, 13 nt, Bordetella pertussis
cggcgcgggcggc

SEQ ID NO: 2394077 - RNA, 13 nt, Bordetella pertussis
cggcgcgggcggu

SEQ ID NO: 2394078 - RNA, 22 nt, Bordetella pertussis
cggcgcgguauggccgcccagc

SEQ ID NO: 2394079 - RNA, 23 nt, Bordetella pertussis
cggcgcgguauggccgcccagca

SEQ ID NO: 2394080 - RNA, 13 nt, Bordetella pertussis
cggcgcguccacg

SEQ ID NO: 2394081 - RNA, 16 nt, Bordetella pertussis
cggcgcguccacgccg

SEQ ID NO: 2394082 - RNA, 17 nt, Bordetella pertussis
cggcgcgucgccggcga

SEQ ID NO: 2394083 - RNA, 16 nt, Bordetella pertussis
cggcgcgucgcgcgcc

SEQ ID NO: 2394084 - RNA, 19 nt, Bordetella pertussis
cggcgcgucgcgcgccagg

SEQ ID NO: 2394085 - RNA, 15 nt, Bordetella pertussis
cggcgcgucgcgcgg

SEQ ID NO: 2394086 - RNA, 16 nt, Bordetella pertussis
cggcgcgucgcgcggc

SEQ ID NO: 2394087 - RNA, 20 nt, Bordetella pertussis
cggcgcgucgcgcggcggca

SEQ ID NO: 2394088 - RNA, 14 nt, Bordetella pertussis
cggcgcgucgcggu

SEQ ID NO: 2394089 - RNA, 20 nt, Bordetella pertussis
cggcgcgucgcgguacaggc

SEQ ID NO: 2394090 - RNA, 16 nt, Bordetella pertussis
cggcgcgugaugucga

SEQ ID NO: 2394091 - RNA, 15 nt, Bordetella pertussis
cggcgcgugccagca

SEQ ID NO: 2394092 - RNA, 23 nt, Bordetella pertussis
cggcgcgugccagcaggucgcgc

SEQ ID NO: 2394093 - RNA, 12 nt, Bordetella pertussis
cggcgcgugcgg

SEQ ID NO: 2394094 - RNA, 21 nt, Bordetella pertussis
cggcgcgugcggaugcagcag

SEQ ID NO: 2394095 - RNA, 22 nt, Bordetella pertussis
cggcgcgugcggaugcagcagc

SEQ ID NO: 2394096 - RNA, 17 nt, Bordetella pertussis
cggcgcgugcuggcgca

SEQ ID NO: 2394097 - RNA, 19 nt, Bordetella pertussis
cggcgcgugcuggcgcagc

SEQ ID NO: 2394098 - RNA, 14 nt, Bordetella pertussis
cggcgcguucagca

SEQ ID NO: 2394099 - RNA, 22 nt, Bordetella pertussis
cggcgcguucagcagcaggccc

SEQ ID NO: 2394100 - RNA, 23 nt, Bordetella pertussis
cggcgcguucagcagcaggcccu

SEQ ID NO: 2394101 - RNA, 19 nt, Bordetella pertussis
cggcgcguucgccgcagcc

SEQ ID NO: 2394102 - RNA, 21 nt, Bordetella pertussis
cggcgcguucgccgcagccgu

SEQ ID NO: 2394103 - RNA, 22 nt, Bordetella pertussis
cggcgcguucucagccgcccgc

SEQ ID NO: 2394104 - RNA, 22 nt, Bordetella pertussis
cggcgcuacagggugccgcgcc

SEQ ID NO: 2394105 - RNA, 23 nt, Bordetella pertussis
cggcgcuacagggugccgcgccg

SEQ ID NO: 2394106 - RNA, 24 nt, Bordetella pertussis
cggcgcuacagggugccgcgccgg

SEQ ID NO: 2394107 - RNA, 15 nt, Bordetella pertussis
cggcgcuacgccgcc

SEQ ID NO: 2394108 - RNA, 14 nt, Bordetella pertussis
cggcgcucagagcc

SEQ ID NO: 2394109 - RNA, 14 nt, Bordetella pertussis
cggcgcucagcgcg

SEQ ID NO: 2394110 - RNA, 15 nt, Bordetella pertussis
cggcgcucagcgcgc

SEQ ID NO: 2394111 - RNA, 16 nt, Bordetella pertussis
cggcgcucagcgcgcc

SEQ ID NO: 2394112 - RNA, 18 nt, Bordetella pertussis
cggcgcucagcgcgccga

SEQ ID NO: 2394113 - RNA, 22 nt, Bordetella pertussis
cggcgcucaggaaccagcggcu

SEQ ID NO: 2394114 - RNA, 17 nt, Bordetella pertussis
cggcgcucaucaucgcg

SEQ ID NO: 2394115 - RNA, 21 nt, Bordetella pertussis
cggcgcucaucaucgcgcugg

SEQ ID NO: 2394116 - RNA, 17 nt, Bordetella pertussis
cggcgcucgccccggcg

SEQ ID NO: 2394117 - RNA, 22 nt, Bordetella pertussis
cggcgcucgccccggcgcgcag

SEQ ID NO: 2394118 - RNA, 23 nt, Bordetella pertussis
cggcgcucgccccggcgcgcagc

SEQ ID NO: 2394119 - RNA, 14 nt, Bordetella pertussis
cggcgcucgcgcac

SEQ ID NO: 2394120 - RNA, 16 nt, Bordetella pertussis
cggcgcucgcgcaccg

SEQ ID NO: 2394121 - RNA, 15 nt, Bordetella pertussis
cggcgcugcacgcgg

SEQ ID NO: 2394122 - RNA, 16 nt, Bordetella pertussis
cggcgcugcacgcggc

SEQ ID NO: 2394123 - RNA, 17 nt, Bordetella pertussis
cggcgcugcacgcggcc

SEQ ID NO: 2394124 - RNA, 18 nt, Bordetella pertussis
cggcgcugcacgcggccg

SEQ ID NO: 2394125 - RNA, 21 nt, Bordetella pertussis
cggcgcugcacgcggccgcgc

SEQ ID NO: 2394126 - RNA, 22 nt, Bordetella pertussis
cggcgcugcacgcggccgcgca

SEQ ID NO: 2394127 - RNA, 16 nt, Bordetella pertussis
cggcgcugcagcgcag

SEQ ID NO: 2394128 - RNA, 15 nt, Bordetella pertussis
cggcgcugcgcagca

SEQ ID NO: 2394129 - RNA, 19 nt, Bordetella pertussis
cggcgcugcgcagcagggc

SEQ ID NO: 2394130 - RNA, 15 nt, Bordetella pertussis
cggcgcugcuggccg

SEQ ID NO: 2394131 - RNA, 16 nt, Bordetella pertussis
cggcgcugcuggccgg

SEQ ID NO: 2394132 - RNA, 17 nt, Bordetella pertussis
cggcgcugcuggccggc

SEQ ID NO: 2394133 - RNA, 18 nt, Bordetella pertussis
cggcgcugcuggccggcc

SEQ ID NO: 2394134 - RNA, 19 nt, Bordetella pertussis
cggcgcugcuggccggcca

SEQ ID NO: 2394135 - RNA, 14 nt, Bordetella pertussis
cggcgcugcugucg

SEQ ID NO: 2394136 - RNA, 18 nt, Bordetella pertussis
cggcgcugcugucgcgcg

SEQ ID NO: 2394137 - RNA, 22 nt, Bordetella pertussis
cggcgcugcugucgcgcgacug

SEQ ID NO: 2394138 - RNA, 23 nt, Bordetella pertussis
cggcgcuggauggcucgggcagc

SEQ ID NO: 2394139 - RNA, 13 nt, Bordetella pertussis
cggcgcuggccau

SEQ ID NO: 2394140 - RNA, 20 nt, Bordetella pertussis
cggcgcuggccaucaccgcc

SEQ ID NO: 2394141 - RNA, 13 nt, Bordetella pertussis
cggcgcuggccgc

SEQ ID NO: 2394142 - RNA, 14 nt, Bordetella pertussis
cggcgcuggccgcc

SEQ ID NO: 2394143 - RNA, 21 nt, Bordetella pertussis
cggcgcuggccugccgcgccg

SEQ ID NO: 2394144 - RNA, 14 nt, Bordetella pertussis
cggcgcuggccugg

SEQ ID NO: 2394145 - RNA, 17 nt, Bordetella pertussis
cggcgcuggccuggccg

SEQ ID NO: 2394146 - RNA, 22 nt, Bordetella pertussis
cggcgcuggccuggccgccggc

SEQ ID NO: 2394147 - RNA, 12 nt, Bordetella pertussis
cggcgcuggcga

SEQ ID NO: 2394148 - RNA, 12 nt, Bordetella pertussis
cggcgcuggcgc

SEQ ID NO: 2394149 - RNA, 14 nt, Bordetella pertussis
cggcgcuggcgccg

SEQ ID NO: 2394150 - RNA, 17 nt, Bordetella pertussis
cggcgcuggcgccgcgc

SEQ ID NO: 2394151 - RNA, 18 nt, Bordetella pertussis
cggcgcuggcgccgcgcg

SEQ ID NO: 2394152 - RNA, 19 nt, Bordetella pertussis
cggcgcuggcgccgcgcgc

SEQ ID NO: 2394153 - RNA, 15 nt, Bordetella pertussis
cggcgcuggcgcgcu

SEQ ID NO: 2394154 - RNA, 16 nt, Bordetella pertussis
cggcgcuggcuggacg

SEQ ID NO: 2394155 - RNA, 19 nt, Bordetella pertussis
cggcgcuggcuggacgcgc

SEQ ID NO: 2394156 - RNA, 18 nt, Bordetella pertussis
cggcgcugggcaggcugg

SEQ ID NO: 2394157 - RNA, 21 nt, Bordetella pertussis
cggcgcuggucaaccuggugu

SEQ ID NO: 2394158 - RNA, 15 nt, Bordetella pertussis
cggcgcuuaccgcgc

SEQ ID NO: 2394159 - RNA, 15 nt, Bordetella pertussis
cggcggaaugcggcg

SEQ ID NO: 2394160 - RNA, 18 nt, Bordetella pertussis
cggcggaaugcggcgaca

SEQ ID NO: 2394161 - RNA, 15 nt, Bordetella pertussis
cggcggacacgcaug

SEQ ID NO: 2394162 - RNA, 15 nt, Bordetella pertussis
cggcggacuggccgc

SEQ ID NO: 2394163 - RNA, 17 nt, Bordetella pertussis
cggcggacuggccgcgc

SEQ ID NO: 2394164 - RNA, 21 nt, Bordetella pertussis
cggcggacuggccgcgccgcu

SEQ ID NO: 2394165 - RNA, 17 nt, Bordetella pertussis
cggcggauucaggcgau

SEQ ID NO: 2394166 - RNA, 15 nt, Bordetella pertussis
cggcggcaagcagcc

SEQ ID NO: 2394167 - RNA, 17 nt, Bordetella pertussis
cggcggcaagcagccgg

SEQ ID NO: 2394168 - RNA, 22 nt, Bordetella pertussis
cggcggcaagguagccgaugac

SEQ ID NO: 2394169 - RNA, 16 nt, Bordetella pertussis
cggcggcaccgcgcag

SEQ ID NO: 2394170 - RNA, 17 nt, Bordetella pertussis
cggcggcaccgcgcagc

SEQ ID NO: 2394171 - RNA, 20 nt, Bordetella pertussis
cggcggcaccgcgcagcccg

SEQ ID NO: 2394172 - RNA, 21 nt, Bordetella pertussis
cggcggcaccgcgcagcccgg

SEQ ID NO: 2394173 - RNA, 14 nt, Bordetella pertussis
cggcggcacgcgcg

SEQ ID NO: 2394174 - RNA, 19 nt, Bordetella pertussis
cggcggcacgcgcgccggc

SEQ ID NO: 2394175 - RNA, 22 nt, Bordetella pertussis
cggcggcacgcgcgccggcagg

SEQ ID NO: 2394176 - RNA, 13 nt, Bordetella pertussis
cggcggcacgcug

SEQ ID NO: 2394177 - RNA, 13 nt, Bordetella pertussis
cggcggcacggcc

SEQ ID NO: 2394178 - RNA, 15 nt, Bordetella pertussis
cggcggcacggccgg

SEQ ID NO: 2394179 - RNA, 17 nt, Bordetella pertussis
cggcggcacggccggcc

SEQ ID NO: 2394180 - RNA, 16 nt, Bordetella pertussis
cggcggcacgguggcg

SEQ ID NO: 2394181 - RNA, 14 nt, Bordetella pertussis
cggcggcagcgcga

SEQ ID NO: 2394182 - RNA, 17 nt, Bordetella pertussis
cggcggcagcgcgaacg

SEQ ID NO: 2394183 - RNA, 16 nt, Bordetella pertussis
cggcggcagcuugacc

SEQ ID NO: 2394184 - RNA, 18 nt, Bordetella pertussis
cggcggcagcuugaccgc

SEQ ID NO: 2394185 - RNA, 23 nt, Bordetella pertussis
cggcggcagcuugaccgccucca

SEQ ID NO: 2394186 - RNA, 21 nt, Bordetella pertussis
cggcggcaggccgcgccacag

SEQ ID NO: 2394187 - RNA, 20 nt, Bordetella pertussis
cggcggcaggucggugcaca

SEQ ID NO: 2394188 - RNA, 20 nt, Bordetella pertussis
cggcgaccaggcccauggcg

SEQ ID NO: 2394189 - RNA, 12 nt, Bordetella pertussis
cggcgaccaggu

SEQ ID NO: 2394190 - RNA, 14 nt, Bordetella pertussis
cggcgaccaggugc

SEQ ID NO: 2394191 - RNA, 22 nt, Bordetella pertussis
cggcgaccaggugcgggccgcu

SEQ ID NO: 2394192 - RNA, 18 nt, Bordetella pertussis
cggcgaccgacggcaucg

SEQ ID NO: 2394193 - RNA, 17 nt, Bordetella pertussis
cggcgaccgccggccgg

SEQ ID NO: 2394194 - RNA, 18 nt, Bordetella pertussis
cggcgaccgccggccggu

SEQ ID NO: 2394195 - RNA, 18 nt, Bordetella pertussis
cggcgaccggcgccggcu

SEQ ID NO: 2394196 - RNA, 16 nt, Bordetella pertussis
cggcgaccgugcgcca

SEQ ID NO: 2394197 - RNA, 18 nt, Bordetella pertussis
cggcgacgacuacgcgcu

SEQ ID NO: 2394198 - RNA, 22 nt, Bordetella pertussis
cggcgacgaucuccacccccgg

SEQ ID NO: 2394199 - RNA, 13 nt, Bordetella pertussis
cggcgacgaugcc

SEQ ID NO: 2394200 - RNA, 13 nt, Bordetella pertussis
cggcgacgcagca

SEQ ID NO: 2394201 - RNA, 15 nt, Bordetella pertussis
cggcgacgcagcacg

SEQ ID NO: 2394202 - RNA, 18 nt, Bordetella pertussis
cggcgacgcagcacggcu

SEQ ID NO: 2394203 - RNA, 13 nt, Bordetella pertussis
cggcgacggcgcc

SEQ ID NO: 2394204 - RNA, 20 nt, Bordetella pertussis
cggcgacggcgccuggcgca

SEQ ID NO: 2394205 - RNA, 16 nt, Bordetella pertussis
cggcgacggcgucggc

SEQ ID NO: 2394206 - RNA, 17 nt, Bordetella pertussis
cggcgacggcgucggcc

SEQ ID NO: 2394207 - RNA, 20 nt, Bordetella pertussis
cggcgacggcgucggccugg

SEQ ID NO: 2394208 - RNA, 13 nt, Bordetella pertussis
cggcgacggucag

SEQ ID NO: 2394209 - RNA, 21 nt, Bordetella pertussis
cggcgacggucaggggcaggc

SEQ ID NO: 2394210 - RNA, 22 nt, Bordetella pertussis
cggcgacggucaggggcaggcg

SEQ ID NO: 2394211 - RNA, 18 nt, Bordetella pertussis
cggcgacguggcgcucca

SEQ ID NO: 2394212 - RNA, 15 nt, Bordetella pertussis
cggcgacguuggcga

SEQ ID NO: 2394213 - RNA, 16 nt, Bordetella pertussis
cggcgacugccccagc

SEQ ID NO: 2394214 - RNA, 19 nt, Bordetella pertussis
cggcgacugccccagcggc

SEQ ID NO: 2394215 - RNA, 21 nt, Bordetella pertussis
cggcgacugccccagcggcug

SEQ ID NO: 2394216 - RNA, 21 nt, Bordetella pertussis
cggcgacuucgccgaugacca

SEQ ID NO: 2394217 - RNA, 15 nt, Bordetella pertussis
cggcgacuucggcgg

SEQ ID NO: 2394218 - RNA, 17 nt, Bordetella pertussis
cggcgacuucggcggcc

SEQ ID NO: 2394219 - RNA, 21 nt, Bordetella pertussis
cggcgacuucggcggccugcu

SEQ ID NO: 2394220 - RNA, 20 nt, Bordetella pertussis
cggcgagaacgcggccgcga

SEQ ID NO: 2394221 - RNA, 15 nt, Bordetella pertussis
cggcgagacgucggc

SEQ ID NO: 2394222 - RNA, 16 nt, Bordetella pertussis
cggcgagacgucggcg

SEQ ID NO: 2394223 - RNA, 17 nt, Bordetella pertussis
cggcgagacgucggcga

SEQ ID NO: 2394224 - RNA, 21 nt, Bordetella pertussis
cggcgagacgucggcgauggc

SEQ ID NO: 2394225 - RNA, 13 nt, Bordetella pertussis
cggcgagcacggc

SEQ ID NO: 2394226 - RNA, 17 nt, Bordetella pertussis
cggcgagcacggccugc

SEQ ID NO: 2394227 - RNA, 19 nt, Bordetella pertussis
cggcgagcacggccugcuc

SEQ ID NO: 2394228 - RNA, 13 nt, Bordetella pertussis
cggcgagcauggc

SEQ ID NO: 2394229 - RNA, 14 nt, Bordetella pertussis
cggcgagcauggcg

SEQ ID NO: 2394230 - RNA, 21 nt, Bordetella pertussis
cggcgagcauggcgguggcca

SEQ ID NO: 2394231 - RNA, 22 nt, Bordetella pertussis
cggcgagcauggcgguggccag

SEQ ID NO: 2394232 - RNA, 13 nt, Bordetella pertussis
cggcgagccgggc

SEQ ID NO: 2394233 - RNA, 15 nt, Bordetella pertussis
cggcgcgccuggcgc

SEQ ID NO: 2394234 - RNA, 19 nt, Bordetella pertussis
cggcgcgccuggcgcgccc

SEQ ID NO: 2394235 - RNA, 20 nt, Bordetella pertussis
cggcgcgccuuacgcggcgc

SEQ ID NO: 2394236 - RNA, 15 nt, Bordetella pertussis
cggcgcgcgcaggcg

SEQ ID NO: 2394237 - RNA, 16 nt, Bordetella pertussis
cggcgcgcgcaggcgc

SEQ ID NO: 2394238 - RNA, 17 nt, Bordetella pertussis
cggcgcgcgcaggcgcu

SEQ ID NO: 2394239 - RNA, 20 nt, Bordetella pertussis
cggcgcgcgcaggcgcucga

SEQ ID NO: 2394240 - RNA, 19 nt, Bordetella pertussis
cggcgcgcgcaugcccgac

SEQ ID NO: 2394241 - RNA, 12 nt, Bordetella pertussis
cggcgcgcgcca

SEQ ID NO: 2394242 - RNA, 16 nt, Bordetella pertussis
cggcgcgcgccaggcc

SEQ ID NO: 2394243 - RNA, 17 nt, Bordetella pertussis
cggcgcgcgccaggccc

SEQ ID NO: 2394244 - RNA, 18 nt, Bordetella pertussis
cggcgcgcgccaggccca

SEQ ID NO: 2394245 - RNA, 17 nt, Bordetella pertussis
cggcgcgcgccagggcg

SEQ ID NO: 2394246 - RNA, 12 nt, Bordetella pertussis
cggcgcgcgccg

SEQ ID NO: 2394247 - RNA, 13 nt, Bordetella pertussis
cggcgcgcgccga

SEQ ID NO: 2394248 - RNA, 13 nt, Bordetella pertussis
cggcgcgcgccgg

SEQ ID NO: 2394249 - RNA, 13 nt, Bordetella pertussis
cggcgcgcgccug

SEQ ID NO: 2394250 - RNA, 14 nt, Bordetella pertussis
cggcgcgcgccugc

SEQ ID NO: 2394251 - RNA, 18 nt, Bordetella pertussis
cggcgcgcgccugcagca

SEQ ID NO: 2394252 - RNA, 11 nt, Bordetella pertussis
cggcgcgcgcg

SEQ ID NO: 2394253 - RNA, 20 nt, Bordetella pertussis
cggcgcgcgcgacuccaccg

SEQ ID NO: 2394254 - RNA, 14 nt, Bordetella pertussis
cggcgcgcgcgccg

SEQ ID NO: 2394255 - RNA, 16 nt, Bordetella pertussis
cggcgcgcgcgccgcc

SEQ ID NO: 2394256 - RNA, 16 nt, Bordetella pertussis
cggcgcgcgcgcgccg

SEQ ID NO: 2394257 - RNA, 13 nt, Bordetella pertussis
cggcgcgcgcggc

SEQ ID NO: 2394258 - RNA, 15 nt, Bordetella pertussis
cggcgcgcgcggcca

SEQ ID NO: 2394259 - RNA, 21 nt, Bordetella pertussis
cggcgcgcgcggcgccugggg

SEQ ID NO: 2394260 - RNA, 13 nt, Bordetella pertussis
cggcgcgcgcguu

SEQ ID NO: 2394261 - RNA, 23 nt, Bordetella pertussis
cggcgcgcgcguugaucaucggc

SEQ ID NO: 2394262 - RNA, 13 nt, Bordetella pertussis
cggcgcgcgcugc

SEQ ID NO: 2394263 - RNA, 14 nt, Bordetella pertussis
cggcgcgcgcugca

SEQ ID NO: 2394264 - RNA, 17 nt, Bordetella pertussis
cggcgcgcgcugcacgg

SEQ ID NO: 2394265 - RNA, 20 nt, Bordetella pertussis
cggcgcgcgcugcacggccu

SEQ ID NO: 2394266 - RNA, 23 nt, Bordetella pertussis
cggcgcgcggaugaucgcgcagc

SEQ ID NO: 2394267 - RNA, 12 nt, Bordetella pertussis
cggcgcgcggcc

SEQ ID NO: 2394268 - RNA, 13 nt, Bordetella pertussis
cggcgcgcggccg

SEQ ID NO: 2394269 - RNA, 14 nt, Bordetella pertussis
cggcgcgcggcugg

SEQ ID NO: 2394270 - RNA, 20 nt, Bordetella pertussis
cggcgcgcggcugggucggc

SEQ ID NO: 2394271 - RNA, 15 nt, Bordetella pertussis
cggcgcgcgguggca

SEQ ID NO: 2394272 - RNA, 12 nt, Bordetella pertussis
cggcgcgcucgg

SEQ ID NO: 2394273 - RNA, 17 nt, Bordetella pertussis
cggcgcgcucggccucg

SEQ ID NO: 2394274 - RNA, 21 nt, Bordetella pertussis
cggcgcgcucuccgaacaggc

SEQ ID NO: 2394275 - RNA, 14 nt, Bordetella pertussis
cggcgcgcuggacg

SEQ ID NO: 2394276 - RNA, 16 nt, Bordetella pertussis
cggcgcgcuggacguc

SEQ ID NO: 2394277 - RNA, 18 nt, Bordetella pertussis
cggcgcgcuuggucagca

SEQ ID NO: 2394278 - RNA, 23 nt, Bordetella pertussis
cggcgcgcuuggucagcaucagc

SEQ ID NO: 2394279 - RNA, 23 nt, Bordetella pertussis
cggcgcggcagccuggggcgagg

SEQ ID NO: 2394280 - RNA, 16 nt, Bordetella pertussis
cggcgcggcagguucu

SEQ ID NO: 2394281 - RNA, 12 nt, Bordetella pertussis
cggcgcggcagu

SEQ ID NO: 2394282 - RNA, 13 nt, Bordetella pertussis
cggcgcggccaac

SEQ ID NO: 2394283 - RNA, 13 nt, Bordetella pertussis
cggcgcggccagc

SEQ ID NO: 2394284 - RNA, 14 nt, Bordetella pertussis
cggcgcggccagca

SEQ ID NO: 2394285 - RNA, 15 nt, Bordetella pertussis
cggcgcggccagcag

SEQ ID NO: 2394286 - RNA, 18 nt, Bordetella pertussis
cggcgcggccagcagcgc

SEQ ID NO: 2394287 - RNA, 20 nt, Bordetella pertussis
cggcgcggcccgccacgcag

SEQ ID NO: 2394288 - RNA, 11 nt, Bordetella pertussis
cggcgcggccg

SEQ ID NO: 2394289 - RNA, 17 nt, Bordetella pertussis
cggcgcggccgacgugg

SEQ ID NO: 2394290 - RNA, 18 nt, Bordetella pertussis
cggcgcggccgacgugga

SEQ ID NO: 2394291 - RNA, 12 nt, Bordetella pertussis
cggcgcggccuu

SEQ ID NO: 2394292 - RNA, 19 nt, Bordetella pertussis
cggcgcggccuugcaugcg

SEQ ID NO: 2394293 - RNA, 22 nt, Bordetella pertussis
cggcgcggccuugcaugcgccg

SEQ ID NO: 2394294 - RNA, 10 nt, Bordetella pertussis
cggcgcggcg

SEQ ID NO: 2394295 - RNA, 13 nt, Bordetella pertussis
cggcgcggcgagc

SEQ ID NO: 2394296 - RNA, 14 nt, Bordetella pertussis
cggcgcggcgagca

SEQ ID NO: 2394297 - RNA, 20 nt, Bordetella pertussis
cggcgcggcgagcacggccu

SEQ ID NO: 2394298 - RNA, 14 nt, Bordetella pertussis
cggcgcggcgaucg

SEQ ID NO: 2394299 - RNA, 16 nt, Bordetella pertussis
cggcgcggcgaucggc

SEQ ID NO: 2394300 - RNA, 19 nt, Bordetella pertussis
cggcgcggcgccagcgccc

SEQ ID NO: 2394301 - RNA, 23 nt, Bordetella pertussis
cggcgcggcgccaugccgcgccc

SEQ ID NO: 2394302 - RNA, 13 nt, Bordetella pertussis
cggcgcggcgccg

SEQ ID NO: 2394303 - RNA, 17 nt, Bordetella pertussis
cggcgcggcgccgucca

SEQ ID NO: 2394304 - RNA, 16 nt, Bordetella pertussis
cggcgcggcgcgcgcc

SEQ ID NO: 2394305 - RNA, 17 nt, Bordetella pertussis
cggcgcggcgcgcgccg

SEQ ID NO: 2394306 - RNA, 18 nt, Bordetella pertussis
cggcgcggcgcgcgccgu

SEQ ID NO: 2394307 - RNA, 15 nt, Bordetella pertussis
cggcgcggcgcgcug

SEQ ID NO: 2394308 - RNA, 16 nt, Bordetella pertussis
cggcgcggcgcgcugg

SEQ ID NO: 2394309 - RNA, 11 nt, Bordetella pertussis
cggcgcggcgg

SEQ ID NO: 2394310 - RNA, 14 nt, Bordetella pertussis
cggcgcggcgggcg

SEQ ID NO: 2394311 - RNA, 19 nt, Bordetella pertussis
cggcgcccaggcccagcgc

SEQ ID NO: 2394312 - RNA, 21 nt, Bordetella pertussis
cggcgcccaggcccagcgcgc

SEQ ID NO: 2394313 - RNA, 12 nt, Bordetella pertussis
cggcgcccauca

SEQ ID NO: 2394314 - RNA, 17 nt, Bordetella pertussis
cggcgcccaucagguga

SEQ ID NO: 2394315 - RNA, 23 nt, Bordetella pertussis
cggcgcccaucaggugaaacagc

SEQ ID NO: 2394316 - RNA, 15 nt, Bordetella pertussis
cggcgcccccagcag

SEQ ID NO: 2394317 - RNA, 13 nt, Bordetella pertussis
cggcgcccccgcg

SEQ ID NO: 2394318 - RNA, 18 nt, Bordetella pertussis
cggcgcccccgcggcgcc

SEQ ID NO: 2394319 - RNA, 16 nt, Bordetella pertussis
cggcgcccgcauggac

SEQ ID NO: 2394320 - RNA, 16 nt, Bordetella pertussis
cggcgcccgcgcaugc

SEQ ID NO: 2394321 - RNA, 22 nt, Bordetella pertussis
cggcgcccgcgcaugcaagaca

SEQ ID NO: 2394322 - RNA, 19 nt, Bordetella pertussis
cggcgcccgcggccugcgc

SEQ ID NO: 2394323 - RNA, 18 nt, Bordetella pertussis
cggcgcccggcagccgaa

SEQ ID NO: 2394324 - RNA, 15 nt, Bordetella pertussis
cggcgcccggcgccg

SEQ ID NO: 2394325 - RNA, 17 nt, Bordetella pertussis
cggcgcccggugcgcgc

SEQ ID NO: 2394326 - RNA, 19 nt, Bordetella pertussis
cggcgcccggugcgcgcag

SEQ ID NO: 2394327 - RNA, 15 nt, Bordetella pertussis
cggcgcccugcaggg

SEQ ID NO: 2394328 - RNA, 17 nt, Bordetella pertussis
cggcgcccugcagggca

SEQ ID NO: 2394329 - RNA, 14 nt, Bordetella pertussis
cggcgcccugcgcg

SEQ ID NO: 2394330 - RNA, 22 nt, Bordetella pertussis
cggcgcccuugaugccgucggc

SEQ ID NO: 2394331 - RNA, 12 nt, Bordetella pertussis
cggcgccgacaa

SEQ ID NO: 2394332 - RNA, 14 nt, Bordetella pertussis
cggcgccgacaacg

SEQ ID NO: 2394333 - RNA, 22 nt, Bordetella pertussis
cggcgccgacaacggcgugcug

SEQ ID NO: 2394334 - RNA, 15 nt, Bordetella pertussis
cggcgccgaccaggu

SEQ ID NO: 2394335 - RNA, 18 nt, Bordetella pertussis
cggcgccgaccagguauc

SEQ ID NO: 2394336 - RNA, 14 nt, Bordetella pertussis
cggcgccgacgcgc

SEQ ID NO: 2394337 - RNA, 15 nt, Bordetella pertussis
cggcgccgacgcgcu

SEQ ID NO: 2394338 - RNA, 20 nt, Bordetella pertussis
cggcgccgagauggacgcgu

SEQ ID NO: 2394339 - RNA, 17 nt, Bordetella pertussis
cggcgccgaggcggucg

SEQ ID NO: 2394340 - RNA, 20 nt, Bordetella pertussis
cggcgccgaggcggucgaug

SEQ ID NO: 2394341 - RNA, 20 nt, Bordetella pertussis
cggcgccgaucagcaggucg

SEQ ID NO: 2394342 - RNA, 21 nt, Bordetella pertussis
cggcgccgaucagcaggucgg

SEQ ID NO: 2394343 - RNA, 23 nt, Bordetella pertussis
cggcgccgaucagcaggucggcg

SEQ ID NO: 2394344 - RNA, 16 nt, Bordetella pertussis
cggcgccgauccggcg

SEQ ID NO: 2394345 - RNA, 20 nt, Bordetella pertussis
cggcgccgauggugcgggcg

SEQ ID NO: 2394346 - RNA, 12 nt, Bordetella pertussis
cggcgccgccgg

SEQ ID NO: 2394347 - RNA, 15 nt, Bordetella pertussis
cggcgccgccggcca

SEQ ID NO: 2394348 - RNA, 21 nt, Bordetella pertussis
cggcgccgccggcggccugga

SEQ ID NO: 2394349 - RNA, 22 nt, Bordetella pertussis
cggcgccgccggcggccuggac

SEQ ID NO: 2394350 - RNA, 13 nt, Bordetella pertussis
cggcgccgccggg

SEQ ID NO: 2394351 - RNA, 18 nt, Bordetella pertussis
cggcgccgccucaggccg

SEQ ID NO: 2394352 - RNA, 18 nt, Bordetella pertussis
cggcggcauacauccucg

SEQ ID NO: 2394353 - RNA, 19 nt, Bordetella pertussis
cggcggcauacauccucga

SEQ ID NO: 2394354 - RNA, 23 nt, Bordetella pertussis
cggcggcauacauccucgaugcc

SEQ ID NO: 2394355 - RNA, 13 nt, Bordetella pertussis
cggcggcaugcgc

SEQ ID NO: 2394356 - RNA, 15 nt, Bordetella pertussis
cggcggcaugcgcca

SEQ ID NO: 2394357 - RNA, 17 nt, Bordetella pertussis
cggcggcaugcugguca

SEQ ID NO: 2394358 - RNA, 18 nt, Bordetella pertussis
cggcggcauucagcgcug

SEQ ID NO: 2394359 - RNA, 15 nt, Bordetella pertussis
cggcggccacgaccg

SEQ ID NO: 2394360 - RNA, 22 nt, Bordetella pertussis
cggcggccacgaccggcucgau

SEQ ID NO: 2394361 - RNA, 11 nt, Bordetella pertussis
cggcggccagc

SEQ ID NO: 2394362 - RNA, 18 nt, Bordetella pertussis
cggcggccagcagcggca

SEQ ID NO: 2394363 - RNA, 14 nt, Bordetella pertussis
cggcggccagccgg

SEQ ID NO: 2394364 - RNA, 17 nt, Bordetella pertussis
cggcggccagccggcgc

SEQ ID NO: 2394365 - RNA, 18 nt, Bordetella pertussis
cggcggccagccggcgcg

SEQ ID NO: 2394366 - RNA, 14 nt, Bordetella pertussis
cggcggccagcgcg

SEQ ID NO: 2394367 - RNA, 16 nt, Bordetella pertussis
cggcggccagcgcgca

SEQ ID NO: 2394368 - RNA, 17 nt, Bordetella pertussis
cggcggccagcgcgccg

SEQ ID NO: 2394369 - RNA, 18 nt, Bordetella pertussis
cggcggccagcgcgccgc

SEQ ID NO: 2394370 - RNA, 19 nt, Bordetella pertussis
cggcggccagcgcgccgcc

SEQ ID NO: 2394371 - RNA, 12 nt, Bordetella pertussis
cggcggccagcu

SEQ ID NO: 2394372 - RNA, 14 nt, Bordetella pertussis
cggcggccaggccg

SEQ ID NO: 2394373 - RNA, 16 nt, Bordetella pertussis
cggcggccaggccggc

SEQ ID NO: 2394374 - RNA, 17 nt, Bordetella pertussis
cggcggccaggccggcg

SEQ ID NO: 2394375 - RNA, 19 nt, Bordetella pertussis
cggcggccaggccggcgaa

SEQ ID NO: 2394376 - RNA, 19 nt, Bordetella pertussis
cggcggccaggccggcgcg

SEQ ID NO: 2394377 - RNA, 17 nt, Bordetella pertussis
cggcggccaggcguacg

SEQ ID NO: 2394378 - RNA, 23 nt, Bordetella pertussis
cggcggccagggaaggggcggcu

SEQ ID NO: 2394379 - RNA, 14 nt, Bordetella pertussis
cggcggccaucgcc

SEQ ID NO: 2394380 - RNA, 18 nt, Bordetella pertussis
cggcggccaugacggcca

SEQ ID NO: 2394381 - RNA, 19 nt, Bordetella pertussis
cggcggccaugacggccau

SEQ ID NO: 2394382 - RNA, 14 nt, Bordetella pertussis
cggcggccaugccc

SEQ ID NO: 2394383 - RNA, 15 nt, Bordetella pertussis
cggcggccaugccca

SEQ ID NO: 2394384 - RNA, 17 nt, Bordetella pertussis
cggcggccaugcccagg

SEQ ID NO: 2394385 - RNA, 21 nt, Bordetella pertussis
cggcggccaugcccaggccca

SEQ ID NO: 2394386 - RNA, 16 nt, Bordetella pertussis
cggcgggcaugacgac

SEQ ID NO: 2394387 - RNA, 22 nt, Bordetella pertussis
cggcgggcaugacgaccgcgac

SEQ ID NO: 2394388 - RNA, 21 nt, Bordetella pertussis
cggcgggccccgcagggcccg

SEQ ID NO: 2394389 - RNA, 12 nt, Bordetella pertussis
cggcgggccgca

SEQ ID NO: 2394390 - RNA, 17 nt, Bordetella pertussis
cggcgggccgcgccccu

SEQ ID NO: 2394391 - RNA, 13 nt, Bordetella pertussis
cggcgggccgcug

SEQ ID NO: 2394392 - RNA, 21 nt, Bordetella pertussis
cggcgggccggcucggcggca

SEQ ID NO: 2394393 - RNA, 23 nt, Bordetella pertussis
cggcgggcgccccgaucggcgcc

SEQ ID NO: 2394394 - RNA, 15 nt, Bordetella pertussis
cggcgggcgcgcagg

SEQ ID NO: 2394395 - RNA, 20 nt, Bordetella pertussis
cggcgggcgcgcaggccucg

SEQ ID NO: 2394396 - RNA, 14 nt, Bordetella pertussis
cggcgggcgcugcc

SEQ ID NO: 2394397 - RNA, 19 nt, Bordetella pertussis
cggcgggcgcugccugccg

SEQ ID NO: 2394398 - RNA, 13 nt, Bordetella pertussis
cggcgggcgcugg

SEQ ID NO: 2394399 - RNA, 18 nt, Bordetella pertussis
cggcgggcgcuggcgcgc

SEQ ID NO: 2394400 - RNA, 23 nt, Bordetella pertussis
cggcgggcgcuggcgcgcggcug

SEQ ID NO: 2394401 - RNA, 15 nt, Bordetella pertussis
cggcgggcggccggc

SEQ ID NO: 2394402 - RNA, 19 nt, Bordetella pertussis
cggcgggcgugaugccgac

SEQ ID NO: 2394403 - RNA, 13 nt, Bordetella pertussis
cggcgggcucagc

SEQ ID NO: 2394404 - RNA, 17 nt, Bordetella pertussis
cggcgggcucgagcugg

SEQ ID NO: 2394405 - RNA, 13 nt, Bordetella pertussis
cggcgggcucggc

SEQ ID NO: 2394406 - RNA, 15 nt, Bordetella pertussis
cggcgggcucggcgc

SEQ ID NO: 2394407 - RNA, 16 nt, Bordetella pertussis
cggcgggcucggcgcc

SEQ ID NO: 2394408 - RNA, 18 nt, Bordetella pertussis
cggcgggcucggcgccgg

SEQ ID NO: 2394409 - RNA, 21 nt, Bordetella pertussis
cggcgggcucggcgccggcgg

SEQ ID NO: 2394410 - RNA, 23 nt, Bordetella pertussis
cggcgggcucggcgccggcggcg

SEQ ID NO: 2394411 - RNA, 16 nt, Bordetella pertussis
cggcggggacaggcgc

SEQ ID NO: 2394412 - RNA, 17 nt, Bordetella pertussis
cggcggggacaggcgcc

SEQ ID NO: 2394413 - RNA, 15 nt, Bordetella pertussis
cggcggggcaggcgc

SEQ ID NO: 2394414 - RNA, 16 nt, Bordetella pertussis
cggcggggcaggcgcc

SEQ ID NO: 2394415 - RNA, 23 nt, Bordetella pertussis
cggcgggucaaguccggcgccgc

SEQ ID NO: 2394416 - RNA, 15 nt, Bordetella pertussis
cggcggguggccucg

SEQ ID NO: 2394417 - RNA, 14 nt, Bordetella pertussis
cggcggguggcggc

SEQ ID NO: 2394418 - RNA, 17 nt, Bordetella pertussis
cgggaagcgcucgcgca

SEQ ID NO: 2394419 - RNA, 20 nt, Bordetella pertussis
cgggaagcugucggcgcugg

SEQ ID NO: 2394420 - RNA, 22 nt, Bordetella pertussis
cgggaauccgcugcgccgaggc

SEQ ID NO: 2394421 - RNA, 14 nt, Bordetella pertussis
cgggaaugaagcgc

SEQ ID NO: 2394422 - RNA, 19 nt, Bordetella pertussis
cgggaaugaugcgcauuau

SEQ ID NO: 2394423 - RNA, 21 nt, Bordetella pertussis
cgggaaugauuccgcuggcga

SEQ ID NO: 2394424 - RNA, 22 nt, Bordetella pertussis
cgggaaugucccacaggcgcgc

SEQ ID NO: 2394425 - RNA, 23 nt, Bordetella pertussis
cgggacacacgcucuugcgcgcg

SEQ ID NO: 2394426 - RNA, 13 nt, Bordetella pertussis
cgggacaggcacc

SEQ ID NO: 2394427 - RNA, 21 nt, Bordetella pertussis
cgggacaggcacccgaugguc

SEQ ID NO: 2394428 - RNA, 16 nt, Bordetella pertussis
cgggacaggcaccuuu

SEQ ID NO: 2394429 - RNA, 16 nt, Bordetella pertussis
cgggacaggcaucagg

SEQ ID NO: 2394430 - RNA, 18 nt, Bordetella pertussis
cgggacaggcgccacagg

SEQ ID NO: 2394431 - RNA, 17 nt, Bordetella pertussis
cgggaccgaacaccacc

SEQ ID NO: 2394432 - RNA, 13 nt, Bordetella pertussis
cgggaccggcgcg

SEQ ID NO: 2394433 - RNA, 16 nt, Bordetella pertussis
cgggaccuuggcggcu

SEQ ID NO: 2394434 - RNA, 17 nt, Bordetella pertussis
cgggacgcaggcccaug

SEQ ID NO: 2394435 - RNA, 22 nt, Bordetella pertussis
cgggacggaaguccugcaucgc

SEQ ID NO: 2394436 - RNA, 13 nt, Bordetella pertussis
cgggacggccagg

SEQ ID NO: 2394437 - RNA, 23 nt, Bordetella pertussis
cgggacuuagaaguccaugccgc

SEQ ID NO: 2394438 - RNA, 22 nt, Bordetella pertussis
cgggacuugguuggccugggcc

SEQ ID NO: 2394439 - RNA, 22 nt, Bordetella pertussis
cgggagccaguccccgugggga

SEQ ID NO: 2394440 - RNA, 14 nt, Bordetella pertussis
cgggagccucugga

SEQ ID NO: 2394441 - RNA, 18 nt, Bordetella pertussis
cgggagccuguccccgcc

SEQ ID NO: 2394442 - RNA, 21 nt, Bordetella pertussis
cgggagccuguccccgccggg

SEQ ID NO: 2394443 - RNA, 22 nt, Bordetella pertussis
cgggagccuguccccgcgggga

SEQ ID NO: 2394444 - RNA, 18 nt, Bordetella pertussis
cgggagcggccagcaagc

SEQ ID NO: 2394445 - RNA, 13 nt, Bordetella pertussis
cgggaggaagggu

SEQ ID NO: 2394446 - RNA, 18 nt, Bordetella pertussis
cgggaggaagggugcggc

SEQ ID NO: 2394447 - RNA, 22 nt, Bordetella pertussis
cgggaggaagggugcggcgcca

SEQ ID NO: 2394448 - RNA, 19 nt, Bordetella pertussis
cgggauaccgcuggccagg

SEQ ID NO: 2394449 - RNA, 15 nt, Bordetella pertussis
cgggauaggccucgg

SEQ ID NO: 2394450 - RNA, 22 nt, Bordetella pertussis
cgggauaggccucggccaccug

SEQ ID NO: 2394451 - RNA, 18 nt, Bordetella pertussis
cgggauaguccagcaccg

SEQ ID NO: 2394452 - RNA, 14 nt, Bordetella pertussis
cgggauccacgccg

SEQ ID NO: 2394453 - RNA, 16 nt, Bordetella pertussis
cgggauccacgccgcc

SEQ ID NO: 2394454 - RNA, 19 nt, Bordetella pertussis
cgggauccacgccgccggc

SEQ ID NO: 2394455 - RNA, 23 nt, Bordetella pertussis
cgggauccacgccgccggccagc

SEQ ID NO: 2394456 - RNA, 18 nt, Bordetella pertussis
cgggaucccgagcgggca

SEQ ID NO: 2394457 - RNA, 13 nt, Bordetella pertussis
cgggauccggcag

SEQ ID NO: 2394458 - RNA, 15 nt, Bordetella pertussis
cgggauccgugcggc

SEQ ID NO: 2394459 - RNA, 20 nt, Bordetella pertussis
cgggauccgugcggcgcgca

SEQ ID NO: 2394460 - RNA, 21 nt, Bordetella pertussis
cgggauccgugcggcgcgcac

SEQ ID NO: 2394461 - RNA, 22 nt, Bordetella pertussis
cgggauccgugcggcgcgcacg

SEQ ID NO: 2394462 - RNA, 24 nt, Bordetella pertussis
cgggauccgugcggcgcgcacggg

SEQ ID NO: 2394463 - RNA, 19 nt, Bordetella pertussis
cgggaucggcgucagcgcc

SEQ ID NO: 2394464 - RNA, 20 nt, Bordetella pertussis
cgggaucggcgucagcgccc

SEQ ID NO: 2394465 - RNA, 21 nt, Bordetella pertussis
cgggaucugcaugccgaccac

SEQ ID NO: 2394466 - RNA, 16 nt, Bordetella pertussis
cgggaugccccgcccg

SEQ ID NO: 2394467 - RNA, 23 nt, Bordetella pertussis
cgggaugccguaggugcgcgcca

SEQ ID NO: 2394468 - RNA, 15 nt, Bordetella pertussis
cgggaugcugcucgg

SEQ ID NO: 2394469 - RNA, 21 nt, Bordetella pertussis
cgggaugcugcucggccaugu

SEQ ID NO: 2394470 - RNA, 18 nt, Bordetella pertussis
cgggaugggccacccagc

SEQ ID NO: 2394471 - RNA, 17 nt, Bordetella pertussis
cgggauggucgcggccg

SEQ ID NO: 2394472 - RNA, 13 nt, Bordetella pertussis
cgggauguccgcg

SEQ ID NO: 2394473 - RNA, 17 nt, Bordetella pertussis
cgggauguccgcgucgg

SEQ ID NO: 2394474 - RNA, 15 nt, Bordetella pertussis
cgggauucugcugca

SEQ ID NO: 2394475 - RNA, 18 nt, Bordetella pertussis
cgggauugccgucacgcg

SEQ ID NO: 2394476 - RNA, 18 nt, Bordetella pertussis
cgggcaaacggcggcagg

SEQ ID NO: 2394477 - RNA, 14 nt, Bordetella pertussis
cgggcaaagcccag

SEQ ID NO: 2394478 - RNA, 16 nt, Bordetella pertussis
cgggcaaagcccagca

SEQ ID NO: 2394479 - RNA, 17 nt, Bordetella pertussis
cgggcaaagcccagcaa

SEQ ID NO: 2394480 - RNA, 19 nt, Bordetella pertussis
cgggcaaagcccagcaagg

SEQ ID NO: 2394481 - RNA, 19 nt, Bordetella pertussis
cgggcaaucggcgugcagc

SEQ ID NO: 2394482 - RNA, 20 nt, Bordetella pertussis
cgggcaaucggcgugcagca

SEQ ID NO: 2394483 - RNA, 18 nt, Bordetella pertussis
cgggcacaacccgcccgg

SEQ ID NO: 2394484 - RNA, 19 nt, Bordetella pertussis
cgggcacaacccgcccggg

SEQ ID NO: 2394485 - RNA, 14 nt, Bordetella pertussis
cgggcaccagcacu

SEQ ID NO: 2394486 - RNA, 17 nt, Bordetella pertussis
cgggcaccagguccugg

SEQ ID NO: 2394487 - RNA, 20 nt, Bordetella pertussis
cgggcaccagguccuggcgg

SEQ ID NO: 2394488 - RNA, 17 nt, Bordetella pertussis
cgggcaccaucucccgc

SEQ ID NO: 2394489 - RNA, 18 nt, Bordetella pertussis
cgggcaccaucucccgca

SEQ ID NO: 2394490 - RNA, 23 nt, Bordetella pertussis
cgggcaccaucucccgcaggccc

SEQ ID NO: 2394491 - RNA, 19 nt, Bordetella pertussis
cgggcaccgacacgcuggc

SEQ ID NO: 2394492 - RNA, 15 nt, Bordetella pertussis
cgggcaccgagccgc

SEQ ID NO: 2394493 - RNA, 22 nt, Bordetella pertussis
cgggcacgagaucgccuggggc

SEQ ID NO: 2394494 - RNA, 19 nt, Bordetella pertussis
cgggcacgaucaccgccgc

SEQ ID NO: 2394495 - RNA, 15 nt, Bordetella pertussis
cgggcacggccagca

SEQ ID NO: 2394496 - RNA, 18 nt, Bordetella pertussis
cgggcacguaguacagca

SEQ ID NO: 2394497 - RNA, 17 nt, Bordetella pertussis
cgggcacucggccaugg

SEQ ID NO: 2394498 - RNA, 14 nt, Bordetella pertussis
cgggcagacgccau

SEQ ID NO: 2394499 - RNA, 15 nt, Bordetella pertussis
cgggcagcaccgcug

SEQ ID NO: 2394500 - RNA, 16 nt, Bordetella pertussis
cgggcagcaccggggc

SEQ ID NO: 2394501 - RNA, 11 nt, Bordetella pertussis
cgggcagcacg

SEQ ID NO: 2394502 - RNA, 21 nt, Bordetella pertussis
cgggcagcacgcgcaccaggc

SEQ ID NO: 2394503 - RNA, 13 nt, Bordetella pertussis
cgggcagcagcag

SEQ ID NO: 2394504 - RNA, 15 nt, Bordetella pertussis
cgggcagcagcaggg

SEQ ID NO: 2394505 - RNA, 18 nt, Bordetella pertussis
cgggcagcagcagggcca

SEQ ID NO: 2394506 - RNA, 15 nt, Bordetella pertussis
cgggcagcaggcgca

SEQ ID NO: 2394507 - RNA, 20 nt, Bordetella pertussis
cgggcagcaggcgcaucagc

SEQ ID NO: 2394508 - RNA, 20 nt, Bordetella pertussis
cgggcaggcgggccaggccg

SEQ ID NO: 2394509 - RNA, 15 nt, Bordetella pertussis
cgggcaggcucagcc

SEQ ID NO: 2394510 - RNA, 17 nt, Bordetella pertussis
cgggcaggcucagcccg

SEQ ID NO: 2394511 - RNA, 19 nt, Bordetella pertussis
cgggcaggcucagcccggc

SEQ ID NO: 2394512 - RNA, 20 nt, Bordetella pertussis
cgggcaggcucagcccggcg

SEQ ID NO: 2394513 - RNA, 19 nt, Bordetella pertussis
cgggcagggcgggggacgc

SEQ ID NO: 2394514 - RNA, 14 nt, Bordetella pertussis
cgggcagggcuucc

SEQ ID NO: 2394515 - RNA, 21 nt, Bordetella pertussis
cgggcagggugggcacgcgcu

SEQ ID NO: 2394516 - RNA, 14 nt, Bordetella pertussis
cgggcaggucggcc

SEQ ID NO: 2394517 - RNA, 15 nt, Bordetella pertussis
cgggcaggucggcca

SEQ ID NO: 2394518 - RNA, 18 nt, Bordetella pertussis
cgggcaggucggccagcg

SEQ ID NO: 2394519 - RNA, 23 nt, Bordetella pertussis
cgggcaggucggccagcgugccg

SEQ ID NO: 2394520 - RNA, 16 nt, Bordetella pertussis
cgggcaggucggcgcg

SEQ ID NO: 2394521 - RNA, 20 nt, Bordetella pertussis
cgggcaggucggcgcggggc

SEQ ID NO: 2394522 - RNA, 16 nt, Bordetella pertussis
cgggcagugcgccgga

SEQ ID NO: 2394523 - RNA, 17 nt, Bordetella pertussis
cgggcaguucgggcacg

SEQ ID NO: 2394524 - RNA, 20 nt, Bordetella pertussis
cgggcaguucgggcacgccg

SEQ ID NO: 2394525 - RNA, 16 nt, Bordetella pertussis
cgggcaguugcuggcg

SEQ ID NO: 2394526 - RNA, 23 nt, Bordetella pertussis
cgggcaguugcuggcggccgugc

SEQ ID NO: 2394527 - RNA, 13 nt, Bordetella pertussis
cgggcaugacgac

SEQ ID NO: 2394528 - RNA, 18 nt, Bordetella pertussis
cgggcaugacgaccgcga

SEQ ID NO: 2394529 - RNA, 19 nt, Bordetella pertussis
cgggcaugcgaaagccggc

SEQ ID NO: 2394530 - RNA, 15 nt, Bordetella pertussis
cgggcaugcgccugc

SEQ ID NO: 2394531 - RNA, 16 nt, Bordetella pertussis
cgggcaugcgccugcg

SEQ ID NO: 2394532 - RNA, 18 nt, Bordetella pertussis
cgggcaugcgccugcgcc

SEQ ID NO: 2394533 - RNA, 18 nt, Bordetella pertussis
cgggcauggcccggcucg

SEQ ID NO: 2394534 - RNA, 20 nt, Bordetella pertussis
cgggcauggcccggcucgcc

SEQ ID NO: 2394535 - RNA, 20 nt, Bordetella pertussis
cgggcauugccggagcagca

SEQ ID NO: 2394536 - RNA, 18 nt, Bordetella pertussis
cgggcauugggcagcgga

SEQ ID NO: 2394537 - RNA, 13 nt, Bordetella pertussis
cgggccacccgcc

SEQ ID NO: 2394538 - RNA, 17 nt, Bordetella pertussis
cgggccacccgccgccg

SEQ ID NO: 2394539 - RNA, 15 nt, Bordetella pertussis
cgggccacgccggcc

SEQ ID NO: 2394540 - RNA, 14 nt, Bordetella pertussis
cgggccacgcgcac

SEQ ID NO: 2394541 - RNA, 12 nt, Bordetella pertussis
cgggccagcaga

SEQ ID NO: 2394542 - RNA, 20 nt, Bordetella pertussis
cgggccagcagaaugccgcc

SEQ ID NO: 2394543 - RNA, 15 nt, Bordetella pertussis
cgggccagccccggc

SEQ ID NO: 2394544 - RNA, 19 nt, Bordetella pertussis
cgggccagccccggcgcgc

SEQ ID NO: 2394545 - RNA, 21 nt, Bordetella pertussis
cgggccagccccggcgcgccg

SEQ ID NO: 2394546 - RNA, 12 nt, Bordetella pertussis
cgggccagcgcg

SEQ ID NO: 2394547 - RNA, 20 nt, Bordetella pertussis
cgggccagcuccccgggcgu

SEQ ID NO: 2394548 - RNA, 12 nt, Bordetella pertussis
cgggccaggccg

SEQ ID NO: 2394549 - RNA, 17 nt, Bordetella pertussis
cgggccaggccgaugcc

SEQ ID NO: 2394550 - RNA, 14 nt, Bordetella pertussis
cgggccaggccggc

SEQ ID NO: 2394551 - RNA, 15 nt, Bordetella pertussis
cgggccaggccggug

SEQ ID NO: 2394552 - RNA, 16 nt, Bordetella pertussis
cgggccaggccggugg

SEQ ID NO: 2394553 - RNA, 17 nt, Bordetella pertussis
cgggccaggccggugga

SEQ ID NO: 2394554 - RNA, 20 nt, Bordetella pertussis
cgggccaugcgggucaggcc

SEQ ID NO: 2394555 - RNA, 21 nt, Bordetella pertussis
cgggccaugcgggucaggccg

SEQ ID NO: 2394556 - RNA, 22 nt, Bordetella pertussis
cgggccaugcgggucaggccgc

SEQ ID NO: 2394557 - RNA, 18 nt, Bordetella pertussis
cgggccauggaugcgcgc

SEQ ID NO: 2394558 - RNA, 20 nt, Bordetella pertussis
cgggccaugucagucguccu

SEQ ID NO: 2394559 - RNA, 15 nt, Bordetella pertussis
cgggccaugucggcu

SEQ ID NO: 2394560 - RNA, 18 nt, Bordetella pertussis
cgggccaugucggcuucg

SEQ ID NO: 2394561 - RNA, 15 nt, Bordetella pertussis
cgggccccgcagggc

SEQ ID NO: 2394562 - RNA, 17 nt, Bordetella pertussis
cgggcccgacagcgccc

SEQ ID NO: 2394563 - RNA, 19 nt, Bordetella pertussis
cgggcccgacagcgccccg

SEQ ID NO: 2394564 - RNA, 18 nt, Bordetella pertussis
cgggcccgcaucgcgcgc

SEQ ID NO: 2394565 - RNA, 20 nt, Bordetella pertussis
cgggcccgcaucgcgcgccg

SEQ ID NO: 2394566 - RNA, 13 nt, Bordetella pertussis
cgggcccgcgcag

SEQ ID NO: 2394567 - RNA, 16 nt, Bordetella pertussis
cgggcccgcucggcca

SEQ ID NO: 2394568 - RNA, 23 nt, Bordetella pertussis
cgggcccggaucauccgggcccg

SEQ ID NO: 2394569 - RNA, 19 nt, Bordetella pertussis
cgggcccggccacggccgg

SEQ ID NO: 2394570 - RNA, 14 nt, Bordetella pertussis
cgggcccggcgcgc

SEQ ID NO: 2394571 - RNA, 15 nt, Bordetella pertussis
cgggcccgucgcgcc

SEQ ID NO: 2394572 - RNA, 22 nt, Bordetella pertussis
cgggcccgucgcgccaggccgg

SEQ ID NO: 2394573 - RNA, 13 nt, Bordetella pertussis
cgggccgaacaug

SEQ ID NO: 2394574 - RNA, 20 nt, Bordetella pertussis
cgggccgaacaugacguucu

SEQ ID NO: 2394575 - RNA, 23 nt, Bordetella pertussis
cgggccgaagaucuccucgcgcg

SEQ ID NO: 2394576 - RNA, 13 nt, Bordetella pertussis
cgggccgaccagg

SEQ ID NO: 2394577 - RNA, 16 nt, Bordetella pertussis
cgggccgaccaggccg

SEQ ID NO: 2394578 - RNA, 17 nt, Bordetella pertussis
cgggccgaccaggccgg

SEQ ID NO: 2394579 - RNA, 18 nt, Bordetella pertussis
cgggccgacgcgcccggg

SEQ ID NO: 2394580 - RNA, 18 nt, Bordetella pertussis
cgggccgacggccucggc

SEQ ID NO: 2394581 - RNA, 20 nt, Bordetella pertussis
cgggccgacggccucggcca

SEQ ID NO: 2394582 - RNA, 15 nt, Bordetella pertussis
cgggccgaggcuucg

SEQ ID NO: 2394583 - RNA, 23 nt, Bordetella pertussis
cgggccgcaagcaagccccaggc

SEQ ID NO: 2394584 - RNA, 13 nt, Bordetella pertussis
cgggccgcacagc

SEQ ID NO: 2394585 - RNA, 13 nt, Bordetella pertussis
cgggccgcagcau

SEQ ID NO: 2394586 - RNA, 15 nt, Bordetella pertussis
cgggccgcagcaugg

SEQ ID NO: 2394587 - RNA, 17 nt, Bordetella pertussis
cgggccgcagcauggcg

SEQ ID NO: 2394588 - RNA, 19 nt, Bordetella pertussis
cgggccgcagcauggcgcc

SEQ ID NO: 2394589 - RNA, 22 nt, Bordetella pertussis
cgggccgcagcauggcgccagc

SEQ ID NO: 2394590 - RNA, 20 nt, Bordetella pertussis
cgggccgcgccccuagcgcc

SEQ ID NO: 2394591 - RNA, 12 nt, Bordetella pertussis
cgggccgcgccg

SEQ ID NO: 2394592 - RNA, 13 nt, Bordetella pertussis
cgggccgcgccgc

SEQ ID NO: 2394593 - RNA, 21 nt, Bordetella pertussis
cgggccgcgccgcggcacggg

SEQ ID NO: 2394594 - RNA, 12 nt, Bordetella pertussis
cgggccgcgcgc

SEQ ID NO: 2394595 - RNA, 13 nt, Bordetella pertussis
cgggccgcgcgcg

SEQ ID NO: 2394596 - RNA, 19 nt, Bordetella pertussis
cgggccgcgcgcgggcgcc

SEQ ID NO: 2394597 - RNA, 18 nt, Bordetella pertussis
cgggccgcuaggccuugc

SEQ ID NO: 2394598 - RNA, 20 nt, Bordetella pertussis
cgggccgcuaggccuugccg

SEQ ID NO: 2394599 - RNA, 23 nt, Bordetella pertussis
cgggcgccuguccccgcugcggc

SEQ ID NO: 2394600 - RNA, 18 nt, Bordetella pertussis
cgggcgcgcagcgcgacc

SEQ ID NO: 2394601 - RNA, 13 nt, Bordetella pertussis
cgggcgcgcaggc

SEQ ID NO: 2394602 - RNA, 14 nt, Bordetella pertussis
cgggcgcgcccggc

SEQ ID NO: 2394603 - RNA, 15 nt, Bordetella pertussis
cgggcgcgcccggcg

SEQ ID NO: 2394604 - RNA, 17 nt, Bordetella pertussis
cgggcgcgcccggcgcg

SEQ ID NO: 2394605 - RNA, 14 nt, Bordetella pertussis
cgggcgcgccgucg

SEQ ID NO: 2394606 - RNA, 15 nt, Bordetella pertussis
cgggcgcgccgucgc

SEQ ID NO: 2394607 - RNA, 18 nt, Bordetella pertussis
cgggcgcgccgucgcugg

SEQ ID NO: 2394608 - RNA, 12 nt, Bordetella pertussis
cgggcgcgcgcc

SEQ ID NO: 2394609 - RNA, 14 nt, Bordetella pertussis
cgggcgcgcgcccc

SEQ ID NO: 2394610 - RNA, 15 nt, Bordetella pertussis
cgggcgcgcgccccg

SEQ ID NO: 2394611 - RNA, 13 nt, Bordetella pertussis
cgggcgcgcgccg

SEQ ID NO: 2394612 - RNA, 14 nt, Bordetella pertussis
cgggcgcgcgccgg

SEQ ID NO: 2394613 - RNA, 15 nt, Bordetella pertussis
cgggcgcgcgccggc

SEQ ID NO: 2394614 - RNA, 23 nt, Bordetella pertussis
cgggcgcgcgccggcggccugca

SEQ ID NO: 2394615 - RNA, 19 nt, Bordetella pertussis
cgggcgcgcugcccagcca

SEQ ID NO: 2394616 - RNA, 21 nt, Bordetella pertussis
cgggcgcgcugcccagccaca

SEQ ID NO: 2394617 - RNA, 14 nt, Bordetella pertussis
cgggcgcggcaggc

SEQ ID NO: 2394618 - RNA, 17 nt, Bordetella pertussis
cgggcgcggcaggcggu

SEQ ID NO: 2394619 - RNA, 14 nt, Bordetella pertussis
cgggcgcggccagg

SEQ ID NO: 2394620 - RNA, 17 nt, Bordetella pertussis
cgggcgcggccaggcgc

SEQ ID NO: 2394621 - RNA, 15 nt, Bordetella pertussis
cgggcgcggcccggc

SEQ ID NO: 2394622 - RNA, 17 nt, Bordetella pertussis
cgggcgcggccgccgcc

SEQ ID NO: 2394623 - RNA, 14 nt, Bordetella pertussis
cgggcgcggcgccc

SEQ ID NO: 2394624 - RNA, 14 nt, Bordetella pertussis
cgggcgcggcgucg

SEQ ID NO: 2394625 - RNA, 19 nt, Bordetella pertussis
cgggcgcgggagcccgcac

SEQ ID NO: 2394626 - RNA, 23 nt, Bordetella pertussis
cgggcgcgguauucgcugcuggc

SEQ ID NO: 2394627 - RNA, 22 nt, Bordetella pertussis
cgggcgcgucaguugggcgcgc

SEQ ID NO: 2394628 - RNA, 14 nt, Bordetella pertussis
cgggcgcugacgcc

SEQ ID NO: 2394629 - RNA, 19 nt, Bordetella pertussis
cgggcgcugacgccgaugu

SEQ ID NO: 2394630 - RNA, 19 nt, Bordetella pertussis
cgggcgcugcacgcagcgc

SEQ ID NO: 2394631 - RNA, 15 nt, Bordetella pertussis
cgggcgcugcccagg

SEQ ID NO: 2394632 - RNA, 19 nt, Bordetella pertussis
cgggcgcugcgccggcggc

SEQ ID NO: 2394633 - RNA, 19 nt, Bordetella pertussis
cgggcgcugcgcgaacgcg

SEQ ID NO: 2394634 - RNA, 15 nt, Bordetella pertussis
cgggcgcuggcgcgc

SEQ ID NO: 2394635 - RNA, 19 nt, Bordetella pertussis
cgggcgcuggcgcgcggcu

SEQ ID NO: 2394636 - RNA, 13 nt, Bordetella pertussis
cgggcgcuugccg

SEQ ID NO: 2394637 - RNA, 21 nt, Bordetella pertussis
cgggcggcaggugcgccagca

SEQ ID NO: 2394638 - RNA, 12 nt, Bordetella pertussis
cgggcggccacg

SEQ ID NO: 2394639 - RNA, 16 nt, Bordetella pertussis
cgggcggccacggcgg

SEQ ID NO: 2394640 - RNA, 13 nt, Bordetella pertussis
cgggcggcccggc

SEQ ID NO: 2394641 - RNA, 15 nt, Bordetella pertussis
cgggcggcccggcgg

SEQ ID NO: 2394642 - RNA, 13 nt, Bordetella pertussis
cgggcggccgacg

SEQ ID NO: 2394643 - RNA, 14 nt, Bordetella pertussis
cgggcggccggcgc

SEQ ID NO: 2394644 - RNA, 18 nt, Bordetella pertussis
cgggcggccuaucaccug

SEQ ID NO: 2394645 - RNA, 19 nt, Bordetella pertussis
cgggcggccugggaggcgc

SEQ ID NO: 2394646 - RNA, 21 nt, Bordetella pertussis
cgggcggccugggaggcgcug

SEQ ID NO: 2394647 - RNA, 12 nt, Bordetella pertussis
cgggcggcgcca

SEQ ID NO: 2394648 - RNA, 16 nt, Bordetella pertussis
cgggcggcgccagcgg

SEQ ID NO: 2394649 - RNA, 14 nt, Bordetella pertussis
cgggcggcgccggc

SEQ ID NO: 2394650 - RNA, 15 nt, Bordetella pertussis
cgggcggcgccgucg

SEQ ID NO: 2394651 - RNA, 14 nt, Bordetella pertussis
cgggcggcgccugg

SEQ ID NO: 2394652 - RNA, 15 nt, Bordetella pertussis
cgggcggcgcgccca

SEQ ID NO: 2394653 - RNA, 14 nt, Bordetella pertussis
cgggcggcgcggcc

SEQ ID NO: 2394654 - RNA, 17 nt, Bordetella pertussis
cgggcggcgcgggcggc

SEQ ID NO: 2394655 - RNA, 18 nt, Bordetella pertussis
cgggcggcgcgggcggcu

SEQ ID NO: 2394656 - RNA, 18 nt, Bordetella pertussis
cgggcggcggcgcguucg

SEQ ID NO: 2394657 - RNA, 19 nt, Bordetella pertussis
cgggcggcggcguggcggc

SEQ ID NO: 2394658 - RNA, 16 nt, Bordetella pertussis
cgggcggcgucgccgc

SEQ ID NO: 2394659 - RNA, 19 nt, Bordetella pertussis
cgggcggcgucgccgcgca

SEQ ID NO: 2394660 - RNA, 12 nt, Bordetella pertussis
cgggcggcguug

SEQ ID NO: 2394661 - RNA, 22 nt, Bordetella pertussis
cgggcggcuaggcgcagcaggc

SEQ ID NO: 2394662 - RNA, 17 nt, Bordetella pertussis
cgggcggcugcccgggc

SEQ ID NO: 2394663 - RNA, 22 nt, Bordetella pertussis
cgggcggcugcccgggcugcug

SEQ ID NO: 2394664 - RNA, 15 nt, Bordetella pertussis
cgggcggcugcuggc

SEQ ID NO: 2394665 - RNA, 22 nt, Bordetella pertussis
cgggcgggaaguggaaccgcgg

SEQ ID NO: 2394666 - RNA, 12 nt, Bordetella pertussis
cgggcgggcgca

SEQ ID NO: 2394667 - RNA, 19 nt, Bordetella pertussis
cgggcgggucggcgaacag

SEQ ID NO: 2394668 - RNA, 18 nt, Bordetella pertussis
cgggcggguucguggcuu

SEQ ID NO: 2394669 - RNA, 17 nt, Bordetella pertussis
cgggcgguacaggucga

SEQ ID NO: 2394670 - RNA, 14 nt, Bordetella pertussis
cgggcggucggcgc

SEQ ID NO: 2394671 - RNA, 15 nt, Bordetella pertussis
cgggcggucggcgcg

SEQ ID NO: 2394672 - RNA, 16 nt, Bordetella pertussis
cgggcggugcggccuc

SEQ ID NO: 2394673 - RNA, 19 nt, Bordetella pertussis
cgggcggugcggccucggc

SEQ ID NO: 2394674 - RNA, 22 nt, Bordetella pertussis
cgggcggugcggccucggcggg

SEQ ID NO: 2394675 - RNA, 18 nt, Bordetella pertussis
cgggcgguuuuuucuugc

SEQ ID NO: 2394676 - RNA, 17 nt, Bordetella pertussis
cgggcguagaaagccag

SEQ ID NO: 2394677 - RNA, 15 nt, Bordetella pertussis
cgggcgucugcccgc

SEQ ID NO: 2394678 - RNA, 16 nt, Bordetella pertussis
cgggcgugagcgccuc

SEQ ID NO: 2394679 - RNA, 18 nt, Bordetella pertussis
cgggcgugagcgccucga

SEQ ID NO: 2394680 - RNA, 19 nt, Bordetella pertussis
cgggcgugaugccgaccag

SEQ ID NO: 2394681 - RNA, 20 nt, Bordetella pertussis
cgggcgugaugccgaccagg

SEQ ID NO: 2394682 - RNA, 23 nt, Bordetella pertussis
cgggcgugaugccgaccaggccc

SEQ ID NO: 2394683 - RNA, 23 nt, Bordetella pertussis
cgggcgugcggauggucgagcgc

SEQ ID NO: 2394684 - RNA, 14 nt, Bordetella pertussis
cgggcgugcuggca

SEQ ID NO: 2394685 - RNA, 15 nt, Bordetella pertussis
cgggcgugcuggcac

SEQ ID NO: 2394686 - RNA, 17 nt, Bordetella pertussis
cgggcguuugcccuucg

SEQ ID NO: 2394687 - RNA, 22 nt, Bordetella pertussis
cgggcguuugcccuucgcggcu

SEQ ID NO: 2394688 - RNA, 23 nt, Bordetella pertussis
cgggcguuugcccuucgcggcug

SEQ ID NO: 2394689 - RNA, 20 nt, Bordetella pertussis
cgggcguuuuugcguccggc

SEQ ID NO: 2394690 - RNA, 22 nt, Bordetella pertussis
cgggcguuuuugcguccggcgc

SEQ ID NO: 2394691 - RNA, 23 nt, Bordetella pertussis
cgggcguuuuugcguccggcgcg

SEQ ID NO: 2394692 - RNA, 21 nt, Bordetella pertussis
cgggcucaggcugcgcgucgg

SEQ ID NO: 2394693 - RNA, 22 nt, Bordetella pertussis
cgggcuccucgcccgaccugcu

SEQ ID NO: 2394694 - RNA, 12 nt, Bordetella pertussis
cgggcucgaagu

SEQ ID NO: 2394695 - RNA, 18 nt, Bordetella pertussis
cgggcucgaaguacagcu

SEQ ID NO: 2394696 - RNA, 18 nt, Bordetella pertussis
cgggcucgaugaccagca

SEQ ID NO: 2394697 - RNA, 18 nt, Bordetella pertussis
cgggcucgcgcgcgcggg

SEQ ID NO: 2394698 - RNA, 19 nt, Bordetella pertussis
cgggcucgcgcgcgcgggc

SEQ ID NO: 2394699 - RNA, 14 nt, Bordetella pertussis
cgggcucggcgccg

SEQ ID NO: 2394700 - RNA, 18 nt, Bordetella pertussis
cgggcucggcgccggcgg

SEQ ID NO: 2394701 - RNA, 22 nt, Bordetella pertussis
cgggcucgggaaugaugcagcu

SEQ ID NO: 2394702 - RNA, 22 nt, Bordetella pertussis
cgggcugaacauccugaccggc

SEQ ID NO: 2394703 - RNA, 18 nt, Bordetella pertussis
cgggcugauccgcaccgg

SEQ ID NO: 2394704 - RNA, 19 nt, Bordetella pertussis
cgggcugauccgcaccggc

SEQ ID NO: 2394705 - RNA, 22 nt, Bordetella pertussis
cgggcugauccgcaccggcgug

SEQ ID NO: 2394706 - RNA, 20 nt, Bordetella pertussis
cgggcugcacuucgaaaaug

SEQ ID NO: 2394707 - RNA, 18 nt, Bordetella pertussis
cgggcugcgacaggcgca

SEQ ID NO: 2394708 - RNA, 13 nt, Bordetella pertussis
cgggcugcgcggg

SEQ ID NO: 2394709 - RNA, 12 nt, Bordetella pertussis
cgggcugcggcu

SEQ ID NO: 2394710 - RNA, 16 nt, Bordetella pertussis
cgggcugcugcacgcg

SEQ ID NO: 2394711 - RNA, 23 nt, Bordetella pertussis
cgggcugcugcacgcgcgcgggc

SEQ ID NO: 2394712 - RNA, 13 nt, Bordetella pertussis
cgggcugcugccc

SEQ ID NO: 2394713 - RNA, 20 nt, Bordetella pertussis
cgggcuggagaacgagccgg

SEQ ID NO: 2394714 - RNA, 21 nt, Bordetella pertussis
cgggguccugaggccaggccg

SEQ ID NO: 2394715 - RNA, 22 nt, Bordetella pertussis
cgggguccugaggccaggccgg

SEQ ID NO: 2394716 - RNA, 13 nt, Bordetella pertussis
cggggucgaucgc

SEQ ID NO: 2394717 - RNA, 24 nt, Bordetella pertussis
cggggucgaucgcaucgcggcagc

SEQ ID NO: 2394718 - RNA, 15 nt, Bordetella pertussis
cggggucggccacca

SEQ ID NO: 2394719 - RNA, 17 nt, Bordetella pertussis
cggggucggccaccacc

SEQ ID NO: 2394720 - RNA, 13 nt, Bordetella pertussis
cggggucggggca

SEQ ID NO: 2394721 - RNA, 18 nt, Bordetella pertussis
cggggucggggcaggccu

SEQ ID NO: 2394722 - RNA, 19 nt, Bordetella pertussis
cggggucgucggcgcugca

SEQ ID NO: 2394723 - RNA, 21 nt, Bordetella pertussis
cggggucgucggcgcugcagc

SEQ ID NO: 2394724 - RNA, 19 nt, Bordetella pertussis
cggggucuugccgcgcagc

SEQ ID NO: 2394725 - RNA, 12 nt, Bordetella pertussis
cggggugcagcu

SEQ ID NO: 2394726 - RNA, 12 nt, Bordetella pertussis
cggggugccugu

SEQ ID NO: 2394727 - RNA, 21 nt, Bordetella pertussis
cggggugccugucccugcggg

SEQ ID NO: 2394728 - RNA, 15 nt, Bordetella pertussis
cgggguggccggcgc

SEQ ID NO: 2394729 - RNA, 13 nt, Bordetella pertussis
cgggguggcgucg

SEQ ID NO: 2394730 - RNA, 14 nt, Bordetella pertussis
cgggguggucuucc

SEQ ID NO: 2394731 - RNA, 23 nt, Bordetella pertussis
cgggguggucuuccaggcgcagg

SEQ ID NO: 2394732 - RNA, 16 nt, Bordetella pertussis
cgggguuccacagcgc

SEQ ID NO: 2394733 - RNA, 19 nt, Bordetella pertussis
cgggguuccacagcgccga

SEQ ID NO: 2394734 - RNA, 20 nt, Bordetella pertussis
cgggguugggaucgcgccag

SEQ ID NO: 2394735 - RNA, 21 nt, Bordetella pertussis
cgggguugggaucgcgccagg

SEQ ID NO: 2394736 - RNA, 19 nt, Bordetella pertussis
cggguacguggccccaggc

SEQ ID NO: 2394737 - RNA, 17 nt, Bordetella pertussis
cggguacuggccgacgg

SEQ ID NO: 2394738 - RNA, 20 nt, Bordetella pertussis
cggguaggcaaagcgcagca

SEQ ID NO: 2394739 - RNA, 17 nt, Bordetella pertussis
cgggucaaguccggcgc

SEQ ID NO: 2394740 - RNA, 16 nt, Bordetella pertussis
cgggucacccgccgca

SEQ ID NO: 2394741 - RNA, 20 nt, Bordetella pertussis
cgggucagccuugcuccggc

SEQ ID NO: 2394742 - RNA, 21 nt, Bordetella pertussis
cgggucagccuugcuccggcg

SEQ ID NO: 2394743 - RNA, 22 nt, Bordetella pertussis
cgggucagccuugcuccggcgu

SEQ ID NO: 2394744 - RNA, 15 nt, Bordetella pertussis
cgggucaggccgccg

SEQ ID NO: 2394745 - RNA, 16 nt, Bordetella pertussis
cgggucaggcugcggc

SEQ ID NO: 2394746 - RNA, 19 nt, Bordetella pertussis
cgggucaggcugcggcgga

SEQ ID NO: 2394747 - RNA, 18 nt, Bordetella pertussis
cggguccacguggcgacg

SEQ ID NO: 2394748 - RNA, 14 nt, Bordetella pertussis
cggguccagcacgc

SEQ ID NO: 2394749 - RNA, 15 nt, Bordetella pertussis
cggguccagcacgcc

SEQ ID NO: 2394750 - RNA, 21 nt, Bordetella pertussis
cggguccagcacgccuugcuc

SEQ ID NO: 2394751 - RNA, 18 nt, Bordetella pertussis
cggguccagcaggauggc

SEQ ID NO: 2394752 - RNA, 13 nt, Bordetella pertussis
cggguccagcccc

SEQ ID NO: 2394753 - RNA, 14 nt, Bordetella pertussis
cggguccaggcccg

SEQ ID NO: 2394754 - RNA, 21 nt, Bordetella pertussis
cgggucccaaccagggccgcc

SEQ ID NO: 2394755 - RNA, 13 nt, Bordetella pertussis
cggguccggccgc

SEQ ID NO: 2394756 - RNA, 23 nt, Bordetella pertussis
cggguccggccgcgcaaggcggc

SEQ ID NO: 2394757 - RNA, 13 nt, Bordetella pertussis
cgggucgagcgcc

SEQ ID NO: 2394758 - RNA, 16 nt, Bordetella pertussis
cgggucgaggucgaug

SEQ ID NO: 2394759 - RNA, 19 nt, Bordetella pertussis
cgggucgaguugcgcgcca

SEQ ID NO: 2394760 - RNA, 12 nt, Bordetella pertussis
cgggucgcgcag

SEQ ID NO: 2394761 - RNA, 13 nt, Bordetella pertussis
cgggucgcgcagc

SEQ ID NO: 2394762 - RNA, 14 nt, Bordetella pertussis
cgggucgcgcagca

SEQ ID NO: 2394763 - RNA, 15 nt, Bordetella pertussis
cgggucgcgcagcag

SEQ ID NO: 2394764 - RNA, 17 nt, Bordetella pertussis
cgggucgcgcagcaggg

SEQ ID NO: 2394765 - RNA, 18 nt, Bordetella pertussis
cgggucgcgcagcagggc

SEQ ID NO: 2394766 - RNA, 20 nt, Bordetella pertussis
cgggucgcgcagcagggccu

SEQ ID NO: 2394767 - RNA, 22 nt, Bordetella pertussis
cgggucgcgcagcagggccugg

SEQ ID NO: 2394768 - RNA, 14 nt, Bordetella pertussis
cgggucgcggcacg

SEQ ID NO: 2394769 - RNA, 19 nt, Bordetella pertussis
cgggucgcugugcgcggcg

SEQ ID NO: 2394770 - RNA, 19 nt, Bordetella pertussis
cgggucggcgaacagcgcg

SEQ ID NO: 2394771 - RNA, 14 nt, Bordetella pertussis
cgggucgucgggcg

SEQ ID NO: 2394772 - RNA, 16 nt, Bordetella pertussis
cgggucgucgggcggc

SEQ ID NO: 2394773 - RNA, 17 nt, Bordetella pertussis
cgggucguuggucgggu

SEQ ID NO: 2394774 - RNA, 18 nt, Bordetella pertussis
cgggucuccacgaagucg

SEQ ID NO: 2394775 - RNA, 15 nt, Bordetella pertussis
cgggucuugagcggc

SEQ ID NO: 2394776 - RNA, 18 nt, Bordetella pertussis
cgggucuugagcggcccg

SEQ ID NO: 2394777 - RNA, 21 nt, Bordetella pertussis
cgggucuugagcggcccgggc

SEQ ID NO: 2394778 - RNA, 20 nt, Bordetella pertussis
cgggugaggggccagccugg

SEQ ID NO: 2394779 - RNA, 21 nt, Bordetella pertussis
cgggugauauuggcgaacgug

SEQ ID NO: 2394780 - RNA, 20 nt, Bordetella pertussis
cgggugaucaguccgacgac

SEQ ID NO: 2394781 - RNA, 17 nt, Bordetella pertussis
cgggugaugcugcagcg

SEQ ID NO: 2394782 - RNA, 21 nt, Bordetella pertussis
cgggugcagguccggucgcgc

SEQ ID NO: 2394783 - RNA, 14 nt, Bordetella pertussis
cgggugccaguccc

SEQ ID NO: 2394784 - RNA, 15 nt, Bordetella pertussis
cgggugccagucccc

SEQ ID NO: 2394785 - RNA, 21 nt, Bordetella pertussis
cgggugccuguccccacaggg

SEQ ID NO: 2394786 - RNA, 22 nt, Bordetella pertussis
cgggugccuguccccgcgggga

SEQ ID NO: 2394787 - RNA, 14 nt, Bordetella pertussis
cgggugcgcagcac

SEQ ID NO: 2394788 - RNA, 22 nt, Bordetella pertussis
cgggugcgcagcacaugggcgc

SEQ ID NO: 2394789 - RNA, 20 nt, Bordetella pertussis
cgggugcgccugcagcgccg

SEQ ID NO: 2394790 - RNA, 18 nt, Bordetella pertussis
cgggugcggcgccugcgu

SEQ ID NO: 2394791 - RNA, 21 nt, Bordetella pertussis
cgggugcgggcaaacggcggc

SEQ ID NO: 2394792 - RNA, 22 nt, Bordetella pertussis
cgggugcgggcaaacggcggca

SEQ ID NO: 2394793 - RNA, 14 nt, Bordetella pertussis
cgggugcugcagcg

SEQ ID NO: 2394794 - RNA, 15 nt, Bordetella pertussis
cgggugcugcagcgc

SEQ ID NO: 2394795 - RNA, 22 nt, Bordetella pertussis
cggguggccgauuccagcgccg

SEQ ID NO: 2394796 - RNA, 21 nt, Bordetella pertussis
cggguggccgcuccagagcgc

SEQ ID NO: 2394797 - RNA, 16 nt, Bordetella pertussis
cggguggccucgcccu

SEQ ID NO: 2394798 - RNA, 19 nt, Bordetella pertussis
cgggugggcauccagcggc

SEQ ID NO: 2394799 - RNA, 15 nt, Bordetella pertussis
cgggugggccggcuu

SEQ ID NO: 2394800 - RNA, 14 nt, Bordetella pertussis
cgggugggcgcgcc

SEQ ID NO: 2394801 - RNA, 15 nt, Bordetella pertussis
cgggugggcgcgccg

SEQ ID NO: 2394802 - RNA, 16 nt, Bordetella pertussis
cgggugggcgcgccgc

SEQ ID NO: 2394803 - RNA, 17 nt, Bordetella pertussis
cgggugggcgcgccgcg

SEQ ID NO: 2394804 - RNA, 14 nt, Bordetella pertussis
cggguggucgcgcc

SEQ ID NO: 2394805 - RNA, 16 nt, Bordetella pertussis
cggguggucgcgcccg

SEQ ID NO: 2394806 - RNA, 21 nt, Bordetella pertussis
cggguguggggggucaggccg

SEQ ID NO: 2394807 - RNA, 22 nt, Bordetella pertussis
cggguguggggggucaggccgu

SEQ ID NO: 2394808 - RNA, 20 nt, Bordetella pertussis
cggguguuccggcgcgcggu

SEQ ID NO: 2394809 - RNA, 17 nt, Bordetella pertussis
cggguguugucaugcga

SEQ ID NO: 2394810 - RNA, 13 nt, Bordetella pertussis
cggguucgacgcc

SEQ ID NO: 2394811 - RNA, 15 nt, Bordetella pertussis
cggguucgacgccgg

SEQ ID NO: 2394812 - RNA, 19 nt, Bordetella pertussis
cggguucggcgguuccagc

SEQ ID NO: 2394813 - RNA, 22 nt, Bordetella pertussis
cggguucggcgguuccagccug

SEQ ID NO: 2394814 - RNA, 13 nt, Bordetella pertussis
cggguugccgcug

SEQ ID NO: 2394815 - RNA, 16 nt, Bordetella pertussis
cggguugcgcgccagc

SEQ ID NO: 2394816 - RNA, 18 nt, Bordetella pertussis
cggguugcgcgccagcuc

SEQ ID NO: 2394817 - RNA, 20 nt, Bordetella pertussis
cggguugcgcgccagcucgc

SEQ ID NO: 2394818 - RNA, 21 nt, Bordetella pertussis
cggguugcgcgccagcucgcg

SEQ ID NO: 2394819 - RNA, 14 nt, Bordetella pertussis
cggguugcggcagc

SEQ ID NO: 2394820 - RNA, 18 nt, Bordetella pertussis
cggguugcggcagcgccg

SEQ ID NO: 2394821 - RNA, 20 nt, Bordetella pertussis
cggguugcggcagcgccgca

SEQ ID NO: 2394822 - RNA, 13 nt, Bordetella pertussis
cggguuggcgaug

SEQ ID NO: 2394823 - RNA, 23 nt, Bordetella pertussis
cggguuggcgaugcucacgccca

SEQ ID NO: 2394824 - RNA, 17 nt, Bordetella pertussis
cggguuggcguccaggc

SEQ ID NO: 2394825 - RNA, 19 nt, Bordetella pertussis
cggguuggcguccaggcgc

SEQ ID NO: 2394826 - RNA, 23 nt, Bordetella pertussis
cggguuggcguccaggcgcgcca

SEQ ID NO: 2394827 - RNA, 22 nt, Bordetella pertussis
cggguuggucgucagcgccgcg

SEQ ID NO: 2394828 - RNA, 17 nt, Bordetella pertussis
cguccgcgucgccgccg

SEQ ID NO: 2394829 - RNA, 17 nt, Bordetella pertussis
cguccggcacggcggca

SEQ ID NO: 2394830 - RNA, 15 nt, Bordetella pertussis
cguccggccccagga

SEQ ID NO: 2394831 - RNA, 12 nt, Bordetella pertussis
cguccggcgccc

SEQ ID NO: 2394832 - RNA, 20 nt, Bordetella pertussis
cguccggcgcccgccgccgg

SEQ ID NO: 2394833 - RNA, 22 nt, Bordetella pertussis
cguccggcgcccgccgccgggc

SEQ ID NO: 2394834 - RNA, 13 nt, Bordetella pertussis
cguccggcgcgcg

SEQ ID NO: 2394835 - RNA, 15 nt, Bordetella pertussis
cguccggcgcgcgca

SEQ ID NO: 2394836 - RNA, 13 nt, Bordetella pertussis
cguccggcgggcc

SEQ ID NO: 2394837 - RNA, 14 nt, Bordetella pertussis
cguccggcgggccg

SEQ ID NO: 2394838 - RNA, 18 nt, Bordetella pertussis
cguccggcgggccgcugu

SEQ ID NO: 2394839 - RNA, 22 nt, Bordetella pertussis
cguccgggccgguuucggccug

SEQ ID NO: 2394840 - RNA, 18 nt, Bordetella pertussis
cguccggggucagguuga

SEQ ID NO: 2394841 - RNA, 15 nt, Bordetella pertussis
cguccguccuggcca

SEQ ID NO: 2394842 - RNA, 18 nt, Bordetella pertussis
cguccguccuggccacug

SEQ ID NO: 2394843 - RNA, 20 nt, Bordetella pertussis
cguccguccuggccacugcc

SEQ ID NO: 2394844 - RNA, 14 nt, Bordetella pertussis
cguccgucgggcaa

SEQ ID NO: 2394845 - RNA, 18 nt, Bordetella pertussis
cguccgucucgcccaggc

SEQ ID NO: 2394846 - RNA, 15 nt, Bordetella pertussis
cguccguggccggcg

SEQ ID NO: 2394847 - RNA, 18 nt, Bordetella pertussis
cguccguuucgucggcgc

SEQ ID NO: 2394848 - RNA, 22 nt, Bordetella pertussis
cguccguuucgucggcgcgcgc

SEQ ID NO: 2394849 - RNA, 23 nt, Bordetella pertussis
cguccguuucgucggcgcgcgcc

SEQ ID NO: 2394850 - RNA, 21 nt, Bordetella pertussis
cguccucaggcccgcggcgcc

SEQ ID NO: 2394851 - RNA, 17 nt, Bordetella pertussis
cguccucgaugacgacg

SEQ ID NO: 2394852 - RNA, 14 nt, Bordetella pertussis
cguccucggcacgg

SEQ ID NO: 2394853 - RNA, 17 nt, Bordetella pertussis
cguccucggcacggcca

SEQ ID NO: 2394854 - RNA, 18 nt, Bordetella pertussis
cguccucggcacggccag

SEQ ID NO: 2394855 - RNA, 14 nt, Bordetella pertussis
cguccucggccacg

SEQ ID NO: 2394856 - RNA, 15 nt, Bordetella pertussis
cguccucggccacgu

SEQ ID NO: 2394857 - RNA, 13 nt, Bordetella pertussis
cguccucggccag

SEQ ID NO: 2394858 - RNA, 16 nt, Bordetella pertussis
cguccucggccagccg

SEQ ID NO: 2394859 - RNA, 18 nt, Bordetella pertussis
cguccucggccagccggg

SEQ ID NO: 2394860 - RNA, 13 nt, Bordetella pertussis
cguccucggccug

SEQ ID NO: 2394861 - RNA, 17 nt, Bordetella pertussis
cguccucggccuggccc

SEQ ID NO: 2394862 - RNA, 22 nt, Bordetella pertussis
cguccucggccuggccccaggc

SEQ ID NO: 2394863 - RNA, 17 nt, Bordetella pertussis
cguccucgucggccaug

SEQ ID NO: 2394864 - RNA, 22 nt, Bordetella pertussis
cguccugcaggaaggccgccgc

SEQ ID NO: 2394865 - RNA, 18 nt, Bordetella pertussis
cguccugcaggcggcgca

SEQ ID NO: 2394866 - RNA, 19 nt, Bordetella pertussis
cguccugccaguugccgcc

SEQ ID NO: 2394867 - RNA, 21 nt, Bordetella pertussis
cguccugccaguugccgccgc

SEQ ID NO: 2394868 - RNA, 21 nt, Bordetella pertussis
cguccugccauugcgcggccu

SEQ ID NO: 2394869 - RNA, 22 nt, Bordetella pertussis
cguccugccauugcgcggccug

SEQ ID NO: 2394870 - RNA, 13 nt, Bordetella pertussis
cguccugccgcga

SEQ ID NO: 2394871 - RNA, 12 nt, Bordetella pertussis
cguccugcggcg

SEQ ID NO: 2394872 - RNA, 14 nt, Bordetella pertussis
cguccugcggcggc

SEQ ID NO: 2394873 - RNA, 15 nt, Bordetella pertussis
cguccugcggcggca

SEQ ID NO: 2394874 - RNA, 19 nt, Bordetella pertussis
cguccugcggcggcagcuu

SEQ ID NO: 2394875 - RNA, 20 nt, Bordetella pertussis
cguccugcggcggcagcuug

SEQ ID NO: 2394876 - RNA, 15 nt, Bordetella pertussis
cguccugcugcggca

SEQ ID NO: 2394877 - RNA, 14 nt, Bordetella pertussis
cguccuggccacug

SEQ ID NO: 2394878 - RNA, 19 nt, Bordetella pertussis
cguccuggcgaccggcggc

SEQ ID NO: 2394879 - RNA, 20 nt, Bordetella pertussis
cguccuggcgaccggcggca

SEQ ID NO: 2394880 - RNA, 12 nt, Bordetella pertussis
cguccuggcgcg

SEQ ID NO: 2394881 - RNA, 15 nt, Bordetella pertussis
cguccuggcgcgaga

SEQ ID NO: 2394882 - RNA, 21 nt, Bordetella pertussis
cguccugggccgagcgcgcca

SEQ ID NO: 2394883 - RNA, 23 nt, Bordetella pertussis
cguccugggccgagcgcgccagc

SEQ ID NO: 2394884 - RNA, 17 nt, Bordetella pertussis
cguccuggugcacgccg

SEQ ID NO: 2394885 - RNA, 16 nt, Bordetella pertussis
cguccugguggaccug

SEQ ID NO: 2394886 - RNA, 19 nt, Bordetella pertussis
cguccugguggaccugccg

SEQ ID NO: 2394887 - RNA, 23 nt, Bordetella pertussis
cguccuuacuugcgcacggcggc

SEQ ID NO: 2394888 - RNA, 17 nt, Bordetella pertussis
cguccuucgucggcggg

SEQ ID NO: 2394889 - RNA, 14 nt, Bordetella pertussis
cguccuugagcgcc

SEQ ID NO: 2394890 - RNA, 14 nt, Bordetella pertussis
cguccuuggcgccg

SEQ ID NO: 2394891 - RNA, 14 nt, Bordetella pertussis
cguccuuggcggcc

SEQ ID NO: 2394892 - RNA, 15 nt, Bordetella pertussis
cguccuuggcggccu

SEQ ID NO: 2394893 - RNA, 18 nt, Bordetella pertussis
cguccuuggcggccuugc

SEQ ID NO: 2394894 - RNA, 21 nt, Bordetella pertussis
cguccuuggcguccggcccca

SEQ ID NO: 2394895 - RNA, 16 nt, Bordetella pertussis
cguccuugugccaggu

SEQ ID NO: 2394896 - RNA, 15 nt, Bordetella pertussis
cgucgaaacgcugcg

SEQ ID NO: 2394897 - RNA, 23 nt, Bordetella pertussis
cgucgaaauaggaucccggcgcc

SEQ ID NO: 2394898 - RNA, 14 nt, Bordetella pertussis
cgucgaacagcauc

SEQ ID NO: 2394899 - RNA, 15 nt, Bordetella pertussis
cgucgaacagcuucu

SEQ ID NO: 2394900 - RNA, 21 nt, Bordetella pertussis
cgucgaacagcuucuccaugc

SEQ ID NO: 2394901 - RNA, 22 nt, Bordetella pertussis
cgucgaacagcuucuccaugcg

SEQ ID NO: 2394902 - RNA, 20 nt, Bordetella pertussis
cgucgaacggccgggcgccc

SEQ ID NO: 2394903 - RNA, 17 nt, Bordetella pertussis
cgucgaacuccucgacg

SEQ ID NO: 2394904 - RNA, 15 nt, Bordetella pertussis
cgucgaacuuguucu

SEQ ID NO: 2394905 - RNA, 17 nt, Bordetella pertussis
cgucgaagccggcgcca

SEQ ID NO: 2394906 - RNA, 17 nt, Bordetella pertussis
cgucgaagcugccgugg

SEQ ID NO: 2394907 - RNA, 16 nt, Bordetella pertussis
cgucgaaggccgccgg

SEQ ID NO: 2394908 - RNA, 15 nt, Bordetella pertussis
cgucgaaggcgcgcu

SEQ ID NO: 2394909 - RNA, 16 nt, Bordetella pertussis
cgucgaaggcgcgcuc

SEQ ID NO: 2394910 - RNA, 22 nt, Bordetella pertussis
cgucgaaggcgcgcuccagcau

SEQ ID NO: 2394911 - RNA, 13 nt, Bordetella pertussis
cgucgaaggcggc

SEQ ID NO: 2394912 - RNA, 18 nt, Bordetella pertussis
cgucgaaggcggccggca

SEQ ID NO: 2394913 - RNA, 22 nt, Bordetella pertussis
cgucgaauacgaaacaggcgcc

SEQ ID NO: 2394914 - RNA, 22 nt, Bordetella pertussis
cgucgaauuccaguugcgcgcc

SEQ ID NO: 2394915 - RNA, 23 nt, Bordetella pertussis
cgucgaauuccaguugcgcgccg

SEQ ID NO: 2394916 - RNA, 21 nt, Bordetella pertussis
cgucgacaccaaccugcuggc

SEQ ID NO: 2394917 - RNA, 23 nt, Bordetella pertussis
cgucgacagcaugaacggcagcg

SEQ ID NO: 2394918 - RNA, 15 nt, Bordetella pertussis
cgucgaccaccagca

SEQ ID NO: 2394919 - RNA, 13 nt, Bordetella pertussis
cgucgaccacgcc

SEQ ID NO: 2394920 - RNA, 21 nt, Bordetella pertussis
cgucgaccacgccggcggcca

SEQ ID NO: 2394921 - RNA, 15 nt, Bordetella pertussis
cgucgaccagcagca

SEQ ID NO: 2394922 - RNA, 17 nt, Bordetella pertussis
cgucgaccagcauccuc

SEQ ID NO: 2394923 - RNA, 13 nt, Bordetella pertussis
cgucgaccccguc

SEQ ID NO: 2394924 - RNA, 14 nt, Bordetella pertussis
cgucgaccgacagc

SEQ ID NO: 2394925 - RNA, 14 nt, Bordetella pertussis
cgucgaccgcgaag

SEQ ID NO: 2394926 - RNA, 15 nt, Bordetella pertussis
cgucgaccgcgaagc

SEQ ID NO: 2394927 - RNA, 19 nt, Bordetella pertussis
cgucgaccgcgaagcgcgc

SEQ ID NO: 2394928 - RNA, 21 nt, Bordetella pertussis
cgucgaccgcgaagcgcgcca

SEQ ID NO: 2394929 - RNA, 19 nt, Bordetella pertussis
cgucgaccgcgggcgcgcg

SEQ ID NO: 2394930 - RNA, 18 nt, Bordetella pertussis
cgucgaccucgagcaccu

SEQ ID NO: 2394931 - RNA, 22 nt, Bordetella pertussis
cgucgaccuggaucacgugcca

SEQ ID NO: 2394932 - RNA, 18 nt, Bordetella pertussis
cgucgacgcagcagccgc

SEQ ID NO: 2394933 - RNA, 22 nt, Bordetella pertussis
cgucgacgcagcagccgcuagg

SEQ ID NO: 2394934 - RNA, 21 nt, Bordetella pertussis
cgggcuggagaacgagccggc

SEQ ID NO: 2394935 - RNA, 20 nt, Bordetella pertussis
cgggcuggauccggcgcugg

SEQ ID NO: 2394936 - RNA, 15 nt, Bordetella pertussis
cgggcuggccgccug

SEQ ID NO: 2394937 - RNA, 20 nt, Bordetella pertussis
cgggcuggccgccugcugcg

SEQ ID NO: 2394938 - RNA, 16 nt, Bordetella pertussis
cgggcugggccgaggc

SEQ ID NO: 2394939 - RNA, 19 nt, Bordetella pertussis
cgggcugggccgaggcgcc

SEQ ID NO: 2394940 - RNA, 18 nt, Bordetella pertussis
cgggcuggggcaggcacu

SEQ ID NO: 2394941 - RNA, 23 nt, Bordetella pertussis
cgggcuggggcaggcacuggcgc

SEQ ID NO: 2394942 - RNA, 19 nt, Bordetella pertussis
cgggcugggugaagccaag

SEQ ID NO: 2394943 - RNA, 20 nt, Bordetella pertussis
cgggcuggucagccuggggc

SEQ ID NO: 2394944 - RNA, 16 nt, Bordetella pertussis
cgggcuggucgcgccg

SEQ ID NO: 2394945 - RNA, 17 nt, Bordetella pertussis
cgggcuggucgcgccgg

SEQ ID NO: 2394946 - RNA, 22 nt, Bordetella pertussis
cgggcugguggugggcgugccc

SEQ ID NO: 2394947 - RNA, 20 nt, Bordetella pertussis
cgggcugucgcagucggggc

SEQ ID NO: 2394948 - RNA, 18 nt, Bordetella pertussis
cgggcuguucgcgcagca

SEQ ID NO: 2394949 - RNA, 19 nt, Bordetella pertussis
cgggcuguucgcgcagcag

SEQ ID NO: 2394950 - RNA, 20 nt, Bordetella pertussis
cgggcuguucgcgcagcagg

SEQ ID NO: 2394951 - RNA, 15 nt, Bordetella pertussis
cgggcuugcgcaccc

SEQ ID NO: 2394952 - RNA, 20 nt, Bordetella pertussis
cgggcuugcgcaccccggug

SEQ ID NO: 2394953 - RNA, 14 nt, Bordetella pertussis
cgggcuugcugccc

SEQ ID NO: 2394954 - RNA, 16 nt, Bordetella pertussis
cgggcuugcugccccc

SEQ ID NO: 2394955 - RNA, 20 nt, Bordetella pertussis
cgggcuugcugccccccgag

SEQ ID NO: 2394956 - RNA, 23 nt, Bordetella pertussis
cgggcuugcugccccccgagggg

SEQ ID NO: 2394957 - RNA, 18 nt, Bordetella pertussis
cgggcuuucggucucgcg

SEQ ID NO: 2394958 - RNA, 19 nt, Bordetella pertussis
cgggcuuucggucucgcgc

SEQ ID NO: 2394959 - RNA, 23 nt, Bordetella pertussis
cggggaaacggccaagcagcgcc

SEQ ID NO: 2394960 - RNA, 19 nt, Bordetella pertussis
cggggaaauugacggcgcu

SEQ ID NO: 2394961 - RNA, 18 nt, Bordetella pertussis
cggggaacaggcgcgcca

SEQ ID NO: 2394962 - RNA, 20 nt, Bordetella pertussis
cggggaaccccgcauuuuug

SEQ ID NO: 2394963 - RNA, 23 nt, Bordetella pertussis
cggggaagauguggucggcgccg

SEQ ID NO: 2394964 - RNA, 22 nt, Bordetella pertussis
cggggaagccgccggcgugccc

SEQ ID NO: 2394965 - RNA, 14 nt, Bordetella pertussis
cggggacaggcacc

SEQ ID NO: 2394966 - RNA, 18 nt, Bordetella pertussis
cggggacaggcacccggg

SEQ ID NO: 2394967 - RNA, 15 nt, Bordetella pertussis
cggggacaggcaccg

SEQ ID NO: 2394968 - RNA, 16 nt, Bordetella pertussis
cggggacaggcaccgc

SEQ ID NO: 2394969 - RNA, 20 nt, Bordetella pertussis
cggggacaggcaccgccgca

SEQ ID NO: 2394970 - RNA, 17 nt, Bordetella pertussis
cggggacaggcaccuug

SEQ ID NO: 2394971 - RNA, 15 nt, Bordetella pertussis
cggggacaggcacgc

SEQ ID NO: 2394972 - RNA, 19 nt, Bordetella pertussis
cggggacaggcacgcgccg

SEQ ID NO: 2394973 - RNA, 21 nt, Bordetella pertussis
cggggacaggcgcccgugcgc

SEQ ID NO: 2394974 - RNA, 17 nt, Bordetella pertussis
cggggacaggcucccgc

SEQ ID NO: 2394975 - RNA, 16 nt, Bordetella pertussis
cggggacuggcaccgg

SEQ ID NO: 2394976 - RNA, 16 nt, Bordetella pertussis
cggggacuggcucccg

SEQ ID NO: 2394977 - RNA, 16 nt, Bordetella pertussis
cggggaggccucgacg

SEQ ID NO: 2394978 - RNA, 15 nt, Bordetella pertussis
cggggaucaccagcc

SEQ ID NO: 2394979 - RNA, 17 nt, Bordetella pertussis
cggggaucaccagcccg

SEQ ID NO: 2394980 - RNA, 20 nt, Bordetella pertussis
cggggauggcuuccugcggc

SEQ ID NO: 2394981 - RNA, 18 nt, Bordetella pertussis
cggggauguuccggcugg

SEQ ID NO: 2394982 - RNA, 21 nt, Bordetella pertussis
cggggcaacgacgcaggcgcc

SEQ ID NO: 2394983 - RNA, 14 nt, Bordetella pertussis
cggggcacccaggc

SEQ ID NO: 2394984 - RNA, 12 nt, Bordetella pertussis
cggggcaggccg

SEQ ID NO: 2394985 - RNA, 13 nt, Bordetella pertussis
cggggcaggccga

SEQ ID NO: 2394986 - RNA, 22 nt, Bordetella pertussis
cggggcaggcgccugcucacgc

SEQ ID NO: 2394987 - RNA, 16 nt, Bordetella pertussis
cggggcagggcgccug

SEQ ID NO: 2394988 - RNA, 21 nt, Bordetella pertussis
cggggcagggcgccugcagac

SEQ ID NO: 2394989 - RNA, 16 nt, Bordetella pertussis
cggggccaagauccag

SEQ ID NO: 2394990 - RNA, 18 nt, Bordetella pertussis
cggggccaagauccagcu

SEQ ID NO: 2394991 - RNA, 23 nt, Bordetella pertussis
cggggccacauggucgcccagca

SEQ ID NO: 2394992 - RNA, 21 nt, Bordetella pertussis
cggggcccgcgggcgcccggc

SEQ ID NO: 2394993 - RNA, 13 nt, Bordetella pertussis
cggggccgcagcu

SEQ ID NO: 2394994 - RNA, 18 nt, Bordetella pertussis
cggggccgccaacgccaa

SEQ ID NO: 2394995 - RNA, 12 nt, Bordetella pertussis
cggggccgccca

SEQ ID NO: 2394996 - RNA, 14 nt, Bordetella pertussis
cggggccgcccagc

SEQ ID NO: 2394997 - RNA, 15 nt, Bordetella pertussis
cggggccgcccagca

SEQ ID NO: 2394998 - RNA, 18 nt, Bordetella pertussis
cggggccgccucggcggc

SEQ ID NO: 2394999 - RNA, 13 nt, Bordetella pertussis
cggggccgcgccg

SEQ ID NO: 2395000 - RNA, 14 nt, Bordetella pertussis
cggggccgcgccgg

SEQ ID NO: 2395001 - RNA, 20 nt, Bordetella pertussis
cggggccgcuucggccugcg

SEQ ID NO: 2395002 - RNA, 22 nt, Bordetella pertussis
cggggccgcuucggccugcgcc

SEQ ID NO: 2395003 - RNA, 23 nt, Bordetella pertussis
cggggccgcuucggccugcgcca

SEQ ID NO: 2395004 - RNA, 12 nt, Bordetella pertussis
cggggccgggcc

SEQ ID NO: 2395005 - RNA, 14 nt, Bordetella pertussis
cggggccgggccgg

SEQ ID NO: 2395006 - RNA, 15 nt, Bordetella pertussis
cggggcgagcgcagc

SEQ ID NO: 2395007 - RNA, 15 nt, Bordetella pertussis
cggggcgcaccggca

SEQ ID NO: 2395008 - RNA, 21 nt, Bordetella pertussis
cggggcgcccagcgcgucggc

SEQ ID NO: 2395009 - RNA, 14 nt, Bordetella pertussis
cggggcgcggccgg

SEQ ID NO: 2395010 - RNA, 15 nt, Bordetella pertussis
cggggcggcgccugc

SEQ ID NO: 2395011 - RNA, 17 nt, Bordetella pertussis
cggggcggcggcgcccg

SEQ ID NO: 2395012 - RNA, 20 nt, Bordetella pertussis
cggggcggcucggcccuaga

SEQ ID NO: 2395013 - RNA, 21 nt, Bordetella pertussis
cggggcggucaaugcggcggc

SEQ ID NO: 2395014 - RNA, 23 nt, Bordetella pertussis
cggggcggucaaugcggcggcgc

SEQ ID NO: 2395015 - RNA, 17 nt, Bordetella pertussis
cggggcguccaccgccg

SEQ ID NO: 2395016 - RNA, 18 nt, Bordetella pertussis
cggggcguccaccgccga

SEQ ID NO: 2395017 - RNA, 16 nt, Bordetella pertussis
cggggcgucgcugcug

SEQ ID NO: 2395018 - RNA, 17 nt, Bordetella pertussis
cggggcgucgcugcugg

SEQ ID NO: 2395019 - RNA, 18 nt, Bordetella pertussis
cggggcgucgcugcuggc

SEQ ID NO: 2395020 - RNA, 13 nt, Bordetella pertussis
cggggcgugagca

SEQ ID NO: 2395021 - RNA, 17 nt, Bordetella pertussis
cggggcgugagcaggcg

SEQ ID NO: 2395022 - RNA, 20 nt, Bordetella pertussis
cggggcguucgacgggcagg

SEQ ID NO: 2395023 - RNA, 15 nt, Bordetella pertussis
cggggcuggccagcu

SEQ ID NO: 2395024 - RNA, 16 nt, Bordetella pertussis
cggggcuggccagcug

SEQ ID NO: 2395025 - RNA, 16 nt, Bordetella pertussis
cggggcuggcgcggcu

SEQ ID NO: 2395026 - RNA, 21 nt, Bordetella pertussis
cggggcuggcgcggcuggcga

SEQ ID NO: 2395027 - RNA, 22 nt, Bordetella pertussis
cggggcuggcgcggcuggcgau

SEQ ID NO: 2395028 - RNA, 13 nt, Bordetella pertussis
cggggcugucgag

SEQ ID NO: 2395029 - RNA, 15 nt, Bordetella pertussis
cggggcugucgcgcg

SEQ ID NO: 2395030 - RNA, 17 nt, Bordetella pertussis
cggggcugucgcgcgca

SEQ ID NO: 2395031 - RNA, 23 nt, Bordetella pertussis
cggggcugucgcgcgcaucgccg

SEQ ID NO: 2395032 - RNA, 23 nt, Bordetella pertussis
cgggggaccuucguucgaagucc

SEQ ID NO: 2395033 - RNA, 14 nt, Bordetella pertussis
cgggggcaggcacg

SEQ ID NO: 2395034 - RNA, 13 nt, Bordetella pertussis
cgggggcaggccg

SEQ ID NO: 2395035 - RNA, 14 nt, Bordetella pertussis
cgggggcaggccgc

SEQ ID NO: 2395036 - RNA, 16 nt, Bordetella pertussis
cgggggcaggccgcgg

SEQ ID NO: 2395037 - RNA, 13 nt, Bordetella pertussis
cgggggcggccgg

SEQ ID NO: 2395038 - RNA, 14 nt, Bordetella pertussis
cgggggcggccggg

SEQ ID NO: 2395039 - RNA, 13 nt, Bordetella pertussis
cgggggcgggccc

SEQ ID NO: 2395040 - RNA, 14 nt, Bordetella pertussis
cgggggcggguuca

SEQ ID NO: 2395041 - RNA, 15 nt, Bordetella pertussis
cggggggcaggcugg

SEQ ID NO: 2395042 - RNA, 13 nt, Bordetella pertussis
cggggguggacgc

SEQ ID NO: 2395043 - RNA, 21 nt, Bordetella pertussis
cggggguggacgccaagaccg

SEQ ID NO: 2395044 - RNA, 23 nt, Bordetella pertussis
cggggguggacgccaagaccgcg

SEQ ID NO: 2395045 - RNA, 17 nt, Bordetella pertussis
cggggucaauccgcccg

SEQ ID NO: 2395046 - RNA, 17 nt, Bordetella pertussis
cggggucagcgccggca

SEQ ID NO: 2395047 - RNA, 22 nt, Bordetella pertussis
cggggucagcgccggcacgcug

SEQ ID NO: 2395048 - RNA, 16 nt, Bordetella pertussis
cgggguccugaggcca

SEQ ID NO: 2395049 - RNA, 14 nt, Bordetella pertussis
cgggccgcuggccc

SEQ ID NO: 2395050 - RNA, 16 nt, Bordetella pertussis
cgggccgcuggcccgg

SEQ ID NO: 2395051 - RNA, 22 nt, Bordetella pertussis
cgggccgcuggucaccgccccg

SEQ ID NO: 2395052 - RNA, 13 nt, Bordetella pertussis
cgggccggauggc

SEQ ID NO: 2395053 - RNA, 14 nt, Bordetella pertussis
cgggccggauggcc

SEQ ID NO: 2395054 - RNA, 19 nt, Bordetella pertussis
cgggccggcaccacgaccg

SEQ ID NO: 2395055 - RNA, 14 nt, Bordetella pertussis
cgggccggccugcg

SEQ ID NO: 2395056 - RNA, 16 nt, Bordetella pertussis
cgggccggccugcguc

SEQ ID NO: 2395057 - RNA, 22 nt, Bordetella pertussis
cgggccggcgaugaagucgcgg

SEQ ID NO: 2395058 - RNA, 13 nt, Bordetella pertussis
cgggccggcgccg

SEQ ID NO: 2395059 - RNA, 15 nt, Bordetella pertussis
cgggccggcgcgccu

SEQ ID NO: 2395060 - RNA, 12 nt, Bordetella pertussis
cgggccggcggc

SEQ ID NO: 2395061 - RNA, 21 nt, Bordetella pertussis
cgggccggcggcagccggcca

SEQ ID NO: 2395062 - RNA, 22 nt, Bordetella pertussis
cgggccggcgggcaugacgacc

SEQ ID NO: 2395063 - RNA, 13 nt, Bordetella pertussis
cgggccggcuaca

SEQ ID NO: 2395064 - RNA, 15 nt, Bordetella pertussis
cgggccggcuacagc

SEQ ID NO: 2395065 - RNA, 20 nt, Bordetella pertussis
cgggccggcuacagcucgcc

SEQ ID NO: 2395066 - RNA, 21 nt, Bordetella pertussis
cgggccggcuacagcucgccg

SEQ ID NO: 2395067 - RNA, 22 nt, Bordetella pertussis
cgggccggcuacagcucgccgg

SEQ ID NO: 2395068 - RNA, 22 nt, Bordetella pertussis
cgggccggcucauucggcgcgc

SEQ ID NO: 2395069 - RNA, 15 nt, Bordetella pertussis
cgggccggcucggcg

SEQ ID NO: 2395070 - RNA, 17 nt, Bordetella pertussis
cggguugugcccgcccg

SEQ ID NO: 2395071 - RNA, 17 nt, Bordetella pertussis
cggguuucggcaucucg

SEQ ID NO: 2395072 - RNA, 23 nt, Bordetella pertussis
cggguuuuccuuuugcgcggccg

SEQ ID NO: 2395073 - RNA, 16 nt, Bordetella pertussis
cgguaaagaccuuggg

SEQ ID NO: 2395074 - RNA, 19 nt, Bordetella pertussis
cgguaagcguccgcgcgcc

SEQ ID NO: 2395075 - RNA, 21 nt, Bordetella pertussis
cgguaagcguccgcgcgccgc

SEQ ID NO: 2395076 - RNA, 19 nt, Bordetella pertussis
cgguaaggcgcuugcgcag

SEQ ID NO: 2395077 - RNA, 12 nt, Bordetella pertussis
cgguaauccagu

SEQ ID NO: 2395078 - RNA, 16 nt, Bordetella pertussis
cgguaaugacgcagcc

SEQ ID NO: 2395079 - RNA, 19 nt, Bordetella pertussis
cgguaaugacgcagccgcc

SEQ ID NO: 2395080 - RNA, 17 nt, Bordetella pertussis
cgguacagccaggccag

SEQ ID NO: 2395081 - RNA, 18 nt, Bordetella pertussis
cgguacagccaggccagc

SEQ ID NO: 2395082 - RNA, 14 nt, Bordetella pertussis
cgguacaggcugcc

SEQ ID NO: 2395083 - RNA, 16 nt, Bordetella pertussis
cguaauaguggucgcc

SEQ ID NO: 2395084 - RNA, 17 nt, Bordetella pertussis
cguaauaguggucgccg

SEQ ID NO: 2395085 - RNA, 16 nt, Bordetella pertussis
cgguggacggccagca

SEQ ID NO: 2395086 - RNA, 17 nt, Bordetella pertussis
cgguggaggacgccgac

SEQ ID NO: 2395087 - RNA, 15 nt, Bordetella pertussis
cgguggccagcgccu

SEQ ID NO: 2395088 - RNA, 12 nt, Bordetella pertussis
cgguggccaugc

SEQ ID NO: 2395089 - RNA, 17 nt, Bordetella pertussis
cgguggccaugcugggc

SEQ ID NO: 2395090 - RNA, 13 nt, Bordetella pertussis
cgucauggcgccg

SEQ ID NO: 2395091 - RNA, 22 nt, Bordetella pertussis
cgucaugggcggggccacaugg

SEQ ID NO: 2395092 - RNA, 17 nt, Bordetella pertussis
cgucauggucgaccagc

SEQ ID NO: 2395093 - RNA, 21 nt, Bordetella pertussis
cgucauggucgaccagcagcc

SEQ ID NO: 2395094 - RNA, 20 nt, Bordetella pertussis
cgucgagaaugacgguggug

SEQ ID NO: 2395095 - RNA, 15 nt, Bordetella pertussis
cgucgagcaccguga

SEQ ID NO: 2395096 - RNA, 12 nt, Bordetella pertussis
cgucgagcacgc

SEQ ID NO: 2395097 - RNA, 15 nt, Bordetella pertussis
cgucgagcacgcggc

SEQ ID NO: 2395098 - RNA, 16 nt, Bordetella pertussis
cgucgagcacgcggcg

SEQ ID NO: 2395099 - RNA, 21 nt, Bordetella pertussis
cgucgagcacgcggcgcggca

SEQ ID NO: 2395100 - RNA, 13 nt, Bordetella pertussis
cgucgagcacggg

SEQ ID NO: 2395101 - RNA, 14 nt, Bordetella pertussis
cgucgagcagcgca

SEQ ID NO: 2395102 - RNA, 18 nt, Bordetella pertussis
cgucgagcaggccggcgu

SEQ ID NO: 2395103 - RNA, 13 nt, Bordetella pertussis
cgucgagccgggc

SEQ ID NO: 2395104 - RNA, 16 nt, Bordetella pertussis
cgucgagccgggcgcc

SEQ ID NO: 2395105 - RNA, 22 nt, Bordetella pertussis
cgucgagcgcgaaauccagcgc

SEQ ID NO: 2395106 - RNA, 14 nt, Bordetella pertussis
cgucgagcgcgacg

SEQ ID NO: 2395107 - RNA, 15 nt, Bordetella pertussis
cgucgagcgcgacgc

SEQ ID NO: 2395108 - RNA, 14 nt, Bordetella pertussis
cgucgagcgcggcc

SEQ ID NO: 2395109 - RNA, 17 nt, Bordetella pertussis
cgucgagcgcggccagg

SEQ ID NO: 2395110 - RNA, 17 nt, Bordetella pertussis
cgucgagcucgauggcu

SEQ ID NO: 2395111 - RNA, 18 nt, Bordetella pertussis
cgucgaggaucaaggccc

SEQ ID NO: 2395112 - RNA, 13 nt, Bordetella pertussis
cgucgaggaugcg

SEQ ID NO: 2395113 - RNA, 23 nt, Bordetella pertussis
cgucgaggaugcgagcaaaggac

SEQ ID NO: 2395114 - RNA, 15 nt, Bordetella pertussis
cgucgaucagccacg

SEQ ID NO: 2395115 - RNA, 16 nt, Bordetella pertussis
cgucgaucagccacgu

SEQ ID NO: 2395116 - RNA, 18 nt, Bordetella pertussis
cgucgaucagcgcgggcc

SEQ ID NO: 2395117 - RNA, 16 nt, Bordetella pertussis
cgucgaucggcgcgcc

SEQ ID NO: 2395118 - RNA, 23 nt, Bordetella pertussis
cgucgaucggcgcgcccgccacg

SEQ ID NO: 2395119 - RNA, 15 nt, Bordetella pertussis
cgucgaugaccagcg

SEQ ID NO: 2395120 - RNA, 16 nt, Bordetella pertussis
cgucgaugaccagcgc

SEQ ID NO: 2395121 - RNA, 17 nt, Bordetella pertussis
cgucgaugaccagcgcc

SEQ ID NO: 2395122 - RNA, 18 nt, Bordetella pertussis
cgucgaugaccagcgccg

SEQ ID NO: 2395123 - RNA, 22 nt, Bordetella pertussis
cgucgaugaccagcgccggcgc

SEQ ID NO: 2395124 - RNA, 14 nt, Bordetella pertussis
cgucgaugaugacg

SEQ ID NO: 2395125 - RNA, 12 nt, Bordetella pertussis
cgucgaugaugc

SEQ ID NO: 2395126 - RNA, 13 nt, Bordetella pertussis
cgucgaugccgac

SEQ ID NO: 2395127 - RNA, 17 nt, Bordetella pertussis
cgucgaugccgaccagg

SEQ ID NO: 2395128 - RNA, 15 nt, Bordetella pertussis
cgucgauggcccgca

SEQ ID NO: 2395129 - RNA, 20 nt, Bordetella pertussis
cgucgauggcguacagcagg

SEQ ID NO: 2395130 - RNA, 21 nt, Bordetella pertussis
cgucgauuucgucgagcucga

SEQ ID NO: 2395131 - RNA, 17 nt, Bordetella pertussis
cgucgcaaaccugccgu

SEQ ID NO: 2395132 - RNA, 22 nt, Bordetella pertussis
cgucgcaaagccggaauccugg

SEQ ID NO: 2395133 - RNA, 23 nt, Bordetella pertussis
cgucgcaaagccggaauccuggc

SEQ ID NO: 2395134 - RNA, 22 nt, Bordetella pertussis
cgucgcacuggguggccagcgc

SEQ ID NO: 2395135 - RNA, 23 nt, Bordetella pertussis
cgucgcacuggguggccagcgcc

SEQ ID NO: 2395136 - RNA, 18 nt, Bordetella pertussis
cgucgccaaagcgcagcg

SEQ ID NO: 2395137 - RNA, 15 nt, Bordetella pertussis
cgucgccaccgccca

SEQ ID NO: 2395138 - RNA, 23 nt, Bordetella pertussis
cgucgccaccucgaucaccaccg

SEQ ID NO: 2395139 - RNA, 13 nt, Bordetella pertussis
cgucgccagcgac

SEQ ID NO: 2395140 - RNA, 13 nt, Bordetella pertussis
cgucgccagcgcg

SEQ ID NO: 2395141 - RNA, 14 nt, Bordetella pertussis
cgucgccaugcggc

SEQ ID NO: 2395142 - RNA, 22 nt, Bordetella pertussis
cgucgcccacauagaccggcug

SEQ ID NO: 2395143 - RNA, 23 nt, Bordetella pertussis
cgucgcccacauagaccggcugc

SEQ ID NO: 2395144 - RNA, 15 nt, Bordetella pertussis
cgucgcccuggcggc

SEQ ID NO: 2395145 - RNA, 18 nt, Bordetella pertussis
cgucgcccuggcggcggu

SEQ ID NO: 2395146 - RNA, 20 nt, Bordetella pertussis
cgucgcccuggcggcgguca

SEQ ID NO: 2395147 - RNA, 20 nt, Bordetella pertussis
cgucgccgaagcaaugcagc

SEQ ID NO: 2395148 - RNA, 14 nt, Bordetella pertussis
cgucgccgcccacg

SEQ ID NO: 2395149 - RNA, 17 nt, Bordetella pertussis
cgucgccgcccacggcg

SEQ ID NO: 2395150 - RNA, 13 nt, Bordetella pertussis
cgucgccgcccau

SEQ ID NO: 2395151 - RNA, 15 nt, Bordetella pertussis
cgucgccgcccaugc

SEQ ID NO: 2395152 - RNA, 12 nt, Bordetella pertussis
cgucgccgcccu

SEQ ID NO: 2395153 - RNA, 15 nt, Bordetella pertussis
cgucgccgcccugcu

SEQ ID NO: 2395154 - RNA, 18 nt, Bordetella pertussis
cgucgccgcccugcugcc

SEQ ID NO: 2395155 - RNA, 14 nt, Bordetella pertussis
cgucgccgcgccgu

SEQ ID NO: 2395156 - RNA, 12 nt, Bordetella pertussis
cgucgccgcgcg

SEQ ID NO: 2395157 - RNA, 15 nt, Bordetella pertussis
cgucgccgcgcggcg

SEQ ID NO: 2395158 - RNA, 19 nt, Bordetella pertussis
cgucgccgcuggccagccg

SEQ ID NO: 2395159 - RNA, 20 nt, Bordetella pertussis
cgucgccgcuggccagccgc

SEQ ID NO: 2395160 - RNA, 15 nt, Bordetella pertussis
cgucgccggccaggc

SEQ ID NO: 2395161 - RNA, 16 nt, Bordetella pertussis
cgucgccggccaggca

SEQ ID NO: 2395162 - RNA, 14 nt, Bordetella pertussis
cgucgccggcgaug

SEQ ID NO: 2395163 - RNA, 13 nt, Bordetella pertussis
cgucgccggcgcu

SEQ ID NO: 2395164 - RNA, 15 nt, Bordetella pertussis
cgucgccggcguucu

SEQ ID NO: 2395165 - RNA, 23 nt, Bordetella pertussis
cgucgccucccauugcgcggcca

SEQ ID NO: 2395166 - RNA, 20 nt, Bordetella pertussis
cgucgccugcccgcacgggc

SEQ ID NO: 2395167 - RNA, 16 nt, Bordetella pertussis
cgucgccuggucgacg

SEQ ID NO: 2395168 - RNA, 15 nt, Bordetella pertussis
cgucgccuucggcgg

SEQ ID NO: 2395169 - RNA, 16 nt, Bordetella pertussis
cgucgccuucggcggc

SEQ ID NO: 2395170 - RNA, 20 nt, Bordetella pertussis
cgucgcgaaacccucccacg

SEQ ID NO: 2395171 - RNA, 16 nt, Bordetella pertussis
cgucgcgaugcgccag

SEQ ID NO: 2395172 - RNA, 17 nt, Bordetella pertussis
cgucgcgaugcgccagg

SEQ ID NO: 2395173 - RNA, 18 nt, Bordetella pertussis
cgucgcgaugcgccaggc

SEQ ID NO: 2395174 - RNA, 21 nt, Bordetella pertussis
cgucgcgauuuccaugacggu

SEQ ID NO: 2395175 - RNA, 18 nt, Bordetella pertussis
cgucgcgcaauacgccgc

SEQ ID NO: 2395176 - RNA, 23 nt, Bordetella pertussis
cgucgcgcacccgcaggccguug

SEQ ID NO: 2395177 - RNA, 21 nt, Bordetella pertussis
cgucgcgcagcaggguggcca

SEQ ID NO: 2395178 - RNA, 14 nt, Bordetella pertussis
cgucgcgcauggac

SEQ ID NO: 2395179 - RNA, 13 nt, Bordetella pertussis
cgucgcgccaggc

SEQ ID NO: 2395180 - RNA, 14 nt, Bordetella pertussis
cgucgcgccaggcc

SEQ ID NO: 2395181 - RNA, 21 nt, Bordetella pertussis
cgucgcgccaggccggcggcg

SEQ ID NO: 2395182 - RNA, 20 nt, Bordetella pertussis
cgucgcgcgagaauggcgcg

SEQ ID NO: 2395183 - RNA, 20 nt, Bordetella pertussis
cgucgcgcgaucaggcggug

SEQ ID NO: 2395184 - RNA, 11 nt, Bordetella pertussis
cgucgcgcgcc

SEQ ID NO: 2395185 - RNA, 15 nt, Bordetella pertussis
cgucgcgcgccaggc

SEQ ID NO: 2395186 - RNA, 20 nt, Bordetella pertussis
cgucgcgcggauccuugacg

SEQ ID NO: 2395187 - RNA, 13 nt, Bordetella pertussis
cgucgcgcggcgg

SEQ ID NO: 2395188 - RNA, 21 nt, Bordetella pertussis
cgucgcgcggcggcaccagca

SEQ ID NO: 2395189 - RNA, 15 nt, Bordetella pertussis
cgucgcgcucggacg

SEQ ID NO: 2395190 - RNA, 19 nt, Bordetella pertussis
cgucgcgcucggacgccgc

SEQ ID NO: 2395191 - RNA, 22 nt, Bordetella pertussis
cgucgcgcugcaauugcgcggc

SEQ ID NO: 2395192 - RNA, 18 nt, Bordetella pertussis
cgucgcgcugcaggcguc

SEQ ID NO: 2395193 - RNA, 18 nt, Bordetella pertussis
cgucgcgcugcgacagca

SEQ ID NO: 2395194 - RNA, 19 nt, Bordetella pertussis
cgucgcgcugcgacagcag

SEQ ID NO: 2395195 - RNA, 21 nt, Bordetella pertussis
cgucgcgcugcgacagcagca

SEQ ID NO: 2395196 - RNA, 21 nt, Bordetella pertussis
cgucgcgcuguuccagccagu

SEQ ID NO: 2395197 - RNA, 14 nt, Bordetella pertussis
cgucguagccgccg

SEQ ID NO: 2395198 - RNA, 13 nt, Bordetella pertussis
cgucguagcgcca

SEQ ID NO: 2395199 - RNA, 15 nt, Bordetella pertussis
cgucguagcgccagc

SEQ ID NO: 2395200 - RNA, 20 nt, Bordetella pertussis
cgucguagcgccagcguucg

SEQ ID NO: 2395201 - RNA, 18 nt, Bordetella pertussis
cgucguagcgcugcagcc

SEQ ID NO: 2395202 - RNA, 16 nt, Bordetella pertussis
cgucguagcgggcggc

SEQ ID NO: 2395203 - RNA, 16 nt, Bordetella pertussis
cgucguagugcgcgcc

SEQ ID NO: 2395204 - RNA, 17 nt, Bordetella pertussis
cgucguagugcgcgccg

SEQ ID NO: 2395205 - RNA, 18 nt, Bordetella pertussis
cgucgucaacccgucgac

SEQ ID NO: 2395206 - RNA, 14 nt, Bordetella pertussis
cgucgucaucgcca

SEQ ID NO: 2395207 - RNA, 15 nt, Bordetella pertussis
cgucguccacgcccg

SEQ ID NO: 2395208 - RNA, 23 nt, Bordetella pertussis
cgucguccacgcccggugccugc

SEQ ID NO: 2395209 - RNA, 12 nt, Bordetella pertussis
cgucguccagcg

SEQ ID NO: 2395210 - RNA, 14 nt, Bordetella pertussis
cgucguccagcguc

SEQ ID NO: 2395211 - RNA, 15 nt, Bordetella pertussis
cgucguccagcguca

SEQ ID NO: 2395212 - RNA, 21 nt, Bordetella pertussis
cguccgcgacgguccugcgcg

SEQ ID NO: 2395213 - RNA, 12 nt, Bordetella pertussis
cguccgcgcgcc

SEQ ID NO: 2395214 - RNA, 14 nt, Bordetella pertussis
cguccgcgcgccgc

SEQ ID NO: 2395215 - RNA, 17 nt, Bordetella pertussis
cguccgcggcccgcccg

SEQ ID NO: 2395216 - RNA, 18 nt, Bordetella pertussis
cguccgcggcccgcccgc

SEQ ID NO: 2395217 - RNA, 14 nt, Bordetella pertussis
cguccgcgucgccg

SEQ ID NO: 2395218 - RNA, 15 nt, Bordetella pertussis
cguccgcgucgccgc

SEQ ID NO: 2395219 - RNA, 18 nt, Bordetella pertussis
cgucguccagcgucaugc

SEQ ID NO: 2395220 - RNA, 18 nt, Bordetella pertussis
cgucguccagcguggcgc

SEQ ID NO: 2395221 - RNA, 18 nt, Bordetella pertussis
cgucguccaucgacgcgg

SEQ ID NO: 2395222 - RNA, 15 nt, Bordetella pertussis
cgucguccguccugg

SEQ ID NO: 2395223 - RNA, 17 nt, Bordetella pertussis
cgucguccguggccggc

SEQ ID NO: 2395224 - RNA, 18 nt, Bordetella pertussis
cgucguccguggccggcg

SEQ ID NO: 2395225 - RNA, 16 nt, Bordetella pertussis
cgucguccucggcacg

SEQ ID NO: 2395226 - RNA, 18 nt, Bordetella pertussis
cgucgucgaugaugacga

SEQ ID NO: 2395227 - RNA, 21 nt, Bordetella pertussis
cgucgucgaugaugacgaccu

SEQ ID NO: 2395228 - RNA, 17 nt, Bordetella pertussis
cgucgucgaugccgacc

SEQ ID NO: 2395229 - RNA, 20 nt, Bordetella pertussis
cgucgucgaugccgaccagg

SEQ ID NO: 2395230 - RNA, 16 nt, Bordetella pertussis
cgucgucgccaccgcc

SEQ ID NO: 2395231 - RNA, 15 nt, Bordetella pertussis
cgucgucgccgucgc

SEQ ID NO: 2395232 - RNA, 20 nt, Bordetella pertussis
cgucgucgcgguccagcacc

SEQ ID NO: 2395233 - RNA, 15 nt, Bordetella pertussis
cgucgucggcaccuu

SEQ ID NO: 2395234 - RNA, 22 nt, Bordetella pertussis
cgucgucguggucgucccgcag

SEQ ID NO: 2395235 - RNA, 15 nt, Bordetella pertussis
cgucgugcgccuggc

SEQ ID NO: 2395236 - RNA, 17 nt, Bordetella pertussis
cgucgugcgccuggcgg

SEQ ID NO: 2395237 - RNA, 17 nt, Bordetella pertussis
cgucguggggcgcggcg

SEQ ID NO: 2395238 - RNA, 18 nt, Bordetella pertussis
cgucguggggcgcggcgg

SEQ ID NO: 2395239 - RNA, 22 nt, Bordetella pertussis
cgucguugacggggacgccggc

SEQ ID NO: 2395240 - RNA, 13 nt, Bordetella pertussis
cgucguugcgccg

SEQ ID NO: 2395241 - RNA, 14 nt, Bordetella pertussis
cgucguuggccgcg

SEQ ID NO: 2395242 - RNA, 16 nt, Bordetella pertussis
cgucguuucccagcaa

SEQ ID NO: 2395243 - RNA, 19 nt, Bordetella pertussis
cgucuacaggcccagcgcc

SEQ ID NO: 2395244 - RNA, 20 nt, Bordetella pertussis
cgucuacaggcccagcgcca

SEQ ID NO: 2395245 - RNA, 22 nt, Bordetella pertussis
cgucuacaggcccagcgccagc

SEQ ID NO: 2395246 - RNA, 15 nt, Bordetella pertussis
cgucuauggccugca

SEQ ID NO: 2395247 - RNA, 13 nt, Bordetella pertussis
cgucuccagcgcc

SEQ ID NO: 2395248 - RNA, 14 nt, Bordetella pertussis
cgucuccagcgccg

SEQ ID NO: 2395249 - RNA, 16 nt, Bordetella pertussis
cgucuccagcgccggc

SEQ ID NO: 2395250 - RNA, 18 nt, Bordetella pertussis
cgucuccagcgccggcag

SEQ ID NO: 2395251 - RNA, 19 nt, Bordetella pertussis
cgucuccagcgccggcagc

SEQ ID NO: 2395252 - RNA, 22 nt, Bordetella pertussis
cgucuccagcgccggcagcccc

SEQ ID NO: 2395253 - RNA, 23 nt, Bordetella pertussis
cgucuccagcgccggcagcccca

SEQ ID NO: 2395254 - RNA, 16 nt, Bordetella pertussis
cgucuccagcgcggcg

SEQ ID NO: 2395255 - RNA, 21 nt, Bordetella pertussis
cgucucgaacgccgcgucgcu

SEQ ID NO: 2395256 - RNA, 13 nt, Bordetella pertussis
cgucucgcccaug

SEQ ID NO: 2395257 - RNA, 13 nt, Bordetella pertussis
cgucucgcgcgcc

SEQ ID NO: 2395258 - RNA, 19 nt, Bordetella pertussis
cgucucggaaaacuggcgg

SEQ ID NO: 2395259 - RNA, 15 nt, Bordetella pertussis
cgucucgggcugggu

SEQ ID NO: 2395260 - RNA, 13 nt, Bordetella pertussis
cgucugagcgccg

SEQ ID NO: 2395261 - RNA, 14 nt, Bordetella pertussis
cgucugagcgccgg

SEQ ID NO: 2395262 - RNA, 13 nt, Bordetella pertussis
cgucugcccgcgg

SEQ ID NO: 2395263 - RNA, 18 nt, Bordetella pertussis
cgucugcccgcgguccag

SEQ ID NO: 2395264 - RNA, 20 nt, Bordetella pertussis
cgucugcccgcgguccagca

SEQ ID NO: 2395265 - RNA, 21 nt, Bordetella pertussis
cgucugcccgcgguccagcac

SEQ ID NO: 2395266 - RNA, 15 nt, Bordetella pertussis
cgucugcccgugcgu

SEQ ID NO: 2395267 - RNA, 14 nt, Bordetella pertussis
cgucugcgccgccg

SEQ ID NO: 2395268 - RNA, 23 nt, Bordetella pertussis
cgucugcuacaccgugcuggccg

SEQ ID NO: 2395269 - RNA, 20 nt, Bordetella pertussis
cgucuggagcggccuggccc

SEQ ID NO: 2395270 - RNA, 15 nt, Bordetella pertussis
cgucuggcacgcuug

SEQ ID NO: 2395271 - RNA, 22 nt, Bordetella pertussis
cgucuggcggcagcucgcgcug

SEQ ID NO: 2395272 - RNA, 22 nt, Bordetella pertussis
cgucuguaucguugucgcgccg

SEQ ID NO: 2395273 - RNA, 23 nt, Bordetella pertussis
cgucuguaucguugucgcgccgc

SEQ ID NO: 2395274 - RNA, 23 nt, Bordetella pertussis
cgucugugcgccccgcuggccgu

SEQ ID NO: 2395275 - RNA, 14 nt, Bordetella pertussis
cgucuucgaccagg

SEQ ID NO: 2395276 - RNA, 15 nt, Bordetella pertussis
cgucuucgaccaggu

SEQ ID NO: 2395277 - RNA, 16 nt, Bordetella pertussis
cgucuucgaccagguc

SEQ ID NO: 2395278 - RNA, 16 nt, Bordetella pertussis
cgucuucggcgcggcg

SEQ ID NO: 2395279 - RNA, 12 nt, Bordetella pertussis
cgucuugaggau

SEQ ID NO: 2395280 - RNA, 18 nt, Bordetella pertussis
cgucuugcccgccagcgc

SEQ ID NO: 2395281 - RNA, 11 nt, Bordetella pertussis
cgucuuggccg

SEQ ID NO: 2395282 - RNA, 14 nt, Bordetella pertussis
cgucuuggccguca

SEQ ID NO: 2395283 - RNA, 20 nt, Bordetella pertussis
cgucuuggcgggcaccaugc

SEQ ID NO: 2395284 - RNA, 21 nt, Bordetella pertussis
cgucuuggcgggcaccaugcg

SEQ ID NO: 2395285 - RNA, 21 nt, Bordetella pertussis
cgugaacgccccggccgaucg

SEQ ID NO: 2395286 - RNA, 12 nt, Bordetella pertussis
cgugaacggcuc

SEQ ID NO: 2395287 - RNA, 16 nt, Bordetella pertussis
cgugaacuccugcaac

SEQ ID NO: 2395288 - RNA, 14 nt, Bordetella pertussis
cgugaacugguccu

SEQ ID NO: 2395289 - RNA, 21 nt, Bordetella pertussis
cgugaagcccauggcguaggc

SEQ ID NO: 2395290 - RNA, 17 nt, Bordetella pertussis
cgugaagcgccgcgccu

SEQ ID NO: 2395291 - RNA, 18 nt, Bordetella pertussis
cgugaaggucggcacgac

SEQ ID NO: 2395292 - RNA, 17 nt, Bordetella pertussis
cgugaagucggccggca

SEQ ID NO: 2395293 - RNA, 21 nt, Bordetella pertussis
cgugaaugcgccuggcguuca

SEQ ID NO: 2395294 - RNA, 15 nt, Bordetella pertussis
cgugaccagcugcac

SEQ ID NO: 2395295 - RNA, 18 nt, Bordetella pertussis
cgugaccagcugcaccag

SEQ ID NO: 2395296 - RNA, 19 nt, Bordetella pertussis
cgugaccagcugcaccagg

SEQ ID NO: 2395297 - RNA, 20 nt, Bordetella pertussis
cgugaccagcugcaccaggc

SEQ ID NO: 2395298 - RNA, 19 nt, Bordetella pertussis
cgugaccgacaggccuggc

SEQ ID NO: 2395299 - RNA, 14 nt, Bordetella pertussis
cgugaccgcgacgc

SEQ ID NO: 2395300 - RNA, 16 nt, Bordetella pertussis
cgugaccgcgacgcgc

SEQ ID NO: 2395301 - RNA, 17 nt, Bordetella pertussis
cgugacgauauccaggc

SEQ ID NO: 2395302 - RNA, 20 nt, Bordetella pertussis
cgugacgauauccaggcgcg

SEQ ID NO: 2395303 - RNA, 21 nt, Bordetella pertussis
cgugacgcgcggguccaggcc

SEQ ID NO: 2395304 - RNA, 22 nt, Bordetella pertussis
cgugacgcugauggccgccagc

SEQ ID NO: 2395305 - RNA, 16 nt, Bordetella pertussis
cgugacggccgccacg

SEQ ID NO: 2395306 - RNA, 18 nt, Bordetella pertussis
cgugacggccgccacgcc

SEQ ID NO: 2395307 - RNA, 12 nt, Bordetella pertussis
cgugacggcggc

SEQ ID NO: 2395308 - RNA, 15 nt, Bordetella pertussis
cgugacuucggccgc

SEQ ID NO: 2395309 - RNA, 17 nt, Bordetella pertussis
cgugacuucggccgcca

SEQ ID NO: 2395310 - RNA, 19 nt, Bordetella pertussis
cgugacuucggccgccagc

SEQ ID NO: 2395311 - RNA, 12 nt, Bordetella pertussis
cgugagcgccac

SEQ ID NO: 2395312 - RNA, 15 nt, Bordetella pertussis
cgugagcgccgccgc

SEQ ID NO: 2395313 - RNA, 14 nt, Bordetella pertussis
cgugaggucgcgcg

SEQ ID NO: 2395314 - RNA, 17 nt, Bordetella pertussis
cgugaggucgcgcguac

SEQ ID NO: 2395315 - RNA, 16 nt, Bordetella pertussis
cgugagugcagcgcuc

SEQ ID NO: 2395316 - RNA, 18 nt, Bordetella pertussis
cgugauauagaccagcag

SEQ ID NO: 2395317 - RNA, 19 nt, Bordetella pertussis
cgugauauagaccagcagc

SEQ ID NO: 2395318 - RNA, 14 nt, Bordetella pertussis
cgugaugcgcgccg

SEQ ID NO: 2395319 - RNA, 15 nt, Bordetella pertussis
cgugaugcgcgccgc

SEQ ID NO: 2395320 - RNA, 16 nt, Bordetella pertussis
cgugaugggcgcaucc

SEQ ID NO: 2395321 - RNA, 22 nt, Bordetella pertussis
cgugaugggcgcauccagcucg

SEQ ID NO: 2395322 - RNA, 17 nt, Bordetella pertussis
cgugauggggccgggcg

SEQ ID NO: 2395323 - RNA, 16 nt, Bordetella pertussis
cgugaugucgccgucg

SEQ ID NO: 2395324 - RNA, 19 nt, Bordetella pertussis
cgugaugucgccgucggca

SEQ ID NO: 2395325 - RNA, 12 nt, Bordetella pertussis
cgugcaccagcc

SEQ ID NO: 2395326 - RNA, 17 nt, Bordetella pertussis
cgugcaccagccauucg

SEQ ID NO: 2395327 - RNA, 12 nt, Bordetella pertussis
cgugcaccaugc

SEQ ID NO: 2395328 - RNA, 22 nt, Bordetella pertussis
cgugcacgcccgcggcgcccag

SEQ ID NO: 2395329 - RNA, 19 nt, Bordetella pertussis
cgugcacgcguaugcccug

SEQ ID NO: 2395330 - RNA, 16 nt, Bordetella pertussis
cgugcagacggcggcu

SEQ ID NO: 2395331 - RNA, 17 nt, Bordetella pertussis
cgugcagagcaccacgg

SEQ ID NO: 2395332 - RNA, 22 nt, Bordetella pertussis
cgugcagagcaccacggcgcgc

SEQ ID NO: 2395333 - RNA, 19 nt, Bordetella pertussis
cgugcagaucugcacgcug

SEQ ID NO: 2395334 - RNA, 20 nt, Bordetella pertussis
cgugcagcaagcccaccggg

SEQ ID NO: 2395335 - RNA, 22 nt, Bordetella pertussis
cgugcagcaagcccaccgggcc

SEQ ID NO: 2395336 - RNA, 14 nt, Bordetella pertussis
cgugcagcaggggc

SEQ ID NO: 2395337 - RNA, 18 nt, Bordetella pertussis
cgugcagcaggggcugcc

SEQ ID NO: 2395338 - RNA, 14 nt, Bordetella pertussis
cgugcagcagguag

SEQ ID NO: 2395339 - RNA, 14 nt, Bordetella pertussis
cgugcagccauucg

SEQ ID NO: 2395340 - RNA, 19 nt, Bordetella pertussis
cgugcagccauucggccag

SEQ ID NO: 2395341 - RNA, 21 nt, Bordetella pertussis
cgugcagccauucggccaggu

SEQ ID NO: 2395342 - RNA, 15 nt, Bordetella pertussis
cgugcagcgccgcgc

SEQ ID NO: 2395343 - RNA, 16 nt, Bordetella pertussis
cgugcagcgccgcgcg

SEQ ID NO: 2395344 - RNA, 19 nt, Bordetella pertussis
cgugcagcgccgcgcgcuc

SEQ ID NO: 2395345 - RNA, 21 nt, Bordetella pertussis
cgugcagcgcgugggccaguc

SEQ ID NO: 2395346 - RNA, 23 nt, Bordetella pertussis
cgugcagcgcgugggccaguccg

SEQ ID NO: 2395347 - RNA, 14 nt, Bordetella pertussis
cgugcaggauggcg

SEQ ID NO: 2395348 - RNA, 15 nt, Bordetella pertussis
cgugcaggauggcgu

SEQ ID NO: 2395349 - RNA, 13 nt, Bordetella pertussis
cgugcaggccaac

SEQ ID NO: 2395350 - RNA, 20 nt, Bordetella pertussis
cgugcaggccaacgggaucc

SEQ ID NO: 2395351 - RNA, 24 nt, Bordetella pertussis
cgugcaggccaacgggauccggca

SEQ ID NO: 2395352 - RNA, 12 nt, Bordetella pertussis
cgugcaggcccg

SEQ ID NO: 2395353 - RNA, 14 nt, Bordetella pertussis
cgugcaggcccggg

SEQ ID NO: 2395354 - RNA, 19 nt, Bordetella pertussis
cgugcaggcccgggcgccu

SEQ ID NO: 2395355 - RNA, 16 nt, Bordetella pertussis
cgugcaggccggcggc

SEQ ID NO: 2395356 - RNA, 15 nt, Bordetella pertussis
cgugcagggccaggu

SEQ ID NO: 2395357 - RNA, 18 nt, Bordetella pertussis
cgugcagguacugggcca

SEQ ID NO: 2395358 - RNA, 22 nt, Bordetella pertussis
cgugcaucccaauuggccgccc

SEQ ID NO: 2395359 - RNA, 14 nt, Bordetella pertussis
cgugccagccgaac

SEQ ID NO: 2395360 - RNA, 22 nt, Bordetella pertussis
cgugccauacagcaaggacaag

SEQ ID NO: 2395361 - RNA, 23 nt, Bordetella pertussis
cgugccauacagcaaggacaagg

SEQ ID NO: 2395362 - RNA, 19 nt, Bordetella pertussis
cgugccauggacgccggua

SEQ ID NO: 2395363 - RNA, 23 nt, Bordetella pertussis
cgugcccagcgagaucagcaccg

SEQ ID NO: 2395364 - RNA, 15 nt, Bordetella pertussis
cgugcccagcuggca

SEQ ID NO: 2395365 - RNA, 21 nt, Bordetella pertussis
cgugcccagcuggcaccgcga

SEQ ID NO: 2395366 - RNA, 19 nt, Bordetella pertussis
cgugcccaguuucgcgacc

SEQ ID NO: 2395367 - RNA, 20 nt, Bordetella pertussis
cgugcccaguuucgcgacca

SEQ ID NO: 2395368 - RNA, 16 nt, Bordetella pertussis
cgugccccgcaugcgc

SEQ ID NO: 2395369 - RNA, 20 nt, Bordetella pertussis
cgugcccgacggacuggcug

SEQ ID NO: 2395370 - RNA, 15 nt, Bordetella pertussis
cgugcccgagggcgc

SEQ ID NO: 2395371 - RNA, 21 nt, Bordetella pertussis
cgugcccgccacccagggcuu

SEQ ID NO: 2395372 - RNA, 22 nt, Bordetella pertussis
cgugcccgccacccagggcuug

SEQ ID NO: 2395373 - RNA, 14 nt, Bordetella pertussis
cgugcccggcgggc

SEQ ID NO: 2395374 - RNA, 16 nt, Bordetella pertussis
cgugcccggcgggccg

SEQ ID NO: 2395375 - RNA, 21 nt, Bordetella pertussis
cgugcccggcgggccgcacuc

SEQ ID NO: 2395376 - RNA, 18 nt, Bordetella pertussis
cgugcccgguucugcggc

SEQ ID NO: 2395377 - RNA, 17 nt, Bordetella pertussis
cgugcccguugccgcgc

SEQ ID NO: 2395378 - RNA, 21 nt, Bordetella pertussis
cgugcccguugccgcgcgcga

SEQ ID NO: 2395379 - RNA, 23 nt, Bordetella pertussis
cgugcccucgggaaacaggccca

SEQ ID NO: 2395380 - RNA, 22 nt, Bordetella pertussis
cgugcccugcggcgcggccagc

SEQ ID NO: 2395381 - RNA, 23 nt, Bordetella pertussis
cgugcccugcggcgcggccagca

SEQ ID NO: 2395382 - RNA, 19 nt, Bordetella pertussis
cgugcccuugagcgugggc

SEQ ID NO: 2395383 - RNA, 17 nt, Bordetella pertussis
cgugcccuugggggccc

SEQ ID NO: 2395384 - RNA, 20 nt, Bordetella pertussis
cgugccgacgaugccgccgc

SEQ ID NO: 2395385 - RNA, 17 nt, Bordetella pertussis
cgugccgcacgguggcg

SEQ ID NO: 2395386 - RNA, 13 nt, Bordetella pertussis
cgugccgcccagg

SEQ ID NO: 2395387 - RNA, 16 nt, Bordetella pertussis
cgugccgcccgguucg

SEQ ID NO: 2395388 - RNA, 14 nt, Bordetella pertussis
cgugccgccggcgc

SEQ ID NO: 2395389 - RNA, 12 nt, Bordetella pertussis
cgugccgcgcag

SEQ ID NO: 2395390 - RNA, 13 nt, Bordetella pertussis
cgugccgcgcagg

SEQ ID NO: 2395391 - RNA, 20 nt, Bordetella pertussis
cgugccggcguauuccugca

SEQ ID NO: 2395392 - RNA, 17 nt, Bordetella pertussis
cgugccgggaugcugcu

SEQ ID NO: 2395393 - RNA, 23 nt, Bordetella pertussis
cgugccgggaugcugcucggcca

SEQ ID NO: 2395394 - RNA, 12 nt, Bordetella pertussis
cgugccgggccu

SEQ ID NO: 2395395 - RNA, 23 nt, Bordetella pertussis
cgugccgggccuggugcccgacg

SEQ ID NO: 2395396 - RNA, 18 nt, Bordetella pertussis
cgugccucaacuggccgg

SEQ ID NO: 2395397 - RNA, 20 nt, Bordetella pertussis
cgugccucaacuggccggcc

SEQ ID NO: 2395398 - RNA, 23 nt, Bordetella pertussis
cgugccucaacuggccggccugg

SEQ ID NO: 2395399 - RNA, 15 nt, Bordetella pertussis
cgugccuguccccgc

SEQ ID NO: 2395400 - RNA, 18 nt, Bordetella pertussis
cgugccuguccccgcacg

SEQ ID NO: 2395401 - RNA, 13 nt, Bordetella pertussis
cgugcgacgcaug

SEQ ID NO: 2395402 - RNA, 21 nt, Bordetella pertussis
cgugcgacgcaugucagcgcc

SEQ ID NO: 2395403 - RNA, 21 nt, Bordetella pertussis
cgugcgagcacggcguggcgc

SEQ ID NO: 2395404 - RNA, 14 nt, Bordetella pertussis
cgugcgaggccacg

SEQ ID NO: 2395405 - RNA, 15 nt, Bordetella pertussis
cgugcgaggccacgg

SEQ ID NO: 2395406 - RNA, 19 nt, Bordetella pertussis
cgugcgaggccacggcaau

SEQ ID NO: 2395407 - RNA, 13 nt, Bordetella pertussis
cgugcgaggcgaa

SEQ ID NO: 2395408 - RNA, 22 nt, Bordetella pertussis
cgugcgaggcgaacaggcacag

SEQ ID NO: 2395409 - RNA, 17 nt, Bordetella pertussis
cgugcgcaacgcgcgcg

SEQ ID NO: 2395410 - RNA, 19 nt, Bordetella pertussis
cgugcgcacgcguucgggc

SEQ ID NO: 2395411 - RNA, 23 nt, Bordetella pertussis
cgugcgcacgcguucgggcggca

SEQ ID NO: 2395412 - RNA, 14 nt, Bordetella pertussis
cgugcgcaggcgcg

SEQ ID NO: 2395413 - RNA, 18 nt, Bordetella pertussis
cgugcgcaggcgcguggc

SEQ ID NO: 2395414 - RNA, 18 nt, Bordetella pertussis
cguggccggcgcggcagc

SEQ ID NO: 2395415 - RNA, 22 nt, Bordetella pertussis
cguggccggcgcggcagccugg

SEQ ID NO: 2395416 - RNA, 13 nt, Bordetella pertussis
cguggccgggccc

SEQ ID NO: 2395417 - RNA, 16 nt, Bordetella pertussis
cguggccgggcccggc

SEQ ID NO: 2395418 - RNA, 20 nt, Bordetella pertussis
cguggccgggcccggcgcgc

SEQ ID NO: 2395419 - RNA, 17 nt, Bordetella pertussis
cguggccgugcugguca

SEQ ID NO: 2395420 - RNA, 21 nt, Bordetella pertussis
cguggccguucggugcgcagc

SEQ ID NO: 2395421 - RNA, 22 nt, Bordetella pertussis
cguggccguucggugcgcagcg

SEQ ID NO: 2395422 - RNA, 17 nt, Bordetella pertussis
cguggccucuugcguga

SEQ ID NO: 2395423 - RNA, 23 nt, Bordetella pertussis
cguggccugcccgucgggcaggu

SEQ ID NO: 2395424 - RNA, 13 nt, Bordetella pertussis
cguggcgacgcgc

SEQ ID NO: 2395425 - RNA, 14 nt, Bordetella pertussis
cguggcgacgucgg

SEQ ID NO: 2395426 - RNA, 16 nt, Bordetella pertussis
cguggcgauagcgcuc

SEQ ID NO: 2395427 - RNA, 21 nt, Bordetella pertussis
cguggcgauagcgcuccagcg

SEQ ID NO: 2395428 - RNA, 21 nt, Bordetella pertussis
cguggcgcaaggcaugcgcca

SEQ ID NO: 2395429 - RNA, 14 nt, Bordetella pertussis
cguggcgcaccagg

SEQ ID NO: 2395430 - RNA, 21 nt, Bordetella pertussis
cguggcgcagucgagcaccgc

SEQ ID NO: 2395431 - RNA, 17 nt, Bordetella pertussis
cguggcgcagugggcca

SEQ ID NO: 2395432 - RNA, 13 nt, Bordetella pertussis
cguggcgcccagc

SEQ ID NO: 2395433 - RNA, 14 nt, Bordetella pertussis
cguggcgccgaagg

SEQ ID NO: 2395434 - RNA, 20 nt, Bordetella pertussis
cguggcgccgaaggcggcgc

SEQ ID NO: 2395435 - RNA, 22 nt, Bordetella pertussis
cguggcgccgaaggcggcgccg

SEQ ID NO: 2395436 - RNA, 18 nt, Bordetella pertussis
cguggcgccgacccugcc

SEQ ID NO: 2395437 - RNA, 22 nt, Bordetella pertussis
cguggcgccgacccugcccggc

SEQ ID NO: 2395438 - RNA, 17 nt, Bordetella pertussis
cguggcgccgcgggccu

SEQ ID NO: 2395439 - RNA, 17 nt, Bordetella pertussis
cguggcgcgcaccuggg

SEQ ID NO: 2395440 - RNA, 18 nt, Bordetella pertussis
cguggcgcgccagcgcca

SEQ ID NO: 2395441 - RNA, 14 nt, Bordetella pertussis
cguggcgcgccucc

SEQ ID NO: 2395442 - RNA, 17 nt, Bordetella pertussis
cguggcgcgccuccagc

SEQ ID NO: 2395443 - RNA, 14 nt, Bordetella pertussis
cguggcgcgcgccg

SEQ ID NO: 2395444 - RNA, 20 nt, Bordetella pertussis
cguggcgcggguggccggau

SEQ ID NO: 2395445 - RNA, 18 nt, Bordetella pertussis
cguggcgcuccaugcggc

SEQ ID NO: 2395446 - RNA, 21 nt, Bordetella pertussis
cguggcgcuccaugcggcggc

SEQ ID NO: 2395447 - RNA, 14 nt, Bordetella pertussis
cguggcggccaggc

SEQ ID NO: 2395448 - RNA, 17 nt, Bordetella pertussis
cguggcggccaggccgg

SEQ ID NO: 2395449 - RNA, 20 nt, Bordetella pertussis
cguggcggccgcgggcagca

SEQ ID NO: 2395450 - RNA, 19 nt, Bordetella pertussis
cguggcggccugcgccggc

SEQ ID NO: 2395451 - RNA, 12 nt, Bordetella pertussis
cguggcggcgca

SEQ ID NO: 2395452 - RNA, 15 nt, Bordetella pertussis
cguggcggcgcagcg

SEQ ID NO: 2395453 - RNA, 17 nt, Bordetella pertussis
cguggcggcgcagcgcc

SEQ ID NO: 2395454 - RNA, 18 nt, Bordetella pertussis
cguggcggcgcagcgccc

SEQ ID NO: 2395455 - RNA, 19 nt, Bordetella pertussis
cguggcggcgcagcgccca

SEQ ID NO: 2395456 - RNA, 16 nt, Bordetella pertussis
cguggcgggaggaagg

SEQ ID NO: 2395457 - RNA, 19 nt, Bordetella pertussis
cguggcgggccgcgccgcg

SEQ ID NO: 2395458 - RNA, 19 nt, Bordetella pertussis
cguggcggggcguucgacg

SEQ ID NO: 2395459 - RNA, 19 nt, Bordetella pertussis
cguggcggguccacguggc

SEQ ID NO: 2395460 - RNA, 20 nt, Bordetella pertussis
cguggcggguccacguggcg

SEQ ID NO: 2395461 - RNA, 21 nt, Bordetella pertussis
cguggcguaauagcuggcggc

SEQ ID NO: 2395462 - RNA, 16 nt, Bordetella pertussis
cguggcguccaugcug

SEQ ID NO: 2395463 - RNA, 22 nt, Bordetella pertussis
cguggcguccaugcugauccug

SEQ ID NO: 2395464 - RNA, 21 nt, Bordetella pertussis
cguggcgucguggggcgcggc

SEQ ID NO: 2395465 - RNA, 16 nt, Bordetella pertussis
cguggcgugcaggccg

SEQ ID NO: 2395466 - RNA, 17 nt, Bordetella pertussis
cguggcgugcaggccgg

SEQ ID NO: 2395467 - RNA, 13 nt, Bordetella pertussis
cguggcgugccgc

SEQ ID NO: 2395468 - RNA, 18 nt, Bordetella pertussis
cguggcguugacggccca

SEQ ID NO: 2395469 - RNA, 20 nt, Bordetella pertussis
cguggcguugacggcccagc

SEQ ID NO: 2395470 - RNA, 23 nt, Bordetella pertussis
cguggcugaccagcagcaccgug

SEQ ID NO: 2395471 - RNA, 17 nt, Bordetella pertussis
cguggcuucagggcuga

SEQ ID NO: 2395472 - RNA, 16 nt, Bordetella pertussis
cgugggacaggcaccc

SEQ ID NO: 2395473 - RNA, 21 nt, Bordetella pertussis
cgugggacaggcacccugccg

SEQ ID NO: 2395474 - RNA, 17 nt, Bordetella pertussis
cgugggcacccggccgc

SEQ ID NO: 2395475 - RNA, 17 nt, Bordetella pertussis
cgugggcaggugcuugg

SEQ ID NO: 2395476 - RNA, 16 nt, Bordetella pertussis
cgugggccaguccgca

SEQ ID NO: 2395477 - RNA, 19 nt, Bordetella pertussis
cgugggccaguccgcagcg

SEQ ID NO: 2395478 - RNA, 16 nt, Bordetella pertussis
cgugggcgaacugguc

SEQ ID NO: 2395479 - RNA, 23 nt, Bordetella pertussis
cgugggcgaacuggucgaacucg

SEQ ID NO: 2395480 - RNA, 20 nt, Bordetella pertussis
cgugggcgccuacggcggcg

SEQ ID NO: 2395481 - RNA, 17 nt, Bordetella pertussis
cgugggcggcggcaugc

SEQ ID NO: 2395482 - RNA, 12 nt, Bordetella pertussis
cgugggcucgau

SEQ ID NO: 2395483 - RNA, 24 nt, Bordetella pertussis
cgugggcuguucguagucgagcca

SEQ ID NO: 2395484 - RNA, 13 nt, Bordetella pertussis
cguggggacaggc

SEQ ID NO: 2395485 - RNA, 15 nt, Bordetella pertussis
cguggggacaggcac

SEQ ID NO: 2395486 - RNA, 20 nt, Bordetella pertussis
cguggggacaggcaccugcg

SEQ ID NO: 2395487 - RNA, 13 nt, Bordetella pertussis
cguggggacgcgg

SEQ ID NO: 2395488 - RNA, 15 nt, Bordetella pertussis
cguggggagcgcggc

SEQ ID NO: 2395489 - RNA, 17 nt, Bordetella pertussis
cguggggagcgcggccc

SEQ ID NO: 2395490 - RNA, 13 nt, Bordetella pertussis
cguggggccggcc

SEQ ID NO: 2395491 - RNA, 14 nt, Bordetella pertussis
cguggggccggccg

SEQ ID NO: 2395492 - RNA, 15 nt, Bordetella pertussis
cguggggccggccgc

SEQ ID NO: 2395493 - RNA, 17 nt, Bordetella pertussis
cguggggcgcggcggcg

SEQ ID NO: 2395494 - RNA, 15 nt, Bordetella pertussis
cgugguacgacgagc

SEQ ID NO: 2395495 - RNA, 21 nt, Bordetella pertussis
cgugguaucgcgccagcgccg

SEQ ID NO: 2395496 - RNA, 22 nt, Bordetella pertussis
cgugguaucgcgccagcgccgc

SEQ ID NO: 2395497 - RNA, 16 nt, Bordetella pertussis
cgugguccacgaagca

SEQ ID NO: 2395498 - RNA, 20 nt, Bordetella pertussis
cguggucgacauagacgcgc

SEQ ID NO: 2395499 - RNA, 14 nt, Bordetella pertussis
cguggucgccagca

SEQ ID NO: 2395500 - RNA, 15 nt, Bordetella pertussis
cguggucgugcuggc

SEQ ID NO: 2395501 - RNA, 16 nt, Bordetella pertussis
cguggugacccguccg

SEQ ID NO: 2395502 - RNA, 15 nt, Bordetella pertussis
cguggugggcaccgu

SEQ ID NO: 2395503 - RNA, 20 nt, Bordetella pertussis
cguggugggccacucgaugg

SEQ ID NO: 2395504 - RNA, 13 nt, Bordetella pertussis
cguugacggccca

SEQ ID NO: 2395505 - RNA, 15 nt, Bordetella pertussis
cguugacggcccagc

SEQ ID NO: 2395506 - RNA, 16 nt, Bordetella pertussis
cguugacggcccagcu

SEQ ID NO: 2395507 - RNA, 20 nt, Bordetella pertussis
cguugacggcccagcucugg

SEQ ID NO: 2395508 - RNA, 16 nt, Bordetella pertussis
cguugagcgccgacgg

SEQ ID NO: 2395509 - RNA, 17 nt, Bordetella pertussis
cguugaggguuucgacg

SEQ ID NO: 2395510 - RNA, 17 nt, Bordetella pertussis
cguugaucaucggcccg

SEQ ID NO: 2395511 - RNA, 17 nt, Bordetella pertussis
cguugaucucgcccagc

SEQ ID NO: 2395512 - RNA, 17 nt, Bordetella pertussis
cguugaucuggccgucg

SEQ ID NO: 2395513 - RNA, 17 nt, Bordetella pertussis
cguugauggggccgcgc

SEQ ID NO: 2395514 - RNA, 19 nt, Bordetella pertussis
cguugauggggccgcgccg

SEQ ID NO: 2395515 - RNA, 17 nt, Bordetella pertussis
cguugcaccgcgucggc

SEQ ID NO: 2395516 - RNA, 19 nt, Bordetella pertussis
cguugcagccacaggccca

SEQ ID NO: 2395517 - RNA, 15 nt, Bordetella pertussis
cguugcagcccagcg

SEQ ID NO: 2395518 - RNA, 16 nt, Bordetella pertussis
cguugcagcccagcgc

SEQ ID NO: 2395519 - RNA, 17 nt, Bordetella pertussis
cguugcagcccagcgcg

SEQ ID NO: 2395520 - RNA, 20 nt, Bordetella pertussis
cguugcauaccucgauggcg

SEQ ID NO: 2395521 - RNA, 21 nt, Bordetella pertussis
cguugcauaccucgauggcgg

SEQ ID NO: 2395522 - RNA, 12 nt, Bordetella pertussis
cguugcauugca

SEQ ID NO: 2395523 - RNA, 15 nt, Bordetella pertussis
cguugccccgauccg

SEQ ID NO: 2395524 - RNA, 16 nt, Bordetella pertussis
cguugccgcgcgcgua

SEQ ID NO: 2395525 - RNA, 21 nt, Bordetella pertussis
cguugccgcuguggcgcgcca

SEQ ID NO: 2395526 - RNA, 15 nt, Bordetella pertussis
cguugccggccagca

SEQ ID NO: 2395527 - RNA, 17 nt, Bordetella pertussis
cguugccggccagcacg

SEQ ID NO: 2395528 - RNA, 21 nt, Bordetella pertussis
cguugccggccagcacgggcg

SEQ ID NO: 2395529 - RNA, 16 nt, Bordetella pertussis
cguugcgcaagccgcc

SEQ ID NO: 2395530 - RNA, 19 nt, Bordetella pertussis
cguugcgcaagccgcccgc

SEQ ID NO: 2395531 - RNA, 20 nt, Bordetella pertussis
cguugcgcaagccgcccgcg

SEQ ID NO: 2395532 - RNA, 15 nt, Bordetella pertussis
cguugcgcaccaugu

SEQ ID NO: 2395533 - RNA, 16 nt, Bordetella pertussis
cguugcgccagcggcg

SEQ ID NO: 2395534 - RNA, 18 nt, Bordetella pertussis
cguugcgccgcaacgccg

SEQ ID NO: 2395535 - RNA, 18 nt, Bordetella pertussis
cguugcgcgacaggcccg

SEQ ID NO: 2395536 - RNA, 20 nt, Bordetella pertussis
cguugcgcgacaggcccgcg

SEQ ID NO: 2395537 - RNA, 16 nt, Bordetella pertussis
cguugcggcagcggcc

SEQ ID NO: 2395538 - RNA, 13 nt, Bordetella pertussis
cguugcggcgcca

SEQ ID NO: 2395539 - RNA, 23 nt, Bordetella pertussis
cguugcggcgccucgguccagcg

SEQ ID NO: 2395540 - RNA, 16 nt, Bordetella pertussis
cguugcggcgucgacg

SEQ ID NO: 2395541 - RNA, 17 nt, Bordetella pertussis
cguugcggcgucgacgu

SEQ ID NO: 2395542 - RNA, 15 nt, Bordetella pertussis
cguugcgggcugcgc

SEQ ID NO: 2395543 - RNA, 14 nt, Bordetella pertussis
cguugcgguagcgc

SEQ ID NO: 2395544 - RNA, 16 nt, Bordetella pertussis
cguugcuccagccagg

SEQ ID NO: 2395545 - RNA, 17 nt, Bordetella pertussis
cguugcuccagccaggc

SEQ ID NO: 2395546 - RNA, 19 nt, Bordetella pertussis
cguugcuccagccaggcgc

SEQ ID NO: 2395547 - RNA, 13 nt, Bordetella pertussis
cguugcucgcgcg

SEQ ID NO: 2395548 - RNA, 19 nt, Bordetella pertussis
cguugcuggcaaagcgcgc

SEQ ID NO: 2395549 - RNA, 23 nt, Bordetella pertussis
cguugcuggcaaagcgcgcgucc

SEQ ID NO: 2395550 - RNA, 21 nt, Bordetella pertussis
cguuggaccccaguuccagca

SEQ ID NO: 2395551 - RNA, 14 nt, Bordetella pertussis
cguuggagccggag

SEQ ID NO: 2395552 - RNA, 23 nt, Bordetella pertussis
cguuggagccggagcagucgcgc

SEQ ID NO: 2395553 - RNA, 14 nt, Bordetella pertussis
cguuggcaggccag

SEQ ID NO: 2395554 - RNA, 20 nt, Bordetella pertussis
cguuggcaggccagcauggc

SEQ ID NO: 2395555 - RNA, 15 nt, Bordetella pertussis
cguuggcauggcgcg

SEQ ID NO: 2395556 - RNA, 20 nt, Bordetella pertussis
cguuggcauggcgcgugcgc

SEQ ID NO: 2395557 - RNA, 17 nt, Bordetella pertussis
cguuggccaaugcgccg

SEQ ID NO: 2395558 - RNA, 21 nt, Bordetella pertussis
cguuggccaaugcgccgcgcc

SEQ ID NO: 2395559 - RNA, 20 nt, Bordetella pertussis
cguuggccacuuccagcgcc

SEQ ID NO: 2395560 - RNA, 12 nt, Bordetella pertussis
cguuggccagcg

SEQ ID NO: 2395561 - RNA, 19 nt, Bordetella pertussis
cguuggccgcgcgguacgc

SEQ ID NO: 2395562 - RNA, 17 nt, Bordetella pertussis
cguuggccgcguagccc

SEQ ID NO: 2395563 - RNA, 22 nt, Bordetella pertussis
cguuggccugccauccggccgc

SEQ ID NO: 2395564 - RNA, 19 nt, Bordetella pertussis
cguuggcgaggacaggcca

SEQ ID NO: 2395565 - RNA, 20 nt, Bordetella pertussis
cguuggcgaggacaggccag

SEQ ID NO: 2395566 - RNA, 15 nt, Bordetella pertussis
cguuggcgcccagcg

SEQ ID NO: 2395567 - RNA, 17 nt, Bordetella pertussis
cguuggcgcccagcgcc

SEQ ID NO: 2395568 - RNA, 13 nt, Bordetella pertussis
cguuggcgcgccu

SEQ ID NO: 2395569 - RNA, 17 nt, Bordetella pertussis
cguuggcggccggccag

SEQ ID NO: 2395570 - RNA, 15 nt, Bordetella pertussis
cguuggcgugcagcc

SEQ ID NO: 2395571 - RNA, 14 nt, Bordetella pertussis
cguugggcaugccg

SEQ ID NO: 2395572 - RNA, 18 nt, Bordetella pertussis
cguuggggaaccgcaccg

SEQ ID NO: 2395573 - RNA, 22 nt, Bordetella pertussis
cguuggucaccacgccuucgag

SEQ ID NO: 2395574 - RNA, 17 nt, Bordetella pertussis
cguuggucagcaccucg

SEQ ID NO: 2395575 - RNA, 20 nt, Bordetella pertussis
cguuggucagcaccucggcg

SEQ ID NO: 2395576 - RNA, 21 nt, Bordetella pertussis
cguuggucagcaccucggcgc

SEQ ID NO: 2395577 - RNA, 15 nt, Bordetella pertussis
cguuggugacgaugg

SEQ ID NO: 2395578 - RNA, 20 nt, Bordetella pertussis
cguuggugacgauggugcgc

SEQ ID NO: 2395579 - RNA, 15 nt, Bordetella pertussis
cguuggugcccagcg

SEQ ID NO: 2395580 - RNA, 21 nt, Bordetella pertussis
cguuggugccgaguucgacuc

SEQ ID NO: 2395581 - RNA, 18 nt, Bordetella pertussis
cguuggugcgcaccuugc

SEQ ID NO: 2395582 - RNA, 15 nt, Bordetella pertussis
cguuggugucggcgg

SEQ ID NO: 2395583 - RNA, 17 nt, Bordetella pertussis
cguuggugucggcggcg

SEQ ID NO: 2395584 - RNA, 21 nt, Bordetella pertussis
cguuggugucggcggcgagcu

SEQ ID NO: 2395585 - RNA, 13 nt, Bordetella pertussis
cguuguccaggcc

SEQ ID NO: 2395586 - RNA, 15 nt, Bordetella pertussis
cguuguccgccugcg

SEQ ID NO: 2395587 - RNA, 16 nt, Bordetella pertussis
cguuguccuggcgcgc

SEQ ID NO: 2395588 - RNA, 21 nt, Bordetella pertussis
cguugucgagcaggccgccgc

SEQ ID NO: 2395589 - RNA, 13 nt, Bordetella pertussis
cguugucgcgccg

SEQ ID NO: 2395590 - RNA, 14 nt, Bordetella pertussis
cguugucgcgccgc

SEQ ID NO: 2395591 - RNA, 15 nt, Bordetella pertussis
cguugucgcgccgcg

SEQ ID NO: 2395592 - RNA, 22 nt, Bordetella pertussis
cguuguggcaggcgucggccag

SEQ ID NO: 2395593 - RNA, 18 nt, Bordetella pertussis
cguuguugccccauugcg

SEQ ID NO: 2395594 - RNA, 17 nt, Bordetella pertussis
cguuuacuccccagacg

SEQ ID NO: 2395595 - RNA, 22 nt, Bordetella pertussis
cguuuacuccccagacgcagac

SEQ ID NO: 2395596 - RNA, 13 nt, Bordetella pertussis
cguuuauguaguu

SEQ ID NO: 2395597 - RNA, 21 nt, Bordetella pertussis
cguuucaggccugcggcgcca

SEQ ID NO: 2395598 - RNA, 17 nt, Bordetella pertussis
cguuuccaagcgcacgc

SEQ ID NO: 2395599 - RNA, 15 nt, Bordetella pertussis
cguuuccagggcgcg

SEQ ID NO: 2395600 - RNA, 19 nt, Bordetella pertussis
cguuuccagggcgcgccgc

SEQ ID NO: 2395601 - RNA, 20 nt, Bordetella pertussis
cguuucccucggugcugcug

SEQ ID NO: 2395602 - RNA, 16 nt, Bordetella pertussis
cguuucgucggcgcgc

SEQ ID NO: 2395603 - RNA, 23 nt, Bordetella pertussis
cguuucgucggcgcgcgccaggc

SEQ ID NO: 2395604 - RNA, 15 nt, Bordetella pertussis
cguuugcgcgcgcgc

SEQ ID NO: 2395605 - RNA, 14 nt, Bordetella pertussis
cguuuuggcgagca

SEQ ID NO: 2395606 - RNA, 21 nt, Bordetella pertussis
cuaagcacaagcgcguggccg

SEQ ID NO: 2395607 - RNA, 14 nt, Bordetella pertussis
cuacaccaucaacg

SEQ ID NO: 2395608 - RNA, 12 nt, Bordetella pertussis
cuacacccugcu

SEQ ID NO: 2395609 - RNA, 17 nt, Bordetella pertussis
cuacaccgugcuggccg

SEQ ID NO: 2395610 - RNA, 16 nt, Bordetella pertussis
cuacacggccgccacc

SEQ ID NO: 2395611 - RNA, 19 nt, Bordetella pertussis
cuacacggccgccaccugg

SEQ ID NO: 2395612 - RNA, 13 nt, Bordetella pertussis
cuacacgguggcg

SEQ ID NO: 2395613 - RNA, 21 nt, Bordetella pertussis
cuacacggugggcgacgcggc

SEQ ID NO: 2395614 - RNA, 15 nt, Bordetella pertussis
cuacagcgccuggcg

SEQ ID NO: 2395615 - RNA, 13 nt, Bordetella pertussis
cuacagcucgccg

SEQ ID NO: 2395616 - RNA, 18 nt, Bordetella pertussis
cuacagcucgccggcgau

SEQ ID NO: 2395617 - RNA, 13 nt, Bordetella pertussis
cuacaggcccagc

SEQ ID NO: 2395618 - RNA, 17 nt, Bordetella pertussis
cuacaggcccagcgcca

SEQ ID NO: 2395619 - RNA, 14 nt, Bordetella pertussis
cuacauccuggaug

SEQ ID NO: 2395620 - RNA, 15 nt, Bordetella pertussis
cuacauccuggaugu

SEQ ID NO: 2395621 - RNA, 19 nt, Bordetella pertussis
cuaccaggcgcgcgcgcgg

SEQ ID NO: 2395622 - RNA, 20 nt, Bordetella pertussis
cuaccaggcgcgcgcgcgga

SEQ ID NO: 2395623 - RNA, 20 nt, Bordetella pertussis
cuaccaggugggcgcgcuca

SEQ ID NO: 2395624 - RNA, 19 nt, Bordetella pertussis
cuacccccugaccggcggc

SEQ ID NO: 2395625 - RNA, 15 nt, Bordetella pertussis
cuaccccggcagcgu

SEQ ID NO: 2395626 - RNA, 15 nt, Bordetella pertussis
cuacccgcgcgagcu

SEQ ID NO: 2395627 - RNA, 20 nt, Bordetella pertussis
cuacccugcccauucccgcc

SEQ ID NO: 2395628 - RNA, 17 nt, Bordetella pertussis
cuaccgcuucccuggca

SEQ ID NO: 2395629 - RNA, 18 nt, Bordetella pertussis
cuaccgcuucccuggcaa

SEQ ID NO: 2395630 - RNA, 16 nt, Bordetella pertussis
cuaccggcgccgacgc

SEQ ID NO: 2395631 - RNA, 17 nt, Bordetella pertussis
cuaccggcgccgacgcg

SEQ ID NO: 2395632 - RNA, 12 nt, Bordetella pertussis
cuaccuggacgg

SEQ ID NO: 2395633 - RNA, 23 nt, Bordetella pertussis
cuacgaauccccgcucaggucga

SEQ ID NO: 2395634 - RNA, 17 nt, Bordetella pertussis
cuacgacacgcucaagg

SEQ ID NO: 2395635 - RNA, 23 nt, Bordetella pertussis
cuacgaccugaauccguaagcgc

SEQ ID NO: 2395636 - RNA, 13 nt, Bordetella pertussis
cuacgacgccugg

SEQ ID NO: 2395637 - RNA, 23 nt, Bordetella pertussis
cuacgccgccgauggcgcgcggc

SEQ ID NO: 2395638 - RNA, 16 nt, Bordetella pertussis
cuacgcgaaccccgcc

SEQ ID NO: 2395639 - RNA, 15 nt, Bordetella pertussis
cuacgcgcgcgccgg

SEQ ID NO: 2395640 - RNA, 16 nt, Bordetella pertussis
cuacgcgcgcgccggc

SEQ ID NO: 2395641 - RNA, 19 nt, Bordetella pertussis
cuacggcggacuggccgcg

SEQ ID NO: 2395642 - RNA, 20 nt, Bordetella pertussis
cuacggcggacuggccgcgc

SEQ ID NO: 2395643 - RNA, 18 nt, Bordetella pertussis
cuacggcggcggccaucg

SEQ ID NO: 2395644 - RNA, 21 nt, Bordetella pertussis
cuacggcggcggccaucgcca

SEQ ID NO: 2395645 - RNA, 16 nt, Bordetella pertussis
cuacggcuggccgucg

SEQ ID NO: 2395646 - RNA, 15 nt, Bordetella pertussis
cuacugcccucgccu

SEQ ID NO: 2395647 - RNA, 12 nt, Bordetella pertussis
cucagcgcgccg

SEQ ID NO: 2395648 - RNA, 13 nt, Bordetella pertussis
cucagcgcgccgc

SEQ ID NO: 2395649 - RNA, 15 nt, Bordetella pertussis
cucagcgcgccgcgc

SEQ ID NO: 2395650 - RNA, 19 nt, Bordetella pertussis
cucagcgcggcgcggccag

SEQ ID NO: 2395651 - RNA, 15 nt, Bordetella pertussis
cucagcggccgcugc

SEQ ID NO: 2395652 - RNA, 17 nt, Bordetella pertussis
cucagcgggcugcugga

SEQ ID NO: 2395653 - RNA, 13 nt, Bordetella pertussis
cucaggccagcga

SEQ ID NO: 2395654 - RNA, 9 nt, Bordetella pertussis
cucaggccg

SEQ ID NO: 2395655 - RNA, 16 nt, Bordetella pertussis
cucaggccgcugggca

SEQ ID NO: 2395656 - RNA, 20 nt, Bordetella pertussis
cucaggccugcacgucccag

SEQ ID NO: 2395657 - RNA, 21 nt, Bordetella pertussis
cucaggcgcggauugaugucg

SEQ ID NO: 2395658 - RNA, 18 nt, Bordetella pertussis
cucaggcggugacgcccu

SEQ ID NO: 2395659 - RNA, 20 nt, Bordetella pertussis
cucaggcggugacgcccugc

SEQ ID NO: 2395660 - RNA, 13 nt, Bordetella pertussis
cucagggggcgcc

SEQ ID NO: 2395661 - RNA, 19 nt, Bordetella pertussis
cucagguagaccacgcgcu

SEQ ID NO: 2395662 - RNA, 17 nt, Bordetella pertussis
cucaguccaaggucagg

SEQ ID NO: 2395663 - RNA, 22 nt, Bordetella pertussis
cucagucggccuggcgcuccuc

SEQ ID NO: 2395664 - RNA, 13 nt, Bordetella pertussis
cucagucgggcag

SEQ ID NO: 2395665 - RNA, 23 nt, Bordetella pertussis
cucagucgggcagcgcccgcgcc

SEQ ID NO: 2395666 - RNA, 22 nt, Bordetella pertussis
cucauaauccguuggugccgag

SEQ ID NO: 2395667 - RNA, 21 nt, Bordetella pertussis
cucauaggcaucgaccagcgc

SEQ ID NO: 2395668 - RNA, 13 nt, Bordetella pertussis
cucaucaucgcgc

SEQ ID NO: 2395669 - RNA, 12 nt, Bordetella pertussis
cucauccaggcg

SEQ ID NO: 2395670 - RNA, 13 nt, Bordetella pertussis
cucaucgagcgcc

SEQ ID NO: 2395671 - RNA, 23 nt, Bordetella pertussis
cucaucgagcgccugggcggcca

SEQ ID NO: 2395672 - RNA, 16 nt, Bordetella pertussis
cucaucggcaggccgg

SEQ ID NO: 2395673 - RNA, 18 nt, Bordetella pertussis
cucaucggcaggccggcg

SEQ ID NO: 2395674 - RNA, 23 nt, Bordetella pertussis
cucaucggcaggccggcgcgcgc

SEQ ID NO: 2395675 - RNA, 15 nt, Bordetella pertussis
cucaugaccagcggc

SEQ ID NO: 2395676 - RNA, 17 nt, Bordetella pertussis
cucaugaccagcggcgu

SEQ ID NO: 2395677 - RNA, 12 nt, Bordetella pertussis
cucaugccggca

SEQ ID NO: 2395678 - RNA, 20 nt, Bordetella pertussis
cucaugccggcaagcacgaa

SEQ ID NO: 2395679 - RNA, 13 nt, Bordetella pertussis
cucaugcgggaca

SEQ ID NO: 2395680 - RNA, 16 nt, Bordetella pertussis
cucaugcgggacaggc

SEQ ID NO: 2395681 - RNA, 18 nt, Bordetella pertussis
cucaugcgggacaggcgc

SEQ ID NO: 2395682 - RNA, 23 nt, Bordetella pertussis
cucgcggauuugcuucaggucgc

SEQ ID NO: 2395683 - RNA, 20 nt, Bordetella pertussis
cucgcggcccuggucgucgc

SEQ ID NO: 2395684 - RNA, 14 nt, Bordetella pertussis
cucgcggcgcagca

SEQ ID NO: 2395685 - RNA, 14 nt, Bordetella pertussis
cucgcggcuggugg

SEQ ID NO: 2395686 - RNA, 15 nt, Bordetella pertussis
cucgcggcuguccug

SEQ ID NO: 2395687 - RNA, 16 nt, Bordetella pertussis
cucgcgggccuuggcc

SEQ ID NO: 2395688 - RNA, 20 nt, Bordetella pertussis
cucgcgggccuuggccagca

SEQ ID NO: 2395689 - RNA, 17 nt, Bordetella pertussis
cucgcgggugcgcagca

SEQ ID NO: 2395690 - RNA, 18 nt, Bordetella pertussis
cucgcgguugcgucucgg

SEQ ID NO: 2395691 - RNA, 16 nt, Bordetella pertussis
cucgcguugcaccgcg

SEQ ID NO: 2395692 - RNA, 13 nt, Bordetella pertussis
cucgcuaacaagg

SEQ ID NO: 2395693 - RNA, 23 nt, Bordetella pertussis
cucgcucacggggcugucgcgcg

SEQ ID NO: 2395694 - RNA, 20 nt, Bordetella pertussis
cucgcuccagcggaccagug

SEQ ID NO: 2395695 - RNA, 13 nt, Bordetella pertussis
cucgcucuuggcg

SEQ ID NO: 2395696 - RNA, 15 nt, Bordetella pertussis
cucgcugaccggcgu

SEQ ID NO: 2395697 - RNA, 13 nt, Bordetella pertussis
cucgcugccggcg

SEQ ID NO: 2395698 - RNA, 14 nt, Bordetella pertussis
cucgcugccggcgc

SEQ ID NO: 2395699 - RNA, 16 nt, Bordetella pertussis
cucgcugccggcgucc

SEQ ID NO: 2395700 - RNA, 15 nt, Bordetella pertussis
cucgcuggcgaagac

SEQ ID NO: 2395701 - RNA, 22 nt, Bordetella pertussis
cucggaagacauggcgcgcgcc

SEQ ID NO: 2395702 - RNA, 22 nt, Bordetella pertussis
cucggacaggucggcgcccacg

SEQ ID NO: 2395703 - RNA, 15 nt, Bordetella pertussis
cucggacgccgcgcg

SEQ ID NO: 2395704 - RNA, 23 nt, Bordetella pertussis
cucggacggauagugguucaugc

SEQ ID NO: 2395705 - RNA, 17 nt, Bordetella pertussis
cucggagccugucccug

SEQ ID NO: 2395706 - RNA, 18 nt, Bordetella pertussis
cucggcaucggccacgcu

SEQ ID NO: 2395707 - RNA, 17 nt, Bordetella pertussis
cucggcauggcgcgcgc

SEQ ID NO: 2395708 - RNA, 15 nt, Bordetella pertussis
cucggccaccaugcg

SEQ ID NO: 2395709 - RNA, 16 nt, Bordetella pertussis
cucggccaccuggcgc

SEQ ID NO: 2395710 - RNA, 14 nt, Bordetella pertussis
cucggccacgcgca

SEQ ID NO: 2395711 - RNA, 16 nt, Bordetella pertussis
cucggccacgcucacg

SEQ ID NO: 2395712 - RNA, 17 nt, Bordetella pertussis
cucggccacgcucacgc

SEQ ID NO: 2395713 - RNA, 17 nt, Bordetella pertussis
cucggccacggucggca

SEQ ID NO: 2395714 - RNA, 11 nt, Bordetella pertussis
cucggccacuu

SEQ ID NO: 2395715 - RNA, 23 nt, Bordetella pertussis
cucggccacuucgcggccgaugu

SEQ ID NO: 2395716 - RNA, 14 nt, Bordetella pertussis
cucggccagcagcg

SEQ ID NO: 2395717 - RNA, 18 nt, Bordetella pertussis
cucggccagcagcgccug

SEQ ID NO: 2395718 - RNA, 17 nt, Bordetella pertussis
cucggccagcagcuuga

SEQ ID NO: 2395719 - RNA, 14 nt, Bordetella pertussis
cucggccagcagug

SEQ ID NO: 2395720 - RNA, 16 nt, Bordetella pertussis
cucggccagcaugcgg

SEQ ID NO: 2395721 - RNA, 12 nt, Bordetella pertussis
cucggccagccg

SEQ ID NO: 2395722 - RNA, 12 nt, Bordetella pertussis
cucggccagcga

SEQ ID NO: 2395723 - RNA, 18 nt, Bordetella pertussis
cucggccagcgaggccgc

SEQ ID NO: 2395724 - RNA, 13 nt, Bordetella pertussis
cucggccagcgcc

SEQ ID NO: 2395725 - RNA, 17 nt, Bordetella pertussis
cucggccagcgcgcgcc

SEQ ID NO: 2395726 - RNA, 19 nt, Bordetella pertussis
cucggccagcgcgcgccag

SEQ ID NO: 2395727 - RNA, 21 nt, Bordetella pertussis
cucggccagcgcgcggccggc

SEQ ID NO: 2395728 - RNA, 13 nt, Bordetella pertussis
cucggccaggcca

SEQ ID NO: 2395729 - RNA, 21 nt, Bordetella pertussis
cucggccaggugcgccaugcg

SEQ ID NO: 2395730 - RNA, 14 nt, Bordetella pertussis
cucggccauggugc

SEQ ID NO: 2395731 - RNA, 20 nt, Bordetella pertussis
cucggccauguagauggccg

SEQ ID NO: 2395732 - RNA, 22 nt, Bordetella pertussis
cucggcccauugcggcaccugc

SEQ ID NO: 2395733 - RNA, 14 nt, Bordetella pertussis
cucggccggcaggu

SEQ ID NO: 2395734 - RNA, 17 nt, Bordetella pertussis
cucggccucgcggcgca

SEQ ID NO: 2395735 - RNA, 20 nt, Bordetella pertussis
cucggccucgcggcgcagca

SEQ ID NO: 2395736 - RNA, 23 nt, Bordetella pertussis
cucggccugcccguucacgcgca

SEQ ID NO: 2395737 - RNA, 16 nt, Bordetella pertussis
cucggccugccggcgc

SEQ ID NO: 2395738 - RNA, 11 nt, Bordetella pertussis
cucggccugcg

SEQ ID NO: 2395739 - RNA, 14 nt, Bordetella pertussis
cucggccugcggcu

SEQ ID NO: 2395740 - RNA, 13 nt, Bordetella pertussis
cucggccugcggu

SEQ ID NO: 2395741 - RNA, 17 nt, Bordetella pertussis
cucggccuggccccagg

SEQ ID NO: 2395742 - RNA, 15 nt, Bordetella pertussis
cucggccuguucgga

SEQ ID NO: 2395743 - RNA, 16 nt, Bordetella pertussis
cucggcgaagccgcag

SEQ ID NO: 2395744 - RNA, 20 nt, Bordetella pertussis
cucggcgaagccgcagcggc

SEQ ID NO: 2395745 - RNA, 16 nt, Bordetella pertussis
cucggcgaagugcccg

SEQ ID NO: 2395746 - RNA, 19 nt, Bordetella pertussis
cucggcgaagugcccgcug

SEQ ID NO: 2395747 - RNA, 14 nt, Bordetella pertussis
cucggcgaccaggc

SEQ ID NO: 2395748 - RNA, 22 nt, Bordetella pertussis
cucggcgacggucaggggcagg

SEQ ID NO: 2395749 - RNA, 19 nt, Bordetella pertussis
cucggcgagcgccucgcgc

SEQ ID NO: 2395750 - RNA, 20 nt, Bordetella pertussis
cucggcgagcgccucgcgcu

SEQ ID NO: 2395751 - RNA, 13 nt, Bordetella pertussis
cucggcgcccagc

SEQ ID NO: 2395752 - RNA, 20 nt, Bordetella pertussis
cucggcgccggcggcgcgga

SEQ ID NO: 2395753 - RNA, 12 nt, Bordetella pertussis
cucggcgccggg

SEQ ID NO: 2395754 - RNA, 12 nt, Bordetella pertussis
cucggcggaugc

SEQ ID NO: 2395755 - RNA, 13 nt, Bordetella pertussis
cucggcggccagc

SEQ ID NO: 2395756 - RNA, 12 nt, Bordetella pertussis
cucggcggccgc

SEQ ID NO: 2395757 - RNA, 15 nt, Bordetella pertussis
cucggcggccgccug

SEQ ID NO: 2395758 - RNA, 12 nt, Bordetella pertussis
cucggcggccuc

SEQ ID NO: 2395759 - RNA, 14 nt, Bordetella pertussis
cucggcggccuccg

SEQ ID NO: 2395760 - RNA, 16 nt, Bordetella pertussis
cucggcggccuccggc

SEQ ID NO: 2395761 - RNA, 18 nt, Bordetella pertussis
cucggcggccuccggcag

SEQ ID NO: 2395762 - RNA, 20 nt, Bordetella pertussis
cucggcggccuccggcagga

SEQ ID NO: 2395763 - RNA, 16 nt, Bordetella pertussis
cucggcgggcggcgcc

SEQ ID NO: 2395764 - RNA, 17 nt, Bordetella pertussis
cucggcgggcggcgcca

SEQ ID NO: 2395765 - RNA, 18 nt, Bordetella pertussis
cucggcgggcggcgccag

SEQ ID NO: 2395766 - RNA, 17 nt, Bordetella pertussis
cucggcgggcuugucgc

SEQ ID NO: 2395767 - RNA, 19 nt, Bordetella pertussis
cucggcggucagcgcggcg

SEQ ID NO: 2395768 - RNA, 17 nt, Bordetella pertussis
cucggcgguugcccgcc

SEQ ID NO: 2395769 - RNA, 17 nt, Bordetella pertussis
cucggcuuccugccgca

SEQ ID NO: 2395770 - RNA, 21 nt, Bordetella pertussis
cucgggaaacaggcccacggc

SEQ ID NO: 2395771 - RNA, 22 nt, Bordetella pertussis
cucgggauaggccucggccacc

SEQ ID NO: 2395772 - RNA, 16 nt, Bordetella pertussis
cucgggcacggccagc

SEQ ID NO: 2395773 - RNA, 20 nt, Bordetella pertussis
cucgggcacggccagcacca

SEQ ID NO: 2395774 - RNA, 14 nt, Bordetella pertussis
cucgggcagcagca

SEQ ID NO: 2395775 - RNA, 19 nt, Bordetella pertussis
cucgggcagcagcagggcc

SEQ ID NO: 2395776 - RNA, 20 nt, Bordetella pertussis
cucgggcagcagcagggcca

SEQ ID NO: 2395777 - RNA, 17 nt, Bordetella pertussis
cucgggcaggucggcca

SEQ ID NO: 2395778 - RNA, 20 nt, Bordetella pertussis
cucgggcaggucggccagcg

SEQ ID NO: 2395779 - RNA, 19 nt, Bordetella pertussis
cucgggcgacaggcgcgcc

SEQ ID NO: 2395780 - RNA, 17 nt, Bordetella pertussis
cucgggcgacuccagcc

SEQ ID NO: 2395781 - RNA, 17 nt, Bordetella pertussis
cucgggcgccucguccu

SEQ ID NO: 2395782 - RNA, 13 nt, Bordetella pertussis
cucgggcgcggca

SEQ ID NO: 2395783 - RNA, 23 nt, Bordetella pertussis
cucgggcgucaugcgcuugucgc

SEQ ID NO: 2395784 - RNA, 13 nt, Bordetella pertussis
cucgggcucgacu

SEQ ID NO: 2395785 - RNA, 19 nt, Bordetella pertussis
cucgggggcgggcccugug

SEQ ID NO: 2395786 - RNA, 16 nt, Bordetella pertussis
cucgggugggccggcu

SEQ ID NO: 2395787 - RNA, 13 nt, Bordetella pertussis
cucggucagcacg

SEQ ID NO: 2395788 - RNA, 16 nt, Bordetella pertussis
cucggucagcgccagg

SEQ ID NO: 2395789 - RNA, 17 nt, Bordetella pertussis
cucggucauguccagcg

SEQ ID NO: 2395790 - RNA, 20 nt, Bordetella pertussis
cucggucauguccagcgcca

SEQ ID NO: 2395791 - RNA, 21 nt, Bordetella pertussis
cucggucauguccagcgccag

SEQ ID NO: 2395792 - RNA, 11 nt, Bordetella pertussis
cucgguccaga

SEQ ID NO: 2395793 - RNA, 13 nt, Bordetella pertussis
cucgguccagcgg

SEQ ID NO: 2395794 - RNA, 22 nt, Bordetella pertussis
cucggucggaaacacguccagc

SEQ ID NO: 2395795 - RNA, 18 nt, Bordetella pertussis
cucggucgucagcacgcc

SEQ ID NO: 2395796 - RNA, 19 nt, Bordetella pertussis
cucggucgucagcacgccc

SEQ ID NO: 2395797 - RNA, 20 nt, Bordetella pertussis
cucggugaugauggccaggu

SEQ ID NO: 2395798 - RNA, 15 nt, Bordetella pertussis
cugcacgcagcgcag

SEQ ID NO: 2395799 - RNA, 17 nt, Bordetella pertussis
cugcacgcagcgcagga

SEQ ID NO: 2395800 - RNA, 13 nt, Bordetella pertussis
cugcacgccgggc

SEQ ID NO: 2395801 - RNA, 14 nt, Bordetella pertussis
cugcacgccgggcg

SEQ ID NO: 2395802 - RNA, 15 nt, Bordetella pertussis
cugcacgccgggcgc

SEQ ID NO: 2395803 - RNA, 20 nt, Bordetella pertussis
cugcacgccgggcgcgcugc

SEQ ID NO: 2395804 - RNA, 13 nt, Bordetella pertussis
cugcacgcgcgcg

SEQ ID NO: 2395805 - RNA, 14 nt, Bordetella pertussis
cugcacgcgcgcgg

SEQ ID NO: 2395806 - RNA, 21 nt, Bordetella pertussis
cugcacgcgcgcgggcgcgcc

SEQ ID NO: 2395807 - RNA, 14 nt, Bordetella pertussis
cugcacgcgggcca

SEQ ID NO: 2395808 - RNA, 17 nt, Bordetella pertussis
cugcacgcgggcgcuga

SEQ ID NO: 2395809 - RNA, 22 nt, Bordetella pertussis
cugcacgcucuugagcgcggcc

SEQ ID NO: 2395810 - RNA, 21 nt, Bordetella pertussis
cugcacggccuugucgcgccc

SEQ ID NO: 2395811 - RNA, 23 nt, Bordetella pertussis
cugcacggccuugucgcgcccga

SEQ ID NO: 2395812 - RNA, 21 nt, Bordetella pertussis
cugcacggcggaaugcggcga

SEQ ID NO: 2395813 - RNA, 23 nt, Bordetella pertussis
cugcacggcggaaugcggcgaca

SEQ ID NO: 2395814 - RNA, 18 nt, Bordetella pertussis
cugcacggugggcagcag

SEQ ID NO: 2395815 - RNA, 19 nt, Bordetella pertussis
cugcacgucccagucgccg

SEQ ID NO: 2395816 - RNA, 19 nt, Bordetella pertussis
cugcacgugaugcaggcgg

SEQ ID NO: 2395817 - RNA, 20 nt, Bordetella pertussis
cugcacgugaugcaggcggu

SEQ ID NO: 2395818 - RNA, 15 nt, Bordetella pertussis
cugcacuugcgaacg

SEQ ID NO: 2395819 - RNA, 19 nt, Bordetella pertussis
cugcacuugcgaacggccg

SEQ ID NO: 2395820 - RNA, 22 nt, Bordetella pertussis
cugcagaucaucgagcaccgcc

SEQ ID NO: 2395821 - RNA, 17 nt, Bordetella pertussis
cugcagaucaucggcgc

SEQ ID NO: 2395822 - RNA, 18 nt, Bordetella pertussis
cugcagaucaucggcgcc

SEQ ID NO: 2395823 - RNA, 19 nt, Bordetella pertussis
cugcagaucaucggcgcca

SEQ ID NO: 2395824 - RNA, 17 nt, Bordetella pertussis
cugcagcagcgccuugc

SEQ ID NO: 2395825 - RNA, 14 nt, Bordetella pertussis
cugcagcagcggca

SEQ ID NO: 2395826 - RNA, 15 nt, Bordetella pertussis
cugcagcagcggcag

SEQ ID NO: 2395827 - RNA, 23 nt, Bordetella pertussis
cugcagcagcguggccgccacca

SEQ ID NO: 2395828 - RNA, 13 nt, Bordetella pertussis
cugcagcaggcgc

SEQ ID NO: 2395829 - RNA, 13 nt, Bordetella pertussis
cugcagcaggcug

SEQ ID NO: 2395830 - RNA, 16 nt, Bordetella pertussis
cugcagcaggcugggc

SEQ ID NO: 2395831 - RNA, 17 nt, Bordetella pertussis
cugcagcaggcugggcg

SEQ ID NO: 2395832 - RNA, 18 nt, Bordetella pertussis
cugcagcaggcugggcga

SEQ ID NO: 2395833 - RNA, 22 nt, Bordetella pertussis
cugcagcaggucggucgccugu

SEQ ID NO: 2395834 - RNA, 12 nt, Bordetella pertussis
cugcagcaugaa

SEQ ID NO: 2395835 - RNA, 22 nt, Bordetella pertussis
cugcagccacuggaacagcuug

SEQ ID NO: 2395836 - RNA, 21 nt, Bordetella pertussis
cugcagccaguugggccaggg

SEQ ID NO: 2395837 - RNA, 14 nt, Bordetella pertussis
cugcagcccggcca

SEQ ID NO: 2395838 - RNA, 18 nt, Bordetella pertussis
cugcagcgcaggaugggc

SEQ ID NO: 2395839 - RNA, 23 nt, Bordetella pertussis
cugcagcgcaucgccgcaggcgu

SEQ ID NO: 2395840 - RNA, 13 nt, Bordetella pertussis
cugcagcgccgcc

SEQ ID NO: 2395841 - RNA, 14 nt, Bordetella pertussis
cugcagcgcgcgcg

SEQ ID NO: 2395842 - RNA, 14 nt, Bordetella pertussis
cugcagcgcugguu

SEQ ID NO: 2395843 - RNA, 21 nt, Bordetella pertussis
cugcagcgcugguucgaccug

SEQ ID NO: 2395844 - RNA, 14 nt, Bordetella pertussis
cugcagcggccagu

SEQ ID NO: 2395845 - RNA, 15 nt, Bordetella pertussis
cugcagcggccaguc

SEQ ID NO: 2395846 - RNA, 21 nt, Bordetella pertussis
cugcagcgugauggggccggg

SEQ ID NO: 2395847 - RNA, 22 nt, Bordetella pertussis
cugcagcgugauggggccgggc

SEQ ID NO: 2395848 - RNA, 12 nt, Bordetella pertussis
cugcagcgugcu

SEQ ID NO: 2395849 - RNA, 15 nt, Bordetella pertussis
cugcagcugcuugcc

SEQ ID NO: 2395850 - RNA, 16 nt, Bordetella pertussis
cugcagcugcuugccc

SEQ ID NO: 2395851 - RNA, 20 nt, Bordetella pertussis
cugcagcugcuugcccaggc

SEQ ID NO: 2395852 - RNA, 21 nt, Bordetella pertussis
cugcaggaacucgcacacgcg

SEQ ID NO: 2395853 - RNA, 18 nt, Bordetella pertussis
cugcaggaagccugcgcg

SEQ ID NO: 2395854 - RNA, 15 nt, Bordetella pertussis
cugcaggaaggccgc

SEQ ID NO: 2395855 - RNA, 22 nt, Bordetella pertussis
cugcaggaucgcggccagcggc

SEQ ID NO: 2395856 - RNA, 23 nt, Bordetella pertussis
cugcaggaucgcggccagcggca

SEQ ID NO: 2395857 - RNA, 16 nt, Bordetella pertussis
cugcaggaugaggcgc

SEQ ID NO: 2395858 - RNA, 12 nt, Bordetella pertussis
cugcaggauggg

SEQ ID NO: 2395859 - RNA, 20 nt, Bordetella pertussis
cugcaggccaucgcggucga

SEQ ID NO: 2395860 - RNA, 14 nt, Bordetella pertussis
cugcaggcccaccg

SEQ ID NO: 2395861 - RNA, 13 nt, Bordetella pertussis
cugcaggcccagc

SEQ ID NO: 2395862 - RNA, 15 nt, Bordetella pertussis
cugcaggcccagcac

SEQ ID NO: 2395863 - RNA, 17 nt, Bordetella pertussis
cugcaggcccagcacgc

SEQ ID NO: 2395864 - RNA, 13 nt, Bordetella pertussis
cugcaggcccggc

SEQ ID NO: 2395865 - RNA, 21 nt, Bordetella pertussis
cugcaggccgccggccagcgc

SEQ ID NO: 2395866 - RNA, 21 nt, Bordetella pertussis
cugcaggccgccggccucuuc

SEQ ID NO: 2395867 - RNA, 14 nt, Bordetella pertussis
cugcaggccggcgc

SEQ ID NO: 2395868 - RNA, 15 nt, Bordetella pertussis
cugcaggccggcgcg

SEQ ID NO: 2395869 - RNA, 17 nt, Bordetella pertussis
cugcaggccggcgcgca

SEQ ID NO: 2395870 - RNA, 14 nt, Bordetella pertussis
cugcaggccgggca

SEQ ID NO: 2395871 - RNA, 14 nt, Bordetella pertussis
cugcaggcggcgca

SEQ ID NO: 2395872 - RNA, 22 nt, Bordetella pertussis
cugcaggcgucccggaugcgau

SEQ ID NO: 2395873 - RNA, 16 nt, Bordetella pertussis
cugcagggcaugggcc

SEQ ID NO: 2395874 - RNA, 21 nt, Bordetella pertussis
cugcagggcaugggcccgggc

SEQ ID NO: 2395875 - RNA, 15 nt, Bordetella pertussis
cugcagggccuggaa

SEQ ID NO: 2395876 - RNA, 15 nt, Bordetella pertussis
cugcagggcgucugc

SEQ ID NO: 2395877 - RNA, 19 nt, Bordetella pertussis
cugcagggcgucugcucgc

SEQ ID NO: 2395878 - RNA, 21 nt, Bordetella pertussis
cugcagggcugcgaugcgggc

SEQ ID NO: 2395879 - RNA, 14 nt, Bordetella pertussis
cugcagggucagcc

SEQ ID NO: 2395880 - RNA, 23 nt, Bordetella pertussis
cugcagguccugguagaucagcg

SEQ ID NO: 2395881 - RNA, 14 nt, Bordetella pertussis
cugcaggugccgcc

SEQ ID NO: 2395882 - RNA, 16 nt, Bordetella pertussis
cugcaguucggccgcc

SEQ ID NO: 2395883 - RNA, 17 nt, Bordetella pertussis
cugcaguucggccgcca

SEQ ID NO: 2395884 - RNA, 14 nt, Bordetella pertussis
cugcaguugcgcca

SEQ ID NO: 2395885 - RNA, 16 nt, Bordetella pertussis
cugcaguugcgccacg

SEQ ID NO: 2395886 - RNA, 20 nt, Bordetella pertussis
cugcaguugcgccacggucu

SEQ ID NO: 2395887 - RNA, 22 nt, Bordetella pertussis
cugcaucacgguaggcgcgucg

SEQ ID NO: 2395888 - RNA, 24 nt, Bordetella pertussis
cugcaucacgguaggcgcgucgcu

SEQ ID NO: 2395889 - RNA, 17 nt, Bordetella pertussis
cugcauccggcccagcg

SEQ ID NO: 2395890 - RNA, 14 nt, Bordetella pertussis
cugcaucggcauga

SEQ ID NO: 2395891 - RNA, 22 nt, Bordetella pertussis
cugcaugaccgccgccagcagc

SEQ ID NO: 2395892 - RNA, 15 nt, Bordetella pertussis
cugcaugauggcccg

SEQ ID NO: 2395893 - RNA, 19 nt, Bordetella pertussis
cugcaugccauagucgcgc

SEQ ID NO: 2395894 - RNA, 23 nt, Bordetella pertussis
cugcaugccccaacggcgcaccg

SEQ ID NO: 2395895 - RNA, 21 nt, Bordetella pertussis
cugcaugcgcacggacagccc

SEQ ID NO: 2395896 - RNA, 20 nt, Bordetella pertussis
cugcaugcgcgaacgcgcgc

SEQ ID NO: 2395897 - RNA, 21 nt, Bordetella pertussis
cugcaugcgcgaacgcgcgcc

SEQ ID NO: 2395898 - RNA, 22 nt, Bordetella pertussis
cugcaugcgcgaacgcgcgccg

SEQ ID NO: 2395899 - RNA, 23 nt, Bordetella pertussis
cugcaugcgcgaacgcgcgccgg

SEQ ID NO: 2395900 - RNA, 17 nt, Bordetella pertussis
cugcaugggcggcccgc

SEQ ID NO: 2395901 - RNA, 20 nt, Bordetella pertussis
cugcauguacucggccaggc

SEQ ID NO: 2395902 - RNA, 22 nt, Bordetella pertussis
cugcauguacucggccaggcca

SEQ ID NO: 2395903 - RNA, 19 nt, Bordetella pertussis
cugcaugucguacaggccg

SEQ ID NO: 2395904 - RNA, 23 nt, Bordetella pertussis
cugccaaccgcgacgcauaucca

SEQ ID NO: 2395905 - RNA, 18 nt, Bordetella pertussis
cugccacacgcgguaggu

SEQ ID NO: 2395906 - RNA, 22 nt, Bordetella pertussis
cugccacacgcgguagguagcg

SEQ ID NO: 2395907 - RNA, 14 nt, Bordetella pertussis
cugccaccagcgcg

SEQ ID NO: 2395908 - RNA, 16 nt, Bordetella pertussis
cugccaccagcgcgcc

SEQ ID NO: 2395909 - RNA, 17 nt, Bordetella pertussis
cugccaccagcgcgcca

SEQ ID NO: 2395910 - RNA, 20 nt, Bordetella pertussis
cugccaccagcgcgccagca

SEQ ID NO: 2395911 - RNA, 16 nt, Bordetella pertussis
cugccagaacagccgc

SEQ ID NO: 2395912 - RNA, 16 nt, Bordetella pertussis
cucgaugcgccagucc

SEQ ID NO: 2395913 - RNA, 19 nt, Bordetella pertussis
cucgaugcgccaguccagc

SEQ ID NO: 2395914 - RNA, 21 nt, Bordetella pertussis
cucgaugcgccaguccagcgc

SEQ ID NO: 2395915 - RNA, 22 nt, Bordetella pertussis
cucgaugcgccaguccagcgcg

SEQ ID NO: 2395916 - RNA, 18 nt, Bordetella pertussis
cucgaugcggucggccgc

SEQ ID NO: 2395917 - RNA, 22 nt, Bordetella pertussis
cucgaugcggucggccgcgccg

SEQ ID NO: 2395918 - RNA, 19 nt, Bordetella pertussis
cucgauggcgcaggcgcgc

SEQ ID NO: 2395919 - RNA, 21 nt, Bordetella pertussis
cucgauggcgcaggcgcgcca

SEQ ID NO: 2395920 - RNA, 20 nt, Bordetella pertussis
cucgaugggauacgccgugc

SEQ ID NO: 2395921 - RNA, 21 nt, Bordetella pertussis
cucgaugggauacgccgugcu

SEQ ID NO: 2395922 - RNA, 15 nt, Bordetella pertussis
cucgaugggcgcgcg

SEQ ID NO: 2395923 - RNA, 17 nt, Bordetella pertussis
cucgaugggcgcgcgca

SEQ ID NO: 2395924 - RNA, 15 nt, Bordetella pertussis
cucgauguggcgcug

SEQ ID NO: 2395925 - RNA, 19 nt, Bordetella pertussis
cucgauguggcgcuggcgg

SEQ ID NO: 2395926 - RNA, 21 nt, Bordetella pertussis
cucgauguggcgcuggcggcu

SEQ ID NO: 2395927 - RNA, 17 nt, Bordetella pertussis
cucgauugaccagcacc

SEQ ID NO: 2395928 - RNA, 20 nt, Bordetella pertussis
cucgcaagugcuggcccgcc

SEQ ID NO: 2395929 - RNA, 14 nt, Bordetella pertussis
cucgcacacgcgcu

SEQ ID NO: 2395930 - RNA, 16 nt, Bordetella pertussis
cucgcacacgcgcugg

SEQ ID NO: 2395931 - RNA, 23 nt, Bordetella pertussis
cucgcacaguucgugcaccagcc

SEQ ID NO: 2395932 - RNA, 23 nt, Bordetella pertussis
cucgcacggcaauguccggggcg

SEQ ID NO: 2395933 - RNA, 16 nt, Bordetella pertussis
cucgcacggccgucaa

SEQ ID NO: 2395934 - RNA, 21 nt, Bordetella pertussis
cucgcacggccgucaacagca

SEQ ID NO: 2395935 - RNA, 20 nt, Bordetella pertussis
cucgcaggaauccuggugcc

SEQ ID NO: 2395936 - RNA, 16 nt, Bordetella pertussis
cucgcaggccugcugc

SEQ ID NO: 2395937 - RNA, 23 nt, Bordetella pertussis
cucgcaucggccugcaccggcgc

SEQ ID NO: 2395938 - RNA, 14 nt, Bordetella pertussis
cucgccacacgcca

SEQ ID NO: 2395939 - RNA, 15 nt, Bordetella pertussis
cucgccagcggcagc

SEQ ID NO: 2395940 - RNA, 17 nt, Bordetella pertussis
cucgccagcggcagcgc

SEQ ID NO: 2395941 - RNA, 22 nt, Bordetella pertussis
cucgccagcggcagcgcgcagg

SEQ ID NO: 2395942 - RNA, 23 nt, Bordetella pertussis
cucgcccacccccggcaccagga

SEQ ID NO: 2395943 - RNA, 12 nt, Bordetella pertussis
cucgcccagcac

SEQ ID NO: 2395944 - RNA, 21 nt, Bordetella pertussis
cucgcccagcaccucgacgca

SEQ ID NO: 2395945 - RNA, 16 nt, Bordetella pertussis
cucgcccagccgccug

SEQ ID NO: 2395946 - RNA, 19 nt, Bordetella pertussis
cucgcccagccgccugagc

SEQ ID NO: 2395947 - RNA, 22 nt, Bordetella pertussis
cucgcccagcgagccggccagc

SEQ ID NO: 2395948 - RNA, 23 nt, Bordetella pertussis
cucgcccagcgagccggccagcg

SEQ ID NO: 2395949 - RNA, 18 nt, Bordetella pertussis
cucgcccagcggcgccga

SEQ ID NO: 2395950 - RNA, 23 nt, Bordetella pertussis
cucgcccagcggcgccgaccagg

SEQ ID NO: 2395951 - RNA, 12 nt, Bordetella pertussis
cucgcccaggcc

SEQ ID NO: 2395952 - RNA, 14 nt, Bordetella pertussis
cucgcccaggccca

SEQ ID NO: 2395953 - RNA, 17 nt, Bordetella pertussis
cucgcccaggcccagca

SEQ ID NO: 2395954 - RNA, 13 nt, Bordetella pertussis
cucgcccaggccg

SEQ ID NO: 2395955 - RNA, 14 nt, Bordetella pertussis
cucgcccaggccgg

SEQ ID NO: 2395956 - RNA, 16 nt, Bordetella pertussis
cucgcccaggccgggc

SEQ ID NO: 2395957 - RNA, 18 nt, Bordetella pertussis
cucgcccccgaaggccgc

SEQ ID NO: 2395958 - RNA, 19 nt, Bordetella pertussis
cucgcccccgaaggccgcg

SEQ ID NO: 2395959 - RNA, 13 nt, Bordetella pertussis
cucgccccgacca

SEQ ID NO: 2395960 - RNA, 15 nt, Bordetella pertussis
cucgccccggcgcgc

SEQ ID NO: 2395961 - RNA, 12 nt, Bordetella pertussis
cucgcccgaccu

SEQ ID NO: 2395962 - RNA, 18 nt, Bordetella pertussis
cucgcccgaucggccggc

SEQ ID NO: 2395963 - RNA, 13 nt, Bordetella pertussis
cucgcccucgcgc

SEQ ID NO: 2395964 - RNA, 15 nt, Bordetella pertussis
cucgcccucgcgcca

SEQ ID NO: 2395965 - RNA, 17 nt, Bordetella pertussis
cucgcccugcuggcgca

SEQ ID NO: 2395966 - RNA, 18 nt, Bordetella pertussis
cucgcccuugagcacggc

SEQ ID NO: 2395967 - RNA, 19 nt, Bordetella pertussis
cucgcccuugcggcgaggc

SEQ ID NO: 2395968 - RNA, 19 nt, Bordetella pertussis
cucgccgaacugccggcgc

SEQ ID NO: 2395969 - RNA, 15 nt, Bordetella pertussis
cucgccgagccgggc

SEQ ID NO: 2395970 - RNA, 16 nt, Bordetella pertussis
cucgccgagccgggcc

SEQ ID NO: 2395971 - RNA, 17 nt, Bordetella pertussis
cucgccgcgcacgggcg

SEQ ID NO: 2395972 - RNA, 15 nt, Bordetella pertussis
cucgccgcgcgacag

SEQ ID NO: 2395973 - RNA, 22 nt, Bordetella pertussis
cucgccgcgcgacagccgcgcc

SEQ ID NO: 2395974 - RNA, 12 nt, Bordetella pertussis
cucgccgcgcgu

SEQ ID NO: 2395975 - RNA, 14 nt, Bordetella pertussis
cucgccgcuccggc

SEQ ID NO: 2395976 - RNA, 12 nt, Bordetella pertussis
cucgccggcccu

SEQ ID NO: 2395977 - RNA, 18 nt, Bordetella pertussis
cucgccggcccugccgcc

SEQ ID NO: 2395978 - RNA, 14 nt, Bordetella pertussis
cucgccggccgcgc

SEQ ID NO: 2395979 - RNA, 17 nt, Bordetella pertussis
cucgccggccgcgccca

SEQ ID NO: 2395980 - RNA, 13 nt, Bordetella pertussis
cucgccggccugg

SEQ ID NO: 2395981 - RNA, 14 nt, Bordetella pertussis
cucgccggccuggc

SEQ ID NO: 2395982 - RNA, 13 nt, Bordetella pertussis
cucgccggcgccg

SEQ ID NO: 2395983 - RNA, 18 nt, Bordetella pertussis
cucgccggcgccgccccu

SEQ ID NO: 2395984 - RNA, 14 nt, Bordetella pertussis
cucgccggcgcugc

SEQ ID NO: 2395985 - RNA, 22 nt, Bordetella pertussis
cucgccguaggcuugcagcuug

SEQ ID NO: 2395986 - RNA, 13 nt, Bordetella pertussis
cucgccgucgacg

SEQ ID NO: 2395987 - RNA, 16 nt, Bordetella pertussis
cucgccgugcugggcg

SEQ ID NO: 2395988 - RNA, 23 nt, Bordetella pertussis
cucgccgugcugggcggccaggc

SEQ ID NO: 2395989 - RNA, 20 nt, Bordetella pertussis
cucgccguucuucgaucgcc

SEQ ID NO: 2395990 - RNA, 15 nt, Bordetella pertussis
cucgccuccccaggc

SEQ ID NO: 2395991 - RNA, 16 nt, Bordetella pertussis
cucgccuccccaggcc

SEQ ID NO: 2395992 - RNA, 23 nt, Bordetella pertussis
cucgccuccccaggccagcugcg

SEQ ID NO: 2395993 - RNA, 14 nt, Bordetella pertussis
cucgccucggcuug

SEQ ID NO: 2395994 - RNA, 16 nt, Bordetella pertussis
cucgcgaaagcacgcc

SEQ ID NO: 2395995 - RNA, 18 nt, Bordetella pertussis
cucgcgaaagcacgccau

SEQ ID NO: 2395996 - RNA, 13 nt, Bordetella pertussis
cucgcgcaacgca

SEQ ID NO: 2395997 - RNA, 17 nt, Bordetella pertussis
cucgcgcacagcgcgca

SEQ ID NO: 2395998 - RNA, 13 nt, Bordetella pertussis
cucgcgcaccgca

SEQ ID NO: 2395999 - RNA, 20 nt, Bordetella pertussis
cucgcgcaccgcaugggcca

SEQ ID NO: 2396000 - RNA, 23 nt, Bordetella pertussis
cucgcgcaccgcaugggccaggc

SEQ ID NO: 2396001 - RNA, 12 nt, Bordetella pertussis
cucgcgcagcag

SEQ ID NO: 2396002 - RNA, 17 nt, Bordetella pertussis
cucgcgcagcguggcgg

SEQ ID NO: 2396003 - RNA, 13 nt, Bordetella pertussis
cucgcgccaccau

SEQ ID NO: 2396004 - RNA, 22 nt, Bordetella pertussis
cucgcgccagggccccuccggc

SEQ ID NO: 2396005 - RNA, 17 nt, Bordetella pertussis
cucgcgcccgagcgcca

SEQ ID NO: 2396006 - RNA, 16 nt, Bordetella pertussis
cucgcgcgaccacugg

SEQ ID NO: 2396007 - RNA, 14 nt, Bordetella pertussis
cucgcgcgccagca

SEQ ID NO: 2396008 - RNA, 14 nt, Bordetella pertussis
cucgcgcgccaggu

SEQ ID NO: 2396009 - RNA, 20 nt, Bordetella pertussis
cucgcgcgcgaugcgcaggc

SEQ ID NO: 2396010 - RNA, 20 nt, Bordetella pertussis
cucgcgcgcgcgggcgcgca

SEQ ID NO: 2396011 - RNA, 15 nt, Bordetella pertussis
cucgcgcgcgugcuc

SEQ ID NO: 2396012 - RNA, 22 nt, Bordetella pertussis
cucgcgcggguccuugccgggc

SEQ ID NO: 2396013 - RNA, 12 nt, Bordetella pertussis
cucgcgcuccag

SEQ ID NO: 2396014 - RNA, 17 nt, Bordetella pertussis
cucgcgcuccaugggcg

SEQ ID NO: 2396015 - RNA, 18 nt, Bordetella pertussis
cucgcgcuccaugggcgu

SEQ ID NO: 2396016 - RNA, 12 nt, Bordetella pertussis
cucgcgcucgag

SEQ ID NO: 2396017 - RNA, 16 nt, Bordetella pertussis
cucgcgcucgcccggc

SEQ ID NO: 2396018 - RNA, 14 nt, Bordetella pertussis
cucgcgcucgcgcu

SEQ ID NO: 2396019 - RNA, 13 nt, Bordetella pertussis
cucgcgcucggcc

SEQ ID NO: 2396020 - RNA, 21 nt, Bordetella pertussis
cucgcgcugcaggaucgcggc

SEQ ID NO: 2396021 - RNA, 23 nt, Bordetella pertussis
cucgcgcugcaggaucgcggcca

SEQ ID NO: 2396022 - RNA, 17 nt, Bordetella pertussis
cucgcggaaauccgggc

SEQ ID NO: 2396023 - RNA, 22 nt, Bordetella pertussis
cucgcggaaauccgggcgcugc

SEQ ID NO: 2396024 - RNA, 17 nt, Bordetella pertussis
cucgcggaugaccuggu

SEQ ID NO: 2396025 - RNA, 18 nt, Bordetella pertussis
cucgcggaugaccuggug

SEQ ID NO: 2396026 - RNA, 23 nt, Bordetella pertussis
cucgcggaugaccuggugcacca

SEQ ID NO: 2396027 - RNA, 17 nt, Bordetella pertussis
cucggugcagcccagca

SEQ ID NO: 2396028 - RNA, 19 nt, Bordetella pertussis
cucggugcagcccagcacc

SEQ ID NO: 2396029 - RNA, 14 nt, Bordetella pertussis
cucggugcgccgcc

SEQ ID NO: 2396030 - RNA, 15 nt, Bordetella pertussis
cucggugcgccgccg

SEQ ID NO: 2396031 - RNA, 15 nt, Bordetella pertussis
cucggugcgggccgg

SEQ ID NO: 2396032 - RNA, 16 nt, Bordetella pertussis
cucggugcucuggccc

SEQ ID NO: 2396033 - RNA, 19 nt, Bordetella pertussis
cucggugcucuggcccgcc

SEQ ID NO: 2396034 - RNA, 14 nt, Bordetella pertussis
cucggugcugcugu

SEQ ID NO: 2396035 - RNA, 18 nt, Bordetella pertussis
cucgguggaggacgccga

SEQ ID NO: 2396036 - RNA, 21 nt, Bordetella pertussis
cucguacgaggcauacaggcu

SEQ ID NO: 2396037 - RNA, 15 nt, Bordetella pertussis
cucguacggcgucgg

SEQ ID NO: 2396038 - RNA, 19 nt, Bordetella pertussis
cucguacggcgucgggcag

SEQ ID NO: 2396039 - RNA, 19 nt, Bordetella pertussis
cucguagaucuugccggcc

SEQ ID NO: 2396040 - RNA, 20 nt, Bordetella pertussis
cucguaggcgagguccaggc

SEQ ID NO: 2396041 - RNA, 15 nt, Bordetella pertussis
cucguccaucgccug

SEQ ID NO: 2396042 - RNA, 18 nt, Bordetella pertussis
cucguccaucgccugcac

SEQ ID NO: 2396043 - RNA, 14 nt, Bordetella pertussis
cucguccauggugg

SEQ ID NO: 2396044 - RNA, 17 nt, Bordetella pertussis
cucgucccccuacugcc

SEQ ID NO: 2396045 - RNA, 14 nt, Bordetella pertussis
cucguccgauggcg

SEQ ID NO: 2396046 - RNA, 22 nt, Bordetella pertussis
cucguccguuucgucggcgcgc

SEQ ID NO: 2396047 - RNA, 17 nt, Bordetella pertussis
cucgucgaccaccagca

SEQ ID NO: 2396048 - RNA, 20 nt, Bordetella pertussis
cucgucgaccacgccggcgg

SEQ ID NO: 2396049 - RNA, 12 nt, Bordetella pertussis
cucgucgacgcg

SEQ ID NO: 2396050 - RNA, 15 nt, Bordetella pertussis
cucgucgaggaucaa

SEQ ID NO: 2396051 - RNA, 15 nt, Bordetella pertussis
cucgucgccgcugga

SEQ ID NO: 2396052 - RNA, 21 nt, Bordetella pertussis
cucgugaucgaccgccagcag

SEQ ID NO: 2396053 - RNA, 20 nt, Bordetella pertussis
cucgugcaucaucugggcgu

SEQ ID NO: 2396054 - RNA, 19 nt, Bordetella pertussis
cucgugcgaggccacggca

SEQ ID NO: 2396055 - RNA, 14 nt, Bordetella pertussis
cucgugcuggccgg

SEQ ID NO: 2396056 - RNA, 14 nt, Bordetella pertussis
cucgugcugggcau

SEQ ID NO: 2396057 - RNA, 13 nt, Bordetella pertussis
cucguggcccagc

SEQ ID NO: 2396058 - RNA, 18 nt, Bordetella pertussis
cucguggcccagcaccgc

SEQ ID NO: 2396059 - RNA, 13 nt, Bordetella pertussis
cucguggcgcgcc

SEQ ID NO: 2396060 - RNA, 20 nt, Bordetella pertussis
cucguuccagaugcgcagca

SEQ ID NO: 2396061 - RNA, 14 nt, Bordetella pertussis
cucguugcccgcgg

SEQ ID NO: 2396062 - RNA, 13 nt, Bordetella pertussis
cucguugcgcaag

SEQ ID NO: 2396063 - RNA, 16 nt, Bordetella pertussis
cucguuggucagcacc

SEQ ID NO: 2396064 - RNA, 19 nt, Bordetella pertussis
cucuacaccaucaacgggc

SEQ ID NO: 2396065 - RNA, 14 nt, Bordetella pertussis
cucuacacggccgc

SEQ ID NO: 2396066 - RNA, 16 nt, Bordetella pertussis
cucuacacggccgcca

SEQ ID NO: 2396067 - RNA, 17 nt, Bordetella pertussis
cucuacacggccgccac

SEQ ID NO: 2396068 - RNA, 23 nt, Bordetella pertussis
cucuaugcgguguugcucgugcu

SEQ ID NO: 2396069 - RNA, 19 nt, Bordetella pertussis
cucuaugucgccggccagu

SEQ ID NO: 2396070 - RNA, 14 nt, Bordetella pertussis
cucuccacuggccu

SEQ ID NO: 2396071 - RNA, 22 nt, Bordetella pertussis
cucugcaccuugggcgccugcg

SEQ ID NO: 2396072 - RNA, 12 nt, Bordetella pertussis
cucugcgcggca

SEQ ID NO: 2396073 - RNA, 15 nt, Bordetella pertussis
cucuggaucgugccc

SEQ ID NO: 2396074 - RNA, 18 nt, Bordetella pertussis
cucuggaucgugcccagc

SEQ ID NO: 2396075 - RNA, 15 nt, Bordetella pertussis
cucuggcacaccagc

SEQ ID NO: 2396076 - RNA, 16 nt, Bordetella pertussis
cucuggcacaccagcg

SEQ ID NO: 2396077 - RNA, 18 nt, Bordetella pertussis
cucuggcacaccagcgcc

SEQ ID NO: 2396078 - RNA, 15 nt, Bordetella pertussis
cucuggcccgccuca

SEQ ID NO: 2396079 - RNA, 14 nt, Bordetella pertussis
cucugguccaggcg

SEQ ID NO: 2396080 - RNA, 16 nt, Bordetella pertussis
cucugguccaggcggu

SEQ ID NO: 2396081 - RNA, 18 nt, Bordetella pertussis
cucuuccaucuacgugcu

SEQ ID NO: 2396082 - RNA, 21 nt, Bordetella pertussis
cucuucgaaguauuucaggau

SEQ ID NO: 2396083 - RNA, 16 nt, Bordetella pertussis
cucuucgagcgcggcg

SEQ ID NO: 2396084 - RNA, 22 nt, Bordetella pertussis
cucuucgaugaugagcgcgccg

SEQ ID NO: 2396085 - RNA, 16 nt, Bordetella pertussis
cucuucggcggccagc

SEQ ID NO: 2396086 - RNA, 21 nt, Bordetella pertussis
cucuucgucgccggcgcugcu

SEQ ID NO: 2396087 - RNA, 20 nt, Bordetella pertussis
cucuucguugucgcgcgcgc

SEQ ID NO: 2396088 - RNA, 20 nt, Bordetella pertussis
cucuucucguccgauggcga

SEQ ID NO: 2396089 - RNA, 13 nt, Bordetella pertussis
cucuugaccuggg

SEQ ID NO: 2396090 - RNA, 18 nt, Bordetella pertussis
cucuugaccugggccagc

SEQ ID NO: 2396091 - RNA, 19 nt, Bordetella pertussis
cucuugaccugggccagca

SEQ ID NO: 2396092 - RNA, 22 nt, Bordetella pertussis
cucuugagcgcggccucgccgg

SEQ ID NO: 2396093 - RNA, 15 nt, Bordetella pertussis
cucuugcgcgcgccg

SEQ ID NO: 2396094 - RNA, 21 nt, Bordetella pertussis
cucuuggcaaccucgccgcgc

SEQ ID NO: 2396095 - RNA, 16 nt, Bordetella pertussis
cucuuggcgccggacu

SEQ ID NO: 2396096 - RNA, 16 nt, Bordetella pertussis
cugaacaccggcgcgc

SEQ ID NO: 2396097 - RNA, 18 nt, Bordetella pertussis
cugaacaccggcgcgccu

SEQ ID NO: 2396098 - RNA, 21 nt, Bordetella pertussis
cugaacaccggcgcgccuggc

SEQ ID NO: 2396099 - RNA, 15 nt, Bordetella pertussis
cugaacaggccuucg

SEQ ID NO: 2396100 - RNA, 18 nt, Bordetella pertussis
cugaaccaggccgccagg

SEQ ID NO: 2396101 - RNA, 16 nt, Bordetella pertussis
cugaaccugcuggccg

SEQ ID NO: 2396102 - RNA, 18 nt, Bordetella pertussis
cugaacgaauaaucgccg

SEQ ID NO: 2396103 - RNA, 18 nt, Bordetella pertussis
cugaacgacgguacaccu

SEQ ID NO: 2396104 - RNA, 16 nt, Bordetella pertussis
cugaacgccgcgcugc

SEQ ID NO: 2396105 - RNA, 14 nt, Bordetella pertussis
cugaacgccgggcc

SEQ ID NO: 2396106 - RNA, 19 nt, Bordetella pertussis
cugaacgccgggccgugcg

SEQ ID NO: 2396107 - RNA, 16 nt, Bordetella pertussis
cugaacgccucgggcu

SEQ ID NO: 2396108 - RNA, 13 nt, Bordetella pertussis
cugaacgcgcgug

SEQ ID NO: 2396109 - RNA, 21 nt, Bordetella pertussis
cugaacgcgcgugaacggcuc

SEQ ID NO: 2396110 - RNA, 22 nt, Bordetella pertussis
cugaacgcguccaggcccuggc

SEQ ID NO: 2396111 - RNA, 19 nt, Bordetella pertussis
cugaacguguaggucagcg

SEQ ID NO: 2396112 - RNA, 22 nt, Bordetella pertussis
cugaacuacgaaacucccacgc

SEQ ID NO: 2396113 - RNA, 15 nt, Bordetella pertussis
cugaacuauggcgcg

SEQ ID NO: 2396114 - RNA, 22 nt, Bordetella pertussis
cugaagcgccgccacaggcuga

SEQ ID NO: 2396115 - RNA, 18 nt, Bordetella pertussis
cugaaggaccucgcgccg

SEQ ID NO: 2396116 - RNA, 19 nt, Bordetella pertussis
cugaaggggcuccccugcu

SEQ ID NO: 2396117 - RNA, 24 nt, Bordetella pertussis
cugaauccggggugccuguccucc

SEQ ID NO: 2396118 - RNA, 16 nt, Bordetella pertussis
cugaaucgcccgggcg

SEQ ID NO: 2396119 - RNA, 17 nt, Bordetella pertussis
cugaaucgcccgggcgc

SEQ ID NO: 2396120 - RNA, 17 nt, Bordetella pertussis
cugaaugccgccgugau

SEQ ID NO: 2396121 - RNA, 12 nt, Bordetella pertussis
cugaauugcggg

SEQ ID NO: 2396122 - RNA, 15 nt, Bordetella pertussis
cugacaauccuggcu

SEQ ID NO: 2396123 - RNA, 12 nt, Bordetella pertussis
cugaccaccggg

SEQ ID NO: 2396124 - RNA, 13 nt, Bordetella pertussis
cugaccaccggga

SEQ ID NO: 2396125 - RNA, 17 nt, Bordetella pertussis
cugaccaccgggaugcc

SEQ ID NO: 2396126 - RNA, 12 nt, Bordetella pertussis
cugaccagcacg

SEQ ID NO: 2396127 - RNA, 18 nt, Bordetella pertussis
cugaccagcacgaugguc

SEQ ID NO: 2396128 - RNA, 23 nt, Bordetella pertussis
cugaccagcagcaccgugccggc

SEQ ID NO: 2396129 - RNA, 16 nt, Bordetella pertussis
cugaccagcgcgucgc

SEQ ID NO: 2396130 - RNA, 18 nt, Bordetella pertussis
cugacccccgaacugggc

SEQ ID NO: 2396131 - RNA, 19 nt, Bordetella pertussis
cugacccccgaacugggcg

SEQ ID NO: 2396132 - RNA, 17 nt, Bordetella pertussis
cugacccgcuggcuggc

SEQ ID NO: 2396133 - RNA, 13 nt, Bordetella pertussis
cugacccuggccg

SEQ ID NO: 2396134 - RNA, 14 nt, Bordetella pertussis
cugacccuggccga

SEQ ID NO: 2396135 - RNA, 13 nt, Bordetella pertussis
cugaccgaagcgc

SEQ ID NO: 2396136 - RNA, 19 nt, Bordetella pertussis
cugaccgaagcgggcgagg

SEQ ID NO: 2396137 - RNA, 13 nt, Bordetella pertussis
cugaccgacggcc

SEQ ID NO: 2396138 - RNA, 19 nt, Bordetella pertussis
cugaccgacgugcgccgca

SEQ ID NO: 2396139 - RNA, 17 nt, Bordetella pertussis
cugaccggcggcacggc

SEQ ID NO: 2396140 - RNA, 14 nt, Bordetella pertussis
cugaccggcggcgc

SEQ ID NO: 2396141 - RNA, 23 nt, Bordetella pertussis
cugaccggcggcgcucaucaucg

SEQ ID NO: 2396142 - RNA, 20 nt, Bordetella pertussis
cugaccggcguauggcccgc

SEQ ID NO: 2396143 - RNA, 20 nt, Bordetella pertussis
cugaccggcuauaccgggcu

SEQ ID NO: 2396144 - RNA, 16 nt, Bordetella pertussis
cugaccguccauggcg

SEQ ID NO: 2396145 - RNA, 16 nt, Bordetella pertussis
cugaccgugcauccca

SEQ ID NO: 2396146 - RNA, 14 nt, Bordetella pertussis
cugaccucgcccag

SEQ ID NO: 2396147 - RNA, 16 nt, Bordetella pertussis
cugaccucgcccaggc

SEQ ID NO: 2396148 - RNA, 19 nt, Bordetella pertussis
cugaccuggugugccuguc

SEQ ID NO: 2396149 - RNA, 21 nt, Bordetella pertussis
cugacgaaacgcgcguccuug

SEQ ID NO: 2396150 - RNA, 13 nt, Bordetella pertussis
cugacgaaaugcg

SEQ ID NO: 2396151 - RNA, 19 nt, Bordetella pertussis
cugacgauguucaggccau

SEQ ID NO: 2396152 - RNA, 22 nt, Bordetella pertussis
cugacgauguucaggccaugcu

SEQ ID NO: 2396153 - RNA, 15 nt, Bordetella pertussis
cugacgccugcgccg

SEQ ID NO: 2396154 - RNA, 17 nt, Bordetella pertussis
cugacgccugcgccggg

SEQ ID NO: 2396155 - RNA, 18 nt, Bordetella pertussis
cugacgcguucuucagcu

SEQ ID NO: 2396156 - RNA, 19 nt, Bordetella pertussis
cugacgcucauccaggcgc

SEQ ID NO: 2396157 - RNA, 15 nt, Bordetella pertussis
cugacggacuggugc

SEQ ID NO: 2396158 - RNA, 20 nt, Bordetella pertussis
cugacggcuacacccugcuc

SEQ ID NO: 2396159 - RNA, 23 nt, Bordetella pertussis
cugacgugcgccacagcaugacc

SEQ ID NO: 2396160 - RNA, 18 nt, Bordetella pertussis
cugacugcggugccuguc

SEQ ID NO: 2396161 - RNA, 20 nt, Bordetella pertussis
cugacuuccggggagccugc

SEQ ID NO: 2396162 - RNA, 16 nt, Bordetella pertussis
cugagaaaggccgcca

SEQ ID NO: 2396163 - RNA, 20 nt, Bordetella pertussis
cugagaaaggccgccacgaa

SEQ ID NO: 2396164 - RNA, 19 nt, Bordetella pertussis
cugagaucguccagcgacu

SEQ ID NO: 2396165 - RNA, 22 nt, Bordetella pertussis
cugagaucguccagcgacuccg

SEQ ID NO: 2396166 - RNA, 17 nt, Bordetella pertussis
cugagcacaugcccggc

SEQ ID NO: 2396167 - RNA, 19 nt, Bordetella pertussis
cugagcacaugcccggcca

SEQ ID NO: 2396168 - RNA, 24 nt, Bordetella pertussis
cugagcacaugcccggccaccagc

SEQ ID NO: 2396169 - RNA, 14 nt, Bordetella pertussis
cugagcaccagcag

SEQ ID NO: 2396170 - RNA, 16 nt, Bordetella pertussis
cugagcaccagcagcc

SEQ ID NO: 2396171 - RNA, 14 nt, Bordetella pertussis
cugagcaccgccgc

SEQ ID NO: 2396172 - RNA, 15 nt, Bordetella pertussis
cugagcaggccgaua

SEQ ID NO: 2396173 - RNA, 13 nt, Bordetella pertussis
cugagccaggcgc

SEQ ID NO: 2396174 - RNA, 18 nt, Bordetella pertussis
cugagccaggcgcccggc

SEQ ID NO: 2396175 - RNA, 21 nt, Bordetella pertussis
cugagccaggcgcccggcgug

SEQ ID NO: 2396176 - RNA, 19 nt, Bordetella pertussis
cugagccauuccggcuggu

SEQ ID NO: 2396177 - RNA, 23 nt, Bordetella pertussis
cugagcugccaggcuaucguggc

SEQ ID NO: 2396178 - RNA, 15 nt, Bordetella pertussis
cugaggcccgauggc

SEQ ID NO: 2396179 - RNA, 16 nt, Bordetella pertussis
cugaggcccgauggcg

SEQ ID NO: 2396180 - RNA, 22 nt, Bordetella pertussis
cugaggcccgauggcggggaug

SEQ ID NO: 2396181 - RNA, 19 nt, Bordetella pertussis
cugaucacccacagcagcg

SEQ ID NO: 2396182 - RNA, 23 nt, Bordetella pertussis
cugaucacccacagcagcgcgcc

SEQ ID NO: 2396183 - RNA, 14 nt, Bordetella pertussis
cugaucaccgccgg

SEQ ID NO: 2396184 - RNA, 21 nt, Bordetella pertussis
cugaucaucuucgugcuggcc

SEQ ID NO: 2396185 - RNA, 17 nt, Bordetella pertussis
cugaucccggcgcuggc

SEQ ID NO: 2396186 - RNA, 19 nt, Bordetella pertussis
cugaucccggcgcuggccg

SEQ ID NO: 2396187 - RNA, 19 nt, Bordetella pertussis
cugauccucgccagcggca

SEQ ID NO: 2396188 - RNA, 14 nt, Bordetella pertussis
cugauccuggcucu

SEQ ID NO: 2396189 - RNA, 22 nt, Bordetella pertussis
cugauccuggcucugaucgcgc

SEQ ID NO: 2396190 - RNA, 23 nt, Bordetella pertussis
cugaucgaggagcugcugugcgc

SEQ ID NO: 2396191 - RNA, 17 nt, Bordetella pertussis
cugaucgaucgcccgcu

SEQ ID NO: 2396192 - RNA, 14 nt, Bordetella pertussis
cugaucgccggcgc

SEQ ID NO: 2396193 - RNA, 15 nt, Bordetella pertussis
cugaucgccggcgcc

SEQ ID NO: 2396194 - RNA, 21 nt, Bordetella pertussis
cugaucgccggcgcccccagc

SEQ ID NO: 2396195 - RNA, 17 nt, Bordetella pertussis
cugaucgcgcagcgccu

SEQ ID NO: 2396196 - RNA, 21 nt, Bordetella pertussis
cugaucgcgcagcgccuggcc

SEQ ID NO: 2396197 - RNA, 23 nt, Bordetella pertussis
cugaucgcgcagcgccuggccga

SEQ ID NO: 2396198 - RNA, 16 nt, Bordetella pertussis
cugaucggccgacugc

SEQ ID NO: 2396199 - RNA, 19 nt, Bordetella pertussis
cugaucggccgacugcugu

SEQ ID NO: 2396200 - RNA, 17 nt, Bordetella pertussis
cugaucuuccugggcga

SEQ ID NO: 2396201 - RNA, 19 nt, Bordetella pertussis
cugaucuugaugcggccgu

SEQ ID NO: 2396202 - RNA, 19 nt, Bordetella pertussis
cugaugagaucgcccgcgu

SEQ ID NO: 2396203 - RNA, 12 nt, Bordetella pertussis
cugaugcccagc

SEQ ID NO: 2396204 - RNA, 14 nt, Bordetella pertussis
cugaugcccagccc

SEQ ID NO: 2396205 - RNA, 15 nt, Bordetella pertussis
cugaugcccagcccg

SEQ ID NO: 2396206 - RNA, 17 nt, Bordetella pertussis
cugaugcccagcccggc

SEQ ID NO: 2396207 - RNA, 21 nt, Bordetella pertussis
cugaugcccagcccggcuucg

SEQ ID NO: 2396208 - RNA, 22 nt, Bordetella pertussis
cugaugccguaccaggugcgca

SEQ ID NO: 2396209 - RNA, 14 nt, Bordetella pertussis
cugaugcgcggcgg

SEQ ID NO: 2396210 - RNA, 18 nt, Bordetella pertussis
cugaugcgcgucaggcga

SEQ ID NO: 2396211 - RNA, 20 nt, Bordetella pertussis
cugaugcgcgucaggcgagc

SEQ ID NO: 2396212 - RNA, 16 nt, Bordetella pertussis
cugaugcuggucagcc

SEQ ID NO: 2396213 - RNA, 13 nt, Bordetella pertussis
cugauggccgcca

SEQ ID NO: 2396214 - RNA, 17 nt, Bordetella pertussis
cugauggccgccagcgg

SEQ ID NO: 2396215 - RNA, 18 nt, Bordetella pertussis
cugauggccgccagcggc

SEQ ID NO: 2396216 - RNA, 22 nt, Bordetella pertussis
cugauucacaggcccgcgcggc

SEQ ID NO: 2396217 - RNA, 23 nt, Bordetella pertussis
cugauucacaggcccgcgcggcc

SEQ ID NO: 2396218 - RNA, 14 nt, Bordetella pertussis
cugauucccaggcc

SEQ ID NO: 2396219 - RNA, 21 nt, Bordetella pertussis
cugauucccaggcccggccgc

SEQ ID NO: 2396220 - RNA, 15 nt, Bordetella pertussis
cugcaaccagcucag

SEQ ID NO: 2396221 - RNA, 23 nt, Bordetella pertussis
cugcaaccuggucaagggcggcc

SEQ ID NO: 2396222 - RNA, 13 nt, Bordetella pertussis
cugcaaggcccgc

SEQ ID NO: 2396223 - RNA, 14 nt, Bordetella pertussis
cugcaaggcccgcc

SEQ ID NO: 2396224 - RNA, 16 nt, Bordetella pertussis
cugcaaggcccgcccg

SEQ ID NO: 2396225 - RNA, 16 nt, Bordetella pertussis
cugcaaggccggcggc

SEQ ID NO: 2396226 - RNA, 23 nt, Bordetella pertussis
cugcaaggccggcggcacgcugc

SEQ ID NO: 2396227 - RNA, 17 nt, Bordetella pertussis
cugcaaggccugcugca

SEQ ID NO: 2396228 - RNA, 17 nt, Bordetella pertussis
cugcaaguccagcgugg

SEQ ID NO: 2396229 - RNA, 20 nt, Bordetella pertussis
cugcaauugcgcggccaugc

SEQ ID NO: 2396230 - RNA, 13 nt, Bordetella pertussis
cugcacagggacc

SEQ ID NO: 2396231 - RNA, 13 nt, Bordetella pertussis
cugcaccagcgcg

SEQ ID NO: 2396232 - RNA, 17 nt, Bordetella pertussis
cugcaccagcgcgccgc

SEQ ID NO: 2396233 - RNA, 22 nt, Bordetella pertussis
cugcaccagcgcgccgcgcgcg

SEQ ID NO: 2396234 - RNA, 21 nt, Bordetella pertussis
cugcacccacacuuggccggc

SEQ ID NO: 2396235 - RNA, 23 nt, Bordetella pertussis
cugcacccacacuuggccggcga

SEQ ID NO: 2396236 - RNA, 16 nt, Bordetella pertussis
cugcacccccuuggcu

SEQ ID NO: 2396237 - RNA, 16 nt, Bordetella pertussis
cugcaccgccgcgcgg

SEQ ID NO: 2396238 - RNA, 13 nt, Bordetella pertussis
cugcaccggcgcc

SEQ ID NO: 2396239 - RNA, 14 nt, Bordetella pertussis
cugcaccggcgcca

SEQ ID NO: 2396240 - RNA, 17 nt, Bordetella pertussis
cugcaccggcgccacgg

SEQ ID NO: 2396241 - RNA, 19 nt, Bordetella pertussis
cugcaccggcgccacggcu

SEQ ID NO: 2396242 - RNA, 14 nt, Bordetella pertussis
cugcaccggcuugu

SEQ ID NO: 2396243 - RNA, 21 nt, Bordetella pertussis
cugcaccggcuugucgaccag

SEQ ID NO: 2396244 - RNA, 22 nt, Bordetella pertussis
cugcaccggcuugucgaccagu

SEQ ID NO: 2396245 - RNA, 14 nt, Bordetella pertussis
cugcaccgucacgc

SEQ ID NO: 2396246 - RNA, 17 nt, Bordetella pertussis
cugcaccgucacgcgcu

SEQ ID NO: 2396247 - RNA, 16 nt, Bordetella pertussis
cugcaccgucaggugc

SEQ ID NO: 2396248 - RNA, 12 nt, Bordetella pertussis
cugcaccugccu

SEQ ID NO: 2396249 - RNA, 14 nt, Bordetella pertussis
cugcaccuugggcg

SEQ ID NO: 2396250 - RNA, 13 nt, Bordetella pertussis
cugcacgaagcgg

SEQ ID NO: 2396251 - RNA, 13 nt, Bordetella pertussis
cugcacgaccugc

SEQ ID NO: 2396252 - RNA, 22 nt, Bordetella pertussis
cugcacgacgggauugccguca

SEQ ID NO: 2396253 - RNA, 18 nt, Bordetella pertussis
cugcacgauggcgccggc

SEQ ID NO: 2396254 - RNA, 21 nt, Bordetella pertussis
cugcacgauggcgccggcuuc

SEQ ID NO: 2396255 - RNA, 14 nt, Bordetella pertussis
cugcacgcagcgca

SEQ ID NO: 2396256 - RNA, 15 nt, Bordetella pertussis
cugccagacggccag

SEQ ID NO: 2396257 - RNA, 16 nt, Bordetella pertussis
cugccagacggccagc

SEQ ID NO: 2396258 - RNA, 17 nt, Bordetella pertussis
cugccagacggccagcg

SEQ ID NO: 2396259 - RNA, 21 nt, Bordetella pertussis
cugccagacggccagcgcgcg

SEQ ID NO: 2396260 - RNA, 22 nt, Bordetella pertussis
cugccagauccgguaugccugc

SEQ ID NO: 2396261 - RNA, 15 nt, Bordetella pertussis
cugccagcccaccag

SEQ ID NO: 2396262 - RNA, 19 nt, Bordetella pertussis
cugccagcccaccagcgcc

SEQ ID NO: 2396263 - RNA, 18 nt, Bordetella pertussis
cugccagccugccacauc

SEQ ID NO: 2396264 - RNA, 16 nt, Bordetella pertussis
cugccaggcgagcgcc

SEQ ID NO: 2396265 - RNA, 21 nt, Bordetella pertussis
cugccaggcgagcgccgcgcu

SEQ ID NO: 2396266 - RNA, 23 nt, Bordetella pertussis
cugccaggcgagcgccgcgcucc

SEQ ID NO: 2396267 - RNA, 16 nt, Bordetella pertussis
cugccaggcgccgcgu

SEQ ID NO: 2396268 - RNA, 21 nt, Bordetella pertussis
cugccaggcgccgcguccggc

SEQ ID NO: 2396269 - RNA, 16 nt, Bordetella pertussis
cugccaguaggcgccc

SEQ ID NO: 2396270 - RNA, 23 nt, Bordetella pertussis
cugccaguugaaccgcaacgcca

SEQ ID NO: 2396271 - RNA, 14 nt, Bordetella pertussis
cugccaguugccgc

SEQ ID NO: 2396272 - RNA, 19 nt, Bordetella pertussis
cugccaguugccgccgccg

SEQ ID NO: 2396273 - RNA, 23 nt, Bordetella pertussis
cugccaguugccgccgccggcgc

SEQ ID NO: 2396274 - RNA, 13 nt, Bordetella pertussis
cugccauccggcc

SEQ ID NO: 2396275 - RNA, 17 nt, Bordetella pertussis
cugccauccucgucgcg

SEQ ID NO: 2396276 - RNA, 18 nt, Bordetella pertussis
cugccauccucgucgcgg

SEQ ID NO: 2396277 - RNA, 19 nt, Bordetella pertussis
cugccaugccccauccagc

SEQ ID NO: 2396278 - RNA, 13 nt, Bordetella pertussis
cugccaugccgcg

SEQ ID NO: 2396279 - RNA, 15 nt, Bordetella pertussis
cugccaugccgcgcg

SEQ ID NO: 2396280 - RNA, 16 nt, Bordetella pertussis
cugccaugccgcgcgc

SEQ ID NO: 2396281 - RNA, 18 nt, Bordetella pertussis
cugccaugccgcgcgccu

SEQ ID NO: 2396282 - RNA, 16 nt, Bordetella pertussis
cugccauggccccggg

SEQ ID NO: 2396283 - RNA, 18 nt, Bordetella pertussis
cugccauggccccgggcg

SEQ ID NO: 2396284 - RNA, 19 nt, Bordetella pertussis
cugccauggccccgggcgg

SEQ ID NO: 2396285 - RNA, 17 nt, Bordetella pertussis
cugccauuccagcuccg

SEQ ID NO: 2396286 - RNA, 19 nt, Bordetella pertussis
cugccauuccagcuccggc

SEQ ID NO: 2396287 - RNA, 13 nt, Bordetella pertussis
cugccauucgucg

SEQ ID NO: 2396288 - RNA, 22 nt, Bordetella pertussis
cugccauucgucguagccgccg

SEQ ID NO: 2396289 - RNA, 17 nt, Bordetella pertussis
cugccauugcgcggccu

SEQ ID NO: 2396290 - RNA, 21 nt, Bordetella pertussis
cugccauugcgcggccugcuc

SEQ ID NO: 2396291 - RNA, 14 nt, Bordetella pertussis
cugcccaccgccgc

SEQ ID NO: 2396292 - RNA, 19 nt, Bordetella pertussis
cugcccaccgccgcccgcc

SEQ ID NO: 2396293 - RNA, 22 nt, Bordetella pertussis
cugcccaccgccgcccgccagg

SEQ ID NO: 2396294 - RNA, 21 nt, Bordetella pertussis
cugcccaccgccguggccggc

SEQ ID NO: 2396295 - RNA, 13 nt, Bordetella pertussis
cugcccaccuucc

SEQ ID NO: 2396296 - RNA, 17 nt, Bordetella pertussis
cugcccaccuuccugcu

SEQ ID NO: 2396297 - RNA, 14 nt, Bordetella pertussis
cugcccaccuugcg

SEQ ID NO: 2396298 - RNA, 16 nt, Bordetella pertussis
cugcccagccacacca

SEQ ID NO: 2396299 - RNA, 18 nt, Bordetella pertussis
cugcccagccacaccagg

SEQ ID NO: 2396300 - RNA, 22 nt, Bordetella pertussis
cugcccagcgucagcugggcau

SEQ ID NO: 2396301 - RNA, 12 nt, Bordetella pertussis
cugcccaggaug

SEQ ID NO: 2396302 - RNA, 12 nt, Bordetella pertussis
cugcccaggcca

SEQ ID NO: 2396303 - RNA, 16 nt, Bordetella pertussis
cugcccaggccagcgc

SEQ ID NO: 2396304 - RNA, 18 nt, Bordetella pertussis
cugcccauggcaagcgca

SEQ ID NO: 2396305 - RNA, 14 nt, Bordetella pertussis
cugcccauggccug

SEQ ID NO: 2396306 - RNA, 20 nt, Bordetella pertussis
cugcccauucccgcccugac

SEQ ID NO: 2396307 - RNA, 22 nt, Bordetella pertussis
cugcccauucccgcccugacgc

SEQ ID NO: 2396308 - RNA, 13 nt, Bordetella pertussis
cugccccagcggc

SEQ ID NO: 2396309 - RNA, 15 nt, Bordetella pertussis
cugccccagcggcug

SEQ ID NO: 2396310 - RNA, 23 nt, Bordetella pertussis
cugccccagcuugucggccgcgc

SEQ ID NO: 2396311 - RNA, 13 nt, Bordetella pertussis
cugccccaggaaa

SEQ ID NO: 2396312 - RNA, 14 nt, Bordetella pertussis
cugccccauggcau

SEQ ID NO: 2396313 - RNA, 13 nt, Bordetella pertussis
cugccccccgagg

SEQ ID NO: 2396314 - RNA, 17 nt, Bordetella pertussis
cugccccccgagggggc

SEQ ID NO: 2396315 - RNA, 18 nt, Bordetella pertussis
cugccccccgagggggcu

SEQ ID NO: 2396316 - RNA, 15 nt, Bordetella pertussis
cugccccgaugaugg

SEQ ID NO: 2396317 - RNA, 19 nt, Bordetella pertussis
cugccccugcggggacagg

SEQ ID NO: 2396318 - RNA, 20 nt, Bordetella pertussis
cugccccugcggggacaggc

SEQ ID NO: 2396319 - RNA, 23 nt, Bordetella pertussis
cugccccugcggggacaggcacc

SEQ ID NO: 2396320 - RNA, 16 nt, Bordetella pertussis
cugcccgaagcgcagc

SEQ ID NO: 2396321 - RNA, 23 nt, Bordetella pertussis
cugcccgaagcgcagcaccaggu

SEQ ID NO: 2396322 - RNA, 22 nt, Bordetella pertussis
cugcccgaagcggcccgggugg

SEQ ID NO: 2396323 - RNA, 15 nt, Bordetella pertussis
cugcccgacggcgcc

SEQ ID NO: 2396324 - RNA, 19 nt, Bordetella pertussis
cugcccgagaccgcccgcu

SEQ ID NO: 2396325 - RNA, 12 nt, Bordetella pertussis
cugcccgcaacg

SEQ ID NO: 2396326 - RNA, 15 nt, Bordetella pertussis
cugcccgcaacgccg

SEQ ID NO: 2396327 - RNA, 22 nt, Bordetella pertussis
cugcccgcacgggccgacggcc

SEQ ID NO: 2396328 - RNA, 16 nt, Bordetella pertussis
cugcccgccgccgccc

SEQ ID NO: 2396329 - RNA, 14 nt, Bordetella pertussis
cugcccgccugguc

SEQ ID NO: 2396330 - RNA, 15 nt, Bordetella pertussis
cugcccgccuggucg

SEQ ID NO: 2396331 - RNA, 24 nt, Bordetella pertussis
cugcccgccuggucgcuggcgccg

SEQ ID NO: 2396332 - RNA, 13 nt, Bordetella pertussis
cugcccgcgccgu

SEQ ID NO: 2396333 - RNA, 22 nt, Bordetella pertussis
cugcccgcgguccagcacggcg

SEQ ID NO: 2396334 - RNA, 23 nt, Bordetella pertussis
cugcccgcgguccagcacggcga

SEQ ID NO: 2396335 - RNA, 23 nt, Bordetella pertussis
cugcccggcagggugacgggcug

SEQ ID NO: 2396336 - RNA, 14 nt, Bordetella pertussis
cugcccgggcacca

SEQ ID NO: 2396337 - RNA, 20 nt, Bordetella pertussis
cugcccgggcaccagguccu

SEQ ID NO: 2396338 - RNA, 13 nt, Bordetella pertussis
cugcccgggcagc

SEQ ID NO: 2396339 - RNA, 16 nt, Bordetella pertussis
cugcccgggcagcacc

SEQ ID NO: 2396340 - RNA, 17 nt, Bordetella pertussis
cugcccgucgcuggcgc

SEQ ID NO: 2396341 - RNA, 20 nt, Bordetella pertussis
cugcccgucgggcaggucgg

SEQ ID NO: 2396342 - RNA, 14 nt, Bordetella pertussis
cugcccgucuuggc

SEQ ID NO: 2396343 - RNA, 15 nt, Bordetella pertussis
cugcccgucuuggcg

SEQ ID NO: 2396344 - RNA, 16 nt, Bordetella pertussis
cugcccgucuuggcgu

SEQ ID NO: 2396345 - RNA, 15 nt, Bordetella pertussis
cugcccgugcgggug

SEQ ID NO: 2396346 - RNA, 16 nt, Bordetella pertussis
cugcccguucacgcgc

SEQ ID NO: 2396347 - RNA, 19 nt, Bordetella pertussis
cugcccguucacgcgcagc

SEQ ID NO: 2396348 - RNA, 22 nt, Bordetella pertussis
cugcccguucacgcgcagcguc

SEQ ID NO: 2396349 - RNA, 13 nt, Bordetella pertussis
cugcccucgcccg

SEQ ID NO: 2396350 - RNA, 21 nt, Bordetella pertussis
cugcccucgggcgacaggcgc

SEQ ID NO: 2396351 - RNA, 19 nt, Bordetella pertussis
cugcccucggucagcgcca

SEQ ID NO: 2396352 - RNA, 21 nt, Bordetella pertussis
cugcccucggucagcgccagg

SEQ ID NO: 2396353 - RNA, 13 nt, Bordetella pertussis
cugcccugcauga

SEQ ID NO: 2396354 - RNA, 21 nt, Bordetella pertussis
cugcccugcggcuugggcccg

SEQ ID NO: 2396355 - RNA, 20 nt, Bordetella pertussis
cugcccugcgugugccuguc

SEQ ID NO: 2396356 - RNA, 18 nt, Bordetella pertussis
cugcccugcugcugcagc

SEQ ID NO: 2396357 - RNA, 22 nt, Bordetella pertussis
cugcccuggacgucugagcgcc

SEQ ID NO: 2396358 - RNA, 18 nt, Bordetella pertussis
cugcccuggaucaggaug

SEQ ID NO: 2396359 - RNA, 15 nt, Bordetella pertussis
cugcccuggcccagg

SEQ ID NO: 2396360 - RNA, 18 nt, Bordetella pertussis
cugcccuggcccaggccg

SEQ ID NO: 2396361 - RNA, 13 nt, Bordetella pertussis
cugcccuggcgcu

SEQ ID NO: 2396362 - RNA, 20 nt, Bordetella pertussis
cugcccugguggcagagggc

SEQ ID NO: 2396363 - RNA, 14 nt, Bordetella pertussis
cugccgaaacgcug

SEQ ID NO: 2396364 - RNA, 16 nt, Bordetella pertussis
cugccgaaacgcuggc

SEQ ID NO: 2396365 - RNA, 19 nt, Bordetella pertussis
cugccgaaacgcuggcgua

SEQ ID NO: 2396366 - RNA, 19 nt, Bordetella pertussis
cugccgaaucggccccugc

SEQ ID NO: 2396367 - RNA, 14 nt, Bordetella pertussis
cugccgaccagcac

SEQ ID NO: 2396368 - RNA, 15 nt, Bordetella pertussis
cugccgaccagcacg

SEQ ID NO: 2396369 - RNA, 16 nt, Bordetella pertussis
cugccgaccagcacgg

SEQ ID NO: 2396370 - RNA, 13 nt, Bordetella pertussis
cugccgagacggc

SEQ ID NO: 2396371 - RNA, 15 nt, Bordetella pertussis
cugcggcacggccag

SEQ ID NO: 2396372 - RNA, 21 nt, Bordetella pertussis
cugcggcacggccagcggcga

SEQ ID NO: 2396373 - RNA, 17 nt, Bordetella pertussis
cugcggccccggcacca

SEQ ID NO: 2396374 - RNA, 13 nt, Bordetella pertussis
cugcggcccgagc

SEQ ID NO: 2396375 - RNA, 20 nt, Bordetella pertussis
cugcggccggugaucuugcc

SEQ ID NO: 2396376 - RNA, 22 nt, Bordetella pertussis
cugcggccggugaucuugccga

SEQ ID NO: 2396377 - RNA, 16 nt, Bordetella pertussis
cugcggcgccagcgcc

SEQ ID NO: 2396378 - RNA, 12 nt, Bordetella pertussis
cugcggcgccug

SEQ ID NO: 2396379 - RNA, 23 nt, Bordetella pertussis
cugcggcgcggccgacguggacc

SEQ ID NO: 2396380 - RNA, 14 nt, Bordetella pertussis
cugcggcgcggcgc

SEQ ID NO: 2396381 - RNA, 17 nt, Bordetella pertussis
cugcggcgcggugucgg

SEQ ID NO: 2396382 - RNA, 19 nt, Bordetella pertussis
cugcggcggauucaggcga

SEQ ID NO: 2396383 - RNA, 22 nt, Bordetella pertussis
cugcggcgggaaugucccacag

SEQ ID NO: 2396384 - RNA, 15 nt, Bordetella pertussis
cugcggcguggcgcc

SEQ ID NO: 2396385 - RNA, 13 nt, Bordetella pertussis
cugcggcuccugc

SEQ ID NO: 2396386 - RNA, 20 nt, Bordetella pertussis
cugcggcugaucaccgccgg

SEQ ID NO: 2396387 - RNA, 18 nt, Bordetella pertussis
cugcggcuugggcccggc

SEQ ID NO: 2396388 - RNA, 24 nt, Bordetella pertussis
cugcggcuugggcccggcguagcu

SEQ ID NO: 2396389 - RNA, 15 nt, Bordetella pertussis
cugcgggccggcgcc

SEQ ID NO: 2396390 - RNA, 16 nt, Bordetella pertussis
cugcgggccgggcagg

SEQ ID NO: 2396391 - RNA, 20 nt, Bordetella pertussis
cugcgggccgggcaggccgc

SEQ ID NO: 2396392 - RNA, 15 nt, Bordetella pertussis
cugcgggcgcagcgc

SEQ ID NO: 2396393 - RNA, 22 nt, Bordetella pertussis
cugcgggcgcagcgccgcuucc

SEQ ID NO: 2396394 - RNA, 18 nt, Bordetella pertussis
cugcgggcgccgcggggc

SEQ ID NO: 2396395 - RNA, 15 nt, Bordetella pertussis
cugcgggcggccugg

SEQ ID NO: 2396396 - RNA, 14 nt, Bordetella pertussis
cugcggggacaggc

SEQ ID NO: 2396397 - RNA, 18 nt, Bordetella pertussis
cugcggggacaggcaccc

SEQ ID NO: 2396398 - RNA, 19 nt, Bordetella pertussis
cugcggggacaggcacccg

SEQ ID NO: 2396399 - RNA, 20 nt, Bordetella pertussis
cugcggggacaggcacccgg

SEQ ID NO: 2396400 - RNA, 22 nt, Bordetella pertussis
cugcggggacaggcacccugcc

SEQ ID NO: 2396401 - RNA, 12 nt, Bordetella pertussis
cugcggggcauu

SEQ ID NO: 2396402 - RNA, 13 nt, Bordetella pertussis
cugcgggggcagg

SEQ ID NO: 2396403 - RNA, 17 nt, Bordetella pertussis
cugcgggggcaggcacg

SEQ ID NO: 2396404 - RNA, 22 nt, Bordetella pertussis
cugcgggucgaguugcgcgcca

SEQ ID NO: 2396405 - RNA, 23 nt, Bordetella pertussis
cugcgggucgaguugcgcgccau

SEQ ID NO: 2396406 - RNA, 15 nt, Bordetella pertussis
cugcgggugcgccug

SEQ ID NO: 2396407 - RNA, 12 nt, Bordetella pertussis
cugcggucagcu

SEQ ID NO: 2396408 - RNA, 18 nt, Bordetella pertussis
cugcgguccgaugucgag

SEQ ID NO: 2396409 - RNA, 21 nt, Bordetella pertussis
cugcggucgcgaucgucgacc

SEQ ID NO: 2396410 - RNA, 18 nt, Bordetella pertussis
cugcggugccugucccca

SEQ ID NO: 2396411 - RNA, 23 nt, Bordetella pertussis
cugcguaucaacuuccagcgccc

SEQ ID NO: 2396412 - RNA, 13 nt, Bordetella pertussis
cugcgucaaggca

SEQ ID NO: 2396413 - RNA, 16 nt, Bordetella pertussis
cugcgucacgaaagcg

SEQ ID NO: 2396414 - RNA, 23 nt, Bordetella pertussis
cugcgucacgaaagcgcccaggc

SEQ ID NO: 2396415 - RNA, 20 nt, Bordetella pertussis
cugcgucaguugaagacgcc

SEQ ID NO: 2396416 - RNA, 22 nt, Bordetella pertussis
cugcgucaguugaagacgccgg

SEQ ID NO: 2396417 - RNA, 15 nt, Bordetella pertussis
cugcguccaccacca

SEQ ID NO: 2396418 - RNA, 20 nt, Bordetella pertussis
cugcguccaccaccaggccg

SEQ ID NO: 2396419 - RNA, 21 nt, Bordetella pertussis
cugcguccaccaccaggccgg

SEQ ID NO: 2396420 - RNA, 23 nt, Bordetella pertussis
cugcguccaccaccaggccggcc

SEQ ID NO: 2396421 - RNA, 12 nt, Bordetella pertussis
cugcguccagcc

SEQ ID NO: 2396422 - RNA, 14 nt, Bordetella pertussis
cugcguccagccga

SEQ ID NO: 2396423 - RNA, 23 nt, Bordetella pertussis
cugcguccagccgagccuggcgu

SEQ ID NO: 2396424 - RNA, 14 nt, Bordetella pertussis
cugcgucgccaccu

SEQ ID NO: 2396425 - RNA, 15 nt, Bordetella pertussis
cugcgucgccaccuc

SEQ ID NO: 2396426 - RNA, 15 nt, Bordetella pertussis
cugcgucugcgugcc

SEQ ID NO: 2396427 - RNA, 17 nt, Bordetella pertussis
cugcgucuugagcaggu

SEQ ID NO: 2396428 - RNA, 13 nt, Bordetella pertussis
cugcgugaaacgc

SEQ ID NO: 2396429 - RNA, 16 nt, Bordetella pertussis
cugcgugaaacgcucg

SEQ ID NO: 2396430 - RNA, 18 nt, Bordetella pertussis
cugcgugaaacgcucgau

SEQ ID NO: 2396431 - RNA, 17 nt, Bordetella pertussis
cugcgugccggagcccg

SEQ ID NO: 2396432 - RNA, 14 nt, Bordetella pertussis
cugcgugcgcggcg

SEQ ID NO: 2396433 - RNA, 22 nt, Bordetella pertussis
cugcgugcgggacaggcaucag

SEQ ID NO: 2396434 - RNA, 16 nt, Bordetella pertussis
cugcguggcgacgcgc

SEQ ID NO: 2396435 - RNA, 17 nt, Bordetella pertussis
cugcguggcgacgcgcu

SEQ ID NO: 2396436 - RNA, 15 nt, Bordetella pertussis
cugcguggcggcguc

SEQ ID NO: 2396437 - RNA, 17 nt, Bordetella pertussis
cugcguggcgggccgcg

SEQ ID NO: 2396438 - RNA, 15 nt, Bordetella pertussis
cugcguucgggacgc

SEQ ID NO: 2396439 - RNA, 16 nt, Bordetella pertussis
cugcguuuucuggccu

SEQ ID NO: 2396440 - RNA, 17 nt, Bordetella pertussis
cugcguuuucuggccuu

SEQ ID NO: 2396441 - RNA, 15 nt, Bordetella pertussis
cugcuacaccgugcu

SEQ ID NO: 2396442 - RNA, 15 nt, Bordetella pertussis
cugcucaacggccac

SEQ ID NO: 2396443 - RNA, 16 nt, Bordetella pertussis
cugcucaacggccacc

SEQ ID NO: 2396444 - RNA, 22 nt, Bordetella pertussis
cugcucaacggccaccagggcc

SEQ ID NO: 2396445 - RNA, 19 nt, Bordetella pertussis
cugcucacgccccgcccuc

SEQ ID NO: 2396446 - RNA, 21 nt, Bordetella pertussis
cugcucccacgaacgccacgc

SEQ ID NO: 2396447 - RNA, 22 nt, Bordetella pertussis
cugcucgaaaugcgcguuggcc

SEQ ID NO: 2396448 - RNA, 18 nt, Bordetella pertussis
cugcucgagcaugcgggc

SEQ ID NO: 2396449 - RNA, 22 nt, Bordetella pertussis
cugcucgagcaugcgggccaug

SEQ ID NO: 2396450 - RNA, 13 nt, Bordetella pertussis
cugcucgagcggc

SEQ ID NO: 2396451 - RNA, 18 nt, Bordetella pertussis
cugcucgaucugguuggc

SEQ ID NO: 2396452 - RNA, 17 nt, Bordetella pertussis
cugcucgcaggccugcu

SEQ ID NO: 2396453 - RNA, 13 nt, Bordetella pertussis
cugcucgccgcgc

SEQ ID NO: 2396454 - RNA, 17 nt, Bordetella pertussis
cugcucgccggccagcg

SEQ ID NO: 2396455 - RNA, 14 nt, Bordetella pertussis
cugcucgccguucu

SEQ ID NO: 2396456 - RNA, 17 nt, Bordetella pertussis
cugcucgcgcagcgugg

SEQ ID NO: 2396457 - RNA, 19 nt, Bordetella pertussis
cugcucggugagcggcacg

SEQ ID NO: 2396458 - RNA, 23 nt, Bordetella pertussis
cugcucggugagcggcacgacgu

SEQ ID NO: 2396459 - RNA, 19 nt, Bordetella pertussis
cugcucggugcucuggccc

SEQ ID NO: 2396460 - RNA, 20 nt, Bordetella pertussis
cugcucggugcucuggcccg

SEQ ID NO: 2396461 - RNA, 21 nt, Bordetella pertussis
cugcucggugcucuggcccgc

SEQ ID NO: 2396462 - RNA, 17 nt, Bordetella pertussis
cugcucgucgccaugcg

SEQ ID NO: 2396463 - RNA, 18 nt, Bordetella pertussis
cugcucguucugcgcgcc

SEQ ID NO: 2396464 - RNA, 21 nt, Bordetella pertussis
cugcucguucugcgcgcccgu

SEQ ID NO: 2396465 - RNA, 19 nt, Bordetella pertussis
cugcugaccgacggccugg

SEQ ID NO: 2396466 - RNA, 17 nt, Bordetella pertussis
cugcugacugugcagcc

SEQ ID NO: 2396467 - RNA, 19 nt, Bordetella pertussis
cugcugacugugcagccac

SEQ ID NO: 2396468 - RNA, 19 nt, Bordetella pertussis
cugcugauccucgccagcg

SEQ ID NO: 2396469 - RNA, 22 nt, Bordetella pertussis
cugcugauccucgccagcggca

SEQ ID NO: 2396470 - RNA, 14 nt, Bordetella pertussis
cugcugcaaggaca

SEQ ID NO: 2396471 - RNA, 20 nt, Bordetella pertussis
cugcugcaaggacaccauga

SEQ ID NO: 2396472 - RNA, 13 nt, Bordetella pertussis
cugcugcagcaca

SEQ ID NO: 2396473 - RNA, 23 nt, Bordetella pertussis
cugcugcagcacacgcauuugca

SEQ ID NO: 2396474 - RNA, 13 nt, Bordetella pertussis
cugcugcagccac

SEQ ID NO: 2396475 - RNA, 18 nt, Bordetella pertussis
cugcugcaggccggcgcg

SEQ ID NO: 2396476 - RNA, 20 nt, Bordetella pertussis
cugcugcaggccggcgcgca

SEQ ID NO: 2396477 - RNA, 15 nt, Bordetella pertussis
cugcugcaggcgcgg

SEQ ID NO: 2396478 - RNA, 20 nt, Bordetella pertussis
cugcugcauguccugcaggu

SEQ ID NO: 2396479 - RNA, 20 nt, Bordetella pertussis
cugcugcccgaagcgcagca

SEQ ID NO: 2396480 - RNA, 23 nt, Bordetella pertussis
cugcugcccgaagcgcagcacca

SEQ ID NO: 2396481 - RNA, 15 nt, Bordetella pertussis
cugcugcccgccgcc

SEQ ID NO: 2396482 - RNA, 22 nt, Bordetella pertussis
cugcugccggauuggcgcugca

SEQ ID NO: 2396483 - RNA, 14 nt, Bordetella pertussis
cugcugccguuucu

SEQ ID NO: 2396484 - RNA, 16 nt, Bordetella pertussis
cugcugcgagacgcgc

SEQ ID NO: 2396485 - RNA, 20 nt, Bordetella pertussis
cuggagcuuggccggugcca

SEQ ID NO: 2396486 - RNA, 13 nt, Bordetella pertussis
cuggagucgggcu

SEQ ID NO: 2396487 - RNA, 15 nt, Bordetella pertussis
cuggauauccacgcc

SEQ ID NO: 2396488 - RNA, 20 nt, Bordetella pertussis
cuggauauccacgccuucgg

SEQ ID NO: 2396489 - RNA, 13 nt, Bordetella pertussis
cuggaucaccgcc

SEQ ID NO: 2396490 - RNA, 19 nt, Bordetella pertussis
cuggaucacgugccagccg

SEQ ID NO: 2396491 - RNA, 21 nt, Bordetella pertussis
cuggaucacgugccagccgaa

SEQ ID NO: 2396492 - RNA, 16 nt, Bordetella pertussis
cuggaucaggaugggc

SEQ ID NO: 2396493 - RNA, 16 nt, Bordetella pertussis
cuggaucgccgaucgg

SEQ ID NO: 2396494 - RNA, 20 nt, Bordetella pertussis
cuggaucgcgcccagcgagc

SEQ ID NO: 2396495 - RNA, 23 nt, Bordetella pertussis
cuggaucgugcccagcuggcacc

SEQ ID NO: 2396496 - RNA, 20 nt, Bordetella pertussis
cuggaucuggugaaacagca

SEQ ID NO: 2396497 - RNA, 23 nt, Bordetella pertussis
cuggaucuggugaaacagcauca

SEQ ID NO: 2396498 - RNA, 17 nt, Bordetella pertussis
cuggaucuuggccuguu

SEQ ID NO: 2396499 - RNA, 18 nt, Bordetella pertussis
cuggaucuuggccuguuc

SEQ ID NO: 2396500 - RNA, 23 nt, Bordetella pertussis
cuggaugaaaucgaggaaggccc

SEQ ID NO: 2396501 - RNA, 15 nt, Bordetella pertussis
cuggauggcggccgc

SEQ ID NO: 2396502 - RNA, 21 nt, Bordetella pertussis
cuggauggcggccgccagcgc

SEQ ID NO: 2396503 - RNA, 24 nt, Bordetella pertussis
cuggauggcucgggcagcagcagg

SEQ ID NO: 2396504 - RNA, 12 nt, Bordetella pertussis
cuggauggucac

SEQ ID NO: 2396505 - RNA, 18 nt, Bordetella pertussis
cuggauggucacgcccag

SEQ ID NO: 2396506 - RNA, 19 nt, Bordetella pertussis
cuggauguacgucagcaug

SEQ ID NO: 2396507 - RNA, 20 nt, Bordetella pertussis
cuggauguacgucagcaugc

SEQ ID NO: 2396508 - RNA, 22 nt, Bordetella pertussis
cuggauguacgucagcaugcac

SEQ ID NO: 2396509 - RNA, 18 nt, Bordetella pertussis
cuggaugugcgcgggcgc

SEQ ID NO: 2396510 - RNA, 20 nt, Bordetella pertussis
cuggaugugcgcgggcgcgg

SEQ ID NO: 2396511 - RNA, 23 nt, Bordetella pertussis
cuggaugugcgcgggcgcgggcu

SEQ ID NO: 2396512 - RNA, 21 nt, Bordetella pertussis
cuggauucgccggucggccgc

SEQ ID NO: 2396513 - RNA, 21 nt, Bordetella pertussis
cuggcaacgggucgcgcagca

SEQ ID NO: 2396514 - RNA, 19 nt, Bordetella pertussis
cuggcaacguugcugcagc

SEQ ID NO: 2396515 - RNA, 20 nt, Bordetella pertussis
cuggcaacguugcugcagcg

SEQ ID NO: 2396516 - RNA, 15 nt, Bordetella pertussis
cuggcaaucggggug

SEQ ID NO: 2396517 - RNA, 19 nt, Bordetella pertussis
cuggcaaucgggguggcgc

SEQ ID NO: 2396518 - RNA, 20 nt, Bordetella pertussis
cuggcaaucgggguggcgcc

SEQ ID NO: 2396519 - RNA, 17 nt, Bordetella pertussis
cuggcaaugcguggccg

SEQ ID NO: 2396520 - RNA, 18 nt, Bordetella pertussis
cuggcaaugcguggccgg

SEQ ID NO: 2396521 - RNA, 19 nt, Bordetella pertussis
cuggcaaugcguggccggc

SEQ ID NO: 2396522 - RNA, 17 nt, Bordetella pertussis
cuggcaaugguccagca

SEQ ID NO: 2396523 - RNA, 14 nt, Bordetella pertussis
cuggcacaccagcg

SEQ ID NO: 2396524 - RNA, 16 nt, Bordetella pertussis
cuggcacaccagcgcc

SEQ ID NO: 2396525 - RNA, 17 nt, Bordetella pertussis
cuggcacaccagcgcca

SEQ ID NO: 2396526 - RNA, 18 nt, Bordetella pertussis
cuggcacaccagcgccag

SEQ ID NO: 2396527 - RNA, 19 nt, Bordetella pertussis
cuggcacaccagcgccagg

SEQ ID NO: 2396528 - RNA, 13 nt, Bordetella pertussis
cuggcacccgcaa

SEQ ID NO: 2396529 - RNA, 12 nt, Bordetella pertussis
cuggcacccgcc

SEQ ID NO: 2396530 - RNA, 21 nt, Bordetella pertussis
cuggcaccggccaagcuccag

SEQ ID NO: 2396531 - RNA, 22 nt, Bordetella pertussis
cuggcaccggccaagcuccagg

SEQ ID NO: 2396532 - RNA, 16 nt, Bordetella pertussis
cuggcaccggccgacc

SEQ ID NO: 2396533 - RNA, 18 nt, Bordetella pertussis
cuggcaccggccgacccg

SEQ ID NO: 2396534 - RNA, 15 nt, Bordetella pertussis
cuggcacugucggcg

SEQ ID NO: 2396535 - RNA, 16 nt, Bordetella pertussis
cuggcacugucggcgu

SEQ ID NO: 2396536 - RNA, 19 nt, Bordetella pertussis
cuggcagaccgagcgcgcc

SEQ ID NO: 2396537 - RNA, 21 nt, Bordetella pertussis
cuggcagaccgagcgcgcccg

SEQ ID NO: 2396538 - RNA, 13 nt, Bordetella pertussis
cuggcagccuuga

SEQ ID NO: 2396539 - RNA, 20 nt, Bordetella pertussis
cuggcagccuugaaagaggc

SEQ ID NO: 2396540 - RNA, 12 nt, Bordetella pertussis
cuggcagcuggc

SEQ ID NO: 2396541 - RNA, 12 nt, Bordetella pertussis
cuggcaggccgc

SEQ ID NO: 2396542 - RNA, 14 nt, Bordetella pertussis
cuggcaucgucgcg

SEQ ID NO: 2396543 - RNA, 16 nt, Bordetella pertussis
cuggcaucgucgcgcu

SEQ ID NO: 2396544 - RNA, 18 nt, Bordetella pertussis
cuggcaucgucgcgcugc

SEQ ID NO: 2396545 - RNA, 13 nt, Bordetella pertussis
cuggcaugcggcg

SEQ ID NO: 2396546 - RNA, 20 nt, Bordetella pertussis
cuggcaugugccaccgccca

SEQ ID NO: 2396547 - RNA, 15 nt, Bordetella pertussis
cuggccaagcgcgcc

SEQ ID NO: 2396548 - RNA, 17 nt, Bordetella pertussis
cuggccacaagcggccc

SEQ ID NO: 2396549 - RNA, 20 nt, Bordetella pertussis
cuggccacaagcggccccag

SEQ ID NO: 2396550 - RNA, 12 nt, Bordetella pertussis
cuggccacgcug

SEQ ID NO: 2396551 - RNA, 13 nt, Bordetella pertussis
cuggccacgcugc

SEQ ID NO: 2396552 - RNA, 17 nt, Bordetella pertussis
cuggccacguugucgcg

SEQ ID NO: 2396553 - RNA, 19 nt, Bordetella pertussis
cuggccacguugucgcgcg

SEQ ID NO: 2396554 - RNA, 20 nt, Bordetella pertussis
cuggccacguugucgcgcgu

SEQ ID NO: 2396555 - RNA, 17 nt, Bordetella pertussis
cuggccacuggccgcgc

SEQ ID NO: 2396556 - RNA, 18 nt, Bordetella pertussis
cuggccacuggccgcgcu

SEQ ID NO: 2396557 - RNA, 14 nt, Bordetella pertussis
cuggccagauagcc

SEQ ID NO: 2396558 - RNA, 19 nt, Bordetella pertussis
cuggccagauagcccaggc

SEQ ID NO: 2396559 - RNA, 21 nt, Bordetella pertussis
cuggccagauagcccaggcgg

SEQ ID NO: 2396560 - RNA, 11 nt, Bordetella pertussis
cuggccagccg

SEQ ID NO: 2396561 - RNA, 14 nt, Bordetella pertussis
cuggccagccgcuc

SEQ ID NO: 2396562 - RNA, 22 nt, Bordetella pertussis
cuggccagccgcucgcgcgacc

SEQ ID NO: 2396563 - RNA, 23 nt, Bordetella pertussis
cuggccagccgcucgcgcgacca

SEQ ID NO: 2396564 - RNA, 15 nt, Bordetella pertussis
cuggccagccggccc

SEQ ID NO: 2396565 - RNA, 18 nt, Bordetella pertussis
cuggccagccggcccagc

SEQ ID NO: 2396566 - RNA, 21 nt, Bordetella pertussis
cuggccagccggcccagcaug

SEQ ID NO: 2396567 - RNA, 23 nt, Bordetella pertussis
cuggccagccggcccagcaugcc

SEQ ID NO: 2396568 - RNA, 21 nt, Bordetella pertussis
cuggccagcggggccgugacg

SEQ ID NO: 2396569 - RNA, 16 nt, Bordetella pertussis
cuggccagcuggcggc

SEQ ID NO: 2396570 - RNA, 18 nt, Bordetella pertussis
cuggccagcuggcggcgc

SEQ ID NO: 2396571 - RNA, 19 nt, Bordetella pertussis
cuggccagcuggcggcgca

SEQ ID NO: 2396572 - RNA, 22 nt, Bordetella pertussis
cuggccagcuggcggcgcagca

SEQ ID NO: 2396573 - RNA, 16 nt, Bordetella pertussis
cuggccauagggcgac

SEQ ID NO: 2396574 - RNA, 19 nt, Bordetella pertussis
cuggccaucaccgccuccg

SEQ ID NO: 2396575 - RNA, 21 nt, Bordetella pertussis
cuggccaucaccgccuccggg

SEQ ID NO: 2396576 - RNA, 14 nt, Bordetella pertussis
cuggcccacgccca

SEQ ID NO: 2396577 - RNA, 16 nt, Bordetella pertussis
cuggcccacgcgcacg

SEQ ID NO: 2396578 - RNA, 22 nt, Bordetella pertussis
cuggcccacucggugcgcgcgc

SEQ ID NO: 2396579 - RNA, 23 nt, Bordetella pertussis
cuggcccacucggugcgcgcgcc

SEQ ID NO: 2396580 - RNA, 19 nt, Bordetella pertussis
cuggcccagaucugccgca

SEQ ID NO: 2396581 - RNA, 20 nt, Bordetella pertussis
cuggcccagaucugccgcaa

SEQ ID NO: 2396582 - RNA, 13 nt, Bordetella pertussis
cuggcccagcgca

SEQ ID NO: 2396583 - RNA, 15 nt, Bordetella pertussis
cuggcccagcuccag

SEQ ID NO: 2396584 - RNA, 16 nt, Bordetella pertussis
cuggcccagcugggcg

SEQ ID NO: 2396585 - RNA, 17 nt, Bordetella pertussis
cuggcccagcugggcgg

SEQ ID NO: 2396586 - RNA, 18 nt, Bordetella pertussis
cuggcccagcugggcggc

SEQ ID NO: 2396587 - RNA, 21 nt, Bordetella pertussis
cuggcccagcugggcggcgug

SEQ ID NO: 2396588 - RNA, 14 nt, Bordetella pertussis
cuggcccaggccga

SEQ ID NO: 2396589 - RNA, 15 nt, Bordetella pertussis
cuggcccaggccgaa

SEQ ID NO: 2396590 - RNA, 23 nt, Bordetella pertussis
cuggcccaggccgaaccacagca

SEQ ID NO: 2396591 - RNA, 19 nt, Bordetella pertussis
cuggcccaguucgcgcagc

SEQ ID NO: 2396592 - RNA, 22 nt, Bordetella pertussis
cuggcccaguucgcgcagcagc

SEQ ID NO: 2396593 - RNA, 18 nt, Bordetella pertussis
cuggcccaugaacaggca

SEQ ID NO: 2396594 - RNA, 15 nt, Bordetella pertussis
cuggccccaggcgcc

SEQ ID NO: 2396595 - RNA, 19 nt, Bordetella pertussis
cuggcccgccagcaaggcg

SEQ ID NO: 2396596 - RNA, 23 nt, Bordetella pertussis
cuggcccgccagcaaggcggcaa

SEQ ID NO: 2396597 - RNA, 14 nt, Bordetella pertussis
cuggcccgcgcgag

SEQ ID NO: 2396598 - RNA, 15 nt, Bordetella pertussis
cuggcccgcgcgagc

SEQ ID NO: 2396599 - RNA, 18 nt, Bordetella pertussis
cuggcccgcgcgagcggc

SEQ ID NO: 2396600 - RNA, 22 nt, Bordetella pertussis
cuggcccgcgcgagcggcgugc

SEQ ID NO: 2396601 - RNA, 20 nt, Bordetella pertussis
cuggcccggcaccguccagc

SEQ ID NO: 2396602 - RNA, 23 nt, Bordetella pertussis
cuggcccgucaugggcggggcca

SEQ ID NO: 2396603 - RNA, 15 nt, Bordetella pertussis
cuggcccuggcagac

SEQ ID NO: 2396604 - RNA, 14 nt, Bordetella pertussis
cuggcccuggcggg

SEQ ID NO: 2396605 - RNA, 17 nt, Bordetella pertussis
cuggcccuggcgggccg

SEQ ID NO: 2396606 - RNA, 13 nt, Bordetella pertussis
cuggcccugggcu

SEQ ID NO: 2396607 - RNA, 20 nt, Bordetella pertussis
cuggcccuuggucugcaggc

SEQ ID NO: 2396608 - RNA, 21 nt, Bordetella pertussis
cuggcccuuggucugcaggcu

SEQ ID NO: 2396609 - RNA, 24 nt, Bordetella pertussis
cuggcccuuggucugcaggcucug

SEQ ID NO: 2396610 - RNA, 15 nt, Bordetella pertussis
cuggccgaacgccgc

SEQ ID NO: 2396611 - RNA, 15 nt, Bordetella pertussis
cuggccgacaaggag

SEQ ID NO: 2396612 - RNA, 13 nt, Bordetella pertussis
cuggccgacgcgc

SEQ ID NO: 2396613 - RNA, 14 nt, Bordetella pertussis
cuggccgacgcgcu

SEQ ID NO: 2396614 - RNA, 15 nt, Bordetella pertussis
cuggccgacgggugg

SEQ ID NO: 2396615 - RNA, 18 nt, Bordetella pertussis
cuggccgagcgcggcaug

SEQ ID NO: 2396616 - RNA, 22 nt, Bordetella pertussis
cuggccgaucaccugcaggccc

SEQ ID NO: 2396617 - RNA, 19 nt, Bordetella pertussis
cuggccgaucugcugggcc

SEQ ID NO: 2396618 - RNA, 15 nt, Bordetella pertussis
cuggccgauggccuc

SEQ ID NO: 2396619 - RNA, 17 nt, Bordetella pertussis
cuggccgauggccucgc

SEQ ID NO: 2396620 - RNA, 17 nt, Bordetella pertussis
cuggccgauuucgcgcg

SEQ ID NO: 2396621 - RNA, 18 nt, Bordetella pertussis
cuggccgauuucgcgcgc

SEQ ID NO: 2396622 - RNA, 20 nt, Bordetella pertussis
cuggccgauuucgcgcgcca

SEQ ID NO: 2396623 - RNA, 22 nt, Bordetella pertussis
cuggccgauuucgcgcgccagc

SEQ ID NO: 2396624 - RNA, 15 nt, Bordetella pertussis
cuggccgccauggcg

SEQ ID NO: 2396625 - RNA, 21 nt, Bordetella pertussis
cuggccgccauggcgcuggca

SEQ ID NO: 2396626 - RNA, 13 nt, Bordetella pertussis
cuggccgcccagc

SEQ ID NO: 2396627 - RNA, 14 nt, Bordetella pertussis
cuggccgcccagcg

SEQ ID NO: 2396628 - RNA, 16 nt, Bordetella pertussis
cuggccgcccagcgcc

SEQ ID NO: 2396629 - RNA, 14 nt, Bordetella pertussis
cuggccgcccgcgg

SEQ ID NO: 2396630 - RNA, 23 nt, Bordetella pertussis
cuggccgccgcgcucaccgaggg

SEQ ID NO: 2396631 - RNA, 18 nt, Bordetella pertussis
cuggccgccgcgggcgcc

SEQ ID NO: 2396632 - RNA, 13 nt, Bordetella pertussis
cuggccgccggcg

SEQ ID NO: 2396633 - RNA, 15 nt, Bordetella pertussis
cuggccgccggcgcg

SEQ ID NO: 2396634 - RNA, 15 nt, Bordetella pertussis
cuggccgccggcggc

SEQ ID NO: 2396635 - RNA, 18 nt, Bordetella pertussis
cuggccgccggcggcgca

SEQ ID NO: 2396636 - RNA, 15 nt, Bordetella pertussis
cuggccgccugcugc

SEQ ID NO: 2396637 - RNA, 22 nt, Bordetella pertussis
cuggccgcgcccgccgcgccau

SEQ ID NO: 2396638 - RNA, 13 nt, Bordetella pertussis
cuggccgcgccgc

SEQ ID NO: 2396639 - RNA, 18 nt, Bordetella pertussis
cuggccgcgccgcuggcg

SEQ ID NO: 2396640 - RNA, 13 nt, Bordetella pertussis
cuggccgcgccgu

SEQ ID NO: 2396641 - RNA, 13 nt, Bordetella pertussis
cuggccgcgcgcc

SEQ ID NO: 2396642 - RNA, 14 nt, Bordetella pertussis
cuggccgcgcucag

SEQ ID NO: 2396643 - RNA, 15 nt, Bordetella pertussis
cuggccgcgcucagc

SEQ ID NO: 2396644 - RNA, 15 nt, Bordetella pertussis
cuggccgcgcucagg

SEQ ID NO: 2396645 - RNA, 19 nt, Bordetella pertussis
cuggccgcgcucaggccgc

SEQ ID NO: 2396646 - RNA, 20 nt, Bordetella pertussis
cuggccgcgcuggcggcgca

SEQ ID NO: 2396647 - RNA, 23 nt, Bordetella pertussis
cuggccgcgcuggcggcgcaggc

SEQ ID NO: 2396648 - RNA, 13 nt, Bordetella pertussis
cuggccggccaac

SEQ ID NO: 2396649 - RNA, 14 nt, Bordetella pertussis
cuggccggccaaca

SEQ ID NO: 2396650 - RNA, 13 nt, Bordetella pertussis
cuggccggccagc

SEQ ID NO: 2396651 - RNA, 14 nt, Bordetella pertussis
cuggccggccgcgu

SEQ ID NO: 2396652 - RNA, 15 nt, Bordetella pertussis
cuggccggccuggcg

SEQ ID NO: 2396653 - RNA, 18 nt, Bordetella pertussis
cuggccggcgacuuccgc

SEQ ID NO: 2396654 - RNA, 12 nt, Bordetella pertussis
cuggccggcgcc

SEQ ID NO: 2396655 - RNA, 12 nt, Bordetella pertussis
cuggccggcgcu

SEQ ID NO: 2396656 - RNA, 16 nt, Bordetella pertussis
cuggccggcguggccu

SEQ ID NO: 2396657 - RNA, 20 nt, Bordetella pertussis
cuggccggcguggccugccc

SEQ ID NO: 2396658 - RNA, 17 nt, Bordetella pertussis
cuggccggugaugcggc

SEQ ID NO: 2396659 - RNA, 22 nt, Bordetella pertussis
cuggccgucgaacuccucgacg

SEQ ID NO: 2396660 - RNA, 18 nt, Bordetella pertussis
cuggccgucgagccgguc

SEQ ID NO: 2396661 - RNA, 18 nt, Bordetella pertussis
cuggccgucgccgcccug

SEQ ID NO: 2396662 - RNA, 13 nt, Bordetella pertussis
cuggccugccgcg

SEQ ID NO: 2396663 - RNA, 14 nt, Bordetella pertussis
cuggccugccgcgc

SEQ ID NO: 2396664 - RNA, 15 nt, Bordetella pertussis
cuggccugccgcgcc

SEQ ID NO: 2396665 - RNA, 17 nt, Bordetella pertussis
cuggccugccgcgccga

SEQ ID NO: 2396666 - RNA, 19 nt, Bordetella pertussis
cuggccugccgcgccgacc

SEQ ID NO: 2396667 - RNA, 13 nt, Bordetella pertussis
cuggccugcgccg

SEQ ID NO: 2396668 - RNA, 16 nt, Bordetella pertussis
cuggccugucuggugg

SEQ ID NO: 2396669 - RNA, 17 nt, Bordetella pertussis
cuggccugucugguggc

SEQ ID NO: 2396670 - RNA, 18 nt, Bordetella pertussis
cuggccugucugguggcg

SEQ ID NO: 2396671 - RNA, 15 nt, Bordetella pertussis
cuggccuuccugcug

SEQ ID NO: 2396672 - RNA, 17 nt, Bordetella pertussis
cuggccuuccugcugac

SEQ ID NO: 2396673 - RNA, 13 nt, Bordetella pertussis
cuggccuucgacc

SEQ ID NO: 2396674 - RNA, 16 nt, Bordetella pertussis
cuggccuucgaccugc

SEQ ID NO: 2396675 - RNA, 15 nt, Bordetella pertussis
cuggccuucuucacg

SEQ ID NO: 2396676 - RNA, 23 nt, Bordetella pertussis
cuggccuugugcgccgucgcacu

SEQ ID NO: 2396677 - RNA, 17 nt, Bordetella pertussis
cuggcgaagaacaccgc

SEQ ID NO: 2396678 - RNA, 18 nt, Bordetella pertussis
cuggcgaagaacaccgcc

SEQ ID NO: 2396679 - RNA, 19 nt, Bordetella pertussis
cuggcgaagaacaccgccg

SEQ ID NO: 2396680 - RNA, 21 nt, Bordetella pertussis
cuggcgaagaccgugaucggc

SEQ ID NO: 2396681 - RNA, 23 nt, Bordetella pertussis
cuggcgaagaccgugaucggcgc

SEQ ID NO: 2396682 - RNA, 16 nt, Bordetella pertussis
cuggcgaccggcggca

SEQ ID NO: 2396683 - RNA, 17 nt, Bordetella pertussis
cuggcgagcacccgcag

SEQ ID NO: 2396684 - RNA, 20 nt, Bordetella pertussis
cuggcgagcacccgcaggcg

SEQ ID NO: 2396685 - RNA, 22 nt, Bordetella pertussis
cuggcgagcacccgcaggcggc

SEQ ID NO: 2396686 - RNA, 14 nt, Bordetella pertussis
cuggcgagcauggc

SEQ ID NO: 2396687 - RNA, 20 nt, Bordetella pertussis
cuggcgaucaccgacagcgc

SEQ ID NO: 2396688 - RNA, 21 nt, Bordetella pertussis
cuggcgaucaccgacagcgcc

SEQ ID NO: 2396689 - RNA, 22 nt, Bordetella pertussis
cuggcgaucaccgacagcgcca

SEQ ID NO: 2396690 - RNA, 14 nt, Bordetella pertussis
cuggcgaucacggc

SEQ ID NO: 2396691 - RNA, 17 nt, Bordetella pertussis
cuggcgaucacggccaa

SEQ ID NO: 2396692 - RNA, 18 nt, Bordetella pertussis
cuggcgaucacggccaac

SEQ ID NO: 2396693 - RNA, 20 nt, Bordetella pertussis
cuggcgaucaggccgcccca

SEQ ID NO: 2396694 - RNA, 22 nt, Bordetella pertussis
cuggcgaucgucaccaucgccg

SEQ ID NO: 2396695 - RNA, 17 nt, Bordetella pertussis
cuggcgaugcccaccag

SEQ ID NO: 2396696 - RNA, 19 nt, Bordetella pertussis
cuggcgaugcccaccagcc

SEQ ID NO: 2396697 - RNA, 22 nt, Bordetella pertussis
cuggcgaugcccaccagccgcc

SEQ ID NO: 2396698 - RNA, 16 nt, Bordetella pertussis
cuggcgaugcgggcca

SEQ ID NO: 2396699 - RNA, 23 nt, Bordetella pertussis
cuggcgaugguggauccgccggu

SEQ ID NO: 2396700 - RNA, 14 nt, Bordetella pertussis
cuggcgcaaggacg

SEQ ID NO: 2396701 - RNA, 19 nt, Bordetella pertussis
cuggcgcaaggcgucgggc

SEQ ID NO: 2396702 - RNA, 16 nt, Bordetella pertussis
cuggcgcaccaggcug

SEQ ID NO: 2396703 - RNA, 14 nt, Bordetella pertussis
cuggcgcacgauga

SEQ ID NO: 2396704 - RNA, 20 nt, Bordetella pertussis
cuggcgcacguccagagucu

SEQ ID NO: 2396705 - RNA, 13 nt, Bordetella pertussis
cuggcgcagcaag

SEQ ID NO: 2396706 - RNA, 16 nt, Bordetella pertussis
cuggcgcagcaaggcg

SEQ ID NO: 2396707 - RNA, 19 nt, Bordetella pertussis
cuggcgcagcaaggcgcgc

SEQ ID NO: 2396708 - RNA, 12 nt, Bordetella pertussis
cuggcgcagcac

SEQ ID NO: 2396709 - RNA, 19 nt, Bordetella pertussis
cuggcgcagcacgccgcgc

SEQ ID NO: 2396710 - RNA, 21 nt, Bordetella pertussis
cuggcgcagcacgccgcgcca

SEQ ID NO: 2396711 - RNA, 23 nt, Bordetella pertussis
cuggcgcagcacgccgcgccagg

SEQ ID NO: 2396712 - RNA, 24 nt, Bordetella pertussis
cuggcgcagcacgccgcgccaggc

SEQ ID NO: 2396713 - RNA, 16 nt, Bordetella pertussis
cuggcgcagcagcgcc

SEQ ID NO: 2396714 - RNA, 18 nt, Bordetella pertussis
cuggcgcgacgccugcgc

SEQ ID NO: 2396715 - RNA, 15 nt, Bordetella pertussis
cuggcgcgagaacca

SEQ ID NO: 2396716 - RNA, 20 nt, Bordetella pertussis
cuggcgcgagaaccaggcca

SEQ ID NO: 2396717 - RNA, 22 nt, Bordetella pertussis
cuggcgcgagaaccaggccacg

SEQ ID NO: 2396718 - RNA, 16 nt, Bordetella pertussis
cuggcgcgagaccacg

SEQ ID NO: 2396719 - RNA, 15 nt, Bordetella pertussis
cuggcgcgaggcggc

SEQ ID NO: 2396720 - RNA, 18 nt, Bordetella pertussis
cuggcgcgcaccaugggc

SEQ ID NO: 2396721 - RNA, 16 nt, Bordetella pertussis
cuggcgcgcaucggcg

SEQ ID NO: 2396722 - RNA, 18 nt, Bordetella pertussis
cuggcgcgcaucggcgcc

SEQ ID NO: 2396723 - RNA, 19 nt, Bordetella pertussis
cuggcgcgcaucggcgccg

SEQ ID NO: 2396724 - RNA, 15 nt, Bordetella pertussis
cuggcgcgccagcuc

SEQ ID NO: 2396725 - RNA, 22 nt, Bordetella pertussis
cuggcgcgccaggaagcgcgcc

SEQ ID NO: 2396726 - RNA, 18 nt, Bordetella pertussis
cuggcgcgccaggcgaug

SEQ ID NO: 2396727 - RNA, 15 nt, Bordetella pertussis
cuggcgcgccgccuc

SEQ ID NO: 2396728 - RNA, 16 nt, Bordetella pertussis
cuggcgcgccgccucg

SEQ ID NO: 2396729 - RNA, 10 nt, Bordetella pertussis
cuggcgcgcg

SEQ ID NO: 2396730 - RNA, 14 nt, Bordetella pertussis
cuggcgcgcgaacg

SEQ ID NO: 2396731 - RNA, 13 nt, Bordetella pertussis
cuggcgcgcgacc

SEQ ID NO: 2396732 - RNA, 15 nt, Bordetella pertussis
cuggcgcgcgcaagc

SEQ ID NO: 2396733 - RNA, 14 nt, Bordetella pertussis
cuggcgcgcggccg

SEQ ID NO: 2396734 - RNA, 19 nt, Bordetella pertussis
cuggcgcgcggccugggcg

SEQ ID NO: 2396735 - RNA, 15 nt, Bordetella pertussis
cuggcgcgcggcugg

SEQ ID NO: 2396736 - RNA, 18 nt, Bordetella pertussis
cuggcgcgcggcuggcug

SEQ ID NO: 2396737 - RNA, 19 nt, Bordetella pertussis
cuggcgcgcggcuggcugu

SEQ ID NO: 2396738 - RNA, 19 nt, Bordetella pertussis
cuggcgcggcgccugcgcg

SEQ ID NO: 2396739 - RNA, 18 nt, Bordetella pertussis
cuggcgcggcggccaggc

SEQ ID NO: 2396740 - RNA, 11 nt, Bordetella pertussis
cuggcgcggcu

SEQ ID NO: 2396741 - RNA, 23 nt, Bordetella pertussis
cuggcgcggcuggcgauggugga

SEQ ID NO: 2396742 - RNA, 15 nt, Bordetella pertussis
cuggcgcgggcggcc

SEQ ID NO: 2396743 - RNA, 19 nt, Bordetella pertussis
cuggcgcgggcggccuauc

SEQ ID NO: 2396744 - RNA, 17 nt, Bordetella pertussis
cuggcgcgucaggccgg

SEQ ID NO: 2396745 - RNA, 15 nt, Bordetella pertussis
cuggcgcgucggcgc

SEQ ID NO: 2396746 - RNA, 17 nt, Bordetella pertussis
cuggcgcgucggcgcgc

SEQ ID NO: 2396747 - RNA, 20 nt, Bordetella pertussis
cuggcgcgucggcgcgcgcg

SEQ ID NO: 2396748 - RNA, 14 nt, Bordetella pertussis
cuggcgcugcagcg

SEQ ID NO: 2396749 - RNA, 20 nt, Bordetella pertussis
cuggcgcuguuuccgggccu

SEQ ID NO: 2396750 - RNA, 21 nt, Bordetella pertussis
cuggcgcuguuuccgggccug

SEQ ID NO: 2396751 - RNA, 17 nt, Bordetella pertussis
cuggcgcuugcccgugc

SEQ ID NO: 2396752 - RNA, 14 nt, Bordetella pertussis
cuggcgcuuggcca

SEQ ID NO: 2396753 - RNA, 23 nt, Bordetella pertussis
cuggcgcuuggccagcuggcgcg

SEQ ID NO: 2396754 - RNA, 17 nt, Bordetella pertussis
cuggcggccgcccagca

SEQ ID NO: 2396755 - RNA, 23 nt, Bordetella pertussis
cuggcggccgcccagcagauggc

SEQ ID NO: 2396756 - RNA, 17 nt, Bordetella pertussis
cuggcggccgcgggcgu

SEQ ID NO: 2396757 - RNA, 16 nt, Bordetella pertussis
cuggcggcgcagcacc

SEQ ID NO: 2396758 - RNA, 17 nt, Bordetella pertussis
cuggcggcgcagcacca

SEQ ID NO: 2396759 - RNA, 20 nt, Bordetella pertussis
cuggcggcgcagcaccaggc

SEQ ID NO: 2396760 - RNA, 16 nt, Bordetella pertussis
cuggcggcgcgcggcu

SEQ ID NO: 2396761 - RNA, 18 nt, Bordetella pertussis
cuggcggcgcgcggcugg

SEQ ID NO: 2396762 - RNA, 14 nt, Bordetella pertussis
cuggcggcugguca

SEQ ID NO: 2396763 - RNA, 20 nt, Bordetella pertussis
cuggcggcugucgggcggcg

SEQ ID NO: 2396764 - RNA, 15 nt, Bordetella pertussis
cuggcgggccgaggc

SEQ ID NO: 2396765 - RNA, 19 nt, Bordetella pertussis
cuggcgggccggaaacgcg

SEQ ID NO: 2396766 - RNA, 17 nt, Bordetella pertussis
cuggcgggccugggcgu

SEQ ID NO: 2396767 - RNA, 20 nt, Bordetella pertussis
cuggcgggccugggcgucga

SEQ ID NO: 2396768 - RNA, 20 nt, Bordetella pertussis
cuggcgggugcugcagcgca

SEQ ID NO: 2396769 - RNA, 20 nt, Bordetella pertussis
cuggcgguaugcggcgccca

SEQ ID NO: 2396770 - RNA, 22 nt, Bordetella pertussis
cuggcgguaugcggcgcccagg

SEQ ID NO: 2396771 - RNA, 23 nt, Bordetella pertussis
cuggcgguaugcggcgcccaggc

SEQ ID NO: 2396772 - RNA, 16 nt, Bordetella pertussis
cuggcgguggccgcgc

SEQ ID NO: 2396773 - RNA, 17 nt, Bordetella pertussis
cuggcgguggccgcgca

SEQ ID NO: 2396774 - RNA, 24 nt, Bordetella pertussis
cuggcgguggccgcgcaugccagc

SEQ ID NO: 2396775 - RNA, 16 nt, Bordetella pertussis
cuggcguacgcugcug

SEQ ID NO: 2396776 - RNA, 20 nt, Bordetella pertussis
cuggcguaugcccacucccg

SEQ ID NO: 2396777 - RNA, 13 nt, Bordetella pertussis
cuggcguccaggu

SEQ ID NO: 2396778 - RNA, 18 nt, Bordetella pertussis
cuggcguccagguugggc

SEQ ID NO: 2396779 - RNA, 14 nt, Bordetella pertussis
cuggcgucgcgcuu

SEQ ID NO: 2396780 - RNA, 17 nt, Bordetella pertussis
cuggcguggccguucgg

SEQ ID NO: 2396781 - RNA, 14 nt, Bordetella pertussis
cuggcguggcgcgc

SEQ ID NO: 2396782 - RNA, 15 nt, Bordetella pertussis
cuggcguggcgcgcg

SEQ ID NO: 2396783 - RNA, 16 nt, Bordetella pertussis
cuggcguggcgcgcgc

SEQ ID NO: 2396784 - RNA, 17 nt, Bordetella pertussis
cuggcguggcgcgcgcc

SEQ ID NO: 2396785 - RNA, 18 nt, Bordetella pertussis
cuggcguggcgcgcgccg

SEQ ID NO: 2396786 - RNA, 19 nt, Bordetella pertussis
cuggcguggcgcgcgccga

SEQ ID NO: 2396787 - RNA, 21 nt, Bordetella pertussis
cuggcguucaaucgcgcuucu

SEQ ID NO: 2396788 - RNA, 18 nt, Bordetella pertussis
cuggcguucggcaccggc

SEQ ID NO: 2396789 - RNA, 16 nt, Bordetella pertussis
cuggcguucgucgccu

SEQ ID NO: 2396790 - RNA, 21 nt, Bordetella pertussis
cuggcguugacguggcugagc

SEQ ID NO: 2396791 - RNA, 18 nt, Bordetella pertussis
cuggcguuugcgcgcgcg

SEQ ID NO: 2396792 - RNA, 14 nt, Bordetella pertussis
cuggcucaggccug

SEQ ID NO: 2396793 - RNA, 15 nt, Bordetella pertussis
cuggcucaggccugc

SEQ ID NO: 2396794 - RNA, 17 nt, Bordetella pertussis
cuggcucaggccugcac

SEQ ID NO: 2396795 - RNA, 20 nt, Bordetella pertussis
cuggcucagucggccuggcg

SEQ ID NO: 2396796 - RNA, 21 nt, Bordetella pertussis
cuggcucagucggccuggcgc

SEQ ID NO: 2396797 - RNA, 15 nt, Bordetella pertussis
cuggcucccaccggu

SEQ ID NO: 2396798 - RNA, 21 nt, Bordetella pertussis
cuggcucccgagggaucagcc

SEQ ID NO: 2396799 - RNA, 18 nt, Bordetella pertussis
cuggcucccgcugacuuc

SEQ ID NO: 2396800 - RNA, 17 nt, Bordetella pertussis
cuggcuccgaagggcug

SEQ ID NO: 2396801 - RNA, 19 nt, Bordetella pertussis
cuggcucguucgcucggcg

SEQ ID NO: 2396802 - RNA, 21 nt, Bordetella pertussis
cuggcucguucgcucggcguc

SEQ ID NO: 2396803 - RNA, 16 nt, Bordetella pertussis
cugccgagacggccgc

SEQ ID NO: 2396804 - RNA, 18 nt, Bordetella pertussis
cugccgagacggccgccg

SEQ ID NO: 2396805 - RNA, 18 nt, Bordetella pertussis
cugccgagcgcugcgcca

SEQ ID NO: 2396806 - RNA, 19 nt, Bordetella pertussis
cugccgaucaagagccugg

SEQ ID NO: 2396807 - RNA, 19 nt, Bordetella pertussis
cugccgcacuucgggccac

SEQ ID NO: 2396808 - RNA, 21 nt, Bordetella pertussis
cugccgcacuucgggccaccc

SEQ ID NO: 2396809 - RNA, 15 nt, Bordetella pertussis
cugccgcaucccgcc

SEQ ID NO: 2396810 - RNA, 18 nt, Bordetella pertussis
cugccgccaagggcgcgc

SEQ ID NO: 2396811 - RNA, 23 nt, Bordetella pertussis
cugccgccaagggcgcgccagca

SEQ ID NO: 2396812 - RNA, 15 nt, Bordetella pertussis
cugccgccaggcauu

SEQ ID NO: 2396813 - RNA, 16 nt, Bordetella pertussis
cugccgcccgagcugg

SEQ ID NO: 2396814 - RNA, 20 nt, Bordetella pertussis
cugccgcccuggcgcagggc

SEQ ID NO: 2396815 - RNA, 21 nt, Bordetella pertussis
cugccgcccuggcgcagggca

SEQ ID NO: 2396816 - RNA, 16 nt, Bordetella pertussis
cugccgccgaugugcg

SEQ ID NO: 2396817 - RNA, 18 nt, Bordetella pertussis
cugccgccugccaguucg

SEQ ID NO: 2396818 - RNA, 19 nt, Bordetella pertussis
cugccgccugccaguucga

SEQ ID NO: 2396819 - RNA, 19 nt, Bordetella pertussis
cugccgccuucgucgcgca

SEQ ID NO: 2396820 - RNA, 17 nt, Bordetella pertussis
cugccgcgccgaccggc

SEQ ID NO: 2396821 - RNA, 12 nt, Bordetella pertussis
cugccgcgcgau

SEQ ID NO: 2396822 - RNA, 12 nt, Bordetella pertussis
cugccgcgcgcc

SEQ ID NO: 2396823 - RNA, 15 nt, Bordetella pertussis
cugccgcgcgccggc

SEQ ID NO: 2396824 - RNA, 22 nt, Bordetella pertussis
cugccgcggauugccguccugg

SEQ ID NO: 2396825 - RNA, 17 nt, Bordetella pertussis
cugccgcgugcccgcgu

SEQ ID NO: 2396826 - RNA, 12 nt, Bordetella pertussis
cugccgcugacc

SEQ ID NO: 2396827 - RNA, 17 nt, Bordetella pertussis
cugccgcugaccggcgg

SEQ ID NO: 2396828 - RNA, 19 nt, Bordetella pertussis
cugccgcugaccggcggca

SEQ ID NO: 2396829 - RNA, 22 nt, Bordetella pertussis
cugccgcugaucuuccugggcg

SEQ ID NO: 2396830 - RNA, 15 nt, Bordetella pertussis
cugccgcugcaggcc

SEQ ID NO: 2396831 - RNA, 17 nt, Bordetella pertussis
cugccgcugcaggcccu

SEQ ID NO: 2396832 - RNA, 20 nt, Bordetella pertussis
cugccggaaacccgggcuuu

SEQ ID NO: 2396833 - RNA, 21 nt, Bordetella pertussis
cugccggauuggcgcugcaca

SEQ ID NO: 2396834 - RNA, 16 nt, Bordetella pertussis
cugccggcagcaggga

SEQ ID NO: 2396835 - RNA, 14 nt, Bordetella pertussis
cugccggcgcccuu

SEQ ID NO: 2396836 - RNA, 12 nt, Bordetella pertussis
cugccggcgcgc

SEQ ID NO: 2396837 - RNA, 13 nt, Bordetella pertussis
cugccggcgcgcc

SEQ ID NO: 2396838 - RNA, 17 nt, Bordetella pertussis
cugccggcgcgcccagg

SEQ ID NO: 2396839 - RNA, 18 nt, Bordetella pertussis
cugccggcgcgcccaggg

SEQ ID NO: 2396840 - RNA, 14 nt, Bordetella pertussis
cugccggcgcgccu

SEQ ID NO: 2396841 - RNA, 20 nt, Bordetella pertussis
cugccggcgcgccucggcgc

SEQ ID NO: 2396842 - RNA, 17 nt, Bordetella pertussis
cugccggcgcgggcgca

SEQ ID NO: 2396843 - RNA, 20 nt, Bordetella pertussis
cugccggcgcgggcgcaggc

SEQ ID NO: 2396844 - RNA, 13 nt, Bordetella pertussis
cugccggcggccu

SEQ ID NO: 2396845 - RNA, 20 nt, Bordetella pertussis
cugccggcguuggccggguc

SEQ ID NO: 2396846 - RNA, 14 nt, Bordetella pertussis
cugccgggacaggc

SEQ ID NO: 2396847 - RNA, 14 nt, Bordetella pertussis
cugccgggcucggc

SEQ ID NO: 2396848 - RNA, 16 nt, Bordetella pertussis
cugccgggcucggcca

SEQ ID NO: 2396849 - RNA, 19 nt, Bordetella pertussis
cugccgggcucggccacca

SEQ ID NO: 2396850 - RNA, 19 nt, Bordetella pertussis
cugccggggcacccaggcg

SEQ ID NO: 2396851 - RNA, 22 nt, Bordetella pertussis
cugccggggcacccaggcgggc

SEQ ID NO: 2396852 - RNA, 18 nt, Bordetella pertussis
cugccgguaaccgacgca

SEQ ID NO: 2396853 - RNA, 21 nt, Bordetella pertussis
cugccgguaaccgacgcagcg

SEQ ID NO: 2396854 - RNA, 15 nt, Bordetella pertussis
cugccguagcccagg

SEQ ID NO: 2396855 - RNA, 21 nt, Bordetella pertussis
cugccguagcccagguccagc

SEQ ID NO: 2396856 - RNA, 18 nt, Bordetella pertussis
cugccguccuugugccag

SEQ ID NO: 2396857 - RNA, 22 nt, Bordetella pertussis
cugccgucgucguccaggcgca

SEQ ID NO: 2396858 - RNA, 16 nt, Bordetella pertussis
cugccgugcagauggc

SEQ ID NO: 2396859 - RNA, 16 nt, Bordetella pertussis
cugccgugggacaggc

SEQ ID NO: 2396860 - RNA, 19 nt, Bordetella pertussis
cugccgugggacaggcacc

SEQ ID NO: 2396861 - RNA, 20 nt, Bordetella pertussis
cugccgugggacaggcacuc

SEQ ID NO: 2396862 - RNA, 17 nt, Bordetella pertussis
cugccguuccagcugcu

SEQ ID NO: 2396863 - RNA, 14 nt, Bordetella pertussis
cugccguucgcgcu

SEQ ID NO: 2396864 - RNA, 16 nt, Bordetella pertussis
cugccguucgcgcugc

SEQ ID NO: 2396865 - RNA, 22 nt, Bordetella pertussis
cugccguucgcgcugcccaccg

SEQ ID NO: 2396866 - RNA, 21 nt, Bordetella pertussis
cugccguugucggucaucacg

SEQ ID NO: 2396867 - RNA, 21 nt, Bordetella pertussis
cugccguuucucaacccgccg

SEQ ID NO: 2396868 - RNA, 22 nt, Bordetella pertussis
cugccguuucucaacccgccgg

SEQ ID NO: 2396869 - RNA, 21 nt, Bordetella pertussis
cugccguuuucgaucagggcg

SEQ ID NO: 2396870 - RNA, 23 nt, Bordetella pertussis
cugccuacuugcgggacuggacg

SEQ ID NO: 2396871 - RNA, 14 nt, Bordetella pertussis
cugccuccaggcgc

SEQ ID NO: 2396872 - RNA, 15 nt, Bordetella pertussis
cugccuccaggcgca

SEQ ID NO: 2396873 - RNA, 15 nt, Bordetella pertussis
cugccugaaaccgca

SEQ ID NO: 2396874 - RNA, 21 nt, Bordetella pertussis
cugccugaaaccgcaggcaag

SEQ ID NO: 2396875 - RNA, 16 nt, Bordetella pertussis
cugccugagcaccgcc

SEQ ID NO: 2396876 - RNA, 22 nt, Bordetella pertussis
cugccugagcaccgccgcgucc

SEQ ID NO: 2396877 - RNA, 17 nt, Bordetella pertussis
cugccugcagcgcgcgc

SEQ ID NO: 2396878 - RNA, 18 nt, Bordetella pertussis
cugccugcagcgcgcgcg

SEQ ID NO: 2396879 - RNA, 14 nt, Bordetella pertussis
cugccugccgccug

SEQ ID NO: 2396880 - RNA, 18 nt, Bordetella pertussis
cugccugccggccggcca

SEQ ID NO: 2396881 - RNA, 19 nt, Bordetella pertussis
cugccugccggccggccag

SEQ ID NO: 2396882 - RNA, 20 nt, Bordetella pertussis
cugccugccggccggccagu

SEQ ID NO: 2396883 - RNA, 13 nt, Bordetella pertussis
cugccuggcgaac

SEQ ID NO: 2396884 - RNA, 15 nt, Bordetella pertussis
cugcgaaaaagcccg

SEQ ID NO: 2396885 - RNA, 17 nt, Bordetella pertussis
cugcgaaacagcagcgg

SEQ ID NO: 2396886 - RNA, 18 nt, Bordetella pertussis
cugcgaaacagcagcgga

SEQ ID NO: 2396887 - RNA, 20 nt, Bordetella pertussis
cugcgaaagcgcgucgagca

SEQ ID NO: 2396888 - RNA, 16 nt, Bordetella pertussis
cugcgaacgcccggcc

SEQ ID NO: 2396889 - RNA, 18 nt, Bordetella pertussis
cugcgaacgcccggccca

SEQ ID NO: 2396890 - RNA, 14 nt, Bordetella pertussis
cugcgacagcagca

SEQ ID NO: 2396891 - RNA, 15 nt, Bordetella pertussis
cugcgacagcagcau

SEQ ID NO: 2396892 - RNA, 20 nt, Bordetella pertussis
cugcgacagcagcaugcggc

SEQ ID NO: 2396893 - RNA, 23 nt, Bordetella pertussis
cugcgacagcagcaugcggcccg

SEQ ID NO: 2396894 - RNA, 13 nt, Bordetella pertussis
cugcgacagcagg

SEQ ID NO: 2396895 - RNA, 18 nt, Bordetella pertussis
cugcgacagcagggccag

SEQ ID NO: 2396896 - RNA, 20 nt, Bordetella pertussis
cugcgacagcagggccaggc

SEQ ID NO: 2396897 - RNA, 17 nt, Bordetella pertussis
cugcgacaggcgcagcu

SEQ ID NO: 2396898 - RNA, 18 nt, Bordetella pertussis
cugcgaccgagccacguc

SEQ ID NO: 2396899 - RNA, 14 nt, Bordetella pertussis
cugcgagacgcgcu

SEQ ID NO: 2396900 - RNA, 20 nt, Bordetella pertussis
cugcgagacgcgcucgcgcg

SEQ ID NO: 2396901 - RNA, 19 nt, Bordetella pertussis
cugcgagagauagcccagc

SEQ ID NO: 2396902 - RNA, 21 nt, Bordetella pertussis
cugcgagagauagcccagcac

SEQ ID NO: 2396903 - RNA, 21 nt, Bordetella pertussis
cugcgagccgccgcccuugcg

SEQ ID NO: 2396904 - RNA, 13 nt, Bordetella pertussis
cugcgaggacagg

SEQ ID NO: 2396905 - RNA, 14 nt, Bordetella pertussis
cugcgaggacaggg

SEQ ID NO: 2396906 - RNA, 19 nt, Bordetella pertussis
cugcgaucaguucggcaug

SEQ ID NO: 2396907 - RNA, 14 nt, Bordetella pertussis
cugcgaugccggcg

SEQ ID NO: 2396908 - RNA, 15 nt, Bordetella pertussis
cugcgaugccggcgu

SEQ ID NO: 2396909 - RNA, 19 nt, Bordetella pertussis
cugcgaugccggcguggcg

SEQ ID NO: 2396910 - RNA, 15 nt, Bordetella pertussis
cugcgauucgcgcuu

SEQ ID NO: 2396911 - RNA, 16 nt, Bordetella pertussis
cugcgcacccgccugg

SEQ ID NO: 2396912 - RNA, 18 nt, Bordetella pertussis
cugcgcacccgccuggac

SEQ ID NO: 2396913 - RNA, 22 nt, Bordetella pertussis
cugcgcacccgccuggacggcg

SEQ ID NO: 2396914 - RNA, 23 nt, Bordetella pertussis
cugcgcacccgccuggacggcga

SEQ ID NO: 2396915 - RNA, 16 nt, Bordetella pertussis
cugcgcaccggccggc

SEQ ID NO: 2396916 - RNA, 17 nt, Bordetella pertussis
cugcgcaccggccggcc

SEQ ID NO: 2396917 - RNA, 21 nt, Bordetella pertussis
cugcgcacgcuggcgcccgcc

SEQ ID NO: 2396918 - RNA, 20 nt, Bordetella pertussis
cugcgcagcagcgcgguggc

SEQ ID NO: 2396919 - RNA, 17 nt, Bordetella pertussis
cugcgcagcagggcggc

SEQ ID NO: 2396920 - RNA, 19 nt, Bordetella pertussis
cugcgcagcagggcggcgg

SEQ ID NO: 2396921 - RNA, 14 nt, Bordetella pertussis
cugcgcaggcgcgc

SEQ ID NO: 2396922 - RNA, 19 nt, Bordetella pertussis
cugcgcaggcgcgcggggg

SEQ ID NO: 2396923 - RNA, 19 nt, Bordetella pertussis
cugcgcaggucggccagga

SEQ ID NO: 2396924 - RNA, 21 nt, Bordetella pertussis
cugcgcaggucggccaggacg

SEQ ID NO: 2396925 - RNA, 21 nt, Bordetella pertussis
cugcgcaucgaucagcgcgcc

SEQ ID NO: 2396926 - RNA, 22 nt, Bordetella pertussis
cugcgcaucgaucagcgcgccg

SEQ ID NO: 2396927 - RNA, 17 nt, Bordetella pertussis
cugcgcaucgaugcggc

SEQ ID NO: 2396928 - RNA, 20 nt, Bordetella pertussis
cugcgcaucgaugcggccuu

SEQ ID NO: 2396929 - RNA, 17 nt, Bordetella pertussis
cugcgcaugcgccuguc

SEQ ID NO: 2396930 - RNA, 16 nt, Bordetella pertussis
cugcgcauggcgucaa

SEQ ID NO: 2396931 - RNA, 21 nt, Bordetella pertussis
cugcgcaugggcgcaggccgc

SEQ ID NO: 2396932 - RNA, 22 nt, Bordetella pertussis
cugcgcaugggcgcaggccgcc

SEQ ID NO: 2396933 - RNA, 23 nt, Bordetella pertussis
cugcgcaugggcgcaggccgcca

SEQ ID NO: 2396934 - RNA, 15 nt, Bordetella pertussis
cugcgcauggucgcg

SEQ ID NO: 2396935 - RNA, 18 nt, Bordetella pertussis
cugcgccaauuguccugg

SEQ ID NO: 2396936 - RNA, 14 nt, Bordetella pertussis
cugcgccaccagcu

SEQ ID NO: 2396937 - RNA, 12 nt, Bordetella pertussis
cugcgccaccgc

SEQ ID NO: 2396938 - RNA, 13 nt, Bordetella pertussis
cugcgccaccugg

SEQ ID NO: 2396939 - RNA, 17 nt, Bordetella pertussis
cugcgccaccuggcgcc

SEQ ID NO: 2396940 - RNA, 14 nt, Bordetella pertussis
cugcgccacggcga

SEQ ID NO: 2396941 - RNA, 13 nt, Bordetella pertussis
cugcgccagccgc

SEQ ID NO: 2396942 - RNA, 15 nt, Bordetella pertussis
cugcgccagccgcgc

SEQ ID NO: 2396943 - RNA, 19 nt, Bordetella pertussis
cugcgccagccgcgccugc

SEQ ID NO: 2396944 - RNA, 21 nt, Bordetella pertussis
cugcgccagccgcgccugcag

SEQ ID NO: 2396945 - RNA, 12 nt, Bordetella pertussis
cugcgccagcgc

SEQ ID NO: 2396946 - RNA, 13 nt, Bordetella pertussis
cugcgccagcgcc

SEQ ID NO: 2396947 - RNA, 14 nt, Bordetella pertussis
cugcgccagcgccu

SEQ ID NO: 2396948 - RNA, 19 nt, Bordetella pertussis
cugcgccagcgccucgcgc

SEQ ID NO: 2396949 - RNA, 20 nt, Bordetella pertussis
cugcgccagcgccucgcgcu

SEQ ID NO: 2396950 - RNA, 23 nt, Bordetella pertussis
cugcgccagcuccagccgcaggc

SEQ ID NO: 2396951 - RNA, 18 nt, Bordetella pertussis
cugcgccaguugcggggc

SEQ ID NO: 2396952 - RNA, 20 nt, Bordetella pertussis
cugcgccaguugcggggcgc

SEQ ID NO: 2396953 - RNA, 23 nt, Bordetella pertussis
cugcgccaguugcggggcgccca

SEQ ID NO: 2396954 - RNA, 17 nt, Bordetella pertussis
cugcgccauggcgcgca

SEQ ID NO: 2396955 - RNA, 18 nt, Bordetella pertussis
cugcgccauggcgcgcag

SEQ ID NO: 2396956 - RNA, 19 nt, Bordetella pertussis
cugcgccauggcgcgcaga

SEQ ID NO: 2396957 - RNA, 21 nt, Bordetella pertussis
cugcgcccgcuacgcgggcuu

SEQ ID NO: 2396958 - RNA, 21 nt, Bordetella pertussis
cugcgcccgcuaugcgggcuu

SEQ ID NO: 2396959 - RNA, 16 nt, Bordetella pertussis
cugcgccgaggcgggc

SEQ ID NO: 2396960 - RNA, 22 nt, Bordetella pertussis
cugcgccgaggcgggcagcaug

SEQ ID NO: 2396961 - RNA, 23 nt, Bordetella pertussis
cugcgccgaggcgggcagcaugg

SEQ ID NO: 2396962 - RNA, 20 nt, Bordetella pertussis
cugcgccgccgcguggcggc

SEQ ID NO: 2396963 - RNA, 12 nt, Bordetella pertussis
cugcgccgccuc

SEQ ID NO: 2396964 - RNA, 14 nt, Bordetella pertussis
cugcgccgccucga

SEQ ID NO: 2396965 - RNA, 13 nt, Bordetella pertussis
cugcgccggcaug

SEQ ID NO: 2396966 - RNA, 13 nt, Bordetella pertussis
cugcgccggcggc

SEQ ID NO: 2396967 - RNA, 17 nt, Bordetella pertussis
cugcgccggcggcaccg

SEQ ID NO: 2396968 - RNA, 19 nt, Bordetella pertussis
cugcgccggcggcaccgcg

SEQ ID NO: 2396969 - RNA, 20 nt, Bordetella pertussis
cugcgccggcggcaccgcgc

SEQ ID NO: 2396970 - RNA, 17 nt, Bordetella pertussis
cugcgccgggcgcggcc

SEQ ID NO: 2396971 - RNA, 21 nt, Bordetella pertussis
cugcgccgggcgcggccaggc

SEQ ID NO: 2396972 - RNA, 21 nt, Bordetella pertussis
cugcgccggguccggccgcgc

SEQ ID NO: 2396973 - RNA, 16 nt, Bordetella pertussis
cugcgccgucugcgcc

SEQ ID NO: 2396974 - RNA, 17 nt, Bordetella pertussis
cugcgccgucugcgccg

SEQ ID NO: 2396975 - RNA, 13 nt, Bordetella pertussis
cugcgccuggccg

SEQ ID NO: 2396976 - RNA, 17 nt, Bordetella pertussis
cugcgccuggccgcgcu

SEQ ID NO: 2396977 - RNA, 20 nt, Bordetella pertussis
cugcgccuuccgggcgaccc

SEQ ID NO: 2396978 - RNA, 17 nt, Bordetella pertussis
cugcgccuuggcgcgca

SEQ ID NO: 2396979 - RNA, 22 nt, Bordetella pertussis
cugcgcgaaacccccuggguga

SEQ ID NO: 2396980 - RNA, 17 nt, Bordetella pertussis
cugcgcgaaacggccgg

SEQ ID NO: 2396981 - RNA, 13 nt, Bordetella pertussis
cugcgcgaacgcg

SEQ ID NO: 2396982 - RNA, 16 nt, Bordetella pertussis
cugcgcgaacgcggcc

SEQ ID NO: 2396983 - RNA, 13 nt, Bordetella pertussis
cugcgcgaagcgc

SEQ ID NO: 2396984 - RNA, 22 nt, Bordetella pertussis
cugcgcgacaaccgcggcgaca

SEQ ID NO: 2396985 - RNA, 14 nt, Bordetella pertussis
cugcgcgaccucca

SEQ ID NO: 2396986 - RNA, 21 nt, Bordetella pertussis
cugcgcgacgaaucggucacg

SEQ ID NO: 2396987 - RNA, 18 nt, Bordetella pertussis
cugcgcgaggugccggac

SEQ ID NO: 2396988 - RNA, 23 nt, Bordetella pertussis
cugcgcgaggugccggacgccga

SEQ ID NO: 2396989 - RNA, 14 nt, Bordetella pertussis
cugcgcgagguggg

SEQ ID NO: 2396990 - RNA, 16 nt, Bordetella pertussis
cugcgcgaggugggcg

SEQ ID NO: 2396991 - RNA, 23 nt, Bordetella pertussis
cugcgcgaggugggcggcagcag

SEQ ID NO: 2396992 - RNA, 17 nt, Bordetella pertussis
cugcgcgaugagcuggc

SEQ ID NO: 2396993 - RNA, 13 nt, Bordetella pertussis
cugcgcgaugcgc

SEQ ID NO: 2396994 - RNA, 17 nt, Bordetella pertussis
cugcgcgaugcgcgcgc

SEQ ID NO: 2396995 - RNA, 22 nt, Bordetella pertussis
cugcgcgaugcgcgcgugcagc

SEQ ID NO: 2396996 - RNA, 14 nt, Bordetella pertussis
cugcgcgccgacca

SEQ ID NO: 2396997 - RNA, 22 nt, Bordetella pertussis
cugcgcgccgaccaccugcacc

SEQ ID NO: 2396998 - RNA, 11 nt, Bordetella pertussis
cugcgcgccgc

SEQ ID NO: 2396999 - RNA, 12 nt, Bordetella pertussis
cugcgcgccgcc

SEQ ID NO: 2397000 - RNA, 23 nt, Bordetella pertussis
cugcgcgccgccgcgcugugcga

SEQ ID NO: 2397001 - RNA, 14 nt, Bordetella pertussis
cugcgcgccgccgg

SEQ ID NO: 2397002 - RNA, 13 nt, Bordetella pertussis
cugcgcgccgccu

SEQ ID NO: 2397003 - RNA, 14 nt, Bordetella pertussis
cugcgcgccgccuc

SEQ ID NO: 2397004 - RNA, 14 nt, Bordetella pertussis
cugcgcgccggcgc

SEQ ID NO: 2397005 - RNA, 17 nt, Bordetella pertussis
cugcgcgccggcgccuu

SEQ ID NO: 2397006 - RNA, 13 nt, Bordetella pertussis
cugcgcgccgggu

SEQ ID NO: 2397007 - RNA, 13 nt, Bordetella pertussis
cugcgcgccgugg

SEQ ID NO: 2397008 - RNA, 17 nt, Bordetella pertussis
cugcgcgccguggugcu

SEQ ID NO: 2397009 - RNA, 15 nt, Bordetella pertussis
cugcgcgcgagcggc

SEQ ID NO: 2397010 - RNA, 17 nt, Bordetella pertussis
cugcgcgcgcagccagg

SEQ ID NO: 2397011 - RNA, 14 nt, Bordetella pertussis
cugcgcgcggccug

SEQ ID NO: 2397012 - RNA, 23 nt, Bordetella pertussis
cugcgcggccgagcgggccagcg

SEQ ID NO: 2397013 - RNA, 17 nt, Bordetella pertussis
cugcgcggcgggccccg

SEQ ID NO: 2397014 - RNA, 18 nt, Bordetella pertussis
cugcgcggcgggccccgc

SEQ ID NO: 2397015 - RNA, 19 nt, Bordetella pertussis
cugcgcggcuuuuucucgg

SEQ ID NO: 2397016 - RNA, 15 nt, Bordetella pertussis
cugcgcggguccggc

SEQ ID NO: 2397017 - RNA, 16 nt, Bordetella pertussis
cugcgcguccuggcgc

SEQ ID NO: 2397018 - RNA, 18 nt, Bordetella pertussis
cugcgcguccuggcgcga

SEQ ID NO: 2397019 - RNA, 14 nt, Bordetella pertussis
cugcgcgugcacga

SEQ ID NO: 2397020 - RNA, 17 nt, Bordetella pertussis
cugcgcgugcacgaccu

SEQ ID NO: 2397021 - RNA, 23 nt, Bordetella pertussis
cugcgcgugcacgaccugccacu

SEQ ID NO: 2397022 - RNA, 16 nt, Bordetella pertussis
cugcgcguggccauca

SEQ ID NO: 2397023 - RNA, 17 nt, Bordetella pertussis
cugcgcguugagcagca

SEQ ID NO: 2397024 - RNA, 19 nt, Bordetella pertussis
cugcgcugcauacgccgcu

SEQ ID NO: 2397025 - RNA, 13 nt, Bordetella pertussis
cugcgcuggccgc

SEQ ID NO: 2397026 - RNA, 15 nt, Bordetella pertussis
cugcgcuggccgcga

SEQ ID NO: 2397027 - RNA, 19 nt, Bordetella pertussis
cugcgcuugaccgccucga

SEQ ID NO: 2397028 - RNA, 21 nt, Bordetella pertussis
cugcggacccaguucggccgc

SEQ ID NO: 2397029 - RNA, 17 nt, Bordetella pertussis
cugcggacggcgggcgc

SEQ ID NO: 2397030 - RNA, 23 nt, Bordetella pertussis
cugcggacggcgggcgccccgau

SEQ ID NO: 2397031 - RNA, 17 nt, Bordetella pertussis
cugcggcaccucggccg

SEQ ID NO: 2397032 - RNA, 16 nt, Bordetella pertussis
cugcugcgccgucugu

SEQ ID NO: 2397033 - RNA, 14 nt, Bordetella pertussis
cugcugcgccuggc

SEQ ID NO: 2397034 - RNA, 19 nt, Bordetella pertussis
cugcugcgccuggccgcgc

SEQ ID NO: 2397035 - RNA, 22 nt, Bordetella pertussis
cugcugcgccuggccgcgcuga

SEQ ID NO: 2397036 - RNA, 15 nt, Bordetella pertussis
cugcugcggcacgau

SEQ ID NO: 2397037 - RNA, 16 nt, Bordetella pertussis
cugcugcggcacggcc

SEQ ID NO: 2397038 - RNA, 17 nt, Bordetella pertussis
cugcugcggcacggcca

SEQ ID NO: 2397039 - RNA, 19 nt, Bordetella pertussis
cugcugcggcacggccagc

SEQ ID NO: 2397040 - RNA, 20 nt, Bordetella pertussis
cugcugcggcacggccagcg

SEQ ID NO: 2397041 - RNA, 18 nt, Bordetella pertussis
cugcugcuggaccuggcc

SEQ ID NO: 2397042 - RNA, 20 nt, Bordetella pertussis
cugcugcuggcuucggcgcu

SEQ ID NO: 2397043 - RNA, 18 nt, Bordetella pertussis
cugcuggaacaccaugcc

SEQ ID NO: 2397044 - RNA, 11 nt, Bordetella pertussis
cugcuggagau

SEQ ID NO: 2397045 - RNA, 17 nt, Bordetella pertussis
cugcuggaggccggcgu

SEQ ID NO: 2397046 - RNA, 20 nt, Bordetella pertussis
cugcuggccaagcgcgccgg

SEQ ID NO: 2397047 - RNA, 17 nt, Bordetella pertussis
cugcuggccaccgucgc

SEQ ID NO: 2397048 - RNA, 17 nt, Bordetella pertussis
cugcuggccgccggcgc

SEQ ID NO: 2397049 - RNA, 13 nt, Bordetella pertussis
cugcuggccggcc

SEQ ID NO: 2397050 - RNA, 15 nt, Bordetella pertussis
cugcuggccggcccc

SEQ ID NO: 2397051 - RNA, 16 nt, Bordetella pertussis
cugcuggccggcccca

SEQ ID NO: 2397052 - RNA, 22 nt, Bordetella pertussis
cugcuggccggccccauccuca

SEQ ID NO: 2397053 - RNA, 21 nt, Bordetella pertussis
cugcuggcgcgcaccaucgcc

SEQ ID NO: 2397054 - RNA, 23 nt, Bordetella pertussis
cugcuggcgcgcaccaucgccga

SEQ ID NO: 2397055 - RNA, 18 nt, Bordetella pertussis
cugcuggcgcgucggcgc

SEQ ID NO: 2397056 - RNA, 16 nt, Bordetella pertussis
cugcuggcggcgcugg

SEQ ID NO: 2397057 - RNA, 12 nt, Bordetella pertussis
cugcuggcugcc

SEQ ID NO: 2397058 - RNA, 15 nt, Bordetella pertussis
cugcuggcugcccug

SEQ ID NO: 2397059 - RNA, 23 nt, Bordetella pertussis
cugcuggcuucggcgcugggcgc

SEQ ID NO: 2397060 - RNA, 14 nt, Bordetella pertussis
cugcugggccgcgc

SEQ ID NO: 2397061 - RNA, 14 nt, Bordetella pertussis
cugcugggccggcg

SEQ ID NO: 2397062 - RNA, 15 nt, Bordetella pertussis
cugcugggccggcgc

SEQ ID NO: 2397063 - RNA, 16 nt, Bordetella pertussis
cugcugggccggcgcg

SEQ ID NO: 2397064 - RNA, 22 nt, Bordetella pertussis
cugcugggccggcgcgcgcagg

SEQ ID NO: 2397065 - RNA, 23 nt, Bordetella pertussis
cugcugggccggcgcgcgcaggc

SEQ ID NO: 2397066 - RNA, 21 nt, Bordetella pertussis
cugcuggggguuggccuugcc

SEQ ID NO: 2397067 - RNA, 20 nt, Bordetella pertussis
cugcugggguggagcgcggc

SEQ ID NO: 2397068 - RNA, 22 nt, Bordetella pertussis
cugcugggguggagcgcggcgc

SEQ ID NO: 2397069 - RNA, 24 nt, Bordetella pertussis
cugcugggguggagcgcggcgcug

SEQ ID NO: 2397070 - RNA, 20 nt, Bordetella pertussis
cugcugguacagccccagcg

SEQ ID NO: 2397071 - RNA, 23 nt, Bordetella pertussis
cugcugguacagccccagcgcca

SEQ ID NO: 2397072 - RNA, 20 nt, Bordetella pertussis
cugcuggucgcgggccaggc

SEQ ID NO: 2397073 - RNA, 22 nt, Bordetella pertussis
cugcuggucgcgggccaggccg

SEQ ID NO: 2397074 - RNA, 16 nt, Bordetella pertussis
cugcuggucggcgugg

SEQ ID NO: 2397075 - RNA, 21 nt, Bordetella pertussis
cugcugguuuucggacgcagc

SEQ ID NO: 2397076 - RNA, 19 nt, Bordetella pertussis
cugcuguacgacagcaagg

SEQ ID NO: 2397077 - RNA, 20 nt, Bordetella pertussis
cugcugucgcgcgacuggcc

SEQ ID NO: 2397078 - RNA, 16 nt, Bordetella pertussis
cugcugugccugccaa

SEQ ID NO: 2397079 - RNA, 19 nt, Bordetella pertussis
cugcugugccugccaagcg

SEQ ID NO: 2397080 - RNA, 15 nt, Bordetella pertussis
cugcuguucgccacg

SEQ ID NO: 2397081 - RNA, 17 nt, Bordetella pertussis
cugcuuauaggcuuuca

SEQ ID NO: 2397082 - RNA, 15 nt, Bordetella pertussis
cugcuucaugcgcuc

SEQ ID NO: 2397083 - RNA, 19 nt, Bordetella pertussis
cugcuugaagacgcccagg

SEQ ID NO: 2397084 - RNA, 22 nt, Bordetella pertussis
cugcuugaagacgcccaggucc

SEQ ID NO: 2397085 - RNA, 21 nt, Bordetella pertussis
cugcuugagcgaaauggcggc

SEQ ID NO: 2397086 - RNA, 16 nt, Bordetella pertussis
cugcuugaggccgcgc

SEQ ID NO: 2397087 - RNA, 20 nt, Bordetella pertussis
cugcuugaggccgcgcgccu

SEQ ID NO: 2397088 - RNA, 13 nt, Bordetella pertussis
cugcuugccggcc

SEQ ID NO: 2397089 - RNA, 14 nt, Bordetella pertussis
cugcuuggcagccu

SEQ ID NO: 2397090 - RNA, 16 nt, Bordetella pertussis
cugcuuggcagccuug

SEQ ID NO: 2397091 - RNA, 20 nt, Bordetella pertussis
cuggaaacuguuggcgugca

SEQ ID NO: 2397092 - RNA, 18 nt, Bordetella pertussis
cuggaacagcuugggcau

SEQ ID NO: 2397093 - RNA, 14 nt, Bordetella pertussis
cuggaacgcgccgc

SEQ ID NO: 2397094 - RNA, 19 nt, Bordetella pertussis
cuggaacgcgccgcuggcg

SEQ ID NO: 2397095 - RNA, 21 nt, Bordetella pertussis
cuggaacggugcgagaucucg

SEQ ID NO: 2397096 - RNA, 22 nt, Bordetella pertussis
cuggaacguuugcggacgggcc

SEQ ID NO: 2397097 - RNA, 20 nt, Bordetella pertussis
cuggaacuugggaucggcca

SEQ ID NO: 2397098 - RNA, 21 nt, Bordetella pertussis
cuggaacuugggaucggccag

SEQ ID NO: 2397099 - RNA, 22 nt, Bordetella pertussis
cuggaagauguaccagcccagc

SEQ ID NO: 2397100 - RNA, 19 nt, Bordetella pertussis
cuggaagcgcgccaggcgc

SEQ ID NO: 2397101 - RNA, 18 nt, Bordetella pertussis
cuggacagugcccugacc

SEQ ID NO: 2397102 - RNA, 20 nt, Bordetella pertussis
cuggaccccuugcggccgcc

SEQ ID NO: 2397103 - RNA, 12 nt, Bordetella pertussis
cuggaccgcgcc

SEQ ID NO: 2397104 - RNA, 15 nt, Bordetella pertussis
cuggaccgcgccugg

SEQ ID NO: 2397105 - RNA, 16 nt, Bordetella pertussis
cuggaccgcgccuggg

SEQ ID NO: 2397106 - RNA, 14 nt, Bordetella pertussis
cuggaccgcgcgcg

SEQ ID NO: 2397107 - RNA, 16 nt, Bordetella pertussis
cuggaccggcuccggc

SEQ ID NO: 2397108 - RNA, 19 nt, Bordetella pertussis
cuggaccugagccaggcgc

SEQ ID NO: 2397109 - RNA, 21 nt, Bordetella pertussis
cuggaccugagccaggcgccc

SEQ ID NO: 2397110 - RNA, 23 nt, Bordetella pertussis
cuggaccugagccaggcgcccgg

SEQ ID NO: 2397111 - RNA, 20 nt, Bordetella pertussis
cuggaccuggccaccaacga

SEQ ID NO: 2397112 - RNA, 13 nt, Bordetella pertussis
cuggacgacgugc

SEQ ID NO: 2397113 - RNA, 16 nt, Bordetella pertussis
cuggacgagggccgcg

SEQ ID NO: 2397114 - RNA, 17 nt, Bordetella pertussis
cuggacgagggccgcgg

SEQ ID NO: 2397115 - RNA, 18 nt, Bordetella pertussis
cuggacgagggccgcggc

SEQ ID NO: 2397116 - RNA, 20 nt, Bordetella pertussis
cuggacgagggccgcggcga

SEQ ID NO: 2397117 - RNA, 22 nt, Bordetella pertussis
cuggacgagggccgcggcgagc

SEQ ID NO: 2397118 - RNA, 15 nt, Bordetella pertussis
cuggacgcccuggcg

SEQ ID NO: 2397119 - RNA, 21 nt, Bordetella pertussis
cuggacgcgccgaacaccagc

SEQ ID NO: 2397120 - RNA, 18 nt, Bordetella pertussis
cuggacgcgcgcggcgac

SEQ ID NO: 2397121 - RNA, 21 nt, Bordetella pertussis
cuggacgcgcgcggcgaccgc

SEQ ID NO: 2397122 - RNA, 15 nt, Bordetella pertussis
cuggacgcgcuggcc

SEQ ID NO: 2397123 - RNA, 17 nt, Bordetella pertussis
cuggacgcgcuggccga

SEQ ID NO: 2397124 - RNA, 15 nt, Bordetella pertussis
cuggacggcgcuggg

SEQ ID NO: 2397125 - RNA, 17 nt, Bordetella pertussis
cuggacggcgcugggga

SEQ ID NO: 2397126 - RNA, 16 nt, Bordetella pertussis
cuggacgggcuggaga

SEQ ID NO: 2397127 - RNA, 16 nt, Bordetella pertussis
cuggacgucugagcgc

SEQ ID NO: 2397128 - RNA, 18 nt, Bordetella pertussis
cuggacgucugagcgccg

SEQ ID NO: 2397129 - RNA, 20 nt, Bordetella pertussis
cuggacgucugagcgccggg

SEQ ID NO: 2397130 - RNA, 20 nt, Bordetella pertussis
cuggacuauggccuggaugu

SEQ ID NO: 2397131 - RNA, 21 nt, Bordetella pertussis
cuggacuguccggcaacacca

SEQ ID NO: 2397132 - RNA, 16 nt, Bordetella pertussis
cuggagaagcgccgcg

SEQ ID NO: 2397133 - RNA, 18 nt, Bordetella pertussis
cuggagaagcgccgcgcc

SEQ ID NO: 2397134 - RNA, 19 nt, Bordetella pertussis
cuggagacuggcaccggcc

SEQ ID NO: 2397135 - RNA, 21 nt, Bordetella pertussis
cuggagacuggcaccggccaa

SEQ ID NO: 2397136 - RNA, 20 nt, Bordetella pertussis
cuggagaucgccgagcggca

SEQ ID NO: 2397137 - RNA, 14 nt, Bordetella pertussis
cuggagaucgccgc

SEQ ID NO: 2397138 - RNA, 14 nt, Bordetella pertussis
cuggagauggcgcc

SEQ ID NO: 2397139 - RNA, 22 nt, Bordetella pertussis
cuggagauggguacagcgcgcc

SEQ ID NO: 2397140 - RNA, 19 nt, Bordetella pertussis
cuggagcgccacgccguca

SEQ ID NO: 2397141 - RNA, 14 nt, Bordetella pertussis
cuggagcgcggcgg

SEQ ID NO: 2397142 - RNA, 17 nt, Bordetella pertussis
cuggagcggccuggccc

SEQ ID NO: 2397143 - RNA, 16 nt, Bordetella pertussis
cuggagcucggguggg

SEQ ID NO: 2397144 - RNA, 21 nt, Bordetella pertussis
cuggagcucuaugucgccggc

SEQ ID NO: 2397145 - RNA, 23 nt, Bordetella pertussis
cuggagcucuaugucgccggcca

SEQ ID NO: 2397146 - RNA, 16 nt, Bordetella pertussis
cuggugaucugcugcg

SEQ ID NO: 2397147 - RNA, 19 nt, Bordetella pertussis
cuggugaucugcugcgugg

SEQ ID NO: 2397148 - RNA, 18 nt, Bordetella pertussis
cuggugauguccugcagg

SEQ ID NO: 2397149 - RNA, 15 nt, Bordetella pertussis
cuggugcaccacgcg

SEQ ID NO: 2397150 - RNA, 20 nt, Bordetella pertussis
cuggugcacgaugcccaggg

SEQ ID NO: 2397151 - RNA, 14 nt, Bordetella pertussis
cuggugcacgccga

SEQ ID NO: 2397152 - RNA, 20 nt, Bordetella pertussis
cuggugccaguccccgcaug

SEQ ID NO: 2397153 - RNA, 16 nt, Bordetella pertussis
cuggugcccgacgccg

SEQ ID NO: 2397154 - RNA, 17 nt, Bordetella pertussis
cuggugcccgacgccgc

SEQ ID NO: 2397155 - RNA, 19 nt, Bordetella pertussis
cuggugccgguugcgcgcc

SEQ ID NO: 2397156 - RNA, 20 nt, Bordetella pertussis
cuggugccgguugcgcgccg

SEQ ID NO: 2397157 - RNA, 16 nt, Bordetella pertussis
cuggugcgccgugccc

SEQ ID NO: 2397158 - RNA, 19 nt, Bordetella pertussis
cuggugcgccgugcccggc

SEQ ID NO: 2397159 - RNA, 16 nt, Bordetella pertussis
cuggugcgcuaccgcu

SEQ ID NO: 2397160 - RNA, 14 nt, Bordetella pertussis
cuggugcuggugcc

SEQ ID NO: 2397161 - RNA, 19 nt, Bordetella pertussis
cuggugcuggugccgcugg

SEQ ID NO: 2397162 - RNA, 14 nt, Bordetella pertussis
cuggugcuggugcu

SEQ ID NO: 2397163 - RNA, 19 nt, Bordetella pertussis
cugguggaccugccguucg

SEQ ID NO: 2397164 - RNA, 18 nt, Bordetella pertussis
cugguggccaccagcccc

SEQ ID NO: 2397165 - RNA, 18 nt, Bordetella pertussis
cugguggcgauccaugug

SEQ ID NO: 2397166 - RNA, 22 nt, Bordetella pertussis
cugguggcgauccauguggcca

SEQ ID NO: 2397167 - RNA, 22 nt, Bordetella pertussis
cuggugggccgacggcucgcgc

SEQ ID NO: 2397168 - RNA, 16 nt, Bordetella pertussis
cugguggugccgcgca

SEQ ID NO: 2397169 - RNA, 23 nt, Bordetella pertussis
cugguggugccguucccgccggg

SEQ ID NO: 2397170 - RNA, 16 nt, Bordetella pertussis
cugguggugggcgugc

SEQ ID NO: 2397171 - RNA, 15 nt, Bordetella pertussis
cugguucaggcgagc

SEQ ID NO: 2397172 - RNA, 12 nt, Bordetella pertussis
cugguucauguc

SEQ ID NO: 2397173 - RNA, 16 nt, Bordetella pertussis
cugguugagcagcacc

SEQ ID NO: 2397174 - RNA, 22 nt, Bordetella pertussis
cugguuggccgccuggcuuucg

SEQ ID NO: 2397175 - RNA, 21 nt, Bordetella pertussis
cugguuguccaccacccaggc

SEQ ID NO: 2397176 - RNA, 22 nt, Bordetella pertussis
cugguuuucggacgcagcuucu

SEQ ID NO: 2397177 - RNA, 22 nt, Bordetella pertussis
cuguaacaacacguacgaccgc

SEQ ID NO: 2397178 - RNA, 17 nt, Bordetella pertussis
cuguaccgcgcgauguc

SEQ ID NO: 2397179 - RNA, 23 nt, Bordetella pertussis
cuguaccgcgcgaugucgaauuc

SEQ ID NO: 2397180 - RNA, 18 nt, Bordetella pertussis
cuguaccgguagcccgcg

SEQ ID NO: 2397181 - RNA, 19 nt, Bordetella pertussis
cuguaccgguagcccgcgu

SEQ ID NO: 2397182 - RNA, 13 nt, Bordetella pertussis
cuguacggccggc

SEQ ID NO: 2397183 - RNA, 19 nt, Bordetella pertussis
cuguacggccggcuccgcu

SEQ ID NO: 2397184 - RNA, 18 nt, Bordetella pertussis
cuguacugguaccaggcg

SEQ ID NO: 2397185 - RNA, 16 nt, Bordetella pertussis
cuguagaggcgcggcu

SEQ ID NO: 2397186 - RNA, 16 nt, Bordetella pertussis
cuguagucgccgcugc

SEQ ID NO: 2397187 - RNA, 14 nt, Bordetella pertussis
cuguaucagcgccu

SEQ ID NO: 2397188 - RNA, 15 nt, Bordetella pertussis
cuguaucuggccugu

SEQ ID NO: 2397189 - RNA, 13 nt, Bordetella pertussis
cuguauuccugac

SEQ ID NO: 2397190 - RNA, 18 nt, Bordetella pertussis
cugucaauagguuguauu

SEQ ID NO: 2397191 - RNA, 17 nt, Bordetella pertussis
cugucauacgccaugaa

SEQ ID NO: 2397192 - RNA, 22 nt, Bordetella pertussis
cugucaugguuucgucaccgaa

SEQ ID NO: 2397193 - RNA, 19 nt, Bordetella pertussis
cuguccaagcgcguggcca

SEQ ID NO: 2397194 - RNA, 13 nt, Bordetella pertussis
cuguccacgccga

SEQ ID NO: 2397195 - RNA, 12 nt, Bordetella pertussis
cuguccaggccg

SEQ ID NO: 2397196 - RNA, 13 nt, Bordetella pertussis
cuguccaggccgg

SEQ ID NO: 2397197 - RNA, 17 nt, Bordetella pertussis
cuguccauauauauagg

SEQ ID NO: 2397198 - RNA, 18 nt, Bordetella pertussis
cugucccaauccgcgaag

SEQ ID NO: 2397199 - RNA, 17 nt, Bordetella pertussis
cugucccagauggcgcc

SEQ ID NO: 2397200 - RNA, 14 nt, Bordetella pertussis
cugucccagcgggg

SEQ ID NO: 2397201 - RNA, 17 nt, Bordetella pertussis
cugucccagcggggaca

SEQ ID NO: 2397202 - RNA, 13 nt, Bordetella pertussis
cugucccaggcgc

SEQ ID NO: 2397203 - RNA, 14 nt, Bordetella pertussis
cuguccccacaggg

SEQ ID NO: 2397204 - RNA, 16 nt, Bordetella pertussis
cuguccccacaggggg

SEQ ID NO: 2397205 - RNA, 17 nt, Bordetella pertussis
cuguccccacaggggga

SEQ ID NO: 2397206 - RNA, 14 nt, Bordetella pertussis
cuguccccaccggg

SEQ ID NO: 2397207 - RNA, 23 nt, Bordetella pertussis
cuguccccaccgggacaggcacc

SEQ ID NO: 2397208 - RNA, 17 nt, Bordetella pertussis
cuguccccacggggaca

SEQ ID NO: 2397209 - RNA, 19 nt, Bordetella pertussis
cuguccccacggggacagg

SEQ ID NO: 2397210 - RNA, 22 nt, Bordetella pertussis
cuguccccacggggacaggcac

SEQ ID NO: 2397211 - RNA, 23 nt, Bordetella pertussis
cuguccccacggggacaggcacc

SEQ ID NO: 2397212 - RNA, 14 nt, Bordetella pertussis
cuguccccacgugg

SEQ ID NO: 2397213 - RNA, 19 nt, Bordetella pertussis
cuguccccacguggacagg

SEQ ID NO: 2397214 - RNA, 23 nt, Bordetella pertussis
cuguccccacguggacaggcacc

SEQ ID NO: 2397215 - RNA, 14 nt, Bordetella pertussis
cuguccccacuggg

SEQ ID NO: 2397216 - RNA, 13 nt, Bordetella pertussis
cuguccccgaacg

SEQ ID NO: 2397217 - RNA, 18 nt, Bordetella pertussis
cuguccccgcaaggggga

SEQ ID NO: 2397218 - RNA, 20 nt, Bordetella pertussis
cuguccccgcagggacaggc

SEQ ID NO: 2397219 - RNA, 23 nt, Bordetella pertussis
cuguccccgcagggacaggcacc

SEQ ID NO: 2397220 - RNA, 14 nt, Bordetella pertussis
cuguccccgcaugg

SEQ ID NO: 2397221 - RNA, 15 nt, Bordetella pertussis
cuguccccgcaugga

SEQ ID NO: 2397222 - RNA, 16 nt, Bordetella pertussis
cuguccccgccgggac

SEQ ID NO: 2397223 - RNA, 22 nt, Bordetella pertussis
cuguccccgccgggacaggcac

SEQ ID NO: 2397224 - RNA, 21 nt, Bordetella pertussis
cuguccccgcgcggggggcug

SEQ ID NO: 2397225 - RNA, 15 nt, Bordetella pertussis
cuguccccgcggagg

SEQ ID NO: 2397226 - RNA, 15 nt, Bordetella pertussis
cuguccccgcgggga

SEQ ID NO: 2397227 - RNA, 17 nt, Bordetella pertussis
cuguccccgcggggaca

SEQ ID NO: 2397228 - RNA, 23 nt, Bordetella pertussis
cuguccccgcggggacagauacc

SEQ ID NO: 2397229 - RNA, 19 nt, Bordetella pertussis
cuguccccgcggggacagg

SEQ ID NO: 2397230 - RNA, 23 nt, Bordetella pertussis
cuguccccgcggggacaggcacc

SEQ ID NO: 2397231 - RNA, 17 nt, Bordetella pertussis
cuguccccgcugcggca

SEQ ID NO: 2397232 - RNA, 18 nt, Bordetella pertussis
cuguccccgcugcggcaa

SEQ ID NO: 2397233 - RNA, 20 nt, Bordetella pertussis
cuguccccgcugggacaggc

SEQ ID NO: 2397234 - RNA, 23 nt, Bordetella pertussis
cuguccccgcugggacaggcaca

SEQ ID NO: 2397235 - RNA, 23 nt, Bordetella pertussis
cuguccccgcugggacaggcacu

SEQ ID NO: 2397236 - RNA, 20 nt, Bordetella pertussis
cuguccccgucgggacaggc

SEQ ID NO: 2397237 - RNA, 14 nt, Bordetella pertussis
cuguccccgugggg

SEQ ID NO: 2397238 - RNA, 19 nt, Bordetella pertussis
cuguccccguggggacagg

SEQ ID NO: 2397239 - RNA, 23 nt, Bordetella pertussis
cuguccccguggggacaggcacc

SEQ ID NO: 2397240 - RNA, 14 nt, Bordetella pertussis
cugucccgacgggg

SEQ ID NO: 2397241 - RNA, 15 nt, Bordetella pertussis
cugucccggcgggga

SEQ ID NO: 2397242 - RNA, 19 nt, Bordetella pertussis
cugucccggcggggacagg

SEQ ID NO: 2397243 - RNA, 23 nt, Bordetella pertussis
cugucccggcugggacaggcacc

SEQ ID NO: 2397244 - RNA, 15 nt, Bordetella pertussis
cugucccugcgggga

SEQ ID NO: 2397245 - RNA, 18 nt, Bordetella pertussis
cugucccugcgggggcag

SEQ ID NO: 2397246 - RNA, 20 nt, Bordetella pertussis
cugucccugcgggggcaggc

SEQ ID NO: 2397247 - RNA, 23 nt, Bordetella pertussis
cugucccugcgggggcaggcacg

SEQ ID NO: 2397248 - RNA, 17 nt, Bordetella pertussis
cuguccgaugcgcugcu

SEQ ID NO: 2397249 - RNA, 23 nt, Bordetella pertussis
cuguccgaugcgcugcuggaggc

SEQ ID NO: 2397250 - RNA, 19 nt, Bordetella pertussis
cuguccgccaccagaucga

SEQ ID NO: 2397251 - RNA, 20 nt, Bordetella pertussis
cuguccggcgcucgccccgg

SEQ ID NO: 2397252 - RNA, 21 nt, Bordetella pertussis
cuguccggcgcucgccccggc

SEQ ID NO: 2397253 - RNA, 15 nt, Bordetella pertussis
cuguccggcgcuggc

SEQ ID NO: 2397254 - RNA, 13 nt, Bordetella pertussis
cuguccguggcca

SEQ ID NO: 2397255 - RNA, 13 nt, Bordetella pertussis
cuguccuccccgc

SEQ ID NO: 2397256 - RNA, 15 nt, Bordetella pertussis
cuguccuccccgcug

SEQ ID NO: 2397257 - RNA, 22 nt, Bordetella pertussis
cugucgcagucggggccgcagc

SEQ ID NO: 2397258 - RNA, 15 nt, Bordetella pertussis
cugucgccacgggcg

SEQ ID NO: 2397259 - RNA, 16 nt, Bordetella pertussis
cugucgccacgggcgu

SEQ ID NO: 2397260 - RNA, 18 nt, Bordetella pertussis
cugucgccacgggcguca

SEQ ID NO: 2397261 - RNA, 19 nt, Bordetella pertussis
cugucgcgccacggcuucg

SEQ ID NO: 2397262 - RNA, 17 nt, Bordetella pertussis
cugucgcgcuacagcgu

SEQ ID NO: 2397263 - RNA, 13 nt, Bordetella pertussis
cugucgcgcugcu

SEQ ID NO: 2397264 - RNA, 16 nt, Bordetella pertussis
cugucgcgcugcuuuc

SEQ ID NO: 2397265 - RNA, 15 nt, Bordetella pertussis
cugucgcgggagauc

SEQ ID NO: 2397266 - RNA, 19 nt, Bordetella pertussis
cugucgcucaugaccagcg

SEQ ID NO: 2397267 - RNA, 22 nt, Bordetella pertussis
cugucgcucaugaccagcggcg

SEQ ID NO: 2397268 - RNA, 14 nt, Bordetella pertussis
cugucgcugaucug

SEQ ID NO: 2397269 - RNA, 22 nt, Bordetella pertussis
cugucggccgaaccgcgcagcc

SEQ ID NO: 2397270 - RNA, 13 nt, Bordetella pertussis
cugucggcguucc

SEQ ID NO: 2397271 - RNA, 17 nt, Bordetella pertussis
cugucggcguuccuggc

SEQ ID NO: 2397272 - RNA, 19 nt, Bordetella pertussis
cugucggcguuccuggcgc

SEQ ID NO: 2397273 - RNA, 22 nt, Bordetella pertussis
cugucgggcggcggcguggcgg

SEQ ID NO: 2397274 - RNA, 20 nt, Bordetella pertussis
cugucguucguauugcugcu

SEQ ID NO: 2397275 - RNA, 18 nt, Bordetella pertussis
cugugcagccacgccugg

SEQ ID NO: 2397276 - RNA, 23 nt, Bordetella pertussis
cugugcagccacgccuggccgcg

SEQ ID NO: 2397277 - RNA, 14 nt, Bordetella pertussis
cugugccagcuggc

SEQ ID NO: 2397278 - RNA, 16 nt, Bordetella pertussis
cugugccagcuggccc

SEQ ID NO: 2397279 - RNA, 19 nt, Bordetella pertussis
cugugccagcuggcccagu

SEQ ID NO: 2397280 - RNA, 20 nt, Bordetella pertussis
cugugccccacacgcgcgca

SEQ ID NO: 2397281 - RNA, 23 nt, Bordetella pertussis
cugugcccgcagagggagcgaca

SEQ ID NO: 2397282 - RNA, 13 nt, Bordetella pertussis
cugugcccgcccc

SEQ ID NO: 2397283 - RNA, 20 nt, Bordetella pertussis
cugugcgauggcacggcacg

SEQ ID NO: 2397284 - RNA, 12 nt, Bordetella pertussis
cugugcgcggcg

SEQ ID NO: 2397285 - RNA, 16 nt, Bordetella pertussis
cugugcgcguuccggc

SEQ ID NO: 2397286 - RNA, 21 nt, Bordetella pertussis
cugugcgcguuccggccgcgc

SEQ ID NO: 2397287 - RNA, 16 nt, Bordetella pertussis
cuguggacgccgccgg

SEQ ID NO: 2397288 - RNA, 15 nt, Bordetella pertussis
cuguggccgcggccc

SEQ ID NO: 2397289 - RNA, 18 nt, Bordetella pertussis
cuguggccgcggcccagc

SEQ ID NO: 2397290 - RNA, 20 nt, Bordetella pertussis
cuguggccgcggcccagcgc

SEQ ID NO: 2397291 - RNA, 16 nt, Bordetella pertussis
cugugggggcgcggcg

SEQ ID NO: 2397292 - RNA, 18 nt, Bordetella pertussis
cugugggggcgcggcggc

SEQ ID NO: 2397293 - RNA, 15 nt, Bordetella pertussis
cuguguccacgaacg

SEQ ID NO: 2397294 - RNA, 15 nt, Bordetella pertussis
cuguguugauccgcc

SEQ ID NO: 2397295 - RNA, 20 nt, Bordetella pertussis
cuguucgcgcagcaggccgc

SEQ ID NO: 2397296 - RNA, 21 nt, Bordetella pertussis
cuguucgcgcagcaggccgcg

SEQ ID NO: 2397297 - RNA, 21 nt, Bordetella pertussis
cuguucggcgaccgccggccg

SEQ ID NO: 2397298 - RNA, 15 nt, Bordetella pertussis
cuguucggcgagccg

SEQ ID NO: 2397299 - RNA, 20 nt, Bordetella pertussis
cuguucggcgagccgggcac

SEQ ID NO: 2397300 - RNA, 15 nt, Bordetella pertussis
cuguucggcgaugcg

SEQ ID NO: 2397301 - RNA, 21 nt, Bordetella pertussis
cuguucggcgaugcgggcggc

SEQ ID NO: 2397302 - RNA, 20 nt, Bordetella pertussis
cuguucgggcgcggugcgca

SEQ ID NO: 2397303 - RNA, 20 nt, Bordetella pertussis
cuguucguagucgagccagg

SEQ ID NO: 2397304 - RNA, 11 nt, Bordetella pertussis
cuguugaggau

SEQ ID NO: 2397305 - RNA, 12 nt, Bordetella pertussis
cuguugcagcgg

SEQ ID NO: 2397306 - RNA, 13 nt, Bordetella pertussis
cuguugcccacca

SEQ ID NO: 2397307 - RNA, 17 nt, Bordetella pertussis
cuguugcccaccagccg

SEQ ID NO: 2397308 - RNA, 23 nt, Bordetella pertussis
cuguugcccaccagccgggcggc

SEQ ID NO: 2397309 - RNA, 21 nt, Bordetella pertussis
cuguugcuccaggccggcaug

SEQ ID NO: 2397310 - RNA, 14 nt, Bordetella pertussis
cuguuggccggcgc

SEQ ID NO: 2397311 - RNA, 18 nt, Bordetella pertussis
cuguuggccgucgccagc

SEQ ID NO: 2397312 - RNA, 14 nt, Bordetella pertussis
cuguuggucagguc

SEQ ID NO: 2397313 - RNA, 19 nt, Bordetella pertussis
cuguuucccuuccuggcca

SEQ ID NO: 2397314 - RNA, 16 nt, Bordetella pertussis
cuguuuccgggccugg

SEQ ID NO: 2397315 - RNA, 19 nt, Bordetella pertussis
cuguuuccgggccuggccu

SEQ ID NO: 2397316 - RNA, 23 nt, Bordetella pertussis
cuguuuccgggccuggccugcgc

SEQ ID NO: 2397317 - RNA, 21 nt, Bordetella pertussis
cuguuuuucauuugccgccug

SEQ ID NO: 2397318 - RNA, 13 nt, Bordetella pertussis
cuuaccgcgccgg

SEQ ID NO: 2397319 - RNA, 17 nt, Bordetella pertussis
cuuacgcggcgcgcgcc

SEQ ID NO: 2397320 - RNA, 20 nt, Bordetella pertussis
cuuacggauaauugggcggc

SEQ ID NO: 2397321 - RNA, 20 nt, Bordetella pertussis
cuuacuggaucuuggccugu

SEQ ID NO: 2397322 - RNA, 14 nt, Bordetella pertussis
cuuagcgcagcagc

SEQ ID NO: 2397323 - RNA, 16 nt, Bordetella pertussis
cuucacauagcccggc

SEQ ID NO: 2397324 - RNA, 15 nt, Bordetella pertussis
cuucaccuugccgcu

SEQ ID NO: 2397325 - RNA, 20 nt, Bordetella pertussis
cuucaccuugccgcugguga

SEQ ID NO: 2397326 - RNA, 18 nt, Bordetella pertussis
cuucacgaaccgcagaag

SEQ ID NO: 2397327 - RNA, 19 nt, Bordetella pertussis
cuucacgacacgcccagca

SEQ ID NO: 2397328 - RNA, 18 nt, Bordetella pertussis
cuucacguagccggccag

SEQ ID NO: 2397329 - RNA, 17 nt, Bordetella pertussis
cuucagcauggagcugg

SEQ ID NO: 2397330 - RNA, 14 nt, Bordetella pertussis
cuucagccagcgau

SEQ ID NO: 2397331 - RNA, 20 nt, Bordetella pertussis
cuucagcccggcgacguugc

SEQ ID NO: 2397332 - RNA, 14 nt, Bordetella pertussis
cuucagccugggcc

SEQ ID NO: 2397333 - RNA, 14 nt, Bordetella pertussis
cuucagcgggccgg

SEQ ID NO: 2397334 - RNA, 17 nt, Bordetella pertussis
cuucagcgggccggcac

SEQ ID NO: 2397335 - RNA, 22 nt, Bordetella pertussis
cuucaggccguuuacuccccag

SEQ ID NO: 2397336 - RNA, 16 nt, Bordetella pertussis
cuucaggcgccgcaga

SEQ ID NO: 2397337 - RNA, 13 nt, Bordetella pertussis
cuucaggcgcgcg

SEQ ID NO: 2397338 - RNA, 17 nt, Bordetella pertussis
cuucaggcgcgcggcag

SEQ ID NO: 2397339 - RNA, 19 nt, Bordetella pertussis
cuucagguagguggacacg

SEQ ID NO: 2397340 - RNA, 15 nt, Bordetella pertussis
cuucagguuccaggu

SEQ ID NO: 2397341 - RNA, 21 nt, Bordetella pertussis
cuucagugcucgggcugcggc

SEQ ID NO: 2397342 - RNA, 14 nt, Bordetella pertussis
cuucaguuccaggc

SEQ ID NO: 2397343 - RNA, 18 nt, Bordetella pertussis
cuucaguugacgccggcg

SEQ ID NO: 2397344 - RNA, 20 nt, Bordetella pertussis
cuucaguugacgccggcggc

SEQ ID NO: 2397345 - RNA, 14 nt, Bordetella pertussis
cuucauccaggcgc

SEQ ID NO: 2397346 - RNA, 18 nt, Bordetella pertussis
cuucaucgucgaggaugc

SEQ ID NO: 2397347 - RNA, 16 nt, Bordetella pertussis
cuucaugccggcguug

SEQ ID NO: 2397348 - RNA, 23 nt, Bordetella pertussis
cuucauggcgucguccagcuugg

SEQ ID NO: 2397349 - RNA, 15 nt, Bordetella pertussis
cuucauuuccugguu

SEQ ID NO: 2397350 - RNA, 17 nt, Bordetella pertussis
cuuccagaucgaccagg

SEQ ID NO: 2397351 - RNA, 16 nt, Bordetella pertussis
cuuccagcagcaugcc

SEQ ID NO: 2397352 - RNA, 16 nt, Bordetella pertussis
cuuccagcagggcggc

SEQ ID NO: 2397353 - RNA, 20 nt, Bordetella pertussis
cuuccagcagggcggcgucg

SEQ ID NO: 2397354 - RNA, 12 nt, Bordetella pertussis
cuuccagcgcau

SEQ ID NO: 2397355 - RNA, 20 nt, Bordetella pertussis
cuuccagcgcauuggugagc

SEQ ID NO: 2397356 - RNA, 22 nt, Bordetella pertussis
cuuccagcgcauuggugagcac

SEQ ID NO: 2397357 - RNA, 23 nt, Bordetella pertussis
cuuccagcgcauuggugagcacg

SEQ ID NO: 2397358 - RNA, 16 nt, Bordetella pertussis
cuuccagcgccugcuc

SEQ ID NO: 2397359 - RNA, 16 nt, Bordetella pertussis
cuuccaggaguuccca

SEQ ID NO: 2397360 - RNA, 20 nt, Bordetella pertussis
cuucucggugcgccgccgcc

SEQ ID NO: 2397361 - RNA, 12 nt, Bordetella pertussis
cuucucuuucuc

SEQ ID NO: 2397362 - RNA, 13 nt, Bordetella pertussis
cuucugcaaggcc

SEQ ID NO: 2397363 - RNA, 16 nt, Bordetella pertussis
cuucugcaaggccugc

SEQ ID NO: 2397364 - RNA, 19 nt, Bordetella pertussis
cuucugcaaggccugcugc

SEQ ID NO: 2397365 - RNA, 14 nt, Bordetella pertussis
cuucugcaucggca

SEQ ID NO: 2397366 - RNA, 19 nt, Bordetella pertussis
cuucugccagacggccagc

SEQ ID NO: 2397367 - RNA, 22 nt, Bordetella pertussis
cuucugccagacggccagcgcg

SEQ ID NO: 2397368 - RNA, 13 nt, Bordetella pertussis
cuucugccgccag

SEQ ID NO: 2397369 - RNA, 13 nt, Bordetella pertussis
cuucugcgccacg

SEQ ID NO: 2397370 - RNA, 15 nt, Bordetella pertussis
cuucugcgccagcgg

SEQ ID NO: 2397371 - RNA, 14 nt, Bordetella pertussis
cuucuggacgcuga

SEQ ID NO: 2397372 - RNA, 17 nt, Bordetella pertussis
cuucuggacuugcggca

SEQ ID NO: 2397373 - RNA, 12 nt, Bordetella pertussis
cuucugggucag

SEQ ID NO: 2397374 - RNA, 18 nt, Bordetella pertussis
cuucugguaguuggccag

SEQ ID NO: 2397375 - RNA, 14 nt, Bordetella pertussis
cuucuucagcuugg

SEQ ID NO: 2397376 - RNA, 17 nt, Bordetella pertussis
cuucuuccuugcgaugc

SEQ ID NO: 2397377 - RNA, 20 nt, Bordetella pertussis
cuucuuccuugcgaugccag

SEQ ID NO: 2397378 - RNA, 20 nt, Bordetella pertussis
cuucuucuuugcccuggcca

SEQ ID NO: 2397379 - RNA, 20 nt, Bordetella pertussis
cuucuugaacagcucggccc

SEQ ID NO: 2397380 - RNA, 19 nt, Bordetella pertussis
cuucuugaacucggccagc

SEQ ID NO: 2397381 - RNA, 21 nt, Bordetella pertussis
cuucuugaacucggccagcag

SEQ ID NO: 2397382 - RNA, 22 nt, Bordetella pertussis
cuucuuggcgaccaggcccacg

SEQ ID NO: 2397383 - RNA, 21 nt, Bordetella pertussis
cuugaaaaaucgggugcugcg

SEQ ID NO: 2397384 - RNA, 13 nt, Bordetella pertussis
cuugaacagcucg

SEQ ID NO: 2397385 - RNA, 22 nt, Bordetella pertussis
cuugaaccccggcugcgcggcc

SEQ ID NO: 2397386 - RNA, 12 nt, Bordetella pertussis
cuugaagacgcc

SEQ ID NO: 2397387 - RNA, 15 nt, Bordetella pertussis
cuugaagacgcccag

SEQ ID NO: 2397388 - RNA, 17 nt, Bordetella pertussis
cuugaccacggccagca

SEQ ID NO: 2397389 - RNA, 20 nt, Bordetella pertussis
cuugaccacggccagcagca

SEQ ID NO: 2397390 - RNA, 23 nt, Bordetella pertussis
cuugaccaguucgcgcagcgccg

SEQ ID NO: 2397391 - RNA, 17 nt, Bordetella pertussis
cuugaccgacgugcugc

SEQ ID NO: 2397392 - RNA, 19 nt, Bordetella pertussis
cuugaccgacgugcugcug

SEQ ID NO: 2397393 - RNA, 18 nt, Bordetella pertussis
cuugaccgccagcaucca

SEQ ID NO: 2397394 - RNA, 17 nt, Bordetella pertussis
cuugaccgccuccagga

SEQ ID NO: 2397395 - RNA, 12 nt, Bordetella pertussis
cuugaccugggc

SEQ ID NO: 2397396 - RNA, 17 nt, Bordetella pertussis
cuugaccugggccagca

SEQ ID NO: 2397397 - RNA, 18 nt, Bordetella pertussis
cuugaccugggccagcag

SEQ ID NO: 2397398 - RNA, 14 nt, Bordetella pertussis
cuugaccuggucgg

SEQ ID NO: 2397399 - RNA, 17 nt, Bordetella pertussis
cuugaccuugagcacgc

SEQ ID NO: 2397400 - RNA, 17 nt, Bordetella pertussis
cuugaccuuggcuugca

SEQ ID NO: 2397401 - RNA, 23 nt, Bordetella pertussis
cuugaccuuggcuugcagcgccu

SEQ ID NO: 2397402 - RNA, 15 nt, Bordetella pertussis
cuugacgcgcaggcc

SEQ ID NO: 2397403 - RNA, 11 nt, Bordetella pertussis
cuugacgcgcg

SEQ ID NO: 2397404 - RNA, 13 nt, Bordetella pertussis
cuugacgcgcgcg

SEQ ID NO: 2397405 - RNA, 14 nt, Bordetella pertussis
cuugacggccaaga

SEQ ID NO: 2397406 - RNA, 14 nt, Bordetella pertussis
cuugacggccagga

SEQ ID NO: 2397407 - RNA, 22 nt, Bordetella pertussis
cuugacguagcggaucgcggcg

SEQ ID NO: 2397408 - RNA, 12 nt, Bordetella pertussis
cuugacguccag

SEQ ID NO: 2397409 - RNA, 15 nt, Bordetella pertussis
cuugacguccagcca

SEQ ID NO: 2397410 - RNA, 17 nt, Bordetella pertussis
cuugacguccagccagg

SEQ ID NO: 2397411 - RNA, 17 nt, Bordetella pertussis
cuugacguccagcgacu

SEQ ID NO: 2397412 - RNA, 19 nt, Bordetella pertussis
cuugagauacuugcgcagc

SEQ ID NO: 2397413 - RNA, 16 nt, Bordetella pertussis
cuugagaugccagcgg

SEQ ID NO: 2397414 - RNA, 18 nt, Bordetella pertussis
cuugagcacggcgcggcu

SEQ ID NO: 2397415 - RNA, 16 nt, Bordetella pertussis
cuugagcacguccagc

SEQ ID NO: 2397416 - RNA, 14 nt, Bordetella pertussis
cuugagcagcgccu

SEQ ID NO: 2397417 - RNA, 14 nt, Bordetella pertussis
cuugagcgccagcu

SEQ ID NO: 2397418 - RNA, 13 nt, Bordetella pertussis
cuugagcgcggcc

SEQ ID NO: 2397419 - RNA, 21 nt, Bordetella pertussis
cuugagcgcggccucgccggc

SEQ ID NO: 2397420 - RNA, 15 nt, Bordetella pertussis
cuugagcggcccggg

SEQ ID NO: 2397421 - RNA, 20 nt, Bordetella pertussis
cuugagcguggcguccaugc

SEQ ID NO: 2397422 - RNA, 19 nt, Bordetella pertussis
cuugaggaacuggacggcg

SEQ ID NO: 2397423 - RNA, 20 nt, Bordetella pertussis
cuugaggauaucggccaggc

SEQ ID NO: 2397424 - RNA, 14 nt, Bordetella pertussis
cuugaggcugguga

SEQ ID NO: 2397425 - RNA, 19 nt, Bordetella pertussis
cuugaguuuggcgaaggcg

SEQ ID NO: 2397426 - RNA, 16 nt, Bordetella pertussis
cuugaucagcggcggc

SEQ ID NO: 2397427 - RNA, 17 nt, Bordetella pertussis
cuugaucagcggcggca

SEQ ID NO: 2397428 - RNA, 19 nt, Bordetella pertussis
cuugaucagcggcggcacg

SEQ ID NO: 2397429 - RNA, 14 nt, Bordetella pertussis
cuugaucagggcca

SEQ ID NO: 2397430 - RNA, 12 nt, Bordetella pertussis
cuugauccagga

SEQ ID NO: 2397431 - RNA, 17 nt, Bordetella pertussis
cuugaugccgcccagca

SEQ ID NO: 2397432 - RNA, 18 nt, Bordetella pertussis
cuugaugccgcccagcau

SEQ ID NO: 2397433 - RNA, 14 nt, Bordetella pertussis
cuugaugccgccga

SEQ ID NO: 2397434 - RNA, 16 nt, Bordetella pertussis
cuugauggccagcgcg

SEQ ID NO: 2397435 - RNA, 17 nt, Bordetella pertussis
cuugcagcggacggcgc

SEQ ID NO: 2397436 - RNA, 13 nt, Bordetella pertussis
cuugcaggccgcg

SEQ ID NO: 2397437 - RNA, 14 nt, Bordetella pertussis
cuugcaggcgccag

SEQ ID NO: 2397438 - RNA, 18 nt, Bordetella pertussis
cuugcaggcgccaguccc

SEQ ID NO: 2397439 - RNA, 15 nt, Bordetella pertussis
cuugccacuauuuuc

SEQ ID NO: 2397440 - RNA, 15 nt, Bordetella pertussis
cuugccagcucgacg

SEQ ID NO: 2397441 - RNA, 23 nt, Bordetella pertussis
cuugccagcucgacgcgcugauc

SEQ ID NO: 2397442 - RNA, 15 nt, Bordetella pertussis
cuugccaggcccggc

SEQ ID NO: 2397443 - RNA, 16 nt, Bordetella pertussis
cuugccagggccuggc

SEQ ID NO: 2397444 - RNA, 17 nt, Bordetella pertussis
cuugccagggccuggca

SEQ ID NO: 2397445 - RNA, 23 nt, Bordetella pertussis
cuugccauaaggcuucucgacca

SEQ ID NO: 2397446 - RNA, 17 nt, Bordetella pertussis
cuugccauaggccagcg

SEQ ID NO: 2397447 - RNA, 18 nt, Bordetella pertussis
cuugccauaggccagcgc

SEQ ID NO: 2397448 - RNA, 17 nt, Bordetella pertussis
cuugccauccagccagg

SEQ ID NO: 2397449 - RNA, 23 nt, Bordetella pertussis
cuugccauccagccaggccgcau

SEQ ID NO: 2397450 - RNA, 16 nt, Bordetella pertussis
cuugcccagcagcucc

SEQ ID NO: 2397451 - RNA, 21 nt, Bordetella pertussis
cuugcccagcagcuccucggc

SEQ ID NO: 2397452 - RNA, 22 nt, Bordetella pertussis
cuugcccagcagcuccucggcc

SEQ ID NO: 2397453 - RNA, 15 nt, Bordetella pertussis
cuugcccaggccggc

SEQ ID NO: 2397454 - RNA, 20 nt, Bordetella pertussis
cuugcccaggccggcgcgcu

SEQ ID NO: 2397455 - RNA, 14 nt, Bordetella pertussis
cuugcccaggcugg

SEQ ID NO: 2397456 - RNA, 16 nt, Bordetella pertussis
cuugcccaggcugggc

SEQ ID NO: 2397457 - RNA, 17 nt, Bordetella pertussis
cuugcccaggcugggcc

SEQ ID NO: 2397458 - RNA, 20 nt, Bordetella pertussis
cuugcccaggcugggccaga

SEQ ID NO: 2397459 - RNA, 14 nt, Bordetella pertussis
cuugcccgagaugc

SEQ ID NO: 2397460 - RNA, 21 nt, Bordetella pertussis
cuugcccgagaugcccgacgc

SEQ ID NO: 2397461 - RNA, 15 nt, Bordetella pertussis
cuugcccgccagcgc

SEQ ID NO: 2397462 - RNA, 14 nt, Bordetella pertussis
cuugcccgcgcgca

SEQ ID NO: 2397463 - RNA, 15 nt, Bordetella pertussis
cuugcccgggcuggc

SEQ ID NO: 2397464 - RNA, 19 nt, Bordetella pertussis
cuugcccgggcuggccgcc

SEQ ID NO: 2397465 - RNA, 22 nt, Bordetella pertussis
cuugcccgugcgugugccuguc

SEQ ID NO: 2397466 - RNA, 16 nt, Bordetella pertussis
cuugcccuuggcggcc

SEQ ID NO: 2397467 - RNA, 20 nt, Bordetella pertussis
cuugccgaagauucccgcgc

SEQ ID NO: 2397468 - RNA, 23 nt, Bordetella pertussis
cuugccgaaggugccugucccaa

SEQ ID NO: 2397469 - RNA, 19 nt, Bordetella pertussis
cuugccgaccuccaggccc

SEQ ID NO: 2397470 - RNA, 21 nt, Bordetella pertussis
cuugccgaccuccaggcccag

SEQ ID NO: 2397471 - RNA, 23 nt, Bordetella pertussis
cuugccgaccuccaggcccaggc

SEQ ID NO: 2397472 - RNA, 17 nt, Bordetella pertussis
cuugccgauccagcgcc

SEQ ID NO: 2397473 - RNA, 17 nt, Bordetella pertussis
cuuggcgucagcgugcg

SEQ ID NO: 2397474 - RNA, 13 nt, Bordetella pertussis
cuugggaucggcc

SEQ ID NO: 2397475 - RNA, 22 nt, Bordetella pertussis
cuugggaucggccaggccggcc

SEQ ID NO: 2397476 - RNA, 15 nt, Bordetella pertussis
cuugggaucguccca

SEQ ID NO: 2397477 - RNA, 17 nt, Bordetella pertussis
cuugggaucgucccagg

SEQ ID NO: 2397478 - RNA, 18 nt, Bordetella pertussis
cuugggcaggccuucgcg

SEQ ID NO: 2397479 - RNA, 18 nt, Bordetella pertussis
cuugggcauuucccagcc

SEQ ID NO: 2397480 - RNA, 13 nt, Bordetella pertussis
cuugggccgcgcc

SEQ ID NO: 2397481 - RNA, 15 nt, Bordetella pertussis
cuugggcgcggcggc

SEQ ID NO: 2397482 - RNA, 16 nt, Bordetella pertussis
cuugggcgcggcggcc

SEQ ID NO: 2397483 - RNA, 19 nt, Bordetella pertussis
cuugggcgcggcggccugg

SEQ ID NO: 2397484 - RNA, 15 nt, Bordetella pertussis
cuuggggcgcgccgc

SEQ ID NO: 2397485 - RNA, 22 nt, Bordetella pertussis
cuuggggcggcccagcggcaaa

SEQ ID NO: 2397486 - RNA, 16 nt, Bordetella pertussis
cuuggucacggccucg

SEQ ID NO: 2397487 - RNA, 18 nt, Bordetella pertussis
cuuggucggguccagcac

SEQ ID NO: 2397488 - RNA, 23 nt, Bordetella pertussis
cuuggucggguccagcacgccuu

SEQ ID NO: 2397489 - RNA, 20 nt, Bordetella pertussis
cuuggugaaaucccccgcca

SEQ ID NO: 2397490 - RNA, 16 nt, Bordetella pertussis
cuuggugcgcgccagg

SEQ ID NO: 2397491 - RNA, 19 nt, Bordetella pertussis
cuugguggggucgaugcca

SEQ ID NO: 2397492 - RNA, 20 nt, Bordetella pertussis
cuugguggggucgaugccag

SEQ ID NO: 2397493 - RNA, 14 nt, Bordetella pertussis
cuuguacaggcacu

SEQ ID NO: 2397494 - RNA, 19 nt, Bordetella pertussis
cuuguacuggucgcgcagc

SEQ ID NO: 2397495 - RNA, 20 nt, Bordetella pertussis
cuuguaggcgauccaggcca

SEQ ID NO: 2397496 - RNA, 21 nt, Bordetella pertussis
cuuguaguggcgguagacgcc

SEQ ID NO: 2397497 - RNA, 20 nt, Bordetella pertussis
cuugucgaucgccaccagcg

SEQ ID NO: 2397498 - RNA, 23 nt, Bordetella pertussis
cuugucgaucgccaccagcguca

SEQ ID NO: 2397499 - RNA, 19 nt, Bordetella pertussis
cuugucgcgcccgauggug

SEQ ID NO: 2397500 - RNA, 21 nt, Bordetella pertussis
cuugucgcgcccgauggugca

SEQ ID NO: 2397501 - RNA, 14 nt, Bordetella pertussis
cuugucgcgggcag

SEQ ID NO: 2397502 - RNA, 15 nt, Bordetella pertussis
cuugucggccgcgcg

SEQ ID NO: 2397503 - RNA, 14 nt, Bordetella pertussis
cuugucuucgauuu

SEQ ID NO: 2397504 - RNA, 17 nt, Bordetella pertussis
cuugugcaucucgaagc

SEQ ID NO: 2397505 - RNA, 16 nt, Bordetella pertussis
cuugugcgccagcgcg

SEQ ID NO: 2397506 - RNA, 24 nt, Bordetella pertussis
cuuguucgagcgcgcgcaugcgca

SEQ ID NO: 2397507 - RNA, 19 nt, Bordetella pertussis
cuuguugcucuugaccugg

SEQ ID NO: 2397508 - RNA, 21 nt, Bordetella pertussis
cuuguugcucuugaccugggc

SEQ ID NO: 2397509 - RNA, 22 nt, Bordetella pertussis
cuuguugcucuugaccugggcc

SEQ ID NO: 2397510 - RNA, 15 nt, Bordetella pertussis
cuuguuggcgccggc

SEQ ID NO: 2397511 - RNA, 23 nt, Bordetella pertussis
cuuguuggcgccggccgcgcgcg

SEQ ID NO: 2397512 - RNA, 14 nt, Bordetella pertussis
cuuucaaagaucug

SEQ ID NO: 2397513 - RNA, 19 nt, Bordetella pertussis
cuuucaaagaucugcuggc

SEQ ID NO: 2397514 - RNA, 24 nt, Bordetella pertussis
cuuucagcacauccgacagauggc

SEQ ID NO: 2397515 - RNA, 20 nt, Bordetella pertussis
cuuucagcgccgagcgccag

SEQ ID NO: 2397516 - RNA, 21 nt, Bordetella pertussis
cuuucaucaaacgcggcgccg

SEQ ID NO: 2397517 - RNA, 18 nt, Bordetella pertussis
cuuucaugggccugggcg

SEQ ID NO: 2397518 - RNA, 17 nt, Bordetella pertussis
cuuucgaagccgcccca

SEQ ID NO: 2397519 - RNA, 16 nt, Bordetella pertussis
cuuucgaccagcgaca

SEQ ID NO: 2397520 - RNA, 22 nt, Bordetella pertussis
cuuucgaccagcgacagcacgg

SEQ ID NO: 2397521 - RNA, 16 nt, Bordetella pertussis
cuuucgauuugcagca

SEQ ID NO: 2397522 - RNA, 22 nt, Bordetella pertussis
cuuucgcacagccggggcgagc

SEQ ID NO: 2397523 - RNA, 16 nt, Bordetella pertussis
cuuucgccgcgcgcuc

SEQ ID NO: 2397524 - RNA, 11 nt, Bordetella pertussis
cuuucgccgga

SEQ ID NO: 2397525 - RNA, 15 nt, Bordetella pertussis
cuuucgcgcgcgccu

SEQ ID NO: 2397526 - RNA, 15 nt, Bordetella pertussis
cuuucucccgccgcu

SEQ ID NO: 2397527 - RNA, 18 nt, Bordetella pertussis
cuuucugcuugccggccc

SEQ ID NO: 2397528 - RNA, 19 nt, Bordetella pertussis
cuuucugcuugccggcccg

SEQ ID NO: 2397529 - RNA, 20 nt, Bordetella pertussis
cuuugccugcgaugccggcg

SEQ ID NO: 2397530 - RNA, 14 nt, Bordetella pertussis
cuuugcgggcgcgc

SEQ ID NO: 2397531 - RNA, 15 nt, Bordetella pertussis
cuuugcgggcgcgcu

SEQ ID NO: 2397532 - RNA, 22 nt, Bordetella pertussis
cuuuggacaggcgugcgcagcu

SEQ ID NO: 2397533 - RNA, 16 nt, Bordetella pertussis
cuuuggccgcgcgccg

SEQ ID NO: 2397534 - RNA, 20 nt, Bordetella pertussis
cuuuggccgcgcgccggcgc

SEQ ID NO: 2397535 - RNA, 24 nt, Bordetella pertussis
cuuugggggggcaccgccaggcag

SEQ ID NO: 2397536 - RNA, 22 nt, Bordetella pertussis
cuuugucguugauggggccgcg

SEQ ID NO: 2397537 - RNA, 15 nt, Bordetella pertussis
cuuuuccacgcccgc

SEQ ID NO: 2397538 - RNA, 16 nt, Bordetella pertussis
cuuuugcggcgcggcg

SEQ ID NO: 2397539 - RNA, 21 nt, Bordetella pertussis
cuuuugcuugggggcguggca

SEQ ID NO: 2397540 - RNA, 13 nt, Bordetella pertussis
cuuuuuccuugcg

SEQ ID NO: 2397541 - RNA, 21 nt, Bordetella pertussis
cuuuuucgagccgcagaacag

SEQ ID NO: 2397542 - RNA, 16 nt, Bordetella pertussis
cuuuuucucggccucg

SEQ ID NO: 2397543 - RNA, 19 nt, Bordetella pertussis
cuuuuuucaucguuacagc

SEQ ID NO: 2397544 - RNA, 16 nt, Bordetella pertussis
gaaaaagcccugcgug

SEQ ID NO: 2397545 - RNA, 18 nt, Bordetella pertussis
gaaaaagcccugcguggc

SEQ ID NO: 2397546 - RNA, 17 nt, Bordetella pertussis
gaaaacagcaccagcau

SEQ ID NO: 2397547 - RNA, 20 nt, Bordetella pertussis
gaaaaccaggcugcccuggc

SEQ ID NO: 2397548 - RNA, 23 nt, Bordetella pertussis
gaaaaccgcucguaucgcccuga

SEQ ID NO: 2397549 - RNA, 14 nt, Bordetella pertussis
gaaaaccggcgccu

SEQ ID NO: 2397550 - RNA, 17 nt, Bordetella pertussis
gaaaaccggcgccuggc

SEQ ID NO: 2397551 - RNA, 18 nt, Bordetella pertussis
gaaaaccggcgccuggcc

SEQ ID NO: 2397552 - RNA, 13 nt, Bordetella pertussis
gaaaagccgcggc

SEQ ID NO: 2397553 - RNA, 15 nt, Bordetella pertussis
gaaaagccgcggccg

SEQ ID NO: 2397554 - RNA, 23 nt, Bordetella pertussis
gaaaagccggcggccggucaggg

SEQ ID NO: 2397555 - RNA, 23 nt, Bordetella pertussis
gaaacagcaucagcggcagcacg

SEQ ID NO: 2397556 - RNA, 22 nt, Bordetella pertussis
gaaacaggcgccgucgaagccg

SEQ ID NO: 2397557 - RNA, 15 nt, Bordetella pertussis
gaaacccccugggug

SEQ ID NO: 2397558 - RNA, 22 nt, Bordetella pertussis
gaaaccgaccugaucgcgcagc

SEQ ID NO: 2397559 - RNA, 20 nt, Bordetella pertussis
gaaaccgccgcggcuugccg

SEQ ID NO: 2397560 - RNA, 12 nt, Bordetella pertussis
gaaaccgcgucg

SEQ ID NO: 2397561 - RNA, 12 nt, Bordetella pertussis
gaaaccggcgcg

SEQ ID NO: 2397562 - RNA, 15 nt, Bordetella pertussis
gaaaccggcgcgcgc

SEQ ID NO: 2397563 - RNA, 15 nt, Bordetella pertussis
gaaaccuggcccggc

SEQ ID NO: 2397564 - RNA, 12 nt, Bordetella pertussis
gaaacgcccagc

SEQ ID NO: 2397565 - RNA, 13 nt, Bordetella pertussis
gaaacgcgcgcgc

SEQ ID NO: 2397566 - RNA, 16 nt, Bordetella pertussis
gaaacgcgcgcgcccu

SEQ ID NO: 2397567 - RNA, 22 nt, Bordetella pertussis
gaaacgcgcguccuuggcggcc

SEQ ID NO: 2397568 - RNA, 18 nt, Bordetella pertussis
gaacaugagccaugccgu

SEQ ID NO: 2397569 - RNA, 14 nt, Bordetella pertussis
gaacauggcccggu

SEQ ID NO: 2397570 - RNA, 21 nt, Bordetella pertussis
gaacauggcccgguugguggc

SEQ ID NO: 2397571 - RNA, 17 nt, Bordetella pertussis
gaacauguccaccagcc

SEQ ID NO: 2397572 - RNA, 22 nt, Bordetella pertussis
gaacauguccaccagccggccg

SEQ ID NO: 2397573 - RNA, 17 nt, Bordetella pertussis
gaacauguucacgccca

SEQ ID NO: 2397574 - RNA, 19 nt, Bordetella pertussis
gaacauguucacgcccagg

SEQ ID NO: 2397575 - RNA, 14 nt, Bordetella pertussis
gaaccacacgaccg

SEQ ID NO: 2397576 - RNA, 12 nt, Bordetella pertussis
gaaccacagcau

SEQ ID NO: 2397577 - RNA, 15 nt, Bordetella pertussis
gaaccacccggccau

SEQ ID NO: 2397578 - RNA, 22 nt, Bordetella pertussis
gaaccacccggccaucgaagcc

SEQ ID NO: 2397579 - RNA, 22 nt, Bordetella pertussis
gaaccagcgcaccaccagcacc

SEQ ID NO: 2397580 - RNA, 20 nt, Bordetella pertussis
gaaccagcggcuggcggugc

SEQ ID NO: 2397581 - RNA, 19 nt, Bordetella pertussis
gaaccaggccaccgcggug

SEQ ID NO: 2397582 - RNA, 14 nt, Bordetella pertussis
gaaccaggccgcca

SEQ ID NO: 2397583 - RNA, 17 nt, Bordetella pertussis
gaaccaggccgccaggg

SEQ ID NO: 2397584 - RNA, 21 nt, Bordetella pertussis
gaaccaguagcacacgccgau

SEQ ID NO: 2397585 - RNA, 17 nt, Bordetella pertussis
gaaccaguugcgggccu

SEQ ID NO: 2397586 - RNA, 17 nt, Bordetella pertussis
gaaccauugcagggugu

SEQ ID NO: 2397587 - RNA, 19 nt, Bordetella pertussis
gaaccauuggggaucgaac

SEQ ID NO: 2397588 - RNA, 16 nt, Bordetella pertussis
gaaccccggcugcgcg

SEQ ID NO: 2397589 - RNA, 22 nt, Bordetella pertussis
gaacccgccgcgaucagcgcgg

SEQ ID NO: 2397590 - RNA, 14 nt, Bordetella pertussis
gaacccggccggcg

SEQ ID NO: 2397591 - RNA, 15 nt, Bordetella pertussis
gaaucgucgaccagc

SEQ ID NO: 2397592 - RNA, 17 nt, Bordetella pertussis
gaaucucccggcgcccu

SEQ ID NO: 2397593 - RNA, 16 nt, Bordetella pertussis
gaaucuucgaugcgcg

SEQ ID NO: 2397594 - RNA, 23 nt, Bordetella pertussis
gaaugaacagcuugcuguccagu

SEQ ID NO: 2397595 - RNA, 19 nt, Bordetella pertussis
gaaugaugcagcuguagcc

SEQ ID NO: 2397596 - RNA, 18 nt, Bordetella pertussis
gaaugccauacguccuuu

SEQ ID NO: 2397597 - RNA, 15 nt, Bordetella pertussis
gaaugccgccgugau

SEQ ID NO: 2397598 - RNA, 21 nt, Bordetella pertussis
gaaugccugguaggcgagcag

SEQ ID NO: 2397599 - RNA, 13 nt, Bordetella pertussis
gaaugcgccuggc

SEQ ID NO: 2397600 - RNA, 19 nt, Bordetella pertussis
gaaugcguguuccagcgcc

SEQ ID NO: 2397601 - RNA, 23 nt, Bordetella pertussis
gaaugcguguuccagcgccuggc

SEQ ID NO: 2397602 - RNA, 17 nt, Bordetella pertussis
gaauggccacggcuugc

SEQ ID NO: 2397603 - RNA, 15 nt, Bordetella pertussis
gaauggcgcgaucca

SEQ ID NO: 2397604 - RNA, 12 nt, Bordetella pertussis
gaauggcgcggu

SEQ ID NO: 2397605 - RNA, 22 nt, Bordetella pertussis
gaaugucccacaggcgcgcggc

SEQ ID NO: 2397606 - RNA, 19 nt, Bordetella pertussis
gaaugucguugcacagcac

SEQ ID NO: 2397607 - RNA, 19 nt, Bordetella pertussis
gaauguugauccggucgcc

SEQ ID NO: 2397608 - RNA, 16 nt, Bordetella pertussis
gaauuccagcucugcu

SEQ ID NO: 2397609 - RNA, 19 nt, Bordetella pertussis
gaauuccucgccgcccagc

SEQ ID NO: 2397610 - RNA, 15 nt, Bordetella pertussis
gaauuccucgcggcu

SEQ ID NO: 2397611 - RNA, 13 nt, Bordetella pertussis
gaauucggcgcgu

SEQ ID NO: 2397612 - RNA, 16 nt, Bordetella pertussis
gaauugccgccgcugc

SEQ ID NO: 2397613 - RNA, 15 nt, Bordetella pertussis
gaauugcgccacgcc

SEQ ID NO: 2397614 - RNA, 20 nt, Bordetella pertussis
gaauugcgccacgcccacuu

SEQ ID NO: 2397615 - RNA, 14 nt, Bordetella pertussis
gaauugcuggagcg

SEQ ID NO: 2397616 - RNA, 21 nt, Bordetella pertussis
gaauugcuggagcgccacgcc

SEQ ID NO: 2397617 - RNA, 13 nt, Bordetella pertussis
gaauuggcggcga

SEQ ID NO: 2397618 - RNA, 19 nt, Bordetella pertussis
gaauuucucggccagcgcc

SEQ ID NO: 2397619 - RNA, 14 nt, Bordetella pertussis
gacaaacccgacga

SEQ ID NO: 2397620 - RNA, 17 nt, Bordetella pertussis
gacaaauagccgaccgc

SEQ ID NO: 2397621 - RNA, 20 nt, Bordetella pertussis
gacaacaagccgggcgccgg

SEQ ID NO: 2397622 - RNA, 16 nt, Bordetella pertussis
gacaacagcuugcccg

SEQ ID NO: 2397623 - RNA, 14 nt, Bordetella pertussis
gaacggggacuggc

SEQ ID NO: 2397624 - RNA, 21 nt, Bordetella pertussis
gaacggggccgccucggcggc

SEQ ID NO: 2397625 - RNA, 16 nt, Bordetella pertussis
gaacgggguggccggc

SEQ ID NO: 2397626 - RNA, 18 nt, Bordetella pertussis
gaacgggguggccggcgc

SEQ ID NO: 2397627 - RNA, 22 nt, Bordetella pertussis
gaacgggguggccggcgcgcgg

SEQ ID NO: 2397628 - RNA, 19 nt, Bordetella pertussis
gaacgucaccccgcccugc

SEQ ID NO: 2397629 - RNA, 21 nt, Bordetella pertussis
gaacuccaggaaagcgccgcc

SEQ ID NO: 2397630 - RNA, 16 nt, Bordetella pertussis
gaacuccgcggcgucg

SEQ ID NO: 2397631 - RNA, 13 nt, Bordetella pertussis
gaacuccggcggc

SEQ ID NO: 2397632 - RNA, 13 nt, Bordetella pertussis
gaacucgauccgg

SEQ ID NO: 2397633 - RNA, 19 nt, Bordetella pertussis
gaacucgauccgggccugg

SEQ ID NO: 2397634 - RNA, 21 nt, Bordetella pertussis
gaacucgauccgggccuggcg

SEQ ID NO: 2397635 - RNA, 18 nt, Bordetella pertussis
gaacucgauggccucggc

SEQ ID NO: 2397636 - RNA, 12 nt, Bordetella pertussis
gaacucgcgcuc

SEQ ID NO: 2397637 - RNA, 16 nt, Bordetella pertussis
gaacucgcgcucggcc

SEQ ID NO: 2397638 - RNA, 19 nt, Bordetella pertussis
gaacucgcgcucggcgacg

SEQ ID NO: 2397639 - RNA, 15 nt, Bordetella pertussis
gaacucggccagcag

SEQ ID NO: 2397640 - RNA, 21 nt, Bordetella pertussis
gaacucgggguggaacugggc

SEQ ID NO: 2397641 - RNA, 19 nt, Bordetella pertussis
gaacucguuggccagcgcg

SEQ ID NO: 2397642 - RNA, 15 nt, Bordetella pertussis
gaacugaugccgacc

SEQ ID NO: 2397643 - RNA, 16 nt, Bordetella pertussis
gaacugaugccgaccg

SEQ ID NO: 2397644 - RNA, 14 nt, Bordetella pertussis
gaacugcaggccgc

SEQ ID NO: 2397645 - RNA, 18 nt, Bordetella pertussis
gaacugcaggccgccggc

SEQ ID NO: 2397646 - RNA, 12 nt, Bordetella pertussis
gaacugccggcg

SEQ ID NO: 2397647 - RNA, 15 nt, Bordetella pertussis
gaacugccggcgcgg

SEQ ID NO: 2397648 - RNA, 22 nt, Bordetella pertussis
gaacugcuccacgugcggcagg

SEQ ID NO: 2397649 - RNA, 19 nt, Bordetella pertussis
gacagcgcucuauucggcc

SEQ ID NO: 2397650 - RNA, 20 nt, Bordetella pertussis
gacagcgcugguggccagau

SEQ ID NO: 2397651 - RNA, 16 nt, Bordetella pertussis
gacagcggcgagcgcg

SEQ ID NO: 2397652 - RNA, 19 nt, Bordetella pertussis
gacagcggcgagcgcggcg

SEQ ID NO: 2397653 - RNA, 16 nt, Bordetella pertussis
gacagcucggggaaau

SEQ ID NO: 2397654 - RNA, 15 nt, Bordetella pertussis
gacagcuugcgcugg

SEQ ID NO: 2397655 - RNA, 16 nt, Bordetella pertussis
gacagcuugcgcuggc

SEQ ID NO: 2397656 - RNA, 18 nt, Bordetella pertussis
gacagcuugcgcuggcgc

SEQ ID NO: 2397657 - RNA, 22 nt, Bordetella pertussis
gacagcuugcgcuggcgcgcgg

SEQ ID NO: 2397658 - RNA, 18 nt, Bordetella pertussis
gacaggaacagcacgugg

SEQ ID NO: 2397659 - RNA, 19 nt, Bordetella pertussis
gacaggaacuccggcggcg

SEQ ID NO: 2397660 - RNA, 20 nt, Bordetella pertussis
gacaggaacuccggcggcgc

SEQ ID NO: 2397661 - RNA, 21 nt, Bordetella pertussis
gacaggaacuccggcggcgca

SEQ ID NO: 2397662 - RNA, 12 nt, Bordetella pertussis
gacaggaugaag

SEQ ID NO: 2397663 - RNA, 17 nt, Bordetella pertussis
gacaggaugaagaccac

SEQ ID NO: 2397664 - RNA, 19 nt, Bordetella pertussis
gacaggaugaagaccacgu

SEQ ID NO: 2397665 - RNA, 12 nt, Bordetella pertussis
gacaggaugggc

SEQ ID NO: 2397666 - RNA, 18 nt, Bordetella pertussis
gacaggcacaccacgcga

SEQ ID NO: 2397667 - RNA, 15 nt, Bordetella pertussis
gacaggcacaccggu

SEQ ID NO: 2397668 - RNA, 20 nt, Bordetella pertussis
gacaggcacauugccguacg

SEQ ID NO: 2397669 - RNA, 15 nt, Bordetella pertussis
gacaggcaccccagc

SEQ ID NO: 2397670 - RNA, 18 nt, Bordetella pertussis
gacaggcaccccagcacc

SEQ ID NO: 2397671 - RNA, 18 nt, Bordetella pertussis
gacaggcacccccgaccg

SEQ ID NO: 2397672 - RNA, 19 nt, Bordetella pertussis
gacaggcaccccggcgccg

SEQ ID NO: 2397673 - RNA, 21 nt, Bordetella pertussis
gacaggcaccccggcgccgcg

SEQ ID NO: 2397674 - RNA, 22 nt, Bordetella pertussis
gacaggcaccccggcgccgcgu

SEQ ID NO: 2397675 - RNA, 14 nt, Bordetella pertussis
gacaggcaccccgu

SEQ ID NO: 2397676 - RNA, 19 nt, Bordetella pertussis
gacaggcaccccgucgucc

SEQ ID NO: 2397677 - RNA, 20 nt, Bordetella pertussis
gacaggcaccccgucguccg

SEQ ID NO: 2397678 - RNA, 22 nt, Bordetella pertussis
gacaggcacccgagggucaggu

SEQ ID NO: 2397679 - RNA, 17 nt, Bordetella pertussis
gacaggcacccgcacgg

SEQ ID NO: 2397680 - RNA, 15 nt, Bordetella pertussis
gacaggcacccgcgc

SEQ ID NO: 2397681 - RNA, 15 nt, Bordetella pertussis
gacaggcacccugcc

SEQ ID NO: 2397682 - RNA, 18 nt, Bordetella pertussis
gacaggcacccuugccgc

SEQ ID NO: 2397683 - RNA, 20 nt, Bordetella pertussis
gacaggcaccgaacccugcc

SEQ ID NO: 2397684 - RNA, 15 nt, Bordetella pertussis
gaccagccagccgcc

SEQ ID NO: 2397685 - RNA, 16 nt, Bordetella pertussis
gaccagccagccgccg

SEQ ID NO: 2397686 - RNA, 17 nt, Bordetella pertussis
gaccagccagccgccgc

SEQ ID NO: 2397687 - RNA, 21 nt, Bordetella pertussis
gaccagccagccgccgcgcgg

SEQ ID NO: 2397688 - RNA, 22 nt, Bordetella pertussis
gaccagccagccgccgcgcggc

SEQ ID NO: 2397689 - RNA, 13 nt, Bordetella pertussis
gaccagcccggcc

SEQ ID NO: 2397690 - RNA, 16 nt, Bordetella pertussis
gaccagcccggccgcc

SEQ ID NO: 2397691 - RNA, 20 nt, Bordetella pertussis
gaccagcgaguugaaggcuu

SEQ ID NO: 2397692 - RNA, 14 nt, Bordetella pertussis
gaccagcgcacggu

SEQ ID NO: 2397693 - RNA, 18 nt, Bordetella pertussis
gaccagcgcgcgccggcc

SEQ ID NO: 2397694 - RNA, 14 nt, Bordetella pertussis
gaccagcgcgcggu

SEQ ID NO: 2397695 - RNA, 23 nt, Bordetella pertussis
gaccagcgcgcggugccgccugg

SEQ ID NO: 2397696 - RNA, 14 nt, Bordetella pertussis
gaccagcgcggccg

SEQ ID NO: 2397697 - RNA, 20 nt, Bordetella pertussis
gaccagcgcgucgcacuggg

SEQ ID NO: 2397698 - RNA, 16 nt, Bordetella pertussis
gaccagcggaucgccg

SEQ ID NO: 2397699 - RNA, 20 nt, Bordetella pertussis
gaccagcggaucgccgggca

SEQ ID NO: 2397700 - RNA, 13 nt, Bordetella pertussis
gaccagcggcgug

SEQ ID NO: 2397701 - RNA, 20 nt, Bordetella pertussis
gaccagcgguugcgccagcu

SEQ ID NO: 2397702 - RNA, 12 nt, Bordetella pertussis
gaccagcugcac

SEQ ID NO: 2397703 - RNA, 19 nt, Bordetella pertussis
gaccagcuucugcgccugc

SEQ ID NO: 2397704 - RNA, 21 nt, Bordetella pertussis
gaccagcuugucgaccaccgg

SEQ ID NO: 2397705 - RNA, 23 nt, Bordetella pertussis
gaccagcuugucgaccaccggcu

SEQ ID NO: 2397706 - RNA, 20 nt, Bordetella pertussis
gaccaggaaguugcccaccg

SEQ ID NO: 2397707 - RNA, 23 nt, Bordetella pertussis
gaccaggaaguugcccaccgaca

SEQ ID NO: 2397708 - RNA, 21 nt, Bordetella pertussis
gaccaggaugaugcagcacac

SEQ ID NO: 2397709 - RNA, 22 nt, Bordetella pertussis
gaccaggaugugacggaccuug

SEQ ID NO: 2397710 - RNA, 14 nt, Bordetella pertussis
gaccaggcccacga

SEQ ID NO: 2397711 - RNA, 12 nt, Bordetella pertussis
gaccaggcccau

SEQ ID NO: 2397712 - RNA, 20 nt, Bordetella pertussis
gaccaggcccauggcguagc

SEQ ID NO: 2397713 - RNA, 14 nt, Bordetella pertussis
gaccaggcccgcca

SEQ ID NO: 2397714 - RNA, 16 nt, Bordetella pertussis
gaccaggcccgccacg

SEQ ID NO: 2397715 - RNA, 14 nt, Bordetella pertussis
gaccaggccggcgg

SEQ ID NO: 2397716 - RNA, 18 nt, Bordetella pertussis
gaccaggccggcggcggg

SEQ ID NO: 2397717 - RNA, 20 nt, Bordetella pertussis
gaccaggccggugcgcacau

SEQ ID NO: 2397718 - RNA, 19 nt, Bordetella pertussis
gaccaggccguggcccagc

SEQ ID NO: 2397719 - RNA, 16 nt, Bordetella pertussis
gaccaggcgggcaucg

SEQ ID NO: 2397720 - RNA, 18 nt, Bordetella pertussis
gaccaggcgggcaucgcc

SEQ ID NO: 2397721 - RNA, 11 nt, Bordetella pertussis
gaccaggcugc

SEQ ID NO: 2397722 - RNA, 13 nt, Bordetella pertussis
gaccaggcugcgc

SEQ ID NO: 2397723 - RNA, 14 nt, Bordetella pertussis
gaccaggcugcgcg

SEQ ID NO: 2397724 - RNA, 19 nt, Bordetella pertussis
gaccaggcugcgcgccggc

SEQ ID NO: 2397725 - RNA, 12 nt, Bordetella pertussis
gaccaggcugga

SEQ ID NO: 2397726 - RNA, 22 nt, Bordetella pertussis
gaccaggcuggagucgggcugc

SEQ ID NO: 2397727 - RNA, 13 nt, Bordetella pertussis
gaccagggcacgg

SEQ ID NO: 2397728 - RNA, 12 nt, Bordetella pertussis
gaccagggcgcc

SEQ ID NO: 2397729 - RNA, 16 nt, Bordetella pertussis
gaccagggcgccgacc

SEQ ID NO: 2397730 - RNA, 19 nt, Bordetella pertussis
gaccagggcggugggcagc

SEQ ID NO: 2397731 - RNA, 23 nt, Bordetella pertussis
gaccagggcggugggcagcgcgu

SEQ ID NO: 2397732 - RNA, 22 nt, Bordetella pertussis
gaccagggcucguagucggugg

SEQ ID NO: 2397733 - RNA, 14 nt, Bordetella pertussis
gaccaggucgaagc

SEQ ID NO: 2397734 - RNA, 16 nt, Bordetella pertussis
gaccaggucgaagcac

SEQ ID NO: 2397735 - RNA, 14 nt, Bordetella pertussis
gaccaggucgccgu

SEQ ID NO: 2397736 - RNA, 16 nt, Bordetella pertussis
gaccaggucgggcacg

SEQ ID NO: 2397737 - RNA, 15 nt, Bordetella pertussis
gaccaguucggccag

SEQ ID NO: 2397738 - RNA, 17 nt, Bordetella pertussis
gaccaguucggccagca

SEQ ID NO: 2397739 - RNA, 18 nt, Bordetella pertussis
gaccaguucggccagcag

SEQ ID NO: 2397740 - RNA, 19 nt, Bordetella pertussis
gaccaguucggccagcagc

SEQ ID NO: 2397741 - RNA, 17 nt, Bordetella pertussis
gaccaucacgagcaggu

SEQ ID NO: 2397742 - RNA, 19 nt, Bordetella pertussis
gaccaucuuguccuucagc

SEQ ID NO: 2397743 - RNA, 22 nt, Bordetella pertussis
gaccaucuuguccuucagcacg

SEQ ID NO: 2397744 - RNA, 18 nt, Bordetella pertussis
gaccaugaccaugccggc

SEQ ID NO: 2397745 - RNA, 22 nt, Bordetella pertussis
gaccaugacgucgacguugcgc

SEQ ID NO: 2397746 - RNA, 22 nt, Bordetella pertussis
gaccaugcgcugggcaugggcg

SEQ ID NO: 2397747 - RNA, 20 nt, Bordetella pertussis
gaccaugcggccgucgccgc

SEQ ID NO: 2397748 - RNA, 21 nt, Bordetella pertussis
gaccauuucgauuucggcggc

SEQ ID NO: 2397749 - RNA, 17 nt, Bordetella pertussis
gacccacuugagcagcg

SEQ ID NO: 2397750 - RNA, 19 nt, Bordetella pertussis
gacccacuugagcagcgcc

SEQ ID NO: 2397751 - RNA, 20 nt, Bordetella pertussis
gacccacuugagcagcgccu

SEQ ID NO: 2397752 - RNA, 23 nt, Bordetella pertussis
gacccacuugagcagcgccuugc

SEQ ID NO: 2397753 - RNA, 15 nt, Bordetella pertussis
gacccagaacccggc

SEQ ID NO: 2397754 - RNA, 20 nt, Bordetella pertussis
gacccagcaccgagcugccg

SEQ ID NO: 2397755 - RNA, 13 nt, Bordetella pertussis
gacccaggccggc

SEQ ID NO: 2397756 - RNA, 16 nt, Bordetella pertussis
gacccaggccggcgcc

SEQ ID NO: 2397757 - RNA, 18 nt, Bordetella pertussis
gacccaggccggcgccag

SEQ ID NO: 2397758 - RNA, 15 nt, Bordetella pertussis
gacccauaccagccc

SEQ ID NO: 2397759 - RNA, 23 nt, Bordetella pertussis
gacccauaguugcaugaugucgc

SEQ ID NO: 2397760 - RNA, 21 nt, Bordetella pertussis
gacccccgaacugggcgcguc

SEQ ID NO: 2397761 - RNA, 16 nt, Bordetella pertussis
gaccccgccgugccgg

SEQ ID NO: 2397762 - RNA, 14 nt, Bordetella pertussis
gaccccgucgaccg

SEQ ID NO: 2397763 - RNA, 16 nt, Bordetella pertussis
gaccccguggucgcca

SEQ ID NO: 2397764 - RNA, 18 nt, Bordetella pertussis
gaccccguggucgccagc

SEQ ID NO: 2397765 - RNA, 19 nt, Bordetella pertussis
gaccccuugcggccgccga

SEQ ID NO: 2397766 - RNA, 20 nt, Bordetella pertussis
gacccgaaggcgcggccggg

SEQ ID NO: 2397767 - RNA, 21 nt, Bordetella pertussis
gacccgaaucucccggcgccc

SEQ ID NO: 2397768 - RNA, 22 nt, Bordetella pertussis
gacccgaaucucccggcgcccu

SEQ ID NO: 2397769 - RNA, 15 nt, Bordetella pertussis
gacccgagcccuggc

SEQ ID NO: 2397770 - RNA, 18 nt, Bordetella pertussis
gacccgagcccuggcuug

SEQ ID NO: 2397771 - RNA, 16 nt, Bordetella pertussis
gacccgauagccgcgc

SEQ ID NO: 2397772 - RNA, 20 nt, Bordetella pertussis
gacccgauagccgcgcgccu

SEQ ID NO: 2397773 - RNA, 12 nt, Bordetella pertussis
gacccgaugcgc

SEQ ID NO: 2397774 - RNA, 16 nt, Bordetella pertussis
gacccgcaaaaccggg

SEQ ID NO: 2397775 - RNA, 16 nt, Bordetella pertussis
gacccgcgccgcaggc

SEQ ID NO: 2397776 - RNA, 20 nt, Bordetella pertussis
gacccgcucggccacgcgca

SEQ ID NO: 2397777 - RNA, 12 nt, Bordetella pertussis
gacccgcuggcu

SEQ ID NO: 2397778 - RNA, 17 nt, Bordetella pertussis
gacccgcuggcuggcag

SEQ ID NO: 2397779 - RNA, 21 nt, Bordetella pertussis
gacccgcuggcuggcagcgac

SEQ ID NO: 2397780 - RNA, 20 nt, Bordetella pertussis
gacccgggccgcuggcccgg

SEQ ID NO: 2397781 - RNA, 13 nt, Bordetella pertussis
gacccguggcccg

SEQ ID NO: 2397782 - RNA, 16 nt, Bordetella pertussis
gacccguuugcgcagc

SEQ ID NO: 2397783 - RNA, 14 nt, Bordetella pertussis
gacccuccucgcuu

SEQ ID NO: 2397784 - RNA, 23 nt, Bordetella pertussis
gacccugcacgauuccgccuacu

SEQ ID NO: 2397785 - RNA, 23 nt, Bordetella pertussis
gacccugcccggcagggugacgg

SEQ ID NO: 2397786 - RNA, 12 nt, Bordetella pertussis
gacccugcgcac

SEQ ID NO: 2397787 - RNA, 21 nt, Bordetella pertussis
gacccugcgcacccgccugga

SEQ ID NO: 2397788 - RNA, 19 nt, Bordetella pertussis
gacccuggccgaacgccgc

SEQ ID NO: 2397789 - RNA, 22 nt, Bordetella pertussis
gacccuguacaagcgcacgcug

SEQ ID NO: 2397790 - RNA, 15 nt, Bordetella pertussis
gaccgaaaagcccac

SEQ ID NO: 2397791 - RNA, 15 nt, Bordetella pertussis
gaccgaacaccaccg

SEQ ID NO: 2397792 - RNA, 16 nt, Bordetella pertussis
gaccgaacaccaccga

SEQ ID NO: 2397793 - RNA, 20 nt, Bordetella pertussis
gaccgaacaccaccgagggc

SEQ ID NO: 2397794 - RNA, 20 nt, Bordetella pertussis
gaccgaaccgauccagcccg

SEQ ID NO: 2397795 - RNA, 21 nt, Bordetella pertussis
gaccgaagaggagcugcacaa

SEQ ID NO: 2397796 - RNA, 13 nt, Bordetella pertussis
gaccgaagcgcgg

SEQ ID NO: 2397797 - RNA, 16 nt, Bordetella pertussis
gaccgaagcgcgggcg

SEQ ID NO: 2397798 - RNA, 14 nt, Bordetella pertussis
gaccgaagcgggcg

SEQ ID NO: 2397799 - RNA, 20 nt, Bordetella pertussis
gaccgcgcgguggccgccgc

SEQ ID NO: 2397800 - RNA, 19 nt, Bordetella pertussis
gaccgcgcugcggucagcu

SEQ ID NO: 2397801 - RNA, 22 nt, Bordetella pertussis
gaccgcgcugcggucagcugug

SEQ ID NO: 2397802 - RNA, 14 nt, Bordetella pertussis
gaccgcggacgcca

SEQ ID NO: 2397803 - RNA, 15 nt, Bordetella pertussis
gaccgcggacgccau

SEQ ID NO: 2397804 - RNA, 16 nt, Bordetella pertussis
gaccgcggacgccaug

SEQ ID NO: 2397805 - RNA, 21 nt, Bordetella pertussis
gaccgcggacgccauggcggc

SEQ ID NO: 2397806 - RNA, 13 nt, Bordetella pertussis
gaccgcggccgcg

SEQ ID NO: 2397807 - RNA, 20 nt, Bordetella pertussis
gaccgcggccgcgcuggcgc

SEQ ID NO: 2397808 - RNA, 24 nt, Bordetella pertussis
gaccgcggccgcgcuggcgcuggc

SEQ ID NO: 2397809 - RNA, 20 nt, Bordetella pertussis
gaccgcggcgguccugcuga

SEQ ID NO: 2397810 - RNA, 15 nt, Bordetella pertussis
gaccgcgggcgcgcg

SEQ ID NO: 2397811 - RNA, 24 nt, Bordetella pertussis
gaccgcguaggccuucaccuugcc

SEQ ID NO: 2397812 - RNA, 19 nt, Bordetella pertussis
gaccgcguaguugucggcg

SEQ ID NO: 2397813 - RNA, 23 nt, Bordetella pertussis
gaccgcguaguugucggcgcaga

SEQ ID NO: 2397814 - RNA, 16 nt, Bordetella pertussis
gaccgcguccgcgacg

SEQ ID NO: 2397815 - RNA, 13 nt, Bordetella pertussis
gaccgcgucgaac

SEQ ID NO: 2397816 - RNA, 22 nt, Bordetella pertussis
gaccgcguugaccggcuggcgc

SEQ ID NO: 2397817 - RNA, 23 nt, Bordetella pertussis
gaccgcguugaccggcuggcgca

SEQ ID NO: 2397818 - RNA, 21 nt, Bordetella pertussis
gaccgcuuccgccaccgcgcc

SEQ ID NO: 2397819 - RNA, 22 nt, Bordetella pertussis
gaccgcuuccgccaccgcgccg

SEQ ID NO: 2397820 - RNA, 20 nt, Bordetella pertussis
gaccgcuucggucagcugcu

SEQ ID NO: 2397821 - RNA, 18 nt, Bordetella pertussis
gaccggaauagauauggg

SEQ ID NO: 2397822 - RNA, 22 nt, Bordetella pertussis
gaccggaaucaccgccgcgacc

SEQ ID NO: 2397823 - RNA, 17 nt, Bordetella pertussis
gaccggcaagcgcucgc

SEQ ID NO: 2397824 - RNA, 21 nt, Bordetella pertussis
gaccggcaagcgcucgccggc

SEQ ID NO: 2397825 - RNA, 22 nt, Bordetella pertussis
gaccggcaagcgcucgccggcg

SEQ ID NO: 2397826 - RNA, 15 nt, Bordetella pertussis
gaccggcagggugcc

SEQ ID NO: 2397827 - RNA, 16 nt, Bordetella pertussis
gaccggccaggcgcgg

SEQ ID NO: 2397828 - RNA, 17 nt, Bordetella pertussis
gaccggccccaccuggc

SEQ ID NO: 2397829 - RNA, 20 nt, Bordetella pertussis
gaccggccccaccuggcggu

SEQ ID NO: 2397830 - RNA, 20 nt, Bordetella pertussis
gaccggccuggucaugacgg

SEQ ID NO: 2397831 - RNA, 15 nt, Bordetella pertussis
gaccggcgaagagcc

SEQ ID NO: 2397832 - RNA, 13 nt, Bordetella pertussis
gaccggcgccggc

SEQ ID NO: 2397833 - RNA, 14 nt, Bordetella pertussis
gaccggcgccggcu

SEQ ID NO: 2397834 - RNA, 15 nt, Bordetella pertussis
gaccggcgccggcuc

SEQ ID NO: 2397835 - RNA, 21 nt, Bordetella pertussis
gaccggcgcgaacaccggcag

SEQ ID NO: 2397836 - RNA, 23 nt, Bordetella pertussis
gaccggcgcgaacaccggcaggc

SEQ ID NO: 2397837 - RNA, 13 nt, Bordetella pertussis
gaccggcgcgcgc

SEQ ID NO: 2397838 - RNA, 13 nt, Bordetella pertussis
gaccggcgcggcc

SEQ ID NO: 2397839 - RNA, 16 nt, Bordetella pertussis
gaccggcgcggccugc

SEQ ID NO: 2397840 - RNA, 19 nt, Bordetella pertussis
gaccggcgcggccugcaau

SEQ ID NO: 2397841 - RNA, 19 nt, Bordetella pertussis
gaccggcggcaccauugcc

SEQ ID NO: 2397842 - RNA, 13 nt, Bordetella pertussis
gaccggcggcacg

SEQ ID NO: 2397843 - RNA, 19 nt, Bordetella pertussis
gaccggcggcacggccggc

SEQ ID NO: 2397844 - RNA, 21 nt, Bordetella pertussis
gaccggcggcacggccggccu

SEQ ID NO: 2397845 - RNA, 14 nt, Bordetella pertussis
gaccggcggcgcuc

SEQ ID NO: 2397846 - RNA, 20 nt, Bordetella pertussis
gaccggcguauggcccgcca

SEQ ID NO: 2397847 - RNA, 16 nt, Bordetella pertussis
gaccggcgugacgcgc

SEQ ID NO: 2397848 - RNA, 17 nt, Bordetella pertussis
gaccggcguguccagcg

SEQ ID NO: 2397849 - RNA, 21 nt, Bordetella pertussis
gaccggcguguccagcggcgc

SEQ ID NO: 2397850 - RNA, 22 nt, Bordetella pertussis
gaccggcguguccagcggcgcc

SEQ ID NO: 2397851 - RNA, 23 nt, Bordetella pertussis
gaccacgacggucugggccaugc

SEQ ID NO: 2397852 - RNA, 13 nt, Bordetella pertussis
gaccacgauggcc

SEQ ID NO: 2397853 - RNA, 16 nt, Bordetella pertussis
gaccacgccggcggcc

SEQ ID NO: 2397854 - RNA, 19 nt, Bordetella pertussis
gaccacgccggcggccaug

SEQ ID NO: 2397855 - RNA, 16 nt, Bordetella pertussis
gaccacgccggcgguc

SEQ ID NO: 2397856 - RNA, 18 nt, Bordetella pertussis
gaccacgcgcgcgccgcc

SEQ ID NO: 2397857 - RNA, 13 nt, Bordetella pertussis
gaccacgcgcugc

SEQ ID NO: 2397858 - RNA, 15 nt, Bordetella pertussis
gaccacgcgcugcgc

SEQ ID NO: 2397859 - RNA, 14 nt, Bordetella pertussis
gaccacgcggcggu

SEQ ID NO: 2397860 - RNA, 19 nt, Bordetella pertussis
gaccacgcguccccgcaga

SEQ ID NO: 2397861 - RNA, 18 nt, Bordetella pertussis
gaccacgcugggccagac

SEQ ID NO: 2397862 - RNA, 17 nt, Bordetella pertussis
gaccacggucuggcgcg

SEQ ID NO: 2397863 - RNA, 19 nt, Bordetella pertussis
gaccacggucuggcgcgac

SEQ ID NO: 2397864 - RNA, 14 nt, Bordetella pertussis
gaccacgucgacca

SEQ ID NO: 2397865 - RNA, 20 nt, Bordetella pertussis
gaccacgucgaucaggccca

SEQ ID NO: 2397866 - RNA, 14 nt, Bordetella pertussis
gaccacguggauga

SEQ ID NO: 2397867 - RNA, 18 nt, Bordetella pertussis
gaccacuaucagcgcguc

SEQ ID NO: 2397868 - RNA, 22 nt, Bordetella pertussis
gaccacuggcagaccgagcgcg

SEQ ID NO: 2397869 - RNA, 14 nt, Bordetella pertussis
gaccagcaccagcg

SEQ ID NO: 2397870 - RNA, 16 nt, Bordetella pertussis
gaccagcaccagcgcc

SEQ ID NO: 2397871 - RNA, 17 nt, Bordetella pertussis
gaccagcaccagcgccu

SEQ ID NO: 2397872 - RNA, 19 nt, Bordetella pertussis
gaccagcaccagcgccugc

SEQ ID NO: 2397873 - RNA, 19 nt, Bordetella pertussis
gaccagcacgauccagccg

SEQ ID NO: 2397874 - RNA, 20 nt, Bordetella pertussis
gaccagcacgauccagccgu

SEQ ID NO: 2397875 - RNA, 22 nt, Bordetella pertussis
gaccagcacgggaugcuccagc

SEQ ID NO: 2397876 - RNA, 14 nt, Bordetella pertussis
gaccagcagcacgu

SEQ ID NO: 2397877 - RNA, 11 nt, Bordetella pertussis
gaccagcagcc

SEQ ID NO: 2397878 - RNA, 20 nt, Bordetella pertussis
gaccagcagccgguuggcgc

SEQ ID NO: 2397879 - RNA, 17 nt, Bordetella pertussis
gaccagcagcgaaucgc

SEQ ID NO: 2397880 - RNA, 14 nt, Bordetella pertussis
gaccagcagcgccg

SEQ ID NO: 2397881 - RNA, 12 nt, Bordetella pertussis
gaccagcagcuc

SEQ ID NO: 2397882 - RNA, 15 nt, Bordetella pertussis
gaccagcagcucggc

SEQ ID NO: 2397883 - RNA, 16 nt, Bordetella pertussis
gaccagcagcucggcg

SEQ ID NO: 2397884 - RNA, 20 nt, Bordetella pertussis
gaccagcagcucggcgaucu

SEQ ID NO: 2397885 - RNA, 10 nt, Bordetella pertussis
gaccagcagg

SEQ ID NO: 2397886 - RNA, 13 nt, Bordetella pertussis
gaccagcaggccc

SEQ ID NO: 2397887 - RNA, 19 nt, Bordetella pertussis
gaccagcaggcccaccagg

SEQ ID NO: 2397888 - RNA, 14 nt, Bordetella pertussis
gaccagcaggccga

SEQ ID NO: 2397889 - RNA, 14 nt, Bordetella pertussis
gaccagccagccgc

SEQ ID NO: 2397890 - RNA, 20 nt, Bordetella pertussis
gaccggcuauaccgggcugg

SEQ ID NO: 2397891 - RNA, 15 nt, Bordetella pertussis
gaccggcucgaucgc

SEQ ID NO: 2397892 - RNA, 18 nt, Bordetella pertussis
gaccggcucgaucgccgc

SEQ ID NO: 2397893 - RNA, 16 nt, Bordetella pertussis
gaccggcuggcgcacg

SEQ ID NO: 2397894 - RNA, 13 nt, Bordetella pertussis
gaccgggccgaag

SEQ ID NO: 2397895 - RNA, 17 nt, Bordetella pertussis
gaccgggccgaccaggc

SEQ ID NO: 2397896 - RNA, 13 nt, Bordetella pertussis
gaccggggcgucc

SEQ ID NO: 2397897 - RNA, 14 nt, Bordetella pertussis
gaccgggucgggcg

SEQ ID NO: 2397898 - RNA, 20 nt, Bordetella pertussis
gaccgggucgucgggcggcg

SEQ ID NO: 2397899 - RNA, 16 nt, Bordetella pertussis
gaccggguggcugcgc

SEQ ID NO: 2397900 - RNA, 19 nt, Bordetella pertussis
gaccggguugcccggcagg

SEQ ID NO: 2397901 - RNA, 18 nt, Bordetella pertussis
gaccggguuuccagcccg

SEQ ID NO: 2397902 - RNA, 12 nt, Bordetella pertussis
gaccggugcccu

SEQ ID NO: 2397903 - RNA, 13 nt, Bordetella pertussis
gaccguagcgcag

SEQ ID NO: 2397904 - RNA, 15 nt, Bordetella pertussis
gaccgugaucggcgc

SEQ ID NO: 2397905 - RNA, 14 nt, Bordetella pertussis
gaccgugcgccaac

SEQ ID NO: 2397906 - RNA, 21 nt, Bordetella pertussis
gaccguuccagacgauggugc

SEQ ID NO: 2397907 - RNA, 22 nt, Bordetella pertussis
gaccguuccagacgauggugcc

SEQ ID NO: 2397908 - RNA, 16 nt, Bordetella pertussis
gaccuccaggcccagg

SEQ ID NO: 2397909 - RNA, 17 nt, Bordetella pertussis
gaccuccaggcccaggc

SEQ ID NO: 2397910 - RNA, 18 nt, Bordetella pertussis
gaccuccugguccgugaa

SEQ ID NO: 2397911 - RNA, 13 nt, Bordetella pertussis
gaccucgagcacc

SEQ ID NO: 2397912 - RNA, 14 nt, Bordetella pertussis
gaccucgcccaggc

SEQ ID NO: 2397913 - RNA, 15 nt, Bordetella pertussis
gaccucgcccaggcc

SEQ ID NO: 2397914 - RNA, 23 nt, Bordetella pertussis
gaccucgcgccggucacgcuggu

SEQ ID NO: 2397915 - RNA, 13 nt, Bordetella pertussis
gaccucgcgcugc

SEQ ID NO: 2397916 - RNA, 17 nt, Bordetella pertussis
gaccucgcgcugcagca

SEQ ID NO: 2397917 - RNA, 15 nt, Bordetella pertussis
gaccucggcaccgag

SEQ ID NO: 2397918 - RNA, 17 nt, Bordetella pertussis
gaccucggcaccgaggc

SEQ ID NO: 2397919 - RNA, 14 nt, Bordetella pertussis
gaccucggcggcgu

SEQ ID NO: 2397920 - RNA, 15 nt, Bordetella pertussis
gaccucggcggcguc

SEQ ID NO: 2397921 - RNA, 21 nt, Bordetella pertussis
gaccucggcggcgucgcuggc

SEQ ID NO: 2397922 - RNA, 23 nt, Bordetella pertussis
gaccucggcggcgucgcuggcag

SEQ ID NO: 2397923 - RNA, 16 nt, Bordetella pertussis
gaccucuccacuggcc

SEQ ID NO: 2397924 - RNA, 22 nt, Bordetella pertussis
gaccucuucguugucgcgcgcg

SEQ ID NO: 2397925 - RNA, 15 nt, Bordetella pertussis
gaccugagccaggcg

SEQ ID NO: 2397926 - RNA, 22 nt, Bordetella pertussis
gaccugagccaggcgcccggcg

SEQ ID NO: 2397927 - RNA, 16 nt, Bordetella pertussis
gaccugaucgcgcagc

SEQ ID NO: 2397928 - RNA, 20 nt, Bordetella pertussis
gaccugaucgcgcagcgccu

SEQ ID NO: 2397929 - RNA, 18 nt, Bordetella pertussis
gaccugcaaccccaccgg

SEQ ID NO: 2397930 - RNA, 17 nt, Bordetella pertussis
gaccugcacgauggcgc

SEQ ID NO: 2397931 - RNA, 18 nt, Bordetella pertussis
gaccugcacgauggcgcc

SEQ ID NO: 2397932 - RNA, 21 nt, Bordetella pertussis
gaccugccacugcaucgugcg

SEQ ID NO: 2397933 - RNA, 20 nt, Bordetella pertussis
gaccugcccgagaccgcccg

SEQ ID NO: 2397934 - RNA, 13 nt, Bordetella pertussis
gaccugcgcaccg

SEQ ID NO: 2397935 - RNA, 15 nt, Bordetella pertussis
gaccugcgcaccggc

SEQ ID NO: 2397936 - RNA, 18 nt, Bordetella pertussis
gaccugcgcaccggccgg

SEQ ID NO: 2397937 - RNA, 20 nt, Bordetella pertussis
gaccugcgcaccggccggcc

SEQ ID NO: 2397938 - RNA, 17 nt, Bordetella pertussis
gaccugcgcgaagcgcu

SEQ ID NO: 2397939 - RNA, 20 nt, Bordetella pertussis
gaccugcgcgaagcgcuggg

SEQ ID NO: 2397940 - RNA, 13 nt, Bordetella pertussis
gaccugcgcgacc

SEQ ID NO: 2397941 - RNA, 12 nt, Bordetella pertussis
gaccugcgcgcc

SEQ ID NO: 2397942 - RNA, 23 nt, Bordetella pertussis
gaccugcgcgccggcauggucga

SEQ ID NO: 2397943 - RNA, 14 nt, Bordetella pertussis
gaccugcgggccgc

SEQ ID NO: 2397944 - RNA, 19 nt, Bordetella pertussis
gaccugcgggccgcacagc

SEQ ID NO: 2397945 - RNA, 20 nt, Bordetella pertussis
gaccugcgggcgcagcgccg

SEQ ID NO: 2397946 - RNA, 19 nt, Bordetella pertussis
cucauggaggggcgcaggc

SEQ ID NO: 2397947 - RNA, 19 nt, Bordetella pertussis
cucauggcacagcgcggcg

SEQ ID NO: 2397948 - RNA, 21 nt, Bordetella pertussis
cucauggccgcgcccagcgcg

SEQ ID NO: 2397949 - RNA, 15 nt, Bordetella pertussis
cucauucggcgcgcu

SEQ ID NO: 2397950 - RNA, 17 nt, Bordetella pertussis
cucauucggcgcgcucg

SEQ ID NO: 2397951 - RNA, 14 nt, Bordetella pertussis
cuccaacugggcca

SEQ ID NO: 2397952 - RNA, 13 nt, Bordetella pertussis
cuccacagccacu

SEQ ID NO: 2397953 - RNA, 14 nt, Bordetella pertussis
cuccaccaccaucu

SEQ ID NO: 2397954 - RNA, 21 nt, Bordetella pertussis
cuccaccagcaccggcagcgu

SEQ ID NO: 2397955 - RNA, 15 nt, Bordetella pertussis
cuccacccccgggcg

SEQ ID NO: 2397956 - RNA, 16 nt, Bordetella pertussis
cuccacccccgggcgc

SEQ ID NO: 2397957 - RNA, 16 nt, Bordetella pertussis
cuccaccgccagcccg

SEQ ID NO: 2397958 - RNA, 19 nt, Bordetella pertussis
cuccaccgggcugaacauc

SEQ ID NO: 2397959 - RNA, 13 nt, Bordetella pertussis
cuccacgccgccg

SEQ ID NO: 2397960 - RNA, 12 nt, Bordetella pertussis
cuccacgugcgg

SEQ ID NO: 2397961 - RNA, 20 nt, Bordetella pertussis
cuccacgugcggcagggccu

SEQ ID NO: 2397962 - RNA, 22 nt, Bordetella pertussis
cuccacgugcggcagggccucc

SEQ ID NO: 2397963 - RNA, 15 nt, Bordetella pertussis
cuccacuggccuucu

SEQ ID NO: 2397964 - RNA, 10 nt, Bordetella pertussis
cuccagcagg

SEQ ID NO: 2397965 - RNA, 16 nt, Bordetella pertussis
cuccagcaucgccgcc

SEQ ID NO: 2397966 - RNA, 18 nt, Bordetella pertussis
cuccagcaucgccgccag

SEQ ID NO: 2397967 - RNA, 14 nt, Bordetella pertussis
cuccagccaggcgc

SEQ ID NO: 2397968 - RNA, 18 nt, Bordetella pertussis
cuccagccaggcgcgcag

SEQ ID NO: 2397969 - RNA, 13 nt, Bordetella pertussis
cuccagcgccagc

SEQ ID NO: 2397970 - RNA, 15 nt, Bordetella pertussis
cuccagcgccagcac

SEQ ID NO: 2397971 - RNA, 15 nt, Bordetella pertussis
cuccagcgccggcag

SEQ ID NO: 2397972 - RNA, 20 nt, Bordetella pertussis
cuccagcgccggcagcccca

SEQ ID NO: 2397973 - RNA, 22 nt, Bordetella pertussis
cuccagcgccggcagccccagc

SEQ ID NO: 2397974 - RNA, 23 nt, Bordetella pertussis
cuccagcgccggcagccccagcg

SEQ ID NO: 2397975 - RNA, 13 nt, Bordetella pertussis
cuccagcgcgccg

SEQ ID NO: 2397976 - RNA, 14 nt, Bordetella pertussis
cuccagcgcggcgg

SEQ ID NO: 2397977 - RNA, 23 nt, Bordetella pertussis
cuccagcgcggcggacugcgccg

SEQ ID NO: 2397978 - RNA, 15 nt, Bordetella pertussis
cuccagcgcggcggg

SEQ ID NO: 2397979 - RNA, 13 nt, Bordetella pertussis
cuccagcgcgucg

SEQ ID NO: 2397980 - RNA, 17 nt, Bordetella pertussis
cuccagcgcgucggcca

SEQ ID NO: 2397981 - RNA, 18 nt, Bordetella pertussis
cuccagcgcgucggccag

SEQ ID NO: 2397982 - RNA, 19 nt, Bordetella pertussis
cuccagcgcgucggccagg

SEQ ID NO: 2397983 - RNA, 20 nt, Bordetella pertussis
cuccagcgcgucggccaggc

SEQ ID NO: 2397984 - RNA, 22 nt, Bordetella pertussis
cuccagcgcuucgugcagcgcg

SEQ ID NO: 2397985 - RNA, 16 nt, Bordetella pertussis
cuccagcgucauggcc

SEQ ID NO: 2397986 - RNA, 20 nt, Bordetella pertussis
cuccagcgugucgaacacca

SEQ ID NO: 2397987 - RNA, 22 nt, Bordetella pertussis
cuccagcgugucgaacaccagg

SEQ ID NO: 2397988 - RNA, 19 nt, Bordetella pertussis
cuccagcucagcagcgcca

SEQ ID NO: 2397989 - RNA, 21 nt, Bordetella pertussis
cuccagcucagcagcgccagg

SEQ ID NO: 2397990 - RNA, 24 nt, Bordetella pertussis
cuccagcucagcagcgccagggcc

SEQ ID NO: 2397991 - RNA, 15 nt, Bordetella pertussis
cuccagcuccagcgc

SEQ ID NO: 2397992 - RNA, 16 nt, Bordetella pertussis
cuccagcuccagcgcg

SEQ ID NO: 2397993 - RNA, 15 nt, Bordetella pertussis
cuccagcuggcgcac

SEQ ID NO: 2397994 - RNA, 17 nt, Bordetella pertussis
cuccagcuggcgcacca

SEQ ID NO: 2397995 - RNA, 18 nt, Bordetella pertussis
cuccagcuggcgcaccag

SEQ ID NO: 2397996 - RNA, 19 nt, Bordetella pertussis
cuccaggaaaaccuccucc

SEQ ID NO: 2397997 - RNA, 16 nt, Bordetella pertussis
cuccaggaaagcgccg

SEQ ID NO: 2397998 - RNA, 19 nt, Bordetella pertussis
cuccaggaaagcgccgccg

SEQ ID NO: 2397999 - RNA, 17 nt, Bordetella pertussis
cuccaggaugcgcgaca

SEQ ID NO: 2398000 - RNA, 13 nt, Bordetella pertussis
cuccaggcccagg

SEQ ID NO: 2398001 - RNA, 14 nt, Bordetella pertussis
cuccaggcccaggc

SEQ ID NO: 2398002 - RNA, 16 nt, Bordetella pertussis
cuccaggccgcccagc

SEQ ID NO: 2398003 - RNA, 14 nt, Bordetella pertussis
cuccaggccggcau

SEQ ID NO: 2398004 - RNA, 13 nt, Bordetella pertussis
cuccaggcggcgg

SEQ ID NO: 2398005 - RNA, 14 nt, Bordetella pertussis
cuccaggcucaggc

SEQ ID NO: 2398006 - RNA, 21 nt, Bordetella pertussis
cuccaggcucaggcggccagg

SEQ ID NO: 2398007 - RNA, 24 nt, Bordetella pertussis
cuccaggcucaggcggccagggcc

SEQ ID NO: 2398008 - RNA, 15 nt, Bordetella pertussis
cuccaggugccagau

SEQ ID NO: 2398009 - RNA, 19 nt, Bordetella pertussis
cuccaggugccagauaucc

SEQ ID NO: 2398010 - RNA, 14 nt, Bordetella pertussis
cuccagucccgcac

SEQ ID NO: 2398011 - RNA, 13 nt, Bordetella pertussis
cuccauagcgccg

SEQ ID NO: 2398012 - RNA, 18 nt, Bordetella pertussis
cuccauagcgccgcucga

SEQ ID NO: 2398013 - RNA, 18 nt, Bordetella pertussis
cuccaucuguucggcgcc

SEQ ID NO: 2398014 - RNA, 19 nt, Bordetella pertussis
cuccaucuguucggcgccg

SEQ ID NO: 2398015 - RNA, 14 nt, Bordetella pertussis
cuccaugcggcggc

SEQ ID NO: 2398016 - RNA, 17 nt, Bordetella pertussis
cuccaugcggcggcggg

SEQ ID NO: 2398017 - RNA, 22 nt, Bordetella pertussis
cuccaugcggcggcgggcggcc

SEQ ID NO: 2398018 - RNA, 15 nt, Bordetella pertussis
cuccauggcgccggc

SEQ ID NO: 2398019 - RNA, 16 nt, Bordetella pertussis
cuccauggcgccggcg

SEQ ID NO: 2398020 - RNA, 23 nt, Bordetella pertussis
cuccauguaaaaacccggccugc

SEQ ID NO: 2398021 - RNA, 18 nt, Bordetella pertussis
cucccacgaacgccacgc

SEQ ID NO: 2398022 - RNA, 14 nt, Bordetella pertussis
cuugccgccgggca

SEQ ID NO: 2398023 - RNA, 21 nt, Bordetella pertussis
cuugccgccgggcaugcacca

SEQ ID NO: 2398024 - RNA, 18 nt, Bordetella pertussis
cuugccgccgugcgagca

SEQ ID NO: 2398025 - RNA, 15 nt, Bordetella pertussis
cuugccgcgcagcgu

SEQ ID NO: 2398026 - RNA, 16 nt, Bordetella pertussis
cuugccgcggcgcggc

SEQ ID NO: 2398027 - RNA, 20 nt, Bordetella pertussis
cuugccggaggucggcgcaa

SEQ ID NO: 2398028 - RNA, 12 nt, Bordetella pertussis
cuugccggccca

SEQ ID NO: 2398029 - RNA, 13 nt, Bordetella pertussis
cuugccggcccgg

SEQ ID NO: 2398030 - RNA, 14 nt, Bordetella pertussis
cuugccggcccggu

SEQ ID NO: 2398031 - RNA, 14 nt, Bordetella pertussis
cuugccggccgccc

SEQ ID NO: 2398032 - RNA, 16 nt, Bordetella pertussis
cuugccggccgcccag

SEQ ID NO: 2398033 - RNA, 23 nt, Bordetella pertussis
cuugccggccgcccaggcgcagc

SEQ ID NO: 2398034 - RNA, 18 nt, Bordetella pertussis
cuugccggccuggcgggc

SEQ ID NO: 2398035 - RNA, 15 nt, Bordetella pertussis
cuugccggccuguuc

SEQ ID NO: 2398036 - RNA, 16 nt, Bordetella pertussis
cuugccggccuguucu

SEQ ID NO: 2398037 - RNA, 19 nt, Bordetella pertussis
cuugccggcgaucacgccg

SEQ ID NO: 2398038 - RNA, 18 nt, Bordetella pertussis
cuugccgguggacggcca

SEQ ID NO: 2398039 - RNA, 21 nt, Bordetella pertussis
cuugccguaggguucgccgcu

SEQ ID NO: 2398040 - RNA, 23 nt, Bordetella pertussis
cuugccguaggguucgccgcugu

SEQ ID NO: 2398041 - RNA, 19 nt, Bordetella pertussis
cuugccgucgaccgcgaag

SEQ ID NO: 2398042 - RNA, 13 nt, Bordetella pertussis
cuugccguugagc

SEQ ID NO: 2398043 - RNA, 15 nt, Bordetella pertussis
cuugccguugagcac

SEQ ID NO: 2398044 - RNA, 15 nt, Bordetella pertussis
cuugccuguccccac

SEQ ID NO: 2398045 - RNA, 16 nt, Bordetella pertussis
cuugccuugcgcggcc

SEQ ID NO: 2398046 - RNA, 19 nt, Bordetella pertussis
cuugcgaggcccggccugc

SEQ ID NO: 2398047 - RNA, 21 nt, Bordetella pertussis
cuugcgaggcccggccugcgu

SEQ ID NO: 2398048 - RNA, 16 nt, Bordetella pertussis
cuugcgcaagccggcc

SEQ ID NO: 2398049 - RNA, 20 nt, Bordetella pertussis
cuugcgcaagccggccgcgc

SEQ ID NO: 2398050 - RNA, 13 nt, Bordetella pertussis
cuugcgcagcgcg

SEQ ID NO: 2398051 - RNA, 15 nt, Bordetella pertussis
cuugcgcagcgcggc

SEQ ID NO: 2398052 - RNA, 23 nt, Bordetella pertussis
cuugcgcagggcgggcggugcgg

SEQ ID NO: 2398053 - RNA, 17 nt, Bordetella pertussis
cuugcgcaucggcggca

SEQ ID NO: 2398054 - RNA, 21 nt, Bordetella pertussis
cuugcgccagccacgcgcgcu

SEQ ID NO: 2398055 - RNA, 14 nt, Bordetella pertussis
cuugcgccgcugcg

SEQ ID NO: 2398056 - RNA, 18 nt, Bordetella pertussis
cuugcgcgaaggccgccc

SEQ ID NO: 2398057 - RNA, 20 nt, Bordetella pertussis
cuugcgcgaaggccgccccc

SEQ ID NO: 2398058 - RNA, 15 nt, Bordetella pertussis
cuugcgcgacagcag

SEQ ID NO: 2398059 - RNA, 19 nt, Bordetella pertussis
cuugcgcgacagcaggccg

SEQ ID NO: 2398060 - RNA, 20 nt, Bordetella pertussis
cuugcgcgacagcaggccgg

SEQ ID NO: 2398061 - RNA, 16 nt, Bordetella pertussis
cuugcgcgacggcgau

SEQ ID NO: 2398062 - RNA, 21 nt, Bordetella pertussis
cuugcgcgcccccacgccgcu

SEQ ID NO: 2398063 - RNA, 15 nt, Bordetella pertussis
cuugcgcgcgccgga

SEQ ID NO: 2398064 - RNA, 14 nt, Bordetella pertussis
cuugcgcggccacc

SEQ ID NO: 2398065 - RNA, 21 nt, Bordetella pertussis
cuugcgcggccacccugccgu

SEQ ID NO: 2398066 - RNA, 15 nt, Bordetella pertussis
cuugcgcggccagca

SEQ ID NO: 2398067 - RNA, 22 nt, Bordetella pertussis
cuugcgcggccagcaccggccc

SEQ ID NO: 2398068 - RNA, 14 nt, Bordetella pertussis
cuugcgcggcgagc

SEQ ID NO: 2398069 - RNA, 18 nt, Bordetella pertussis
cuugcgcggcgagcgccg

SEQ ID NO: 2398070 - RNA, 21 nt, Bordetella pertussis
cuugcgcggcgagcgccgcca

SEQ ID NO: 2398071 - RNA, 20 nt, Bordetella pertussis
cuugcgcguaggcgcgcgca

SEQ ID NO: 2398072 - RNA, 15 nt, Bordetella pertussis
cuugcgcguccaggc

SEQ ID NO: 2398073 - RNA, 17 nt, Bordetella pertussis
cuugcgcucgcccagca

SEQ ID NO: 2398074 - RNA, 13 nt, Bordetella pertussis
cuugcgcuggcgc

SEQ ID NO: 2398075 - RNA, 15 nt, Bordetella pertussis
cuugcgcuggcgcgc

SEQ ID NO: 2398076 - RNA, 18 nt, Bordetella pertussis
cuugcgcuggcgcgcggc

SEQ ID NO: 2398077 - RNA, 20 nt, Bordetella pertussis
cuugcgcuuuuuucuccagc

SEQ ID NO: 2398078 - RNA, 21 nt, Bordetella pertussis
cuugcgcuuuuuucuccagcg

SEQ ID NO: 2398079 - RNA, 22 nt, Bordetella pertussis
cuugcgcuuuuuucuccagcgc

SEQ ID NO: 2398080 - RNA, 23 nt, Bordetella pertussis
cuugcgcuuuuuucuccagcgcc

SEQ ID NO: 2398081 - RNA, 13 nt, Bordetella pertussis
cuugcggccgcgc

SEQ ID NO: 2398082 - RNA, 14 nt, Bordetella pertussis
cuugcggccgcgca

SEQ ID NO: 2398083 - RNA, 14 nt, Bordetella pertussis
cuugcggccggcgc

SEQ ID NO: 2398084 - RNA, 14 nt, Bordetella pertussis
cuugcggcgaggcu

SEQ ID NO: 2398085 - RNA, 22 nt, Bordetella pertussis
cuugcggcgaugcacccaggcg

SEQ ID NO: 2398086 - RNA, 19 nt, Bordetella pertussis
cuugcggcgcuggcuggac

SEQ ID NO: 2398087 - RNA, 21 nt, Bordetella pertussis
cuugcgggccggcugggcggc

SEQ ID NO: 2398088 - RNA, 16 nt, Bordetella pertussis
cuugcggguccagcag

SEQ ID NO: 2398089 - RNA, 20 nt, Bordetella pertussis
cuugcggguccagcaggaug

SEQ ID NO: 2398090 - RNA, 20 nt, Bordetella pertussis
cuugcgguccguacgccacu

SEQ ID NO: 2398091 - RNA, 19 nt, Bordetella pertussis
cuugcgguugaaggcgaac

SEQ ID NO: 2398092 - RNA, 14 nt, Bordetella pertussis
cuugcguucaugcc

SEQ ID NO: 2398093 - RNA, 15 nt, Bordetella pertussis
cuugcucagucgggc

SEQ ID NO: 2398094 - RNA, 22 nt, Bordetella pertussis
cuugcucagucgggcagcgccc

SEQ ID NO: 2398095 - RNA, 14 nt, Bordetella pertussis
cuugcucaucacca

SEQ ID NO: 2398096 - RNA, 21 nt, Bordetella pertussis
cuugcucccaguucugcagcg

SEQ ID NO: 2398097 - RNA, 16 nt, Bordetella pertussis
cuugcucgcccauggc

SEQ ID NO: 2398098 - RNA, 18 nt, Bordetella pertussis
cuugcucgcccauggcau

SEQ ID NO: 2398099 - RNA, 18 nt, Bordetella pertussis
cuugcugaaccugcuggc

SEQ ID NO: 2398100 - RNA, 22 nt, Bordetella pertussis
cuugcugaaccugcuggccgcc

SEQ ID NO: 2398101 - RNA, 22 nt, Bordetella pertussis
cuugcugauuucgaucaugcgc

SEQ ID NO: 2398102 - RNA, 13 nt, Bordetella pertussis
cuugcugcccccc

SEQ ID NO: 2398103 - RNA, 14 nt, Bordetella pertussis
cuugcugcccgacg

SEQ ID NO: 2398104 - RNA, 17 nt, Bordetella pertussis
cuugcugcccgacggcg

SEQ ID NO: 2398105 - RNA, 15 nt, Bordetella pertussis
cuugcugcuguuggc

SEQ ID NO: 2398106 - RNA, 20 nt, Bordetella pertussis
cuugcuggaccgcgccuggg

SEQ ID NO: 2398107 - RNA, 18 nt, Bordetella pertussis
cuugcuguccagucugga

SEQ ID NO: 2398108 - RNA, 16 nt, Bordetella pertussis
cuugcuugccagcucg

SEQ ID NO: 2398109 - RNA, 15 nt, Bordetella pertussis
cuuggaguucuucuu

SEQ ID NO: 2398110 - RNA, 20 nt, Bordetella pertussis
cuuggaguucuucuuggcca

SEQ ID NO: 2398111 - RNA, 13 nt, Bordetella pertussis
cuuggccaccacg

SEQ ID NO: 2398112 - RNA, 16 nt, Bordetella pertussis
cuuggccacuucgccg

SEQ ID NO: 2398113 - RNA, 16 nt, Bordetella pertussis
cuuggccagcagcgca

SEQ ID NO: 2398114 - RNA, 23 nt, Bordetella pertussis
cuuggccgaacauauccacgcca

SEQ ID NO: 2398115 - RNA, 11 nt, Bordetella pertussis
cuuggccgcag

SEQ ID NO: 2398116 - RNA, 16 nt, Bordetella pertussis
cuuggccgcagccggc

SEQ ID NO: 2398117 - RNA, 16 nt, Bordetella pertussis
cuuggccgccacgcug

SEQ ID NO: 2398118 - RNA, 17 nt, Bordetella pertussis
cuuggccucggccggca

SEQ ID NO: 2398119 - RNA, 14 nt, Bordetella pertussis
cuuggccugggcgc

SEQ ID NO: 2398120 - RNA, 14 nt, Bordetella pertussis
gacgacggccggcg

SEQ ID NO: 2398121 - RNA, 16 nt, Bordetella pertussis
gacgacggccggcgcg

SEQ ID NO: 2398122 - RNA, 14 nt, Bordetella pertussis
gacgacuacgcgcu

SEQ ID NO: 2398123 - RNA, 16 nt, Bordetella pertussis
gacgacuucgacggca

SEQ ID NO: 2398124 - RNA, 19 nt, Bordetella pertussis
gacgagaaugcgccguccg

SEQ ID NO: 2398125 - RNA, 14 nt, Bordetella pertussis
gacgagacaggcgc

SEQ ID NO: 2398126 - RNA, 17 nt, Bordetella pertussis
gacgagacaggcgcgcc

SEQ ID NO: 2398127 - RNA, 20 nt, Bordetella pertussis
gacgagacaggcgcgccauc

SEQ ID NO: 2398128 - RNA, 14 nt, Bordetella pertussis
gacgagaucgcgcc

SEQ ID NO: 2398129 - RNA, 22 nt, Bordetella pertussis
gacgagcaagcccacaccauca

SEQ ID NO: 2398130 - RNA, 13 nt, Bordetella pertussis
gacgagcgcacca

SEQ ID NO: 2398131 - RNA, 19 nt, Bordetella pertussis
gacgagcgcaccauggcgc

SEQ ID NO: 2398132 - RNA, 20 nt, Bordetella pertussis
gacgagcgcaccauggcgcc

SEQ ID NO: 2398133 - RNA, 15 nt, Bordetella pertussis
gacgaggagccggcg

SEQ ID NO: 2398134 - RNA, 16 nt, Bordetella pertussis
gacgaggagccggcgg

SEQ ID NO: 2398135 - RNA, 20 nt, Bordetella pertussis
gacgaggccgaguagcggcg

SEQ ID NO: 2398136 - RNA, 14 nt, Bordetella pertussis
gacgagggccgcgg

SEQ ID NO: 2398137 - RNA, 16 nt, Bordetella pertussis
gacgagggccgcggcg

SEQ ID NO: 2398138 - RNA, 19 nt, Bordetella pertussis
gacgagggccggcgccagc

SEQ ID NO: 2398139 - RNA, 15 nt, Bordetella pertussis
gacgagggcgccaug

SEQ ID NO: 2398140 - RNA, 18 nt, Bordetella pertussis
gacgaggggguguucucc

SEQ ID NO: 2398141 - RNA, 14 nt, Bordetella pertussis
gacgaggugccugu

SEQ ID NO: 2398142 - RNA, 21 nt, Bordetella pertussis
gacgaguugcucggagcccag

SEQ ID NO: 2398143 - RNA, 16 nt, Bordetella pertussis
gacgaucacgguggcg

SEQ ID NO: 2398144 - RNA, 18 nt, Bordetella pertussis
gacgaucauccaggccgu

SEQ ID NO: 2398145 - RNA, 20 nt, Bordetella pertussis
gacgaucauccaggccguga

SEQ ID NO: 2398146 - RNA, 12 nt, Bordetella pertussis
gacgauccggcg

SEQ ID NO: 2398147 - RNA, 16 nt, Bordetella pertussis
gacgauccggcgaccg

SEQ ID NO: 2398148 - RNA, 15 nt, Bordetella pertussis
gacgaucuccacccc

SEQ ID NO: 2398149 - RNA, 17 nt, Bordetella pertussis
gacgaucucgcccugcu

SEQ ID NO: 2398150 - RNA, 15 nt, Bordetella pertussis
gacgaucucgcggcu

SEQ ID NO: 2398151 - RNA, 22 nt, Bordetella pertussis
gacgaucucgcggcugguggug

SEQ ID NO: 2398152 - RNA, 19 nt, Bordetella pertussis
gacgaucucggcguugacc

SEQ ID NO: 2398153 - RNA, 23 nt, Bordetella pertussis
gacgaugaucaugaugaugaugu

SEQ ID NO: 2398154 - RNA, 15 nt, Bordetella pertussis
gacgaugcccaggcc

SEQ ID NO: 2398155 - RNA, 15 nt, Bordetella pertussis
gacgaugcccugcgc

SEQ ID NO: 2398156 - RNA, 14 nt, Bordetella pertussis
gacgaugccgccgc

SEQ ID NO: 2398157 - RNA, 11 nt, Bordetella pertussis
gacgaugcgcg

SEQ ID NO: 2398158 - RNA, 23 nt, Bordetella pertussis
gacgauggaaaugccguccagga

SEQ ID NO: 2398159 - RNA, 15 nt, Bordetella pertussis
gacgauggccggggc

SEQ ID NO: 2398160 - RNA, 17 nt, Bordetella pertussis
gacgauggucuugccgc

SEQ ID NO: 2398161 - RNA, 20 nt, Bordetella pertussis
gacgauggucuugccgccgu

SEQ ID NO: 2398162 - RNA, 21 nt, Bordetella pertussis
gacgauguagaucuggcgcgu

SEQ ID NO: 2398163 - RNA, 14 nt, Bordetella pertussis
gacgaugucgccgc

SEQ ID NO: 2398164 - RNA, 22 nt, Bordetella pertussis
gacgauguucaggccaugcugg

SEQ ID NO: 2398165 - RNA, 17 nt, Bordetella pertussis
gacgcaaaaacgcccgg

SEQ ID NO: 2398166 - RNA, 18 nt, Bordetella pertussis
gacgcaaaaacgcccggc

SEQ ID NO: 2398167 - RNA, 22 nt, Bordetella pertussis
gacgcaaaaacgcccggcgcgg

SEQ ID NO: 2398168 - RNA, 21 nt, Bordetella pertussis
gacgcaacagacccgggccgc

SEQ ID NO: 2398169 - RNA, 16 nt, Bordetella pertussis
gacgcaaccggucggc

SEQ ID NO: 2398170 - RNA, 13 nt, Bordetella pertussis
gacgcagaccacg

SEQ ID NO: 2398171 - RNA, 15 nt, Bordetella pertussis
gacgcagaccacgcc

SEQ ID NO: 2398172 - RNA, 20 nt, Bordetella pertussis
gacggucaggggcaggcgca

SEQ ID NO: 2398173 - RNA, 21 nt, Bordetella pertussis
gacggucaggggcaggcgcac

SEQ ID NO: 2398174 - RNA, 22 nt, Bordetella pertussis
gacggucaggggcaggcgcacg

SEQ ID NO: 2398175 - RNA, 20 nt, Bordetella pertussis
gacggucugggccaugccgu

SEQ ID NO: 2398176 - RNA, 14 nt, Bordetella pertussis
gacggugccggcca

SEQ ID NO: 2398177 - RNA, 14 nt, Bordetella pertussis
gacggugcgcgcca

SEQ ID NO: 2398178 - RNA, 15 nt, Bordetella pertussis
gacgguggccgcggc

SEQ ID NO: 2398179 - RNA, 16 nt, Bordetella pertussis
gacgguggccgcggcg

SEQ ID NO: 2398180 - RNA, 19 nt, Bordetella pertussis
gacgguggccgcggcgucc

SEQ ID NO: 2398181 - RNA, 17 nt, Bordetella pertussis
gacgguggugucggcgg

SEQ ID NO: 2398182 - RNA, 19 nt, Bordetella pertussis
gacgguggugucggcggcc

SEQ ID NO: 2398183 - RNA, 20 nt, Bordetella pertussis
gacgguggugucggcggcca

SEQ ID NO: 2398184 - RNA, 15 nt, Bordetella pertussis
gacggugucgcugac

SEQ ID NO: 2398185 - RNA, 20 nt, Bordetella pertussis
gacgguuaacgaaucgcugc

SEQ ID NO: 2398186 - RNA, 22 nt, Bordetella pertussis
gacgguuaacgaaucgcugccu

SEQ ID NO: 2398187 - RNA, 18 nt, Bordetella pertussis
gacguaccaagccugcuu

SEQ ID NO: 2398188 - RNA, 18 nt, Bordetella pertussis
gacguacuucucgucgcg

SEQ ID NO: 2398189 - RNA, 22 nt, Bordetella pertussis
gacguacuucucgucgcgcaug

SEQ ID NO: 2398190 - RNA, 15 nt, Bordetella pertussis
gacguacuugaucug

SEQ ID NO: 2398191 - RNA, 14 nt, Bordetella pertussis
gacguagccgcugc

SEQ ID NO: 2398192 - RNA, 16 nt, Bordetella pertussis
gacguagccgcugccg

SEQ ID NO: 2398193 - RNA, 19 nt, Bordetella pertussis
gacguagccgcugccguug

SEQ ID NO: 2398194 - RNA, 20 nt, Bordetella pertussis
gacguagcggaucgcggcgc

SEQ ID NO: 2398195 - RNA, 18 nt, Bordetella pertussis
gacguagucgcacgcggc

SEQ ID NO: 2398196 - RNA, 19 nt, Bordetella pertussis
gacguagucgcacgcggcu

SEQ ID NO: 2398197 - RNA, 20 nt, Bordetella pertussis
gacguagucgcgccagcggc

SEQ ID NO: 2398198 - RNA, 15 nt, Bordetella pertussis
gacguagucggcgcc

SEQ ID NO: 2398199 - RNA, 22 nt, Bordetella pertussis
gacguccacgaugucguccagc

SEQ ID NO: 2398200 - RNA, 14 nt, Bordetella pertussis
gacguccagcccgu

SEQ ID NO: 2398201 - RNA, 22 nt, Bordetella pertussis
gacguccagcccgugggcggcg

SEQ ID NO: 2398202 - RNA, 14 nt, Bordetella pertussis
gacguccagcgcca

SEQ ID NO: 2398203 - RNA, 15 nt, Bordetella pertussis
gacguccagcgccac

SEQ ID NO: 2398204 - RNA, 17 nt, Bordetella pertussis
gacguccagcgccacca

SEQ ID NO: 2398205 - RNA, 21 nt, Bordetella pertussis
gacguccagcgccaccagcag

SEQ ID NO: 2398206 - RNA, 12 nt, Bordetella pertussis
gacguccaggcc

SEQ ID NO: 2398207 - RNA, 19 nt, Bordetella pertussis
gacgucccaggccgaagcc

SEQ ID NO: 2398208 - RNA, 20 nt, Bordetella pertussis
gacgucccaggccgaagcca

SEQ ID NO: 2398209 - RNA, 13 nt, Bordetella pertussis
gacguccggcggg

SEQ ID NO: 2398210 - RNA, 21 nt, Bordetella pertussis
gacguccugguggaccugccg

SEQ ID NO: 2398211 - RNA, 13 nt, Bordetella pertussis
gacgucgaucgag

SEQ ID NO: 2398212 - RNA, 13 nt, Bordetella pertussis
gacgucgcccaac

SEQ ID NO: 2398213 - RNA, 21 nt, Bordetella pertussis
gacgucgcccuggauggcggc

SEQ ID NO: 2398214 - RNA, 23 nt, Bordetella pertussis
gacgucgcccuggauggcggccg

SEQ ID NO: 2398215 - RNA, 19 nt, Bordetella pertussis
gacgucggccucgcgcagg

SEQ ID NO: 2398216 - RNA, 18 nt, Bordetella pertussis
gacgucggcgauggcccg

SEQ ID NO: 2398217 - RNA, 16 nt, Bordetella pertussis
gacgucggugacggcg

SEQ ID NO: 2398218 - RNA, 16 nt, Bordetella pertussis
gacgucguaccccgag

SEQ ID NO: 2398219 - RNA, 17 nt, Bordetella pertussis
gacgucguagugcgcgc

SEQ ID NO: 2398220 - RNA, 21 nt, Bordetella pertussis
gacgucgucgguggggcaggu

SEQ ID NO: 2398221 - RNA, 22 nt, Bordetella pertussis
gacgucuucguacagccugccc

SEQ ID NO: 2398222 - RNA, 13 nt, Bordetella pertussis
gacgucuugcugc

SEQ ID NO: 2398223 - RNA, 15 nt, Bordetella pertussis
gacgugaaagcucca

SEQ ID NO: 2398224 - RNA, 18 nt, Bordetella pertussis
gacgugcgcgaccgcgcg

SEQ ID NO: 2398225 - RNA, 19 nt, Bordetella pertussis
gacgugcgcgaccgcgcgg

SEQ ID NO: 2398226 - RNA, 16 nt, Bordetella pertussis
gacgugcugcugcacg

SEQ ID NO: 2398227 - RNA, 19 nt, Bordetella pertussis
gacgugcugcugcacguga

SEQ ID NO: 2398228 - RNA, 15 nt, Bordetella pertussis
gacguggaccgcgcg

SEQ ID NO: 2398229 - RNA, 17 nt, Bordetella pertussis
gacguggccuaccacgc

SEQ ID NO: 2398230 - RNA, 14 nt, Bordetella pertussis
gacguggcgcucca

SEQ ID NO: 2398231 - RNA, 22 nt, Bordetella pertussis
gacgugggcgccuacggcggcg

SEQ ID NO: 2398232 - RNA, 23 nt, Bordetella pertussis
gacgugucccccggugccgaaga

SEQ ID NO: 2398233 - RNA, 18 nt, Bordetella pertussis
gacgugucggccaccacg

SEQ ID NO: 2398234 - RNA, 16 nt, Bordetella pertussis
gacguucuccagcgcc

SEQ ID NO: 2398235 - RNA, 17 nt, Bordetella pertussis
gacguucuccagcgccg

SEQ ID NO: 2398236 - RNA, 16 nt, Bordetella pertussis
gacguugccgcgcgcg

SEQ ID NO: 2398237 - RNA, 17 nt, Bordetella pertussis
gacguugccgcgcgcgu

SEQ ID NO: 2398238 - RNA, 12 nt, Bordetella pertussis
gacguugcgcga

SEQ ID NO: 2398239 - RNA, 19 nt, Bordetella pertussis
gacguugcgcgacaggccc

SEQ ID NO: 2398240 - RNA, 20 nt, Bordetella pertussis
gacguugcgcgacaggcccg

SEQ ID NO: 2398241 - RNA, 13 nt, Bordetella pertussis
gacguuggcgaau

SEQ ID NO: 2398242 - RNA, 20 nt, Bordetella pertussis
gacguuggcgaaugccuggu

SEQ ID NO: 2398243 - RNA, 18 nt, Bordetella pertussis
gacguuggucaccacgcc

SEQ ID NO: 2398244 - RNA, 14 nt, Bordetella pertussis
gacguuguccaggc

SEQ ID NO: 2398245 - RNA, 22 nt, Bordetella pertussis
gacguuguucaggaaggcccgg

SEQ ID NO: 2398246 - RNA, 14 nt, Bordetella pertussis
gacuacgcgcuggc

SEQ ID NO: 2398247 - RNA, 16 nt, Bordetella pertussis
gacuacgcgcuggcgc

SEQ ID NO: 2398248 - RNA, 18 nt, Bordetella pertussis
gacuacgcgcuggcgcag

SEQ ID NO: 2398249 - RNA, 19 nt, Bordetella pertussis
gacuacggcggacuggccg

SEQ ID NO: 2398250 - RNA, 14 nt, Bordetella pertussis
gacuauagcucucu

SEQ ID NO: 2398251 - RNA, 19 nt, Bordetella pertussis
gacuauggccuggaugugc

SEQ ID NO: 2398252 - RNA, 20 nt, Bordetella pertussis
gacucauaggcaucgaccag

SEQ ID NO: 2398253 - RNA, 19 nt, Bordetella pertussis
gacuccaggagcucguccc

SEQ ID NO: 2398254 - RNA, 20 nt, Bordetella pertussis
gacucccaugacccugcacg

SEQ ID NO: 2398255 - RNA, 17 nt, Bordetella pertussis
gacuccggccgggccag

SEQ ID NO: 2398256 - RNA, 15 nt, Bordetella pertussis
gacucgaaacgggcg

SEQ ID NO: 2398257 - RNA, 18 nt, Bordetella pertussis
gacucgaaacgggcggcg

SEQ ID NO: 2398258 - RNA, 20 nt, Bordetella pertussis
gacucgaaacgggcggcguc

SEQ ID NO: 2398259 - RNA, 19 nt, Bordetella pertussis
gacucgacgaacacgcgcg

SEQ ID NO: 2398260 - RNA, 16 nt, Bordetella pertussis
gacucgauggcgcagg

SEQ ID NO: 2398261 - RNA, 21 nt, Bordetella pertussis
gacucgccgugcugggcggcc

SEQ ID NO: 2398262 - RNA, 17 nt, Bordetella pertussis
gacucggccgagaacgc

SEQ ID NO: 2398263 - RNA, 13 nt, Bordetella pertussis
gacucgggcaugc

SEQ ID NO: 2398264 - RNA, 19 nt, Bordetella pertussis
gacucgggcaugcgccugc

SEQ ID NO: 2398265 - RNA, 23 nt, Bordetella pertussis
gacucgggcaugcgccugcgcca

SEQ ID NO: 2398266 - RNA, 19 nt, Bordetella pertussis
gacucguccauggugggca

SEQ ID NO: 2398267 - RNA, 16 nt, Bordetella pertussis
gacucgucgaccacca

SEQ ID NO: 2398268 - RNA, 18 nt, Bordetella pertussis
gacucgucgaccaccagc

SEQ ID NO: 2398269 - RNA, 18 nt, Bordetella pertussis
gacucuuuuggagaugug

SEQ ID NO: 2398270 - RNA, 14 nt, Bordetella pertussis
gacugagucgucau

SEQ ID NO: 2398271 - RNA, 14 nt, Bordetella pertussis
gacugcagcaggcu

SEQ ID NO: 2398272 - RNA, 15 nt, Bordetella pertussis
gacugcaggcgcugc

SEQ ID NO: 2398273 - RNA, 18 nt, Bordetella pertussis
gacugccccagcggcugg

SEQ ID NO: 2398274 - RNA, 19 nt, Bordetella pertussis
gacugccccagcggcuggc

SEQ ID NO: 2398275 - RNA, 20 nt, Bordetella pertussis
gacugccccagcggcuggcg

SEQ ID NO: 2398276 - RNA, 12 nt, Bordetella pertussis
gacugcgccgca

SEQ ID NO: 2398277 - RNA, 16 nt, Bordetella pertussis
gacugcggugccuguc

SEQ ID NO: 2398278 - RNA, 21 nt, Bordetella pertussis
gacugcuguacgacagcaagg

SEQ ID NO: 2398279 - RNA, 14 nt, Bordetella pertussis
gacuggacgaugag

SEQ ID NO: 2398280 - RNA, 19 nt, Bordetella pertussis
gacuggacgaugagcuggu

SEQ ID NO: 2398281 - RNA, 16 nt, Bordetella pertussis
gacuggauauggcgcc

SEQ ID NO: 2398282 - RNA, 15 nt, Bordetella pertussis
gacuggcaccaaucc

SEQ ID NO: 2398283 - RNA, 24 nt, Bordetella pertussis
gacuggcacccgccaauugcuugc

SEQ ID NO: 2398284 - RNA, 17 nt, Bordetella pertussis
gacuggcaccggccaag

SEQ ID NO: 2398285 - RNA, 23 nt, Bordetella pertussis
gacuggcaccggccaagcuccag

SEQ ID NO: 2398286 - RNA, 16 nt, Bordetella pertussis
gacuggcaccugcaag

SEQ ID NO: 2398287 - RNA, 16 nt, Bordetella pertussis
gacuggcacgcgcuga

SEQ ID NO: 2398288 - RNA, 22 nt, Bordetella pertussis
gacuggcccaggcgggccaggu

SEQ ID NO: 2398289 - RNA, 12 nt, Bordetella pertussis
gacuggccgcgc

SEQ ID NO: 2398290 - RNA, 15 nt, Bordetella pertussis
gacuggccgcgccgc

SEQ ID NO: 2398291 - RNA, 22 nt, Bordetella pertussis
gacuggccgcgccgcuggcggc

SEQ ID NO: 2398292 - RNA, 15 nt, Bordetella pertussis
gacuggcgcgcacca

SEQ ID NO: 2398293 - RNA, 19 nt, Bordetella pertussis
gacuggcggcugcgggcgc

SEQ ID NO: 2398294 - RNA, 21 nt, Bordetella pertussis
gacugggcggauuggacagca

SEQ ID NO: 2398295 - RNA, 17 nt, Bordetella pertussis
gacugggugcgccugac

SEQ ID NO: 2398296 - RNA, 18 nt, Bordetella pertussis
gacugugcagccacgccu

SEQ ID NO: 2398297 - RNA, 18 nt, Bordetella pertussis
gacuuccggggagccugc

SEQ ID NO: 2398298 - RNA, 19 nt, Bordetella pertussis
gacuuccggggagccugcc

SEQ ID NO: 2398299 - RNA, 19 nt, Bordetella pertussis
gacuuccgugccauacagc

SEQ ID NO: 2398300 - RNA, 20 nt, Bordetella pertussis
gacuucgacccggacaacgc

SEQ ID NO: 2398301 - RNA, 20 nt, Bordetella pertussis
gacuucgcgaaagcgcugcg

SEQ ID NO: 2398302 - RNA, 19 nt, Bordetella pertussis
gacuucggcggccaugccg

SEQ ID NO: 2398303 - RNA, 14 nt, Bordetella pertussis
gacuucggcggccu

SEQ ID NO: 2398304 - RNA, 15 nt, Bordetella pertussis
gacuucggcggccug

SEQ ID NO: 2398305 - RNA, 20 nt, Bordetella pertussis
gacuucggucagcuugccgc

SEQ ID NO: 2398306 - RNA, 21 nt, Bordetella pertussis
gacuucgucaacgcccugacg

SEQ ID NO: 2398307 - RNA, 21 nt, Bordetella pertussis
gacuucucuuucucgggcguc

SEQ ID NO: 2398308 - RNA, 18 nt, Bordetella pertussis
gacuugaaucccgacgag

SEQ ID NO: 2398309 - RNA, 15 nt, Bordetella pertussis
gacuugggcaggccu

SEQ ID NO: 2398310 - RNA, 15 nt, Bordetella pertussis
gagaaaccagccgcc

SEQ ID NO: 2398311 - RNA, 21 nt, Bordetella pertussis
gagaaaccgauggugccgggc

SEQ ID NO: 2398312 - RNA, 15 nt, Bordetella pertussis
gagaaagaagccccc

SEQ ID NO: 2398313 - RNA, 23 nt, Bordetella pertussis
gagaaagaagcccccgcgcugcg

SEQ ID NO: 2398314 - RNA, 18 nt, Bordetella pertussis
gagaaaggccgccacgaa

SEQ ID NO: 2398315 - RNA, 12 nt, Bordetella pertussis
gagaaauccagc

SEQ ID NO: 2398316 - RNA, 17 nt, Bordetella pertussis
gagaacagccacacgcu

SEQ ID NO: 2398317 - RNA, 13 nt, Bordetella pertussis
gagaacaggcggc

SEQ ID NO: 2398318 - RNA, 16 nt, Bordetella pertussis
gagaacgagccggccg

SEQ ID NO: 2398319 - RNA, 19 nt, Bordetella pertussis
gagaacgagccggccgcgc

SEQ ID NO: 2398320 - RNA, 23 nt, Bordetella pertussis
gagaacgagccggccgcgcccga

SEQ ID NO: 2398321 - RNA, 16 nt, Bordetella pertussis
gagaacgccgucgggg

SEQ ID NO: 2398322 - RNA, 21 nt, Bordetella pertussis
gagaacgccgucgggguggcg

SEQ ID NO: 2398323 - RNA, 17 nt, Bordetella pertussis
gagaacgcggccgcgac

SEQ ID NO: 2398324 - RNA, 16 nt, Bordetella pertussis
gagaacgcgucgcuca

SEQ ID NO: 2398325 - RNA, 15 nt, Bordetella pertussis
gagaacucgguggcg

SEQ ID NO: 2398326 - RNA, 18 nt, Bordetella pertussis
gagaagauuucccagagc

SEQ ID NO: 2398327 - RNA, 17 nt, Bordetella pertussis
gagaagcgccgcgccga

SEQ ID NO: 2398328 - RNA, 20 nt, Bordetella pertussis
gagaagggcuugaccagggc

SEQ ID NO: 2398329 - RNA, 17 nt, Bordetella pertussis
gagaagucaucgauggc

SEQ ID NO: 2398330 - RNA, 15 nt, Bordetella pertussis
gagaaguuggcgggc

SEQ ID NO: 2398331 - RNA, 18 nt, Bordetella pertussis
gagaaucaugggcgacgc

SEQ ID NO: 2398332 - RNA, 14 nt, Bordetella pertussis
gagaauccgcaggc

SEQ ID NO: 2398333 - RNA, 13 nt, Bordetella pertussis
gagacaggcgcgc

SEQ ID NO: 2398334 - RNA, 15 nt, Bordetella pertussis
gagacaggcgcgcca

SEQ ID NO: 2398335 - RNA, 15 nt, Bordetella pertussis
gagacaucaugcaga

SEQ ID NO: 2398336 - RNA, 16 nt, Bordetella pertussis
gagacaucaugcagaa

SEQ ID NO: 2398337 - RNA, 22 nt, Bordetella pertussis
gagaccaagcugcgcgaggacc

SEQ ID NO: 2398338 - RNA, 14 nt, Bordetella pertussis
gagaccagcagcgg

SEQ ID NO: 2398339 - RNA, 13 nt, Bordetella pertussis
gagaccaugacgu

SEQ ID NO: 2398340 - RNA, 15 nt, Bordetella pertussis
gagaccaugacgucg

SEQ ID NO: 2398341 - RNA, 16 nt, Bordetella pertussis
gagaccgcccgcugcu

SEQ ID NO: 2398342 - RNA, 19 nt, Bordetella pertussis
gagaccggcgccugcggca

SEQ ID NO: 2398343 - RNA, 22 nt, Bordetella pertussis
gagaccguggaaaccgcgucgu

SEQ ID NO: 2398344 - RNA, 22 nt, Bordetella pertussis
gagaccuugugcggcagguuga

SEQ ID NO: 2398345 - RNA, 23 nt, Bordetella pertussis
gagaccuugugcggcagguugaa

SEQ ID NO: 2398346 - RNA, 19 nt, Bordetella pertussis
gagacgaaggcgccggcca

SEQ ID NO: 2398347 - RNA, 19 nt, Bordetella pertussis
gagacgcgcucgcgcgcgu

SEQ ID NO: 2398348 - RNA, 15 nt, Bordetella pertussis
gagacgcugucgcgc

SEQ ID NO: 2398349 - RNA, 22 nt, Bordetella pertussis
gagacgucuucguacagccugc

SEQ ID NO: 2398350 - RNA, 16 nt, Bordetella pertussis
gagacuggcaccggcc

SEQ ID NO: 2398351 - RNA, 15 nt, Bordetella pertussis
gagacuggcagugcg

SEQ ID NO: 2398352 - RNA, 15 nt, Bordetella pertussis
gagagccggccacgc

SEQ ID NO: 2398353 - RNA, 21 nt, Bordetella pertussis
gagagccggccacgcgcugca

SEQ ID NO: 2398354 - RNA, 18 nt, Bordetella pertussis
gagagccugggcgcgcgc

SEQ ID NO: 2398355 - RNA, 14 nt, Bordetella pertussis
gagagcgccacgcc

SEQ ID NO: 2398356 - RNA, 22 nt, Bordetella pertussis
gagagcgccacgccagcggcga

SEQ ID NO: 2398357 - RNA, 15 nt, Bordetella pertussis
gagaggaucaccgca

SEQ ID NO: 2398358 - RNA, 21 nt, Bordetella pertussis
gagaggaucaccgcauggaac

SEQ ID NO: 2398359 - RNA, 17 nt, Bordetella pertussis
gagaguucauccacagc

SEQ ID NO: 2398360 - RNA, 15 nt, Bordetella pertussis
gagauacuggccgau

SEQ ID NO: 2398361 - RNA, 22 nt, Bordetella pertussis
gagauacuugcgcagcgcggcg

SEQ ID NO: 2398362 - RNA, 13 nt, Bordetella pertussis
gagauagcccagc

SEQ ID NO: 2398363 - RNA, 14 nt, Bordetella pertussis
gagauagcccagca

SEQ ID NO: 2398364 - RNA, 23 nt, Bordetella pertussis
gagauagcccagcaccugcaggc

SEQ ID NO: 2398365 - RNA, 16 nt, Bordetella pertussis
gagauaggcggccagg

SEQ ID NO: 2398366 - RNA, 15 nt, Bordetella pertussis
gagaucagcaccgcg

SEQ ID NO: 2398367 - RNA, 21 nt, Bordetella pertussis
gagauccagcgagaccuugug

SEQ ID NO: 2398368 - RNA, 14 nt, Bordetella pertussis
gagauccgccggcg

SEQ ID NO: 2398369 - RNA, 14 nt, Bordetella pertussis
gagauccggccuuc

SEQ ID NO: 2398370 - RNA, 16 nt, Bordetella pertussis
gagaucgccgagcggc

SEQ ID NO: 2398371 - RNA, 17 nt, Bordetella pertussis
gagaucgccgagcggca

SEQ ID NO: 2398372 - RNA, 23 nt, Bordetella pertussis
gagaucucgaugcguucgcccgu

SEQ ID NO: 2398373 - RNA, 16 nt, Bordetella pertussis
gagaugccagcggcgc

SEQ ID NO: 2398374 - RNA, 19 nt, Bordetella pertussis
gagaugccagcggcgcagc

SEQ ID NO: 2398375 - RNA, 21 nt, Bordetella pertussis
gagaugccagcggcgcagccg

SEQ ID NO: 2398376 - RNA, 20 nt, Bordetella pertussis
gagaugccgucgaaggccgc

SEQ ID NO: 2398377 - RNA, 20 nt, Bordetella pertussis
gagauggcgcaggcgcgcgc

SEQ ID NO: 2398378 - RNA, 13 nt, Bordetella pertussis
gagauggcgccga

SEQ ID NO: 2398379 - RNA, 22 nt, Bordetella pertussis
gagauggguacagcgcgcccga

SEQ ID NO: 2398380 - RNA, 15 nt, Bordetella pertussis
gagauguccauggcc

SEQ ID NO: 2398381 - RNA, 17 nt, Bordetella pertussis
gagauguccauggccug

SEQ ID NO: 2398382 - RNA, 20 nt, Bordetella pertussis
gagauguccauggccugcag

SEQ ID NO: 2398383 - RNA, 21 nt, Bordetella pertussis
gagauguccauggccugcagg

SEQ ID NO: 2398384 - RNA, 22 nt, Bordetella pertussis
gagaugugcggcguggcggggc

SEQ ID NO: 2398385 - RNA, 17 nt, Bordetella pertussis
gagauguuccugcgcga

SEQ ID NO: 2398386 - RNA, 19 nt, Bordetella pertussis
gagauuggccgagcgcgga

SEQ ID NO: 2398387 - RNA, 15 nt, Bordetella pertussis
gagcaacgugcgcac

SEQ ID NO: 2398388 - RNA, 23 nt, Bordetella pertussis
gagcaaucaagggccuuuuucuu

SEQ ID NO: 2398389 - RNA, 16 nt, Bordetella pertussis
gagcaauccgaggccc

SEQ ID NO: 2398390 - RNA, 16 nt, Bordetella pertussis
gagcaauccgucaggc

SEQ ID NO: 2398391 - RNA, 17 nt, Bordetella pertussis
gagcacaugcccggcca

SEQ ID NO: 2398392 - RNA, 20 nt, Bordetella pertussis
gagcacaugcccggccacca

SEQ ID NO: 2398393 - RNA, 18 nt, Bordetella pertussis
gagcaccacggcgcgcgc

SEQ ID NO: 2398394 - RNA, 13 nt, Bordetella pertussis
gagcaccagcagc

SEQ ID NO: 2398395 - RNA, 14 nt, Bordetella pertussis
gagcaccagcagcc

SEQ ID NO: 2398396 - RNA, 17 nt, Bordetella pertussis
gagcaccagcagcccca

SEQ ID NO: 2398397 - RNA, 19 nt, Bordetella pertussis
gagcaccagcagccccagc

SEQ ID NO: 2398398 - RNA, 16 nt, Bordetella pertussis
gagcaccgagaccggg

SEQ ID NO: 2398399 - RNA, 20 nt, Bordetella pertussis
gagcaccgccgcguccucgg

SEQ ID NO: 2398400 - RNA, 22 nt, Bordetella pertussis
gagcaccguauccucgaucagc

SEQ ID NO: 2398401 - RNA, 12 nt, Bordetella pertussis
gagcacgcggcg

SEQ ID NO: 2398402 - RNA, 15 nt, Bordetella pertussis
gagcacgcggcgcgg

SEQ ID NO: 2398403 - RNA, 19 nt, Bordetella pertussis
gagcacgcggcgcggcagg

SEQ ID NO: 2398404 - RNA, 15 nt, Bordetella pertussis
gagcacggccugcuc

SEQ ID NO: 2398405 - RNA, 14 nt, Bordetella pertussis
gagcacggcguggc

SEQ ID NO: 2398406 - RNA, 15 nt, Bordetella pertussis
gagcacggcguggcg

SEQ ID NO: 2398407 - RNA, 16 nt, Bordetella pertussis
gagcacggcguggcgc

SEQ ID NO: 2398408 - RNA, 18 nt, Bordetella pertussis
gagcacggcguggcgcgc

SEQ ID NO: 2398409 - RNA, 22 nt, Bordetella pertussis
gagcacgguuucgccgugcugg

SEQ ID NO: 2398410 - RNA, 14 nt, Bordetella pertussis
gagcacguccagcg

SEQ ID NO: 2398411 - RNA, 18 nt, Bordetella pertussis
gagcacguccagcggcgc

SEQ ID NO: 2398412 - RNA, 16 nt, Bordetella pertussis
gagcacuuucgacacg

SEQ ID NO: 2398413 - RNA, 20 nt, Bordetella pertussis
gagcagaugcaccggccagu

SEQ ID NO: 2398414 - RNA, 22 nt, Bordetella pertussis
gagcagaugcgacuggcggcug

SEQ ID NO: 2398415 - RNA, 11 nt, Bordetella pertussis
gagcagcagcg

SEQ ID NO: 2398416 - RNA, 17 nt, Bordetella pertussis
gagcagcaugugcucgg

SEQ ID NO: 2398417 - RNA, 22 nt, Bordetella pertussis
gagcagcaugugcucgggacgc

SEQ ID NO: 2398418 - RNA, 20 nt, Bordetella pertussis
gagcagccacugcgucacga

SEQ ID NO: 2398419 - RNA, 20 nt, Bordetella pertussis
gagcagcguugcggcgucga

SEQ ID NO: 2398420 - RNA, 22 nt, Bordetella pertussis
gagcaggcccguguagacggca

SEQ ID NO: 2398421 - RNA, 13 nt, Bordetella pertussis
gagcaggccgccc

SEQ ID NO: 2398422 - RNA, 15 nt, Bordetella pertussis
gagcaggccgccgcc

SEQ ID NO: 2398423 - RNA, 17 nt, Bordetella pertussis
gagcaggccgccgccgg

SEQ ID NO: 2398424 - RNA, 18 nt, Bordetella pertussis
gagcaggccgccgccggu

SEQ ID NO: 2398425 - RNA, 14 nt, Bordetella pertussis
gagcaggccgccgg

SEQ ID NO: 2398426 - RNA, 20 nt, Bordetella pertussis
gagcaggccgccggggaggc

SEQ ID NO: 2398427 - RNA, 17 nt, Bordetella pertussis
gagcaggccggcguuca

SEQ ID NO: 2398428 - RNA, 13 nt, Bordetella pertussis
gagcaggccgggu

SEQ ID NO: 2398429 - RNA, 16 nt, Bordetella pertussis
gagcaggcgcaggccg

SEQ ID NO: 2398430 - RNA, 15 nt, Bordetella pertussis
gagcaggcgcgcggu

SEQ ID NO: 2398431 - RNA, 17 nt, Bordetella pertussis
gagcaggucgagguccu

SEQ ID NO: 2398432 - RNA, 23 nt, Bordetella pertussis
gagcaggucgagguccugcucgg

SEQ ID NO: 2398433 - RNA, 18 nt, Bordetella pertussis
gagcagguuggagaucau

SEQ ID NO: 2398434 - RNA, 16 nt, Bordetella pertussis
gagcagucgcgcagcc

SEQ ID NO: 2398435 - RNA, 16 nt, Bordetella pertussis
gagcaucauggcgcgc

SEQ ID NO: 2398436 - RNA, 18 nt, Bordetella pertussis
gagcaucauggcgcgcgc

SEQ ID NO: 2398437 - RNA, 20 nt, Bordetella pertussis
gagcaucauggcgcgcgccg

SEQ ID NO: 2398438 - RNA, 17 nt, Bordetella pertussis
gagcaucccggcgcuca

SEQ ID NO: 2398439 - RNA, 18 nt, Bordetella pertussis
gagcaucuggcgcauggc

SEQ ID NO: 2398440 - RNA, 15 nt, Bordetella pertussis
gagcaugcggcgucc

SEQ ID NO: 2398441 - RNA, 14 nt, Bordetella pertussis
gagcauggcggugg

SEQ ID NO: 2398442 - RNA, 17 nt, Bordetella pertussis
gagcauggcgguggcca

SEQ ID NO: 2398443 - RNA, 20 nt, Bordetella pertussis
gagcauggcgguggccagcg

SEQ ID NO: 2398444 - RNA, 22 nt, Bordetella pertussis
gagcauggcgguggccagcgcc

SEQ ID NO: 2398445 - RNA, 23 nt, Bordetella pertussis
gaagcgcaagcccaggcggccca

SEQ ID NO: 2398446 - RNA, 13 nt, Bordetella pertussis
gaagcgcaggccu

SEQ ID NO: 2398447 - RNA, 15 nt, Bordetella pertussis
gaagcgccauggcag

SEQ ID NO: 2398448 - RNA, 20 nt, Bordetella pertussis
gaagcgcccuggcguggcgc

SEQ ID NO: 2398449 - RNA, 15 nt, Bordetella pertussis
gaagcgccgccacag

SEQ ID NO: 2398450 - RNA, 14 nt, Bordetella pertussis
gaagcgccgcgccu

SEQ ID NO: 2398451 - RNA, 15 nt, Bordetella pertussis
gaagcgcgccagcag

SEQ ID NO: 2398452 - RNA, 17 nt, Bordetella pertussis
gaagcgcgccagcagcg

SEQ ID NO: 2398453 - RNA, 15 nt, Bordetella pertussis
gaagcgcgccaggcg

SEQ ID NO: 2398454 - RNA, 18 nt, Bordetella pertussis
gaagcgcgccaggcgcau

SEQ ID NO: 2398455 - RNA, 11 nt, Bordetella pertussis
gaagcgcgcgu

SEQ ID NO: 2398456 - RNA, 17 nt, Bordetella pertussis
gaagcgcgcgugcaggu

SEQ ID NO: 2398457 - RNA, 22 nt, Bordetella pertussis
gaagcgcgugucccagccggcg

SEQ ID NO: 2398458 - RNA, 13 nt, Bordetella pertussis
gaagcggaugcgc

SEQ ID NO: 2398459 - RNA, 17 nt, Bordetella pertussis
gaagcggcccggguggg

SEQ ID NO: 2398460 - RNA, 22 nt, Bordetella pertussis
gaagcggcccgggugggcggca

SEQ ID NO: 2398461 - RNA, 24 nt, Bordetella pertussis
gaagcggcccgggugggcggcauc

SEQ ID NO: 2398462 - RNA, 15 nt, Bordetella pertussis
gaagcggcgcaccag

SEQ ID NO: 2398463 - RNA, 15 nt, Bordetella pertussis
gaagcggcucaggcg

SEQ ID NO: 2398464 - RNA, 13 nt, Bordetella pertussis
gaagcgggccugc

SEQ ID NO: 2398465 - RNA, 15 nt, Bordetella pertussis
gaagcgggccugccg

SEQ ID NO: 2398466 - RNA, 19 nt, Bordetella pertussis
gaagcgggccugccgcgcg

SEQ ID NO: 2398467 - RNA, 19 nt, Bordetella pertussis
gaagcgggcgccggcgccc

SEQ ID NO: 2398468 - RNA, 15 nt, Bordetella pertussis
gaagcggugcgcugg

SEQ ID NO: 2398469 - RNA, 12 nt, Bordetella pertussis
gaagcgucggcc

SEQ ID NO: 2398470 - RNA, 18 nt, Bordetella pertussis
gaagcgucggccugcacg

SEQ ID NO: 2398471 - RNA, 18 nt, Bordetella pertussis
gaagcguucggccuugcc

SEQ ID NO: 2398472 - RNA, 23 nt, Bordetella pertussis
gaagcugacgaaacgcgcguccu

SEQ ID NO: 2398473 - RNA, 14 nt, Bordetella pertussis
gaagcuggccagcg

SEQ ID NO: 2398474 - RNA, 22 nt, Bordetella pertussis
gaagcuggccagcgguacgccg

SEQ ID NO: 2398475 - RNA, 18 nt, Bordetella pertussis
gacggcaaucuugccgcc

SEQ ID NO: 2398476 - RNA, 20 nt, Bordetella pertussis
gacggcaaucuugccgccgg

SEQ ID NO: 2398477 - RNA, 15 nt, Bordetella pertussis
gacggcaaugccugc

SEQ ID NO: 2398478 - RNA, 22 nt, Bordetella pertussis
gacggcaaugccugcgcgaugc

SEQ ID NO: 2398479 - RNA, 16 nt, Bordetella pertussis
gacggcagcaagcugu

SEQ ID NO: 2398480 - RNA, 15 nt, Bordetella pertussis
gacggcagcaccgcc

SEQ ID NO: 2398481 - RNA, 13 nt, Bordetella pertussis
gacggcaucuguc

SEQ ID NO: 2398482 - RNA, 15 nt, Bordetella pertussis
gacggcauggccggc

SEQ ID NO: 2398483 - RNA, 15 nt, Bordetella pertussis
gacggcauggcggcc

SEQ ID NO: 2398484 - RNA, 16 nt, Bordetella pertussis
gacggcauggcggcca

SEQ ID NO: 2398485 - RNA, 17 nt, Bordetella pertussis
gacggcauggcggccag

SEQ ID NO: 2398486 - RNA, 19 nt, Bordetella pertussis
gacggccaagacgcgggga

SEQ ID NO: 2398487 - RNA, 18 nt, Bordetella pertussis
gacggccaagacgguauc

SEQ ID NO: 2398488 - RNA, 15 nt, Bordetella pertussis
gacggccagcgcgcg

SEQ ID NO: 2398489 - RNA, 16 nt, Bordetella pertussis
gacggccagcgcgcgu

SEQ ID NO: 2398490 - RNA, 18 nt, Bordetella pertussis
gacggccagcgcgcgugc

SEQ ID NO: 2398491 - RNA, 14 nt, Bordetella pertussis
gacggccaggaugg

SEQ ID NO: 2398492 - RNA, 12 nt, Bordetella pertussis
gacggccagggg

SEQ ID NO: 2398493 - RNA, 14 nt, Bordetella pertussis
gacggccauccggc

SEQ ID NO: 2398494 - RNA, 18 nt, Bordetella pertussis
gacggccauucagaccgg

SEQ ID NO: 2398495 - RNA, 23 nt, Bordetella pertussis
gacggcccagcucugguccaggc

SEQ ID NO: 2398496 - RNA, 15 nt, Bordetella pertussis
gacggccccagcgcc

SEQ ID NO: 2398497 - RNA, 16 nt, Bordetella pertussis
gacggccccagcgccg

SEQ ID NO: 2398498 - RNA, 17 nt, Bordetella pertussis
gacggccccagcgccgc

SEQ ID NO: 2398499 - RNA, 22 nt, Bordetella pertussis
gacggccccguugucgccgcgg

SEQ ID NO: 2398500 - RNA, 12 nt, Bordetella pertussis
gacggcccugca

SEQ ID NO: 2398501 - RNA, 17 nt, Bordetella pertussis
gacggccgccacgcccu

SEQ ID NO: 2398502 - RNA, 17 nt, Bordetella pertussis
gacggccgccgacgccg

SEQ ID NO: 2398503 - RNA, 13 nt, Bordetella pertussis
gacggccggcgcg

SEQ ID NO: 2398504 - RNA, 15 nt, Bordetella pertussis
gacggccggggcccg

SEQ ID NO: 2398505 - RNA, 21 nt, Bordetella pertussis
gacggccucccgccgcccggc

SEQ ID NO: 2398506 - RNA, 24 nt, Bordetella pertussis
gacggccuccgcgccgaccacgcu

SEQ ID NO: 2398507 - RNA, 17 nt, Bordetella pertussis
gacggccucggccagga

SEQ ID NO: 2398508 - RNA, 21 nt, Bordetella pertussis
gacggccuggaggccgagcgc

SEQ ID NO: 2398509 - RNA, 22 nt, Bordetella pertussis
gacggcgcacccgcggcgcaug

SEQ ID NO: 2398510 - RNA, 14 nt, Bordetella pertussis
gacggcgcccugca

SEQ ID NO: 2398511 - RNA, 17 nt, Bordetella pertussis
gacggcgccgauccggc

SEQ ID NO: 2398512 - RNA, 20 nt, Bordetella pertussis
gacggcgccgauccggcgca

SEQ ID NO: 2398513 - RNA, 16 nt, Bordetella pertussis
gacggcgccgugcugg

SEQ ID NO: 2398514 - RNA, 20 nt, Bordetella pertussis
gacggcgccgugcuggaggu

SEQ ID NO: 2398515 - RNA, 22 nt, Bordetella pertussis
gacggcgccuauugcgacgccg

SEQ ID NO: 2398516 - RNA, 13 nt, Bordetella pertussis
gacggcgccuggc

SEQ ID NO: 2398517 - RNA, 15 nt, Bordetella pertussis
gacggcgccuggcgc

SEQ ID NO: 2398518 - RNA, 17 nt, Bordetella pertussis
gacggcgccuggcgcau

SEQ ID NO: 2398519 - RNA, 13 nt, Bordetella pertussis
gacggcgcgcccg

SEQ ID NO: 2398520 - RNA, 14 nt, Bordetella pertussis
gacggcgcgcccgc

SEQ ID NO: 2398521 - RNA, 14 nt, Bordetella pertussis
gacggcgcucggcc

SEQ ID NO: 2398522 - RNA, 15 nt, Bordetella pertussis
gacggcgcucggccu

SEQ ID NO: 2398523 - RNA, 19 nt, Bordetella pertussis
gaucgacgcgauguccagc

SEQ ID NO: 2398524 - RNA, 22 nt, Bordetella pertussis
gaucgacgcgauguccagcucc

SEQ ID NO: 2398525 - RNA, 20 nt, Bordetella pertussis
gaucgagaaguuggcgggcg

SEQ ID NO: 2398526 - RNA, 15 nt, Bordetella pertussis
gaucgaguaggccgg

SEQ ID NO: 2398527 - RNA, 23 nt, Bordetella pertussis
gaucgaguaggccggcacguccg

SEQ ID NO: 2398528 - RNA, 16 nt, Bordetella pertussis
gaucgaucagccagcc

SEQ ID NO: 2398529 - RNA, 18 nt, Bordetella pertussis
gaucgaucagccagccgg

SEQ ID NO: 2398530 - RNA, 20 nt, Bordetella pertussis
gaucgaucagccagccggcg

SEQ ID NO: 2398531 - RNA, 20 nt, Bordetella pertussis
gaucgcacacaccgcgucau

SEQ ID NO: 2398532 - RNA, 21 nt, Bordetella pertussis
gaucgcauuucucggccuggg

SEQ ID NO: 2398533 - RNA, 13 nt, Bordetella pertussis
gaucgccagcagg

SEQ ID NO: 2398534 - RNA, 16 nt, Bordetella pertussis
gaucgccagcaggcgc

SEQ ID NO: 2398535 - RNA, 20 nt, Bordetella pertussis
gaucgccagcaggcgcuggu

SEQ ID NO: 2398536 - RNA, 20 nt, Bordetella pertussis
gaucgccaggucggccagcc

SEQ ID NO: 2398537 - RNA, 18 nt, Bordetella pertussis
gaucgccaugacgcuggu

SEQ ID NO: 2398538 - RNA, 19 nt, Bordetella pertussis
gaucgccaugacgcugguc

SEQ ID NO: 2398539 - RNA, 21 nt, Bordetella pertussis
gaucgccaugacgcuggucga

SEQ ID NO: 2398540 - RNA, 15 nt, Bordetella pertussis
gaucgcccgcgugcg

SEQ ID NO: 2398541 - RNA, 18 nt, Bordetella pertussis
gaucgccgacgaugucgc

SEQ ID NO: 2398542 - RNA, 16 nt, Bordetella pertussis
gaucgccgagcggcau

SEQ ID NO: 2398543 - RNA, 16 nt, Bordetella pertussis
gaucgccgaucggcaa

SEQ ID NO: 2398544 - RNA, 15 nt, Bordetella pertussis
gaucgccgcaugggc

SEQ ID NO: 2398545 - RNA, 17 nt, Bordetella pertussis
gaucgccgcaugggcgc

SEQ ID NO: 2398546 - RNA, 12 nt, Bordetella pertussis
gaucgccgccgc

SEQ ID NO: 2398547 - RNA, 13 nt, Bordetella pertussis
gaucgccgccggc

SEQ ID NO: 2398548 - RNA, 22 nt, Bordetella pertussis
gaucgccggcgcccccagcagc

SEQ ID NO: 2398549 - RNA, 18 nt, Bordetella pertussis
gaucugcuugaggccgcg

SEQ ID NO: 2398550 - RNA, 17 nt, Bordetella pertussis
gaucuggcaaucggggu

SEQ ID NO: 2398551 - RNA, 23 nt, Bordetella pertussis
gaucuggccgauggccucgcugc

SEQ ID NO: 2398552 - RNA, 19 nt, Bordetella pertussis
gaucuggcgcgcgaccagg

SEQ ID NO: 2398553 - RNA, 21 nt, Bordetella pertussis
gaucuggcgcgcgaccaggcu

SEQ ID NO: 2398554 - RNA, 14 nt, Bordetella pertussis
gaucuggcgcguca

SEQ ID NO: 2398555 - RNA, 14 nt, Bordetella pertussis
gaucugggccucgg

SEQ ID NO: 2398556 - RNA, 16 nt, Bordetella pertussis
gaucugguccugggcc

SEQ ID NO: 2398557 - RNA, 15 nt, Bordetella pertussis
gaucuggugaaacag

SEQ ID NO: 2398558 - RNA, 13 nt, Bordetella pertussis
gaucugguuggcc

SEQ ID NO: 2398559 - RNA, 16 nt, Bordetella pertussis
gaucugguuggccaca

SEQ ID NO: 2398560 - RNA, 15 nt, Bordetella pertussis
gaucuguaccgccgg

SEQ ID NO: 2398561 - RNA, 14 nt, Bordetella pertussis
gaucuuccuugaag

SEQ ID NO: 2398562 - RNA, 17 nt, Bordetella pertussis
gaucuucgccugcaugg

SEQ ID NO: 2398563 - RNA, 15 nt, Bordetella pertussis
gaucuucucgacggc

SEQ ID NO: 2398564 - RNA, 20 nt, Bordetella pertussis
gaucuucucgacggcgcgcg

SEQ ID NO: 2398565 - RNA, 17 nt, Bordetella pertussis
gaucuugccgaugcggc

SEQ ID NO: 2398566 - RNA, 15 nt, Bordetella pertussis
gaucuugccggccgu

SEQ ID NO: 2398567 - RNA, 17 nt, Bordetella pertussis
gaucuugccggccuggc

SEQ ID NO: 2398568 - RNA, 11 nt, Bordetella pertussis
gaucuuggccu

SEQ ID NO: 2398569 - RNA, 19 nt, Bordetella pertussis
gaucuugugcaucucgaag

SEQ ID NO: 2398570 - RNA, 14 nt, Bordetella pertussis
gaugaacagcggca

SEQ ID NO: 2398571 - RNA, 20 nt, Bordetella pertussis
gaugaacaucggcagcgagg

SEQ ID NO: 2398572 - RNA, 21 nt, Bordetella pertussis
gaugaacaucggcagcgaggc

SEQ ID NO: 2398573 - RNA, 22 nt, Bordetella pertussis
gaugaacaucggcagcgaggcg

SEQ ID NO: 2398574 - RNA, 14 nt, Bordetella pertussis
gaugaacgacaggg

SEQ ID NO: 2398575 - RNA, 23 nt, Bordetella pertussis
gaugaacgaccagcacgagaugu

SEQ ID NO: 2398576 - RNA, 20 nt, Bordetella pertussis
gaugaacgacccggucgugu

SEQ ID NO: 2398577 - RNA, 14 nt, Bordetella pertussis
gaugaagaugccga

SEQ ID NO: 2398578 - RNA, 20 nt, Bordetella pertussis
gaugaagaugccgaaccaga

SEQ ID NO: 2398579 - RNA, 20 nt, Bordetella pertussis
gaugaagcccgagcggcgcc

SEQ ID NO: 2398580 - RNA, 21 nt, Bordetella pertussis
gaugaagcccgagcggcgcca

SEQ ID NO: 2398581 - RNA, 19 nt, Bordetella pertussis
gaugaagggcuggccggcc

SEQ ID NO: 2398582 - RNA, 22 nt, Bordetella pertussis
gaugaagucgcggcccgccagg

SEQ ID NO: 2398583 - RNA, 19 nt, Bordetella pertussis
gaugaauuccagccaggcc

SEQ ID NO: 2398584 - RNA, 17 nt, Bordetella pertussis
gaugacaucgccgcugc

SEQ ID NO: 2398585 - RNA, 17 nt, Bordetella pertussis
gaugaccagccagccgc

SEQ ID NO: 2398586 - RNA, 18 nt, Bordetella pertussis
gaugaccagccagccgcc

SEQ ID NO: 2398587 - RNA, 22 nt, Bordetella pertussis
gaugaccagccagccgccgcgc

SEQ ID NO: 2398588 - RNA, 14 nt, Bordetella pertussis
gaugaccagcgccg

SEQ ID NO: 2398589 - RNA, 15 nt, Bordetella pertussis
gaugaccagggcgcc

SEQ ID NO: 2398590 - RNA, 14 nt, Bordetella pertussis
gaugaccggccagg

SEQ ID NO: 2398591 - RNA, 15 nt, Bordetella pertussis
gaugaccggccaggc

SEQ ID NO: 2398592 - RNA, 17 nt, Bordetella pertussis
gaugaccggccaggcgc

SEQ ID NO: 2398593 - RNA, 20 nt, Bordetella pertussis
gaugaccucgcgcugcagca

SEQ ID NO: 2398594 - RNA, 19 nt, Bordetella pertussis
gaugaccugcgccaggugc

SEQ ID NO: 2398595 - RNA, 16 nt, Bordetella pertussis
gaugaccugggccugg

SEQ ID NO: 2398596 - RNA, 14 nt, Bordetella pertussis
gaugacgcgccgcg

SEQ ID NO: 2398597 - RNA, 17 nt, Bordetella pertussis
gaugacguggcaguccu

SEQ ID NO: 2398598 - RNA, 21 nt, Bordetella pertussis
gaugagacacggcaguaugac

SEQ ID NO: 2398599 - RNA, 23 nt, Bordetella pertussis
gaugagaucgcccgcgugcgugc

SEQ ID NO: 2398600 - RNA, 18 nt, Bordetella pertussis
gaugagcaugauuuccug

SEQ ID NO: 2398601 - RNA, 13 nt, Bordetella pertussis
gaugagcgcgccg

SEQ ID NO: 2398602 - RNA, 13 nt, Bordetella pertussis
gaugaucgcgcag

SEQ ID NO: 2398603 - RNA, 15 nt, Bordetella pertussis
gaugaucgcgcagca

SEQ ID NO: 2398604 - RNA, 23 nt, Bordetella pertussis
gaugaucgcgcagcaccgccagc

SEQ ID NO: 2398605 - RNA, 14 nt, Bordetella pertussis
gaugaucggcgcca

SEQ ID NO: 2398606 - RNA, 16 nt, Bordetella pertussis
gaugaucuacgcgcgc

SEQ ID NO: 2398607 - RNA, 23 nt, Bordetella pertussis
gaugaucuacgcgcgcgccggca

SEQ ID NO: 2398608 - RNA, 13 nt, Bordetella pertussis
gaugaugagcgcg

SEQ ID NO: 2398609 - RNA, 18 nt, Bordetella pertussis
gaugaugagcgcgccgcc

SEQ ID NO: 2398610 - RNA, 16 nt, Bordetella pertussis
gaugaugaucggcgcc

SEQ ID NO: 2398611 - RNA, 13 nt, Bordetella pertussis
gaugaugcagcac

SEQ ID NO: 2398612 - RNA, 12 nt, Bordetella pertussis
gaugaugcccag

SEQ ID NO: 2398613 - RNA, 14 nt, Bordetella pertussis
gaugaugcggcgcc

SEQ ID NO: 2398614 - RNA, 20 nt, Bordetella pertussis
gaugaugcgguugaucaggg

SEQ ID NO: 2398615 - RNA, 14 nt, Bordetella pertussis
gaugauggccaggu

SEQ ID NO: 2398616 - RNA, 15 nt, Bordetella pertussis
gaugauggccagguc

SEQ ID NO: 2398617 - RNA, 15 nt, Bordetella pertussis
gaugauggcguccgc

SEQ ID NO: 2398618 - RNA, 17 nt, Bordetella pertussis
gaugauggucggugccg

SEQ ID NO: 2398619 - RNA, 16 nt, Bordetella pertussis
gaugaugugguagccg

SEQ ID NO: 2398620 - RNA, 15 nt, Bordetella pertussis
gaugauucauagccc

SEQ ID NO: 2398621 - RNA, 22 nt, Bordetella pertussis
gaugcacagguagaucagccgc

SEQ ID NO: 2398622 - RNA, 20 nt, Bordetella pertussis
gaugcaccggccagucgcgg

SEQ ID NO: 2398623 - RNA, 17 nt, Bordetella pertussis
gaugcacguagcgcagc

SEQ ID NO: 2398624 - RNA, 21 nt, Bordetella pertussis
gaugcagcacgucggcgucgg

SEQ ID NO: 2398625 - RNA, 12 nt, Bordetella pertussis
gaugcagcagcg

SEQ ID NO: 2398626 - RNA, 15 nt, Bordetella pertussis
gaugcaggccugcac

SEQ ID NO: 2398627 - RNA, 16 nt, Bordetella pertussis
gaugcaggccugcacg

SEQ ID NO: 2398628 - RNA, 21 nt, Bordetella pertussis
gaugcaggcggucgaggcgca

SEQ ID NO: 2398629 - RNA, 19 nt, Bordetella pertussis
gaugcaggucggggcgcuc

SEQ ID NO: 2398630 - RNA, 15 nt, Bordetella pertussis
gaugcaugaaccgca

SEQ ID NO: 2398631 - RNA, 17 nt, Bordetella pertussis
gaugcauucggcggccg

SEQ ID NO: 2398632 - RNA, 17 nt, Bordetella pertussis
gaugccaccucgcuugc

SEQ ID NO: 2398633 - RNA, 16 nt, Bordetella pertussis
gaugccagcggcgcag

SEQ ID NO: 2398634 - RNA, 17 nt, Bordetella pertussis
gaugccagcggcgcagc

SEQ ID NO: 2398635 - RNA, 22 nt, Bordetella pertussis
gaugccagcggcgcagccggcc

SEQ ID NO: 2398636 - RNA, 23 nt, Bordetella pertussis
gaugccagugaaacgcgacgcgc

SEQ ID NO: 2398637 - RNA, 20 nt, Bordetella pertussis
gaugccaguuguagcgguca

SEQ ID NO: 2398638 - RNA, 15 nt, Bordetella pertussis
gaugcccaccagccg

SEQ ID NO: 2398639 - RNA, 16 nt, Bordetella pertussis
gaugcccaccagccgc

SEQ ID NO: 2398640 - RNA, 17 nt, Bordetella pertussis
gaugcccaccagccgcc

SEQ ID NO: 2398641 - RNA, 18 nt, Bordetella pertussis
gaugcccaccagccgccc

SEQ ID NO: 2398642 - RNA, 13 nt, Bordetella pertussis
gaugcccagcacc

SEQ ID NO: 2398643 - RNA, 11 nt, Bordetella pertussis
gaugcgcggcg

SEQ ID NO: 2398644 - RNA, 14 nt, Bordetella pertussis
gaugcgcggggcca

SEQ ID NO: 2398645 - RNA, 17 nt, Bordetella pertussis
gaugcgcggggccaggc

SEQ ID NO: 2398646 - RNA, 18 nt, Bordetella pertussis
gaugcgcggggccaggcg

SEQ ID NO: 2398647 - RNA, 15 nt, Bordetella pertussis
gaugcgcgucaggcg

SEQ ID NO: 2398648 - RNA, 13 nt, Bordetella pertussis
gaugcgcuggccg

SEQ ID NO: 2398649 - RNA, 15 nt, Bordetella pertussis
gaugcgcuggccggc

SEQ ID NO: 2398650 - RNA, 16 nt, Bordetella pertussis
gaugcgcuggccggcc

SEQ ID NO: 2398651 - RNA, 14 nt, Bordetella pertussis
gaugcgcugggcca

SEQ ID NO: 2398652 - RNA, 23 nt, Bordetella pertussis
gaugcgcuugccgcccacugcca

SEQ ID NO: 2398653 - RNA, 21 nt, Bordetella pertussis
gaugcggccguugcuccagcc

SEQ ID NO: 2398654 - RNA, 15 nt, Bordetella pertussis
gaugcggccuucgcc

SEQ ID NO: 2398655 - RNA, 13 nt, Bordetella pertussis
gaugcggcgcaug

SEQ ID NO: 2398656 - RNA, 15 nt, Bordetella pertussis
gaugcggcgcaugcu

SEQ ID NO: 2398657 - RNA, 22 nt, Bordetella pertussis
gaugcggcgccacgcagaaggc

SEQ ID NO: 2398658 - RNA, 15 nt, Bordetella pertussis
gauugaacugcugga

SEQ ID NO: 2398659 - RNA, 15 nt, Bordetella pertussis
gauugaccagcacca

SEQ ID NO: 2398660 - RNA, 18 nt, Bordetella pertussis
gauugaccagcaccagcg

SEQ ID NO: 2398661 - RNA, 15 nt, Bordetella pertussis
gauugagcacgcaug

SEQ ID NO: 2398662 - RNA, 15 nt, Bordetella pertussis
gauugaggccagcac

SEQ ID NO: 2398663 - RNA, 18 nt, Bordetella pertussis
gauugcagguggccagcc

SEQ ID NO: 2398664 - RNA, 23 nt, Bordetella pertussis
gauugcaucuccaggaugcgcga

SEQ ID NO: 2398665 - RNA, 16 nt, Bordetella pertussis
gauugccgccgcgcag

SEQ ID NO: 2398666 - RNA, 15 nt, Bordetella pertussis
gauugccgcgcggcg

SEQ ID NO: 2398667 - RNA, 23 nt, Bordetella pertussis
gauugccguccuggcgaccggcg

SEQ ID NO: 2398668 - RNA, 14 nt, Bordetella pertussis
gauugcgccagcgc

SEQ ID NO: 2398669 - RNA, 17 nt, Bordetella pertussis
gauugcgccagcgcugu

SEQ ID NO: 2398670 - RNA, 18 nt, Bordetella pertussis
gauugcggcccgcggccu

SEQ ID NO: 2398671 - RNA, 19 nt, Bordetella pertussis
gauugcggcccgcggccuu

SEQ ID NO: 2398672 - RNA, 22 nt, Bordetella pertussis
gauugcggcccgcggccuuggu

SEQ ID NO: 2398673 - RNA, 23 nt, Bordetella pertussis
gauugcggugcccuugcucccag

SEQ ID NO: 2398674 - RNA, 15 nt, Bordetella pertussis
gauuguccagcggca

SEQ ID NO: 2398675 - RNA, 22 nt, Bordetella pertussis
gauugugcaugacggccaggau

SEQ ID NO: 2398676 - RNA, 17 nt, Bordetella pertussis
gauuuccucgcgcacca

SEQ ID NO: 2398677 - RNA, 17 nt, Bordetella pertussis
gauuuccuugcgccgcc

SEQ ID NO: 2398678 - RNA, 21 nt, Bordetella pertussis
gauuucgaucacggcgcgcgc

SEQ ID NO: 2398679 - RNA, 18 nt, Bordetella pertussis
gauuucgcgaugcucgau

SEQ ID NO: 2398680 - RNA, 21 nt, Bordetella pertussis
gauuucgcgcgccagcgcggc

SEQ ID NO: 2398681 - RNA, 22 nt, Bordetella pertussis
gauuucgcgcgccagcgcggcg

SEQ ID NO: 2398682 - RNA, 15 nt, Bordetella pertussis
gauuucggagcggcu

SEQ ID NO: 2398683 - RNA, 15 nt, Bordetella pertussis
gauuucggggcgcga

SEQ ID NO: 2398684 - RNA, 16 nt, Bordetella pertussis
gauuucuucgccuggc

SEQ ID NO: 2398685 - RNA, 21 nt, Bordetella pertussis
gauuucuucgccuggccggcu

SEQ ID NO: 2398686 - RNA, 14 nt, Bordetella pertussis
gauuugagcagcgu

SEQ ID NO: 2398687 - RNA, 14 nt, Bordetella pertussis
gauuugccgcagcc

SEQ ID NO: 2398688 - RNA, 17 nt, Bordetella pertussis
gcaaaaccgggcccgga

SEQ ID NO: 2398689 - RNA, 14 nt, Bordetella pertussis
gcaaaacgcgcauu

SEQ ID NO: 2398690 - RNA, 23 nt, Bordetella pertussis
gcaaaacggugccuugcggcgcc

SEQ ID NO: 2398691 - RNA, 14 nt, Bordetella pertussis
gcaaacaggcugcu

SEQ ID NO: 2398692 - RNA, 15 nt, Bordetella pertussis
gcaaacaggcugcug

SEQ ID NO: 2398693 - RNA, 23 nt, Bordetella pertussis
gcaaacaggcugcugugccugcc

SEQ ID NO: 2398694 - RNA, 21 nt, Bordetella pertussis
gcaaacccggcgaagccggca

SEQ ID NO: 2398695 - RNA, 17 nt, Bordetella pertussis
gcaaaccgacgcggcca

SEQ ID NO: 2398696 - RNA, 18 nt, Bordetella pertussis
gcaaaccgacgcggccag

SEQ ID NO: 2398697 - RNA, 20 nt, Bordetella pertussis
gcaaaccgacgcggccagcg

SEQ ID NO: 2398698 - RNA, 22 nt, Bordetella pertussis
gcaaaccgacgcggccagcggc

SEQ ID NO: 2398699 - RNA, 23 nt, Bordetella pertussis
gcaaaccugaugccugucccgca

SEQ ID NO: 2398700 - RNA, 16 nt, Bordetella pertussis
gcaaacggcggcaggc

SEQ ID NO: 2398701 - RNA, 18 nt, Bordetella pertussis
gcaaacggcggcaggccg

SEQ ID NO: 2398702 - RNA, 23 nt, Bordetella pertussis
gcaaacggcggcaggccgcgcca

SEQ ID NO: 2398703 - RNA, 19 nt, Bordetella pertussis
gcaaacgggggcaggccgc

SEQ ID NO: 2398704 - RNA, 17 nt, Bordetella pertussis
gcaaacuguccguggcc

SEQ ID NO: 2398705 - RNA, 18 nt, Bordetella pertussis
gcaaacuguccguggcca

SEQ ID NO: 2398706 - RNA, 18 nt, Bordetella pertussis
gcaaacuuccccgcgugc

SEQ ID NO: 2398707 - RNA, 21 nt, Bordetella pertussis
gcaaagaaauugggcguggcg

SEQ ID NO: 2398708 - RNA, 12 nt, Bordetella pertussis
gcaaagcccagc

SEQ ID NO: 2398709 - RNA, 13 nt, Bordetella pertussis
gcaaagcccagca

SEQ ID NO: 2398710 - RNA, 14 nt, Bordetella pertussis
gcaaagcccagcaa

SEQ ID NO: 2398711 - RNA, 14 nt, Bordetella pertussis
gcaaagccugacgg

SEQ ID NO: 2398712 - RNA, 22 nt, Bordetella pertussis
gcaaagcgcgcguccugcgcca

SEQ ID NO: 2398713 - RNA, 12 nt, Bordetella pertussis
gcaaagcgcggc

SEQ ID NO: 2398714 - RNA, 13 nt, Bordetella pertussis
gcaaagcgcggcu

SEQ ID NO: 2398715 - RNA, 15 nt, Bordetella pertussis
gcaaagcgcggcugc

SEQ ID NO: 2398716 - RNA, 23 nt, Bordetella pertussis
gcaaaguagugcccccacgcugc

SEQ ID NO: 2398717 - RNA, 23 nt, Bordetella pertussis
gcaaagucggggcgccggucgug

SEQ ID NO: 2398718 - RNA, 20 nt, Bordetella pertussis
gcaacaaaggaaaucgcggc

SEQ ID NO: 2398719 - RNA, 21 nt, Bordetella pertussis
gcaacaaaggaaaucgcggcg

SEQ ID NO: 2398720 - RNA, 22 nt, Bordetella pertussis
gcaacaaaggaaaucgcggcgc

SEQ ID NO: 2398721 - RNA, 17 nt, Bordetella pertussis
gcaacacgaccagcagg

SEQ ID NO: 2398722 - RNA, 18 nt, Bordetella pertussis
gcaacacgaccagcaggc

SEQ ID NO: 2398723 - RNA, 23 nt, Bordetella pertussis
gcaacagacccgggccgcuggcc

SEQ ID NO: 2398724 - RNA, 13 nt, Bordetella pertussis
gcaacagcagguc

SEQ ID NO: 2398725 - RNA, 23 nt, Bordetella pertussis
gcaacagcaggucggagucggcg

SEQ ID NO: 2398726 - RNA, 17 nt, Bordetella pertussis
gcaacaggcagcugcgc

SEQ ID NO: 2398727 - RNA, 18 nt, Bordetella pertussis
gcaacaggcagcugcgcg

SEQ ID NO: 2398728 - RNA, 23 nt, Bordetella pertussis
gcaacaggucguuguggcaggcg

SEQ ID NO: 2398729 - RNA, 18 nt, Bordetella pertussis
gcaaccaggggcggcgcg

SEQ ID NO: 2398730 - RNA, 19 nt, Bordetella pertussis
gcaaccaggggcggcgcgg

SEQ ID NO: 2398731 - RNA, 16 nt, Bordetella pertussis
gcaacccacccccagc

SEQ ID NO: 2398732 - RNA, 20 nt, Bordetella pertussis
gcaacccacccccagcagca

SEQ ID NO: 2398733 - RNA, 13 nt, Bordetella pertussis
gcaacccacggcg

SEQ ID NO: 2398734 - RNA, 14 nt, Bordetella pertussis
gcaacccacggcgu

SEQ ID NO: 2398735 - RNA, 16 nt, Bordetella pertussis
gcaacccagcagcggc

SEQ ID NO: 2398736 - RNA, 13 nt, Bordetella pertussis
gcaaccccaccgg

SEQ ID NO: 2398737 - RNA, 15 nt, Bordetella pertussis
gcaaccccaccggca

SEQ ID NO: 2398738 - RNA, 13 nt, Bordetella pertussis
gcaaccccagcag

SEQ ID NO: 2398739 - RNA, 14 nt, Bordetella pertussis
gcaaccccagcagc

SEQ ID NO: 2398740 - RNA, 15 nt, Bordetella pertussis
gcaaccccagcagcg

SEQ ID NO: 2398741 - RNA, 17 nt, Bordetella pertussis
gcaaccccagcagcgcc

SEQ ID NO: 2398742 - RNA, 18 nt, Bordetella pertussis
gcaacccgcccacgcggc

SEQ ID NO: 2398743 - RNA, 20 nt, Bordetella pertussis
gcaacccgcccggguuggcg

SEQ ID NO: 2398744 - RNA, 22 nt, Bordetella pertussis
gcaacccgcccuugccagggcc

SEQ ID NO: 2398745 - RNA, 19 nt, Bordetella pertussis
gcaacccgcuuuuuccugc

SEQ ID NO: 2398746 - RNA, 17 nt, Bordetella pertussis
gcaaccgccacgugcug

SEQ ID NO: 2398747 - RNA, 18 nt, Bordetella pertussis
gcaaccgccacgugcugc

SEQ ID NO: 2398748 - RNA, 13 nt, Bordetella pertussis
gcaaccggcccga

SEQ ID NO: 2398749 - RNA, 15 nt, Bordetella pertussis
gcaaccggucggccg

SEQ ID NO: 2398750 - RNA, 16 nt, Bordetella pertussis
gcaaccggucggccgg

SEQ ID NO: 2398751 - RNA, 17 nt, Bordetella pertussis
gcaaccggucggccggc

SEQ ID NO: 2398752 - RNA, 13 nt, Bordetella pertussis
gcaaccgucgcca

SEQ ID NO: 2398753 - RNA, 18 nt, Bordetella pertussis
gcaaccgucgccagcgcg

SEQ ID NO: 2398754 - RNA, 19 nt, Bordetella pertussis
gcaaccgucgccagcgcgu

SEQ ID NO: 2398755 - RNA, 23 nt, Bordetella pertussis
gcaaccgucggugaugcucugcc

SEQ ID NO: 2398756 - RNA, 24 nt, Bordetella pertussis
gcaaccgucggugaugcucugccc

SEQ ID NO: 2398757 - RNA, 21 nt, Bordetella pertussis
gcaaccucgccgcgccagcug

SEQ ID NO: 2398758 - RNA, 24 nt, Bordetella pertussis
gcaaccucgccgcgccagcugcgc

SEQ ID NO: 2398759 - RNA, 16 nt, Bordetella pertussis
gcaaccugcacgcggg

SEQ ID NO: 2398760 - RNA, 18 nt, Bordetella pertussis
gcaaccugcacgcgggcg

SEQ ID NO: 2398761 - RNA, 13 nt, Bordetella pertussis
gcaaccuggucaa

SEQ ID NO: 2398762 - RNA, 20 nt, Bordetella pertussis
gcaaccuggucaagggcggc

SEQ ID NO: 2398763 - RNA, 22 nt, Bordetella pertussis
gcaaccuggucaagggcggcca

SEQ ID NO: 2398764 - RNA, 15 nt, Bordetella pertussis
gcaacgacgcaggcg

SEQ ID NO: 2398765 - RNA, 16 nt, Bordetella pertussis
gcaacgccacgcgcgg

SEQ ID NO: 2398766 - RNA, 14 nt, Bordetella pertussis
gcaacgccagcagg

SEQ ID NO: 2398767 - RNA, 17 nt, Bordetella pertussis
gcaacgccgccaccagg

SEQ ID NO: 2398768 - RNA, 19 nt, Bordetella pertussis
gcaacgccgccggcagggc

SEQ ID NO: 2398769 - RNA, 22 nt, Bordetella pertussis
gcaacgccgccggcagggccag

SEQ ID NO: 2398770 - RNA, 21 nt, Bordetella pertussis
gcaaucgacgaacaaggccgg

SEQ ID NO: 2398771 - RNA, 21 nt, Bordetella pertussis
gcaaucgaugaagaucaggcg

SEQ ID NO: 2398772 - RNA, 21 nt, Bordetella pertussis
gcaaucgaugaucacgcgcuc

SEQ ID NO: 2398773 - RNA, 14 nt, Bordetella pertussis
gcaaucuugccgcc

SEQ ID NO: 2398774 - RNA, 14 nt, Bordetella pertussis
gcaaugcgcaggcc

SEQ ID NO: 2398775 - RNA, 18 nt, Bordetella pertussis
gcaaugcgcaggcccgac

SEQ ID NO: 2398776 - RNA, 13 nt, Bordetella pertussis
gcaaugcgcgcgc

SEQ ID NO: 2398777 - RNA, 13 nt, Bordetella pertussis
gcaaugcgcggcg

SEQ ID NO: 2398778 - RNA, 16 nt, Bordetella pertussis
gcaaugcggccaggcc

SEQ ID NO: 2398779 - RNA, 18 nt, Bordetella pertussis
gcaaugcggccaggcccg

SEQ ID NO: 2398780 - RNA, 21 nt, Bordetella pertussis
gcaauggacacagcggcgcga

SEQ ID NO: 2398781 - RNA, 14 nt, Bordetella pertussis
gcaaugguccagca

SEQ ID NO: 2398782 - RNA, 17 nt, Bordetella pertussis
gcaaugucgcaggccgc

SEQ ID NO: 2398783 - RNA, 19 nt, Bordetella pertussis
gcaaugucgcaggccgcgg

SEQ ID NO: 2398784 - RNA, 16 nt, Bordetella pertussis
gcaauucgaccggcag

SEQ ID NO: 2398785 - RNA, 17 nt, Bordetella pertussis
gcaauucgaccggcagg

SEQ ID NO: 2398786 - RNA, 21 nt, Bordetella pertussis
gcaauucguugaucuggccgu

SEQ ID NO: 2398787 - RNA, 19 nt, Bordetella pertussis
gcaauugccccagcacgaa

SEQ ID NO: 2398788 - RNA, 14 nt, Bordetella pertussis
gcaauugcgcggcc

SEQ ID NO: 2398789 - RNA, 21 nt, Bordetella pertussis
gcaauugcgcggccaugccgg

SEQ ID NO: 2398790 - RNA, 18 nt, Bordetella pertussis
gcaauuuucgguauggcg

SEQ ID NO: 2398791 - RNA, 20 nt, Bordetella pertussis
gcaauuuucgguauggcggc

SEQ ID NO: 2398792 - RNA, 22 nt, Bordetella pertussis
gcacaaagcggguugcggcagc

SEQ ID NO: 2398793 - RNA, 13 nt, Bordetella pertussis
gcacaacccgccc

SEQ ID NO: 2398794 - RNA, 15 nt, Bordetella pertussis
gcacaacccgcccgg

SEQ ID NO: 2398795 - RNA, 16 nt, Bordetella pertussis
gcacaaccuggcgcgc

SEQ ID NO: 2398796 - RNA, 20 nt, Bordetella pertussis
gcacaaucugcgucgccugg

SEQ ID NO: 2398797 - RNA, 15 nt, Bordetella pertussis
gcacacaccgcguca

SEQ ID NO: 2398798 - RNA, 16 nt, Bordetella pertussis
gcacacaccgcgucau

SEQ ID NO: 2398799 - RNA, 13 nt, Bordetella pertussis
gcacacauggcgc

SEQ ID NO: 2398800 - RNA, 16 nt, Bordetella pertussis
gcacaccagcgccagg

SEQ ID NO: 2398801 - RNA, 17 nt, Bordetella pertussis
gcacaccagcgccagga

SEQ ID NO: 2398802 - RNA, 21 nt, Bordetella pertussis
gcacaccggucuacgccauga

SEQ ID NO: 2398803 - RNA, 13 nt, Bordetella pertussis
gcacaccgucacg

SEQ ID NO: 2398804 - RNA, 16 nt, Bordetella pertussis
gcacaccgucacgcgc

SEQ ID NO: 2398805 - RNA, 21 nt, Bordetella pertussis
gcacaccgucacgcgcaaggc

SEQ ID NO: 2398806 - RNA, 22 nt, Bordetella pertussis
gcacaccgucacgcgcaaggcg

SEQ ID NO: 2398807 - RNA, 19 nt, Bordetella pertussis
gcacacgaccggcuugccg

SEQ ID NO: 2398808 - RNA, 20 nt, Bordetella pertussis
gcacacgcauuugcagcggc

SEQ ID NO: 2398809 - RNA, 21 nt, Bordetella pertussis
gcacacgcauuugcagcggcg

SEQ ID NO: 2398810 - RNA, 23 nt, Bordetella pertussis
gcacacgccgauugaggccagca

SEQ ID NO: 2398811 - RNA, 14 nt, Bordetella pertussis
gcacacggucagca

SEQ ID NO: 2398812 - RNA, 21 nt, Bordetella pertussis
gcacacggucagcaaccccag

SEQ ID NO: 2398813 - RNA, 16 nt, Bordetella pertussis
gcacacucugucgcgg

SEQ ID NO: 2398814 - RNA, 20 nt, Bordetella pertussis
gcacacuggccagcaagcgc

SEQ ID NO: 2398815 - RNA, 19 nt, Bordetella pertussis
gcacagcaccugguggcgc

SEQ ID NO: 2398816 - RNA, 12 nt, Bordetella pertussis
gcacagcacguc

SEQ ID NO: 2398817 - RNA, 17 nt, Bordetella pertussis
gcacagcaugcgcuggu

SEQ ID NO: 2398818 - RNA, 22 nt, Bordetella pertussis
gcacagcccgaucgacggccgc

SEQ ID NO: 2398819 - RNA, 14 nt, Bordetella pertussis
gcacagccgcagcc

SEQ ID NO: 2398820 - RNA, 15 nt, Bordetella pertussis
gcacagccgcagccg

SEQ ID NO: 2398821 - RNA, 16 nt, Bordetella pertussis
gcacagccggggcgag

SEQ ID NO: 2398822 - RNA, 17 nt, Bordetella pertussis
gcacagccggggcgagc

SEQ ID NO: 2398823 - RNA, 12 nt, Bordetella pertussis
gcacagcgcggc

SEQ ID NO: 2398824 - RNA, 13 nt, Bordetella pertussis
gcacagcgcggcg

SEQ ID NO: 2398825 - RNA, 23 nt, Bordetella pertussis
gcacagcgcggcgaugccccagu

SEQ ID NO: 2398826 - RNA, 15 nt, Bordetella pertussis
gcacaggaacagccu

SEQ ID NO: 2398827 - RNA, 18 nt, Bordetella pertussis
gcacaggaacagccugcc

SEQ ID NO: 2398828 - RNA, 22 nt, Bordetella pertussis
gcacaggauggcgaucaggaaa

SEQ ID NO: 2398829 - RNA, 19 nt, Bordetella pertussis
gcacaggccaucggcgcca

SEQ ID NO: 2398830 - RNA, 22 nt, Bordetella pertussis
gcacaggccaucggcgccaagc

SEQ ID NO: 2398831 - RNA, 12 nt, Bordetella pertussis
gcacaggcgcuc

SEQ ID NO: 2398832 - RNA, 13 nt, Bordetella pertussis
gcacaggcgcucg

SEQ ID NO: 2398833 - RNA, 16 nt, Bordetella pertussis
gcacaggcgcucgccc

SEQ ID NO: 2398834 - RNA, 23 nt, Bordetella pertussis
gcacaggcgcucgcccucgcgcc

SEQ ID NO: 2398835 - RNA, 13 nt, Bordetella pertussis
gcacaggcggcgc

SEQ ID NO: 2398836 - RNA, 15 nt, Bordetella pertussis
gcacaggcggcgccg

SEQ ID NO: 2398837 - RNA, 17 nt, Bordetella pertussis
gcacaggcggcgccggc

SEQ ID NO: 2398838 - RNA, 20 nt, Bordetella pertussis
gcacaggcggcgccggcacg

SEQ ID NO: 2398839 - RNA, 19 nt, Bordetella pertussis
gcacaguucgugcaccagc

SEQ ID NO: 2398840 - RNA, 20 nt, Bordetella pertussis
gcacaguucgugcaccagcc

SEQ ID NO: 2398841 - RNA, 15 nt, Bordetella pertussis
gcacaguugcaggcc

SEQ ID NO: 2398842 - RNA, 16 nt, Bordetella pertussis
gcacaguugcaggcca

SEQ ID NO: 2398843 - RNA, 17 nt, Bordetella pertussis
gcacaguugcaggccau

SEQ ID NO: 2398844 - RNA, 16 nt, Bordetella pertussis
gcacaguuugucggcg

SEQ ID NO: 2398845 - RNA, 17 nt, Bordetella pertussis
gcacauacaaggcgcgg

SEQ ID NO: 2398846 - RNA, 19 nt, Bordetella pertussis
gcacauacaaggcgcggca

SEQ ID NO: 2398847 - RNA, 13 nt, Bordetella pertussis
gcacauacagcgg

SEQ ID NO: 2398848 - RNA, 21 nt, Bordetella pertussis
gcacauacagcggagccgcgc

SEQ ID NO: 2398849 - RNA, 20 nt, Bordetella pertussis
gcacauacgccgccgaggcg

SEQ ID NO: 2398850 - RNA, 18 nt, Bordetella pertussis
gcacauagcgcaagcccg

SEQ ID NO: 2398851 - RNA, 16 nt, Bordetella pertussis
gcacauccagccgaug

SEQ ID NO: 2398852 - RNA, 18 nt, Bordetella pertussis
gcacauccagcgccagca

SEQ ID NO: 2398853 - RNA, 19 nt, Bordetella pertussis
gcacaucgacgucggccuc

SEQ ID NO: 2398854 - RNA, 16 nt, Bordetella pertussis
gcacaucgcccggcag

SEQ ID NO: 2398855 - RNA, 17 nt, Bordetella pertussis
gcacaucgcccggcagg

SEQ ID NO: 2398856 - RNA, 20 nt, Bordetella pertussis
gcacaucggaauuggcggcg

SEQ ID NO: 2398857 - RNA, 14 nt, Bordetella pertussis
gcacaucggccacc

SEQ ID NO: 2398858 - RNA, 20 nt, Bordetella pertussis
gcacaucgucgacgucgauc

SEQ ID NO: 2398859 - RNA, 15 nt, Bordetella pertussis
gcacaugaugcccag

SEQ ID NO: 2398860 - RNA, 22 nt, Bordetella pertussis
gcacaugaugcccagcgccagg

SEQ ID NO: 2398861 - RNA, 15 nt, Bordetella pertussis
gcacaugcccggcca

SEQ ID NO: 2398862 - RNA, 21 nt, Bordetella pertussis
gcacaugcccggccaccagcg

SEQ ID NO: 2398863 - RNA, 15 nt, Bordetella pertussis
gcacauggcggaugg

SEQ ID NO: 2398864 - RNA, 13 nt, Bordetella pertussis
gcacaugggcgcg

SEQ ID NO: 2398865 - RNA, 22 nt, Bordetella pertussis
gcaccaacugguagugcggcgc

SEQ ID NO: 2398866 - RNA, 15 nt, Bordetella pertussis
gcaccaauccccccc

SEQ ID NO: 2398867 - RNA, 20 nt, Bordetella pertussis
gcaccaaucuugccaggccc

SEQ ID NO: 2398868 - RNA, 21 nt, Bordetella pertussis
gcaccaaucuugccaggcccg

SEQ ID NO: 2398869 - RNA, 23 nt, Bordetella pertussis
gcaccaaucuugccaggcccggc

SEQ ID NO: 2398870 - RNA, 19 nt, Bordetella pertussis
gcaccaccaccaugugcuu

SEQ ID NO: 2398871 - RNA, 15 nt, Bordetella pertussis
gcaccaccaccgccc

SEQ ID NO: 2398872 - RNA, 16 nt, Bordetella pertussis
gcaccaccagcaccgc

SEQ ID NO: 2398873 - RNA, 18 nt, Bordetella pertussis
gcaccaccagcaccgcca

SEQ ID NO: 2398874 - RNA, 20 nt, Bordetella pertussis
gcaccaccagcaccgccacg

SEQ ID NO: 2398875 - RNA, 14 nt, Bordetella pertussis
gcaccaccgccgau

SEQ ID NO: 2398876 - RNA, 18 nt, Bordetella pertussis
gcaccacgaugucggcgc

SEQ ID NO: 2398877 - RNA, 19 nt, Bordetella pertussis
gcaccacgaugucggcgca

SEQ ID NO: 2398878 - RNA, 14 nt, Bordetella pertussis
gcaccacgcgcucc

SEQ ID NO: 2398879 - RNA, 19 nt, Bordetella pertussis
gcaccacggcggccaggcc

SEQ ID NO: 2398880 - RNA, 22 nt, Bordetella pertussis
gcaccacggcggccaggccggc

SEQ ID NO: 2398881 - RNA, 23 nt, Bordetella pertussis
gcaccacggcggccaggccggcg

SEQ ID NO: 2398882 - RNA, 19 nt, Bordetella pertussis
gcaccacgggcucgcugac

SEQ ID NO: 2398883 - RNA, 23 nt, Bordetella pertussis
gcaccacgggcucgcugaccggc

SEQ ID NO: 2398884 - RNA, 14 nt, Bordetella pertussis
gcaccacguccugg

SEQ ID NO: 2398885 - RNA, 22 nt, Bordetella pertussis
gcaccacguccuggggcgcggu

SEQ ID NO: 2398886 - RNA, 16 nt, Bordetella pertussis
gcaccagcacuucgau

SEQ ID NO: 2398887 - RNA, 11 nt, Bordetella pertussis
gcaccagcagc

SEQ ID NO: 2398888 - RNA, 15 nt, Bordetella pertussis
gcaccagcagcccca

SEQ ID NO: 2398889 - RNA, 16 nt, Bordetella pertussis
gcaccagcagccccag

SEQ ID NO: 2398890 - RNA, 17 nt, Bordetella pertussis
gcaccagcagccccagc

SEQ ID NO: 2398891 - RNA, 13 nt, Bordetella pertussis
gcaccagcaggcc

SEQ ID NO: 2398892 - RNA, 14 nt, Bordetella pertussis
gcaccagcaggccg

SEQ ID NO: 2398893 - RNA, 17 nt, Bordetella pertussis
gcaccagcaggccggug

SEQ ID NO: 2398894 - RNA, 16 nt, Bordetella pertussis
gcaccagcaugcgcgu

SEQ ID NO: 2398895 - RNA, 12 nt, Bordetella pertussis
gcaccagcaugu

SEQ ID NO: 2398896 - RNA, 12 nt, Bordetella pertussis
gcaccagcccga

SEQ ID NO: 2398897 - RNA, 14 nt, Bordetella pertussis
gcaccagcccgccc

SEQ ID NO: 2398898 - RNA, 16 nt, Bordetella pertussis
gcaccagcccgcccgc

SEQ ID NO: 2398899 - RNA, 12 nt, Bordetella pertussis
gcaccagccggg

SEQ ID NO: 2398900 - RNA, 14 nt, Bordetella pertussis
gcaccagcgaggcg

SEQ ID NO: 2398901 - RNA, 21 nt, Bordetella pertussis
gcaccagcgaguuguccuggc

SEQ ID NO: 2398902 - RNA, 20 nt, Bordetella pertussis
gcaccagcgcauugccgccg

SEQ ID NO: 2398903 - RNA, 16 nt, Bordetella pertussis
gcaccagcgccacgcc

SEQ ID NO: 2398904 - RNA, 19 nt, Bordetella pertussis
gcaccagcgccacgcccag

SEQ ID NO: 2398905 - RNA, 15 nt, Bordetella pertussis
gcaccagcgccgacg

SEQ ID NO: 2398906 - RNA, 22 nt, Bordetella pertussis
gcaccagcgccgacggcauggc

SEQ ID NO: 2398907 - RNA, 14 nt, Bordetella pertussis
gcaccagcgccugc

SEQ ID NO: 2398908 - RNA, 16 nt, Bordetella pertussis
gcaccagcgccugccg

SEQ ID NO: 2398909 - RNA, 13 nt, Bordetella pertussis
gcaccagcgcgcc

SEQ ID NO: 2398910 - RNA, 17 nt, Bordetella pertussis
gcaccagcgcgccgauc

SEQ ID NO: 2398911 - RNA, 17 nt, Bordetella pertussis
gcaccagcgcgccgcgc

SEQ ID NO: 2398912 - RNA, 18 nt, Bordetella pertussis
gcaccagcgcgccgcgcg

SEQ ID NO: 2398913 - RNA, 14 nt, Bordetella pertussis
gcaccagcggaaug

SEQ ID NO: 2398914 - RNA, 23 nt, Bordetella pertussis
gcaccagcggcgauaccaguagc

SEQ ID NO: 2398915 - RNA, 20 nt, Bordetella pertussis
gcaccagcuuggccugcgga

SEQ ID NO: 2398916 - RNA, 19 nt, Bordetella pertussis
gcaccaggauccccagcac

SEQ ID NO: 2398917 - RNA, 22 nt, Bordetella pertussis
gcaccaggcccaugaaggcggc

SEQ ID NO: 2398918 - RNA, 12 nt, Bordetella pertussis
gcaccaggccga

SEQ ID NO: 2398919 - RNA, 14 nt, Bordetella pertussis
gcaccaggccgaac

SEQ ID NO: 2398920 - RNA, 12 nt, Bordetella pertussis
gcaccaggccgc

SEQ ID NO: 2398921 - RNA, 13 nt, Bordetella pertussis
gcaccaggccgcc

SEQ ID NO: 2398922 - RNA, 15 nt, Bordetella pertussis
gcaccaggccgccgg

SEQ ID NO: 2398923 - RNA, 16 nt, Bordetella pertussis
gcaccaggccgccggc

SEQ ID NO: 2398924 - RNA, 17 nt, Bordetella pertussis
gcaccaggccgccggcc

SEQ ID NO: 2398925 - RNA, 19 nt, Bordetella pertussis
gcaccaggccgccggccag

SEQ ID NO: 2398926 - RNA, 14 nt, Bordetella pertussis
gcaccaggccgcgg

SEQ ID NO: 2398927 - RNA, 15 nt, Bordetella pertussis
gcaccaggccgcggc

SEQ ID NO: 2398928 - RNA, 19 nt, Bordetella pertussis
gcaccaggccgcggcgccc

SEQ ID NO: 2398929 - RNA, 14 nt, Bordetella pertussis
gcaccaggccugcc

SEQ ID NO: 2398930 - RNA, 15 nt, Bordetella pertussis
gcaccaggcgcacgg

SEQ ID NO: 2398931 - RNA, 16 nt, Bordetella pertussis
gcaccaggcgcacggc

SEQ ID NO: 2398932 - RNA, 13 nt, Bordetella pertussis
gcaccaggcgcgg

SEQ ID NO: 2398933 - RNA, 19 nt, Bordetella pertussis
gcaccaggcgcucgcgcgc

SEQ ID NO: 2398934 - RNA, 23 nt, Bordetella pertussis
gcaccaggcgcucgcgcgccagc

SEQ ID NO: 2398935 - RNA, 21 nt, Bordetella pertussis
gcaccaggcuuugcgcgccau

SEQ ID NO: 2398936 - RNA, 14 nt, Bordetella pertussis
gcaccagggcgcgc

SEQ ID NO: 2398937 - RNA, 18 nt, Bordetella pertussis
gcaccagggcgcgcagca

SEQ ID NO: 2398938 - RNA, 14 nt, Bordetella pertussis
gcaccagguccugg

SEQ ID NO: 2398939 - RNA, 15 nt, Bordetella pertussis
gcaccagguccuggc

SEQ ID NO: 2398940 - RNA, 16 nt, Bordetella pertussis
gcaccagguccuggcg

SEQ ID NO: 2398941 - RNA, 19 nt, Bordetella pertussis
gcaccagguccuggcggcc

SEQ ID NO: 2398942 - RNA, 17 nt, Bordetella pertussis
gcaccaggucgcggugc

SEQ ID NO: 2398943 - RNA, 18 nt, Bordetella pertussis
gcaccaggucgcggugcg

SEQ ID NO: 2398944 - RNA, 22 nt, Bordetella pertussis
gcaccaggucgcggugcgccac

SEQ ID NO: 2398945 - RNA, 16 nt, Bordetella pertussis
gcaccagguuggcgau

SEQ ID NO: 2398946 - RNA, 14 nt, Bordetella pertussis
gcaccagucccgca

SEQ ID NO: 2398947 - RNA, 17 nt, Bordetella pertussis
gcaccagucccgcaccg

SEQ ID NO: 2398948 - RNA, 17 nt, Bordetella pertussis
gcaccagugcgccggcg

SEQ ID NO: 2398949 - RNA, 22 nt, Bordetella pertussis
gcaccagugcgccggcgcggcg

SEQ ID NO: 2398950 - RNA, 19 nt, Bordetella pertussis
gcaccaguuucucggccac

SEQ ID NO: 2398951 - RNA, 19 nt, Bordetella pertussis
gcaccaguuugccguugcc

SEQ ID NO: 2398952 - RNA, 14 nt, Bordetella pertussis
gcaccaguuuucuc

SEQ ID NO: 2398953 - RNA, 12 nt, Bordetella pertussis
gcaccaucgccg

SEQ ID NO: 2398954 - RNA, 15 nt, Bordetella pertussis
gcaccaucgccgagc

SEQ ID NO: 2398955 - RNA, 15 nt, Bordetella pertussis
gcaccaucgccgccu

SEQ ID NO: 2398956 - RNA, 18 nt, Bordetella pertussis
gcaccaucguugccuggg

SEQ ID NO: 2398957 - RNA, 22 nt, Bordetella pertussis
gcaccaucucccgcaggcccac

SEQ ID NO: 2398958 - RNA, 16 nt, Bordetella pertussis
gcaccaugcgcaccag

SEQ ID NO: 2398959 - RNA, 20 nt, Bordetella pertussis
gcaccaugcgcaccaggcgc

SEQ ID NO: 2398960 - RNA, 19 nt, Bordetella pertussis
gcaccaugcggugcgcccu

SEQ ID NO: 2398961 - RNA, 12 nt, Bordetella pertussis
gcaccauggcgc

SEQ ID NO: 2398962 - RNA, 18 nt, Bordetella pertussis
gcaccauggcgcccacgg

SEQ ID NO: 2398963 - RNA, 21 nt, Bordetella pertussis
gcaccauggcgcccacggccg

SEQ ID NO: 2398964 - RNA, 21 nt, Bordetella pertussis
gcaccaugggcgucgucgccg

SEQ ID NO: 2398965 - RNA, 18 nt, Bordetella pertussis
gcaccaugggcucgugca

SEQ ID NO: 2398966 - RNA, 17 nt, Bordetella pertussis
gcaccaugugcgagagc

SEQ ID NO: 2398967 - RNA, 21 nt, Bordetella pertussis
gcaccauucucgcccugcugg

SEQ ID NO: 2398968 - RNA, 23 nt, Bordetella pertussis
gcaccauucucgcccugcuggcg

SEQ ID NO: 2398969 - RNA, 19 nt, Bordetella pertussis
gcaccauugccggcgcgca

SEQ ID NO: 2398970 - RNA, 19 nt, Bordetella pertussis
gcacccacacuuggccggc

SEQ ID NO: 2398971 - RNA, 21 nt, Bordetella pertussis
gcacccacacuuggccggcga

SEQ ID NO: 2398972 - RNA, 15 nt, Bordetella pertussis
gcacccaggcgccga

SEQ ID NO: 2398973 - RNA, 17 nt, Bordetella pertussis
gcacccaggcgccgauc

SEQ ID NO: 2398974 - RNA, 15 nt, Bordetella pertussis
gcacccaggcgggcu

SEQ ID NO: 2398975 - RNA, 16 nt, Bordetella pertussis
gcacccaggcgggcug

SEQ ID NO: 2398976 - RNA, 19 nt, Bordetella pertussis
gcacccccgaccgagccac

SEQ ID NO: 2398977 - RNA, 19 nt, Bordetella pertussis
gcaccccggccgacggcaa

SEQ ID NO: 2398978 - RNA, 15 nt, Bordetella pertussis
gcaccccggcgccgc

SEQ ID NO: 2398979 - RNA, 18 nt, Bordetella pertussis
gcaccccggugucgccgu

SEQ ID NO: 2398980 - RNA, 21 nt, Bordetella pertussis
gcaccccgucaugcgccauga

SEQ ID NO: 2398981 - RNA, 20 nt, Bordetella pertussis
gcaccccgucggcucagucc

SEQ ID NO: 2398982 - RNA, 21 nt, Bordetella pertussis
gcaccccgucggcucagucca

SEQ ID NO: 2398983 - RNA, 19 nt, Bordetella pertussis
gcacccgaugacggggcgg

SEQ ID NO: 2398984 - RNA, 21 nt, Bordetella pertussis
gcacccgaugacggggcggcg

SEQ ID NO: 2398985 - RNA, 12 nt, Bordetella pertussis
gcacccgcaaga

SEQ ID NO: 2398986 - RNA, 22 nt, Bordetella pertussis
gcacccgcacgggcagacgcca

SEQ ID NO: 2398987 - RNA, 14 nt, Bordetella pertussis
gcacccgcaggccg

SEQ ID NO: 2398988 - RNA, 15 nt, Bordetella pertussis
gcacccgcaggccgu

SEQ ID NO: 2398989 - RNA, 16 nt, Bordetella pertussis
gcacccgcaggcggcu

SEQ ID NO: 2398990 - RNA, 19 nt, Bordetella pertussis
gcacccgcaggcggcuggu

SEQ ID NO: 2398991 - RNA, 21 nt, Bordetella pertussis
gcacccgcaggcggcuggugc

SEQ ID NO: 2398992 - RNA, 19 nt, Bordetella pertussis
gcacccgcaugguggcgca

SEQ ID NO: 2398993 - RNA, 22 nt, Bordetella pertussis
gcacccgcaugguggcgcaggc

SEQ ID NO: 2398994 - RNA, 21 nt, Bordetella pertussis
gcacccgccuggacggcgagg

SEQ ID NO: 2398995 - RNA, 15 nt, Bordetella pertussis
gcacccgcgcgcagc

SEQ ID NO: 2398996 - RNA, 16 nt, Bordetella pertussis
gcacccgcgcgcagcg

SEQ ID NO: 2398997 - RNA, 13 nt, Bordetella pertussis
gcacccgcggcgc

SEQ ID NO: 2398998 - RNA, 23 nt, Bordetella pertussis
gcacccgcggcgcaugcagccgc

SEQ ID NO: 2398999 - RNA, 20 nt, Bordetella pertussis
gcacccgcuaccccggcagc

SEQ ID NO: 2399000 - RNA, 23 nt, Bordetella pertussis
gcacccgcuaccccggcagcguc

SEQ ID NO: 2399001 - RNA, 13 nt, Bordetella pertussis
gcacccggccgcu

SEQ ID NO: 2399002 - RNA, 15 nt, Bordetella pertussis
gcacccggccgcugu

SEQ ID NO: 2399003 - RNA, 21 nt, Bordetella pertussis
gcacccggccgcuguagaagu

SEQ ID NO: 2399004 - RNA, 20 nt, Bordetella pertussis
gcacccgucccugguccagc

SEQ ID NO: 2399005 - RNA, 21 nt, Bordetella pertussis
gcacccgucccugguccagca

SEQ ID NO: 2399006 - RNA, 19 nt, Bordetella pertussis
gcacccugcaggccgggca

SEQ ID NO: 2399007 - RNA, 20 nt, Bordetella pertussis
gcacccugcaggccgggcag

SEQ ID NO: 2399008 - RNA, 22 nt, Bordetella pertussis
gcacccugucauacgccaugaa

SEQ ID NO: 2399009 - RNA, 15 nt, Bordetella pertussis
gcacccuugccgcag

SEQ ID NO: 2399010 - RNA, 19 nt, Bordetella pertussis
gcacccuugccgcagcggg

SEQ ID NO: 2399011 - RNA, 15 nt, Bordetella pertussis
gcacccuugcucagu

SEQ ID NO: 2399012 - RNA, 21 nt, Bordetella pertussis
gcacccuugcucagucgggca

SEQ ID NO: 2399013 - RNA, 22 nt, Bordetella pertussis
gcacccuugcucagucgggcag

SEQ ID NO: 2399014 - RNA, 16 nt, Bordetella pertussis
gcacccuuuugccgca

SEQ ID NO: 2399015 - RNA, 17 nt, Bordetella pertussis
gcaccgaacccugccuc

SEQ ID NO: 2399016 - RNA, 15 nt, Bordetella pertussis
gcaccgaacgggcgu

SEQ ID NO: 2399017 - RNA, 19 nt, Bordetella pertussis
gcaccgaacgggcguggcg

SEQ ID NO: 2399018 - RNA, 22 nt, Bordetella pertussis
gcaccgaacgggcguggcgcag

SEQ ID NO: 2399019 - RNA, 16 nt, Bordetella pertussis
gcaccgacacgcuggc

SEQ ID NO: 2399020 - RNA, 15 nt, Bordetella pertussis
gcaccgacagcaagg

SEQ ID NO: 2399021 - RNA, 15 nt, Bordetella pertussis
gcaccgacaggccga

SEQ ID NO: 2399022 - RNA, 16 nt, Bordetella pertussis
gcaccgaccagcgcgc

SEQ ID NO: 2399023 - RNA, 18 nt, Bordetella pertussis
gcaccgaccagcgcgcgc

SEQ ID NO: 2399024 - RNA, 14 nt, Bordetella pertussis
gcaccgacgggcug

SEQ ID NO: 2399025 - RNA, 16 nt, Bordetella pertussis
gcaccgagaccgggcg

SEQ ID NO: 2399026 - RNA, 17 nt, Bordetella pertussis
gcaccgagaccgggcgg

SEQ ID NO: 2399027 - RNA, 18 nt, Bordetella pertussis
gcaccgagcacagcaacu

SEQ ID NO: 2399028 - RNA, 20 nt, Bordetella pertussis
gcaccgagccgcagguccag

SEQ ID NO: 2399029 - RNA, 14 nt, Bordetella pertussis
gcaccgagcugccg

SEQ ID NO: 2399030 - RNA, 15 nt, Bordetella pertussis
gcaccgagcugccgc

SEQ ID NO: 2399031 - RNA, 17 nt, Bordetella pertussis
gcaccgagcugccgccu

SEQ ID NO: 2399032 - RNA, 17 nt, Bordetella pertussis
gcaccgaggccgagugg

SEQ ID NO: 2399033 - RNA, 23 nt, Bordetella pertussis
gcaccgaggccgaguggccgcug

SEQ ID NO: 2399034 - RNA, 14 nt, Bordetella pertussis
gcaccgaggugccg

SEQ ID NO: 2399035 - RNA, 22 nt, Bordetella pertussis
gcaccgaggugccggcggugau

SEQ ID NO: 2399036 - RNA, 16 nt, Bordetella pertussis
gcaccgaugcgccggc

SEQ ID NO: 2399037 - RNA, 18 nt, Bordetella pertussis
gcaccgaugcgccggccu

SEQ ID NO: 2399038 - RNA, 11 nt, Bordetella pertussis
gcaccgcaagg

SEQ ID NO: 2399039 - RNA, 17 nt, Bordetella pertussis
gcaccgcaugggccagg

SEQ ID NO: 2399040 - RNA, 18 nt, Bordetella pertussis
gcaccgcaugggccaggc

SEQ ID NO: 2399041 - RNA, 19 nt, Bordetella pertussis
gcaccgcaugggccaggcg

SEQ ID NO: 2399042 - RNA, 20 nt, Bordetella pertussis
gcaccgcaugggccaggcgc

SEQ ID NO: 2399043 - RNA, 12 nt, Bordetella pertussis
gcaccgccaccg

SEQ ID NO: 2399044 - RNA, 18 nt, Bordetella pertussis
gcaccgccaccguggcgu

SEQ ID NO: 2399045 - RNA, 14 nt, Bordetella pertussis
gcaccgccagcgcg

SEQ ID NO: 2399046 - RNA, 21 nt, Bordetella pertussis
gcaccgccaggcagauccgcc

SEQ ID NO: 2399047 - RNA, 19 nt, Bordetella pertussis
gcaccgccaugugcgccgc

SEQ ID NO: 2399048 - RNA, 20 nt, Bordetella pertussis
gcaccgccaugugcgccgcg

SEQ ID NO: 2399049 - RNA, 16 nt, Bordetella pertussis
gcaccgccgcacagcc

SEQ ID NO: 2399050 - RNA, 12 nt, Bordetella pertussis
gcaccgccgccg

SEQ ID NO: 2399051 - RNA, 16 nt, Bordetella pertussis
gcaccgccgccggccc

SEQ ID NO: 2399052 - RNA, 18 nt, Bordetella pertussis
gcaccgccgccggcccgg

SEQ ID NO: 2399053 - RNA, 21 nt, Bordetella pertussis
gcaccgccgcgcggugcucgg

SEQ ID NO: 2399054 - RNA, 15 nt, Bordetella pertussis
gcaccgccgcguugc

SEQ ID NO: 2399055 - RNA, 22 nt, Bordetella pertussis
gcaccgccugcugcgccuggcc

SEQ ID NO: 2399056 - RNA, 16 nt, Bordetella pertussis
gcaccgcgaccaugcg

SEQ ID NO: 2399057 - RNA, 20 nt, Bordetella pertussis
gcaccgcgaccaugcggccg

SEQ ID NO: 2399058 - RNA, 14 nt, Bordetella pertussis
gcaccgcgacgacc

SEQ ID NO: 2399059 - RNA, 14 nt, Bordetella pertussis
gcaccgcgcagccc

SEQ ID NO: 2399060 - RNA, 16 nt, Bordetella pertussis
gcaccgcgcagcccgg

SEQ ID NO: 2399061 - RNA, 15 nt, Bordetella pertussis
gcaccgcgccagcgc

SEQ ID NO: 2399062 - RNA, 17 nt, Bordetella pertussis
gcaccgcgccagcgccg

SEQ ID NO: 2399063 - RNA, 23 nt, Bordetella pertussis
gcaccgcgccagcgccggcgcgu

SEQ ID NO: 2399064 - RNA, 22 nt, Bordetella pertussis
gcaccgcgcgcacgaccaccag

SEQ ID NO: 2399065 - RNA, 13 nt, Bordetella pertussis
gcaccgcgcuggg

SEQ ID NO: 2399066 - RNA, 15 nt, Bordetella pertussis
gcaccgcggcgggcu

SEQ ID NO: 2399067 - RNA, 17 nt, Bordetella pertussis
gcaccgcgucggccugc

SEQ ID NO: 2399068 - RNA, 21 nt, Bordetella pertussis
gcaccgcuucuucgucgcgcc

SEQ ID NO: 2399069 - RNA, 17 nt, Bordetella pertussis
gcaccggaggcgccgcg

SEQ ID NO: 2399070 - RNA, 18 nt, Bordetella pertussis
gcaccggaggcgccgcgg

SEQ ID NO: 2399071 - RNA, 22 nt, Bordetella pertussis
gcaccggauccugcggcgcggu

SEQ ID NO: 2399072 - RNA, 16 nt, Bordetella pertussis
gcaccggcacgacggc

SEQ ID NO: 2399073 - RNA, 17 nt, Bordetella pertussis
gcaccggcacgcgccag

SEQ ID NO: 2399074 - RNA, 20 nt, Bordetella pertussis
gcaccggcacgcgccagcug

SEQ ID NO: 2399075 - RNA, 20 nt, Bordetella pertussis
gcaccggcagcguaucgccc

SEQ ID NO: 2399076 - RNA, 23 nt, Bordetella pertussis
gcaccggccaggggcgcuggucg

SEQ ID NO: 2399077 - RNA, 12 nt, Bordetella pertussis
gcaccggccagu

SEQ ID NO: 2399078 - RNA, 14 nt, Bordetella pertussis
gcaccggccgaccc

SEQ ID NO: 2399079 - RNA, 17 nt, Bordetella pertussis
gcaccggccgacccgcg

SEQ ID NO: 2399080 - RNA, 20 nt, Bordetella pertussis
gcaccggccgacccgcggcc

SEQ ID NO: 2399081 - RNA, 22 nt, Bordetella pertussis
gcaccggccgacccgcggcccu

SEQ ID NO: 2399082 - RNA, 14 nt, Bordetella pertussis
gcaccggccgccgc

SEQ ID NO: 2399083 - RNA, 15 nt, Bordetella pertussis
gcaccggccgccgca

SEQ ID NO: 2399084 - RNA, 22 nt, Bordetella pertussis
gcaccggccgccgcaugccggg

SEQ ID NO: 2399085 - RNA, 13 nt, Bordetella pertussis
gcaccggccggcc

SEQ ID NO: 2399086 - RNA, 19 nt, Bordetella pertussis
gcaccggccggccgggcag

SEQ ID NO: 2399087 - RNA, 13 nt, Bordetella pertussis
gcaccggcgccac

SEQ ID NO: 2399088 - RNA, 16 nt, Bordetella pertussis
gcaccggcgccacggc

SEQ ID NO: 2399089 - RNA, 19 nt, Bordetella pertussis
gcaccggcgugagcgccac

SEQ ID NO: 2399090 - RNA, 20 nt, Bordetella pertussis
gcaccggcgugagcgccacc

SEQ ID NO: 2399091 - RNA, 21 nt, Bordetella pertussis
gcaccggcgugagcgccaccg

SEQ ID NO: 2399092 - RNA, 19 nt, Bordetella pertussis
gcaccggcgugcgcuggcu

SEQ ID NO: 2399093 - RNA, 21 nt, Bordetella pertussis
gcaccggcgugcgcuggcugg

SEQ ID NO: 2399094 - RNA, 19 nt, Bordetella pertussis
gcaccggcuuggggcgcgc

SEQ ID NO: 2399095 - RNA, 20 nt, Bordetella pertussis
gcaccggcuuggggcgcgcc

SEQ ID NO: 2399096 - RNA, 20 nt, Bordetella pertussis
gcaccgggaaguccgccgcg

SEQ ID NO: 2399097 - RNA, 23 nt, Bordetella pertussis
gcaccgggaaguccgccgcguug

SEQ ID NO: 2399098 - RNA, 14 nt, Bordetella pertussis
gcaccgggccgaac

SEQ ID NO: 2399099 - RNA, 22 nt, Bordetella pertussis
gcaccgggccgaacaugacguu

SEQ ID NO: 2399100 - RNA, 13 nt, Bordetella pertussis
gcacgcggcgcgg

SEQ ID NO: 2399101 - RNA, 17 nt, Bordetella pertussis
gcacgcgguccacgccg

SEQ ID NO: 2399102 - RNA, 20 nt, Bordetella pertussis
gcacgcgguccacgccgggu

SEQ ID NO: 2399103 - RNA, 16 nt, Bordetella pertussis
gcacgcguucgggcgg

SEQ ID NO: 2399104 - RNA, 23 nt, Bordetella pertussis
gcacgcguucgggcggcaggugc

SEQ ID NO: 2399105 - RNA, 23 nt, Bordetella pertussis
gcacgcucagcaugcgcugggcg

SEQ ID NO: 2399106 - RNA, 18 nt, Bordetella pertussis
gcacgcucugcaccuugg

SEQ ID NO: 2399107 - RNA, 14 nt, Bordetella pertussis
gcacgcucuugagc

SEQ ID NO: 2399108 - RNA, 21 nt, Bordetella pertussis
gcacgcucuugagcgcggccu

SEQ ID NO: 2399109 - RNA, 18 nt, Bordetella pertussis
gcacgcugaccgaagcgg

SEQ ID NO: 2399110 - RNA, 23 nt, Bordetella pertussis
gcacgcugaccgaagcgggcgag

SEQ ID NO: 2399111 - RNA, 23 nt, Bordetella pertussis
gcagcaccaggcuuugcgcgcca

SEQ ID NO: 2399112 - RNA, 16 nt, Bordetella pertussis
gcagcaccgccagcgc

SEQ ID NO: 2399113 - RNA, 17 nt, Bordetella pertussis
gcagcaccgccagcgcg

SEQ ID NO: 2399114 - RNA, 14 nt, Bordetella pertussis
gcagcaccggcaga

SEQ ID NO: 2399115 - RNA, 12 nt, Bordetella pertussis
gcagcaccggcg

SEQ ID NO: 2399116 - RNA, 20 nt, Bordetella pertussis
gcagcaccgggaaguccgcc

SEQ ID NO: 2399117 - RNA, 15 nt, Bordetella pertussis
gcagcaccgugccgg

SEQ ID NO: 2399118 - RNA, 22 nt, Bordetella pertussis
gcagcaccucggacgagacagg

SEQ ID NO: 2399119 - RNA, 23 nt, Bordetella pertussis
gcagcaccucggacgagacaggc

SEQ ID NO: 2399120 - RNA, 19 nt, Bordetella pertussis
gcagcaccucggcguggcg

SEQ ID NO: 2399121 - RNA, 22 nt, Bordetella pertussis
gcagcaccucggcguggcgggg

SEQ ID NO: 2399122 - RNA, 15 nt, Bordetella pertussis
gcagcaccucggggc

SEQ ID NO: 2399123 - RNA, 18 nt, Bordetella pertussis
gcagcaccucggggcgcg

SEQ ID NO: 2399124 - RNA, 21 nt, Bordetella pertussis
gcagcaccucggggcgcggcc

SEQ ID NO: 2399125 - RNA, 19 nt, Bordetella pertussis
gcagcaccuucugccgcca

SEQ ID NO: 2399126 - RNA, 19 nt, Bordetella pertussis
gcagcacgaucgcggcgcu

SEQ ID NO: 2399127 - RNA, 21 nt, Bordetella pertussis
gcagcacgaucgcggcgcugg

SEQ ID NO: 2399128 - RNA, 22 nt, Bordetella pertussis
gcagcacgaucgcggcgcuggc

SEQ ID NO: 2399129 - RNA, 14 nt, Bordetella pertussis
gcagcacgauggcg

SEQ ID NO: 2399130 - RNA, 15 nt, Bordetella pertussis
gcagcacgauggcgc

SEQ ID NO: 2399131 - RNA, 19 nt, Bordetella pertussis
gcagcacgauggcgcccac

SEQ ID NO: 2399132 - RNA, 20 nt, Bordetella pertussis
gcagcacgauggcgcccacg

SEQ ID NO: 2399133 - RNA, 23 nt, Bordetella pertussis
gcagcacgauggcgcccacggcc

SEQ ID NO: 2399134 - RNA, 15 nt, Bordetella pertussis
gcagcacgcaccagg

SEQ ID NO: 2399135 - RNA, 12 nt, Bordetella pertussis
gcagcacgccca

SEQ ID NO: 2399136 - RNA, 18 nt, Bordetella pertussis
gcagcacgcccagauggc

SEQ ID NO: 2399137 - RNA, 19 nt, Bordetella pertussis
gcagcacgcccagauggcc

SEQ ID NO: 2399138 - RNA, 20 nt, Bordetella pertussis
gcagcacgcccauggucagg

SEQ ID NO: 2399139 - RNA, 18 nt, Bordetella pertussis
gcagcacgccgaucgcgc

SEQ ID NO: 2399140 - RNA, 19 nt, Bordetella pertussis
gcagcacgccgcgccaggc

SEQ ID NO: 2399141 - RNA, 19 nt, Bordetella pertussis
gcagcacgcgcaccaggcc

SEQ ID NO: 2399142 - RNA, 12 nt, Bordetella pertussis
gcagcacgcugc

SEQ ID NO: 2399143 - RNA, 13 nt, Bordetella pertussis
gcagcacgcugcg

SEQ ID NO: 2399144 - RNA, 18 nt, Bordetella pertussis
gcagcacgcugcgcggcg

SEQ ID NO: 2399145 - RNA, 15 nt, Bordetella pertussis
gcagcacgcuggccu

SEQ ID NO: 2399146 - RNA, 16 nt, Bordetella pertussis
gcagcacgcuggccuu

SEQ ID NO: 2399147 - RNA, 14 nt, Bordetella pertussis
gcagcacggccacg

SEQ ID NO: 2399148 - RNA, 17 nt, Bordetella pertussis
gcagcacggccacggcc

SEQ ID NO: 2399149 - RNA, 20 nt, Bordetella pertussis
gcagcacggccacggccggc

SEQ ID NO: 2399150 - RNA, 21 nt, Bordetella pertussis
gcagcacggccacggccggca

SEQ ID NO: 2399151 - RNA, 19 nt, Bordetella pertussis
gcagcacggcuugcgcgcc

SEQ ID NO: 2399152 - RNA, 20 nt, Bordetella pertussis
gcagcacggcuugcgcgccu

SEQ ID NO: 2399153 - RNA, 18 nt, Bordetella pertussis
gcagcacgucguagcgcu

SEQ ID NO: 2399154 - RNA, 16 nt, Bordetella pertussis
gcagcacuaccugcgc

SEQ ID NO: 2399155 - RNA, 19 nt, Bordetella pertussis
gcagcagaauguauuggcc

SEQ ID NO: 2399156 - RNA, 13 nt, Bordetella pertussis
gcagcagaucggc

SEQ ID NO: 2399157 - RNA, 16 nt, Bordetella pertussis
gcagcagaucggcggc

SEQ ID NO: 2399158 - RNA, 18 nt, Bordetella pertussis
gcagcagaucggcggccu

SEQ ID NO: 2399159 - RNA, 19 nt, Bordetella pertussis
gcagcagaucggcggccug

SEQ ID NO: 2399160 - RNA, 20 nt, Bordetella pertussis
gcagcagaucggcggccugg

SEQ ID NO: 2399161 - RNA, 18 nt, Bordetella pertussis
gcagcagauugccgcgcg

SEQ ID NO: 2399162 - RNA, 20 nt, Bordetella pertussis
gcagcagauugccgcgcggc

SEQ ID NO: 2399163 - RNA, 12 nt, Bordetella pertussis
gcagcagcacgc

SEQ ID NO: 2399164 - RNA, 18 nt, Bordetella pertussis
gcagcagcacgcagaugu

SEQ ID NO: 2399165 - RNA, 15 nt, Bordetella pertussis
gcagcagcacgccca

SEQ ID NO: 2399166 - RNA, 14 nt, Bordetella pertussis
gcagcagcagcgca

SEQ ID NO: 2399167 - RNA, 16 nt, Bordetella pertussis
gcagcagcagcgcggu

SEQ ID NO: 2399168 - RNA, 14 nt, Bordetella pertussis
gcagcagcagcgug

SEQ ID NO: 2399169 - RNA, 15 nt, Bordetella pertussis
gcagcagcagggcca

SEQ ID NO: 2399170 - RNA, 17 nt, Bordetella pertussis
gcagcagcagggccagg

SEQ ID NO: 2399171 - RNA, 14 nt, Bordetella pertussis
gcagcagccgcuag

SEQ ID NO: 2399172 - RNA, 15 nt, Bordetella pertussis
gcagcagcgacagga

SEQ ID NO: 2399173 - RNA, 15 nt, Bordetella pertussis
gcagcagcgcaucga

SEQ ID NO: 2399174 - RNA, 14 nt, Bordetella pertussis
gcagcagcgccggc

SEQ ID NO: 2399175 - RNA, 18 nt, Bordetella pertussis
gcagcagcgccggcaggc

SEQ ID NO: 2399176 - RNA, 20 nt, Bordetella pertussis
gcagcagcgccuugcggcgc

SEQ ID NO: 2399177 - RNA, 14 nt, Bordetella pertussis
gcagcagcgcgccg

SEQ ID NO: 2399178 - RNA, 13 nt, Bordetella pertussis
gcagcagcgcggu

SEQ ID NO: 2399179 - RNA, 13 nt, Bordetella pertussis
gcagcagcgggcu

SEQ ID NO: 2399180 - RNA, 16 nt, Bordetella pertussis
gcagcaggaacaggcu

SEQ ID NO: 2399181 - RNA, 18 nt, Bordetella pertussis
gcagcaggaacaggcugc

SEQ ID NO: 2399182 - RNA, 20 nt, Bordetella pertussis
gcagcaggaguuccgcgucu

SEQ ID NO: 2399183 - RNA, 14 nt, Bordetella pertussis
gcagcaggccagga

SEQ ID NO: 2399184 - RNA, 12 nt, Bordetella pertussis
gcagcaggccca

SEQ ID NO: 2399185 - RNA, 17 nt, Bordetella pertussis
gcagcaggcccuccggc

SEQ ID NO: 2399186 - RNA, 14 nt, Bordetella pertussis
gcagcaggccgcgc

SEQ ID NO: 2399187 - RNA, 12 nt, Bordetella pertussis
gcagcaggccgg

SEQ ID NO: 2399188 - RNA, 14 nt, Bordetella pertussis
gcagcaggccggcg

SEQ ID NO: 2399189 - RNA, 16 nt, Bordetella pertussis
gcagcaggccggcggc

SEQ ID NO: 2399190 - RNA, 19 nt, Bordetella pertussis
gcagcaggccguugccgcu

SEQ ID NO: 2399191 - RNA, 13 nt, Bordetella pertussis
gcagcaggcgcac

SEQ ID NO: 2399192 - RNA, 15 nt, Bordetella pertussis
gcagcaggcgcacca

SEQ ID NO: 2399193 - RNA, 16 nt, Bordetella pertussis
gcagcaggcgcaccag

SEQ ID NO: 2399194 - RNA, 13 nt, Bordetella pertussis
gcagcaggcgcau

SEQ ID NO: 2399195 - RNA, 16 nt, Bordetella pertussis
gcagcaggcgcgcggc

SEQ ID NO: 2399196 - RNA, 17 nt, Bordetella pertussis
gcagcaggcgcgcggcc

SEQ ID NO: 2399197 - RNA, 13 nt, Bordetella pertussis
gcagcaggcgcuc

SEQ ID NO: 2399198 - RNA, 21 nt, Bordetella pertussis
gcagcaggcgcucggccagcg

SEQ ID NO: 2399199 - RNA, 17 nt, Bordetella pertussis
gcagcaggcugccgccg

SEQ ID NO: 2399200 - RNA, 20 nt, Bordetella pertussis
gcagcaggcugccgccggcg

SEQ ID NO: 2399201 - RNA, 20 nt, Bordetella pertussis
gcagcagggccacgcccagg

SEQ ID NO: 2399202 - RNA, 16 nt, Bordetella pertussis
gcagcagggccaggcc

SEQ ID NO: 2399203 - RNA, 18 nt, Bordetella pertussis
gcagcagggccaggccga

SEQ ID NO: 2399204 - RNA, 13 nt, Bordetella pertussis
gcagcagggccug

SEQ ID NO: 2399205 - RNA, 15 nt, Bordetella pertussis
gcagcagggccuggc

SEQ ID NO: 2399206 - RNA, 23 nt, Bordetella pertussis
gcagcagggccuggcagaugcgc

SEQ ID NO: 2399207 - RNA, 18 nt, Bordetella pertussis
gcagcagguaguagccga

SEQ ID NO: 2399208 - RNA, 18 nt, Bordetella pertussis
gcagcaguucggcgucgg

SEQ ID NO: 2399209 - RNA, 20 nt, Bordetella pertussis
gcagcaguucggcgucggug

SEQ ID NO: 2399210 - RNA, 18 nt, Bordetella pertussis
gcagcaguucggucagcg

SEQ ID NO: 2399211 - RNA, 22 nt, Bordetella pertussis
gcagcaguucggucagcgcggc

SEQ ID NO: 2399212 - RNA, 18 nt, Bordetella pertussis
gcagcaucuugcgccgcu

SEQ ID NO: 2399213 - RNA, 21 nt, Bordetella pertussis
gcagcaucuugcgccgcugcg

SEQ ID NO: 2399214 - RNA, 14 nt, Bordetella pertussis
gcagcaugaccgac

SEQ ID NO: 2399215 - RNA, 15 nt, Bordetella pertussis
gcagcaugagcugau

SEQ ID NO: 2399216 - RNA, 21 nt, Bordetella pertussis
gcagcaugagcugaugcucgc

SEQ ID NO: 2399217 - RNA, 18 nt, Bordetella pertussis
gcagcaugaucuugccga

SEQ ID NO: 2399218 - RNA, 19 nt, Bordetella pertussis
gcagcaugaucuugccgac

SEQ ID NO: 2399219 - RNA, 15 nt, Bordetella pertussis
gcagcaugccgcggu

SEQ ID NO: 2399220 - RNA, 14 nt, Bordetella pertussis
gcagcaugcggccc

SEQ ID NO: 2399221 - RNA, 20 nt, Bordetella pertussis
gcagcaugcggcccgcgcug

SEQ ID NO: 2399222 - RNA, 16 nt, Bordetella pertussis
gcagcauggcgccaug

SEQ ID NO: 2399223 - RNA, 13 nt, Bordetella pertussis
gcagcauggcggg

SEQ ID NO: 2399224 - RNA, 13 nt, Bordetella pertussis
gcagcgcccgcgc

SEQ ID NO: 2399225 - RNA, 14 nt, Bordetella pertussis
gcagcgccgccacc

SEQ ID NO: 2399226 - RNA, 21 nt, Bordetella pertussis
gcagcgccgccaccucggcgu

SEQ ID NO: 2399227 - RNA, 17 nt, Bordetella pertussis
gcagcgccggcaggcgc

SEQ ID NO: 2399228 - RNA, 18 nt, Bordetella pertussis
gcagcgccggcugggcgu

SEQ ID NO: 2399229 - RNA, 22 nt, Bordetella pertussis
gcagcgccgguucgacgcugau

SEQ ID NO: 2399230 - RNA, 23 nt, Bordetella pertussis
gcagcgccgguucgacgcugauc

SEQ ID NO: 2399231 - RNA, 14 nt, Bordetella pertussis
gcagcgccugcagg

SEQ ID NO: 2399232 - RNA, 13 nt, Bordetella pertussis
gcagcgccugccg

SEQ ID NO: 2399233 - RNA, 19 nt, Bordetella pertussis
gcagcgccugccgcgugcc

SEQ ID NO: 2399234 - RNA, 21 nt, Bordetella pertussis
gcagcgccugccgcgugcccg

SEQ ID NO: 2399235 - RNA, 18 nt, Bordetella pertussis
gcagcgccuggccgagcg

SEQ ID NO: 2399236 - RNA, 23 nt, Bordetella pertussis
gcagcgccuggccgagcgcggca

SEQ ID NO: 2399237 - RNA, 19 nt, Bordetella pertussis
gcagcgcgaacggcgggcg

SEQ ID NO: 2399238 - RNA, 22 nt, Bordetella pertussis
gcagcgcgaacggcgggcggau

SEQ ID NO: 2399239 - RNA, 14 nt, Bordetella pertussis
gcagcgcgaccggc

SEQ ID NO: 2399240 - RNA, 13 nt, Bordetella pertussis
gcagcgcgccagg

SEQ ID NO: 2399241 - RNA, 14 nt, Bordetella pertussis
gcagcgcgccaggc

SEQ ID NO: 2399242 - RNA, 16 nt, Bordetella pertussis
gcagcgcgccaggcgc

SEQ ID NO: 2399243 - RNA, 21 nt, Bordetella pertussis
gcagcgcgccaggcgcugcgc

SEQ ID NO: 2399244 - RNA, 14 nt, Bordetella pertussis
gcagcgcgccgccg

SEQ ID NO: 2399245 - RNA, 15 nt, Bordetella pertussis
gcagcgcgccgccga

SEQ ID NO: 2399246 - RNA, 16 nt, Bordetella pertussis
gcagcgcgccgccgau

SEQ ID NO: 2399247 - RNA, 17 nt, Bordetella pertussis
gcagcgcgccgccgaug

SEQ ID NO: 2399248 - RNA, 13 nt, Bordetella pertussis
gcagcgcgccggg

SEQ ID NO: 2399249 - RNA, 19 nt, Bordetella pertussis
gcagcgcgccgggcggguc

SEQ ID NO: 2399250 - RNA, 19 nt, Bordetella pertussis
gcagcgcggcacgcugcug

SEQ ID NO: 2399251 - RNA, 21 nt, Bordetella pertussis
gcagcgcggcacgcugcugau

SEQ ID NO: 2399252 - RNA, 14 nt, Bordetella pertussis
gcagcgcggccggc

SEQ ID NO: 2399253 - RNA, 22 nt, Bordetella pertussis
gcagcgcggccggcaccaggau

SEQ ID NO: 2399254 - RNA, 13 nt, Bordetella pertussis
gcagcgcggcgcc

SEQ ID NO: 2399255 - RNA, 14 nt, Bordetella pertussis
gcagcgcggcgccg

SEQ ID NO: 2399256 - RNA, 15 nt, Bordetella pertussis
gcagcgcggcggcga

SEQ ID NO: 2399257 - RNA, 21 nt, Bordetella pertussis
gcagcgcggcguugaccuggu

SEQ ID NO: 2399258 - RNA, 21 nt, Bordetella pertussis
gcagcgcggucaugccgaaca

SEQ ID NO: 2399259 - RNA, 18 nt, Bordetella pertussis
gcagcgcggugcggguga

SEQ ID NO: 2399260 - RNA, 17 nt, Bordetella pertussis
gcagcgcgguggccagc

SEQ ID NO: 2399261 - RNA, 18 nt, Bordetella pertussis
gcagcgcgguggccagcg

SEQ ID NO: 2399262 - RNA, 19 nt, Bordetella pertussis
gcagcgcgguggccagcga

SEQ ID NO: 2399263 - RNA, 15 nt, Bordetella pertussis
gcagcgcguccugcc

SEQ ID NO: 2399264 - RNA, 17 nt, Bordetella pertussis
gcagcgcguccugccag

SEQ ID NO: 2399265 - RNA, 23 nt, Bordetella pertussis
gcagcgcgucggcgcggucggcg

SEQ ID NO: 2399266 - RNA, 22 nt, Bordetella pertussis
gcagcgcgugcagccagcggcc

SEQ ID NO: 2399267 - RNA, 19 nt, Bordetella pertussis
gcagcgcgugugguuggcg

SEQ ID NO: 2399268 - RNA, 12 nt, Bordetella pertussis
gcagcggacggc

SEQ ID NO: 2399269 - RNA, 13 nt, Bordetella pertussis
gcagcggacggcg

SEQ ID NO: 2399270 - RNA, 19 nt, Bordetella pertussis
gcagcggacgguagcgcac

SEQ ID NO: 2399271 - RNA, 23 nt, Bordetella pertussis
gcagcggacgguagcgcacgcac

SEQ ID NO: 2399272 - RNA, 14 nt, Bordetella pertussis
gcagcggacucaua

SEQ ID NO: 2399273 - RNA, 16 nt, Bordetella pertussis
gcagcggagcgacggc

SEQ ID NO: 2399274 - RNA, 14 nt, Bordetella pertussis
gcagcggcagcagc

SEQ ID NO: 2399275 - RNA, 19 nt, Bordetella pertussis
gcagcggcagcagcagcgc

SEQ ID NO: 2399276 - RNA, 15 nt, Bordetella pertussis
gcagcggcagcaugg

SEQ ID NO: 2399277 - RNA, 14 nt, Bordetella pertussis
gcagcggcagcgca

SEQ ID NO: 2399278 - RNA, 18 nt, Bordetella pertussis
gcagcggcaggcccugcc

SEQ ID NO: 2399279 - RNA, 20 nt, Bordetella pertussis
gcagcggcaggcccugccgc

SEQ ID NO: 2399280 - RNA, 20 nt, Bordetella pertussis
gcagcggcaggcggcugacg

SEQ ID NO: 2399281 - RNA, 15 nt, Bordetella pertussis
gcagcggcaggucgg

SEQ ID NO: 2399282 - RNA, 18 nt, Bordetella pertussis
gcagcggcaucacgccgg

SEQ ID NO: 2399283 - RNA, 20 nt, Bordetella pertussis
gcagcggcaucacgccggug

SEQ ID NO: 2399284 - RNA, 14 nt, Bordetella pertussis
gcagcggccagcgc

SEQ ID NO: 2399285 - RNA, 18 nt, Bordetella pertussis
gcagcggccagcgcggcg

SEQ ID NO: 2399286 - RNA, 15 nt, Bordetella pertussis
gcagcggccagucca

SEQ ID NO: 2399287 - RNA, 17 nt, Bordetella pertussis
gcagcggccauggacga

SEQ ID NO: 2399288 - RNA, 13 nt, Bordetella pertussis
gcagcggccgcgc

SEQ ID NO: 2399289 - RNA, 13 nt, Bordetella pertussis
gcagcggcgacgg

SEQ ID NO: 2399290 - RNA, 12 nt, Bordetella pertussis
gcagcggcgcca

SEQ ID NO: 2399291 - RNA, 14 nt, Bordetella pertussis
gcagcggcgccaug

SEQ ID NO: 2399292 - RNA, 14 nt, Bordetella pertussis
gcagcggcgcgcgc

SEQ ID NO: 2399293 - RNA, 17 nt, Bordetella pertussis
gcagcggcgcgcgcagg

SEQ ID NO: 2399294 - RNA, 13 nt, Bordetella pertussis
gcagcggcggcac

SEQ ID NO: 2399295 - RNA, 20 nt, Bordetella pertussis
gcagcggcggcacgguggcg

SEQ ID NO: 2399296 - RNA, 15 nt, Bordetella pertussis
gcagcggcggcgcgg

SEQ ID NO: 2399297 - RNA, 16 nt, Bordetella pertussis
gcagcggcggcgcggu

SEQ ID NO: 2399298 - RNA, 22 nt, Bordetella pertussis
gcagcggcggcgcggucagcau

SEQ ID NO: 2399299 - RNA, 20 nt, Bordetella pertussis
gcagcggcuccccuggucag

SEQ ID NO: 2399300 - RNA, 16 nt, Bordetella pertussis
gcagcggcucgacgcc

SEQ ID NO: 2399301 - RNA, 15 nt, Bordetella pertussis
gcagcggcucgagcg

SEQ ID NO: 2399302 - RNA, 17 nt, Bordetella pertussis
gcagcggcucgagcggc

SEQ ID NO: 2399303 - RNA, 21 nt, Bordetella pertussis
gcagcggcucgagcggcagca

SEQ ID NO: 2399304 - RNA, 15 nt, Bordetella pertussis
gcagcggcuucaugc

SEQ ID NO: 2399305 - RNA, 16 nt, Bordetella pertussis
gcagcggcuucaugcc

SEQ ID NO: 2399306 - RNA, 18 nt, Bordetella pertussis
gcagcggcuucaugccgg

SEQ ID NO: 2399307 - RNA, 20 nt, Bordetella pertussis
gcagcgggcccgucgcgcca

SEQ ID NO: 2399308 - RNA, 23 nt, Bordetella pertussis
gcagcgggcccgucgcgccaggc

SEQ ID NO: 2399309 - RNA, 13 nt, Bordetella pertussis
gcagcgggcuggg

SEQ ID NO: 2399310 - RNA, 15 nt, Bordetella pertussis
gcagcgggcuggggc

SEQ ID NO: 2399311 - RNA, 22 nt, Bordetella pertussis
gcagcgggcuggggcaggcacu

SEQ ID NO: 2399312 - RNA, 13 nt, Bordetella pertussis
gcagcggggacag

SEQ ID NO: 2399313 - RNA, 14 nt, Bordetella pertussis
gcagcggggacagg

SEQ ID NO: 2399314 - RNA, 18 nt, Bordetella pertussis
gcagcggguugcgcgcca

SEQ ID NO: 2399315 - RNA, 19 nt, Bordetella pertussis
gcagcggguugcgcgccag

SEQ ID NO: 2399316 - RNA, 16 nt, Bordetella pertussis
gcagcguacgcacgcc

SEQ ID NO: 2399317 - RNA, 21 nt, Bordetella pertussis
gcagcguaucgcccgcgcggu

SEQ ID NO: 2399318 - RNA, 19 nt, Bordetella pertussis
gcagcgucaauccgccgcc

SEQ ID NO: 2399319 - RNA, 20 nt, Bordetella pertussis
gcagcgucaauccgccgcca

SEQ ID NO: 2399320 - RNA, 23 nt, Bordetella pertussis
gcagcgucaauccgccgccagca

SEQ ID NO: 2399321 - RNA, 15 nt, Bordetella pertussis
gcagcgucucgccca

SEQ ID NO: 2399322 - RNA, 18 nt, Bordetella pertussis
gcagcgucugcgcaucga

SEQ ID NO: 2399323 - RNA, 15 nt, Bordetella pertussis
gcagcgucugcuggu

SEQ ID NO: 2399324 - RNA, 16 nt, Bordetella pertussis
gcagcgucugcuggua

SEQ ID NO: 2399325 - RNA, 21 nt, Bordetella pertussis
gcagcgucugcugguacagcc

SEQ ID NO: 2399326 - RNA, 20 nt, Bordetella pertussis
gcagcgugaccgacaggccu

SEQ ID NO: 2399327 - RNA, 21 nt, Bordetella pertussis
gcagcgugaccgacaggccug

SEQ ID NO: 2399328 - RNA, 17 nt, Bordetella pertussis
gcagcgugaugccgucg

SEQ ID NO: 2399329 - RNA, 20 nt, Bordetella pertussis
gcagcgugcgacgcauguca

SEQ ID NO: 2399330 - RNA, 13 nt, Bordetella pertussis
gcagcguggccac

SEQ ID NO: 2399331 - RNA, 16 nt, Bordetella pertussis
gcagcguggccaccag

SEQ ID NO: 2399332 - RNA, 22 nt, Bordetella pertussis
gcagcguggccgccaccagcgc

SEQ ID NO: 2399333 - RNA, 23 nt, Bordetella pertussis
gcagcguggccgccaccagcgcg

SEQ ID NO: 2399334 - RNA, 12 nt, Bordetella pertussis
gcagcguggcgc

SEQ ID NO: 2399335 - RNA, 16 nt, Bordetella pertussis
gcagcguggcgcgggu

SEQ ID NO: 2399336 - RNA, 14 nt, Bordetella pertussis
gcagcguggcggcg

SEQ ID NO: 2399337 - RNA, 21 nt, Bordetella pertussis
gcaggccauugcuggcgcgau

SEQ ID NO: 2399338 - RNA, 14 nt, Bordetella pertussis
gcaggcccaccagg

SEQ ID NO: 2399339 - RNA, 16 nt, Bordetella pertussis
gcaggcccaccaggga

SEQ ID NO: 2399340 - RNA, 17 nt, Bordetella pertussis
gcaggcccaccagggac

SEQ ID NO: 2399341 - RNA, 17 nt, Bordetella pertussis
gcaggcccaccagggcc

SEQ ID NO: 2399342 - RNA, 20 nt, Bordetella pertussis
gcaggcccaccggcaugccg

SEQ ID NO: 2399343 - RNA, 12 nt, Bordetella pertussis
gcaggcccagca

SEQ ID NO: 2399344 - RNA, 15 nt, Bordetella pertussis
gcaggcccagcacgc

SEQ ID NO: 2399345 - RNA, 16 nt, Bordetella pertussis
gcaggcccagcacgcg

SEQ ID NO: 2399346 - RNA, 21 nt, Bordetella pertussis
gcaggcccagcacgcgcgcca

SEQ ID NO: 2399347 - RNA, 12 nt, Bordetella pertussis
gcaggcccagcc

SEQ ID NO: 2399348 - RNA, 15 nt, Bordetella pertussis
gcaggcccagccagc

SEQ ID NO: 2399349 - RNA, 16 nt, Bordetella pertussis
gcaggcccagccagcc

SEQ ID NO: 2399350 - RNA, 17 nt, Bordetella pertussis
gcaggcccaugacgccg

SEQ ID NO: 2399351 - RNA, 20 nt, Bordetella pertussis
gcaggcccaugacgccggug

SEQ ID NO: 2399352 - RNA, 15 nt, Bordetella pertussis
gcaggcccaugccgc

SEQ ID NO: 2399353 - RNA, 17 nt, Bordetella pertussis
gcaggcccaugccgcgc

SEQ ID NO: 2399354 - RNA, 14 nt, Bordetella pertussis
gcaggccccggccc

SEQ ID NO: 2399355 - RNA, 18 nt, Bordetella pertussis
gcaggccccggcccggcg

SEQ ID NO: 2399356 - RNA, 20 nt, Bordetella pertussis
gcaggccccggcccggcggg

SEQ ID NO: 2399357 - RNA, 21 nt, Bordetella pertussis
gcaggccccggcccggcgggc

SEQ ID NO: 2399358 - RNA, 17 nt, Bordetella pertussis
gcaggcccgacaggaac

SEQ ID NO: 2399359 - RNA, 13 nt, Bordetella pertussis
gcaggcccggcgc

SEQ ID NO: 2399360 - RNA, 13 nt, Bordetella pertussis
gcaggcccgggcg

SEQ ID NO: 2399361 - RNA, 21 nt, Bordetella pertussis
gcaggcccguguagacggcaa

SEQ ID NO: 2399362 - RNA, 21 nt, Bordetella pertussis
gcaggcccuccggcgccagca

SEQ ID NO: 2399363 - RNA, 23 nt, Bordetella pertussis
gcaggcccuccggcgccagcaug

SEQ ID NO: 2399364 - RNA, 13 nt, Bordetella pertussis
gcaggcccugccg

SEQ ID NO: 2399365 - RNA, 14 nt, Bordetella pertussis
gcaggcccugggcg

SEQ ID NO: 2399366 - RNA, 16 nt, Bordetella pertussis
gcaggcccugggcgag

SEQ ID NO: 2399367 - RNA, 20 nt, Bordetella pertussis
gcaggcccuugaucaggcgc

SEQ ID NO: 2399368 - RNA, 13 nt, Bordetella pertussis
gcaggccgaaacc

SEQ ID NO: 2399369 - RNA, 19 nt, Bordetella pertussis
gcaggccgaggaccugcug

SEQ ID NO: 2399370 - RNA, 15 nt, Bordetella pertussis
gcaggccgcagcggg

SEQ ID NO: 2399371 - RNA, 14 nt, Bordetella pertussis
gcaggccgccacuu

SEQ ID NO: 2399372 - RNA, 16 nt, Bordetella pertussis
gcaggccgccacuugc

SEQ ID NO: 2399373 - RNA, 14 nt, Bordetella pertussis
gcaggccgcccagc

SEQ ID NO: 2399374 - RNA, 15 nt, Bordetella pertussis
gcaggccgcccagcg

SEQ ID NO: 2399375 - RNA, 17 nt, Bordetella pertussis
gcaggccgcccagcgca

SEQ ID NO: 2399376 - RNA, 15 nt, Bordetella pertussis
gcaggccgccgccgg

SEQ ID NO: 2399377 - RNA, 12 nt, Bordetella pertussis
gcaggccgccgg

SEQ ID NO: 2399378 - RNA, 14 nt, Bordetella pertussis
gcaggccgccggcc

SEQ ID NO: 2399379 - RNA, 14 nt, Bordetella pertussis
gcaggccgccgggg

SEQ ID NO: 2399380 - RNA, 18 nt, Bordetella pertussis
gcaggccgcgcagcacgc

SEQ ID NO: 2399381 - RNA, 15 nt, Bordetella pertussis
gcaggccgcgccggc

SEQ ID NO: 2399382 - RNA, 15 nt, Bordetella pertussis
gcaggccgcgcgugc

SEQ ID NO: 2399383 - RNA, 22 nt, Bordetella pertussis
gcaggccgcgcgugcggggcgg

SEQ ID NO: 2399384 - RNA, 16 nt, Bordetella pertussis
gcaggccgcgcugcca

SEQ ID NO: 2399385 - RNA, 22 nt, Bordetella pertussis
gcaggccgcgcugccagccaug

SEQ ID NO: 2399386 - RNA, 14 nt, Bordetella pertussis
gcaggccgcgcugg

SEQ ID NO: 2399387 - RNA, 16 nt, Bordetella pertussis
gcaggccgcgcuggug

SEQ ID NO: 2399388 - RNA, 17 nt, Bordetella pertussis
gcaggccgcgcuggugc

SEQ ID NO: 2399389 - RNA, 19 nt, Bordetella pertussis
gcaggccgcgcuggugcug

SEQ ID NO: 2399390 - RNA, 11 nt, Bordetella pertussis
gcaggccgcgg

SEQ ID NO: 2399391 - RNA, 15 nt, Bordetella pertussis
gcaggccgcggccag

SEQ ID NO: 2399392 - RNA, 16 nt, Bordetella pertussis
gcaggccgcggccagg

SEQ ID NO: 2399393 - RNA, 18 nt, Bordetella pertussis
gcaggccgcggccaggcc

SEQ ID NO: 2399394 - RNA, 12 nt, Bordetella pertussis
gcaggccgcgua

SEQ ID NO: 2399395 - RNA, 15 nt, Bordetella pertussis
gcaggccggccagca

SEQ ID NO: 2399396 - RNA, 14 nt, Bordetella pertussis
gcaggccggcgcgc

SEQ ID NO: 2399397 - RNA, 16 nt, Bordetella pertussis
gcaggccggcggccag

SEQ ID NO: 2399398 - RNA, 21 nt, Bordetella pertussis
gcaggccggcggccagcgcgc

SEQ ID NO: 2399399 - RNA, 20 nt, Bordetella pertussis
gcaggccguuccaguccagc

SEQ ID NO: 2399400 - RNA, 21 nt, Bordetella pertussis
gcaggccucgcccgaucggcc

SEQ ID NO: 2399401 - RNA, 14 nt, Bordetella pertussis
gcaggccugcugca

SEQ ID NO: 2399402 - RNA, 11 nt, Bordetella pertussis
gcaggccuggu

SEQ ID NO: 2399403 - RNA, 20 nt, Bordetella pertussis
gcaggccuggucgagcgggc

SEQ ID NO: 2399404 - RNA, 21 nt, Bordetella pertussis
gcaggccuggucgagcgggcg

SEQ ID NO: 2399405 - RNA, 20 nt, Bordetella pertussis
gcaggcgaaacgccagcccg

SEQ ID NO: 2399406 - RNA, 14 nt, Bordetella pertussis
gcaggcgcaccagc

SEQ ID NO: 2399407 - RNA, 20 nt, Bordetella pertussis
gcaggcgcaccagcgcgccg

SEQ ID NO: 2399408 - RNA, 14 nt, Bordetella pertussis
gcaggcgcacgccg

SEQ ID NO: 2399409 - RNA, 12 nt, Bordetella pertussis
gcaggcgcagcg

SEQ ID NO: 2399410 - RNA, 14 nt, Bordetella pertussis
gcaggcgcagcggc

SEQ ID NO: 2399411 - RNA, 15 nt, Bordetella pertussis
gcaggcgcagcggcg

SEQ ID NO: 2399412 - RNA, 17 nt, Bordetella pertussis
gcaggcgcagcggcggc

SEQ ID NO: 2399413 - RNA, 14 nt, Bordetella pertussis
gcaggcgcaggccg

SEQ ID NO: 2399414 - RNA, 15 nt, Bordetella pertussis
gcaggcgcaggccgc

SEQ ID NO: 2399415 - RNA, 14 nt, Bordetella pertussis
gcaggcgcaucagc

SEQ ID NO: 2399416 - RNA, 22 nt, Bordetella pertussis
gcaggcgcaucagcuuggccac

SEQ ID NO: 2399417 - RNA, 21 nt, Bordetella pertussis
gcaggcgcccaacccaggucg

SEQ ID NO: 2399418 - RNA, 13 nt, Bordetella pertussis
gcaggcgccgcac

SEQ ID NO: 2399419 - RNA, 12 nt, Bordetella pertussis
gcaggcgccgcc

SEQ ID NO: 2399420 - RNA, 14 nt, Bordetella pertussis
gcaggcgccgcccc

SEQ ID NO: 2399421 - RNA, 13 nt, Bordetella pertussis
gcaggcgccgccg

SEQ ID NO: 2399422 - RNA, 13 nt, Bordetella pertussis
gcaggcgccggcu

SEQ ID NO: 2399423 - RNA, 15 nt, Bordetella pertussis
gcaggcgccggcugg

SEQ ID NO: 2399424 - RNA, 16 nt, Bordetella pertussis
gcaggcgccggcuggc

SEQ ID NO: 2399425 - RNA, 13 nt, Bordetella pertussis
gcaggcgccuucg

SEQ ID NO: 2399426 - RNA, 12 nt, Bordetella pertussis
gcaggcgcgagc

SEQ ID NO: 2399427 - RNA, 14 nt, Bordetella pertussis
gcaggcgcgagcgc

SEQ ID NO: 2399428 - RNA, 19 nt, Bordetella pertussis
gcaggcgcgagcgccgggc

SEQ ID NO: 2399429 - RNA, 13 nt, Bordetella pertussis
gcaggcgcgccag

SEQ ID NO: 2399430 - RNA, 15 nt, Bordetella pertussis
gcaggcgcgccagcc

SEQ ID NO: 2399431 - RNA, 16 nt, Bordetella pertussis
gcaggcgcgccagccc

SEQ ID NO: 2399432 - RNA, 15 nt, Bordetella pertussis
gcaggcgcgccgggc

SEQ ID NO: 2399433 - RNA, 15 nt, Bordetella pertussis
gcaggcgcgcgccuu

SEQ ID NO: 2399434 - RNA, 12 nt, Bordetella pertussis
gcaggcgcgcgg

SEQ ID NO: 2399435 - RNA, 14 nt, Bordetella pertussis
gcaggcgcgcggcc

SEQ ID NO: 2399436 - RNA, 15 nt, Bordetella pertussis
gcaggcgcgcggccu

SEQ ID NO: 2399437 - RNA, 16 nt, Bordetella pertussis
gcaggcgcgcggccuc

SEQ ID NO: 2399438 - RNA, 17 nt, Bordetella pertussis
gcaggcgcgcucaggcc

SEQ ID NO: 2399439 - RNA, 23 nt, Bordetella pertussis
gcaggcgcgcucaggccgccggc

SEQ ID NO: 2399440 - RNA, 15 nt, Bordetella pertussis
gcaggcgcucggcca

SEQ ID NO: 2399441 - RNA, 19 nt, Bordetella pertussis
gcaggcgcucggccagcga

SEQ ID NO: 2399442 - RNA, 13 nt, Bordetella pertussis
gcaggcgcugcag

SEQ ID NO: 2399443 - RNA, 14 nt, Bordetella pertussis
gcaggcgcugcagc

SEQ ID NO: 2399444 - RNA, 14 nt, Bordetella pertussis
gcaggcgcugcgca

SEQ ID NO: 2399445 - RNA, 15 nt, Bordetella pertussis
gcaggcgcugcgcau

SEQ ID NO: 2399446 - RNA, 18 nt, Bordetella pertussis
gcaggcgcugcgcauaga

SEQ ID NO: 2399447 - RNA, 12 nt, Bordetella pertussis
gcaggcgcuggu

SEQ ID NO: 2399448 - RNA, 14 nt, Bordetella pertussis
gcaggcgcuggucg

SEQ ID NO: 2399449 - RNA, 18 nt, Bordetella pertussis
gcaggcgcuggucgucgc

SEQ ID NO: 2399450 - RNA, 17 nt, Bordetella pertussis
gcaggcggcagaaggcg

SEQ ID NO: 2399451 - RNA, 21 nt, Bordetella pertussis
gcaggcggcagaaggcgacau

SEQ ID NO: 2399452 - RNA, 22 nt, Bordetella pertussis
gcagguccugcacgcgggccag

SEQ ID NO: 2399453 - RNA, 12 nt, Bordetella pertussis
gcagguccuggu

SEQ ID NO: 2399454 - RNA, 23 nt, Bordetella pertussis
gcagguccugguagaucagcgcg

SEQ ID NO: 2399455 - RNA, 23 nt, Bordetella pertussis
gcagguccugguaucccucgccc

SEQ ID NO: 2399456 - RNA, 22 nt, Bordetella pertussis
gcaggucgaucuccacgaaggc

SEQ ID NO: 2399457 - RNA, 17 nt, Bordetella pertussis
gcaggucgaugcccucc

SEQ ID NO: 2399458 - RNA, 20 nt, Bordetella pertussis
gcaggucgauggggucgggc

SEQ ID NO: 2399459 - RNA, 22 nt, Bordetella pertussis
gcaggucgauggggucgggccg

SEQ ID NO: 2399460 - RNA, 16 nt, Bordetella pertussis
gcaggucgccagcagg

SEQ ID NO: 2399461 - RNA, 17 nt, Bordetella pertussis
gcaggucgccagcaggc

SEQ ID NO: 2399462 - RNA, 18 nt, Bordetella pertussis
gcaggucgccagcaggcc

SEQ ID NO: 2399463 - RNA, 23 nt, Bordetella pertussis
gcaggucggagucggcgccgcgc

SEQ ID NO: 2399464 - RNA, 16 nt, Bordetella pertussis
gcaggucggcgaugcg

SEQ ID NO: 2399465 - RNA, 16 nt, Bordetella pertussis
gcaggucggcgcggcc

SEQ ID NO: 2399466 - RNA, 21 nt, Bordetella pertussis
gcaggucgggauaguccagca

SEQ ID NO: 2399467 - RNA, 21 nt, Bordetella pertussis
gcaggucgggcagggugggca

SEQ ID NO: 2399468 - RNA, 20 nt, Bordetella pertussis
gcaggucggggcgcucgagc

SEQ ID NO: 2399469 - RNA, 12 nt, Bordetella pertussis
gcaggucggucg

SEQ ID NO: 2399470 - RNA, 20 nt, Bordetella pertussis
gcaggucgucgagccgggcc

SEQ ID NO: 2399471 - RNA, 17 nt, Bordetella pertussis
gcaggucguggccgugc

SEQ ID NO: 2399472 - RNA, 17 nt, Bordetella pertussis
gcaggucuucgggcgug

SEQ ID NO: 2399473 - RNA, 19 nt, Bordetella pertussis
gcaggugaugcgcgcggcc

SEQ ID NO: 2399474 - RNA, 14 nt, Bordetella pertussis
gcaggugcacgcac

SEQ ID NO: 2399475 - RNA, 22 nt, Bordetella pertussis
gcaggugcacgcacgguacgcc

SEQ ID NO: 2399476 - RNA, 15 nt, Bordetella pertussis
gcaggugccgccggc

SEQ ID NO: 2399477 - RNA, 16 nt, Bordetella pertussis
gcaggugccgccggcg

SEQ ID NO: 2399478 - RNA, 19 nt, Bordetella pertussis
gcaggugccgccggcgcgg

SEQ ID NO: 2399479 - RNA, 18 nt, Bordetella pertussis
gcauaggacgccaccagu

SEQ ID NO: 2399480 - RNA, 18 nt, Bordetella pertussis
gcauaggcggcgcaggcc

SEQ ID NO: 2399481 - RNA, 20 nt, Bordetella pertussis
gcauauccaggcggcgcucg

SEQ ID NO: 2399482 - RNA, 15 nt, Bordetella pertussis
gcauauccgcgugcg

SEQ ID NO: 2399483 - RNA, 17 nt, Bordetella pertussis
gcauauggagccaggcg

SEQ ID NO: 2399484 - RNA, 17 nt, Bordetella pertussis
gcaucaacacgcuggac

SEQ ID NO: 2399485 - RNA, 18 nt, Bordetella pertussis
gcaucaacacgcuggacg

SEQ ID NO: 2399486 - RNA, 16 nt, Bordetella pertussis
gcaucaauagcccgug

SEQ ID NO: 2399487 - RNA, 23 nt, Bordetella pertussis
gcaucaccagcucgcggcccugg

SEQ ID NO: 2399488 - RNA, 13 nt, Bordetella pertussis
gcaucaccuucaa

SEQ ID NO: 2399489 - RNA, 21 nt, Bordetella pertussis
gcaucacuuucccauccuggc

SEQ ID NO: 2399490 - RNA, 13 nt, Bordetella pertussis
gcaucagcagacc

SEQ ID NO: 2399491 - RNA, 17 nt, Bordetella pertussis
gcaucagcccuacccug

SEQ ID NO: 2399492 - RNA, 21 nt, Bordetella pertussis
gcaucagcccuacccugauca

SEQ ID NO: 2399493 - RNA, 13 nt, Bordetella pertussis
gcaucagcgcgcc

SEQ ID NO: 2399494 - RNA, 14 nt, Bordetella pertussis
gcaucagcggcagc

SEQ ID NO: 2399495 - RNA, 17 nt, Bordetella pertussis
gcaucagcggcagcacg

SEQ ID NO: 2399496 - RNA, 19 nt, Bordetella pertussis
gcaucagcuuggccaccac

SEQ ID NO: 2399497 - RNA, 20 nt, Bordetella pertussis
gcaucagcuuggccaccacg

SEQ ID NO: 2399498 - RNA, 14 nt, Bordetella pertussis
gcaucaggcccgac

SEQ ID NO: 2399499 - RNA, 15 nt, Bordetella pertussis
gcaucagggcgaucu

SEQ ID NO: 2399500 - RNA, 19 nt, Bordetella pertussis
gcaucagggcgaugccgca

SEQ ID NO: 2399501 - RNA, 20 nt, Bordetella pertussis
gcaucaggggcucggccagg

SEQ ID NO: 2399502 - RNA, 18 nt, Bordetella pertussis
gcaucaguucaggcuggc

SEQ ID NO: 2399503 - RNA, 18 nt, Bordetella pertussis
gcaucaugaggcggcggu

SEQ ID NO: 2399504 - RNA, 14 nt, Bordetella pertussis
gcaucauggcgcgc

SEQ ID NO: 2399505 - RNA, 21 nt, Bordetella pertussis
gcaucauguaaggcgcaugcc

SEQ ID NO: 2399506 - RNA, 22 nt, Bordetella pertussis
gcaucauguaaggcgcaugcca

SEQ ID NO: 2399507 - RNA, 22 nt, Bordetella pertussis
gcaucccaauuggccgcccugg

SEQ ID NO: 2399508 - RNA, 16 nt, Bordetella pertussis
gcaucccgcccccgcc

SEQ ID NO: 2399509 - RNA, 17 nt, Bordetella pertussis
gcaucccgcccccgccg

SEQ ID NO: 2399510 - RNA, 20 nt, Bordetella pertussis
gcaucccgcccccgccgcac

SEQ ID NO: 2399511 - RNA, 14 nt, Bordetella pertussis
gcaucccggcgcuc

SEQ ID NO: 2399512 - RNA, 22 nt, Bordetella pertussis
gcaucccggcgcucagcgcgcc

SEQ ID NO: 2399513 - RNA, 14 nt, Bordetella pertussis
gcauccgcgccagg

SEQ ID NO: 2399514 - RNA, 15 nt, Bordetella pertussis
gcauccgcgccagga

SEQ ID NO: 2399515 - RNA, 14 nt, Bordetella pertussis
gcauccggcccagc

SEQ ID NO: 2399516 - RNA, 17 nt, Bordetella pertussis
gcauccggcccagcgcc

SEQ ID NO: 2399517 - RNA, 13 nt, Bordetella pertussis
gcauccggcccgg

SEQ ID NO: 2399518 - RNA, 22 nt, Bordetella pertussis
gcauccggcccggugcagccgc

SEQ ID NO: 2399519 - RNA, 20 nt, Bordetella pertussis
gcauccggugauuucggcgc

SEQ ID NO: 2399520 - RNA, 23 nt, Bordetella pertussis
gcauccggugauuucggcgcauc

SEQ ID NO: 2399521 - RNA, 17 nt, Bordetella pertussis
gcauccgguggugcugg

SEQ ID NO: 2399522 - RNA, 23 nt, Bordetella pertussis
gcauccgguggugcugggcggcg

SEQ ID NO: 2399523 - RNA, 18 nt, Bordetella pertussis
gcauccuucacgaaccgc

SEQ ID NO: 2399524 - RNA, 15 nt, Bordetella pertussis
gcaucgaacgugcug

SEQ ID NO: 2399525 - RNA, 15 nt, Bordetella pertussis
gcaucgacagcgcgc

SEQ ID NO: 2399526 - RNA, 16 nt, Bordetella pertussis
gcaucgacagcgcgcc

SEQ ID NO: 2399527 - RNA, 19 nt, Bordetella pertussis
gcaucgacagcgcgcccgc

SEQ ID NO: 2399528 - RNA, 16 nt, Bordetella pertussis
gcaucgacaugcccgc

SEQ ID NO: 2399529 - RNA, 17 nt, Bordetella pertussis
gcaucgaccacgcgcgc

SEQ ID NO: 2399530 - RNA, 18 nt, Bordetella pertussis
gcaucgaccacgcgcgcg

SEQ ID NO: 2399531 - RNA, 19 nt, Bordetella pertussis
gcaucgaccacgcgcgcgc

SEQ ID NO: 2399532 - RNA, 15 nt, Bordetella pertussis
gcaucgaccagcgca

SEQ ID NO: 2399533 - RNA, 17 nt, Bordetella pertussis
gcaucgaccagcgcacg

SEQ ID NO: 2399534 - RNA, 18 nt, Bordetella pertussis
gcaucgaccagcgcacgg

SEQ ID NO: 2399535 - RNA, 18 nt, Bordetella pertussis
gcaucgagaaaccagccg

SEQ ID NO: 2399536 - RNA, 19 nt, Bordetella pertussis
gcaucgagaaaccagccgc

SEQ ID NO: 2399537 - RNA, 19 nt, Bordetella pertussis
gcaucgagauugagcacgc

SEQ ID NO: 2399538 - RNA, 22 nt, Bordetella pertussis
gcaucgagcuccugcaggaugg

SEQ ID NO: 2399539 - RNA, 17 nt, Bordetella pertussis
gcaucgaucagcgcgcc

SEQ ID NO: 2399540 - RNA, 18 nt, Bordetella pertussis
gcaucgaucagcgcgccg

SEQ ID NO: 2399541 - RNA, 15 nt, Bordetella pertussis
gcaucgaugcggccu

SEQ ID NO: 2399542 - RNA, 19 nt, Bordetella pertussis
gcaucgauuucucgcugcu

SEQ ID NO: 2399543 - RNA, 15 nt, Bordetella pertussis
gcaucgccaugccgg

SEQ ID NO: 2399544 - RNA, 24 nt, Bordetella pertussis
gcaucgcccaccaugagcacgccc

SEQ ID NO: 2399545 - RNA, 13 nt, Bordetella pertussis
gcaucgccccgga

SEQ ID NO: 2399546 - RNA, 13 nt, Bordetella pertussis
gcaucgcccugcu

SEQ ID NO: 2399547 - RNA, 12 nt, Bordetella pertussis
gcaucgccgcca

SEQ ID NO: 2399548 - RNA, 15 nt, Bordetella pertussis
gcaucgccgccagcu

SEQ ID NO: 2399549 - RNA, 18 nt, Bordetella pertussis
gcaucgccgccagcuugg

SEQ ID NO: 2399550 - RNA, 15 nt, Bordetella pertussis
gcaucgccgcgggcg

SEQ ID NO: 2399551 - RNA, 17 nt, Bordetella pertussis
gcaucgcgaugcgcagc

SEQ ID NO: 2399552 - RNA, 22 nt, Bordetella pertussis
gcaucgcgcaagggccagucgu

SEQ ID NO: 2399553 - RNA, 17 nt, Bordetella pertussis
gcaucgcgcagcgugcg

SEQ ID NO: 2399554 - RNA, 16 nt, Bordetella pertussis
gcaucgcgccuucggc

SEQ ID NO: 2399555 - RNA, 14 nt, Bordetella pertussis
gcaucgcgcgccgc

SEQ ID NO: 2399556 - RNA, 14 nt, Bordetella pertussis
gcaucgcgcgcgcc

SEQ ID NO: 2399557 - RNA, 17 nt, Bordetella pertussis
gcaucgcgcgcgccggc

SEQ ID NO: 2399558 - RNA, 13 nt, Bordetella pertussis
gcaucgcgcggca

SEQ ID NO: 2399559 - RNA, 13 nt, Bordetella pertussis
gcaucgcgcugac

SEQ ID NO: 2399560 - RNA, 21 nt, Bordetella pertussis
gcaucgcgcugacagcgcucu

SEQ ID NO: 2399561 - RNA, 16 nt, Bordetella pertussis
gcaucgcggcagcccg

SEQ ID NO: 2399562 - RNA, 17 nt, Bordetella pertussis
gcaucgcggcagcccgg

SEQ ID NO: 2399563 - RNA, 21 nt, Bordetella pertussis
gcaucggcacaccccgggcgg

SEQ ID NO: 2399564 - RNA, 16 nt, Bordetella pertussis
gcaucggccacgcugc

SEQ ID NO: 2399565 - RNA, 22 nt, Bordetella pertussis
gcaucggccacgcugcccugcu

SEQ ID NO: 2399566 - RNA, 18 nt, Bordetella pertussis
gcaucggccaggcgccug

SEQ ID NO: 2399567 - RNA, 17 nt, Bordetella pertussis
gcaucggccauggcggu

SEQ ID NO: 2399568 - RNA, 19 nt, Bordetella pertussis
gcaucggccauggcgguga

SEQ ID NO: 2399569 - RNA, 16 nt, Bordetella pertussis
gcaucggccugcaccg

SEQ ID NO: 2399570 - RNA, 18 nt, Bordetella pertussis
gcaucggccugcaccggc

SEQ ID NO: 2399571 - RNA, 21 nt, Bordetella pertussis
gcaucggccugcaccggcgcg

SEQ ID NO: 2399572 - RNA, 15 nt, Bordetella pertussis
gcaucggcgccgagc

SEQ ID NO: 2399573 - RNA, 16 nt, Bordetella pertussis
gcaucggcgccgagca

SEQ ID NO: 2399574 - RNA, 14 nt, Bordetella pertussis
gcaucggcgccgcg

SEQ ID NO: 2399575 - RNA, 15 nt, Bordetella pertussis
gcaucggcgccgcgc

SEQ ID NO: 2399576 - RNA, 16 nt, Bordetella pertussis
gcaucggcgccgcgcg

SEQ ID NO: 2399577 - RNA, 19 nt, Bordetella pertussis
gcaucggcgccgcgcgcuu

SEQ ID NO: 2399578 - RNA, 16 nt, Bordetella pertussis
gcaucggcgccggcgu

SEQ ID NO: 2399579 - RNA, 13 nt, Bordetella pertussis
gcaucggcggcag

SEQ ID NO: 2399580 - RNA, 18 nt, Bordetella pertussis
gcaucggcggcaggucgg

SEQ ID NO: 2399581 - RNA, 13 nt, Bordetella pertussis
gcaucggcggcuu

SEQ ID NO: 2399582 - RNA, 17 nt, Bordetella pertussis
gcaucggcguaccaggc

SEQ ID NO: 2399583 - RNA, 19 nt, Bordetella pertussis
gcaucggcguaccaggcag

SEQ ID NO: 2399584 - RNA, 15 nt, Bordetella pertussis
gcaucggcuggcgca

SEQ ID NO: 2399585 - RNA, 20 nt, Bordetella pertussis
gcaucgggguuccacagcgc

SEQ ID NO: 2399586 - RNA, 22 nt, Bordetella pertussis
gcaucgggguuccacagcgccg

SEQ ID NO: 2399587 - RNA, 17 nt, Bordetella pertussis
gcaucggucaacgccug

SEQ ID NO: 2399588 - RNA, 22 nt, Bordetella pertussis
gcaucggucaacgccugcgggc

SEQ ID NO: 2399589 - RNA, 20 nt, Bordetella pertussis
gcaucguaguugggcgccuu

SEQ ID NO: 2399590 - RNA, 15 nt, Bordetella pertussis
gcaucguaucgggcg

SEQ ID NO: 2399591 - RNA, 20 nt, Bordetella pertussis
gcaucguaucgggcgucagc

SEQ ID NO: 2399592 - RNA, 18 nt, Bordetella pertussis
gccaacgccaagcugcug

SEQ ID NO: 2399593 - RNA, 19 nt, Bordetella pertussis
gccaacgccaagcugcugg

SEQ ID NO: 2399594 - RNA, 23 nt, Bordetella pertussis
gccaacgccaagcugcuggccgg

SEQ ID NO: 2399595 - RNA, 14 nt, Bordetella pertussis
gccaacgcggcgcg

SEQ ID NO: 2399596 - RNA, 22 nt, Bordetella pertussis
gccaacggaagagggcggggcg

SEQ ID NO: 2399597 - RNA, 16 nt, Bordetella pertussis
gccaacggcuggcugg

SEQ ID NO: 2399598 - RNA, 15 nt, Bordetella pertussis
gccaacggugccagu

SEQ ID NO: 2399599 - RNA, 17 nt, Bordetella pertussis
gccaacggugccagucc

SEQ ID NO: 2399600 - RNA, 22 nt, Bordetella pertussis
gccaacggugccagucccccug

SEQ ID NO: 2399601 - RNA, 23 nt, Bordetella pertussis
gccaacggugccagucccccugc

SEQ ID NO: 2399602 - RNA, 13 nt, Bordetella pertussis
gccaacgucggca

SEQ ID NO: 2399603 - RNA, 14 nt, Bordetella pertussis
gccaacgucggcag

SEQ ID NO: 2399604 - RNA, 16 nt, Bordetella pertussis
gccaacucgcuccagc

SEQ ID NO: 2399605 - RNA, 17 nt, Bordetella pertussis
gccaagaccgcggccgc

SEQ ID NO: 2399606 - RNA, 12 nt, Bordetella pertussis
gccaagacgcgg

SEQ ID NO: 2399607 - RNA, 23 nt, Bordetella pertussis
gccaagacgcggggacaggcaca

SEQ ID NO: 2399608 - RNA, 15 nt, Bordetella pertussis
gccaagauccagcuu

SEQ ID NO: 2399609 - RNA, 20 nt, Bordetella pertussis
gccaagcagaccuaccaggc

SEQ ID NO: 2399610 - RNA, 22 nt, Bordetella pertussis
gccaagcagaccuaccaggccg

SEQ ID NO: 2399611 - RNA, 18 nt, Bordetella pertussis
gccaagcagcgccugccg

SEQ ID NO: 2399612 - RNA, 13 nt, Bordetella pertussis
gccaagcgccgcg

SEQ ID NO: 2399613 - RNA, 14 nt, Bordetella pertussis
gccaagcgccgcgg

SEQ ID NO: 2399614 - RNA, 17 nt, Bordetella pertussis
gccaagcgccgcggcca

SEQ ID NO: 2399615 - RNA, 19 nt, Bordetella pertussis
gccaagcgccgcggccacg

SEQ ID NO: 2399616 - RNA, 16 nt, Bordetella pertussis
gccaagcggcaggcgg

SEQ ID NO: 2399617 - RNA, 18 nt, Bordetella pertussis
gccaagcggcaggcggca

SEQ ID NO: 2399618 - RNA, 23 nt, Bordetella pertussis
gccaagcuggagaagcgccgcgc

SEQ ID NO: 2399619 - RNA, 17 nt, Bordetella pertussis
gccaaggcauuggcgcc

SEQ ID NO: 2399620 - RNA, 19 nt, Bordetella pertussis
gccaaggcauuggcgccgc

SEQ ID NO: 2399621 - RNA, 20 nt, Bordetella pertussis
gccaaggcauuggcgccgcg

SEQ ID NO: 2399622 - RNA, 24 nt, Bordetella pertussis
gccaaggcauuggcgccgcgcucg

SEQ ID NO: 2399623 - RNA, 18 nt, Bordetella pertussis
gccaaggccggcgcgucg

SEQ ID NO: 2399624 - RNA, 19 nt, Bordetella pertussis
gccaaggccggcgcgucgc

SEQ ID NO: 2399625 - RNA, 12 nt, Bordetella pertussis
gccaagggcgcc

SEQ ID NO: 2399626 - RNA, 15 nt, Bordetella pertussis
gccaagggcgccgcg

SEQ ID NO: 2399627 - RNA, 18 nt, Bordetella pertussis
gccaagggcgccgcgccg

SEQ ID NO: 2399628 - RNA, 21 nt, Bordetella pertussis
gccaagggcgccgcgccgggg

SEQ ID NO: 2399629 - RNA, 17 nt, Bordetella pertussis
gccaagggcgcgccagc

SEQ ID NO: 2399630 - RNA, 18 nt, Bordetella pertussis
gccaagggcgcgccagca

SEQ ID NO: 2399631 - RNA, 22 nt, Bordetella pertussis
gccaagggcgugcgcuugcgca

SEQ ID NO: 2399632 - RNA, 21 nt, Bordetella pertussis
gccaauaacagaggaacgccg

SEQ ID NO: 2399633 - RNA, 23 nt, Bordetella pertussis
gccaauaacagaggaacgccgcg

SEQ ID NO: 2399634 - RNA, 21 nt, Bordetella pertussis
gccaaucaugcgcugcuggcc

SEQ ID NO: 2399635 - RNA, 14 nt, Bordetella pertussis
gccaaucggccugc

SEQ ID NO: 2399636 - RNA, 17 nt, Bordetella pertussis
gccaaucggccugcugg

SEQ ID NO: 2399637 - RNA, 13 nt, Bordetella pertussis
gccaaucugccgc

SEQ ID NO: 2399638 - RNA, 21 nt, Bordetella pertussis
gccaaucugccgcugaccggc

SEQ ID NO: 2399639 - RNA, 14 nt, Bordetella pertussis
gccaaugccgcggu

SEQ ID NO: 2399640 - RNA, 15 nt, Bordetella pertussis
gccaaugcgccgcgc

SEQ ID NO: 2399641 - RNA, 17 nt, Bordetella pertussis
gccaaugcgccgcgcca

SEQ ID NO: 2399642 - RNA, 15 nt, Bordetella pertussis
gccaauggccgcggc

SEQ ID NO: 2399643 - RNA, 17 nt, Bordetella pertussis
gccaauggccgcggcgu

SEQ ID NO: 2399644 - RNA, 22 nt, Bordetella pertussis
gccaauggccggugagauccag

SEQ ID NO: 2399645 - RNA, 17 nt, Bordetella pertussis
gccaauggcggaugcgc

SEQ ID NO: 2399646 - RNA, 18 nt, Bordetella pertussis
gccaauuguccuggucga

SEQ ID NO: 2399647 - RNA, 23 nt, Bordetella pertussis
gccaauuguccuggucgaccagg

SEQ ID NO: 2399648 - RNA, 21 nt, Bordetella pertussis
gccacaaagccuccguccaug

SEQ ID NO: 2399649 - RNA, 23 nt, Bordetella pertussis
gccacaaagccuccguccaugcg

SEQ ID NO: 2399650 - RNA, 15 nt, Bordetella pertussis
gccacaaagggcgug

SEQ ID NO: 2399651 - RNA, 13 nt, Bordetella pertussis
gccacaagcggcc

SEQ ID NO: 2399652 - RNA, 14 nt, Bordetella pertussis
gccacaagcggccc

SEQ ID NO: 2399653 - RNA, 16 nt, Bordetella pertussis
gccacaagcggcccca

SEQ ID NO: 2399654 - RNA, 18 nt, Bordetella pertussis
gccacaagcggccccagg

SEQ ID NO: 2399655 - RNA, 22 nt, Bordetella pertussis
gccacacauagggugccugucc

SEQ ID NO: 2399656 - RNA, 21 nt, Bordetella pertussis
gccacaccagguugucggcgc

SEQ ID NO: 2399657 - RNA, 18 nt, Bordetella pertussis
gccacacgaucagcgccc

SEQ ID NO: 2399658 - RNA, 19 nt, Bordetella pertussis
gccacacgaucagcgccca

SEQ ID NO: 2399659 - RNA, 20 nt, Bordetella pertussis
gccacacgaucagcgcccag

SEQ ID NO: 2399660 - RNA, 21 nt, Bordetella pertussis
gccacacgcugaagcgccgcc

SEQ ID NO: 2399661 - RNA, 15 nt, Bordetella pertussis
gccacacgggcgccu

SEQ ID NO: 2399662 - RNA, 17 nt, Bordetella pertussis
gccacacgggcgccugc

SEQ ID NO: 2399663 - RNA, 16 nt, Bordetella pertussis
gccacagauuggccac

SEQ ID NO: 2399664 - RNA, 20 nt, Bordetella pertussis
gccacagcaugaccucggcc

SEQ ID NO: 2399665 - RNA, 23 nt, Bordetella pertussis
gccacagcaugaccucggccugc

SEQ ID NO: 2399666 - RNA, 13 nt, Bordetella pertussis
gccacagcgccau

SEQ ID NO: 2399667 - RNA, 14 nt, Bordetella pertussis
gccacagcgccauc

SEQ ID NO: 2399668 - RNA, 15 nt, Bordetella pertussis
gccacagcgccaucg

SEQ ID NO: 2399669 - RNA, 17 nt, Bordetella pertussis
gccacagcgccaucgcg

SEQ ID NO: 2399670 - RNA, 18 nt, Bordetella pertussis
gccacagcgccaucgcgc

SEQ ID NO: 2399671 - RNA, 12 nt, Bordetella pertussis
gccacagcgccg

SEQ ID NO: 2399672 - RNA, 14 nt, Bordetella pertussis
gccacagcgccgcg

SEQ ID NO: 2399673 - RNA, 15 nt, Bordetella pertussis
gccacagcgccgcgg

SEQ ID NO: 2399674 - RNA, 16 nt, Bordetella pertussis
gccacagcgccgcggc

SEQ ID NO: 2399675 - RNA, 18 nt, Bordetella pertussis
gccacagcgcguggccgg

SEQ ID NO: 2399676 - RNA, 15 nt, Bordetella pertussis
gccacagcgugacgg

SEQ ID NO: 2399677 - RNA, 19 nt, Bordetella pertussis
gccacagcgugacggcggc

SEQ ID NO: 2399678 - RNA, 20 nt, Bordetella pertussis
gccacagcgugacggcggcg

SEQ ID NO: 2399679 - RNA, 12 nt, Bordetella pertussis
gccacaggccca

SEQ ID NO: 2399680 - RNA, 13 nt, Bordetella pertussis
gccacaggcccau

SEQ ID NO: 2399681 - RNA, 15 nt, Bordetella pertussis
gccacaggcccaugc

SEQ ID NO: 2399682 - RNA, 20 nt, Bordetella pertussis
gccacagggccugacgcuca

SEQ ID NO: 2399683 - RNA, 19 nt, Bordetella pertussis
gccacagggcgaaggccag

SEQ ID NO: 2399684 - RNA, 20 nt, Bordetella pertussis
gccacagggcgaaggccagc

SEQ ID NO: 2399685 - RNA, 21 nt, Bordetella pertussis
gccacaggugcgcggcgcgcc

SEQ ID NO: 2399686 - RNA, 22 nt, Bordetella pertussis
gccacaggugcgcggcgcgccg

SEQ ID NO: 2399687 - RNA, 23 nt, Bordetella pertussis
gccacaggugcgcggcgcgccgu

SEQ ID NO: 2399688 - RNA, 22 nt, Bordetella pertussis
gccacaucaucgaccaccagcg

SEQ ID NO: 2399689 - RNA, 17 nt, Bordetella pertussis
gccacauccugcacggc

SEQ ID NO: 2399690 - RNA, 19 nt, Bordetella pertussis
gccacauggucgcccagca

SEQ ID NO: 2399691 - RNA, 14 nt, Bordetella pertussis
gccaccaccaggcc

SEQ ID NO: 2399692 - RNA, 17 nt, Bordetella pertussis
gccaccaccaggcccag

SEQ ID NO: 2399693 - RNA, 22 nt, Bordetella pertussis
gccaccaccggcacgccggcgg

SEQ ID NO: 2399694 - RNA, 20 nt, Bordetella pertussis
gccaccaccgucucgaacgc

SEQ ID NO: 2399695 - RNA, 17 nt, Bordetella pertussis
gccaccaccucggccuc

SEQ ID NO: 2399696 - RNA, 18 nt, Bordetella pertussis
gccaccaccucggccucg

SEQ ID NO: 2399697 - RNA, 19 nt, Bordetella pertussis
gccaccaccucggccucgc

SEQ ID NO: 2399698 - RNA, 23 nt, Bordetella pertussis
gccaccaccucggccucgcuggc

SEQ ID NO: 2399699 - RNA, 12 nt, Bordetella pertussis
gccaccacgccc

SEQ ID NO: 2399700 - RNA, 14 nt, Bordetella pertussis
gccaccacgcccau

SEQ ID NO: 2399701 - RNA, 21 nt, Bordetella pertussis
gccaccacgcccaucugccag

SEQ ID NO: 2399702 - RNA, 13 nt, Bordetella pertussis
gccaccacgcgca

SEQ ID NO: 2399703 - RNA, 17 nt, Bordetella pertussis
gccaccacugcaaggcc

SEQ ID NO: 2399704 - RNA, 21 nt, Bordetella pertussis
gccacgacguagucggcgccc

SEQ ID NO: 2399705 - RNA, 22 nt, Bordetella pertussis
gccacgagcaguacacgcgcaa

SEQ ID NO: 2399706 - RNA, 23 nt, Bordetella pertussis
gccacgaucccgucauggcggca

SEQ ID NO: 2399707 - RNA, 14 nt, Bordetella pertussis
gccacgcagaaggc

SEQ ID NO: 2399708 - RNA, 12 nt, Bordetella pertussis
gccacgcagcgc

SEQ ID NO: 2399709 - RNA, 16 nt, Bordetella pertussis
gccacgcaggcgggcg

SEQ ID NO: 2399710 - RNA, 18 nt, Bordetella pertussis
gccacgccagcggcgagc

SEQ ID NO: 2399711 - RNA, 19 nt, Bordetella pertussis
gccacgccagcggcgagca

SEQ ID NO: 2399712 - RNA, 15 nt, Bordetella pertussis
gccacgcccaggccg

SEQ ID NO: 2399713 - RNA, 18 nt, Bordetella pertussis
gccacgcccaggccgugg

SEQ ID NO: 2399714 - RNA, 20 nt, Bordetella pertussis
gccacgcccaggccguggcg

SEQ ID NO: 2399715 - RNA, 22 nt, Bordetella pertussis
gccacgcccaggccguggcgca

SEQ ID NO: 2399716 - RNA, 19 nt, Bordetella pertussis
gccacgcccaucugguuga

SEQ ID NO: 2399717 - RNA, 20 nt, Bordetella pertussis
gccacgcccgucucgcgcgc

SEQ ID NO: 2399718 - RNA, 22 nt, Bordetella pertussis
gccacgcccgucucgcgcgcca

SEQ ID NO: 2399719 - RNA, 23 nt, Bordetella pertussis
gccacgcccgucucgcgcgccag

SEQ ID NO: 2399720 - RNA, 12 nt, Bordetella pertussis
gccacgcccugg

SEQ ID NO: 2399721 - RNA, 22 nt, Bordetella pertussis
gccacgcccuggcagcuggcgc

SEQ ID NO: 2399722 - RNA, 12 nt, Bordetella pertussis
gccacgccggcc

SEQ ID NO: 2399723 - RNA, 13 nt, Bordetella pertussis
gccacgccggcca

SEQ ID NO: 2399724 - RNA, 15 nt, Bordetella pertussis
gccacgccggccacg

SEQ ID NO: 2399725 - RNA, 15 nt, Bordetella pertussis
gccacgccggccagc

SEQ ID NO: 2399726 - RNA, 16 nt, Bordetella pertussis
gccacgccggccagcu

SEQ ID NO: 2399727 - RNA, 17 nt, Bordetella pertussis
gccacgccggccagcuu

SEQ ID NO: 2399728 - RNA, 14 nt, Bordetella pertussis
gccacgccggccgc

SEQ ID NO: 2399729 - RNA, 15 nt, Bordetella pertussis
gccacgccggccggg

SEQ ID NO: 2399730 - RNA, 16 nt, Bordetella pertussis
gccacgccggccgggg

SEQ ID NO: 2399731 - RNA, 21 nt, Bordetella pertussis
gccacgccgucagcgacaucg

SEQ ID NO: 2399732 - RNA, 14 nt, Bordetella pertussis
gccacgccuggccg

SEQ ID NO: 2399733 - RNA, 17 nt, Bordetella pertussis
gccacgccuggccgcgc

SEQ ID NO: 2399734 - RNA, 22 nt, Bordetella pertussis
gccacgccuggccgcgcucagc

SEQ ID NO: 2399735 - RNA, 18 nt, Bordetella pertussis
gccacgcgagcccgcguc

SEQ ID NO: 2399736 - RNA, 18 nt, Bordetella pertussis
gccacgcgcaacgccgcc

SEQ ID NO: 2399737 - RNA, 20 nt, Bordetella pertussis
gccacgcgcaacgccgccac

SEQ ID NO: 2399738 - RNA, 13 nt, Bordetella pertussis
gccacgcgcacgg

SEQ ID NO: 2399739 - RNA, 21 nt, Bordetella pertussis
gccacgcgccgcccgggccgg

SEQ ID NO: 2399740 - RNA, 14 nt, Bordetella pertussis
gccacgcgccgugc

SEQ ID NO: 2399741 - RNA, 20 nt, Bordetella pertussis
gccacgcgccgugcagacgg

SEQ ID NO: 2399742 - RNA, 16 nt, Bordetella pertussis
gccacgcgcgauccgc

SEQ ID NO: 2399743 - RNA, 15 nt, Bordetella pertussis
gccacgcgcgcuggc

SEQ ID NO: 2399744 - RNA, 20 nt, Bordetella pertussis
gccacgcgcgcuggcgcccg

SEQ ID NO: 2399745 - RNA, 23 nt, Bordetella pertussis
gccacgcgcgcuggcgcccggcc

SEQ ID NO: 2399746 - RNA, 17 nt, Bordetella pertussis
gccacgcgcggaucggc

SEQ ID NO: 2399747 - RNA, 14 nt, Bordetella pertussis
gccacgcgcgggcu

SEQ ID NO: 2399748 - RNA, 15 nt, Bordetella pertussis
gccacgcgcgggcug

SEQ ID NO: 2399749 - RNA, 16 nt, Bordetella pertussis
gccacgcgcgggcugg

SEQ ID NO: 2399750 - RNA, 19 nt, Bordetella pertussis
gccacgcgcugcagcagca

SEQ ID NO: 2399751 - RNA, 20 nt, Bordetella pertussis
gccacgcgcugcagcagcau

SEQ ID NO: 2399752 - RNA, 18 nt, Bordetella pertussis
gccacgcgcuguugcugg

SEQ ID NO: 2399753 - RNA, 15 nt, Bordetella pertussis
gccacgcgcuugcgc

SEQ ID NO: 2399754 - RNA, 19 nt, Bordetella pertussis
gccacgcgcuugcgcgcca

SEQ ID NO: 2399755 - RNA, 14 nt, Bordetella pertussis
gccacgcgggccgg

SEQ ID NO: 2399756 - RNA, 16 nt, Bordetella pertussis
gccacgcgggccggcc

SEQ ID NO: 2399757 - RNA, 17 nt, Bordetella pertussis
gccacgcgggccggccg

SEQ ID NO: 2399758 - RNA, 16 nt, Bordetella pertussis
gccacgcgguccagcc

SEQ ID NO: 2399759 - RNA, 19 nt, Bordetella pertussis
gccacgcgguccagccccu

SEQ ID NO: 2399760 - RNA, 16 nt, Bordetella pertussis
gccacgcucacgcccg

SEQ ID NO: 2399761 - RNA, 17 nt, Bordetella pertussis
gccacgcucacgcccgu

SEQ ID NO: 2399762 - RNA, 16 nt, Bordetella pertussis
gccacgcugcccugcu

SEQ ID NO: 2399763 - RNA, 19 nt, Bordetella pertussis
gccacgcugcccugcugcu

SEQ ID NO: 2399764 - RNA, 16 nt, Bordetella pertussis
gccacgcugcugccgu

SEQ ID NO: 2399765 - RNA, 18 nt, Bordetella pertussis
gccacgcuggccgcgcug

SEQ ID NO: 2399766 - RNA, 17 nt, Bordetella pertussis
gccacgcuguacuggua

SEQ ID NO: 2399767 - RNA, 18 nt, Bordetella pertussis
gccacgcuguuuucggcc

SEQ ID NO: 2399768 - RNA, 20 nt, Bordetella pertussis
gccacggcaggcgccugccc

SEQ ID NO: 2399769 - RNA, 14 nt, Bordetella pertussis
gccacggcccgcca

SEQ ID NO: 2399770 - RNA, 16 nt, Bordetella pertussis
gccacggcccgccagg

SEQ ID NO: 2399771 - RNA, 17 nt, Bordetella pertussis
gccacggcccgccagga

SEQ ID NO: 2399772 - RNA, 13 nt, Bordetella pertussis
gccacggcccugg

SEQ ID NO: 2399773 - RNA, 12 nt, Bordetella pertussis
gccacggccgcg

SEQ ID NO: 2399774 - RNA, 13 nt, Bordetella pertussis
gccacggccgcga

SEQ ID NO: 2399775 - RNA, 16 nt, Bordetella pertussis
gccacggccggcagcg

SEQ ID NO: 2399776 - RNA, 22 nt, Bordetella pertussis
gccacggccggcagcgccuugc

SEQ ID NO: 2399777 - RNA, 14 nt, Bordetella pertussis
gccacggccugccc

SEQ ID NO: 2399778 - RNA, 17 nt, Bordetella pertussis
gccacggccugcccggg

SEQ ID NO: 2399779 - RNA, 21 nt, Bordetella pertussis
gccacggcgaugaacagcggc

SEQ ID NO: 2399780 - RNA, 12 nt, Bordetella pertussis
gccacggcgccc

SEQ ID NO: 2399781 - RNA, 14 nt, Bordetella pertussis
gccacggcgcccga

SEQ ID NO: 2399782 - RNA, 17 nt, Bordetella pertussis
gccacggcgcccgaggc

SEQ ID NO: 2399783 - RNA, 15 nt, Bordetella pertussis
gccacggcgggccgg

SEQ ID NO: 2399784 - RNA, 17 nt, Bordetella pertussis
gccacggcgggccggcu

SEQ ID NO: 2399785 - RNA, 23 nt, Bordetella pertussis
gccacggcgggccggcucggcgg

SEQ ID NO: 2399786 - RNA, 23 nt, Bordetella pertussis
gccacggcggugaccaccaggcc

SEQ ID NO: 2399787 - RNA, 16 nt, Bordetella pertussis
gccacggcggugcuga

SEQ ID NO: 2399788 - RNA, 17 nt, Bordetella pertussis
gccacggcggugcugaa

SEQ ID NO: 2399789 - RNA, 13 nt, Bordetella pertussis
gccacggcgucgc

SEQ ID NO: 2399790 - RNA, 15 nt, Bordetella pertussis
gccacggcgucgccg

SEQ ID NO: 2399791 - RNA, 17 nt, Bordetella pertussis
gccacggcgucgccggc

SEQ ID NO: 2399792 - RNA, 19 nt, Bordetella pertussis
gccacggcgucgccggcca

SEQ ID NO: 2399793 - RNA, 21 nt, Bordetella pertussis
gccacggcuggaaagaccugc

SEQ ID NO: 2399794 - RNA, 18 nt, Bordetella pertussis
gccacggcuucgcccagc

SEQ ID NO: 2399795 - RNA, 21 nt, Bordetella pertussis
gccacggcuucgcccagcgcu

SEQ ID NO: 2399796 - RNA, 15 nt, Bordetella pertussis
gccacgggcccgcgc

SEQ ID NO: 2399797 - RNA, 19 nt, Bordetella pertussis
gccacgggcgucaccggcg

SEQ ID NO: 2399798 - RNA, 22 nt, Bordetella pertussis
gccacgggcgucaccggcgagc

SEQ ID NO: 2399799 - RNA, 18 nt, Bordetella pertussis
gccacggucgcgagcugc

SEQ ID NO: 2399800 - RNA, 13 nt, Bordetella pertussis
gccacggucggca

SEQ ID NO: 2399801 - RNA, 19 nt, Bordetella pertussis
gccacggucugcacgccgg

SEQ ID NO: 2399802 - RNA, 20 nt, Bordetella pertussis
gccacggucugcacgccggg

SEQ ID NO: 2399803 - RNA, 21 nt, Bordetella pertussis
gccacggucugcacgccgggc

SEQ ID NO: 2399804 - RNA, 22 nt, Bordetella pertussis
gccacggucugcacgccgggcg

SEQ ID NO: 2399805 - RNA, 19 nt, Bordetella pertussis
gccacgucacggaucagcc

SEQ ID NO: 2399806 - RNA, 20 nt, Bordetella pertussis
gccacgucacggaucagccg

SEQ ID NO: 2399807 - RNA, 22 nt, Bordetella pertussis
gccacgucacggaucagccgcu

SEQ ID NO: 2399808 - RNA, 12 nt, Bordetella pertussis
gccacguccagc

SEQ ID NO: 2399809 - RNA, 15 nt, Bordetella pertussis
gccacguccagcacg

SEQ ID NO: 2399810 - RNA, 20 nt, Bordetella pertussis
gccacguccagcacggccgc

SEQ ID NO: 2399811 - RNA, 22 nt, Bordetella pertussis
gccacgucgaccucgagcaccu

SEQ ID NO: 2399812 - RNA, 15 nt, Bordetella pertussis
gccacgucgcccaca

SEQ ID NO: 2399813 - RNA, 14 nt, Bordetella pertussis
gccacgucgccggc

SEQ ID NO: 2399814 - RNA, 18 nt, Bordetella pertussis
gccacgucgcucggccuc

SEQ ID NO: 2399815 - RNA, 20 nt, Bordetella pertussis
gccacgucgcucggccuccc

SEQ ID NO: 2399816 - RNA, 13 nt, Bordetella pertussis
gccacgucggcgg

SEQ ID NO: 2399817 - RNA, 14 nt, Bordetella pertussis
gccagcagcucggc

SEQ ID NO: 2399818 - RNA, 16 nt, Bordetella pertussis
gccagcagcucggcca

SEQ ID NO: 2399819 - RNA, 17 nt, Bordetella pertussis
gccagcagcucggccac

SEQ ID NO: 2399820 - RNA, 15 nt, Bordetella pertussis
gccagcagcucggcg

SEQ ID NO: 2399821 - RNA, 16 nt, Bordetella pertussis
gccagcagcuggcgca

SEQ ID NO: 2399822 - RNA, 19 nt, Bordetella pertussis
gccagcagcuggcgcagca

SEQ ID NO: 2399823 - RNA, 22 nt, Bordetella pertussis
gccagcagcuggcgcagcacgc

SEQ ID NO: 2399824 - RNA, 19 nt, Bordetella pertussis
gccagcagcuguuccugcu

SEQ ID NO: 2399825 - RNA, 17 nt, Bordetella pertussis
gccagcagcuuggccac

SEQ ID NO: 2399826 - RNA, 19 nt, Bordetella pertussis
gccagcaggagcccgcugc

SEQ ID NO: 2399827 - RNA, 21 nt, Bordetella pertussis
gccagcaggagcccgcugccg

SEQ ID NO: 2399828 - RNA, 22 nt, Bordetella pertussis
gccagcaggagcccgcugccga

SEQ ID NO: 2399829 - RNA, 15 nt, Bordetella pertussis
gccagcaggcccugg

SEQ ID NO: 2399830 - RNA, 22 nt, Bordetella pertussis
gccagcaggcccugggccagca

SEQ ID NO: 2399831 - RNA, 22 nt, Bordetella pertussis
gccagcaggcgaaacgccagcc

SEQ ID NO: 2399832 - RNA, 15 nt, Bordetella pertussis
gccagcaggcgcugg

SEQ ID NO: 2399833 - RNA, 17 nt, Bordetella pertussis
gccagcaggcgcugguc

SEQ ID NO: 2399834 - RNA, 14 nt, Bordetella pertussis
gccagcaggcucag

SEQ ID NO: 2399835 - RNA, 15 nt, Bordetella pertussis
gccagcaggcucagc

SEQ ID NO: 2399836 - RNA, 16 nt, Bordetella pertussis
gccagcagggucagcg

SEQ ID NO: 2399837 - RNA, 18 nt, Bordetella pertussis
gccagcagggucagcggc

SEQ ID NO: 2399838 - RNA, 21 nt, Bordetella pertussis
gccagcagggucagcggccgg

SEQ ID NO: 2399839 - RNA, 12 nt, Bordetella pertussis
gccagcaggucg

SEQ ID NO: 2399840 - RNA, 17 nt, Bordetella pertussis
gccagcaggucgcgcac

SEQ ID NO: 2399841 - RNA, 18 nt, Bordetella pertussis
gccagcaguguuucggcc

SEQ ID NO: 2399842 - RNA, 21 nt, Bordetella pertussis
gccagcaguguuucggccugc

SEQ ID NO: 2399843 - RNA, 22 nt, Bordetella pertussis
gccagcaguguuucggccugcu

SEQ ID NO: 2399844 - RNA, 22 nt, Bordetella pertussis
gccagcauccagccgaucagcc

SEQ ID NO: 2399845 - RNA, 14 nt, Bordetella pertussis
gccagcaucggcac

SEQ ID NO: 2399846 - RNA, 15 nt, Bordetella pertussis
gccagcaucggcacc

SEQ ID NO: 2399847 - RNA, 19 nt, Bordetella pertussis
gccagcaucggcacccagc

SEQ ID NO: 2399848 - RNA, 20 nt, Bordetella pertussis
gccagcaucggcacccagcc

SEQ ID NO: 2399849 - RNA, 22 nt, Bordetella pertussis
gccagcaucggcacccagccgg

SEQ ID NO: 2399850 - RNA, 22 nt, Bordetella pertussis
gccagcaucguaucgggcguca

SEQ ID NO: 2399851 - RNA, 21 nt, Bordetella pertussis
gccagcaugaucaugccgcug

SEQ ID NO: 2399852 - RNA, 18 nt, Bordetella pertussis
gccagcaugcgcgcggcc

SEQ ID NO: 2399853 - RNA, 21 nt, Bordetella pertussis
gccagcaugcgcgcggccucg

SEQ ID NO: 2399854 - RNA, 16 nt, Bordetella pertussis
gccagcauggcggcca

SEQ ID NO: 2399855 - RNA, 17 nt, Bordetella pertussis
gccagcauggcggccag

SEQ ID NO: 2399856 - RNA, 18 nt, Bordetella pertussis
gccagcauggcggccagg

SEQ ID NO: 2399857 - RNA, 20 nt, Bordetella pertussis
gccagcauggcggccaggcg

SEQ ID NO: 2399858 - RNA, 15 nt, Bordetella pertussis
gccagcauggcgucg

SEQ ID NO: 2399859 - RNA, 18 nt, Bordetella pertussis
gccagcauuaccagcaac

SEQ ID NO: 2399860 - RNA, 14 nt, Bordetella pertussis
gccagccacgccgg

SEQ ID NO: 2399861 - RNA, 15 nt, Bordetella pertussis
gccagccacgccggc

SEQ ID NO: 2399862 - RNA, 23 nt, Bordetella pertussis
gccagccacgccggcgcgccggc

SEQ ID NO: 2399863 - RNA, 21 nt, Bordetella pertussis
gccagccacgcgcgcuggcgc

SEQ ID NO: 2399864 - RNA, 13 nt, Bordetella pertussis
gccagccagcgca

SEQ ID NO: 2399865 - RNA, 14 nt, Bordetella pertussis
gccagccagcgccg

SEQ ID NO: 2399866 - RNA, 15 nt, Bordetella pertussis
gccagccagcgccgc

SEQ ID NO: 2399867 - RNA, 16 nt, Bordetella pertussis
gccagccagcgccgca

SEQ ID NO: 2399868 - RNA, 12 nt, Bordetella pertussis
gccagccaggcg

SEQ ID NO: 2399869 - RNA, 21 nt, Bordetella pertussis
gccagccaggcgguggccucg

SEQ ID NO: 2399870 - RNA, 15 nt, Bordetella pertussis
gccagccaggugcua

SEQ ID NO: 2399871 - RNA, 17 nt, Bordetella pertussis
gccagccauugccgcac

SEQ ID NO: 2399872 - RNA, 18 nt, Bordetella pertussis
gccagccauugccgcacg

SEQ ID NO: 2399873 - RNA, 15 nt, Bordetella pertussis
gccagcccaccagcg

SEQ ID NO: 2399874 - RNA, 16 nt, Bordetella pertussis
gccagcccaccagcgc

SEQ ID NO: 2399875 - RNA, 18 nt, Bordetella pertussis
gccagcccaccagcgcca

SEQ ID NO: 2399876 - RNA, 14 nt, Bordetella pertussis
gccagccccaccuu

SEQ ID NO: 2399877 - RNA, 17 nt, Bordetella pertussis
gccagccccaccuugcc

SEQ ID NO: 2399878 - RNA, 21 nt, Bordetella pertussis
gccagccccaccuugcccagc

SEQ ID NO: 2399879 - RNA, 17 nt, Bordetella pertussis
gccagcccccugcgggg

SEQ ID NO: 2399880 - RNA, 12 nt, Bordetella pertussis
gccagccccggc

SEQ ID NO: 2399881 - RNA, 13 nt, Bordetella pertussis
gccagcccgacgg

SEQ ID NO: 2399882 - RNA, 15 nt, Bordetella pertussis
gccagcccgacggcc

SEQ ID NO: 2399883 - RNA, 16 nt, Bordetella pertussis
gccagcccgacggcca

SEQ ID NO: 2399884 - RNA, 22 nt, Bordetella pertussis
gccagcccgacggccagcgcga

SEQ ID NO: 2399885 - RNA, 13 nt, Bordetella pertussis
gccagcccgaggc

SEQ ID NO: 2399886 - RNA, 14 nt, Bordetella pertussis
gccagcccgcccgc

SEQ ID NO: 2399887 - RNA, 18 nt, Bordetella pertussis
gccagcccgcccgcgagc

SEQ ID NO: 2399888 - RNA, 12 nt, Bordetella pertussis
gccagcccgccg

SEQ ID NO: 2399889 - RNA, 16 nt, Bordetella pertussis
gccagcccgccgcugg

SEQ ID NO: 2399890 - RNA, 15 nt, Bordetella pertussis
gccagcccgccggcg

SEQ ID NO: 2399891 - RNA, 13 nt, Bordetella pertussis
gccagcccgcugc

SEQ ID NO: 2399892 - RNA, 15 nt, Bordetella pertussis
gccagcccgcugccg

SEQ ID NO: 2399893 - RNA, 18 nt, Bordetella pertussis
gccagcccugggugucga

SEQ ID NO: 2399894 - RNA, 18 nt, Bordetella pertussis
gccagcccuugcuugccg

SEQ ID NO: 2399895 - RNA, 13 nt, Bordetella pertussis
gccagccgccgcg

SEQ ID NO: 2399896 - RNA, 14 nt, Bordetella pertussis
gccagccgccgcgc

SEQ ID NO: 2399897 - RNA, 17 nt, Bordetella pertussis
gccagccgccgcgcggc

SEQ ID NO: 2399898 - RNA, 20 nt, Bordetella pertussis
gccagccgccgcgcggcgga

SEQ ID NO: 2399899 - RNA, 16 nt, Bordetella pertussis
gccagccgcgccugca

SEQ ID NO: 2399900 - RNA, 15 nt, Bordetella pertussis
gccagccgcgcgacc

SEQ ID NO: 2399901 - RNA, 13 nt, Bordetella pertussis
gccagccgcucca

SEQ ID NO: 2399902 - RNA, 14 nt, Bordetella pertussis
gccagccgcuccag

SEQ ID NO: 2399903 - RNA, 15 nt, Bordetella pertussis
gccagccgcuccagg

SEQ ID NO: 2399904 - RNA, 19 nt, Bordetella pertussis
gccagccgcucgcgcgacc

SEQ ID NO: 2399905 - RNA, 20 nt, Bordetella pertussis
gccagccgcucgcgcgacca

SEQ ID NO: 2399906 - RNA, 14 nt, Bordetella pertussis
gccagccgcuggcg

SEQ ID NO: 2399907 - RNA, 22 nt, Bordetella pertussis
gccagccgcuggcgaucaggcc

SEQ ID NO: 2399908 - RNA, 15 nt, Bordetella pertussis
gccagccgcuggcgc

SEQ ID NO: 2399909 - RNA, 18 nt, Bordetella pertussis
gccagccgcuggcgcgcc

SEQ ID NO: 2399910 - RNA, 22 nt, Bordetella pertussis
gccagccgcuggcgcgccgccu

SEQ ID NO: 2399911 - RNA, 20 nt, Bordetella pertussis
gccagccgcuugcggccagg

SEQ ID NO: 2399912 - RNA, 22 nt, Bordetella pertussis
gccagccgcuugcggccaggcg

SEQ ID NO: 2399913 - RNA, 14 nt, Bordetella pertussis
gccagccggcccag

SEQ ID NO: 2399914 - RNA, 15 nt, Bordetella pertussis
gccagccggcccagc

SEQ ID NO: 2399915 - RNA, 22 nt, Bordetella pertussis
gccagccggcccagcacgccgc

SEQ ID NO: 2399916 - RNA, 14 nt, Bordetella pertussis
gccagccggcccga

SEQ ID NO: 2399917 - RNA, 16 nt, Bordetella pertussis
gccagccggcccgaca

SEQ ID NO: 2399918 - RNA, 16 nt, Bordetella pertussis
gccagccggccgaugg

SEQ ID NO: 2399919 - RNA, 13 nt, Bordetella pertussis
gccagccggcggc

SEQ ID NO: 2399920 - RNA, 17 nt, Bordetella pertussis
gccagccggcggccagc

SEQ ID NO: 2399921 - RNA, 17 nt, Bordetella pertussis
gccagccgggcgaucgc

SEQ ID NO: 2399922 - RNA, 13 nt, Bordetella pertussis
gccagccgggugg

SEQ ID NO: 2399923 - RNA, 17 nt, Bordetella pertussis
gccagccggguggucgc

SEQ ID NO: 2399924 - RNA, 21 nt, Bordetella pertussis
gccagccggguggucgcgccc

SEQ ID NO: 2399925 - RNA, 23 nt, Bordetella pertussis
gccagccggguggucgcgcccgc

SEQ ID NO: 2399926 - RNA, 18 nt, Bordetella pertussis
gccagccguugcgccagc

SEQ ID NO: 2399927 - RNA, 19 nt, Bordetella pertussis
gccagccguugcgccagcg

SEQ ID NO: 2399928 - RNA, 22 nt, Bordetella pertussis
gccagccguugcgccagcggcg

SEQ ID NO: 2399929 - RNA, 12 nt, Bordetella pertussis
gccagccugccg

SEQ ID NO: 2399930 - RNA, 21 nt, Bordetella pertussis
gccagcggcgacugccccagc

SEQ ID NO: 2399931 - RNA, 14 nt, Bordetella pertussis
gccagcggcgagca

SEQ ID NO: 2399932 - RNA, 17 nt, Bordetella pertussis
gccagcggcgcagccgg

SEQ ID NO: 2399933 - RNA, 19 nt, Bordetella pertussis
gccagcggcgcagccggcc

SEQ ID NO: 2399934 - RNA, 13 nt, Bordetella pertussis
gccagcggcgcgg

SEQ ID NO: 2399935 - RNA, 15 nt, Bordetella pertussis
gccagcggcgcggcg

SEQ ID NO: 2399936 - RNA, 16 nt, Bordetella pertussis
gccagcggcgcggcgc

SEQ ID NO: 2399937 - RNA, 21 nt, Bordetella pertussis
gccagcggcgcggcgcgcugg

SEQ ID NO: 2399938 - RNA, 22 nt, Bordetella pertussis
gccagcggcgcggcgcgcugga

SEQ ID NO: 2399939 - RNA, 22 nt, Bordetella pertussis
gccagcggcugcuugagcagcc

SEQ ID NO: 2399940 - RNA, 13 nt, Bordetella pertussis
gccagcggcuggc

SEQ ID NO: 2399941 - RNA, 16 nt, Bordetella pertussis
gccagcggcuggcgcc

SEQ ID NO: 2399942 - RNA, 18 nt, Bordetella pertussis
gccagcgggagccugucc

SEQ ID NO: 2399943 - RNA, 13 nt, Bordetella pertussis
gccagcggugcgc

SEQ ID NO: 2399944 - RNA, 17 nt, Bordetella pertussis
gccagcggugcgcggcg

SEQ ID NO: 2399945 - RNA, 22 nt, Bordetella pertussis
gccagcggugcgcggcgcagcc

SEQ ID NO: 2399946 - RNA, 23 nt, Bordetella pertussis
gccagcggugcgcggcgcagccc

SEQ ID NO: 2399947 - RNA, 21 nt, Bordetella pertussis
gccagcgguucgucggcgcuc

SEQ ID NO: 2399948 - RNA, 14 nt, Bordetella pertussis
gccagcguaucgcc

SEQ ID NO: 2399949 - RNA, 17 nt, Bordetella pertussis
gccagcguaucgccgcc

SEQ ID NO: 2399950 - RNA, 19 nt, Bordetella pertussis
gccagcguaucgccgccgc

SEQ ID NO: 2399951 - RNA, 22 nt, Bordetella pertussis
gccagcguaucgccgccgccgg

SEQ ID NO: 2399952 - RNA, 20 nt, Bordetella pertussis
gccagcgucaggcugggaga

SEQ ID NO: 2399953 - RNA, 15 nt, Bordetella pertussis
gccagcgugcccagc

SEQ ID NO: 2399954 - RNA, 15 nt, Bordetella pertussis
gccagcgugccggug

SEQ ID NO: 2399955 - RNA, 23 nt, Bordetella pertussis
gccagcgugccggugacgacgcg

SEQ ID NO: 2399956 - RNA, 17 nt, Bordetella pertussis
gccagcguggccgaggu

SEQ ID NO: 2399957 - RNA, 15 nt, Bordetella pertussis
gccagcguucggcca

SEQ ID NO: 2399958 - RNA, 16 nt, Bordetella pertussis
gccagcguucggccac

SEQ ID NO: 2399959 - RNA, 19 nt, Bordetella pertussis
gccagcguucggccacccg

SEQ ID NO: 2399960 - RNA, 16 nt, Bordetella pertussis
gccagcuccaccgggc

SEQ ID NO: 2399961 - RNA, 19 nt, Bordetella pertussis
gccagcuccaccgggcuga

SEQ ID NO: 2399962 - RNA, 18 nt, Bordetella pertussis
gccagcuccagccgcagg

SEQ ID NO: 2399963 - RNA, 19 nt, Bordetella pertussis
gccagcuccagccgcaggc

SEQ ID NO: 2399964 - RNA, 12 nt, Bordetella pertussis
gccagcuccagg

SEQ ID NO: 2399965 - RNA, 15 nt, Bordetella pertussis
gccagcuccccgggc

SEQ ID NO: 2399966 - RNA, 16 nt, Bordetella pertussis
gccagcuccccgggcg

SEQ ID NO: 2399967 - RNA, 17 nt, Bordetella pertussis
gccagcuccccgggcgu

SEQ ID NO: 2399968 - RNA, 21 nt, Bordetella pertussis
gccagcuccccgggcgugacc

SEQ ID NO: 2399969 - RNA, 14 nt, Bordetella pertussis
gccagcucgacgcg

SEQ ID NO: 2399970 - RNA, 19 nt, Bordetella pertussis
gccagcucgacgcgcugau

SEQ ID NO: 2399971 - RNA, 15 nt, Bordetella pertussis
gccagcucgcgcagc

SEQ ID NO: 2399972 - RNA, 16 nt, Bordetella pertussis
gccagcucgcgcagca

SEQ ID NO: 2399973 - RNA, 19 nt, Bordetella pertussis
gccagcucgcgcagcaggc

SEQ ID NO: 2399974 - RNA, 16 nt, Bordetella pertussis
gccagcucgcguugca

SEQ ID NO: 2399975 - RNA, 22 nt, Bordetella pertussis
gccagcucgcguugcaccgcgu

SEQ ID NO: 2399976 - RNA, 13 nt, Bordetella pertussis
gccagcucggcca

SEQ ID NO: 2399977 - RNA, 14 nt, Bordetella pertussis
gccagcucggccug

SEQ ID NO: 2399978 - RNA, 16 nt, Bordetella pertussis
gccagcucggccugcg

SEQ ID NO: 2399979 - RNA, 18 nt, Bordetella pertussis
gccagcucggccugcggc

SEQ ID NO: 2399980 - RNA, 21 nt, Bordetella pertussis
gccagcucggccugcggcucg

SEQ ID NO: 2399981 - RNA, 20 nt, Bordetella pertussis
gccagcucggcggccgccug

SEQ ID NO: 2399982 - RNA, 13 nt, Bordetella pertussis
gccagcucuuccg

SEQ ID NO: 2399983 - RNA, 21 nt, Bordetella pertussis
gccagcucuuccgagauggcc

SEQ ID NO: 2399984 - RNA, 21 nt, Bordetella pertussis
gccagcucuucgagcgcggcg

SEQ ID NO: 2399985 - RNA, 23 nt, Bordetella pertussis
gccagcugaccucgcccaggccg

SEQ ID NO: 2399986 - RNA, 20 nt, Bordetella pertussis
gccagcugcaugcgcacgga

SEQ ID NO: 2399987 - RNA, 22 nt, Bordetella pertussis
gccagcugcaugcgcacggaca

SEQ ID NO: 2399988 - RNA, 12 nt, Bordetella pertussis
gccagcugcgca

SEQ ID NO: 2399989 - RNA, 13 nt, Bordetella pertussis
gccagcugcgcag

SEQ ID NO: 2399990 - RNA, 14 nt, Bordetella pertussis
gccagcugcgcccc

SEQ ID NO: 2399991 - RNA, 22 nt, Bordetella pertussis
gccagcugcgcccccucuucuc

SEQ ID NO: 2399992 - RNA, 18 nt, Bordetella pertussis
gccagcugcguggcgacg

SEQ ID NO: 2399993 - RNA, 21 nt, Bordetella pertussis
gccagcugcguggcgacgcgc

SEQ ID NO: 2399994 - RNA, 22 nt, Bordetella pertussis
gccagcugcguggcgacgcgcu

SEQ ID NO: 2399995 - RNA, 15 nt, Bordetella pertussis
gccagcuggaccgcc

SEQ ID NO: 2399996 - RNA, 20 nt, Bordetella pertussis
gccagcuggaccgccuggcc

SEQ ID NO: 2399997 - RNA, 13 nt, Bordetella pertussis
gccagcuggccca

SEQ ID NO: 2399998 - RNA, 15 nt, Bordetella pertussis
gccagcuggcccagu

SEQ ID NO: 2399999 - RNA, 13 nt, Bordetella pertussis
gccagcuggcgcg

SEQ ID NO: 2400000 - RNA, 20 nt, Bordetella pertussis
gccagcuggcgcguggccgc

SEQ ID NO: 2400001 - RNA, 14 nt, Bordetella pertussis
gccagcuggcggcg

SEQ ID NO: 2400002 - RNA, 17 nt, Bordetella pertussis
gccagcuggcggcgcag

SEQ ID NO: 2400003 - RNA, 19 nt, Bordetella pertussis
gccagcuggcggcgcagca

SEQ ID NO: 2400004 - RNA, 16 nt, Bordetella pertussis
gccagcuucgggcccu

SEQ ID NO: 2400005 - RNA, 18 nt, Bordetella pertussis
gccagcuugaccgccagc

SEQ ID NO: 2400006 - RNA, 19 nt, Bordetella pertussis
gccagcuugaccgccagca

SEQ ID NO: 2400007 - RNA, 22 nt, Bordetella pertussis
gccagcuugacguccagccagg

SEQ ID NO: 2400008 - RNA, 15 nt, Bordetella pertussis
gccagcuugcaggcg

SEQ ID NO: 2400009 - RNA, 18 nt, Bordetella pertussis
gccagcuugcaggcgccu

SEQ ID NO: 2400010 - RNA, 21 nt, Bordetella pertussis
gccagcuugcaggcgccuucg

SEQ ID NO: 2400011 - RNA, 15 nt, Bordetella pertussis
gccagcuugcgcgcc

SEQ ID NO: 2400012 - RNA, 16 nt, Bordetella pertussis
gccagcuugcgcgccu

SEQ ID NO: 2400013 - RNA, 17 nt, Bordetella pertussis
gccagcuugcgcgccuu

SEQ ID NO: 2400014 - RNA, 17 nt, Bordetella pertussis
gccagcuuguagcggcc

SEQ ID NO: 2400015 - RNA, 18 nt, Bordetella pertussis
gccagcuuguagcggcca

SEQ ID NO: 2400016 - RNA, 21 nt, Bordetella pertussis
gccagcuuguagcggccaucg

SEQ ID NO: 2400017 - RNA, 20 nt, Bordetella pertussis
gccaggaaaagccgccuucg

SEQ ID NO: 2400018 - RNA, 16 nt, Bordetella pertussis
gccaggaaagccggcg

SEQ ID NO: 2400019 - RNA, 17 nt, Bordetella pertussis
gccaggaacagcgccgg

SEQ ID NO: 2400020 - RNA, 16 nt, Bordetella pertussis
gccaggaagaucggcc

SEQ ID NO: 2400021 - RNA, 19 nt, Bordetella pertussis
gccaggaagcgcgccgcgc

SEQ ID NO: 2400022 - RNA, 22 nt, Bordetella pertussis
gccaggaagcgcgccgcgcgca

SEQ ID NO: 2400023 - RNA, 16 nt, Bordetella pertussis
gccaggaagcggcgca

SEQ ID NO: 2400024 - RNA, 17 nt, Bordetella pertussis
gccaggaagcggcgcac

SEQ ID NO: 2400025 - RNA, 19 nt, Bordetella pertussis
gccaggaagcggcgcacca

SEQ ID NO: 2400026 - RNA, 23 nt, Bordetella pertussis
gccaggaagcgggccugccgcgc

SEQ ID NO: 2400027 - RNA, 15 nt, Bordetella pertussis
gccaggacgaucccg

SEQ ID NO: 2400028 - RNA, 18 nt, Bordetella pertussis
gccaggacgaucccggcc

SEQ ID NO: 2400029 - RNA, 22 nt, Bordetella pertussis
gccaggacgaucccggccacgg

SEQ ID NO: 2400030 - RNA, 17 nt, Bordetella pertussis
gccaggacggugucgcu

SEQ ID NO: 2400031 - RNA, 21 nt, Bordetella pertussis
gccaggacuucgucgaucaug

SEQ ID NO: 2400032 - RNA, 16 nt, Bordetella pertussis
gccaggaucgcggcca

SEQ ID NO: 2400033 - RNA, 18 nt, Bordetella pertussis
gccaggaucgcggccagc

SEQ ID NO: 2400034 - RNA, 11 nt, Bordetella pertussis
gccaggaugag

SEQ ID NO: 2400035 - RNA, 14 nt, Bordetella pertussis
gccaggauggccac

SEQ ID NO: 2400036 - RNA, 21 nt, Bordetella pertussis
gccaggauggccacgaccacc

SEQ ID NO: 2400037 - RNA, 21 nt, Bordetella pertussis
gccaggauggcguugccggcc

SEQ ID NO: 2400038 - RNA, 22 nt, Bordetella pertussis
gccaggauggcguugccggccu

SEQ ID NO: 2400039 - RNA, 17 nt, Bordetella pertussis
gccaggauuucauggca

SEQ ID NO: 2400040 - RNA, 16 nt, Bordetella pertussis
gccaggcaaaggccca

SEQ ID NO: 2400041 - RNA, 20 nt, Bordetella pertussis
gccaggcaaaggcccaggca

SEQ ID NO: 2400042 - RNA, 18 nt, Bordetella pertussis
gccaguagcgugugcagg

SEQ ID NO: 2400043 - RNA, 14 nt, Bordetella pertussis
gccaguaggcgccc

SEQ ID NO: 2400044 - RNA, 16 nt, Bordetella pertussis
gccaguaggcgcccca

SEQ ID NO: 2400045 - RNA, 18 nt, Bordetella pertussis
gccaguaggcgccccagg

SEQ ID NO: 2400046 - RNA, 12 nt, Bordetella pertussis
gccaguccagcg

SEQ ID NO: 2400047 - RNA, 17 nt, Bordetella pertussis
gccaguccagcgcgccg

SEQ ID NO: 2400048 - RNA, 18 nt, Bordetella pertussis
gccaguccagcgcgccgc

SEQ ID NO: 2400049 - RNA, 20 nt, Bordetella pertussis
gccaguccagcgcgccgcga

SEQ ID NO: 2400050 - RNA, 19 nt, Bordetella pertussis
gccaguccccaugcggccc

SEQ ID NO: 2400051 - RNA, 21 nt, Bordetella pertussis
gccaguccccaugcggggacu

SEQ ID NO: 2400052 - RNA, 20 nt, Bordetella pertussis
gccaguccccauguggggac

SEQ ID NO: 2400053 - RNA, 15 nt, Bordetella pertussis
gccagucccccgcgg

SEQ ID NO: 2400054 - RNA, 18 nt, Bordetella pertussis
gccagucccccgcgggga

SEQ ID NO: 2400055 - RNA, 16 nt, Bordetella pertussis
gccaguccccgcaggg

SEQ ID NO: 2400056 - RNA, 17 nt, Bordetella pertussis
gccaguccccgcaggga

SEQ ID NO: 2400057 - RNA, 22 nt, Bordetella pertussis
gccaguccccgcagggacaggc

SEQ ID NO: 2400058 - RNA, 14 nt, Bordetella pertussis
gccaguccccgcgg

SEQ ID NO: 2400059 - RNA, 22 nt, Bordetella pertussis
gccaguccccgcggggacaggc

SEQ ID NO: 2400060 - RNA, 22 nt, Bordetella pertussis
gccaguccccguucggggacag

SEQ ID NO: 2400061 - RNA, 17 nt, Bordetella pertussis
gccaguccccugcgggg

SEQ ID NO: 2400062 - RNA, 21 nt, Bordetella pertussis
gccaguccccugcggggacag

SEQ ID NO: 2400063 - RNA, 15 nt, Bordetella pertussis
gccaguccgcagcgc

SEQ ID NO: 2400064 - RNA, 19 nt, Bordetella pertussis
gccaguccgcagcgcagcg

SEQ ID NO: 2400065 - RNA, 22 nt, Bordetella pertussis
gccaguccgcagcgcagcgcca

SEQ ID NO: 2400066 - RNA, 16 nt, Bordetella pertussis
gccaguccgcgcucgc

SEQ ID NO: 2400067 - RNA, 17 nt, Bordetella pertussis
gccaguccgcgcucgcc

SEQ ID NO: 2400068 - RNA, 21 nt, Bordetella pertussis
gccaguccgcgcucgcccagc

SEQ ID NO: 2400069 - RNA, 22 nt, Bordetella pertussis
gccaguccgcgcucgcccagcc

SEQ ID NO: 2400070 - RNA, 14 nt, Bordetella pertussis
gccagucgcgcagc

SEQ ID NO: 2400071 - RNA, 18 nt, Bordetella pertussis
gccagucuccaggcucag

SEQ ID NO: 2400072 - RNA, 20 nt, Bordetella pertussis
gccagucuccaggcucaggc

SEQ ID NO: 2400073 - RNA, 23 nt, Bordetella pertussis
gccagucuccaggcucaggcggc

SEQ ID NO: 2400074 - RNA, 18 nt, Bordetella pertussis
gccagugaaacgcgacgc

SEQ ID NO: 2400075 - RNA, 20 nt, Bordetella pertussis
gccagugaaacgcgacgcgc

SEQ ID NO: 2400076 - RNA, 12 nt, Bordetella pertussis
gccagugccugg

SEQ ID NO: 2400077 - RNA, 17 nt, Bordetella pertussis
gccagugccuggacgcg

SEQ ID NO: 2400078 - RNA, 18 nt, Bordetella pertussis
gccagugccuggacgcgc

SEQ ID NO: 2400079 - RNA, 20 nt, Bordetella pertussis
gccagugccuggacgcgcug

SEQ ID NO: 2400080 - RNA, 21 nt, Bordetella pertussis
gccagugccuggacgcgcugg

SEQ ID NO: 2400081 - RNA, 22 nt, Bordetella pertussis
gccagugccuggacgcgcuggc

SEQ ID NO: 2400082 - RNA, 20 nt, Bordetella pertussis
gccagugcuucgagauccgc

SEQ ID NO: 2400083 - RNA, 23 nt, Bordetella pertussis
gccagugcuucgagauccgccgg

SEQ ID NO: 2400084 - RNA, 15 nt, Bordetella pertussis
gccaguggcgcggcg

SEQ ID NO: 2400085 - RNA, 17 nt, Bordetella pertussis
gccagugguccaucagg

SEQ ID NO: 2400086 - RNA, 16 nt, Bordetella pertussis
gccaguucaaggcgcg

SEQ ID NO: 2400087 - RNA, 17 nt, Bordetella pertussis
gccaguucaaggcgcga

SEQ ID NO: 2400088 - RNA, 19 nt, Bordetella pertussis
gccaguuccgugcgcgccc

SEQ ID NO: 2400089 - RNA, 15 nt, Bordetella pertussis
gccaguucgaugcgc

SEQ ID NO: 2400090 - RNA, 14 nt, Bordetella pertussis
gccaguucgcggcg

SEQ ID NO: 2400091 - RNA, 15 nt, Bordetella pertussis
gccaguucgcggcgc

SEQ ID NO: 2400092 - RNA, 16 nt, Bordetella pertussis
gccaguucgcggcgca

SEQ ID NO: 2400093 - RNA, 17 nt, Bordetella pertussis
gccaguucgcggcgcag

SEQ ID NO: 2400094 - RNA, 18 nt, Bordetella pertussis
gccaguucgcggcgcagc

SEQ ID NO: 2400095 - RNA, 14 nt, Bordetella pertussis
gccaguugaaccgc

SEQ ID NO: 2400096 - RNA, 23 nt, Bordetella pertussis
gccaguugaaccgcaacgccagc

SEQ ID NO: 2400097 - RNA, 14 nt, Bordetella pertussis
gccaguugccgccg

SEQ ID NO: 2400098 - RNA, 15 nt, Bordetella pertussis
gccaguugccgccgc

SEQ ID NO: 2400099 - RNA, 17 nt, Bordetella pertussis
gccaugccgcgcgccuu

SEQ ID NO: 2400100 - RNA, 14 nt, Bordetella pertussis
gccaugccggcccc

SEQ ID NO: 2400101 - RNA, 12 nt, Bordetella pertussis
gccaugccggga

SEQ ID NO: 2400102 - RNA, 13 nt, Bordetella pertussis
gccaugccgggca

SEQ ID NO: 2400103 - RNA, 17 nt, Bordetella pertussis
gccaugccgggcaagca

SEQ ID NO: 2400104 - RNA, 17 nt, Bordetella pertussis
gccaugccgucaccggc

SEQ ID NO: 2400105 - RNA, 16 nt, Bordetella pertussis
gccaugccguccugcu

SEQ ID NO: 2400106 - RNA, 21 nt, Bordetella pertussis
gccaugccguccugcugcggc

SEQ ID NO: 2400107 - RNA, 17 nt, Bordetella pertussis
gccaugccgucgcgcac

SEQ ID NO: 2400108 - RNA, 18 nt, Bordetella pertussis
gccaugccgucgcgcacc

SEQ ID NO: 2400109 - RNA, 19 nt, Bordetella pertussis
gccaugccgucgcgcacca

SEQ ID NO: 2400110 - RNA, 23 nt, Bordetella pertussis
gccaugccgucgcgcaccaccug

SEQ ID NO: 2400111 - RNA, 22 nt, Bordetella pertussis
gccaugccgucuggcggcagcu

SEQ ID NO: 2400112 - RNA, 14 nt, Bordetella pertussis
gccaugcgacagcc

SEQ ID NO: 2400113 - RNA, 19 nt, Bordetella pertussis
gccaugcgauacagcuugg

SEQ ID NO: 2400114 - RNA, 20 nt, Bordetella pertussis
gccaugcgauaggcgaagcg

SEQ ID NO: 2400115 - RNA, 16 nt, Bordetella pertussis
gccaugcgaugcugca

SEQ ID NO: 2400116 - RNA, 18 nt, Bordetella pertussis
gccaugcgcacucgaccg

SEQ ID NO: 2400117 - RNA, 22 nt, Bordetella pertussis
gccaugcgcacucgaccgccgg

SEQ ID NO: 2400118 - RNA, 12 nt, Bordetella pertussis
gccaugcgcagg

SEQ ID NO: 2400119 - RNA, 14 nt, Bordetella pertussis
gccaugcgcauggc

SEQ ID NO: 2400120 - RNA, 13 nt, Bordetella pertussis
gccaugcgccagc

SEQ ID NO: 2400121 - RNA, 15 nt, Bordetella pertussis
gccaugcgccagcag

SEQ ID NO: 2400122 - RNA, 16 nt, Bordetella pertussis
gccaugcgccagcagg

SEQ ID NO: 2400123 - RNA, 18 nt, Bordetella pertussis
gccaugcgcccggccacc

SEQ ID NO: 2400124 - RNA, 13 nt, Bordetella pertussis
gccaugcgcgcca

SEQ ID NO: 2400125 - RNA, 14 nt, Bordetella pertussis
gccaugcgcuugga

SEQ ID NO: 2400126 - RNA, 17 nt, Bordetella pertussis
gccaugcggacgccagc

SEQ ID NO: 2400127 - RNA, 18 nt, Bordetella pertussis
gccaugcggacgccagcc

SEQ ID NO: 2400128 - RNA, 19 nt, Bordetella pertussis
gccaugcggacgccagccc

SEQ ID NO: 2400129 - RNA, 20 nt, Bordetella pertussis
gccaugcggacgccagcccu

SEQ ID NO: 2400130 - RNA, 21 nt, Bordetella pertussis
gccaugcggaugaacgaccag

SEQ ID NO: 2400131 - RNA, 14 nt, Bordetella pertussis
gccaugcggcuggc

SEQ ID NO: 2400132 - RNA, 16 nt, Bordetella pertussis
gccaugcggcuggccg

SEQ ID NO: 2400133 - RNA, 18 nt, Bordetella pertussis
gccaugcggcuggccgau

SEQ ID NO: 2400134 - RNA, 17 nt, Bordetella pertussis
gccaugcgggucaggcc

SEQ ID NO: 2400135 - RNA, 18 nt, Bordetella pertussis
gccaugcgggucaggccg

SEQ ID NO: 2400136 - RNA, 20 nt, Bordetella pertussis
gccaugcgggucaggccgcc

SEQ ID NO: 2400137 - RNA, 21 nt, Bordetella pertussis
gccaugcgggucaggccgccg

SEQ ID NO: 2400138 - RNA, 14 nt, Bordetella pertussis
gccaugcggugcgc

SEQ ID NO: 2400139 - RNA, 17 nt, Bordetella pertussis
gccaugcggugcgccgc

SEQ ID NO: 2400140 - RNA, 18 nt, Bordetella pertussis
gccaugcggugcgccgcg

SEQ ID NO: 2400141 - RNA, 19 nt, Bordetella pertussis
gccaugcggugcgccgcgu

SEQ ID NO: 2400142 - RNA, 21 nt, Bordetella pertussis
gccaugcggugcgccgcguca

SEQ ID NO: 2400143 - RNA, 13 nt, Bordetella pertussis
gccaugcucagca

SEQ ID NO: 2400144 - RNA, 15 nt, Bordetella pertussis
gccaugcucagcagc

SEQ ID NO: 2400145 - RNA, 19 nt, Bordetella pertussis
gccaugcucagcagcaccg

SEQ ID NO: 2400146 - RNA, 17 nt, Bordetella pertussis
gccaugcucguccaucg

SEQ ID NO: 2400147 - RNA, 18 nt, Bordetella pertussis
gccaugcugccaaccgcg

SEQ ID NO: 2400148 - RNA, 15 nt, Bordetella pertussis
gccaugcuggccgcc

SEQ ID NO: 2400149 - RNA, 19 nt, Bordetella pertussis
gccaugcuggccgccgcgc

SEQ ID NO: 2400150 - RNA, 21 nt, Bordetella pertussis
gccaugcuggccgccgcgcuc

SEQ ID NO: 2400151 - RNA, 14 nt, Bordetella pertussis
gccaugcugggcgg

SEQ ID NO: 2400152 - RNA, 20 nt, Bordetella pertussis
gccauggaagcggcagacga

SEQ ID NO: 2400153 - RNA, 14 nt, Bordetella pertussis
gccauggacagcac

SEQ ID NO: 2400154 - RNA, 20 nt, Bordetella pertussis
gccauggacagcaccgacag

SEQ ID NO: 2400155 - RNA, 19 nt, Bordetella pertussis
gccauggacgagggccggc

SEQ ID NO: 2400156 - RNA, 21 nt, Bordetella pertussis
gccauggacgaguugcucgga

SEQ ID NO: 2400157 - RNA, 14 nt, Bordetella pertussis
gccauggacgccga

SEQ ID NO: 2400158 - RNA, 17 nt, Bordetella pertussis
gccauggacgccgaaca

SEQ ID NO: 2400159 - RNA, 16 nt, Bordetella pertussis
gccauggacgccggua

SEQ ID NO: 2400160 - RNA, 16 nt, Bordetella pertussis
gccauggaggcgcagc

SEQ ID NO: 2400161 - RNA, 17 nt, Bordetella pertussis
gccauggaggcgcagcg

SEQ ID NO: 2400162 - RNA, 15 nt, Bordetella pertussis
gccauggaugcgcgc

SEQ ID NO: 2400163 - RNA, 19 nt, Bordetella pertussis
gccauggcacaggccaucg

SEQ ID NO: 2400164 - RNA, 17 nt, Bordetella pertussis
gccauggcagggcgccg

SEQ ID NO: 2400165 - RNA, 19 nt, Bordetella pertussis
gccauggcaggguccgucg

SEQ ID NO: 2400166 - RNA, 17 nt, Bordetella pertussis
gccauggccacgacgag

SEQ ID NO: 2400167 - RNA, 22 nt, Bordetella pertussis
gccauggccacgacgagaguuu

SEQ ID NO: 2400168 - RNA, 13 nt, Bordetella pertussis
gccauggccgcca

SEQ ID NO: 2400169 - RNA, 16 nt, Bordetella pertussis
gccauggccgcgcggc

SEQ ID NO: 2400170 - RNA, 13 nt, Bordetella pertussis
gccauggcggccg

SEQ ID NO: 2400171 - RNA, 15 nt, Bordetella pertussis
gccauggcggccgcc

SEQ ID NO: 2400172 - RNA, 17 nt, Bordetella pertussis
gccauggcggccgccgc

SEQ ID NO: 2400173 - RNA, 19 nt, Bordetella pertussis
gccauggcggccgccgcca

SEQ ID NO: 2400174 - RNA, 13 nt, Bordetella pertussis
gccauggcggcgc

SEQ ID NO: 2400175 - RNA, 15 nt, Bordetella pertussis
gccauggcggcgccc

SEQ ID NO: 2400176 - RNA, 17 nt, Bordetella pertussis
gccauggcggcgcccau

SEQ ID NO: 2400177 - RNA, 16 nt, Bordetella pertussis
gccauggcggcggcca

SEQ ID NO: 2400178 - RNA, 21 nt, Bordetella pertussis
gccauggcggcggccacgacc

SEQ ID NO: 2400179 - RNA, 22 nt, Bordetella pertussis
gccauggcggcggccacgaccg

SEQ ID NO: 2400180 - RNA, 17 nt, Bordetella pertussis
gccauggucucccccuc

SEQ ID NO: 2400181 - RNA, 20 nt, Bordetella pertussis
gccauggugaacggccccgc

SEQ ID NO: 2400182 - RNA, 23 nt, Bordetella pertussis
gccauggugaacggccccgccag

SEQ ID NO: 2400183 - RNA, 18 nt, Bordetella pertussis
gccauggugccgcgcagg

SEQ ID NO: 2400184 - RNA, 19 nt, Bordetella pertussis
gccauggugccgcgcaggc

SEQ ID NO: 2400185 - RNA, 18 nt, Bordetella pertussis
gccauguagauggccgcc

SEQ ID NO: 2400186 - RNA, 22 nt, Bordetella pertussis
gccaugucagucguccuccgcg

SEQ ID NO: 2400187 - RNA, 16 nt, Bordetella pertussis
gccauguccuggcagg

SEQ ID NO: 2400188 - RNA, 20 nt, Bordetella pertussis
gccaugucgacgaucucgcg

SEQ ID NO: 2400189 - RNA, 16 nt, Bordetella pertussis
gccaugucggcuucgg

SEQ ID NO: 2400190 - RNA, 13 nt, Bordetella pertussis
gccaugugcgcca

SEQ ID NO: 2400191 - RNA, 14 nt, Bordetella pertussis
gccaugugcgccgc

SEQ ID NO: 2400192 - RNA, 15 nt, Bordetella pertussis
gccaugugcgccgcg

SEQ ID NO: 2400193 - RNA, 16 nt, Bordetella pertussis
gccaugugcgccgcgc

SEQ ID NO: 2400194 - RNA, 17 nt, Bordetella pertussis
gccauguggcgacgccc

SEQ ID NO: 2400195 - RNA, 19 nt, Bordetella pertussis
gccauguggcgacgcccag

SEQ ID NO: 2400196 - RNA, 21 nt, Bordetella pertussis
gccauguggcgacgcccagcc

SEQ ID NO: 2400197 - RNA, 16 nt, Bordetella pertussis
gccauguucagcuuca

SEQ ID NO: 2400198 - RNA, 15 nt, Bordetella pertussis
gccauguucgaccag

SEQ ID NO: 2400199 - RNA, 14 nt, Bordetella pertussis
gccauucagaccgg

SEQ ID NO: 2400200 - RNA, 17 nt, Bordetella pertussis
gccauucagaccggguu

SEQ ID NO: 2400201 - RNA, 18 nt, Bordetella pertussis
gccauucauccagcgcgc

SEQ ID NO: 2400202 - RNA, 20 nt, Bordetella pertussis
gccauucauccagcgcgcga

SEQ ID NO: 2400203 - RNA, 16 nt, Bordetella pertussis
gccauuccagcuccgg

SEQ ID NO: 2400204 - RNA, 20 nt, Bordetella pertussis
gccauuccagcuccggcggc

SEQ ID NO: 2400205 - RNA, 15 nt, Bordetella pertussis
gccauuccggcuggu

SEQ ID NO: 2400206 - RNA, 21 nt, Bordetella pertussis
gccauucgauggcggcgcugg

SEQ ID NO: 2400207 - RNA, 14 nt, Bordetella pertussis
gccauucggccagg

SEQ ID NO: 2400208 - RNA, 21 nt, Bordetella pertussis
gccauucgucguagccgccga

SEQ ID NO: 2400209 - RNA, 20 nt, Bordetella pertussis
gccauucuucgccgaugcgc

SEQ ID NO: 2400210 - RNA, 17 nt, Bordetella pertussis
gccauugcacgcgcagg

SEQ ID NO: 2400211 - RNA, 15 nt, Bordetella pertussis
gccauugccacggcg

SEQ ID NO: 2400212 - RNA, 17 nt, Bordetella pertussis
gccauugcccacagcac

SEQ ID NO: 2400213 - RNA, 23 nt, Bordetella pertussis
gccauugccgcacgaucgcgccg

SEQ ID NO: 2400214 - RNA, 23 nt, Bordetella pertussis
gccauugcgccguugcgggcugc

SEQ ID NO: 2400215 - RNA, 15 nt, Bordetella pertussis
gccauugcgcggccu

SEQ ID NO: 2400216 - RNA, 16 nt, Bordetella pertussis
gccauugcgcggccug

SEQ ID NO: 2400217 - RNA, 16 nt, Bordetella pertussis
gcccaacccggcgagg

SEQ ID NO: 2400218 - RNA, 22 nt, Bordetella pertussis
gcccaacccggcgaggccgccc

SEQ ID NO: 2400219 - RNA, 14 nt, Bordetella pertussis
gcccaacgaggaca

SEQ ID NO: 2400220 - RNA, 22 nt, Bordetella pertussis
gcccaacgaggacaaccaggaa

SEQ ID NO: 2400221 - RNA, 18 nt, Bordetella pertussis
gcccaaggccccgcgacc

SEQ ID NO: 2400222 - RNA, 19 nt, Bordetella pertussis
gcccaauccgaucagcacg

SEQ ID NO: 2400223 - RNA, 16 nt, Bordetella pertussis
gcccaaucgggcagca

SEQ ID NO: 2400224 - RNA, 17 nt, Bordetella pertussis
gcccaaucgggcagcac

SEQ ID NO: 2400225 - RNA, 18 nt, Bordetella pertussis
gcccaaucgggcagcacg

SEQ ID NO: 2400226 - RNA, 22 nt, Bordetella pertussis
gcccaaugucaccgacgccagc

SEQ ID NO: 2400227 - RNA, 16 nt, Bordetella pertussis
gcccacagcacggaau

SEQ ID NO: 2400228 - RNA, 14 nt, Bordetella pertussis
gcccacagcgcccc

SEQ ID NO: 2400229 - RNA, 16 nt, Bordetella pertussis
gcccacagcgccccca

SEQ ID NO: 2400230 - RNA, 20 nt, Bordetella pertussis
gcccacagcgcccccagcac

SEQ ID NO: 2400231 - RNA, 17 nt, Bordetella pertussis
gcccacaggaacaggcc

SEQ ID NO: 2400232 - RNA, 20 nt, Bordetella pertussis
gcccacaggaacaggccggc

SEQ ID NO: 2400233 - RNA, 19 nt, Bordetella pertussis
gcccacauagaccggcugc

SEQ ID NO: 2400234 - RNA, 14 nt, Bordetella pertussis
gcccacauagcggc

SEQ ID NO: 2400235 - RNA, 18 nt, Bordetella pertussis
gcccacauagcggccggc

SEQ ID NO: 2400236 - RNA, 19 nt, Bordetella pertussis
gcccacauagcggccggcg

SEQ ID NO: 2400237 - RNA, 20 nt, Bordetella pertussis
gcccacauagcggccggcgc

SEQ ID NO: 2400238 - RNA, 22 nt, Bordetella pertussis
gcccacauagcggccggcgcgc

SEQ ID NO: 2400239 - RNA, 15 nt, Bordetella pertussis
gcccacaucgucgcg

SEQ ID NO: 2400240 - RNA, 16 nt, Bordetella pertussis
gcccacaugccgugcc

SEQ ID NO: 2400241 - RNA, 13 nt, Bordetella pertussis
gcccacauggcgg

SEQ ID NO: 2400242 - RNA, 15 nt, Bordetella pertussis
gcccacauggcggcg

SEQ ID NO: 2400243 - RNA, 16 nt, Bordetella pertussis
gcccacauggcggcga

SEQ ID NO: 2400244 - RNA, 15 nt, Bordetella pertussis
gcccaccaccagcgc

SEQ ID NO: 2400245 - RNA, 18 nt, Bordetella pertussis
gcccaccaccagcgcggc

SEQ ID NO: 2400246 - RNA, 21 nt, Bordetella pertussis
gcccaccaccagcgcggccag

SEQ ID NO: 2400247 - RNA, 22 nt, Bordetella pertussis
gcccaccaccagcgcggccagc

SEQ ID NO: 2400248 - RNA, 16 nt, Bordetella pertussis
gcccaccaccagcggc

SEQ ID NO: 2400249 - RNA, 17 nt, Bordetella pertussis
gcccaccaccagcggcg

SEQ ID NO: 2400250 - RNA, 20 nt, Bordetella pertussis
gcccaccacgccgcccagcg

SEQ ID NO: 2400251 - RNA, 13 nt, Bordetella pertussis
gcccaccagccgc

SEQ ID NO: 2400252 - RNA, 15 nt, Bordetella pertussis
gcccaccagccgccc

SEQ ID NO: 2400253 - RNA, 14 nt, Bordetella pertussis
gcccaccagccggg

SEQ ID NO: 2400254 - RNA, 15 nt, Bordetella pertussis
gcccaccagccgggc

SEQ ID NO: 2400255 - RNA, 20 nt, Bordetella pertussis
gcccaccagcgccacgccgg

SEQ ID NO: 2400256 - RNA, 21 nt, Bordetella pertussis
gcccaccagcgccacgccggc

SEQ ID NO: 2400257 - RNA, 22 nt, Bordetella pertussis
gcccaccagggaccaauacgcc

SEQ ID NO: 2400258 - RNA, 17 nt, Bordetella pertussis
gcccaccagggccagcu

SEQ ID NO: 2400259 - RNA, 18 nt, Bordetella pertussis
gcccaccaugagcacgcc

SEQ ID NO: 2400260 - RNA, 19 nt, Bordetella pertussis
gcccaccaugagcacgccc

SEQ ID NO: 2400261 - RNA, 21 nt, Bordetella pertussis
gcccaccaugagcacgcccca

SEQ ID NO: 2400262 - RNA, 16 nt, Bordetella pertussis
gcccacccccggcacc

SEQ ID NO: 2400263 - RNA, 14 nt, Bordetella pertussis
gcccacccggcacg

SEQ ID NO: 2400264 - RNA, 22 nt, Bordetella pertussis
gcccaccgacaugaccgcgucc

SEQ ID NO: 2400265 - RNA, 23 nt, Bordetella pertussis
gcccaccgacaugaccgcguccg

SEQ ID NO: 2400266 - RNA, 20 nt, Bordetella pertussis
gcccaccgagacgcugucgc

SEQ ID NO: 2400267 - RNA, 12 nt, Bordetella pertussis
gcccaccgcauc

SEQ ID NO: 2400268 - RNA, 16 nt, Bordetella pertussis
gcccaccgcaucgcgc

SEQ ID NO: 2400269 - RNA, 19 nt, Bordetella pertussis
gcccaccgcaucgcgcagc

SEQ ID NO: 2400270 - RNA, 20 nt, Bordetella pertussis
gcccaccgcaucgcgcagcg

SEQ ID NO: 2400271 - RNA, 22 nt, Bordetella pertussis
gcccaccgccaggaagaucggc

SEQ ID NO: 2400272 - RNA, 14 nt, Bordetella pertussis
gcccaccgccgccc

SEQ ID NO: 2400273 - RNA, 18 nt, Bordetella pertussis
gcccaccgccgcccgcca

SEQ ID NO: 2400274 - RNA, 21 nt, Bordetella pertussis
gccggcccggaauaccgccag

SEQ ID NO: 2400275 - RNA, 11 nt, Bordetella pertussis
gccggcccggu

SEQ ID NO: 2400276 - RNA, 21 nt, Bordetella pertussis
gccggcccgugcgcaacgcgc

SEQ ID NO: 2400277 - RNA, 18 nt, Bordetella pertussis
gccggcccguuggcaggc

SEQ ID NO: 2400278 - RNA, 19 nt, Bordetella pertussis
gccggcccugccgcccugg

SEQ ID NO: 2400279 - RNA, 22 nt, Bordetella pertussis
gccggcccugccgcccuggcgc

SEQ ID NO: 2400280 - RNA, 17 nt, Bordetella pertussis
gccggccgaccggcgcg

SEQ ID NO: 2400281 - RNA, 19 nt, Bordetella pertussis
gccggccgaccggcgcgcg

SEQ ID NO: 2400282 - RNA, 20 nt, Bordetella pertussis
gccggccgacggcgcuggcg

SEQ ID NO: 2400283 - RNA, 17 nt, Bordetella pertussis
gccggccgauagccgcg

SEQ ID NO: 2400284 - RNA, 19 nt, Bordetella pertussis
gccggccgauagccgcggc

SEQ ID NO: 2400285 - RNA, 23 nt, Bordetella pertussis
gccggccgauagccgcggcgccg

SEQ ID NO: 2400286 - RNA, 21 nt, Bordetella pertussis
gccggccgaugacaucgccgc

SEQ ID NO: 2400287 - RNA, 16 nt, Bordetella pertussis
gccggccgccauggcc

SEQ ID NO: 2400288 - RNA, 19 nt, Bordetella pertussis
gccggccgccauggccggc

SEQ ID NO: 2400289 - RNA, 18 nt, Bordetella pertussis
gccggccgcccaggcgca

SEQ ID NO: 2400290 - RNA, 19 nt, Bordetella pertussis
gccggccgcccaggcgcag

SEQ ID NO: 2400291 - RNA, 20 nt, Bordetella pertussis
gccggccgcccaggcgcagc

SEQ ID NO: 2400292 - RNA, 12 nt, Bordetella pertussis
gccggccgccga

SEQ ID NO: 2400293 - RNA, 17 nt, Bordetella pertussis
gccggccgccgaacgag

SEQ ID NO: 2400294 - RNA, 13 nt, Bordetella pertussis
gccggccgccggc

SEQ ID NO: 2400295 - RNA, 14 nt, Bordetella pertussis
gccggccgccgggc

SEQ ID NO: 2400296 - RNA, 14 nt, Bordetella pertussis
gccggccgccucca

SEQ ID NO: 2400297 - RNA, 18 nt, Bordetella pertussis
gccggccgccuccaggcg

SEQ ID NO: 2400298 - RNA, 14 nt, Bordetella pertussis
gccggccgccuggc

SEQ ID NO: 2400299 - RNA, 14 nt, Bordetella pertussis
gccggccgcgccca

SEQ ID NO: 2400300 - RNA, 15 nt, Bordetella pertussis
gccggccgcgcccag

SEQ ID NO: 2400301 - RNA, 16 nt, Bordetella pertussis
gccggccgcgcccagc

SEQ ID NO: 2400302 - RNA, 17 nt, Bordetella pertussis
gccggccgcgcccagcg

SEQ ID NO: 2400303 - RNA, 13 nt, Bordetella pertussis
gccggccgcgccg

SEQ ID NO: 2400304 - RNA, 15 nt, Bordetella pertussis
gccggccgcgccgcg

SEQ ID NO: 2400305 - RNA, 16 nt, Bordetella pertussis
gccggccgcgccgcgc

SEQ ID NO: 2400306 - RNA, 20 nt, Bordetella pertussis
gccggccgcgccgcgccggu

SEQ ID NO: 2400307 - RNA, 14 nt, Bordetella pertussis
gccggccgcgcgcg

SEQ ID NO: 2400308 - RNA, 15 nt, Bordetella pertussis
gccggccgcgcgcgc

SEQ ID NO: 2400309 - RNA, 17 nt, Bordetella pertussis
gccggccgcgcgcgcca

SEQ ID NO: 2400310 - RNA, 18 nt, Bordetella pertussis
gccggccgcgcgcgccag

SEQ ID NO: 2400311 - RNA, 18 nt, Bordetella pertussis
gccggccgcgcgcgccau

SEQ ID NO: 2400312 - RNA, 20 nt, Bordetella pertussis
gccggccgcgcgcgccaugu

SEQ ID NO: 2400313 - RNA, 14 nt, Bordetella pertussis
gccggccgcgcggc

SEQ ID NO: 2400314 - RNA, 19 nt, Bordetella pertussis
gccggccgcgcggccguca

SEQ ID NO: 2400315 - RNA, 18 nt, Bordetella pertussis
gccggccgcggggcuggc

SEQ ID NO: 2400316 - RNA, 20 nt, Bordetella pertussis
gccggccgcggggcuggcca

SEQ ID NO: 2400317 - RNA, 22 nt, Bordetella pertussis
gccggccgcggggcuggccagc

SEQ ID NO: 2400318 - RNA, 12 nt, Bordetella pertussis
gccggccgcguu

SEQ ID NO: 2400319 - RNA, 15 nt, Bordetella pertussis
gccggccggaccgcu

SEQ ID NO: 2400320 - RNA, 13 nt, Bordetella pertussis
gccggccggccag

SEQ ID NO: 2400321 - RNA, 14 nt, Bordetella pertussis
gccggccggccagu

SEQ ID NO: 2400322 - RNA, 22 nt, Bordetella pertussis
gccggccgggccgcgcgaugcg

SEQ ID NO: 2400323 - RNA, 14 nt, Bordetella pertussis
gccggccgggcgcg

SEQ ID NO: 2400324 - RNA, 23 nt, Bordetella pertussis
gccggccggguugucgcccacca

SEQ ID NO: 2400325 - RNA, 22 nt, Bordetella pertussis
gccggccggugcaucggccggc

SEQ ID NO: 2400326 - RNA, 17 nt, Bordetella pertussis
gccggccguuucaggcc

SEQ ID NO: 2400327 - RNA, 23 nt, Bordetella pertussis
gccggccguuucaggccugcggc

SEQ ID NO: 2400328 - RNA, 13 nt, Bordetella pertussis
gccggccuccagc

SEQ ID NO: 2400329 - RNA, 16 nt, Bordetella pertussis
gccggccuccagcauc

SEQ ID NO: 2400330 - RNA, 13 nt, Bordetella pertussis
gccggccucggcc

SEQ ID NO: 2400331 - RNA, 16 nt, Bordetella pertussis
gccggccucggccaug

SEQ ID NO: 2400332 - RNA, 22 nt, Bordetella pertussis
gccggccucuucgucgccggcg

SEQ ID NO: 2400333 - RNA, 16 nt, Bordetella pertussis
gccggccugacgcgca

SEQ ID NO: 2400334 - RNA, 18 nt, Bordetella pertussis
gccggccugacgcgcaag

SEQ ID NO: 2400335 - RNA, 14 nt, Bordetella pertussis
gccggccugaggcc

SEQ ID NO: 2400336 - RNA, 19 nt, Bordetella pertussis
gccggccugcaaugcggcc

SEQ ID NO: 2400337 - RNA, 23 nt, Bordetella pertussis
gccggccugcaaugcggccaggc

SEQ ID NO: 2400338 - RNA, 17 nt, Bordetella pertussis
gccggccugcaggugcc

SEQ ID NO: 2400339 - RNA, 15 nt, Bordetella pertussis
gccggccugccggcg

SEQ ID NO: 2400340 - RNA, 16 nt, Bordetella pertussis
gccggccugccggcgc

SEQ ID NO: 2400341 - RNA, 18 nt, Bordetella pertussis
gccggccugccggcgcac

SEQ ID NO: 2400342 - RNA, 12 nt, Bordetella pertussis
gccggccugcgc

SEQ ID NO: 2400343 - RNA, 16 nt, Bordetella pertussis
gccggccugcgccagc

SEQ ID NO: 2400344 - RNA, 17 nt, Bordetella pertussis
gccggccugcgccagcu

SEQ ID NO: 2400345 - RNA, 18 nt, Bordetella pertussis
gccggccugcgccgggcg

SEQ ID NO: 2400346 - RNA, 15 nt, Bordetella pertussis
gccggccugcgucgc

SEQ ID NO: 2400347 - RNA, 16 nt, Bordetella pertussis
gccggccugcgucgcc

SEQ ID NO: 2400348 - RNA, 17 nt, Bordetella pertussis
gccggccugcgucgcca

SEQ ID NO: 2400349 - RNA, 19 nt, Bordetella pertussis
gccggccugcgucgccacc

SEQ ID NO: 2400350 - RNA, 18 nt, Bordetella pertussis
gccggccugcucgccggc

SEQ ID NO: 2400351 - RNA, 19 nt, Bordetella pertussis
gccggccugcucgccggcc

SEQ ID NO: 2400352 - RNA, 14 nt, Bordetella pertussis
gccggccugcuugg

SEQ ID NO: 2400353 - RNA, 12 nt, Bordetella pertussis
gccggccuggcg

SEQ ID NO: 2400354 - RNA, 14 nt, Bordetella pertussis
gccggccuggcgcg

SEQ ID NO: 2400355 - RNA, 15 nt, Bordetella pertussis
gccggccuggcgcga

SEQ ID NO: 2400356 - RNA, 15 nt, Bordetella pertussis
gccggccuggcgcgc

SEQ ID NO: 2400357 - RNA, 19 nt, Bordetella pertussis
gccggccuggcgcgcggcc

SEQ ID NO: 2400358 - RNA, 17 nt, Bordetella pertussis
gccggccuggcgggccg

SEQ ID NO: 2400359 - RNA, 13 nt, Bordetella pertussis
gccggccuggcuc

SEQ ID NO: 2400360 - RNA, 16 nt, Bordetella pertussis
gccggccugggcggcg

SEQ ID NO: 2400361 - RNA, 18 nt, Bordetella pertussis
gccggccugggcggcggc

SEQ ID NO: 2400362 - RNA, 19 nt, Bordetella pertussis
gccggccugggcggcggcg

SEQ ID NO: 2400363 - RNA, 20 nt, Bordetella pertussis
gccggccugggcggcggcga

SEQ ID NO: 2400364 - RNA, 18 nt, Bordetella pertussis
gccggccuggggacgggc

SEQ ID NO: 2400365 - RNA, 22 nt, Bordetella pertussis
gccggccuggggacgggcgcac

SEQ ID NO: 2400366 - RNA, 15 nt, Bordetella pertussis
gccggccuguucuuu

SEQ ID NO: 2400367 - RNA, 23 nt, Bordetella pertussis
gccggccuuggccauguccuggc

SEQ ID NO: 2400368 - RNA, 21 nt, Bordetella pertussis
gccggcgaauaugcccucuuc

SEQ ID NO: 2400369 - RNA, 17 nt, Bordetella pertussis
gccggcgaaugccggcc

SEQ ID NO: 2400370 - RNA, 18 nt, Bordetella pertussis
gccggcgaaugccggccg

SEQ ID NO: 2400371 - RNA, 12 nt, Bordetella pertussis
gccggcgacaua

SEQ ID NO: 2400372 - RNA, 13 nt, Bordetella pertussis
gccggcgacauag

SEQ ID NO: 2400373 - RNA, 23 nt, Bordetella pertussis
gccggcgacauagaucuccggcg

SEQ ID NO: 2400374 - RNA, 15 nt, Bordetella pertussis
gccggcgacgccgcg

SEQ ID NO: 2400375 - RNA, 16 nt, Bordetella pertussis
gccggcgacgccgcgg

SEQ ID NO: 2400376 - RNA, 18 nt, Bordetella pertussis
gccggcgacgccgcggug

SEQ ID NO: 2400377 - RNA, 20 nt, Bordetella pertussis
gccggcgacgccgcggugcu

SEQ ID NO: 2400378 - RNA, 14 nt, Bordetella pertussis
gccggcgacggcau

SEQ ID NO: 2400379 - RNA, 15 nt, Bordetella pertussis
gccggcgacguggug

SEQ ID NO: 2400380 - RNA, 18 nt, Bordetella pertussis
gccggcgacguggugugc

SEQ ID NO: 2400381 - RNA, 19 nt, Bordetella pertussis
gccggcgagacgucggcga

SEQ ID NO: 2400382 - RNA, 15 nt, Bordetella pertussis
gccggcgauauggcc

SEQ ID NO: 2400383 - RNA, 19 nt, Bordetella pertussis
gccggcgauauggccaggg

SEQ ID NO: 2400384 - RNA, 22 nt, Bordetella pertussis
gccggcgauauggccagggucg

SEQ ID NO: 2400385 - RNA, 13 nt, Bordetella pertussis
gccggcgaucacg

SEQ ID NO: 2400386 - RNA, 15 nt, Bordetella pertussis
gccggcgaucacgcc

SEQ ID NO: 2400387 - RNA, 21 nt, Bordetella pertussis
gccggcgaugaagucgcggcc

SEQ ID NO: 2400388 - RNA, 22 nt, Bordetella pertussis
gccggcgaugaagucgcggccc

SEQ ID NO: 2400389 - RNA, 18 nt, Bordetella pertussis
gccggcgaugaucgccuc

SEQ ID NO: 2400390 - RNA, 19 nt, Bordetella pertussis
gccggcgaugauggggucg

SEQ ID NO: 2400391 - RNA, 16 nt, Bordetella pertussis
gccggcgauggacacg

SEQ ID NO: 2400392 - RNA, 21 nt, Bordetella pertussis
gccggcgauggcguugcgcac

SEQ ID NO: 2400393 - RNA, 17 nt, Bordetella pertussis
gccggcgauugcgccag

SEQ ID NO: 2400394 - RNA, 18 nt, Bordetella pertussis
gccggcgauugcgccagc

SEQ ID NO: 2400395 - RNA, 16 nt, Bordetella pertussis
gccggcgcaacgggcc

SEQ ID NO: 2400396 - RNA, 17 nt, Bordetella pertussis
gccggcgcaacgggccg

SEQ ID NO: 2400397 - RNA, 18 nt, Bordetella pertussis
gccggcgcaacgggccga

SEQ ID NO: 2400398 - RNA, 18 nt, Bordetella pertussis
gccggcgcacaaucugcg

SEQ ID NO: 2400399 - RNA, 22 nt, Bordetella pertussis
gccggcgcacaaucugcgucgc

SEQ ID NO: 2400400 - RNA, 21 nt, Bordetella pertussis
gccggcgcaguuccggcgggc

SEQ ID NO: 2400401 - RNA, 20 nt, Bordetella pertussis
gccggcgcaugagccggcag

SEQ ID NO: 2400402 - RNA, 13 nt, Bordetella pertussis
gccggcgccagca

SEQ ID NO: 2400403 - RNA, 13 nt, Bordetella pertussis
gccggcgccagcc

SEQ ID NO: 2400404 - RNA, 15 nt, Bordetella pertussis
gccggcgccagccgc

SEQ ID NO: 2400405 - RNA, 17 nt, Bordetella pertussis
gccggcgccagccgcuc

SEQ ID NO: 2400406 - RNA, 16 nt, Bordetella pertussis
gccggcgcccccagca

SEQ ID NO: 2400407 - RNA, 19 nt, Bordetella pertussis
gccggcgcccccagcagcg

SEQ ID NO: 2400408 - RNA, 11 nt, Bordetella pertussis
gccggcgcccu

SEQ ID NO: 2400409 - RNA, 22 nt, Bordetella pertussis
gccggcgcccuugaugccgucg

SEQ ID NO: 2400410 - RNA, 12 nt, Bordetella pertussis
gccggcgccggc

SEQ ID NO: 2400411 - RNA, 13 nt, Bordetella pertussis
gccggcgccggca

SEQ ID NO: 2400412 - RNA, 16 nt, Bordetella pertussis
gccggcgccggcgacg

SEQ ID NO: 2400413 - RNA, 15 nt, Bordetella pertussis
gccggcgccggcgcg

SEQ ID NO: 2400414 - RNA, 17 nt, Bordetella pertussis
gccggcgccggcgcgcc

SEQ ID NO: 2400415 - RNA, 19 nt, Bordetella pertussis
gccggcgccggcgcgccgc

SEQ ID NO: 2400416 - RNA, 16 nt, Bordetella pertussis
gccggcgccgggcagc

SEQ ID NO: 2400417 - RNA, 20 nt, Bordetella pertussis
gccggcgccgggcagcccgc

SEQ ID NO: 2400418 - RNA, 23 nt, Bordetella pertussis
gccggcgccgggcagcccgcgca

SEQ ID NO: 2400419 - RNA, 22 nt, Bordetella pertussis
gccggcgccgguguccacgguc

SEQ ID NO: 2400420 - RNA, 14 nt, Bordetella pertussis
gccggcgccguuca

SEQ ID NO: 2400421 - RNA, 18 nt, Bordetella pertussis
gccggcgccguucaugcg

SEQ ID NO: 2400422 - RNA, 21 nt, Bordetella pertussis
gccggcgccguuuucagcgca

SEQ ID NO: 2400423 - RNA, 22 nt, Bordetella pertussis
gccggcgccguuuucagcgcag

SEQ ID NO: 2400424 - RNA, 17 nt, Bordetella pertussis
gccggcgccuggggcgg

SEQ ID NO: 2400425 - RNA, 17 nt, Bordetella pertussis
gccggcgccuuggccug

SEQ ID NO: 2400426 - RNA, 18 nt, Bordetella pertussis
gccggcgccuuggccugg

SEQ ID NO: 2400427 - RNA, 19 nt, Bordetella pertussis
gccggcgccuuggccuggg

SEQ ID NO: 2400428 - RNA, 13 nt, Bordetella pertussis
gccggcgcgaacc

SEQ ID NO: 2400429 - RNA, 15 nt, Bordetella pertussis
gccggcgcgaacccc

SEQ ID NO: 2400430 - RNA, 21 nt, Bordetella pertussis
gccggcgcgaaccccuccggc

SEQ ID NO: 2400431 - RNA, 22 nt, Bordetella pertussis
gccggcgcgaaccccuccggcg

SEQ ID NO: 2400432 - RNA, 14 nt, Bordetella pertussis
gccggcgcgaccgc

SEQ ID NO: 2400433 - RNA, 19 nt, Bordetella pertussis
gccggcgcgaccgccucca

SEQ ID NO: 2400434 - RNA, 21 nt, Bordetella pertussis
gccggcgcgaccgccuccagc

SEQ ID NO: 2400435 - RNA, 14 nt, Bordetella pertussis
gccggcgcgcaaac

SEQ ID NO: 2400436 - RNA, 13 nt, Bordetella pertussis
gccggcgcgcagg

SEQ ID NO: 2400437 - RNA, 15 nt, Bordetella pertussis
gccggcgcgcaggca

SEQ ID NO: 2400438 - RNA, 15 nt, Bordetella pertussis
gccggcgcgcauccg

SEQ ID NO: 2400439 - RNA, 13 nt, Bordetella pertussis
gccggcgcgccca

SEQ ID NO: 2400440 - RNA, 12 nt, Bordetella pertussis
gccggcgcgccg

SEQ ID NO: 2400441 - RNA, 19 nt, Bordetella pertussis
gccggcgcgccggccgcgg

SEQ ID NO: 2400442 - RNA, 16 nt, Bordetella pertussis
gccggcgcgccggccu

SEQ ID NO: 2400443 - RNA, 15 nt, Bordetella pertussis
gccggcgcgccgggc

SEQ ID NO: 2400444 - RNA, 16 nt, Bordetella pertussis
gccggcgcgccgggcc

SEQ ID NO: 2400445 - RNA, 22 nt, Bordetella pertussis
gccggcgcgccgggccagaccu

SEQ ID NO: 2400446 - RNA, 17 nt, Bordetella pertussis
gccggcgcgccucggcg

SEQ ID NO: 2400447 - RNA, 18 nt, Bordetella pertussis
gccggcgcgccucggcgc

SEQ ID NO: 2400448 - RNA, 14 nt, Bordetella pertussis
gccggcgcgccugc

SEQ ID NO: 2400449 - RNA, 15 nt, Bordetella pertussis
gccggcgcgccugcc

SEQ ID NO: 2400450 - RNA, 22 nt, Bordetella pertussis
gccggcgcgcgaucucgggcag

SEQ ID NO: 2400451 - RNA, 12 nt, Bordetella pertussis
gccggcgcgcgc

SEQ ID NO: 2400452 - RNA, 14 nt, Bordetella pertussis
gccggcgcgcgcag

SEQ ID NO: 2400453 - RNA, 15 nt, Bordetella pertussis
gccggcgcgcgcagg

SEQ ID NO: 2400454 - RNA, 19 nt, Bordetella pertussis
gccggcgcgcgcaggcgcu

SEQ ID NO: 2400455 - RNA, 21 nt, Bordetella pertussis
gccggcgcgcgcaggcgcucg

SEQ ID NO: 2400456 - RNA, 14 nt, Bordetella pertussis
gccggcgcgcgcga

SEQ ID NO: 2400457 - RNA, 17 nt, Bordetella pertussis
gccggcgcgcgcgacca

SEQ ID NO: 2400458 - RNA, 17 nt, Bordetella pertussis
gccggcgcgcgcgcgcc

SEQ ID NO: 2400459 - RNA, 19 nt, Bordetella pertussis
gccggcgcgcgcguacagc

SEQ ID NO: 2400460 - RNA, 21 nt, Bordetella pertussis
gccggcgcgcgcguacagccg

SEQ ID NO: 2400461 - RNA, 21 nt, Bordetella pertussis
gccggcgcgcggaugaucgcg

SEQ ID NO: 2400462 - RNA, 14 nt, Bordetella pertussis
gccggcgcgcucgc

SEQ ID NO: 2400463 - RNA, 15 nt, Bordetella pertussis
gccggcgcgcucggc

SEQ ID NO: 2400464 - RNA, 16 nt, Bordetella pertussis
gccggcgcgcucggcc

SEQ ID NO: 2400465 - RNA, 17 nt, Bordetella pertussis
gccggcgcgcucggccu

SEQ ID NO: 2400466 - RNA, 14 nt, Bordetella pertussis
gccggcgcggcugc

SEQ ID NO: 2400467 - RNA, 15 nt, Bordetella pertussis
gccggcgcggcugcu

SEQ ID NO: 2400468 - RNA, 16 nt, Bordetella pertussis
gccggcgcggcugcug

SEQ ID NO: 2400469 - RNA, 20 nt, Bordetella pertussis
gccggcgcggcugcugggca

SEQ ID NO: 2400470 - RNA, 13 nt, Bordetella pertussis
gccggcgcgggcg

SEQ ID NO: 2400471 - RNA, 16 nt, Bordetella pertussis
gccggcgcgggcgcag

SEQ ID NO: 2400472 - RNA, 19 nt, Bordetella pertussis
gccggcgcguccacgccgu

SEQ ID NO: 2400473 - RNA, 13 nt, Bordetella pertussis
gccggcgcgucgc

SEQ ID NO: 2400474 - RNA, 20 nt, Bordetella pertussis
gccggcgcgucgccggcgau

SEQ ID NO: 2400475 - RNA, 18 nt, Bordetella pertussis
gccggcgcgucgcgcggc

SEQ ID NO: 2400476 - RNA, 19 nt, Bordetella pertussis
gccggcgcgucgcgcggcg

SEQ ID NO: 2400477 - RNA, 22 nt, Bordetella pertussis
gccggcgcgucgcgcggcggca

SEQ ID NO: 2400478 - RNA, 15 nt, Bordetella pertussis
gccggcgcgugcugg

SEQ ID NO: 2400479 - RNA, 18 nt, Bordetella pertussis
gccggcgcgugcuggcgc

SEQ ID NO: 2400480 - RNA, 21 nt, Bordetella pertussis
gccggcgcgugcuggcgcagc

SEQ ID NO: 2400481 - RNA, 22 nt, Bordetella pertussis
gccggcgcgugcuggcgcagca

SEQ ID NO: 2400482 - RNA, 21 nt, Bordetella pertussis
gccggcgcucagcgacgcgcg

SEQ ID NO: 2400483 - RNA, 15 nt, Bordetella pertussis
gccggcgcucgcgca

SEQ ID NO: 2400484 - RNA, 16 nt, Bordetella pertussis
gccggcgcucgcgcac

SEQ ID NO: 2400485 - RNA, 20 nt, Bordetella pertussis
gccggcgcucgcgcaccgca

SEQ ID NO: 2400486 - RNA, 12 nt, Bordetella pertussis
gccggcgcugcg

SEQ ID NO: 2400487 - RNA, 13 nt, Bordetella pertussis
gccggcgcugcgc

SEQ ID NO: 2400488 - RNA, 17 nt, Bordetella pertussis
gccggcgcugcgcagca

SEQ ID NO: 2400489 - RNA, 14 nt, Bordetella pertussis
gccggcgcugcugu

SEQ ID NO: 2400490 - RNA, 19 nt, Bordetella pertussis
gccggcgcugcugucgcgc

SEQ ID NO: 2400491 - RNA, 23 nt, Bordetella pertussis
gccggcgcugggcaggcuggcgc

SEQ ID NO: 2400492 - RNA, 23 nt, Bordetella pertussis
gccggcggauuugcucgcgucua

SEQ ID NO: 2400493 - RNA, 23 nt, Bordetella pertussis
gccggcggcaagguagccgauga

SEQ ID NO: 2400494 - RNA, 13 nt, Bordetella pertussis
gccggcggcaccg

SEQ ID NO: 2400495 - RNA, 17 nt, Bordetella pertussis
gccggcggcaccgcgca

SEQ ID NO: 2400496 - RNA, 20 nt, Bordetella pertussis
gccggcggcaccgcgcagcc

SEQ ID NO: 2400497 - RNA, 18 nt, Bordetella pertussis
gccggcggcacgcugcgc

SEQ ID NO: 2400498 - RNA, 15 nt, Bordetella pertussis
gccggcggcagccgg

SEQ ID NO: 2400499 - RNA, 16 nt, Bordetella pertussis
gccggcggcagccggc

SEQ ID NO: 2400500 - RNA, 19 nt, Bordetella pertussis
gccggcggcagccggccau

SEQ ID NO: 2400501 - RNA, 19 nt, Bordetella pertussis
gccggcggcaugcgccagc

SEQ ID NO: 2400502 - RNA, 20 nt, Bordetella pertussis
gccggcggcaugcgccagcc

SEQ ID NO: 2400503 - RNA, 13 nt, Bordetella pertussis
gccggcggccagc

SEQ ID NO: 2400504 - RNA, 15 nt, Bordetella pertussis
gccaggcgcccggcg

SEQ ID NO: 2400505 - RNA, 17 nt, Bordetella pertussis
gccaggcgcccggcgug

SEQ ID NO: 2400506 - RNA, 12 nt, Bordetella pertussis
gccaggcgccgc

SEQ ID NO: 2400507 - RNA, 16 nt, Bordetella pertussis
gccaggcgccgcgucc

SEQ ID NO: 2400508 - RNA, 13 nt, Bordetella pertussis
gccaggcgccgcu

SEQ ID NO: 2400509 - RNA, 14 nt, Bordetella pertussis
gccaggcgccggcg

SEQ ID NO: 2400510 - RNA, 14 nt, Bordetella pertussis
gccaggcgccgggc

SEQ ID NO: 2400511 - RNA, 18 nt, Bordetella pertussis
gccaggcgccgggccgcu

SEQ ID NO: 2400512 - RNA, 20 nt, Bordetella pertussis
gccaggcgccgggccgcuag

SEQ ID NO: 2400513 - RNA, 14 nt, Bordetella pertussis
gccaggcgcgaucg

SEQ ID NO: 2400514 - RNA, 12 nt, Bordetella pertussis
gccaggcgcgca

SEQ ID NO: 2400515 - RNA, 16 nt, Bordetella pertussis
gccaggcgcgcaucgc

SEQ ID NO: 2400516 - RNA, 21 nt, Bordetella pertussis
gccaggcgcgcaucgcgcggc

SEQ ID NO: 2400517 - RNA, 22 nt, Bordetella pertussis
gccaggcgcgcaucgcgcggca

SEQ ID NO: 2400518 - RNA, 14 nt, Bordetella pertussis
gccaggcgcgccgc

SEQ ID NO: 2400519 - RNA, 13 nt, Bordetella pertussis
gccaggcgcggau

SEQ ID NO: 2400520 - RNA, 14 nt, Bordetella pertussis
gccaggcgcgugcg

SEQ ID NO: 2400521 - RNA, 14 nt, Bordetella pertussis
gccaggcgcucagc

SEQ ID NO: 2400522 - RNA, 12 nt, Bordetella pertussis
gccaggcgcucc

SEQ ID NO: 2400523 - RNA, 15 nt, Bordetella pertussis
gccaggcgcuccagc

SEQ ID NO: 2400524 - RNA, 16 nt, Bordetella pertussis
gccaggcgcuccagca

SEQ ID NO: 2400525 - RNA, 12 nt, Bordetella pertussis
gccaggcgcugc

SEQ ID NO: 2400526 - RNA, 14 nt, Bordetella pertussis
gccaggcgcugcgc

SEQ ID NO: 2400527 - RNA, 19 nt, Bordetella pertussis
gccaggcggcggcgcggcg

SEQ ID NO: 2400528 - RNA, 19 nt, Bordetella pertussis
gccaggcgguacaggccgg

SEQ ID NO: 2400529 - RNA, 14 nt, Bordetella pertussis
gccaggcgguggcc

SEQ ID NO: 2400530 - RNA, 17 nt, Bordetella pertussis
gccaggcgguggccucg

SEQ ID NO: 2400531 - RNA, 13 nt, Bordetella pertussis
gccaggcguacgc

SEQ ID NO: 2400532 - RNA, 21 nt, Bordetella pertussis
gccaggcguagaccaccugcu

SEQ ID NO: 2400533 - RNA, 13 nt, Bordetella pertussis
gccaggcucagca

SEQ ID NO: 2400534 - RNA, 14 nt, Bordetella pertussis
gccaggcucagcag

SEQ ID NO: 2400535 - RNA, 16 nt, Bordetella pertussis
gccaggcucagcaggg

SEQ ID NO: 2400536 - RNA, 17 nt, Bordetella pertussis
gccaggcucugggcgga

SEQ ID NO: 2400537 - RNA, 23 nt, Bordetella pertussis
gccaggcucuuuuucgagccgca

SEQ ID NO: 2400538 - RNA, 15 nt, Bordetella pertussis
gccaggcugaccagc

SEQ ID NO: 2400539 - RNA, 16 nt, Bordetella pertussis
gccaggcugaccagcg

SEQ ID NO: 2400540 - RNA, 18 nt, Bordetella pertussis
gccaggcugaccagcgcg

SEQ ID NO: 2400541 - RNA, 23 nt, Bordetella pertussis
gccaggcugaccagcgcgucgca

SEQ ID NO: 2400542 - RNA, 22 nt, Bordetella pertussis
gccaggcugucgucgucggcac

SEQ ID NO: 2400543 - RNA, 22 nt, Bordetella pertussis
gccaggcuuugggcaaaacgcg

SEQ ID NO: 2400544 - RNA, 18 nt, Bordetella pertussis
gccagggaaggggcggcu

SEQ ID NO: 2400545 - RNA, 17 nt, Bordetella pertussis
gccagggaaucacccga

SEQ ID NO: 2400546 - RNA, 22 nt, Bordetella pertussis
gccagggaaucacccgauacga

SEQ ID NO: 2400547 - RNA, 20 nt, Bordetella pertussis
gccagggaggcgaugcugac

SEQ ID NO: 2400548 - RNA, 14 nt, Bordetella pertussis
gccagggcagggcg

SEQ ID NO: 2400549 - RNA, 16 nt, Bordetella pertussis
gccagggccacgccgg

SEQ ID NO: 2400550 - RNA, 17 nt, Bordetella pertussis
gccagggccacgccggc

SEQ ID NO: 2400551 - RNA, 19 nt, Bordetella pertussis
gccagggccacgccggccg

SEQ ID NO: 2400552 - RNA, 17 nt, Bordetella pertussis
gccagggccaggccgcc

SEQ ID NO: 2400553 - RNA, 19 nt, Bordetella pertussis
gccagggccauguggcgca

SEQ ID NO: 2400554 - RNA, 20 nt, Bordetella pertussis
gccagggccauguggcgcag

SEQ ID NO: 2400555 - RNA, 22 nt, Bordetella pertussis
gccagggccauguggcgcagcg

SEQ ID NO: 2400556 - RNA, 20 nt, Bordetella pertussis
gccagggccccuccggcgcc

SEQ ID NO: 2400557 - RNA, 13 nt, Bordetella pertussis
gccagggccgccg

SEQ ID NO: 2400558 - RNA, 17 nt, Bordetella pertussis
gccagggccgccgcgcc

SEQ ID NO: 2400559 - RNA, 13 nt, Bordetella pertussis
gccagggccuccu

SEQ ID NO: 2400560 - RNA, 12 nt, Bordetella pertussis
gccagggccucg

SEQ ID NO: 2400561 - RNA, 18 nt, Bordetella pertussis
gccagggccucgcgggcc

SEQ ID NO: 2400562 - RNA, 12 nt, Bordetella pertussis
gccagggccugc

SEQ ID NO: 2400563 - RNA, 18 nt, Bordetella pertussis
gccagggccugcgggccg

SEQ ID NO: 2400564 - RNA, 19 nt, Bordetella pertussis
gccagggccugcgggccgg

SEQ ID NO: 2400565 - RNA, 12 nt, Bordetella pertussis
gccggccagcaa

SEQ ID NO: 2400566 - RNA, 13 nt, Bordetella pertussis
gccggccagcaag

SEQ ID NO: 2400567 - RNA, 12 nt, Bordetella pertussis
gccggccagcag

SEQ ID NO: 2400568 - RNA, 14 nt, Bordetella pertussis
gccggccagcagcg

SEQ ID NO: 2400569 - RNA, 20 nt, Bordetella pertussis
gccggccagcagcgacggcc

SEQ ID NO: 2400570 - RNA, 23 nt, Bordetella pertussis
gccggccagccauugccgcacga

SEQ ID NO: 2400571 - RNA, 13 nt, Bordetella pertussis
gccggccagccug

SEQ ID NO: 2400572 - RNA, 22 nt, Bordetella pertussis
gccggccagccugcccgucgac

SEQ ID NO: 2400573 - RNA, 14 nt, Bordetella pertussis
gccggccagccugu

SEQ ID NO: 2400574 - RNA, 19 nt, Bordetella pertussis
gccggccagccugugcgcc

SEQ ID NO: 2400575 - RNA, 13 nt, Bordetella pertussis
gccggccagcgcc

SEQ ID NO: 2400576 - RNA, 14 nt, Bordetella pertussis
gccggccagcgcca

SEQ ID NO: 2400577 - RNA, 16 nt, Bordetella pertussis
gccggccagcgccacc

SEQ ID NO: 2400578 - RNA, 17 nt, Bordetella pertussis
gccggccagcgccacca

SEQ ID NO: 2400579 - RNA, 15 nt, Bordetella pertussis
gccggccagcgccag

SEQ ID NO: 2400580 - RNA, 16 nt, Bordetella pertussis
gccggccagcgccagu

SEQ ID NO: 2400581 - RNA, 16 nt, Bordetella pertussis
gccggccagcgccugg

SEQ ID NO: 2400582 - RNA, 15 nt, Bordetella pertussis
gccggccagcgcgcc

SEQ ID NO: 2400583 - RNA, 23 nt, Bordetella pertussis
gccggccagcgcgccggccaggg

SEQ ID NO: 2400584 - RNA, 24 nt, Bordetella pertussis
gccggccagcgcgccggccagggc

SEQ ID NO: 2400585 - RNA, 14 nt, Bordetella pertussis
gccggccagcgcgg

SEQ ID NO: 2400586 - RNA, 15 nt, Bordetella pertussis
gccggccagcgcggu

SEQ ID NO: 2400587 - RNA, 12 nt, Bordetella pertussis
gccggccagcgg

SEQ ID NO: 2400588 - RNA, 16 nt, Bordetella pertussis
gccggccagcggcagg

SEQ ID NO: 2400589 - RNA, 12 nt, Bordetella pertussis
gccggccagcug

SEQ ID NO: 2400590 - RNA, 23 nt, Bordetella pertussis
gccggccaggacgaucccggcca

SEQ ID NO: 2400591 - RNA, 18 nt, Bordetella pertussis
gccggccaggaugagggc

SEQ ID NO: 2400592 - RNA, 12 nt, Bordetella pertussis
gccggccaggcc

SEQ ID NO: 2400593 - RNA, 13 nt, Bordetella pertussis
gccggccaggccc

SEQ ID NO: 2400594 - RNA, 14 nt, Bordetella pertussis
gccggccaggcccu

SEQ ID NO: 2400595 - RNA, 15 nt, Bordetella pertussis
gccggccaggcgccg

SEQ ID NO: 2400596 - RNA, 16 nt, Bordetella pertussis
gccggccaggcgccgc

SEQ ID NO: 2400597 - RNA, 17 nt, Bordetella pertussis
gccggccaggcgccgcu

SEQ ID NO: 2400598 - RNA, 22 nt, Bordetella pertussis
gccggccaggcgccgcucagcg

SEQ ID NO: 2400599 - RNA, 14 nt, Bordetella pertussis
gccggccagggcca

SEQ ID NO: 2400600 - RNA, 19 nt, Bordetella pertussis
gccggccagggccaccacg

SEQ ID NO: 2400601 - RNA, 20 nt, Bordetella pertussis
gccggccagggccacgccgg

SEQ ID NO: 2400602 - RNA, 13 nt, Bordetella pertussis
gccggccagggcg

SEQ ID NO: 2400603 - RNA, 16 nt, Bordetella pertussis
gccggccagguagugc

SEQ ID NO: 2400604 - RNA, 15 nt, Bordetella pertussis
gccggccaguggcgc

SEQ ID NO: 2400605 - RNA, 22 nt, Bordetella pertussis
gccggccaguggcgcggcgucg

SEQ ID NO: 2400606 - RNA, 11 nt, Bordetella pertussis
gccggccauca

SEQ ID NO: 2400607 - RNA, 12 nt, Bordetella pertussis
gccggccaucac

SEQ ID NO: 2400608 - RNA, 19 nt, Bordetella pertussis
gccggccaucaggugcagg

SEQ ID NO: 2400609 - RNA, 22 nt, Bordetella pertussis
gccggccaugcucagcagcacc

SEQ ID NO: 2400610 - RNA, 23 nt, Bordetella pertussis
gccggccaugcucagcagcaccg

SEQ ID NO: 2400611 - RNA, 14 nt, Bordetella pertussis
gccggccauggccc

SEQ ID NO: 2400612 - RNA, 15 nt, Bordetella pertussis
gccggccauggccgc

SEQ ID NO: 2400613 - RNA, 16 nt, Bordetella pertussis
gccggccauggccgcc

SEQ ID NO: 2400614 - RNA, 20 nt, Bordetella pertussis
gccggccauggcggccggcg

SEQ ID NO: 2400615 - RNA, 22 nt, Bordetella pertussis
gccggcccaaggccccgcgacc

SEQ ID NO: 2400616 - RNA, 14 nt, Bordetella pertussis
gccggcccagcacg

SEQ ID NO: 2400617 - RNA, 15 nt, Bordetella pertussis
gccggcccagcacgc

SEQ ID NO: 2400618 - RNA, 16 nt, Bordetella pertussis
gccggcccagcacgcc

SEQ ID NO: 2400619 - RNA, 19 nt, Bordetella pertussis
gccggcccagcacgccgcg

SEQ ID NO: 2400620 - RNA, 19 nt, Bordetella pertussis
gccggcccaggauggcgcc

SEQ ID NO: 2400621 - RNA, 20 nt, Bordetella pertussis
gccggcccaggauggcgcca

SEQ ID NO: 2400622 - RNA, 22 nt, Bordetella pertussis
gccggcccaggauggcgccagc

SEQ ID NO: 2400623 - RNA, 13 nt, Bordetella pertussis
gccggcccaggcg

SEQ ID NO: 2400624 - RNA, 15 nt, Bordetella pertussis
gccggcccaggcgcg

SEQ ID NO: 2400625 - RNA, 22 nt, Bordetella pertussis
gccggcccaggcgcgcuggcgc

SEQ ID NO: 2400626 - RNA, 22 nt, Bordetella pertussis
gccggcccaguccagggugucc

SEQ ID NO: 2400627 - RNA, 23 nt, Bordetella pertussis
gccggcccaucuguacggccggc

SEQ ID NO: 2400628 - RNA, 21 nt, Bordetella pertussis
gccggccccauccucaucgug

SEQ ID NO: 2400629 - RNA, 20 nt, Bordetella pertussis
gccggccccgcaaggggccg

SEQ ID NO: 2400630 - RNA, 22 nt, Bordetella pertussis
gccggccccgcaaggggccggc

SEQ ID NO: 2400631 - RNA, 20 nt, Bordetella pertussis
gccggcccgacaccuggacc

SEQ ID NO: 2400632 - RNA, 22 nt, Bordetella pertussis
gccggcccgcaccugaacaccg

SEQ ID NO: 2400633 - RNA, 15 nt, Bordetella pertussis
gccggcccgccacgc

SEQ ID NO: 2400634 - RNA, 19 nt, Bordetella pertussis
gccggcccgccccacggcg

SEQ ID NO: 2400635 - RNA, 13 nt, Bordetella pertussis
gccggcccgccuc

SEQ ID NO: 2400636 - RNA, 12 nt, Bordetella pertussis
gccggcccgcgc

SEQ ID NO: 2400637 - RNA, 17 nt, Bordetella pertussis
gccggcggccagcgcgc

SEQ ID NO: 2400638 - RNA, 18 nt, Bordetella pertussis
gccggcggccagcgcgcc

SEQ ID NO: 2400639 - RNA, 20 nt, Bordetella pertussis
gccggcggccagcgcgccgc

SEQ ID NO: 2400640 - RNA, 21 nt, Bordetella pertussis
gccggcggccagcgcgccgcc

SEQ ID NO: 2400641 - RNA, 15 nt, Bordetella pertussis
gccggcggccagcuu

SEQ ID NO: 2400642 - RNA, 23 nt, Bordetella pertussis
gccggcggcccauucgcgcaccg

SEQ ID NO: 2400643 - RNA, 14 nt, Bordetella pertussis
gccggcggccgguc

SEQ ID NO: 2400644 - RNA, 14 nt, Bordetella pertussis
gccggcggccuccg

SEQ ID NO: 2400645 - RNA, 19 nt, Bordetella pertussis
gccggcggccuccgcgcac

SEQ ID NO: 2400646 - RNA, 14 nt, Bordetella pertussis
gccggcggccugca

SEQ ID NO: 2400647 - RNA, 15 nt, Bordetella pertussis
gccggcggccugcag

SEQ ID NO: 2400648 - RNA, 16 nt, Bordetella pertussis
gccggcggccugcagg

SEQ ID NO: 2400649 - RNA, 15 nt, Bordetella pertussis
gccggcggccuggac

SEQ ID NO: 2400650 - RNA, 16 nt, Bordetella pertussis
gccggcggccuggacc

SEQ ID NO: 2400651 - RNA, 13 nt, Bordetella pertussis
gccggcggcgagc

SEQ ID NO: 2400652 - RNA, 17 nt, Bordetella pertussis
gccggcggcgagcgcgg

SEQ ID NO: 2400653 - RNA, 20 nt, Bordetella pertussis
gccggcggcgaugcgggcca

SEQ ID NO: 2400654 - RNA, 12 nt, Bordetella pertussis
gccggcggcgca

SEQ ID NO: 2400655 - RNA, 14 nt, Bordetella pertussis
gccggcggcgcacc

SEQ ID NO: 2400656 - RNA, 17 nt, Bordetella pertussis
gccggcggcgccggccu

SEQ ID NO: 2400657 - RNA, 13 nt, Bordetella pertussis
gccggcggcgccu

SEQ ID NO: 2400658 - RNA, 15 nt, Bordetella pertussis
gccggcggcgcggau

SEQ ID NO: 2400659 - RNA, 14 nt, Bordetella pertussis
gccggcggcgcugg

SEQ ID NO: 2400660 - RNA, 13 nt, Bordetella pertussis
gccggcggcgggc

SEQ ID NO: 2400661 - RNA, 17 nt, Bordetella pertussis
gccggcggcggucagcg

SEQ ID NO: 2400662 - RNA, 11 nt, Bordetella pertussis
gccggcggcgu

SEQ ID NO: 2400663 - RNA, 21 nt, Bordetella pertussis
gccgggcuggauccggcgcug

SEQ ID NO: 2400664 - RNA, 22 nt, Bordetella pertussis
gccgggcuggauccggcgcugg

SEQ ID NO: 2400665 - RNA, 23 nt, Bordetella pertussis
gccgggcuggauccggcgcuggc

SEQ ID NO: 2400666 - RNA, 13 nt, Bordetella pertussis
gccgggcuggugc

SEQ ID NO: 2400667 - RNA, 15 nt, Bordetella pertussis
gccgggcuggugcgc

SEQ ID NO: 2400668 - RNA, 20 nt, Bordetella pertussis
gccgggcuggugcgccgugc

SEQ ID NO: 2400669 - RNA, 21 nt, Bordetella pertussis
gccgggcuggugcgccgugcc

SEQ ID NO: 2400670 - RNA, 18 nt, Bordetella pertussis
gccgggcuguccgccacc

SEQ ID NO: 2400671 - RNA, 19 nt, Bordetella pertussis
gccgggcuguccgccacca

SEQ ID NO: 2400672 - RNA, 13 nt, Bordetella pertussis
gccgggcuugcgc

SEQ ID NO: 2400673 - RNA, 14 nt, Bordetella pertussis
gccgggcuugcgca

SEQ ID NO: 2400674 - RNA, 16 nt, Bordetella pertussis
gccgggcuugcgcacc

SEQ ID NO: 2400675 - RNA, 17 nt, Bordetella pertussis
gccgggcuugcgcaccc

SEQ ID NO: 2400676 - RNA, 20 nt, Bordetella pertussis
gccggggaagccgccggcgu

SEQ ID NO: 2400677 - RNA, 14 nt, Bordetella pertussis
gccggggaggccuc

SEQ ID NO: 2400678 - RNA, 15 nt, Bordetella pertussis
gccggggcccgcggg

SEQ ID NO: 2400679 - RNA, 17 nt, Bordetella pertussis
gccggggcccgcgggcg

SEQ ID NO: 2400680 - RNA, 24 nt, Bordetella pertussis
gccggggcccgcgggcgcccggcc

SEQ ID NO: 2400681 - RNA, 14 nt, Bordetella pertussis
gccggggccgccca

SEQ ID NO: 2400682 - RNA, 15 nt, Bordetella pertussis
gccggggccgcccug

SEQ ID NO: 2400683 - RNA, 19 nt, Bordetella pertussis
gccggggccgcccugccua

SEQ ID NO: 2400684 - RNA, 16 nt, Bordetella pertussis
gccggggccgcccugg

SEQ ID NO: 2400685 - RNA, 20 nt, Bordetella pertussis
gccggggccgcccuggucau

SEQ ID NO: 2400686 - RNA, 18 nt, Bordetella pertussis
gccggggcgagcgcagcc

SEQ ID NO: 2400687 - RNA, 19 nt, Bordetella pertussis
gccggggcgagcgcagccg

SEQ ID NO: 2400688 - RNA, 23 nt, Bordetella pertussis
gccggggcgagcgcagccgcucc

SEQ ID NO: 2400689 - RNA, 15 nt, Bordetella pertussis
gccggggcgcaccgg

SEQ ID NO: 2400690 - RNA, 22 nt, Bordetella pertussis
gccggggcgcaccggcacgcgc

SEQ ID NO: 2400691 - RNA, 17 nt, Bordetella pertussis
gccggggcggcgcagca

SEQ ID NO: 2400692 - RNA, 20 nt, Bordetella pertussis
gccggggcggcggcgcccgc

SEQ ID NO: 2400693 - RNA, 13 nt, Bordetella pertussis
gccggggcggcuc

SEQ ID NO: 2400694 - RNA, 15 nt, Bordetella pertussis
gccggggcggcucgg

SEQ ID NO: 2400695 - RNA, 20 nt, Bordetella pertussis
gccgggggcguugcggugca

SEQ ID NO: 2400696 - RNA, 16 nt, Bordetella pertussis
gccggggggcgcacgc

SEQ ID NO: 2400697 - RNA, 20 nt, Bordetella pertussis
gccggggggcgcacgccgcg

SEQ ID NO: 2400698 - RNA, 22 nt, Bordetella pertussis
gccggggggcgcacgccgcgcc

SEQ ID NO: 2400699 - RNA, 15 nt, Bordetella pertussis
gccggggucagcgcc

SEQ ID NO: 2400700 - RNA, 16 nt, Bordetella pertussis
gccggggucagcgccg

SEQ ID NO: 2400701 - RNA, 18 nt, Bordetella pertussis
gccggggucagcgccggc

SEQ ID NO: 2400702 - RNA, 21 nt, Bordetella pertussis
gccggggucagcgccggcacg

SEQ ID NO: 2400703 - RNA, 19 nt, Bordetella pertussis
gccggggucuugccgcgca

SEQ ID NO: 2400704 - RNA, 21 nt, Bordetella pertussis
gccggggucuugccgcgcagc

SEQ ID NO: 2400705 - RNA, 23 nt, Bordetella pertussis
gccgggucaucgagguggcgggc

SEQ ID NO: 2400706 - RNA, 15 nt, Bordetella pertussis
gccgggucccuggcc

SEQ ID NO: 2400707 - RNA, 19 nt, Bordetella pertussis
gccgggucccuggcccugg

SEQ ID NO: 2400708 - RNA, 16 nt, Bordetella pertussis
gccggguccggccgcg

SEQ ID NO: 2400709 - RNA, 19 nt, Bordetella pertussis
gccggguccggccgcgcaa

SEQ ID NO: 2400710 - RNA, 15 nt, Bordetella pertussis
gccgggucgaggucg

SEQ ID NO: 2400711 - RNA, 13 nt, Bordetella pertussis
gccgggucgccgg

SEQ ID NO: 2400712 - RNA, 15 nt, Bordetella pertussis
gccgggucgccggug

SEQ ID NO: 2400713 - RNA, 16 nt, Bordetella pertussis
gccgggucgccggugg

SEQ ID NO: 2400714 - RNA, 22 nt, Bordetella pertussis
gccgggucgccgguggugucga

SEQ ID NO: 2400715 - RNA, 14 nt, Bordetella pertussis
gccgggucgcgcag

SEQ ID NO: 2400716 - RNA, 19 nt, Bordetella pertussis
gccgggucgcugugcgcgg

SEQ ID NO: 2400717 - RNA, 15 nt, Bordetella pertussis
gccgggucuggccgg

SEQ ID NO: 2400718 - RNA, 19 nt, Bordetella pertussis
gccgggucuggccggccgc

SEQ ID NO: 2400719 - RNA, 17 nt, Bordetella pertussis
gccggguggguucgggc

SEQ ID NO: 2400720 - RNA, 20 nt, Bordetella pertussis
gccggguggguucgggcguu

SEQ ID NO: 2400721 - RNA, 19 nt, Bordetella pertussis
gccggguggucgcgcccgc

SEQ ID NO: 2400722 - RNA, 20 nt, Bordetella pertussis
gccggguggucgcgcccgcc

SEQ ID NO: 2400723 - RNA, 23 nt, Bordetella pertussis
gccggguggucgcgcccgccgug

SEQ ID NO: 2400724 - RNA, 22 nt, Bordetella pertussis
gccggguguggggggucaggcc

SEQ ID NO: 2400725 - RNA, 19 nt, Bordetella pertussis
gccggguguuccggcgcgc

SEQ ID NO: 2400726 - RNA, 14 nt, Bordetella pertussis
gccggguugucgcc

SEQ ID NO: 2400727 - RNA, 18 nt, Bordetella pertussis
gccggguugucgcccacc

SEQ ID NO: 2400728 - RNA, 15 nt, Bordetella pertussis
gccggguuucucgac

SEQ ID NO: 2400729 - RNA, 24 nt, Bordetella pertussis
gccggguuuuccuuuugcgcggcc

SEQ ID NO: 2400730 - RNA, 20 nt, Bordetella pertussis
gccggguuuuuacaugccgc

SEQ ID NO: 2400731 - RNA, 23 nt, Bordetella pertussis
gccggguuuuuacaugccgcgcg

SEQ ID NO: 2400732 - RNA, 19 nt, Bordetella pertussis
gccgguaaccgacgcagcg

SEQ ID NO: 2400733 - RNA, 22 nt, Bordetella pertussis
gccgguaaccgacgcagcgcac

SEQ ID NO: 2400734 - RNA, 19 nt, Bordetella pertussis
gccgguaaggcgcuugcgc

SEQ ID NO: 2400735 - RNA, 21 nt, Bordetella pertussis
gccgguaaggcgcuugcgcag

SEQ ID NO: 2400736 - RNA, 18 nt, Bordetella pertussis
gccgguacagccaggcca

SEQ ID NO: 2400737 - RNA, 15 nt, Bordetella pertussis
gccgguagcgcuggg

SEQ ID NO: 2400738 - RNA, 16 nt, Bordetella pertussis
gccgguagcgcugggc

SEQ ID NO: 2400739 - RNA, 20 nt, Bordetella pertussis
gccgguagcgcugggcgcca

SEQ ID NO: 2400740 - RNA, 22 nt, Bordetella pertussis
gccgguagcgcugggcgccagc

SEQ ID NO: 2400741 - RNA, 23 nt, Bordetella pertussis
gccgguagcgcugggcgccagca

SEQ ID NO: 2400742 - RNA, 13 nt, Bordetella pertussis
gccgguaucgacg

SEQ ID NO: 2400743 - RNA, 16 nt, Bordetella pertussis
gccgguaucgacgcgc

SEQ ID NO: 2400744 - RNA, 17 nt, Bordetella pertussis
gccgguaucgacgcgcg

SEQ ID NO: 2400745 - RNA, 14 nt, Bordetella pertussis
gccgguaucgcggc

SEQ ID NO: 2400746 - RNA, 15 nt, Bordetella pertussis
gccgguaucgcggcg

SEQ ID NO: 2400747 - RNA, 17 nt, Bordetella pertussis
gccgguaucgcggcgca

SEQ ID NO: 2400748 - RNA, 18 nt, Bordetella pertussis
gccgguaucgcggcgcag

SEQ ID NO: 2400749 - RNA, 22 nt, Bordetella pertussis
gccgguaucgguguggugcugc

SEQ ID NO: 2400750 - RNA, 15 nt, Bordetella pertussis
gccggucaccgccgc

SEQ ID NO: 2400751 - RNA, 16 nt, Bordetella pertussis
gccggucaccgccgcc

SEQ ID NO: 2400752 - RNA, 14 nt, Bordetella pertussis
gccggucacgcugg

SEQ ID NO: 2400753 - RNA, 15 nt, Bordetella pertussis
gccggucacgcuggu

SEQ ID NO: 2400754 - RNA, 19 nt, Bordetella pertussis
gccggucacgcugguggcc

SEQ ID NO: 2400755 - RNA, 19 nt, Bordetella pertussis
gccggucacugccgaaacg

SEQ ID NO: 2400756 - RNA, 20 nt, Bordetella pertussis
gccggucacugccgaaacgc

SEQ ID NO: 2400757 - RNA, 16 nt, Bordetella pertussis
gccggucagcccaggc

SEQ ID NO: 2400758 - RNA, 17 nt, Bordetella pertussis
gccggucagcccaggcg

SEQ ID NO: 2400759 - RNA, 19 nt, Bordetella pertussis
gccggucaggaaguccugg

SEQ ID NO: 2400760 - RNA, 13 nt, Bordetella pertussis
gccggucaggcgu

SEQ ID NO: 2400761 - RNA, 14 nt, Bordetella pertussis
gccggucagggagg

SEQ ID NO: 2400762 - RNA, 20 nt, Bordetella pertussis
gccggucaugcaccugcagg

SEQ ID NO: 2400763 - RNA, 12 nt, Bordetella pertussis
gccgguccagcg

SEQ ID NO: 2400764 - RNA, 14 nt, Bordetella pertussis
gccgguccagcgcc

SEQ ID NO: 2400765 - RNA, 17 nt, Bordetella pertussis
gccgguccagcgcccga

SEQ ID NO: 2400766 - RNA, 18 nt, Bordetella pertussis
gccgguccgcucgaggcc

SEQ ID NO: 2400767 - RNA, 21 nt, Bordetella pertussis
gccgguccgcucgaggccagg

SEQ ID NO: 2400768 - RNA, 22 nt, Bordetella pertussis
gccgguccgcucgaggccaggc

SEQ ID NO: 2400769 - RNA, 24 nt, Bordetella pertussis
gccgguccgcucgaggccaggcug

SEQ ID NO: 2400770 - RNA, 14 nt, Bordetella pertussis
gccggucgccagcg

SEQ ID NO: 2400771 - RNA, 15 nt, Bordetella pertussis
gccggucgccagcga

SEQ ID NO: 2400772 - RNA, 13 nt, Bordetella pertussis
gccggucgcggcg

SEQ ID NO: 2400773 - RNA, 19 nt, Bordetella pertussis
gccggucggccgcuccgcc

SEQ ID NO: 2400774 - RNA, 16 nt, Bordetella pertussis
gccggucuccagcgcg

SEQ ID NO: 2400775 - RNA, 22 nt, Bordetella pertussis
gccggucuccagcgcgucggcc

SEQ ID NO: 2400776 - RNA, 21 nt, Bordetella pertussis
gccggucugcauguaguucac

SEQ ID NO: 2400777 - RNA, 22 nt, Bordetella pertussis
gccucgcgcucgcgcucggcca

SEQ ID NO: 2400778 - RNA, 19 nt, Bordetella pertussis
gccucgcggcgcagcauga

SEQ ID NO: 2400779 - RNA, 14 nt, Bordetella pertussis
gccucgcggcgcgu

SEQ ID NO: 2400780 - RNA, 17 nt, Bordetella pertussis
gccucgcgggccuuggc

SEQ ID NO: 2400781 - RNA, 19 nt, Bordetella pertussis
gccucgcgggccuuggcca

SEQ ID NO: 2400782 - RNA, 15 nt, Bordetella pertussis
gccucgcugccaggg

SEQ ID NO: 2400783 - RNA, 16 nt, Bordetella pertussis
gccucgcugccagggu

SEQ ID NO: 2400784 - RNA, 18 nt, Bordetella pertussis
gccucgcugcgggcggcc

SEQ ID NO: 2400785 - RNA, 19 nt, Bordetella pertussis
gccucgcuggagaccggca

SEQ ID NO: 2400786 - RNA, 12 nt, Bordetella pertussis
gccucgcuggcg

SEQ ID NO: 2400787 - RNA, 14 nt, Bordetella pertussis
gccucggacgccug

SEQ ID NO: 2400788 - RNA, 16 nt, Bordetella pertussis
gccucggacgccuggc

SEQ ID NO: 2400789 - RNA, 21 nt, Bordetella pertussis
gccucggacgccuggcgcggc

SEQ ID NO: 2400790 - RNA, 23 nt, Bordetella pertussis
gccucggacgccuggcgcggccc

SEQ ID NO: 2400791 - RNA, 15 nt, Bordetella pertussis
gccucggcauggcgc

SEQ ID NO: 2400792 - RNA, 18 nt, Bordetella pertussis
gccucggcauggcgcgcg

SEQ ID NO: 2400793 - RNA, 12 nt, Bordetella pertussis
gccucggccacc

SEQ ID NO: 2400794 - RNA, 15 nt, Bordetella pertussis
gccucggccaccugg

SEQ ID NO: 2400795 - RNA, 16 nt, Bordetella pertussis
gccucggccaccuggc

SEQ ID NO: 2400796 - RNA, 19 nt, Bordetella pertussis
gccucggccaccuggcgca

SEQ ID NO: 2400797 - RNA, 22 nt, Bordetella pertussis
gccucggccaccuggcgcaagg

SEQ ID NO: 2400798 - RNA, 12 nt, Bordetella pertussis
gccucggccagc

SEQ ID NO: 2400799 - RNA, 17 nt, Bordetella pertussis
gccucggccagcugggc

SEQ ID NO: 2400800 - RNA, 21 nt, Bordetella pertussis
gccucggccaggaaagccggc

SEQ ID NO: 2400801 - RNA, 22 nt, Bordetella pertussis
gccucggccaggaaagccggcg

SEQ ID NO: 2400802 - RNA, 13 nt, Bordetella pertussis
gccucggccggca

SEQ ID NO: 2400803 - RNA, 15 nt, Bordetella pertussis
gccucggccggcagg

SEQ ID NO: 2400804 - RNA, 19 nt, Bordetella pertussis
gccucggcgaagugcccgc

SEQ ID NO: 2400805 - RNA, 22 nt, Bordetella pertussis
gccucggcgcgcgcggcgccgc

SEQ ID NO: 2400806 - RNA, 15 nt, Bordetella pertussis
gccucggcggccagc

SEQ ID NO: 2400807 - RNA, 18 nt, Bordetella pertussis
gccucggcggccagcgcg

SEQ ID NO: 2400808 - RNA, 19 nt, Bordetella pertussis
gccucggcggccagcgcgc

SEQ ID NO: 2400809 - RNA, 23 nt, Bordetella pertussis
gccucggcggccagcgcgcccuc

SEQ ID NO: 2400810 - RNA, 13 nt, Bordetella pertussis
gccucggcggccu

SEQ ID NO: 2400811 - RNA, 21 nt, Bordetella pertussis
gccucggcggccuccggcagg

SEQ ID NO: 2400812 - RNA, 16 nt, Bordetella pertussis
gccucggcuccgccau

SEQ ID NO: 2400813 - RNA, 18 nt, Bordetella pertussis
gccucggcuccgccauug

SEQ ID NO: 2400814 - RNA, 14 nt, Bordetella pertussis
gccucggcuugcgc

SEQ ID NO: 2400815 - RNA, 13 nt, Bordetella pertussis
gccucgggcacgg

SEQ ID NO: 2400816 - RNA, 16 nt, Bordetella pertussis
gccucgggcacggcca

SEQ ID NO: 2400817 - RNA, 19 nt, Bordetella pertussis
gccucgggcacggccagca

SEQ ID NO: 2400818 - RNA, 21 nt, Bordetella pertussis
gccucgggcacggccagcacc

SEQ ID NO: 2400819 - RNA, 14 nt, Bordetella pertussis
gccucgggcgcaac

SEQ ID NO: 2400820 - RNA, 22 nt, Bordetella pertussis
gccucgggcgcaacgucgaaca

SEQ ID NO: 2400821 - RNA, 16 nt, Bordetella pertussis
gccucggucagggugg

SEQ ID NO: 2400822 - RNA, 14 nt, Bordetella pertussis
gccucgguccagcg

SEQ ID NO: 2400823 - RNA, 15 nt, Bordetella pertussis
gccucggucgccucg

SEQ ID NO: 2400824 - RNA, 16 nt, Bordetella pertussis
gccucguaggccauca

SEQ ID NO: 2400825 - RNA, 16 nt, Bordetella pertussis
gccucguccacgucgu

SEQ ID NO: 2400826 - RNA, 13 nt, Bordetella pertussis
gccucguccucgu

SEQ ID NO: 2400827 - RNA, 14 nt, Bordetella pertussis
gccucguccugcag

SEQ ID NO: 2400828 - RNA, 17 nt, Bordetella pertussis
gccucguccugcaggcg

SEQ ID NO: 2400829 - RNA, 19 nt, Bordetella pertussis
gccucguccugcaggcggc

SEQ ID NO: 2400830 - RNA, 21 nt, Bordetella pertussis
gccucguccugcaggcggcgc

SEQ ID NO: 2400831 - RNA, 20 nt, Bordetella pertussis
gccucgucgaccacgccggc

SEQ ID NO: 2400832 - RNA, 21 nt, Bordetella pertussis
gccucgucgaccacgccggcg

SEQ ID NO: 2400833 - RNA, 13 nt, Bordetella pertussis
gccucgucgcgca

SEQ ID NO: 2400834 - RNA, 15 nt, Bordetella pertussis
gccucgucgcgcaac

SEQ ID NO: 2400835 - RNA, 16 nt, Bordetella pertussis
gccucgucgcgcaacg

SEQ ID NO: 2400836 - RNA, 21 nt, Bordetella pertussis
gccucgucgcgcaacgccggg

SEQ ID NO: 2400837 - RNA, 22 nt, Bordetella pertussis
gccucgucgcgcaacgccgggu

SEQ ID NO: 2400838 - RNA, 18 nt, Bordetella pertussis
gccucgugcgaggccacg

SEQ ID NO: 2400839 - RNA, 20 nt, Bordetella pertussis
gccucgugcgaggccacggc

SEQ ID NO: 2400840 - RNA, 18 nt, Bordetella pertussis
gccucgugcugcugcagg

SEQ ID NO: 2400841 - RNA, 21 nt, Bordetella pertussis
gccucguucaugucgcgggug

SEQ ID NO: 2400842 - RNA, 21 nt, Bordetella pertussis
gccucguuccuguuccugcag

SEQ ID NO: 2400843 - RNA, 23 nt, Bordetella pertussis
gccucguuccuguuccugcaggg

SEQ ID NO: 2400844 - RNA, 16 nt, Bordetella pertussis
gccucguuggucagca

SEQ ID NO: 2400845 - RNA, 20 nt, Bordetella pertussis
gccucguuggucagcaccuc

SEQ ID NO: 2400846 - RNA, 23 nt, Bordetella pertussis
gccucguuggucagcaccucggc

SEQ ID NO: 2400847 - RNA, 14 nt, Bordetella pertussis
gccucuggaagacg

SEQ ID NO: 2400848 - RNA, 20 nt, Bordetella pertussis
gccucuucgucgccggcgcu

SEQ ID NO: 2400849 - RNA, 15 nt, Bordetella pertussis
gccucuugcgugacc

SEQ ID NO: 2400850 - RNA, 20 nt, Bordetella pertussis
gccugaaccaggccgccagg

SEQ ID NO: 2400851 - RNA, 16 nt, Bordetella pertussis
gccugacgcgcaagcg

SEQ ID NO: 2400852 - RNA, 22 nt, Bordetella pertussis
gccugacgcgcaagcggcccca

SEQ ID NO: 2400853 - RNA, 18 nt, Bordetella pertussis
gccugacgcucauccagg

SEQ ID NO: 2400854 - RNA, 19 nt, Bordetella pertussis
gccugacgcucauccaggc

SEQ ID NO: 2400855 - RNA, 21 nt, Bordetella pertussis
gccugacgcucauccaggcgc

SEQ ID NO: 2400856 - RNA, 20 nt, Bordetella pertussis
gccugacggcuacacccugc

SEQ ID NO: 2400857 - RNA, 16 nt, Bordetella pertussis
gccugacgggccucga

SEQ ID NO: 2400858 - RNA, 21 nt, Bordetella pertussis
gccugacgugcgccacagcau

SEQ ID NO: 2400859 - RNA, 13 nt, Bordetella pertussis
gccugacguucgg

SEQ ID NO: 2400860 - RNA, 16 nt, Bordetella pertussis
gccugacguucggggc

SEQ ID NO: 2400861 - RNA, 16 nt, Bordetella pertussis
gccugagcaccgccgc

SEQ ID NO: 2400862 - RNA, 18 nt, Bordetella pertussis
gccugagcaccgccgcgu

SEQ ID NO: 2400863 - RNA, 21 nt, Bordetella pertussis
gccugagccgauacaggcgcu

SEQ ID NO: 2400864 - RNA, 23 nt, Bordetella pertussis
gccugagccgauacaggcgcucg

SEQ ID NO: 2400865 - RNA, 17 nt, Bordetella pertussis
gccugagcugccaggcu

SEQ ID NO: 2400866 - RNA, 14 nt, Bordetella pertussis
gccugaggcccgau

SEQ ID NO: 2400867 - RNA, 15 nt, Bordetella pertussis
gccugaggcccgaug

SEQ ID NO: 2400868 - RNA, 16 nt, Bordetella pertussis
gccugaggcccgaugg

SEQ ID NO: 2400869 - RNA, 22 nt, Bordetella pertussis
gccugaggcccgauggcgggga

SEQ ID NO: 2400870 - RNA, 16 nt, Bordetella pertussis
gccugaugcgcagacg

SEQ ID NO: 2400871 - RNA, 18 nt, Bordetella pertussis
gccugauggcgcguguca

SEQ ID NO: 2400872 - RNA, 18 nt, Bordetella pertussis
gccugauucccaggcccg

SEQ ID NO: 2400873 - RNA, 21 nt, Bordetella pertussis
gccugcaaaaaacaagcucgc

SEQ ID NO: 2400874 - RNA, 18 nt, Bordetella pertussis
gccugcaaguccagcgug

SEQ ID NO: 2400875 - RNA, 14 nt, Bordetella pertussis
gccugcaaugcggc

SEQ ID NO: 2400876 - RNA, 16 nt, Bordetella pertussis
gccugcaaugcggcca

SEQ ID NO: 2400877 - RNA, 22 nt, Bordetella pertussis
gccugcaaugcggccaggcccg

SEQ ID NO: 2400878 - RNA, 13 nt, Bordetella pertussis
gccugcaccgccg

SEQ ID NO: 2400879 - RNA, 15 nt, Bordetella pertussis
gccugcaccgccgcg

SEQ ID NO: 2400880 - RNA, 17 nt, Bordetella pertussis
gccugcacgaccugcgc

SEQ ID NO: 2400881 - RNA, 23 nt, Bordetella pertussis
gccugcacgacgggauugccguc

SEQ ID NO: 2400882 - RNA, 18 nt, Bordetella pertussis
gccugcacgcucuugagc

SEQ ID NO: 2400883 - RNA, 20 nt, Bordetella pertussis
gccugcacgcucuugagcgc

SEQ ID NO: 2400884 - RNA, 23 nt, Bordetella pertussis
gccugcacgcucuugagcgcggc

SEQ ID NO: 2400885 - RNA, 18 nt, Bordetella pertussis
gccugcacgucccagucg

SEQ ID NO: 2400886 - RNA, 14 nt, Bordetella pertussis
gccugcagaccagc

SEQ ID NO: 2400887 - RNA, 16 nt, Bordetella pertussis
gccugcagaccagcac

SEQ ID NO: 2400888 - RNA, 22 nt, Bordetella pertussis
gccugcagaccagcaccggcac

SEQ ID NO: 2400889 - RNA, 18 nt, Bordetella pertussis
gccugcagcacggccacg

SEQ ID NO: 2400890 - RNA, 15 nt, Bordetella pertussis
gccugcagcagcggc

SEQ ID NO: 2400891 - RNA, 15 nt, Bordetella pertussis
gccggucuggucggc

SEQ ID NO: 2400892 - RNA, 17 nt, Bordetella pertussis
gccggucuggucggcga

SEQ ID NO: 2400893 - RNA, 15 nt, Bordetella pertussis
gccggugaccgccag

SEQ ID NO: 2400894 - RNA, 17 nt, Bordetella pertussis
gccggugaccgccagca

SEQ ID NO: 2400895 - RNA, 19 nt, Bordetella pertussis
gccggugauaugcgccagg

SEQ ID NO: 2400896 - RNA, 22 nt, Bordetella pertussis
gccggugauaugcgccaggccc

SEQ ID NO: 2400897 - RNA, 18 nt, Bordetella pertussis
gccguccaggcgccgcac

SEQ ID NO: 2400898 - RNA, 23 nt, Bordetella pertussis
gccguccaggcgccgcacgccgg

SEQ ID NO: 2400899 - RNA, 18 nt, Bordetella pertussis
gccguccagucccguggc

SEQ ID NO: 2400900 - RNA, 20 nt, Bordetella pertussis
gccguccagucccguggcgc

SEQ ID NO: 2400901 - RNA, 16 nt, Bordetella pertussis
gccguccgagcccgac

SEQ ID NO: 2400902 - RNA, 19 nt, Bordetella pertussis
gccguccgagcccgacgcg

SEQ ID NO: 2400903 - RNA, 15 nt, Bordetella pertussis
gccguccgcaucgcg

SEQ ID NO: 2400904 - RNA, 13 nt, Bordetella pertussis
gccguccggccgu

SEQ ID NO: 2400905 - RNA, 16 nt, Bordetella pertussis
gccguccggccgugcc

SEQ ID NO: 2400906 - RNA, 20 nt, Bordetella pertussis
gccguccggccgugccgccc

SEQ ID NO: 2400907 - RNA, 15 nt, Bordetella pertussis
gccguccgggccggu

SEQ ID NO: 2400908 - RNA, 21 nt, Bordetella pertussis
gccguccgugagugcagcgcu

SEQ ID NO: 2400909 - RNA, 15 nt, Bordetella pertussis
gccguccucgcgggc

SEQ ID NO: 2400910 - RNA, 16 nt, Bordetella pertussis
gccguccucgcgggcc

SEQ ID NO: 2400911 - RNA, 19 nt, Bordetella pertussis
gccguccucgcgggccugg

SEQ ID NO: 2400912 - RNA, 14 nt, Bordetella pertussis
gccguccuggccgu

SEQ ID NO: 2400913 - RNA, 16 nt, Bordetella pertussis
gccguccuggccguca

SEQ ID NO: 2400914 - RNA, 16 nt, Bordetella pertussis
gccguccuggcgaccg

SEQ ID NO: 2400915 - RNA, 21 nt, Bordetella pertussis
gccguccuggcgaccggcggc

SEQ ID NO: 2400916 - RNA, 16 nt, Bordetella pertussis
gccguccuuggcgccg

SEQ ID NO: 2400917 - RNA, 22 nt, Bordetella pertussis
gccguccuuggcgccggcgaug

SEQ ID NO: 2400918 - RNA, 17 nt, Bordetella pertussis
gccguccuugugccagg

SEQ ID NO: 2400919 - RNA, 18 nt, Bordetella pertussis
gccgucgaacuccugcag

SEQ ID NO: 2400920 - RNA, 20 nt, Bordetella pertussis
gccgucgaacuccugcagca

SEQ ID NO: 2400921 - RNA, 17 nt, Bordetella pertussis
gccgucgaagccggcgc

SEQ ID NO: 2400922 - RNA, 15 nt, Bordetella pertussis
gccgucgaaggccgc

SEQ ID NO: 2400923 - RNA, 20 nt, Bordetella pertussis
gccgucgaccccgucgaccg

SEQ ID NO: 2400924 - RNA, 15 nt, Bordetella pertussis
gccgucgaccgacag

SEQ ID NO: 2400925 - RNA, 18 nt, Bordetella pertussis
gccgucgaccgacagcac

SEQ ID NO: 2400926 - RNA, 16 nt, Bordetella pertussis
gccgucgagaaugacg

SEQ ID NO: 2400927 - RNA, 22 nt, Bordetella pertussis
gccgucgagaaugacgguggug

SEQ ID NO: 2400928 - RNA, 21 nt, Bordetella pertussis
gccgucgagcaucccggcgcu

SEQ ID NO: 2400929 - RNA, 16 nt, Bordetella pertussis
gccgucgagccgggcg

SEQ ID NO: 2400930 - RNA, 17 nt, Bordetella pertussis
gccgucgagccgggcgc

SEQ ID NO: 2400931 - RNA, 19 nt, Bordetella pertussis
gccgucgagccgggcgccg

SEQ ID NO: 2400932 - RNA, 22 nt, Bordetella pertussis
gccgucgagcgcgaaauccagc

SEQ ID NO: 2400933 - RNA, 20 nt, Bordetella pertussis
gccgucgagcgcggccaggc

SEQ ID NO: 2400934 - RNA, 24 nt, Bordetella pertussis
gccgucgagcgcggccaggcgcgu

SEQ ID NO: 2400935 - RNA, 23 nt, Bordetella pertussis
gccgucgagcugcucgagcaugc

SEQ ID NO: 2400936 - RNA, 18 nt, Bordetella pertussis
gccgucgaugaugcgguu

SEQ ID NO: 2400937 - RNA, 20 nt, Bordetella pertussis
gccgucgaugaugcgguuga

SEQ ID NO: 2400938 - RNA, 21 nt, Bordetella pertussis
gccgucgaugaugcgguugau

SEQ ID NO: 2400939 - RNA, 12 nt, Bordetella pertussis
gccgucgcacug

SEQ ID NO: 2400940 - RNA, 18 nt, Bordetella pertussis
gccgucgccaaagcgcag

SEQ ID NO: 2400941 - RNA, 20 nt, Bordetella pertussis
gccgucgccaaagcgcagcg

SEQ ID NO: 2400942 - RNA, 13 nt, Bordetella pertussis
gccgucgccagcg

SEQ ID NO: 2400943 - RNA, 14 nt, Bordetella pertussis
gccgucgccagcga

SEQ ID NO: 2400944 - RNA, 13 nt, Bordetella pertussis
gccgucgcccugg

SEQ ID NO: 2400945 - RNA, 16 nt, Bordetella pertussis
gccgucgcccuggcgg

SEQ ID NO: 2400946 - RNA, 19 nt, Bordetella pertussis
gccgucgcccuggcggcgg

SEQ ID NO: 2400947 - RNA, 15 nt, Bordetella pertussis
gccgucgccgaucgg

SEQ ID NO: 2400948 - RNA, 16 nt, Bordetella pertussis
gccgucgccgaucggc

SEQ ID NO: 2400949 - RNA, 14 nt, Bordetella pertussis
gccgucgccgccca

SEQ ID NO: 2400950 - RNA, 18 nt, Bordetella pertussis
gccgucgccgcccacggc

SEQ ID NO: 2400951 - RNA, 16 nt, Bordetella pertussis
gccgucgccgcccugc

SEQ ID NO: 2400952 - RNA, 23 nt, Bordetella pertussis
gccgucgccgcccugcugcccgc

SEQ ID NO: 2400953 - RNA, 13 nt, Bordetella pertussis
gccgucgccgcgc

SEQ ID NO: 2400954 - RNA, 16 nt, Bordetella pertussis
gccgucgccuucggcg

SEQ ID NO: 2400955 - RNA, 13 nt, Bordetella pertussis
gccgucgcgcacc

SEQ ID NO: 2400956 - RNA, 15 nt, Bordetella pertussis
gccgucgcgcaccac

SEQ ID NO: 2400957 - RNA, 20 nt, Bordetella pertussis
gccgucgcgcaccaccuggc

SEQ ID NO: 2400958 - RNA, 13 nt, Bordetella pertussis
gccgucgcgcugc

SEQ ID NO: 2400959 - RNA, 21 nt, Bordetella pertussis
gccgucgcgcuguuccagcca

SEQ ID NO: 2400960 - RNA, 21 nt, Bordetella pertussis
gccgucggccacguccggguu

SEQ ID NO: 2400961 - RNA, 15 nt, Bordetella pertussis
gccgucggccagcuu

SEQ ID NO: 2400962 - RNA, 22 nt, Bordetella pertussis
gccgugaucuugaugccgccca

SEQ ID NO: 2400963 - RNA, 15 nt, Bordetella pertussis
gccgugaugccgccc

SEQ ID NO: 2400964 - RNA, 16 nt, Bordetella pertussis
gccgugaugccgcccg

SEQ ID NO: 2400965 - RNA, 17 nt, Bordetella pertussis
gccgugaugccgcccgc

SEQ ID NO: 2400966 - RNA, 18 nt, Bordetella pertussis
gccgugaugccgcccgca

SEQ ID NO: 2400967 - RNA, 22 nt, Bordetella pertussis
gccgugaugccgcccgcaugca

SEQ ID NO: 2400968 - RNA, 14 nt, Bordetella pertussis
gccgugcagacggc

SEQ ID NO: 2400969 - RNA, 14 nt, Bordetella pertussis
gccgugcagauggc

SEQ ID NO: 2400970 - RNA, 15 nt, Bordetella pertussis
gccgugcagauggcg

SEQ ID NO: 2400971 - RNA, 13 nt, Bordetella pertussis
gccgugcaggccc

SEQ ID NO: 2400972 - RNA, 23 nt, Bordetella pertussis
gccgugccagauacccacuucga

SEQ ID NO: 2400973 - RNA, 23 nt, Bordetella pertussis
gccgugcccgacggacuggcugg

SEQ ID NO: 2400974 - RNA, 13 nt, Bordetella pertussis
gccgugcccgagg

SEQ ID NO: 2400975 - RNA, 17 nt, Bordetella pertussis
gccgugcccgagggcgc

SEQ ID NO: 2400976 - RNA, 18 nt, Bordetella pertussis
gccgugcccgagggcgcg

SEQ ID NO: 2400977 - RNA, 14 nt, Bordetella pertussis
gccgugcccggcgg

SEQ ID NO: 2400978 - RNA, 19 nt, Bordetella pertussis
gccgugcccggcgggccgc

SEQ ID NO: 2400979 - RNA, 19 nt, Bordetella pertussis
gccgugccgcccgguucgc

SEQ ID NO: 2400980 - RNA, 20 nt, Bordetella pertussis
gccgugccgcccgguucgcc

SEQ ID NO: 2400981 - RNA, 15 nt, Bordetella pertussis
gccgugccgcgcgca

SEQ ID NO: 2400982 - RNA, 22 nt, Bordetella pertussis
gccgugccgcgcgcaccggcuu

SEQ ID NO: 2400983 - RNA, 15 nt, Bordetella pertussis
gccgugccgggccug

SEQ ID NO: 2400984 - RNA, 17 nt, Bordetella pertussis
gccgugccgggccuggu

SEQ ID NO: 2400985 - RNA, 22 nt, Bordetella pertussis
gccgugccucaacuggccggcc

SEQ ID NO: 2400986 - RNA, 16 nt, Bordetella pertussis
gccgugcgagcacggc

SEQ ID NO: 2400987 - RNA, 22 nt, Bordetella pertussis
gccgugcgaggcgaacaggcac

SEQ ID NO: 2400988 - RNA, 14 nt, Bordetella pertussis
gccgugcgccagcg

SEQ ID NO: 2400989 - RNA, 16 nt, Bordetella pertussis
gccgugcgccagcgcc

SEQ ID NO: 2400990 - RNA, 19 nt, Bordetella pertussis
gccgugcgccagcgccagc

SEQ ID NO: 2400991 - RNA, 19 nt, Bordetella pertussis
gccgugcgcgggcgcggca

SEQ ID NO: 2400992 - RNA, 22 nt, Bordetella pertussis
gccgugcuggaggugccguccg

SEQ ID NO: 2400993 - RNA, 20 nt, Bordetella pertussis
gccgugcugggcggccaggc

SEQ ID NO: 2400994 - RNA, 23 nt, Bordetella pertussis
gccgugcuggucauugaccugcu

SEQ ID NO: 2400995 - RNA, 19 nt, Bordetella pertussis
gccgugcugguuguccacc

SEQ ID NO: 2400996 - RNA, 22 nt, Bordetella pertussis
gccgugcuguaccucagccugc

SEQ ID NO: 2400997 - RNA, 23 nt, Bordetella pertussis
gccgugcuucucguagaacgcau

SEQ ID NO: 2400998 - RNA, 15 nt, Bordetella pertussis
gccguggaggcggcg

SEQ ID NO: 2400999 - RNA, 20 nt, Bordetella pertussis
gccguggccaagggcgccgc

SEQ ID NO: 2401000 - RNA, 14 nt, Bordetella pertussis
gccguggcccagcc

SEQ ID NO: 2401001 - RNA, 15 nt, Bordetella pertussis
gccguggcccagccg

SEQ ID NO: 2401002 - RNA, 16 nt, Bordetella pertussis
gccguggccggcaucg

SEQ ID NO: 2401003 - RNA, 19 nt, Bordetella pertussis
gccguggccgggcccggcg

SEQ ID NO: 2401004 - RNA, 15 nt, Bordetella pertussis
gccguggcgcaaggc

SEQ ID NO: 2401005 - RNA, 13 nt, Bordetella pertussis
gccguggcgcacc

SEQ ID NO: 2401006 - RNA, 14 nt, Bordetella pertussis
gccguggcgcacca

SEQ ID NO: 2401007 - RNA, 12 nt, Bordetella pertussis
gccguggcggcc

SEQ ID NO: 2401008 - RNA, 15 nt, Bordetella pertussis
gccguggcggccaca

SEQ ID NO: 2401009 - RNA, 14 nt, Bordetella pertussis
gccguggcggccug

SEQ ID NO: 2401010 - RNA, 16 nt, Bordetella pertussis
gccguggcgugcaggc

SEQ ID NO: 2401011 - RNA, 18 nt, Bordetella pertussis
gccguggcgugcaggccg

SEQ ID NO: 2401012 - RNA, 19 nt, Bordetella pertussis
gccguggcgugcaggccgg

SEQ ID NO: 2401013 - RNA, 23 nt, Bordetella pertussis
gccguggcgugcaggccggcggc

SEQ ID NO: 2401014 - RNA, 21 nt, Bordetella pertussis
gccguggcguugacggcccag

SEQ ID NO: 2401015 - RNA, 17 nt, Bordetella pertussis
gccgugggacaggcacu

SEQ ID NO: 2401016 - RNA, 14 nt, Bordetella pertussis
gccgugguacgugg

SEQ ID NO: 2401017 - RNA, 20 nt, Bordetella pertussis
gccguggugcugaccggcuu

SEQ ID NO: 2401018 - RNA, 17 nt, Bordetella pertussis
gccguguaggcggucuu

SEQ ID NO: 2401019 - RNA, 20 nt, Bordetella pertussis
gccguguucgagcaggcgcg

SEQ ID NO: 2401020 - RNA, 22 nt, Bordetella pertussis
gccguguucgagcaggcgcgcg

SEQ ID NO: 2401021 - RNA, 16 nt, Bordetella pertussis
gccguuaugcggacgc

SEQ ID NO: 2401022 - RNA, 20 nt, Bordetella pertussis
gccguucagggacgggccag

SEQ ID NO: 2401023 - RNA, 22 nt, Bordetella pertussis
gccguucagggacgggccagcc

SEQ ID NO: 2401024 - RNA, 22 nt, Bordetella pertussis
gccguucagguucaucagccgg

SEQ ID NO: 2401025 - RNA, 17 nt, Bordetella pertussis
gccguucaucagcgcgc

SEQ ID NO: 2401026 - RNA, 22 nt, Bordetella pertussis
gccguucaucagcgcgcgcagc

SEQ ID NO: 2401027 - RNA, 21 nt, Bordetella pertussis
gccguucaugccgaccacggc

SEQ ID NO: 2401028 - RNA, 13 nt, Bordetella pertussis
gccguuccagcug

SEQ ID NO: 2401029 - RNA, 14 nt, Bordetella pertussis
gccguuccagucca

SEQ ID NO: 2401030 - RNA, 17 nt, Bordetella pertussis
gccguuccaguccagcg

SEQ ID NO: 2401031 - RNA, 22 nt, Bordetella pertussis
gccguuccaguccagcgucggc

SEQ ID NO: 2401032 - RNA, 14 nt, Bordetella pertussis
gccguucccgccgg

SEQ ID NO: 2401033 - RNA, 22 nt, Bordetella pertussis
gccguuccugcagcgugcugcg

SEQ ID NO: 2401034 - RNA, 13 nt, Bordetella pertussis
gccguucggccag

SEQ ID NO: 2401035 - RNA, 14 nt, Bordetella pertussis
gccguucggccagc

SEQ ID NO: 2401036 - RNA, 15 nt, Bordetella pertussis
gccguucggccagcg

SEQ ID NO: 2401037 - RNA, 14 nt, Bordetella pertussis
gccguucggugcgc

SEQ ID NO: 2401038 - RNA, 18 nt, Bordetella pertussis
gccguucggugcgcagcg

SEQ ID NO: 2401039 - RNA, 20 nt, Bordetella pertussis
gccguucggugcgcagcggc

SEQ ID NO: 2401040 - RNA, 21 nt, Bordetella pertussis
gccguucggugcgcagcggca

SEQ ID NO: 2401041 - RNA, 16 nt, Bordetella pertussis
gccguucgucgcgcag

SEQ ID NO: 2401042 - RNA, 17 nt, Bordetella pertussis
gccguucgucgcgcagc

SEQ ID NO: 2401043 - RNA, 23 nt, Bordetella pertussis
gccguucuggcagugcgccuggc

SEQ ID NO: 2401044 - RNA, 20 nt, Bordetella pertussis
gccguucuggcugcgcgccu

SEQ ID NO: 2401045 - RNA, 13 nt, Bordetella pertussis
gccguugagcacg

SEQ ID NO: 2401046 - RNA, 17 nt, Bordetella pertussis
gccguugaucugguuca

SEQ ID NO: 2401047 - RNA, 13 nt, Bordetella pertussis
gccguugccgcug

SEQ ID NO: 2401048 - RNA, 15 nt, Bordetella pertussis
gccguugcgccagcg

SEQ ID NO: 2401049 - RNA, 16 nt, Bordetella pertussis
gccguugcggcccgcc

SEQ ID NO: 2401050 - RNA, 17 nt, Bordetella pertussis
gccguugcucgcgcgca

SEQ ID NO: 2401051 - RNA, 18 nt, Bordetella pertussis
gccguuggccagcgccgc

SEQ ID NO: 2401052 - RNA, 17 nt, Bordetella pertussis
gccguuggccgcgcggu

SEQ ID NO: 2401053 - RNA, 21 nt, Bordetella pertussis
gccguuggccgcgcgguacgc

SEQ ID NO: 2401054 - RNA, 15 nt, Bordetella pertussis
gccguuggcgauggc

SEQ ID NO: 2401055 - RNA, 21 nt, Bordetella pertussis
gccguuggcgcccagcgccau

SEQ ID NO: 2401056 - RNA, 14 nt, Bordetella pertussis
gccguuggcgcgcc

SEQ ID NO: 2401057 - RNA, 15 nt, Bordetella pertussis
gccguuggcgcgccu

SEQ ID NO: 2401058 - RNA, 12 nt, Bordetella pertussis
gccguuggcgug

SEQ ID NO: 2401059 - RNA, 16 nt, Bordetella pertussis
gccguuguccgccugc

SEQ ID NO: 2401060 - RNA, 21 nt, Bordetella pertussis
gccguuguccgccugcggacg

SEQ ID NO: 2401061 - RNA, 16 nt, Bordetella pertussis
gccguuguccuggcgc

SEQ ID NO: 2401062 - RNA, 17 nt, Bordetella pertussis
gccguuguccuggcgcg

SEQ ID NO: 2401063 - RNA, 20 nt, Bordetella pertussis
gccguuguccuggcgcgcca

SEQ ID NO: 2401064 - RNA, 20 nt, Bordetella pertussis
gccguuucaggccugcggcg

SEQ ID NO: 2401065 - RNA, 21 nt, Bordetella pertussis
gccguuucucaacccgccggc

SEQ ID NO: 2401066 - RNA, 23 nt, Bordetella pertussis
gccguuucucaacccgccggcca

SEQ ID NO: 2401067 - RNA, 16 nt, Bordetella pertussis
gccguuuucagcgcag

SEQ ID NO: 2401068 - RNA, 17 nt, Bordetella pertussis
gccguuuucagcgcagg

SEQ ID NO: 2401069 - RNA, 20 nt, Bordetella pertussis
gccguuuucgaucagggcga

SEQ ID NO: 2401070 - RNA, 23 nt, Bordetella pertussis
gccguuuuuuuguucaucgagca

SEQ ID NO: 2401071 - RNA, 14 nt, Bordetella pertussis
gccuacacgguggc

SEQ ID NO: 2401072 - RNA, 16 nt, Bordetella pertussis
gccuacacgguggcgg

SEQ ID NO: 2401073 - RNA, 20 nt, Bordetella pertussis
gccuacagcagcggcucgag

SEQ ID NO: 2401074 - RNA, 23 nt, Bordetella pertussis
gccuaccgcuauuuuucgacacc

SEQ ID NO: 2401075 - RNA, 13 nt, Bordetella pertussis
gccuaccggcgcc

SEQ ID NO: 2401076 - RNA, 14 nt, Bordetella pertussis
gccuaccggcgccg

SEQ ID NO: 2401077 - RNA, 18 nt, Bordetella pertussis
gccuaccggcgccgacgc

SEQ ID NO: 2401078 - RNA, 14 nt, Bordetella pertussis
gccuacggcggcgg

SEQ ID NO: 2401079 - RNA, 15 nt, Bordetella pertussis
gccuacggcggcggc

SEQ ID NO: 2401080 - RNA, 17 nt, Bordetella pertussis
gccuacggcggcggcca

SEQ ID NO: 2401081 - RNA, 16 nt, Bordetella pertussis
gccuacuggcgcgcgc

SEQ ID NO: 2401082 - RNA, 17 nt, Bordetella pertussis
gccuacuggcgcgcgca

SEQ ID NO: 2401083 - RNA, 18 nt, Bordetella pertussis
gccuacuggcgcgcgcaa

SEQ ID NO: 2401084 - RNA, 17 nt, Bordetella pertussis
gccuacuugccggcgcu

SEQ ID NO: 2401085 - RNA, 21 nt, Bordetella pertussis
gccuacuugccggcgcucagc

SEQ ID NO: 2401086 - RNA, 12 nt, Bordetella pertussis
gccuagcccggc

SEQ ID NO: 2401087 - RNA, 13 nt, Bordetella pertussis
gccuagcccggcg

SEQ ID NO: 2401088 - RNA, 15 nt, Bordetella pertussis
gccuagcccggcgcc

SEQ ID NO: 2401089 - RNA, 16 nt, Bordetella pertussis
gccuagcccggcgcca

SEQ ID NO: 2401090 - RNA, 19 nt, Bordetella pertussis
gccuagcccggcgccaccc

SEQ ID NO: 2401091 - RNA, 15 nt, Bordetella pertussis
gccuauaucgacggc

SEQ ID NO: 2401092 - RNA, 16 nt, Bordetella pertussis
gccuaugaagacgcgc

SEQ ID NO: 2401093 - RNA, 17 nt, Bordetella pertussis
gccuauguaggcgccgc

SEQ ID NO: 2401094 - RNA, 19 nt, Bordetella pertussis
gccuauguaggcgccgcgc

SEQ ID NO: 2401095 - RNA, 13 nt, Bordetella pertussis
gccuauuggcugu

SEQ ID NO: 2401096 - RNA, 20 nt, Bordetella pertussis
gccuauuggcuguaucuggc

SEQ ID NO: 2401097 - RNA, 16 nt, Bordetella pertussis
gccuauuuggcggccu

SEQ ID NO: 2401098 - RNA, 20 nt, Bordetella pertussis
gccuauuuggcggccuggcc

SEQ ID NO: 2401099 - RNA, 14 nt, Bordetella pertussis
gccucaacuggccg

SEQ ID NO: 2401100 - RNA, 21 nt, Bordetella pertussis
gccucaacuggccggccuggc

SEQ ID NO: 2401101 - RNA, 18 nt, Bordetella pertussis
gccucaaucgaugaugug

SEQ ID NO: 2401102 - RNA, 15 nt, Bordetella pertussis
gccucaccgcgccgg

SEQ ID NO: 2401103 - RNA, 20 nt, Bordetella pertussis
gccucacuccauagcgccgc

SEQ ID NO: 2401104 - RNA, 22 nt, Bordetella pertussis
gccucagaccacgacggucugg

SEQ ID NO: 2401105 - RNA, 14 nt, Bordetella pertussis
gccucagcccgcgu

SEQ ID NO: 2401106 - RNA, 14 nt, Bordetella pertussis
gccucagcggccgc

SEQ ID NO: 2401107 - RNA, 15 nt, Bordetella pertussis
gccucagcggccgcu

SEQ ID NO: 2401108 - RNA, 18 nt, Bordetella pertussis
gccucagcggccgcugcc

SEQ ID NO: 2401109 - RNA, 19 nt, Bordetella pertussis
gccucagcggccgcugccg

SEQ ID NO: 2401110 - RNA, 23 nt, Bordetella pertussis
gccucagcguuuccagggcgcgc

SEQ ID NO: 2401111 - RNA, 13 nt, Bordetella pertussis
gccucaggccggc

SEQ ID NO: 2401112 - RNA, 19 nt, Bordetella pertussis
gccucaggccggcgccugg

SEQ ID NO: 2401113 - RNA, 22 nt, Bordetella pertussis
gccucauccccgcgugccuguc

SEQ ID NO: 2401114 - RNA, 17 nt, Bordetella pertussis
gccucaucguucugcgu

SEQ ID NO: 2401115 - RNA, 14 nt, Bordetella pertussis
gccucaugacgggg

SEQ ID NO: 2401116 - RNA, 16 nt, Bordetella pertussis
gccucaugacggggcc

SEQ ID NO: 2401117 - RNA, 17 nt, Bordetella pertussis
gccucaugacggggccu

SEQ ID NO: 2401118 - RNA, 19 nt, Bordetella pertussis
gccucaugacggggccuuc

SEQ ID NO: 2401119 - RNA, 16 nt, Bordetella pertussis
gccuccagcaucgccg

SEQ ID NO: 2401120 - RNA, 19 nt, Bordetella pertussis
gccuccagcaucgccgcca

SEQ ID NO: 2401121 - RNA, 21 nt, Bordetella pertussis
gccuccagcaucgccgccagc

SEQ ID NO: 2401122 - RNA, 14 nt, Bordetella pertussis
gccuccagcgcggc

SEQ ID NO: 2401123 - RNA, 17 nt, Bordetella pertussis
gccuccagcgcggcggg

SEQ ID NO: 2401124 - RNA, 13 nt, Bordetella pertussis
gccuccagcucca

SEQ ID NO: 2401125 - RNA, 20 nt, Bordetella pertussis
gccuccagcuccagcgcgcc

SEQ ID NO: 2401126 - RNA, 21 nt, Bordetella pertussis
gccuccagcuccagcgcgccg

SEQ ID NO: 2401127 - RNA, 22 nt, Bordetella pertussis
gccuccagcuccagcgcgccga

SEQ ID NO: 2401128 - RNA, 18 nt, Bordetella pertussis
gccuccaggaugagcgcc

SEQ ID NO: 2401129 - RNA, 19 nt, Bordetella pertussis
gccuccaggaugagcgccu

SEQ ID NO: 2401130 - RNA, 20 nt, Bordetella pertussis
gccuccaggaugagcgccug

SEQ ID NO: 2401131 - RNA, 22 nt, Bordetella pertussis
gccuccaggaugagcgccugca

SEQ ID NO: 2401132 - RNA, 18 nt, Bordetella pertussis
gccuccaggcgcaagccu

SEQ ID NO: 2401133 - RNA, 16 nt, Bordetella pertussis
gccuccaggcggcggu

SEQ ID NO: 2401134 - RNA, 12 nt, Bordetella pertussis
gccuccaucagc

SEQ ID NO: 2401135 - RNA, 23 nt, Bordetella pertussis
gccucccauugcgcggccagggc

SEQ ID NO: 2401136 - RNA, 16 nt, Bordetella pertussis
gccuccccaggccagc

SEQ ID NO: 2401137 - RNA, 14 nt, Bordetella pertussis
gccucccgccgccc

SEQ ID NO: 2401138 - RNA, 18 nt, Bordetella pertussis
gccucccgccgcccggcc

SEQ ID NO: 2401139 - RNA, 18 nt, Bordetella pertussis
gccucccggaccagcagu

SEQ ID NO: 2401140 - RNA, 13 nt, Bordetella pertussis
gccuccgcgcaca

SEQ ID NO: 2401141 - RNA, 18 nt, Bordetella pertussis
gccuccgcgcacagcgcg

SEQ ID NO: 2401142 - RNA, 12 nt, Bordetella pertussis
gccuccggcagg

SEQ ID NO: 2401143 - RNA, 19 nt, Bordetella pertussis
gccuccggcaggaucugca

SEQ ID NO: 2401144 - RNA, 21 nt, Bordetella pertussis
gccucgaacguccgccccauc

SEQ ID NO: 2401145 - RNA, 21 nt, Bordetella pertussis
gccucgaagaucaacaaggcg

SEQ ID NO: 2401146 - RNA, 15 nt, Bordetella pertussis
gccucgaagcccggc

SEQ ID NO: 2401147 - RNA, 18 nt, Bordetella pertussis
gccucgaagcccggcagg

SEQ ID NO: 2401148 - RNA, 18 nt, Bordetella pertussis
gccucgaagcggcucagg

SEQ ID NO: 2401149 - RNA, 20 nt, Bordetella pertussis
gccucgaagcggcucaggcg

SEQ ID NO: 2401150 - RNA, 22 nt, Bordetella pertussis
gccucgaagcggcucaggcgcg

SEQ ID NO: 2401151 - RNA, 18 nt, Bordetella pertussis
gccucgacgaugcccugc

SEQ ID NO: 2401152 - RNA, 21 nt, Bordetella pertussis
gccucgacgauggccggggcg

SEQ ID NO: 2401153 - RNA, 13 nt, Bordetella pertussis
gccucgacgcccg

SEQ ID NO: 2401154 - RNA, 16 nt, Bordetella pertussis
gccucgacgcccgggc

SEQ ID NO: 2401155 - RNA, 15 nt, Bordetella pertussis
gccucgacggccgcc

SEQ ID NO: 2401156 - RNA, 18 nt, Bordetella pertussis
gccucgagguauucgcgc

SEQ ID NO: 2401157 - RNA, 21 nt, Bordetella pertussis
gccucgagguauucgcgcgau

SEQ ID NO: 2401158 - RNA, 16 nt, Bordetella pertussis
gccucgaucgccaggu

SEQ ID NO: 2401159 - RNA, 17 nt, Bordetella pertussis
gccucgaugaaggugcg

SEQ ID NO: 2401160 - RNA, 19 nt, Bordetella pertussis
gccucgaugcccucgcgca

SEQ ID NO: 2401161 - RNA, 21 nt, Bordetella pertussis
gccucgaugcccucgcgcacg

SEQ ID NO: 2401162 - RNA, 18 nt, Bordetella pertussis
gccucgaugguggcgaug

SEQ ID NO: 2401163 - RNA, 17 nt, Bordetella pertussis
gccucgaugucaucgcc

SEQ ID NO: 2401164 - RNA, 12 nt, Bordetella pertussis
gccucgcaucgg

SEQ ID NO: 2401165 - RNA, 20 nt, Bordetella pertussis
gccucgcaucggccugcacc

SEQ ID NO: 2401166 - RNA, 21 nt, Bordetella pertussis
gccucgcaucggccugcaccg

SEQ ID NO: 2401167 - RNA, 16 nt, Bordetella pertussis
gccucgcccgaucggc

SEQ ID NO: 2401168 - RNA, 17 nt, Bordetella pertussis
gccucgcccgaucggcc

SEQ ID NO: 2401169 - RNA, 19 nt, Bordetella pertussis
gccucgcccgaucggccgg

SEQ ID NO: 2401170 - RNA, 20 nt, Bordetella pertussis
gccucgcccgaucggccggc

SEQ ID NO: 2401171 - RNA, 21 nt, Bordetella pertussis
gccucgcccgaucggccggcc

SEQ ID NO: 2401172 - RNA, 15 nt, Bordetella pertussis
gccucgcccuggcgc

SEQ ID NO: 2401173 - RNA, 16 nt, Bordetella pertussis
gccucgccggcccugc

SEQ ID NO: 2401174 - RNA, 21 nt, Bordetella pertussis
gccucgccggcccugccgccc

SEQ ID NO: 2401175 - RNA, 15 nt, Bordetella pertussis
gccucgccggccugg

SEQ ID NO: 2401176 - RNA, 16 nt, Bordetella pertussis
gccucgccggccuggc

SEQ ID NO: 2401177 - RNA, 21 nt, Bordetella pertussis
gccucgccggccuggcgcgcg

SEQ ID NO: 2401178 - RNA, 23 nt, Bordetella pertussis
gccucgcgacggccucccgccgc

SEQ ID NO: 2401179 - RNA, 16 nt, Bordetella pertussis
gccucgcgcagggcgg

SEQ ID NO: 2401180 - RNA, 19 nt, Bordetella pertussis
gccucgcgcagggcggccu

SEQ ID NO: 2401181 - RNA, 13 nt, Bordetella pertussis
gccucgcgcucca

SEQ ID NO: 2401182 - RNA, 14 nt, Bordetella pertussis
gccucgcgcuccag

SEQ ID NO: 2401183 - RNA, 15 nt, Bordetella pertussis
gccucgcgcuccagc

SEQ ID NO: 2401184 - RNA, 16 nt, Bordetella pertussis
gccucgcgcuccagca

SEQ ID NO: 2401185 - RNA, 14 nt, Bordetella pertussis
gccucgcgcuccau

SEQ ID NO: 2401186 - RNA, 18 nt, Bordetella pertussis
gccucgcgcuccaugggc

SEQ ID NO: 2401187 - RNA, 16 nt, Bordetella pertussis
gccucgcgcucgagcg

SEQ ID NO: 2401188 - RNA, 20 nt, Bordetella pertussis
gccucgcgcucgagcgcggc

SEQ ID NO: 2401189 - RNA, 13 nt, Bordetella pertussis
gccucgcgcucgc

SEQ ID NO: 2401190 - RNA, 15 nt, Bordetella pertussis
gccucgcgcucgcgc

SEQ ID NO: 2401191 - RNA, 16 nt, Bordetella pertussis
gccugcagcagcggca

SEQ ID NO: 2401192 - RNA, 23 nt, Bordetella pertussis
gccugcagcagcggcagcucggc

SEQ ID NO: 2401193 - RNA, 15 nt, Bordetella pertussis
gccugcagcaugacc

SEQ ID NO: 2401194 - RNA, 20 nt, Bordetella pertussis
gccugcagcaugaccgacag

SEQ ID NO: 2401195 - RNA, 17 nt, Bordetella pertussis
gccugcaggaagccugc

SEQ ID NO: 2401196 - RNA, 22 nt, Bordetella pertussis
gccugcaggaagccugcgcgcg

SEQ ID NO: 2401197 - RNA, 14 nt, Bordetella pertussis
gccugcaggcccag

SEQ ID NO: 2401198 - RNA, 17 nt, Bordetella pertussis
gccugcaggcccagcac

SEQ ID NO: 2401199 - RNA, 21 nt, Bordetella pertussis
gccugcaggcccagcacgcgc

SEQ ID NO: 2401200 - RNA, 22 nt, Bordetella pertussis
gccugcaggcccagcacgcgcg

SEQ ID NO: 2401201 - RNA, 13 nt, Bordetella pertussis
gccugcaggccgu

SEQ ID NO: 2401202 - RNA, 12 nt, Bordetella pertussis
gccugcaggcgg

SEQ ID NO: 2401203 - RNA, 15 nt, Bordetella pertussis
gccugcaggcggucg

SEQ ID NO: 2401204 - RNA, 14 nt, Bordetella pertussis
gccugcaggcucuu

SEQ ID NO: 2401205 - RNA, 22 nt, Bordetella pertussis
gccugcaggcucuugaccagcu

SEQ ID NO: 2401206 - RNA, 18 nt, Bordetella pertussis
gccugcaggugccgccgg

SEQ ID NO: 2401207 - RNA, 17 nt, Bordetella pertussis
gccugcaguucggccgc

SEQ ID NO: 2401208 - RNA, 19 nt, Bordetella pertussis
gccugcaguucggccgcca

SEQ ID NO: 2401209 - RNA, 22 nt, Bordetella pertussis
gccugcaguucggccgccaggu

SEQ ID NO: 2401210 - RNA, 23 nt, Bordetella pertussis
gccugcaguucggccgccagguc

SEQ ID NO: 2401211 - RNA, 19 nt, Bordetella pertussis
gccugcauccggcccagcg

SEQ ID NO: 2401212 - RNA, 21 nt, Bordetella pertussis
gccugcauccggcccagcgcc

SEQ ID NO: 2401213 - RNA, 16 nt, Bordetella pertussis
gccugcaugccauagu

SEQ ID NO: 2401214 - RNA, 15 nt, Bordetella pertussis
gccugcauguccagc

SEQ ID NO: 2401215 - RNA, 16 nt, Bordetella pertussis
gccugcauguccagcg

SEQ ID NO: 2401216 - RNA, 19 nt, Bordetella pertussis
gccugcaugucguacaggc

SEQ ID NO: 2401217 - RNA, 17 nt, Bordetella pertussis
gccugccaagcgccgcg

SEQ ID NO: 2401218 - RNA, 21 nt, Bordetella pertussis
gccugccaagcgccgcggcca

SEQ ID NO: 2401219 - RNA, 14 nt, Bordetella pertussis
gccugccacaucga

SEQ ID NO: 2401220 - RNA, 18 nt, Bordetella pertussis
gccugccacaucgaaggc

SEQ ID NO: 2401221 - RNA, 19 nt, Bordetella pertussis
gccugccaccgacaagccg

SEQ ID NO: 2401222 - RNA, 19 nt, Bordetella pertussis
gccugccagaacagccgcg

SEQ ID NO: 2401223 - RNA, 20 nt, Bordetella pertussis
gccugccagaacagccgcga

SEQ ID NO: 2401224 - RNA, 19 nt, Bordetella pertussis
gccugccagcccaccagcg

SEQ ID NO: 2401225 - RNA, 22 nt, Bordetella pertussis
gccugccagcccaccagcgcca

SEQ ID NO: 2401226 - RNA, 12 nt, Bordetella pertussis
gccugccagccu

SEQ ID NO: 2401227 - RNA, 16 nt, Bordetella pertussis
gccugccagccugcca

SEQ ID NO: 2401228 - RNA, 17 nt, Bordetella pertussis
gccugccauccggccgc

SEQ ID NO: 2401229 - RNA, 23 nt, Bordetella pertussis
gccugccauucgucguagccgcc

SEQ ID NO: 2401230 - RNA, 13 nt, Bordetella pertussis
gccugcccaggcc

SEQ ID NO: 2401231 - RNA, 14 nt, Bordetella pertussis
gccugcccauggcc

SEQ ID NO: 2401232 - RNA, 16 nt, Bordetella pertussis
gccugcccauggccug

SEQ ID NO: 2401233 - RNA, 17 nt, Bordetella pertussis
gccugcccauggccugc

SEQ ID NO: 2401234 - RNA, 20 nt, Bordetella pertussis
gccugcccauggccugcaac

SEQ ID NO: 2401235 - RNA, 15 nt, Bordetella pertussis
gccugccccgccugc

SEQ ID NO: 2401236 - RNA, 17 nt, Bordetella pertussis
gccugccccgccugcgc

SEQ ID NO: 2401237 - RNA, 14 nt, Bordetella pertussis
gccugccccggcag

SEQ ID NO: 2401238 - RNA, 20 nt, Bordetella pertussis
gccugccccugcggggacag

SEQ ID NO: 2401239 - RNA, 24 nt, Bordetella pertussis
gccugccccugcggggacaggcac

SEQ ID NO: 2401240 - RNA, 17 nt, Bordetella pertussis
gccugcccgcacgggcc

SEQ ID NO: 2401241 - RNA, 15 nt, Bordetella pertussis
gccugcccgggcacc

SEQ ID NO: 2401242 - RNA, 19 nt, Bordetella pertussis
gccugcccgggcaccaggu

SEQ ID NO: 2401243 - RNA, 16 nt, Bordetella pertussis
gccugcccgggcggga

SEQ ID NO: 2401244 - RNA, 17 nt, Bordetella pertussis
gccugcccgucgggcag

SEQ ID NO: 2401245 - RNA, 23 nt, Bordetella pertussis
gccugcccgucgggcaggucggc

SEQ ID NO: 2401246 - RNA, 21 nt, Bordetella pertussis
gccugcccguucacgcgcagc

SEQ ID NO: 2401247 - RNA, 21 nt, Bordetella pertussis
gccugcccucgggcgacaggc

SEQ ID NO: 2401248 - RNA, 14 nt, Bordetella pertussis
gccugccgagcgcu

SEQ ID NO: 2401249 - RNA, 16 nt, Bordetella pertussis
gccugccgagcgcugc

SEQ ID NO: 2401250 - RNA, 20 nt, Bordetella pertussis
gccugccgagcgcugcgcca

SEQ ID NO: 2401251 - RNA, 16 nt, Bordetella pertussis
gccugccgaucgugca

SEQ ID NO: 2401252 - RNA, 22 nt, Bordetella pertussis
gccugccgaucgugcacgcccg

SEQ ID NO: 2401253 - RNA, 19 nt, Bordetella pertussis
gccugccgcaucccgcccc

SEQ ID NO: 2401254 - RNA, 22 nt, Bordetella pertussis
gccugccgcaucccgcccccgc

SEQ ID NO: 2401255 - RNA, 16 nt, Bordetella pertussis
gccugccgccugccag

SEQ ID NO: 2401256 - RNA, 14 nt, Bordetella pertussis
gccugccgcgcccg

SEQ ID NO: 2401257 - RNA, 15 nt, Bordetella pertussis
gccugccgcgcccgg

SEQ ID NO: 2401258 - RNA, 17 nt, Bordetella pertussis
gccugccgcgcccggcg

SEQ ID NO: 2401259 - RNA, 21 nt, Bordetella pertussis
gccugccgcgcccggcggcca

SEQ ID NO: 2401260 - RNA, 13 nt, Bordetella pertussis
gccugccgcgccg

SEQ ID NO: 2401261 - RNA, 15 nt, Bordetella pertussis
gccugccgcgccgac

SEQ ID NO: 2401262 - RNA, 14 nt, Bordetella pertussis
gccugccgcggccg

SEQ ID NO: 2401263 - RNA, 16 nt, Bordetella pertussis
gccugccgcggccgcc

SEQ ID NO: 2401264 - RNA, 15 nt, Bordetella pertussis
gccugccgcgugccc

SEQ ID NO: 2401265 - RNA, 16 nt, Bordetella pertussis
gccugccggccggcca

SEQ ID NO: 2401266 - RNA, 13 nt, Bordetella pertussis
gccugccggccug

SEQ ID NO: 2401267 - RNA, 14 nt, Bordetella pertussis
gccugccggccugg

SEQ ID NO: 2401268 - RNA, 15 nt, Bordetella pertussis
gccugccggccuggc

SEQ ID NO: 2401269 - RNA, 15 nt, Bordetella pertussis
gccugccggcgcaca

SEQ ID NO: 2401270 - RNA, 17 nt, Bordetella pertussis
gccugccggcgcgccca

SEQ ID NO: 2401271 - RNA, 14 nt, Bordetella pertussis
gccugccggcggcc

SEQ ID NO: 2401272 - RNA, 15 nt, Bordetella pertussis
gccugccugauggcg

SEQ ID NO: 2401273 - RNA, 16 nt, Bordetella pertussis
gccugccugauggcgc

SEQ ID NO: 2401274 - RNA, 16 nt, Bordetella pertussis
gccugcgaacgcccgg

SEQ ID NO: 2401275 - RNA, 19 nt, Bordetella pertussis
gccugcgaacgcccggccc

SEQ ID NO: 2401276 - RNA, 21 nt, Bordetella pertussis
gccugcgaacgcccggcccag

SEQ ID NO: 2401277 - RNA, 22 nt, Bordetella pertussis
gccugcgaacgcccggcccagg

SEQ ID NO: 2401278 - RNA, 21 nt, Bordetella pertussis
gccugcgagagauagcccagc

SEQ ID NO: 2401279 - RNA, 16 nt, Bordetella pertussis
gccugcgaugccggcg

SEQ ID NO: 2401280 - RNA, 15 nt, Bordetella pertussis
gccugcgccaccagc

SEQ ID NO: 2401281 - RNA, 16 nt, Bordetella pertussis
gccugcgccaccagcu

SEQ ID NO: 2401282 - RNA, 24 nt, Bordetella pertussis
gccugcgccaccagcuugcgcgcc

SEQ ID NO: 2401283 - RNA, 18 nt, Bordetella pertussis
gccugcgccacguccagc

SEQ ID NO: 2401284 - RNA, 23 nt, Bordetella pertussis
gccugcgccacguccagcacggc

SEQ ID NO: 2401285 - RNA, 15 nt, Bordetella pertussis
gccugcgccagccgc

SEQ ID NO: 2401286 - RNA, 21 nt, Bordetella pertussis
gccugcgccagccgcgccugc

SEQ ID NO: 2401287 - RNA, 19 nt, Bordetella pertussis
gccugcgccagcuccagcc

SEQ ID NO: 2401288 - RNA, 21 nt, Bordetella pertussis
gccugcgccagcuccagccgc

SEQ ID NO: 2401289 - RNA, 22 nt, Bordetella pertussis
gccugcgccagcuccagccgca

SEQ ID NO: 2401290 - RNA, 12 nt, Bordetella pertussis
gccugcgccaug

SEQ ID NO: 2401291 - RNA, 16 nt, Bordetella pertussis
gccugcgccauggcgc

SEQ ID NO: 2401292 - RNA, 21 nt, Bordetella pertussis
gccugcgccauggcgcgcaga

SEQ ID NO: 2401293 - RNA, 19 nt, Bordetella pertussis
gccugcgccauguggcgac

SEQ ID NO: 2401294 - RNA, 12 nt, Bordetella pertussis
gccugcgccgcc

SEQ ID NO: 2401295 - RNA, 15 nt, Bordetella pertussis
gccugcgccgccgcg

SEQ ID NO: 2401296 - RNA, 18 nt, Bordetella pertussis
gccugcgccgccgcgcgc

SEQ ID NO: 2401297 - RNA, 22 nt, Bordetella pertussis
gccugcgccgccgcgcgcuggc

SEQ ID NO: 2401298 - RNA, 19 nt, Bordetella pertussis
gccugcgccggcauggcca

SEQ ID NO: 2401299 - RNA, 20 nt, Bordetella pertussis
gccugcgccgggcgcggcca

SEQ ID NO: 2401300 - RNA, 21 nt, Bordetella pertussis
gccugcgccgggcgcggccag

SEQ ID NO: 2401301 - RNA, 23 nt, Bordetella pertussis
gccugcgccgggcgcggccaggc

SEQ ID NO: 2401302 - RNA, 21 nt, Bordetella pertussis
gccugcgccggguccggccgc

SEQ ID NO: 2401303 - RNA, 20 nt, Bordetella pertussis
gccugcgcgaaacccccugg

SEQ ID NO: 2401304 - RNA, 13 nt, Bordetella pertussis
gccugcgcgccga

SEQ ID NO: 2401305 - RNA, 16 nt, Bordetella pertussis
gccugcgcgccgacca

SEQ ID NO: 2401306 - RNA, 13 nt, Bordetella pertussis
gccugcgcgccgg

SEQ ID NO: 2401307 - RNA, 16 nt, Bordetella pertussis
gccugcgcgccggguu

SEQ ID NO: 2401308 - RNA, 19 nt, Bordetella pertussis
gccugcgcgccggguuuuu

SEQ ID NO: 2401309 - RNA, 15 nt, Bordetella pertussis
gccugcgcgcgagca

SEQ ID NO: 2401310 - RNA, 13 nt, Bordetella pertussis
gccugcgcggccu

SEQ ID NO: 2401311 - RNA, 19 nt, Bordetella pertussis
gccugcggacggcgggcgc

SEQ ID NO: 2401312 - RNA, 22 nt, Bordetella pertussis
gccugcggaugcaggaucuggu

SEQ ID NO: 2401313 - RNA, 16 nt, Bordetella pertussis
gccugcggcaggccgc

SEQ ID NO: 2401314 - RNA, 17 nt, Bordetella pertussis
gccugcggcaggccgca

SEQ ID NO: 2401315 - RNA, 20 nt, Bordetella pertussis
gccugcggcaggccgcagcg

SEQ ID NO: 2401316 - RNA, 23 nt, Bordetella pertussis
gccugcggcaggccgcagcgggc

SEQ ID NO: 2401317 - RNA, 18 nt, Bordetella pertussis
gccugcggcauggugugc

SEQ ID NO: 2401318 - RNA, 15 nt, Bordetella pertussis
gccugcggcgccagc

SEQ ID NO: 2401319 - RNA, 16 nt, Bordetella pertussis
gccugcggcgccagcg

SEQ ID NO: 2401320 - RNA, 17 nt, Bordetella pertussis
gccugcggcgccagcgc

SEQ ID NO: 2401321 - RNA, 19 nt, Bordetella pertussis
gccugcggcgccagcgccg

SEQ ID NO: 2401322 - RNA, 20 nt, Bordetella pertussis
gccugcggcgccagcgccgc

SEQ ID NO: 2401323 - RNA, 15 nt, Bordetella pertussis
gccugcggcgcggcc

SEQ ID NO: 2401324 - RNA, 16 nt, Bordetella pertussis
gccugcggcgcggccg

SEQ ID NO: 2401325 - RNA, 20 nt, Bordetella pertussis
gccugcggcgcggccgacgu

SEQ ID NO: 2401326 - RNA, 17 nt, Bordetella pertussis
gccugcggcgucaggcc

SEQ ID NO: 2401327 - RNA, 18 nt, Bordetella pertussis
gccugcggcgucaggccg

SEQ ID NO: 2401328 - RNA, 19 nt, Bordetella pertussis
gccugcggcgucaggccgu

SEQ ID NO: 2401329 - RNA, 13 nt, Bordetella pertussis
gccugcgggccgg

SEQ ID NO: 2401330 - RNA, 16 nt, Bordetella pertussis
gccugcgggccgggca

SEQ ID NO: 2401331 - RNA, 17 nt, Bordetella pertussis
gccugcgggccgggcag

SEQ ID NO: 2401332 - RNA, 20 nt, Bordetella pertussis
gccugcgggccgggcaggcc

SEQ ID NO: 2401333 - RNA, 22 nt, Bordetella pertussis
gccugcgggccgggcaggccgc

SEQ ID NO: 2401334 - RNA, 15 nt, Bordetella pertussis
gccugcgggcgccgc

SEQ ID NO: 2401335 - RNA, 16 nt, Bordetella pertussis
gccugcgggcgccgcg

SEQ ID NO: 2401336 - RNA, 21 nt, Bordetella pertussis
gccugcgggcugaugcaggcc

SEQ ID NO: 2401337 - RNA, 22 nt, Bordetella pertussis
gccugcgggcugaugcaggccu

SEQ ID NO: 2401338 - RNA, 23 nt, Bordetella pertussis
gccugcgggcugaugcaggccug

SEQ ID NO: 2401339 - RNA, 13 nt, Bordetella pertussis
gccugcgggugcg

SEQ ID NO: 2401340 - RNA, 18 nt, Bordetella pertussis
gccugcgggugcgccugc

SEQ ID NO: 2401341 - RNA, 13 nt, Bordetella pertussis
gccugcgucgcca

SEQ ID NO: 2401342 - RNA, 17 nt, Bordetella pertussis
gccugcgucguugcccc

SEQ ID NO: 2401343 - RNA, 23 nt, Bordetella pertussis
gccugcguggcgggccgcgccgc

SEQ ID NO: 2401344 - RNA, 16 nt, Bordetella pertussis
gccugcucacgccccg

SEQ ID NO: 2401345 - RNA, 18 nt, Bordetella pertussis
gccugcucacgccccgcc

SEQ ID NO: 2401346 - RNA, 17 nt, Bordetella pertussis
gccugcuccggcgugau

SEQ ID NO: 2401347 - RNA, 20 nt, Bordetella pertussis
gccugcucgaccugcucggg

SEQ ID NO: 2401348 - RNA, 21 nt, Bordetella pertussis
gccugcucgaccugcucgggc

SEQ ID NO: 2401349 - RNA, 16 nt, Bordetella pertussis
gccugcucgcaggccu

SEQ ID NO: 2401350 - RNA, 17 nt, Bordetella pertussis
gccugcucgcaggccug

SEQ ID NO: 2401351 - RNA, 18 nt, Bordetella pertussis
gccugcucgcaggccugc

SEQ ID NO: 2401352 - RNA, 19 nt, Bordetella pertussis
gccugcucgcaggccugcu

SEQ ID NO: 2401353 - RNA, 22 nt, Bordetella pertussis
gccugcucgcccacauagcggc

SEQ ID NO: 2401354 - RNA, 23 nt, Bordetella pertussis
gccugcucgcccacauagcggcc

SEQ ID NO: 2401355 - RNA, 16 nt, Bordetella pertussis
gccugcucgccggcca

SEQ ID NO: 2401356 - RNA, 18 nt, Bordetella pertussis
gccugcucgccggccagc

SEQ ID NO: 2401357 - RNA, 18 nt, Bordetella pertussis
gccugcucguacagcggc

SEQ ID NO: 2401358 - RNA, 20 nt, Bordetella pertussis
gccugcucguugcgcaagcc

SEQ ID NO: 2401359 - RNA, 22 nt, Bordetella pertussis
gccugcucguugcgcaagccgc

SEQ ID NO: 2401360 - RNA, 18 nt, Bordetella pertussis
gccugcugcagcacacgc

SEQ ID NO: 2401361 - RNA, 14 nt, Bordetella pertussis
gccugcugcagcgu

SEQ ID NO: 2401362 - RNA, 15 nt, Bordetella pertussis
gccugcugcagcgug

SEQ ID NO: 2401363 - RNA, 17 nt, Bordetella pertussis
gccugcugcagcgugau

SEQ ID NO: 2401364 - RNA, 12 nt, Bordetella pertussis
gccugcugcaug

SEQ ID NO: 2401365 - RNA, 15 nt, Bordetella pertussis
gccugcugcgccugg

SEQ ID NO: 2401366 - RNA, 16 nt, Bordetella pertussis
gccugcugcgccuggc

SEQ ID NO: 2401367 - RNA, 15 nt, Bordetella pertussis
gccugcuggucggcc

SEQ ID NO: 2401368 - RNA, 16 nt, Bordetella pertussis
gccugcuggucggccu

SEQ ID NO: 2401369 - RNA, 12 nt, Bordetella pertussis
gccugcuggugc

SEQ ID NO: 2401370 - RNA, 16 nt, Bordetella pertussis
gccugcuggugcuggu

SEQ ID NO: 2401371 - RNA, 18 nt, Bordetella pertussis
gccugcuggugcuggugc

SEQ ID NO: 2401372 - RNA, 20 nt, Bordetella pertussis
gccugcuggugcuggugcug

SEQ ID NO: 2401373 - RNA, 17 nt, Bordetella pertussis
gccugcugucgcuggga

SEQ ID NO: 2401374 - RNA, 19 nt, Bordetella pertussis
gccugcugugcgauggcac

SEQ ID NO: 2401375 - RNA, 19 nt, Bordetella pertussis
gccugcuugaagacgccca

SEQ ID NO: 2401376 - RNA, 24 nt, Bordetella pertussis
gccugcuugaagacgcccaggucc

SEQ ID NO: 2401377 - RNA, 16 nt, Bordetella pertussis
gccugcuugcaggaag

SEQ ID NO: 2401378 - RNA, 23 nt, Bordetella pertussis
gccugcuugcaggaagcgcacca

SEQ ID NO: 2401379 - RNA, 18 nt, Bordetella pertussis
gccugcuuggcagccuug

SEQ ID NO: 2401380 - RNA, 19 nt, Bordetella pertussis
gccugcuuggcagccuugg

SEQ ID NO: 2401381 - RNA, 13 nt, Bordetella pertussis
gccugcuuggccg

SEQ ID NO: 2401382 - RNA, 17 nt, Bordetella pertussis
gccugcuuggcgcgcag

SEQ ID NO: 2401383 - RNA, 19 nt, Bordetella pertussis
gccugcuuggcgcgcagca

SEQ ID NO: 2401384 - RNA, 21 nt, Bordetella pertussis
gccugcuuggcgcgcagcagc

SEQ ID NO: 2401385 - RNA, 19 nt, Bordetella pertussis
gccugcuuguacaggcgcg

SEQ ID NO: 2401386 - RNA, 20 nt, Bordetella pertussis
gccugcuuguacaggcgcgg

SEQ ID NO: 2401387 - RNA, 16 nt, Bordetella pertussis
gccuggaagcuggcca

SEQ ID NO: 2401388 - RNA, 18 nt, Bordetella pertussis
gccuggaagcuggccagc

SEQ ID NO: 2401389 - RNA, 19 nt, Bordetella pertussis
gccuggaagugaugccgcc

SEQ ID NO: 2401390 - RNA, 19 nt, Bordetella pertussis
gccuggaccggcuccggcc

SEQ ID NO: 2401391 - RNA, 24 nt, Bordetella pertussis
gccuggaccggcuccggccgcuuc

SEQ ID NO: 2401392 - RNA, 12 nt, Bordetella pertussis
gccuggaccuga

SEQ ID NO: 2401393 - RNA, 18 nt, Bordetella pertussis
gccuggaccugacccccg

SEQ ID NO: 2401394 - RNA, 17 nt, Bordetella pertussis
gccuggaccugagccag

SEQ ID NO: 2401395 - RNA, 18 nt, Bordetella pertussis
gccuggaccugagccagg

SEQ ID NO: 2401396 - RNA, 14 nt, Bordetella pertussis
gccuggacgcgcug

SEQ ID NO: 2401397 - RNA, 15 nt, Bordetella pertussis
gccuggacgcgcugg

SEQ ID NO: 2401398 - RNA, 17 nt, Bordetella pertussis
gccuggacgcgcuggcc

SEQ ID NO: 2401399 - RNA, 19 nt, Bordetella pertussis
gccuggacgcgcuggccga

SEQ ID NO: 2401400 - RNA, 20 nt, Bordetella pertussis
gccuggacgcgcuggccgac

SEQ ID NO: 2401401 - RNA, 21 nt, Bordetella pertussis
gccuggacgcgcuggccgaca

SEQ ID NO: 2401402 - RNA, 17 nt, Bordetella pertussis
gccuggagcucgggugg

SEQ ID NO: 2401403 - RNA, 21 nt, Bordetella pertussis
gccuggaggccgagcgcgagc

SEQ ID NO: 2401404 - RNA, 19 nt, Bordetella pertussis
gccuggaucggggggugcg

SEQ ID NO: 2401405 - RNA, 15 nt, Bordetella pertussis
gccuggaugugcagg

SEQ ID NO: 2401406 - RNA, 14 nt, Bordetella pertussis
gccuggcaaugcgu

SEQ ID NO: 2401407 - RNA, 20 nt, Bordetella pertussis
gccuggcaaugcguggccgg

SEQ ID NO: 2401408 - RNA, 16 nt, Bordetella pertussis
gccuggcacaucggcc

SEQ ID NO: 2401409 - RNA, 18 nt, Bordetella pertussis
gccuggcacaucggcccu

SEQ ID NO: 2401410 - RNA, 15 nt, Bordetella pertussis
gccuggcagaugcgc

SEQ ID NO: 2401411 - RNA, 21 nt, Bordetella pertussis
gccuggcagaugcgcgccagg

SEQ ID NO: 2401412 - RNA, 15 nt, Bordetella pertussis
gccuggccagauagc

SEQ ID NO: 2401413 - RNA, 20 nt, Bordetella pertussis
gccuggccagauagcccagg

SEQ ID NO: 2401414 - RNA, 13 nt, Bordetella pertussis
gccuggcccagcu

SEQ ID NO: 2401415 - RNA, 20 nt, Bordetella pertussis
gccuggcccagcuccagcug

SEQ ID NO: 2401416 - RNA, 22 nt, Bordetella pertussis
gccuggcccagcuccagcuggc

SEQ ID NO: 2401417 - RNA, 15 nt, Bordetella pertussis
gccuggccccaggcg

SEQ ID NO: 2401418 - RNA, 19 nt, Bordetella pertussis
gccuggccccaggcgcccg

SEQ ID NO: 2401419 - RNA, 13 nt, Bordetella pertussis
gccugucccgcug

SEQ ID NO: 2401420 - RNA, 19 nt, Bordetella pertussis
gccugucccggcugggaca

SEQ ID NO: 2401421 - RNA, 20 nt, Bordetella pertussis
gccugucccggcugggacag

SEQ ID NO: 2401422 - RNA, 24 nt, Bordetella pertussis
gccugucccggcugggacaggcac

SEQ ID NO: 2401423 - RNA, 20 nt, Bordetella pertussis
gccugucccugccgggacag

SEQ ID NO: 2401424 - RNA, 15 nt, Bordetella pertussis
gccugucccugcggg

SEQ ID NO: 2401425 - RNA, 19 nt, Bordetella pertussis
gccugucccugcgggggca

SEQ ID NO: 2401426 - RNA, 17 nt, Bordetella pertussis
gccuguccuccccgcug

SEQ ID NO: 2401427 - RNA, 20 nt, Bordetella pertussis
gccugucuguuugcgcagug

SEQ ID NO: 2401428 - RNA, 15 nt, Bordetella pertussis
gccugugccagcugg

SEQ ID NO: 2401429 - RNA, 16 nt, Bordetella pertussis
gccugugccagcuggc

SEQ ID NO: 2401430 - RNA, 19 nt, Bordetella pertussis
gccugugccagcuggccca

SEQ ID NO: 2401431 - RNA, 13 nt, Bordetella pertussis
gccugugcccgca

SEQ ID NO: 2401432 - RNA, 17 nt, Bordetella pertussis
gccuguucccgccgggc

SEQ ID NO: 2401433 - RNA, 15 nt, Bordetella pertussis
gccuguucggacgca

SEQ ID NO: 2401434 - RNA, 14 nt, Bordetella pertussis
gccuguucuuucuu

SEQ ID NO: 2401435 - RNA, 17 nt, Bordetella pertussis
gccuuacgcggcgcgcg

SEQ ID NO: 2401436 - RNA, 18 nt, Bordetella pertussis
gccuuacgcggcgcgcgc

SEQ ID NO: 2401437 - RNA, 19 nt, Bordetella pertussis
gccuuacgcgguccgcagc

SEQ ID NO: 2401438 - RNA, 20 nt, Bordetella pertussis
gccuuacgcgguccgcagcg

SEQ ID NO: 2401439 - RNA, 22 nt, Bordetella pertussis
gccuuacgcgguccgcagcgcu

SEQ ID NO: 2401440 - RNA, 19 nt, Bordetella pertussis
gccuucacauccacugucu

SEQ ID NO: 2401441 - RNA, 22 nt, Bordetella pertussis
gccuucaccccgccaccgcccc

SEQ ID NO: 2401442 - RNA, 18 nt, Bordetella pertussis
gccuucagguucaugacc

SEQ ID NO: 2401443 - RNA, 17 nt, Bordetella pertussis
gccuucaugaucuggcc

SEQ ID NO: 2401444 - RNA, 24 nt, Bordetella pertussis
gccuucaugaucuggccgaccagc

SEQ ID NO: 2401445 - RNA, 19 nt, Bordetella pertussis
gccuuccaaguugcucaug

SEQ ID NO: 2401446 - RNA, 13 nt, Bordetella pertussis
gccuuccaccagc

SEQ ID NO: 2401447 - RNA, 15 nt, Bordetella pertussis
gccuucccaggcgag

SEQ ID NO: 2401448 - RNA, 17 nt, Bordetella pertussis
gccuucccaggcgaggc

SEQ ID NO: 2401449 - RNA, 21 nt, Bordetella pertussis
gccuucccaggcgaggcuggc

SEQ ID NO: 2401450 - RNA, 16 nt, Bordetella pertussis
gccuuccggcagcggc

SEQ ID NO: 2401451 - RNA, 20 nt, Bordetella pertussis
gccuuccggcagcggccagc

SEQ ID NO: 2401452 - RNA, 21 nt, Bordetella pertussis
gccuuccggcagcggccagcg

SEQ ID NO: 2401453 - RNA, 23 nt, Bordetella pertussis
gccuuccggcagcggccagcgcg

SEQ ID NO: 2401454 - RNA, 21 nt, Bordetella pertussis
gccuuccuugaacugcgcggu

SEQ ID NO: 2401455 - RNA, 23 nt, Bordetella pertussis
gccuuccuugaacugcgcggucu

SEQ ID NO: 2401456 - RNA, 22 nt, Bordetella pertussis
gccuucgaacucgauggccucg

SEQ ID NO: 2401457 - RNA, 24 nt, Bordetella pertussis
gccuucgaacucgauggccucggc

SEQ ID NO: 2401458 - RNA, 16 nt, Bordetella pertussis
gccuucgaccugcccg

SEQ ID NO: 2401459 - RNA, 18 nt, Bordetella pertussis
gccuucgaccugcccgag

SEQ ID NO: 2401460 - RNA, 19 nt, Bordetella pertussis
gccuucgacggcgggaccg

SEQ ID NO: 2401461 - RNA, 15 nt, Bordetella pertussis
gccuucgaggccggc

SEQ ID NO: 2401462 - RNA, 15 nt, Bordetella pertussis
gccuucgcgauccag

SEQ ID NO: 2401463 - RNA, 21 nt, Bordetella pertussis
gccuucgcgguaggacggcag

SEQ ID NO: 2401464 - RNA, 12 nt, Bordetella pertussis
gccuucgcugac

SEQ ID NO: 2401465 - RNA, 13 nt, Bordetella pertussis
gccuucgcugccc

SEQ ID NO: 2401466 - RNA, 22 nt, Bordetella pertussis
gccuucggccggcugcgcgccg

SEQ ID NO: 2401467 - RNA, 23 nt, Bordetella pertussis
gccuucggcgacuucggcggcca

SEQ ID NO: 2401468 - RNA, 14 nt, Bordetella pertussis
gccuucggcgcgca

SEQ ID NO: 2401469 - RNA, 16 nt, Bordetella pertussis
gccuucggcgcgcacg

SEQ ID NO: 2401470 - RNA, 17 nt, Bordetella pertussis
gccuucggcgcgcacgc

SEQ ID NO: 2401471 - RNA, 14 nt, Bordetella pertussis
gccuucggcgcgcg

SEQ ID NO: 2401472 - RNA, 15 nt, Bordetella pertussis
gccuucggcgcgcgc

SEQ ID NO: 2401473 - RNA, 17 nt, Bordetella pertussis
gccuucggcgcgcgccg

SEQ ID NO: 2401474 - RNA, 19 nt, Bordetella pertussis
gccuucggcgcgcgccggc

SEQ ID NO: 2401475 - RNA, 21 nt, Bordetella pertussis
gccuucggcgcgcgccggcuc

SEQ ID NO: 2401476 - RNA, 15 nt, Bordetella pertussis
gccuucggcgcggcg

SEQ ID NO: 2401477 - RNA, 19 nt, Bordetella pertussis
gccuucggcgcggcgggcg

SEQ ID NO: 2401478 - RNA, 22 nt, Bordetella pertussis
gccuucggcggcgauggucugg

SEQ ID NO: 2401479 - RNA, 16 nt, Bordetella pertussis
gccuucggcggcgcgc

SEQ ID NO: 2401480 - RNA, 19 nt, Bordetella pertussis
gccuucggcggcgcgcugg

SEQ ID NO: 2401481 - RNA, 17 nt, Bordetella pertussis
gccuucggcggcgggcu

SEQ ID NO: 2401482 - RNA, 18 nt, Bordetella pertussis
gccuucggcggcgggcug

SEQ ID NO: 2401483 - RNA, 12 nt, Bordetella pertussis
gccuucgggcgg

SEQ ID NO: 2401484 - RNA, 14 nt, Bordetella pertussis
gccuucgggcgguu

SEQ ID NO: 2401485 - RNA, 21 nt, Bordetella pertussis
gccuucguaaacaucgcgcau

SEQ ID NO: 2401486 - RNA, 17 nt, Bordetella pertussis
gccuucguccugccauu

SEQ ID NO: 2401487 - RNA, 22 nt, Bordetella pertussis
gccuugcggcgaugcacccagg

SEQ ID NO: 2401488 - RNA, 15 nt, Bordetella pertussis
gccuugcggcgccgu

SEQ ID NO: 2401489 - RNA, 14 nt, Bordetella pertussis
gccuugcgggccgg

SEQ ID NO: 2401490 - RNA, 15 nt, Bordetella pertussis
gccuugcuccggcgu

SEQ ID NO: 2401491 - RNA, 14 nt, Bordetella pertussis
gccuugcucgacca

SEQ ID NO: 2401492 - RNA, 18 nt, Bordetella pertussis
gccuugcugaaccugcug

SEQ ID NO: 2401493 - RNA, 23 nt, Bordetella pertussis
gccuugcugaaccugcuggccgc

SEQ ID NO: 2401494 - RNA, 14 nt, Bordetella pertussis
gccuugcugcccga

SEQ ID NO: 2401495 - RNA, 15 nt, Bordetella pertussis
gccuugcugcccgac

SEQ ID NO: 2401496 - RNA, 18 nt, Bordetella pertussis
gccuugcugcccgacggc

SEQ ID NO: 2401497 - RNA, 13 nt, Bordetella pertussis
gccuuggccagca

SEQ ID NO: 2401498 - RNA, 21 nt, Bordetella pertussis
gccuuggccauguccuggcag

SEQ ID NO: 2401499 - RNA, 14 nt, Bordetella pertussis
gccuuggccgcagc

SEQ ID NO: 2401500 - RNA, 19 nt, Bordetella pertussis
gccuuggccgcagccggcu

SEQ ID NO: 2401501 - RNA, 17 nt, Bordetella pertussis
gccuuggccugggccga

SEQ ID NO: 2401502 - RNA, 21 nt, Bordetella pertussis
gccuuggccugggccgacaug

SEQ ID NO: 2401503 - RNA, 22 nt, Bordetella pertussis
gccuuggcgaauggccacggcu

SEQ ID NO: 2401504 - RNA, 13 nt, Bordetella pertussis
gccuuggcgcgca

SEQ ID NO: 2401505 - RNA, 14 nt, Bordetella pertussis
gccuuggcgcgcag

SEQ ID NO: 2401506 - RNA, 16 nt, Bordetella pertussis
gccuuggcggccccgc

SEQ ID NO: 2401507 - RNA, 15 nt, Bordetella pertussis
gccuugggcgcggcg

SEQ ID NO: 2401508 - RNA, 11 nt, Bordetella pertussis
gccuuggggcg

SEQ ID NO: 2401509 - RNA, 14 nt, Bordetella pertussis
gccuuggggcggcc

SEQ ID NO: 2401510 - RNA, 15 nt, Bordetella pertussis
gccuuggggcggccc

SEQ ID NO: 2401511 - RNA, 19 nt, Bordetella pertussis
gccuuggggcggcccggcg

SEQ ID NO: 2401512 - RNA, 23 nt, Bordetella pertussis
gccuuggucgcgaccucggcggc

SEQ ID NO: 2401513 - RNA, 15 nt, Bordetella pertussis
gccuugguggggucg

SEQ ID NO: 2401514 - RNA, 16 nt, Bordetella pertussis
gccuugucgcgcccga

SEQ ID NO: 2401515 - RNA, 14 nt, Bordetella pertussis
gccuugugcgccag

SEQ ID NO: 2401516 - RNA, 16 nt, Bordetella pertussis
gccuugugcgccagcg

SEQ ID NO: 2401517 - RNA, 18 nt, Bordetella pertussis
gccuugugcgccagcgcg

SEQ ID NO: 2401518 - RNA, 15 nt, Bordetella pertussis
gccuuuuccaggcgu

SEQ ID NO: 2401519 - RNA, 15 nt, Bordetella pertussis
gcgaaacagcagcgg

SEQ ID NO: 2401520 - RNA, 23 nt, Bordetella pertussis
gcgaaacccucccacgaccugca

SEQ ID NO: 2401521 - RNA, 21 nt, Bordetella pertussis
gcgaaaccggugaucagcagg

SEQ ID NO: 2401522 - RNA, 23 nt, Bordetella pertussis
gcgaaacgccagcccgacggcca

SEQ ID NO: 2401523 - RNA, 13 nt, Bordetella pertussis
gcgaaacggccag

SEQ ID NO: 2401524 - RNA, 15 nt, Bordetella pertussis
gcgaaacggccagcg

SEQ ID NO: 2401525 - RNA, 13 nt, Bordetella pertussis
gcgaaacggccgg

SEQ ID NO: 2401526 - RNA, 21 nt, Bordetella pertussis
gcgaaacggcgggcgcgcagg

SEQ ID NO: 2401527 - RNA, 17 nt, Bordetella pertussis
gcgaaagccggccuccg

SEQ ID NO: 2401528 - RNA, 21 nt, Bordetella pertussis
gcgaaagcgcgucgagcaggc

SEQ ID NO: 2401529 - RNA, 21 nt, Bordetella pertussis
gcgaaagcgcugcgccgcggc

SEQ ID NO: 2401530 - RNA, 12 nt, Bordetella pertussis
gcgaaagcggcc

SEQ ID NO: 2401531 - RNA, 14 nt, Bordetella pertussis
gcgaaagcggccag

SEQ ID NO: 2401532 - RNA, 15 nt, Bordetella pertussis
gcgaaagcggcgugu

SEQ ID NO: 2401533 - RNA, 16 nt, Bordetella pertussis
gcgaaauccagcgcgc

SEQ ID NO: 2401534 - RNA, 17 nt, Bordetella pertussis
gcgaaauccagcgcgcc

SEQ ID NO: 2401535 - RNA, 22 nt, Bordetella pertussis
gcgaaaucuucugcgccacggc

SEQ ID NO: 2401536 - RNA, 18 nt, Bordetella pertussis
gcgaaauggcggccucgg

SEQ ID NO: 2401537 - RNA, 19 nt, Bordetella pertussis
gcgaaauggcggccucggg

SEQ ID NO: 2401538 - RNA, 23 nt, Bordetella pertussis
gcgaaaugucgagcgcgaugcca

SEQ ID NO: 2401539 - RNA, 19 nt, Bordetella pertussis
gcgaacaacgggaucggcg

SEQ ID NO: 2401540 - RNA, 12 nt, Bordetella pertussis
gcgaacaccagg

SEQ ID NO: 2401541 - RNA, 13 nt, Bordetella pertussis
gcgaacaccggca

SEQ ID NO: 2401542 - RNA, 14 nt, Bordetella pertussis
gcgaacaccggcag

SEQ ID NO: 2401543 - RNA, 18 nt, Bordetella pertussis
gcgaacaccggcaggccg

SEQ ID NO: 2401544 - RNA, 22 nt, Bordetella pertussis
gcgaacaccggcaggccgcgcu

SEQ ID NO: 2401545 - RNA, 14 nt, Bordetella pertussis
gcgaacagggcgcg

SEQ ID NO: 2401546 - RNA, 17 nt, Bordetella pertussis
gcgaacagggcgcgacg

SEQ ID NO: 2401547 - RNA, 21 nt, Bordetella pertussis
gcgaacagggcgcgacgccag

SEQ ID NO: 2401548 - RNA, 22 nt, Bordetella pertussis
gcgaacaguugcaccagugcgc

SEQ ID NO: 2401549 - RNA, 17 nt, Bordetella pertussis
gcgaacauggccgagau

SEQ ID NO: 2401550 - RNA, 23 nt, Bordetella pertussis
gcgaaccaggccaccgcggugcc

SEQ ID NO: 2401551 - RNA, 15 nt, Bordetella pertussis
gcgaaccaggccugc

SEQ ID NO: 2401552 - RNA, 16 nt, Bordetella pertussis
gcgaaccaggccugcg

SEQ ID NO: 2401553 - RNA, 15 nt, Bordetella pertussis
gcgaacccgaucgcg

SEQ ID NO: 2401554 - RNA, 15 nt, Bordetella pertussis
gcgaacccgccgcga

SEQ ID NO: 2401555 - RNA, 19 nt, Bordetella pertussis
gcgaacccgccgcgaucag

SEQ ID NO: 2401556 - RNA, 21 nt, Bordetella pertussis
gcgaaccgaauuccggcucgg

SEQ ID NO: 2401557 - RNA, 16 nt, Bordetella pertussis
gcgaaccggugcuggu

SEQ ID NO: 2401558 - RNA, 19 nt, Bordetella pertussis
gcgaacgcccggcccaggc

SEQ ID NO: 2401559 - RNA, 18 nt, Bordetella pertussis
gcgaacgcgccggcccag

SEQ ID NO: 2401560 - RNA, 20 nt, Bordetella pertussis
gcgaacgcgccggcccaggc

SEQ ID NO: 2401561 - RNA, 13 nt, Bordetella pertussis
gcgaacgcgcgcc

SEQ ID NO: 2401562 - RNA, 17 nt, Bordetella pertussis
gcgaacgcgcgccggcc

SEQ ID NO: 2401563 - RNA, 21 nt, Bordetella pertussis
gcgaacggauggucgugcggc

SEQ ID NO: 2401564 - RNA, 21 nt, Bordetella pertussis
gcgaacggcagcuugucgauc

SEQ ID NO: 2401565 - RNA, 14 nt, Bordetella pertussis
gcgaacggcccacg

SEQ ID NO: 2401566 - RNA, 13 nt, Bordetella pertussis
gcgaacggccgcc

SEQ ID NO: 2401567 - RNA, 16 nt, Bordetella pertussis
gcgaacggccgcccgg

SEQ ID NO: 2401568 - RNA, 17 nt, Bordetella pertussis
gcgaacggccgcccggc

SEQ ID NO: 2401569 - RNA, 18 nt, Bordetella pertussis
gcgaacggccgcccggca

SEQ ID NO: 2401570 - RNA, 19 nt, Bordetella pertussis
gcgaacggcgggcggauca

SEQ ID NO: 2401571 - RNA, 18 nt, Bordetella pertussis
gcgaacgggguggccggc

SEQ ID NO: 2401572 - RNA, 19 nt, Bordetella pertussis
gcgaacgggguggccggcg

SEQ ID NO: 2401573 - RNA, 22 nt, Bordetella pertussis
gcgaacgggguggccggcgcgc

SEQ ID NO: 2401574 - RNA, 14 nt, Bordetella pertussis
gcgaacgugcgcgc

SEQ ID NO: 2401575 - RNA, 15 nt, Bordetella pertussis
gcgaacgugcgcgcc

SEQ ID NO: 2401576 - RNA, 22 nt, Bordetella pertussis
gcgaacuccauuucgugcguga

SEQ ID NO: 2401577 - RNA, 13 nt, Bordetella pertussis
gcgaacugcucgu

SEQ ID NO: 2401578 - RNA, 13 nt, Bordetella pertussis
gcgaacugggcgu

SEQ ID NO: 2401579 - RNA, 17 nt, Bordetella pertussis
gcgaacugggcgucguc

SEQ ID NO: 2401580 - RNA, 23 nt, Bordetella pertussis
gcgaacugggcgucguccugcag

SEQ ID NO: 2401581 - RNA, 16 nt, Bordetella pertussis
gcgaagaacaccgccg

SEQ ID NO: 2401582 - RNA, 19 nt, Bordetella pertussis
gcgaagaacaccgccgcgc

SEQ ID NO: 2401583 - RNA, 23 nt, Bordetella pertussis
gcgaagaacaccgccgcgccgcc

SEQ ID NO: 2401584 - RNA, 14 nt, Bordetella pertussis
gcgaagacgauggc

SEQ ID NO: 2401585 - RNA, 15 nt, Bordetella pertussis
gcgaagacgauggcg

SEQ ID NO: 2401586 - RNA, 14 nt, Bordetella pertussis
gcgaagcagccggc

SEQ ID NO: 2401587 - RNA, 16 nt, Bordetella pertussis
gcgaagcagccggcca

SEQ ID NO: 2401588 - RNA, 18 nt, Bordetella pertussis
gcgaagcagccggccaag

SEQ ID NO: 2401589 - RNA, 17 nt, Bordetella pertussis
gcgaagccaucgacaag

SEQ ID NO: 2401590 - RNA, 14 nt, Bordetella pertussis
gcgaagccggcacg

SEQ ID NO: 2401591 - RNA, 18 nt, Bordetella pertussis
gcgaagccuugcgcggcc

SEQ ID NO: 2401592 - RNA, 12 nt, Bordetella pertussis
gcgaagcgcccu

SEQ ID NO: 2401593 - RNA, 14 nt, Bordetella pertussis
gcgaagcgcccugg

SEQ ID NO: 2401594 - RNA, 13 nt, Bordetella pertussis
gcgaagcgcgcca

SEQ ID NO: 2401595 - RNA, 15 nt, Bordetella pertussis
gcgaagcgcgccagc

SEQ ID NO: 2401596 - RNA, 13 nt, Bordetella pertussis
gcgaagcgcuggg

SEQ ID NO: 2401597 - RNA, 19 nt, Bordetella pertussis
gcgaagcggaaacgcgcgc

SEQ ID NO: 2401598 - RNA, 22 nt, Bordetella pertussis
gcgaagcggaaacgcgcgcgcc

SEQ ID NO: 2401599 - RNA, 23 nt, Bordetella pertussis
gcgaagcggaaacgcgcgcgccc

SEQ ID NO: 2401600 - RNA, 21 nt, Bordetella pertussis
gcgaccgcgcggcgcugcacg

SEQ ID NO: 2401601 - RNA, 15 nt, Bordetella pertussis
gcgaccggcgccggc

SEQ ID NO: 2401602 - RNA, 12 nt, Bordetella pertussis
gcgaccggcggc

SEQ ID NO: 2401603 - RNA, 14 nt, Bordetella pertussis
gcgaccggcggcac

SEQ ID NO: 2401604 - RNA, 16 nt, Bordetella pertussis
gcgaccgggccgaaga

SEQ ID NO: 2401605 - RNA, 13 nt, Bordetella pertussis
gcgaccgugcgcc

SEQ ID NO: 2401606 - RNA, 14 nt, Bordetella pertussis
gcgaccucggcggc

SEQ ID NO: 2401607 - RNA, 15 nt, Bordetella pertussis
gcgaccucggcggcg

SEQ ID NO: 2401608 - RNA, 19 nt, Bordetella pertussis
gcgaccucggcggcgucgc

SEQ ID NO: 2401609 - RNA, 19 nt, Bordetella pertussis
gcgaccugcgcgaccgccg

SEQ ID NO: 2401610 - RNA, 20 nt, Bordetella pertussis
gcgaccugcgcgaccgccgc

SEQ ID NO: 2401611 - RNA, 17 nt, Bordetella pertussis
gcgacgaacugaucggc

SEQ ID NO: 2401612 - RNA, 15 nt, Bordetella pertussis
gcgacgaaucgguca

SEQ ID NO: 2401613 - RNA, 16 nt, Bordetella pertussis
gcgacgaaucggucac

SEQ ID NO: 2401614 - RNA, 17 nt, Bordetella pertussis
gcgacgaaucggucacg

SEQ ID NO: 2401615 - RNA, 18 nt, Bordetella pertussis
gcgacgaauggguccgcg

SEQ ID NO: 2401616 - RNA, 18 nt, Bordetella pertussis
gcgacgacagcggcgagc

SEQ ID NO: 2401617 - RNA, 22 nt, Bordetella pertussis
gcgacgaccccgccgugccggg

SEQ ID NO: 2401618 - RNA, 18 nt, Bordetella pertussis
gcgacgacuacgcgcugg

SEQ ID NO: 2401619 - RNA, 21 nt, Bordetella pertussis
gcgacgacuacgcgcuggcgc

SEQ ID NO: 2401620 - RNA, 23 nt, Bordetella pertussis
gcgacgacuacgcgcuggcgcag

SEQ ID NO: 2401621 - RNA, 15 nt, Bordetella pertussis
gcgacgagggcgcca

SEQ ID NO: 2401622 - RNA, 17 nt, Bordetella pertussis
gcgacgauccggcgacc

SEQ ID NO: 2401623 - RNA, 17 nt, Bordetella pertussis
gcgacgaucuccacccc

SEQ ID NO: 2401624 - RNA, 22 nt, Bordetella pertussis
gcgacgcaacagacccgggccg

SEQ ID NO: 2401625 - RNA, 19 nt, Bordetella pertussis
gcgacgcauauccaggcgg

SEQ ID NO: 2401626 - RNA, 20 nt, Bordetella pertussis
gcgacgcauauccaggcggc

SEQ ID NO: 2401627 - RNA, 18 nt, Bordetella pertussis
gcgacgcaugucagcgcc

SEQ ID NO: 2401628 - RNA, 22 nt, Bordetella pertussis
gcgacgcaugucagcgccuggc

SEQ ID NO: 2401629 - RNA, 17 nt, Bordetella pertussis
gcgacgccagcgcgcca

SEQ ID NO: 2401630 - RNA, 16 nt, Bordetella pertussis
gcgacgccgccgaugg

SEQ ID NO: 2401631 - RNA, 15 nt, Bordetella pertussis
gcgacgccgcggugc

SEQ ID NO: 2401632 - RNA, 15 nt, Bordetella pertussis
gcgacgccguggugg

SEQ ID NO: 2401633 - RNA, 16 nt, Bordetella pertussis
gcgacgcgacgcgggc

SEQ ID NO: 2401634 - RNA, 22 nt, Bordetella pertussis
gcgacgcgcccucaguccagcu

SEQ ID NO: 2401635 - RNA, 15 nt, Bordetella pertussis
gcgacgcgccugcgc

SEQ ID NO: 2401636 - RNA, 19 nt, Bordetella pertussis
gcgacgcgccugcgcgcgg

SEQ ID NO: 2401637 - RNA, 16 nt, Bordetella pertussis
gcgacgcgcgccggcg

SEQ ID NO: 2401638 - RNA, 14 nt, Bordetella pertussis
gcgacgcgcugccg

SEQ ID NO: 2401639 - RNA, 15 nt, Bordetella pertussis
gcgacgcggcguacu

SEQ ID NO: 2401640 - RNA, 17 nt, Bordetella pertussis
gcgacgcggcguacugg

SEQ ID NO: 2401641 - RNA, 15 nt, Bordetella pertussis
gcgacgcguagccga

SEQ ID NO: 2401642 - RNA, 13 nt, Bordetella pertussis
gcgacgcuggcga

SEQ ID NO: 2401643 - RNA, 21 nt, Bordetella pertussis
gcgacgcuggcgaugcccacc

SEQ ID NO: 2401644 - RNA, 23 nt, Bordetella pertussis
gcgacgcuggcgaugcccaccag

SEQ ID NO: 2401645 - RNA, 20 nt, Bordetella pertussis
gcgacggaugggcgccgugc

SEQ ID NO: 2401646 - RNA, 18 nt, Bordetella pertussis
gcgacggcaaugccugcg

SEQ ID NO: 2401647 - RNA, 15 nt, Bordetella pertussis
gcgacggcagaugga

SEQ ID NO: 2401648 - RNA, 14 nt, Bordetella pertussis
gcgacggcaucgau

SEQ ID NO: 2401649 - RNA, 19 nt, Bordetella pertussis
gcgacggccccagcgccgc

SEQ ID NO: 2401650 - RNA, 20 nt, Bordetella pertussis
gcgacggccccagcgccgcg

SEQ ID NO: 2401651 - RNA, 21 nt, Bordetella pertussis
gcgacggccccagcgccgcga

SEQ ID NO: 2401652 - RNA, 18 nt, Bordetella pertussis
gcgacggccucccgccgc

SEQ ID NO: 2401653 - RNA, 14 nt, Bordetella pertussis
gcgacggccugcca

SEQ ID NO: 2401654 - RNA, 18 nt, Bordetella pertussis
gcgacggcgauguccugg

SEQ ID NO: 2401655 - RNA, 14 nt, Bordetella pertussis
gcgacggcgccggc

SEQ ID NO: 2401656 - RNA, 18 nt, Bordetella pertussis
gcgacggcgccuggcgca

SEQ ID NO: 2401657 - RNA, 12 nt, Bordetella pertussis
gcgacggcggcc

SEQ ID NO: 2401658 - RNA, 13 nt, Bordetella pertussis
gcgacggcggccu

SEQ ID NO: 2401659 - RNA, 14 nt, Bordetella pertussis
gcgacgggcaccga

SEQ ID NO: 2401660 - RNA, 20 nt, Bordetella pertussis
gcgacggucaggggcaggcg

SEQ ID NO: 2401661 - RNA, 21 nt, Bordetella pertussis
gcgacggucaggggcaggcgc

SEQ ID NO: 2401662 - RNA, 22 nt, Bordetella pertussis
gcgacggucaggggcaggcgca

SEQ ID NO: 2401663 - RNA, 18 nt, Bordetella pertussis
gcgacgguccugcgcgcc

SEQ ID NO: 2401664 - RNA, 20 nt, Bordetella pertussis
gcgacgucccaggccgaagc

SEQ ID NO: 2401665 - RNA, 21 nt, Bordetella pertussis
gcgacgucccaggccgaagcc

SEQ ID NO: 2401666 - RNA, 19 nt, Bordetella pertussis
gcgacgugacccgaugcgc

SEQ ID NO: 2401667 - RNA, 17 nt, Bordetella pertussis
gcgacgugucggccacc

SEQ ID NO: 2401668 - RNA, 18 nt, Bordetella pertussis
gcgacgugucggccacca

SEQ ID NO: 2401669 - RNA, 19 nt, Bordetella pertussis
gcgacguuggucaccacgc

SEQ ID NO: 2401670 - RNA, 16 nt, Bordetella pertussis
gcgacuccagcccgau

SEQ ID NO: 2401671 - RNA, 16 nt, Bordetella pertussis
gcgacuccggccgggc

SEQ ID NO: 2401672 - RNA, 18 nt, Bordetella pertussis
gcgacuccggccgggcca

SEQ ID NO: 2401673 - RNA, 22 nt, Bordetella pertussis
gcgacucgaacaccggcuuggc

SEQ ID NO: 2401674 - RNA, 20 nt, Bordetella pertussis
gcgacucgacgaacacgcgc

SEQ ID NO: 2401675 - RNA, 17 nt, Bordetella pertussis
gcgacucgccgugcugg

SEQ ID NO: 2401676 - RNA, 17 nt, Bordetella pertussis
gcgacugccccagcggc

SEQ ID NO: 2401677 - RNA, 21 nt, Bordetella pertussis
gcgacugccccagcggcuggc

SEQ ID NO: 2401678 - RNA, 23 nt, Bordetella pertussis
gcgacugccccagcggcuggcgc

SEQ ID NO: 2401679 - RNA, 19 nt, Bordetella pertussis
gcgacuggcccaggcgggc

SEQ ID NO: 2401680 - RNA, 14 nt, Bordetella pertussis
gcgacuggcggcug

SEQ ID NO: 2401681 - RNA, 15 nt, Bordetella pertussis
gcgacuggcggcugc

SEQ ID NO: 2401682 - RNA, 20 nt, Bordetella pertussis
gcgacuuccgcuuccggccg

SEQ ID NO: 2401683 - RNA, 21 nt, Bordetella pertussis
gcgacuuccgcuuccggccgg

SEQ ID NO: 2401684 - RNA, 14 nt, Bordetella pertussis
gcgacuucgccgau

SEQ ID NO: 2401685 - RNA, 24 nt, Bordetella pertussis
gcgacuucgcgaaagcgcugcgcc

SEQ ID NO: 2401686 - RNA, 16 nt, Bordetella pertussis
gcgacuucggcggcca

SEQ ID NO: 2401687 - RNA, 18 nt, Bordetella pertussis
gcgacuucuaccuggacg

SEQ ID NO: 2401688 - RNA, 15 nt, Bordetella pertussis
gcgagaaaaucggcg

SEQ ID NO: 2401689 - RNA, 18 nt, Bordetella pertussis
gcgagaacgcggccgcga

SEQ ID NO: 2401690 - RNA, 15 nt, Bordetella pertussis
gcgagaauggcgcga

SEQ ID NO: 2401691 - RNA, 16 nt, Bordetella pertussis
gcgagaccacgauggc

SEQ ID NO: 2401692 - RNA, 21 nt, Bordetella pertussis
gcgagaccacgauggccggcg

SEQ ID NO: 2401693 - RNA, 18 nt, Bordetella pertussis
gccggcugggcguucucg

SEQ ID NO: 2401694 - RNA, 17 nt, Bordetella pertussis
gccggcuucagccgcaa

SEQ ID NO: 2401695 - RNA, 13 nt, Bordetella pertussis
gccggcuuccagc

SEQ ID NO: 2401696 - RNA, 15 nt, Bordetella pertussis
gccggcuuccagcag

SEQ ID NO: 2401697 - RNA, 16 nt, Bordetella pertussis
gccggcuuccagcagc

SEQ ID NO: 2401698 - RNA, 20 nt, Bordetella pertussis
gccggcuugcauggugccgg

SEQ ID NO: 2401699 - RNA, 21 nt, Bordetella pertussis
gccggcuugcauggugccgga

SEQ ID NO: 2401700 - RNA, 13 nt, Bordetella pertussis
gccggcuugcgca

SEQ ID NO: 2401701 - RNA, 17 nt, Bordetella pertussis
gccggcuugcgcaagcc

SEQ ID NO: 2401702 - RNA, 21 nt, Bordetella pertussis
gccggcuugcgcaagccggcc

SEQ ID NO: 2401703 - RNA, 22 nt, Bordetella pertussis
gccggcuugcgcaagccggccg

SEQ ID NO: 2401704 - RNA, 17 nt, Bordetella pertussis
gccggcuugcgccagcc

SEQ ID NO: 2401705 - RNA, 18 nt, Bordetella pertussis
gccggcuugcgccagcca

SEQ ID NO: 2401706 - RNA, 16 nt, Bordetella pertussis
gccggcuuucagcgcc

SEQ ID NO: 2401707 - RNA, 18 nt, Bordetella pertussis
gccggcuuucagcgccga

SEQ ID NO: 2401708 - RNA, 20 nt, Bordetella pertussis
gccggcuuucagcgccgagc

SEQ ID NO: 2401709 - RNA, 13 nt, Bordetella pertussis
gccgggaaaaaga

SEQ ID NO: 2401710 - RNA, 21 nt, Bordetella pertussis
gccgggacaaucgaagauggu

SEQ ID NO: 2401711 - RNA, 13 nt, Bordetella pertussis
gccgggacaggca

SEQ ID NO: 2401712 - RNA, 14 nt, Bordetella pertussis
gccgggacaggcac

SEQ ID NO: 2401713 - RNA, 15 nt, Bordetella pertussis
gccgggacaggcacc

SEQ ID NO: 2401714 - RNA, 17 nt, Bordetella pertussis
gccgggacaggcacccg

SEQ ID NO: 2401715 - RNA, 20 nt, Bordetella pertussis
gccgggaccuuggcggcugg

SEQ ID NO: 2401716 - RNA, 19 nt, Bordetella pertussis
gccgggacggaaguccugc

SEQ ID NO: 2401717 - RNA, 16 nt, Bordetella pertussis
gccgggagcggccagc

SEQ ID NO: 2401718 - RNA, 17 nt, Bordetella pertussis
gccgggagcggccagca

SEQ ID NO: 2401719 - RNA, 20 nt, Bordetella pertussis
gccgggauccacgccgccgg

SEQ ID NO: 2401720 - RNA, 22 nt, Bordetella pertussis
gccgggauccacgccgccggcc

SEQ ID NO: 2401721 - RNA, 20 nt, Bordetella pertussis
gccgggaugcugcucggcca

SEQ ID NO: 2401722 - RNA, 16 nt, Bordetella pertussis
gccgggcacaccguca

SEQ ID NO: 2401723 - RNA, 23 nt, Bordetella pertussis
gccgggcacaccgucacgcgcaa

SEQ ID NO: 2401724 - RNA, 15 nt, Bordetella pertussis
gccgggcaccgagcc

SEQ ID NO: 2401725 - RNA, 22 nt, Bordetella pertussis
gccgggcacguaguacagcagc

SEQ ID NO: 2401726 - RNA, 23 nt, Bordetella pertussis
gccgggcagcaucacggugccgc

SEQ ID NO: 2401727 - RNA, 16 nt, Bordetella pertussis
gccgggcagcccgcgc

SEQ ID NO: 2401728 - RNA, 19 nt, Bordetella pertussis
gccgggcagcccgcgcacg

SEQ ID NO: 2401729 - RNA, 22 nt, Bordetella pertussis
gccgggcagcccgcgcacgccc

SEQ ID NO: 2401730 - RNA, 16 nt, Bordetella pertussis
gccgggcagcgggccg

SEQ ID NO: 2401731 - RNA, 19 nt, Bordetella pertussis
gccgggcagcgggccgcag

SEQ ID NO: 2401732 - RNA, 21 nt, Bordetella pertussis
gccgggcagcgggccgcagca

SEQ ID NO: 2401733 - RNA, 23 nt, Bordetella pertussis
gccgggcagcgggccgcagcaug

SEQ ID NO: 2401734 - RNA, 14 nt, Bordetella pertussis
gccgggcaggccgc

SEQ ID NO: 2401735 - RNA, 20 nt, Bordetella pertussis
gccgggcaguccuggcuggg

SEQ ID NO: 2401736 - RNA, 16 nt, Bordetella pertussis
gccgggcaguucgggc

SEQ ID NO: 2401737 - RNA, 20 nt, Bordetella pertussis
gccgggcauggcccggcucg

SEQ ID NO: 2401738 - RNA, 22 nt, Bordetella pertussis
gccgggcauggcccggcucgcc

SEQ ID NO: 2401739 - RNA, 15 nt, Bordetella pertussis
gccgggcauugccgg

SEQ ID NO: 2401740 - RNA, 21 nt, Bordetella pertussis
gccgggcauugccggagcagc

SEQ ID NO: 2401741 - RNA, 16 nt, Bordetella pertussis
gccgggccacgcgcac

SEQ ID NO: 2401742 - RNA, 23 nt, Bordetella pertussis
gccgggccagaccuggugaucgc

SEQ ID NO: 2401743 - RNA, 14 nt, Bordetella pertussis
gccgggccagcgcg

SEQ ID NO: 2401744 - RNA, 15 nt, Bordetella pertussis
gccgggccagcgcga

SEQ ID NO: 2401745 - RNA, 16 nt, Bordetella pertussis
gccgggccagcgcgau

SEQ ID NO: 2401746 - RNA, 17 nt, Bordetella pertussis
gccgggccagcgcgauc

SEQ ID NO: 2401747 - RNA, 16 nt, Bordetella pertussis
gccgggcccggccacg

SEQ ID NO: 2401748 - RNA, 19 nt, Bordetella pertussis
gccgggcccggccacggcc

SEQ ID NO: 2401749 - RNA, 23 nt, Bordetella pertussis
gccgggcccggccacggccgggc

SEQ ID NO: 2401750 - RNA, 16 nt, Bordetella pertussis
gccgggcccggcgcgc

SEQ ID NO: 2401751 - RNA, 14 nt, Bordetella pertussis
gccgggccgcgccc

SEQ ID NO: 2401752 - RNA, 15 nt, Bordetella pertussis
gccgggccgcgccgc

SEQ ID NO: 2401753 - RNA, 15 nt, Bordetella pertussis
gccgggccggcgggc

SEQ ID NO: 2401754 - RNA, 15 nt, Bordetella pertussis
gccgggccgggcacg

SEQ ID NO: 2401755 - RNA, 15 nt, Bordetella pertussis
gccgggccgugcgcc

SEQ ID NO: 2401756 - RNA, 17 nt, Bordetella pertussis
gccgggccuagcccggc

SEQ ID NO: 2401757 - RNA, 20 nt, Bordetella pertussis
gccgggccuagcccggcgcc

SEQ ID NO: 2401758 - RNA, 22 nt, Bordetella pertussis
gccgggccucaaucgaugaugu

SEQ ID NO: 2401759 - RNA, 18 nt, Bordetella pertussis
gccgggcgaaccgguggc

SEQ ID NO: 2401760 - RNA, 19 nt, Bordetella pertussis
gccgggcgacggcgugcug

SEQ ID NO: 2401761 - RNA, 14 nt, Bordetella pertussis
gccgggcgaucgcg

SEQ ID NO: 2401762 - RNA, 23 nt, Bordetella pertussis
gccgggcgaucgcgucggccaag

SEQ ID NO: 2401763 - RNA, 12 nt, Bordetella pertussis
gccgggcgccca

SEQ ID NO: 2401764 - RNA, 15 nt, Bordetella pertussis
gccgggcgcccagcg

SEQ ID NO: 2401765 - RNA, 21 nt, Bordetella pertussis
gccgggcgcccagcgucucga

SEQ ID NO: 2401766 - RNA, 18 nt, Bordetella pertussis
gccgggcgccgauccagc

SEQ ID NO: 2401767 - RNA, 19 nt, Bordetella pertussis
gccgggcgccgauccagcc

SEQ ID NO: 2401768 - RNA, 20 nt, Bordetella pertussis
gccgggcgccgauccagccc

SEQ ID NO: 2401769 - RNA, 12 nt, Bordetella pertussis
gccgggcgccgc

SEQ ID NO: 2401770 - RNA, 15 nt, Bordetella pertussis
gccgggcgccgcgcc

SEQ ID NO: 2401771 - RNA, 19 nt, Bordetella pertussis
gccgggcgccgcgccccau

SEQ ID NO: 2401772 - RNA, 23 nt, Bordetella pertussis
gccgggcgccgcgccccaucacc

SEQ ID NO: 2401773 - RNA, 14 nt, Bordetella pertussis
gccgggcgccggcg

SEQ ID NO: 2401774 - RNA, 16 nt, Bordetella pertussis
gccgggcgccggcggc

SEQ ID NO: 2401775 - RNA, 13 nt, Bordetella pertussis
gccgggcgcgccg

SEQ ID NO: 2401776 - RNA, 16 nt, Bordetella pertussis
gccgggcgcgccggcg

SEQ ID NO: 2401777 - RNA, 13 nt, Bordetella pertussis
gccgggcgcgcgc

SEQ ID NO: 2401778 - RNA, 14 nt, Bordetella pertussis
gccgggcgcgcgcc

SEQ ID NO: 2401779 - RNA, 15 nt, Bordetella pertussis
gccgggcgcgcgccg

SEQ ID NO: 2401780 - RNA, 13 nt, Bordetella pertussis
gccgggcgcgcug

SEQ ID NO: 2401781 - RNA, 15 nt, Bordetella pertussis
gccgggcgcgcugcc

SEQ ID NO: 2401782 - RNA, 16 nt, Bordetella pertussis
gccgggcgcggccagg

SEQ ID NO: 2401783 - RNA, 17 nt, Bordetella pertussis
gccgggcgcggccaggc

SEQ ID NO: 2401784 - RNA, 15 nt, Bordetella pertussis
gccgggcgcggcccg

SEQ ID NO: 2401785 - RNA, 19 nt, Bordetella pertussis
gccgggcgcggcccggcgu

SEQ ID NO: 2401786 - RNA, 17 nt, Bordetella pertussis
gccgggcgcggccgccg

SEQ ID NO: 2401787 - RNA, 19 nt, Bordetella pertussis
gccgggcgcggccgccgcc

SEQ ID NO: 2401788 - RNA, 13 nt, Bordetella pertussis
gccgggcgcggcg

SEQ ID NO: 2401789 - RNA, 16 nt, Bordetella pertussis
gccgggcgcggcgccc

SEQ ID NO: 2401790 - RNA, 18 nt, Bordetella pertussis
gccgggcgcggcgcccgc

SEQ ID NO: 2401791 - RNA, 21 nt, Bordetella pertussis
gccgggcgcggcgcccgccug

SEQ ID NO: 2401792 - RNA, 11 nt, Bordetella pertussis
gccgggcgcgu

SEQ ID NO: 2401793 - RNA, 18 nt, Bordetella pertussis
gccgggcgcguggcccgc

SEQ ID NO: 2401794 - RNA, 17 nt, Bordetella pertussis
gccgggcggccacggcg

SEQ ID NO: 2401795 - RNA, 11 nt, Bordetella pertussis
gccgggcggcg

SEQ ID NO: 2401796 - RNA, 17 nt, Bordetella pertussis
gccgggcggcgccgucg

SEQ ID NO: 2401797 - RNA, 15 nt, Bordetella pertussis
gccgggcggcgcggg

SEQ ID NO: 2401798 - RNA, 16 nt, Bordetella pertussis
gccgggcuccucgccc

SEQ ID NO: 2401799 - RNA, 12 nt, Bordetella pertussis
gccgggcucgaa

SEQ ID NO: 2401800 - RNA, 22 nt, Bordetella pertussis
gccgggcucgaugaccagcagc

SEQ ID NO: 2401801 - RNA, 23 nt, Bordetella pertussis
gccgggcucgaugaccagcagcg

SEQ ID NO: 2401802 - RNA, 14 nt, Bordetella pertussis
gccgggcucggcca

SEQ ID NO: 2401803 - RNA, 16 nt, Bordetella pertussis
gccgggcucggccacc

SEQ ID NO: 2401804 - RNA, 14 nt, Bordetella pertussis
gccgggcuggaucc

SEQ ID NO: 2401805 - RNA, 17 nt, Bordetella pertussis
gccgggcuggauccggc

SEQ ID NO: 2401806 - RNA, 18 nt, Bordetella pertussis
gccgggcuggauccggcg

SEQ ID NO: 2401807 - RNA, 20 nt, Bordetella pertussis
gccgggcuggauccggcgcu

SEQ ID NO: 2401808 - RNA, 13 nt, Bordetella pertussis
gcacgcugaucgc

SEQ ID NO: 2401809 - RNA, 17 nt, Bordetella pertussis
gcacgcugaucgccggc

SEQ ID NO: 2401810 - RNA, 19 nt, Bordetella pertussis
gcacgcugaucgccggcgc

SEQ ID NO: 2401811 - RNA, 21 nt, Bordetella pertussis
gcacgcugaucgccggcgccc

SEQ ID NO: 2401812 - RNA, 15 nt, Bordetella pertussis
gcacgcugcgcaggc

SEQ ID NO: 2401813 - RNA, 17 nt, Bordetella pertussis
gcacgcugcgcaggcgc

SEQ ID NO: 2401814 - RNA, 18 nt, Bordetella pertussis
gcacgcugcgcaggcgcg

SEQ ID NO: 2401815 - RNA, 15 nt, Bordetella pertussis
gcacgcugcgcggcg

SEQ ID NO: 2401816 - RNA, 17 nt, Bordetella pertussis
gcacgcugcgcggcggc

SEQ ID NO: 2401817 - RNA, 19 nt, Bordetella pertussis
gcacgcugcgcggcggcuu

SEQ ID NO: 2401818 - RNA, 22 nt, Bordetella pertussis
gcacgcugcugauccucgccag

SEQ ID NO: 2401819 - RNA, 17 nt, Bordetella pertussis
gcacgcuggcgcccgcc

SEQ ID NO: 2401820 - RNA, 17 nt, Bordetella pertussis
gcacgcuggcguugacg

SEQ ID NO: 2401821 - RNA, 20 nt, Bordetella pertussis
gcacgcugggcgaggcgcug

SEQ ID NO: 2401822 - RNA, 21 nt, Bordetella pertussis
gcacgcugggcgaggcgcugg

SEQ ID NO: 2401823 - RNA, 24 nt, Bordetella pertussis
gcacgcugggcgaggcgcuggccg

SEQ ID NO: 2401824 - RNA, 14 nt, Bordetella pertussis
gcacgcuugccgca

SEQ ID NO: 2401825 - RNA, 20 nt, Bordetella pertussis
gcacggacagcccgcgcugg

SEQ ID NO: 2401826 - RNA, 21 nt, Bordetella pertussis
gcacggacagcccgcgcuggc

SEQ ID NO: 2401827 - RNA, 17 nt, Bordetella pertussis
gcacggagggugcgcaa

SEQ ID NO: 2401828 - RNA, 16 nt, Bordetella pertussis
gcacggcaaaacggug

SEQ ID NO: 2401829 - RNA, 18 nt, Bordetella pertussis
gcacggcaauguccgggg

SEQ ID NO: 2401830 - RNA, 15 nt, Bordetella pertussis
gcacggcacgccucg

SEQ ID NO: 2401831 - RNA, 12 nt, Bordetella pertussis
gcacggccacga

SEQ ID NO: 2401832 - RNA, 17 nt, Bordetella pertussis
gcacggccacggccggc

SEQ ID NO: 2401833 - RNA, 15 nt, Bordetella pertussis
gcacggccagcacca

SEQ ID NO: 2401834 - RNA, 12 nt, Bordetella pertussis
gcacggccagcg

SEQ ID NO: 2401835 - RNA, 15 nt, Bordetella pertussis
gcacggccggccagg

SEQ ID NO: 2401836 - RNA, 16 nt, Bordetella pertussis
gcacggccggccaggc

SEQ ID NO: 2401837 - RNA, 17 nt, Bordetella pertussis
gcacggccggccaggcg

SEQ ID NO: 2401838 - RNA, 19 nt, Bordetella pertussis
gcacggccuugucgcgccc

SEQ ID NO: 2401839 - RNA, 14 nt, Bordetella pertussis
gcacggcgcacacc

SEQ ID NO: 2401840 - RNA, 12 nt, Bordetella pertussis
gcacggcgcccu

SEQ ID NO: 2401841 - RNA, 16 nt, Bordetella pertussis
gcacggcgcccugcgc

SEQ ID NO: 2401842 - RNA, 12 nt, Bordetella pertussis
gcacggcggcga

SEQ ID NO: 2401843 - RNA, 14 nt, Bordetella pertussis
gcacggcguggcgc

SEQ ID NO: 2401844 - RNA, 18 nt, Bordetella pertussis
gcacggcguggcgcgcac

SEQ ID NO: 2401845 - RNA, 19 nt, Bordetella pertussis
gcacggcuugcgcgccugc

SEQ ID NO: 2401846 - RNA, 22 nt, Bordetella pertussis
gcacggcuugcgcgccugcugg

SEQ ID NO: 2401847 - RNA, 18 nt, Bordetella pertussis
gcacgggcagacgccauc

SEQ ID NO: 2401848 - RNA, 14 nt, Bordetella pertussis
gcacgggccaugga

SEQ ID NO: 2401849 - RNA, 18 nt, Bordetella pertussis
gcacgggcgaggcggggc

SEQ ID NO: 2401850 - RNA, 15 nt, Bordetella pertussis
gcacgggcgagggcu

SEQ ID NO: 2401851 - RNA, 23 nt, Bordetella pertussis
gcacgggcgagggcugcccucgc

SEQ ID NO: 2401852 - RNA, 12 nt, Bordetella pertussis
gcacgggcgccu

SEQ ID NO: 2401853 - RNA, 13 nt, Bordetella pertussis
gcacgggcgccug

SEQ ID NO: 2401854 - RNA, 17 nt, Bordetella pertussis
gcacgggcgccuguccc

SEQ ID NO: 2401855 - RNA, 19 nt, Bordetella pertussis
gcacgggcgccuguccccg

SEQ ID NO: 2401856 - RNA, 17 nt, Bordetella pertussis
gcacggggacaggcacg

SEQ ID NO: 2401857 - RNA, 14 nt, Bordetella pertussis
gcacggggacuggc

SEQ ID NO: 2401858 - RNA, 21 nt, Bordetella pertussis
gcacggggacuggcaccggcc

SEQ ID NO: 2401859 - RNA, 15 nt, Bordetella pertussis
gcacggggagcgacc

SEQ ID NO: 2401860 - RNA, 14 nt, Bordetella pertussis
gcacggggcaucaa

SEQ ID NO: 2401861 - RNA, 16 nt, Bordetella pertussis
gcacgggucaggcugc

SEQ ID NO: 2401862 - RNA, 22 nt, Bordetella pertussis
gcacgggucaggcugcggcgga

SEQ ID NO: 2401863 - RNA, 16 nt, Bordetella pertussis
gcacgguacgccgaac

SEQ ID NO: 2401864 - RNA, 14 nt, Bordetella pertussis
gcacgguccaggcg

SEQ ID NO: 2401865 - RNA, 19 nt, Bordetella pertussis
gcacgguccaggcggccgc

SEQ ID NO: 2401866 - RNA, 14 nt, Bordetella pertussis
gcacggucggcgcg

SEQ ID NO: 2401867 - RNA, 15 nt, Bordetella pertussis
gcacggucggcgcgu

SEQ ID NO: 2401868 - RNA, 15 nt, Bordetella pertussis
gcacggugccgcgcg

SEQ ID NO: 2401869 - RNA, 16 nt, Bordetella pertussis
gcacggugccgcgcgc

SEQ ID NO: 2401870 - RNA, 17 nt, Bordetella pertussis
gcacggugccgcgcgcu

SEQ ID NO: 2401871 - RNA, 18 nt, Bordetella pertussis
gcacggugccgcgcgcuu

SEQ ID NO: 2401872 - RNA, 19 nt, Bordetella pertussis
gcacggugccgcgcgcuuc

SEQ ID NO: 2401873 - RNA, 22 nt, Bordetella pertussis
gcacgguggcgaaggccgccgc

SEQ ID NO: 2401874 - RNA, 13 nt, Bordetella pertussis
gcacgguggcgcc

SEQ ID NO: 2401875 - RNA, 19 nt, Bordetella pertussis
gcacgguggcgcccggcgg

SEQ ID NO: 2401876 - RNA, 17 nt, Bordetella pertussis
gcacgguggcgccgucg

SEQ ID NO: 2401877 - RNA, 23 nt, Bordetella pertussis
gcacgguggcgccgucgcgcugu

SEQ ID NO: 2401878 - RNA, 18 nt, Bordetella pertussis
gcacggugggcagcagca

SEQ ID NO: 2401879 - RNA, 20 nt, Bordetella pertussis
gcacgguguugaccaccacg

SEQ ID NO: 2401880 - RNA, 17 nt, Bordetella pertussis
gcacgguugccacggug

SEQ ID NO: 2401881 - RNA, 20 nt, Bordetella pertussis
gcacguaaucgaagccgggc

SEQ ID NO: 2401882 - RNA, 21 nt, Bordetella pertussis
gcacguaaucgaagccgggcg

SEQ ID NO: 2401883 - RNA, 16 nt, Bordetella pertussis
gcacguaccaggcgcu

SEQ ID NO: 2401884 - RNA, 17 nt, Bordetella pertussis
gcacguaccaggcgcug

SEQ ID NO: 2401885 - RNA, 15 nt, Bordetella pertussis
gcacguagcgcagca

SEQ ID NO: 2401886 - RNA, 17 nt, Bordetella pertussis
gcacgucauccugggcg

SEQ ID NO: 2401887 - RNA, 19 nt, Bordetella pertussis
gcacgucauccugggcgcg

SEQ ID NO: 2401888 - RNA, 23 nt, Bordetella pertussis
gcacgucauccugggcgcgcgcc

SEQ ID NO: 2401889 - RNA, 21 nt, Bordetella pertussis
gcacgucauugcaucgcagca

SEQ ID NO: 2401890 - RNA, 19 nt, Bordetella pertussis
gcacguccaaugccagggu

SEQ ID NO: 2401891 - RNA, 23 nt, Bordetella pertussis
gcacguccagagucugccuggcg

SEQ ID NO: 2401892 - RNA, 12 nt, Bordetella pertussis
gcacguccagcg

SEQ ID NO: 2401893 - RNA, 13 nt, Bordetella pertussis
gcacguccagcgg

SEQ ID NO: 2401894 - RNA, 16 nt, Bordetella pertussis
gcacguccagcggcgc

SEQ ID NO: 2401895 - RNA, 19 nt, Bordetella pertussis
gcacgucccagucgccgcg

SEQ ID NO: 2401896 - RNA, 18 nt, Bordetella pertussis
gcacguccggcacggcgg

SEQ ID NO: 2401897 - RNA, 13 nt, Bordetella pertussis
gcacgucgcgcaa

SEQ ID NO: 2401898 - RNA, 15 nt, Bordetella pertussis
gcacgucgggcagga

SEQ ID NO: 2401899 - RNA, 19 nt, Bordetella pertussis
gcacgucgggcaggauggc

SEQ ID NO: 2401900 - RNA, 20 nt, Bordetella pertussis
gcacgucgggcaggauggcc

SEQ ID NO: 2401901 - RNA, 22 nt, Bordetella pertussis
gcacgucgguggugaccacggc

SEQ ID NO: 2401902 - RNA, 17 nt, Bordetella pertussis
gcacgucguagcgcugc

SEQ ID NO: 2401903 - RNA, 21 nt, Bordetella pertussis
gcacgucguagcgcugcagcc

SEQ ID NO: 2401904 - RNA, 14 nt, Bordetella pertussis
gcacgugacgccgg

SEQ ID NO: 2401905 - RNA, 16 nt, Bordetella pertussis
gcacgugaugcaggcg

SEQ ID NO: 2401906 - RNA, 18 nt, Bordetella pertussis
gcacgugaugcaggcggu

SEQ ID NO: 2401907 - RNA, 17 nt, Bordetella pertussis
gcacgugccggauggcg

SEQ ID NO: 2401908 - RNA, 22 nt, Bordetella pertussis
gcacgugccggauggcgcggau

SEQ ID NO: 2401909 - RNA, 16 nt, Bordetella pertussis
gaugcccagcaccgcc

SEQ ID NO: 2401910 - RNA, 17 nt, Bordetella pertussis
gaugcccagcaccgcca

SEQ ID NO: 2401911 - RNA, 14 nt, Bordetella pertussis
gaugcccagcgccg

SEQ ID NO: 2401912 - RNA, 21 nt, Bordetella pertussis
gaugcccaggcccgccagggc

SEQ ID NO: 2401913 - RNA, 17 nt, Bordetella pertussis
gaugcccaggcccuggc

SEQ ID NO: 2401914 - RNA, 18 nt, Bordetella pertussis
gaugcccaggcccuggcu

SEQ ID NO: 2401915 - RNA, 16 nt, Bordetella pertussis
gaugcccagggccgcg

SEQ ID NO: 2401916 - RNA, 12 nt, Bordetella pertussis
gaugccccaggu

SEQ ID NO: 2401917 - RNA, 22 nt, Bordetella pertussis
gaugccccagguccgccggcac

SEQ ID NO: 2401918 - RNA, 13 nt, Bordetella pertussis
gaugccccagucc

SEQ ID NO: 2401919 - RNA, 21 nt, Bordetella pertussis
gaugccccaguccaggccggc

SEQ ID NO: 2401920 - RNA, 16 nt, Bordetella pertussis
gaugccccgcccgcgu

SEQ ID NO: 2401921 - RNA, 17 nt, Bordetella pertussis
gaugcccgaggcggcgc

SEQ ID NO: 2401922 - RNA, 17 nt, Bordetella pertussis
gaugcccgcgcaccagg

SEQ ID NO: 2401923 - RNA, 20 nt, Bordetella pertussis
gaugcccgcgcaccaggcgc

SEQ ID NO: 2401924 - RNA, 14 nt, Bordetella pertussis
gaugcccgcgggca

SEQ ID NO: 2401925 - RNA, 18 nt, Bordetella pertussis
gaugcccgggaucugcga

SEQ ID NO: 2401926 - RNA, 22 nt, Bordetella pertussis
gaugcccucgcgcacggugcgc

SEQ ID NO: 2401927 - RNA, 18 nt, Bordetella pertussis
gccuggcguucggcaccg

SEQ ID NO: 2401928 - RNA, 20 nt, Bordetella pertussis
gccuggcguucggcaccggc

SEQ ID NO: 2401929 - RNA, 17 nt, Bordetella pertussis
gccuggcucaggccugc

SEQ ID NO: 2401930 - RNA, 18 nt, Bordetella pertussis
gccuggcucaggccugca

SEQ ID NO: 2401931 - RNA, 19 nt, Bordetella pertussis
gccuggcucaggccugcac

SEQ ID NO: 2401932 - RNA, 20 nt, Bordetella pertussis
gccuggcucaggccugcacg

SEQ ID NO: 2401933 - RNA, 16 nt, Bordetella pertussis
gccuggcucagucggc

SEQ ID NO: 2401934 - RNA, 13 nt, Bordetella pertussis
gccuggcugcaag

SEQ ID NO: 2401935 - RNA, 17 nt, Bordetella pertussis
gccuggcuuacaggccc

SEQ ID NO: 2401936 - RNA, 18 nt, Bordetella pertussis
gccuggcuuacaggccca

SEQ ID NO: 2401937 - RNA, 22 nt, Bordetella pertussis
gccuggcuucccgguccaggcc

SEQ ID NO: 2401938 - RNA, 18 nt, Bordetella pertussis
gccuggcuuucgccgcgg

SEQ ID NO: 2401939 - RNA, 19 nt, Bordetella pertussis
gccugggccauggccucgu

SEQ ID NO: 2401940 - RNA, 12 nt, Bordetella pertussis
gccugggccugu

SEQ ID NO: 2401941 - RNA, 17 nt, Bordetella pertussis
gccugggccuucuuguc

SEQ ID NO: 2401942 - RNA, 17 nt, Bordetella pertussis
gccugggcgccuggcug

SEQ ID NO: 2401943 - RNA, 19 nt, Bordetella pertussis
gccugggcgccuggcugca

SEQ ID NO: 2401944 - RNA, 13 nt, Bordetella pertussis
gccugggcgcgcg

SEQ ID NO: 2401945 - RNA, 14 nt, Bordetella pertussis
gccugggcgcgcgc

SEQ ID NO: 2401946 - RNA, 23 nt, Bordetella pertussis
gccugggcgcgcgcccaggccag

SEQ ID NO: 2401947 - RNA, 19 nt, Bordetella pertussis
gccugggcgcgguccagca

SEQ ID NO: 2401948 - RNA, 13 nt, Bordetella pertussis
gccugggcggcca

SEQ ID NO: 2401949 - RNA, 16 nt, Bordetella pertussis
gccugggcggccacgu

SEQ ID NO: 2401950 - RNA, 13 nt, Bordetella pertussis
gccugggcggcgc

SEQ ID NO: 2401951 - RNA, 16 nt, Bordetella pertussis
gccugggcggcgcagu

SEQ ID NO: 2401952 - RNA, 18 nt, Bordetella pertussis
gccugggcggcgcagucg

SEQ ID NO: 2401953 - RNA, 18 nt, Bordetella pertussis
gccugggcggcgcgcucu

SEQ ID NO: 2401954 - RNA, 15 nt, Bordetella pertussis
gccugggcggcggcg

SEQ ID NO: 2401955 - RNA, 22 nt, Bordetella pertussis
gccugggcggcggcgaugccgc

SEQ ID NO: 2401956 - RNA, 18 nt, Bordetella pertussis
gccuggggacgggcgcac

SEQ ID NO: 2401957 - RNA, 19 nt, Bordetella pertussis
gccuggggacgggcgcaca

SEQ ID NO: 2401958 - RNA, 21 nt, Bordetella pertussis
gccuggggacgggcgcacagu

SEQ ID NO: 2401959 - RNA, 9 nt, Bordetella pertussis
gccuggggc

SEQ ID NO: 2401960 - RNA, 17 nt, Bordetella pertussis
gccuggggcaggcggcu

SEQ ID NO: 2401961 - RNA, 21 nt, Bordetella pertussis
gccuggggcaguuuccagggc

SEQ ID NO: 2401962 - RNA, 10 nt, Bordetella pertussis
gccuggggcg

SEQ ID NO: 2401963 - RNA, 22 nt, Bordetella pertussis
gccuggggcgaggggggcgugg

SEQ ID NO: 2401964 - RNA, 22 nt, Bordetella pertussis
gccugggugcgguaggcgcccg

SEQ ID NO: 2401965 - RNA, 23 nt, Bordetella pertussis
gccugggugcgguaggcgcccga

SEQ ID NO: 2401966 - RNA, 13 nt, Bordetella pertussis
gccugggugcugg

SEQ ID NO: 2401967 - RNA, 18 nt, Bordetella pertussis
gccugggugcuggugcgc

SEQ ID NO: 2401968 - RNA, 13 nt, Bordetella pertussis
gccuggguggcca

SEQ ID NO: 2401969 - RNA, 14 nt, Bordetella pertussis
gccuggguggccag

SEQ ID NO: 2401970 - RNA, 17 nt, Bordetella pertussis
gccuggguggccagcug

SEQ ID NO: 2401971 - RNA, 16 nt, Bordetella pertussis
gccugguacaggccga

SEQ ID NO: 2401972 - RNA, 17 nt, Bordetella pertussis
gccugguacgacagcuc

SEQ ID NO: 2401973 - RNA, 23 nt, Bordetella pertussis
gccugguagaguacugcguucgg

SEQ ID NO: 2401974 - RNA, 15 nt, Bordetella pertussis
gccugguaggcgagc

SEQ ID NO: 2401975 - RNA, 19 nt, Bordetella pertussis
gccugguaguaaucgcgcg

SEQ ID NO: 2401976 - RNA, 20 nt, Bordetella pertussis
gccugguaguaaucgcgcgc

SEQ ID NO: 2401977 - RNA, 21 nt, Bordetella pertussis
gccugguaguaaucgcgcgcc

SEQ ID NO: 2401978 - RNA, 18 nt, Bordetella pertussis
gccugguauugccugugg

SEQ ID NO: 2401979 - RNA, 15 nt, Bordetella pertussis
gccuggucagcgccg

SEQ ID NO: 2401980 - RNA, 16 nt, Bordetella pertussis
gccuggucagcgccga

SEQ ID NO: 2401981 - RNA, 16 nt, Bordetella pertussis
gccuggucagguugcg

SEQ ID NO: 2401982 - RNA, 21 nt, Bordetella pertussis
gccuggucgacgccggcgacg

SEQ ID NO: 2401983 - RNA, 20 nt, Bordetella pertussis
gccuggucgagcgggcgcca

SEQ ID NO: 2401984 - RNA, 15 nt, Bordetella pertussis
gccuggucgcgcgcc

SEQ ID NO: 2401985 - RNA, 17 nt, Bordetella pertussis
gccuggucgcgcgccug

SEQ ID NO: 2401986 - RNA, 19 nt, Bordetella pertussis
gccuggucgcgcgccugca

SEQ ID NO: 2401987 - RNA, 14 nt, Bordetella pertussis
gccuggucgcuggc

SEQ ID NO: 2401988 - RNA, 15 nt, Bordetella pertussis
gccuggucgcuggcg

SEQ ID NO: 2401989 - RNA, 16 nt, Bordetella pertussis
gccuggucgcuggcgc

SEQ ID NO: 2401990 - RNA, 18 nt, Bordetella pertussis
gccuggucgcuggcgccg

SEQ ID NO: 2401991 - RNA, 21 nt, Bordetella pertussis
gccuggucggggucggccacc

SEQ ID NO: 2401992 - RNA, 21 nt, Bordetella pertussis
gccuggugcccgacgccgcgc

SEQ ID NO: 2401993 - RNA, 21 nt, Bordetella pertussis
gcgagacgaaggcgccggcca

SEQ ID NO: 2401994 - RNA, 17 nt, Bordetella pertussis
gcgagacgcgcucgcgc

SEQ ID NO: 2401995 - RNA, 23 nt, Bordetella pertussis
gcgagacgucggcgauggcccgg

SEQ ID NO: 2401996 - RNA, 15 nt, Bordetella pertussis
gcgagagcgccacgc

SEQ ID NO: 2401997 - RNA, 18 nt, Bordetella pertussis
gcgagagcgccacgccag

SEQ ID NO: 2401998 - RNA, 17 nt, Bordetella pertussis
gcgagagcuccagccgg

SEQ ID NO: 2401999 - RNA, 20 nt, Bordetella pertussis
gcgagaggguguugccgagg

SEQ ID NO: 2402000 - RNA, 20 nt, Bordetella pertussis
gcgagaucagcaccgcgacc

SEQ ID NO: 2402001 - RNA, 17 nt, Bordetella pertussis
gcgagaucagccaccgg

SEQ ID NO: 2402002 - RNA, 16 nt, Bordetella pertussis
gcgagaucucgaugcg

SEQ ID NO: 2402003 - RNA, 23 nt, Bordetella pertussis
gcgagaucucgaugcguucgccc

SEQ ID NO: 2402004 - RNA, 15 nt, Bordetella pertussis
gcgagauggggcgga

SEQ ID NO: 2402005 - RNA, 19 nt, Bordetella pertussis
gcgagcaaaggacacgcgc

SEQ ID NO: 2402006 - RNA, 14 nt, Bordetella pertussis
gcgagcacccgcag

SEQ ID NO: 2402007 - RNA, 17 nt, Bordetella pertussis
gcgagcacccgcaggcg

SEQ ID NO: 2402008 - RNA, 19 nt, Bordetella pertussis
gcgagcacccgcaggcggc

SEQ ID NO: 2402009 - RNA, 22 nt, Bordetella pertussis
gcgagcacccgcaggcggcugg

SEQ ID NO: 2402010 - RNA, 19 nt, Bordetella pertussis
gcgagcacggccugcucgu

SEQ ID NO: 2402011 - RNA, 16 nt, Bordetella pertussis
gcgagcagaugcaccg

SEQ ID NO: 2402012 - RNA, 11 nt, Bordetella pertussis
gcgagcaggcc

SEQ ID NO: 2402013 - RNA, 14 nt, Bordetella pertussis
gcgagcagggcauc

SEQ ID NO: 2402014 - RNA, 21 nt, Bordetella pertussis
gcgagcagggcaucaccaucg

SEQ ID NO: 2402015 - RNA, 18 nt, Bordetella pertussis
gcgagcagguccauggcc

SEQ ID NO: 2402016 - RNA, 17 nt, Bordetella pertussis
gcgagcagucgaccacg

SEQ ID NO: 2402017 - RNA, 22 nt, Bordetella pertussis
gcgagcaugagugauuguccug

SEQ ID NO: 2402018 - RNA, 14 nt, Bordetella pertussis
gcgagcaugcgcag

SEQ ID NO: 2402019 - RNA, 17 nt, Bordetella pertussis
gcgagcauggcgguggc

SEQ ID NO: 2402020 - RNA, 19 nt, Bordetella pertussis
gcgagcauggcgguggcca

SEQ ID NO: 2402021 - RNA, 20 nt, Bordetella pertussis
gcgagcauggcgguggccag

SEQ ID NO: 2402022 - RNA, 15 nt, Bordetella pertussis
gcgagcccgccaucg

SEQ ID NO: 2402023 - RNA, 20 nt, Bordetella pertussis
gcgagcccgccaucgccagg

SEQ ID NO: 2402024 - RNA, 20 nt, Bordetella pertussis
gcgagcccgcgucagacgcg

SEQ ID NO: 2402025 - RNA, 18 nt, Bordetella pertussis
gcgagccgcccacgggcg

SEQ ID NO: 2402026 - RNA, 13 nt, Bordetella pertussis
gcgagccgccgcc

SEQ ID NO: 2402027 - RNA, 14 nt, Bordetella pertussis
gcgagccggccagc

SEQ ID NO: 2402028 - RNA, 15 nt, Bordetella pertussis
gcgagccggccagcg

SEQ ID NO: 2402029 - RNA, 17 nt, Bordetella pertussis
gcgagccggccagcgcc

SEQ ID NO: 2402030 - RNA, 18 nt, Bordetella pertussis
gcgagccggccagcgcca

SEQ ID NO: 2402031 - RNA, 22 nt, Bordetella pertussis
gcgagccggccagcgccaccac

SEQ ID NO: 2402032 - RNA, 12 nt, Bordetella pertussis
gcgagccgggca

SEQ ID NO: 2402033 - RNA, 16 nt, Bordetella pertussis
gcgagccgggcaccga

SEQ ID NO: 2402034 - RNA, 18 nt, Bordetella pertussis
gcgagccuucggccggcu

SEQ ID NO: 2402035 - RNA, 17 nt, Bordetella pertussis
gcgagcgaaagccgucg

SEQ ID NO: 2402036 - RNA, 17 nt, Bordetella pertussis
gcgagcgcaagcaccgc

SEQ ID NO: 2402037 - RNA, 20 nt, Bordetella pertussis
gcgagcgcacaggcggcgcc

SEQ ID NO: 2402038 - RNA, 13 nt, Bordetella pertussis
gcgagcgcagccg

SEQ ID NO: 2402039 - RNA, 14 nt, Bordetella pertussis
gcgagcgcagccgc

SEQ ID NO: 2402040 - RNA, 16 nt, Bordetella pertussis
gcgagcgcagccgcuc

SEQ ID NO: 2402041 - RNA, 12 nt, Bordetella pertussis
gcgagcgccgcc

SEQ ID NO: 2402042 - RNA, 22 nt, Bordetella pertussis
gcgagcgccgcgcuccagggcg

SEQ ID NO: 2402043 - RNA, 14 nt, Bordetella pertussis
gcgagcgccgggcg

SEQ ID NO: 2402044 - RNA, 15 nt, Bordetella pertussis
gcgagcgccucgcgc

SEQ ID NO: 2402045 - RNA, 23 nt, Bordetella pertussis
gcgagcgcggcauagcccaggcc

SEQ ID NO: 2402046 - RNA, 17 nt, Bordetella pertussis
gcgagcgcggcgcgcgc

SEQ ID NO: 2402047 - RNA, 20 nt, Bordetella pertussis
gcgagcgcggcgcgcgccag

SEQ ID NO: 2402048 - RNA, 24 nt, Bordetella pertussis
gcgagcgcggcgcgcgccagggcg

SEQ ID NO: 2402049 - RNA, 16 nt, Bordetella pertussis
gcgagcgcggcgggug

SEQ ID NO: 2402050 - RNA, 14 nt, Bordetella pertussis
gcgagcggccagcc

SEQ ID NO: 2402051 - RNA, 20 nt, Bordetella pertussis
gcgagcggcggccgcgucca

SEQ ID NO: 2402052 - RNA, 22 nt, Bordetella pertussis
gcgagcggcggccgcguccagc

SEQ ID NO: 2402053 - RNA, 14 nt, Bordetella pertussis
gcgagcggcgucgc

SEQ ID NO: 2402054 - RNA, 15 nt, Bordetella pertussis
gcgagcugcgcgacc

SEQ ID NO: 2402055 - RNA, 17 nt, Bordetella pertussis
gcgagcugcgcgaccuc

SEQ ID NO: 2402056 - RNA, 20 nt, Bordetella pertussis
gcgagcugcgcgaccuccag

SEQ ID NO: 2402057 - RNA, 15 nt, Bordetella pertussis
gcgagcugcgcggcu

SEQ ID NO: 2402058 - RNA, 15 nt, Bordetella pertussis
gcgaggacacgcagc

SEQ ID NO: 2402059 - RNA, 16 nt, Bordetella pertussis
gcgaggacacgcagcu

SEQ ID NO: 2402060 - RNA, 15 nt, Bordetella pertussis
gcgaggacaggccag

SEQ ID NO: 2402061 - RNA, 22 nt, Bordetella pertussis
gcgaggacgaccuugcuggacc

SEQ ID NO: 2402062 - RNA, 15 nt, Bordetella pertussis
gcgaggaugccgcgc

SEQ ID NO: 2402063 - RNA, 19 nt, Bordetella pertussis
gcgaggccgcccgccccgg

SEQ ID NO: 2402064 - RNA, 23 nt, Bordetella pertussis
gcgaggccgcuucgugcggccgc

SEQ ID NO: 2402065 - RNA, 14 nt, Bordetella pertussis
gcgaggcgcagcgc

SEQ ID NO: 2402066 - RNA, 13 nt, Bordetella pertussis
gcgaggcgcaggc

SEQ ID NO: 2402067 - RNA, 21 nt, Bordetella pertussis
gcgaggcgcaggccgacgcgc

SEQ ID NO: 2402068 - RNA, 15 nt, Bordetella pertussis
gcgaggcgcgggcga

SEQ ID NO: 2402069 - RNA, 16 nt, Bordetella pertussis
gcgaggcgcuggccgg

SEQ ID NO: 2402070 - RNA, 15 nt, Bordetella pertussis
gcgaggcggccuuga

SEQ ID NO: 2402071 - RNA, 14 nt, Bordetella pertussis
gcgaggcggcggcc

SEQ ID NO: 2402072 - RNA, 17 nt, Bordetella pertussis
gcgaggcggggcuggcg

SEQ ID NO: 2402073 - RNA, 18 nt, Bordetella pertussis
gcgaggcggggcuggcgc

SEQ ID NO: 2402074 - RNA, 19 nt, Bordetella pertussis
gcgaggcggggcuggcgcg

SEQ ID NO: 2402075 - RNA, 19 nt, Bordetella pertussis
gcgaggcuggcgcccacgc

SEQ ID NO: 2402076 - RNA, 22 nt, Bordetella pertussis
gcgaggcuuuuuuucgccgggc

SEQ ID NO: 2402077 - RNA, 23 nt, Bordetella pertussis
gcgaggcuuuuuuucgccgggcg

SEQ ID NO: 2402078 - RNA, 18 nt, Bordetella pertussis
gcgagggcaucagcgcga

SEQ ID NO: 2402079 - RNA, 22 nt, Bordetella pertussis
gcgagggcgucguagcccucgc

SEQ ID NO: 2402080 - RNA, 20 nt, Bordetella pertussis
gcgagggcucgaccgccgcc

SEQ ID NO: 2402081 - RNA, 18 nt, Bordetella pertussis
gcgagggucaggcgcgcu

SEQ ID NO: 2402082 - RNA, 21 nt, Bordetella pertussis
gcgagguagggcgcggccagg

SEQ ID NO: 2402083 - RNA, 17 nt, Bordetella pertussis
gcgagguauuggccuug

SEQ ID NO: 2402084 - RNA, 19 nt, Bordetella pertussis
gcgagguauuggccuugcc

SEQ ID NO: 2402085 - RNA, 18 nt, Bordetella pertussis
gcgaggucagcccggcgg

SEQ ID NO: 2402086 - RNA, 21 nt, Bordetella pertussis
gcgaggucagcccggcggcca

SEQ ID NO: 2402087 - RNA, 14 nt, Bordetella pertussis
gcgagguccaggcg

SEQ ID NO: 2402088 - RNA, 15 nt, Bordetella pertussis
gcgaggugcccgcga

SEQ ID NO: 2402089 - RNA, 15 nt, Bordetella pertussis
gcgaggugccggacg

SEQ ID NO: 2402090 - RNA, 19 nt, Bordetella pertussis
gcgaggugccggacgccga

SEQ ID NO: 2402091 - RNA, 16 nt, Bordetella pertussis
gcgagguggcgcucgc

SEQ ID NO: 2402092 - RNA, 18 nt, Bordetella pertussis
gcgagguugcaggccagg

SEQ ID NO: 2402093 - RNA, 22 nt, Bordetella pertussis
gcgaguagacgcagccgcagua

SEQ ID NO: 2402094 - RNA, 18 nt, Bordetella pertussis
gcgaguaucccuaccgcc

SEQ ID NO: 2402095 - RNA, 13 nt, Bordetella pertussis
gcgagugcgcccc

SEQ ID NO: 2402096 - RNA, 14 nt, Bordetella pertussis
gcgagugcgccccg

SEQ ID NO: 2402097 - RNA, 19 nt, Bordetella pertussis
gcgaguuguccuggccggg

SEQ ID NO: 2402098 - RNA, 19 nt, Bordetella pertussis
gcgauacagcuuggcgcgc

SEQ ID NO: 2402099 - RNA, 19 nt, Bordetella pertussis
gcgauacgcgccgccuggc

SEQ ID NO: 2402100 - RNA, 15 nt, Bordetella pertussis
gcgauagcgccgcgc

SEQ ID NO: 2402101 - RNA, 16 nt, Bordetella pertussis
gcgauagcgccgcgca

SEQ ID NO: 2402102 - RNA, 18 nt, Bordetella pertussis
gcgauagcgccgcgcauc

SEQ ID NO: 2402103 - RNA, 17 nt, Bordetella pertussis
gcgauagcgcuccagcg

SEQ ID NO: 2402104 - RNA, 19 nt, Bordetella pertussis
gcgauagcgggccugcagc

SEQ ID NO: 2402105 - RNA, 16 nt, Bordetella pertussis
gcgauaggcgaagcgc

SEQ ID NO: 2402106 - RNA, 14 nt, Bordetella pertussis
gcgauaggugcgca

SEQ ID NO: 2402107 - RNA, 16 nt, Bordetella pertussis
gcgauaggugcgcagc

SEQ ID NO: 2402108 - RNA, 13 nt, Bordetella pertussis
gcgauauggccag

SEQ ID NO: 2402109 - RNA, 14 nt, Bordetella pertussis
gcgauauggccagg

SEQ ID NO: 2402110 - RNA, 15 nt, Bordetella pertussis
gcgauauuuugccgu

SEQ ID NO: 2402111 - RNA, 18 nt, Bordetella pertussis
gcgaucaccgacagcgcc

SEQ ID NO: 2402112 - RNA, 20 nt, Bordetella pertussis
gcgaucaccugcguggccgc

SEQ ID NO: 2402113 - RNA, 20 nt, Bordetella pertussis
gcgaucagcaccgcggcggg

SEQ ID NO: 2402114 - RNA, 14 nt, Bordetella pertussis
gcgaucagcgcggc

SEQ ID NO: 2402115 - RNA, 16 nt, Bordetella pertussis
gcgaucagcgcggccg

SEQ ID NO: 2402116 - RNA, 17 nt, Bordetella pertussis
gcgaucagcgcggccgc

SEQ ID NO: 2402117 - RNA, 14 nt, Bordetella pertussis
gcgaucaggccgcc

SEQ ID NO: 2402118 - RNA, 16 nt, Bordetella pertussis
gcgaucaggccgcccc

SEQ ID NO: 2402119 - RNA, 22 nt, Bordetella pertussis
gcgaucaggcggugccccggcc

SEQ ID NO: 2402120 - RNA, 21 nt, Bordetella pertussis
gcgaucaugcaguacaggcgc

SEQ ID NO: 2402121 - RNA, 22 nt, Bordetella pertussis
gcgaucaugcaguacaggcgcg

SEQ ID NO: 2402122 - RNA, 15 nt, Bordetella pertussis
gcgaucaugccgccg

SEQ ID NO: 2402123 - RNA, 16 nt, Bordetella pertussis
gcgaucaugccgccga

SEQ ID NO: 2402124 - RNA, 21 nt, Bordetella pertussis
gcgauccagcagcguggccac

SEQ ID NO: 2402125 - RNA, 12 nt, Bordetella pertussis
gcgauccaggcc

SEQ ID NO: 2402126 - RNA, 13 nt, Bordetella pertussis
gcgauccagggcc

SEQ ID NO: 2402127 - RNA, 19 nt, Bordetella pertussis
gcgauccagggccgccagc

SEQ ID NO: 2402128 - RNA, 14 nt, Bordetella pertussis
gcgauccagggcga

SEQ ID NO: 2402129 - RNA, 16 nt, Bordetella pertussis
gcgauccgcgccaggc

SEQ ID NO: 2402130 - RNA, 17 nt, Bordetella pertussis
gcgauccgcgccaggcg

SEQ ID NO: 2402131 - RNA, 15 nt, Bordetella pertussis
gcgauccucgacccg

SEQ ID NO: 2402132 - RNA, 20 nt, Bordetella pertussis
gcgauccucgacccgaaggc

SEQ ID NO: 2402133 - RNA, 18 nt, Bordetella pertussis
gcgauccugcccaccgcc

SEQ ID NO: 2402134 - RNA, 21 nt, Bordetella pertussis
gcgauccugcccaccgccgcc

SEQ ID NO: 2402135 - RNA, 16 nt, Bordetella pertussis
gcgauccuucgcggcc

SEQ ID NO: 2402136 - RNA, 13 nt, Bordetella pertussis
gcgaucgaacgcg

SEQ ID NO: 2402137 - RNA, 16 nt, Bordetella pertussis
gcgaucgaacgcggcc

SEQ ID NO: 2402138 - RNA, 19 nt, Bordetella pertussis
gcgaucgaacgcggccaga

SEQ ID NO: 2402139 - RNA, 19 nt, Bordetella pertussis
gcgaucgaauggucggccu

SEQ ID NO: 2402140 - RNA, 14 nt, Bordetella pertussis
gcgaucgccagcag

SEQ ID NO: 2402141 - RNA, 15 nt, Bordetella pertussis
gcgaucgccagcagg

SEQ ID NO: 2402142 - RNA, 21 nt, Bordetella pertussis
gcgaucgcgucggccaaggcc

SEQ ID NO: 2402143 - RNA, 23 nt, Bordetella pertussis
gcgaucgcgucggccaaggccgg

SEQ ID NO: 2402144 - RNA, 19 nt, Bordetella pertussis
gcgaucggagaaaucgccg

SEQ ID NO: 2402145 - RNA, 21 nt, Bordetella pertussis
gcgaucggagaaaucgccgcc

SEQ ID NO: 2402146 - RNA, 23 nt, Bordetella pertussis
gcgaucggagaaaucgccgccgg

SEQ ID NO: 2402147 - RNA, 12 nt, Bordetella pertussis
gcgaucggcccg

SEQ ID NO: 2402148 - RNA, 16 nt, Bordetella pertussis
gcgaucggcccgggcg

SEQ ID NO: 2402149 - RNA, 20 nt, Bordetella pertussis
gcgaucgucaccaucgccgc

SEQ ID NO: 2402150 - RNA, 22 nt, Bordetella pertussis
gcgaucgucaccaucgccgcgu

SEQ ID NO: 2402151 - RNA, 14 nt, Bordetella pertussis
gcgaucgucgaccg

SEQ ID NO: 2402152 - RNA, 17 nt, Bordetella pertussis
gcgaucgucgaccgcga

SEQ ID NO: 2402153 - RNA, 20 nt, Bordetella pertussis
gcgaucgucgcugcgcggcg

SEQ ID NO: 2402154 - RNA, 18 nt, Bordetella pertussis
gcgaucucagccaucauc

SEQ ID NO: 2402155 - RNA, 19 nt, Bordetella pertussis
gcgaucucagccaucauca

SEQ ID NO: 2402156 - RNA, 19 nt, Bordetella pertussis
gcgaucucgcgcagggugg

SEQ ID NO: 2402157 - RNA, 16 nt, Bordetella pertussis
gcgaucucgcgcgcgc

SEQ ID NO: 2402158 - RNA, 18 nt, Bordetella pertussis
gcgaucucgucgaccgcc

SEQ ID NO: 2402159 - RNA, 20 nt, Bordetella pertussis
gcgaucucgucgaccgccuc

SEQ ID NO: 2402160 - RNA, 18 nt, Bordetella pertussis
gcgaucucguggcccagc

SEQ ID NO: 2402161 - RNA, 15 nt, Bordetella pertussis
gcgaucugcgcggcg

SEQ ID NO: 2402162 - RNA, 16 nt, Bordetella pertussis
gcgaucugcgcggcgg

SEQ ID NO: 2402163 - RNA, 17 nt, Bordetella pertussis
gcgaucugcgcggcggu

SEQ ID NO: 2402164 - RNA, 16 nt, Bordetella pertussis
gcgaucugggccucgg

SEQ ID NO: 2402165 - RNA, 17 nt, Bordetella pertussis
gcgaucugggccucggc

SEQ ID NO: 2402166 - RNA, 21 nt, Bordetella pertussis
gcgaucugggccucggccagc

SEQ ID NO: 2402167 - RNA, 19 nt, Bordetella pertussis
gcgaucuucagcaccagcu

SEQ ID NO: 2402168 - RNA, 21 nt, Bordetella pertussis
gcgaucuucagcaccagcucc

SEQ ID NO: 2402169 - RNA, 16 nt, Bordetella pertussis
gcgaucuugccggccu

SEQ ID NO: 2402170 - RNA, 18 nt, Bordetella pertussis
gcgaucuugccggccugg

SEQ ID NO: 2402171 - RNA, 20 nt, Bordetella pertussis
gcgaucuugccggccuggcg

SEQ ID NO: 2402172 - RNA, 22 nt, Bordetella pertussis
gcgaugaacagcggcacgccgg

SEQ ID NO: 2402173 - RNA, 22 nt, Bordetella pertussis
gcgaugaagucgcggcccgcca

SEQ ID NO: 2402174 - RNA, 21 nt, Bordetella pertussis
gcgaugacggcuucgaccacg

SEQ ID NO: 2402175 - RNA, 16 nt, Bordetella pertussis
gcgaugagcuggcgca

SEQ ID NO: 2402176 - RNA, 18 nt, Bordetella pertussis
gcgaugcaugaaccgcag

SEQ ID NO: 2402177 - RNA, 21 nt, Bordetella pertussis
gcgaugcaugaaccgcagcgc

SEQ ID NO: 2402178 - RNA, 17 nt, Bordetella pertussis
gcgaugcauucggcggc

SEQ ID NO: 2402179 - RNA, 18 nt, Bordetella pertussis
gcgaugcauucggcggcc

SEQ ID NO: 2402180 - RNA, 19 nt, Bordetella pertussis
gcgaugcauucggcggccg

SEQ ID NO: 2402181 - RNA, 20 nt, Bordetella pertussis
gcgaugcauucggcggccgg

SEQ ID NO: 2402182 - RNA, 22 nt, Bordetella pertussis
gcgaugcccaccagccgcccgg

SEQ ID NO: 2402183 - RNA, 23 nt, Bordetella pertussis
gcgaugcccaccagccgcccggc

SEQ ID NO: 2402184 - RNA, 18 nt, Bordetella pertussis
gcgaugcccagcgccgcc

SEQ ID NO: 2402185 - RNA, 20 nt, Bordetella pertussis
gcgaugcccagcgccgccga

SEQ ID NO: 2402186 - RNA, 21 nt, Bordetella pertussis
gcgaugcccagcgccgccgac

SEQ ID NO: 2402187 - RNA, 19 nt, Bordetella pertussis
gcgaugcccgcgcaccagg

SEQ ID NO: 2402188 - RNA, 21 nt, Bordetella pertussis
gcgaugcccgcgcaccaggcg

SEQ ID NO: 2402189 - RNA, 23 nt, Bordetella pertussis
gcgaugcccgcgcaccaggcgcg

SEQ ID NO: 2402190 - RNA, 16 nt, Bordetella pertussis
gcgaugccgcugucgg

SEQ ID NO: 2402191 - RNA, 13 nt, Bordetella pertussis
gcgaugccggcca

SEQ ID NO: 2402192 - RNA, 17 nt, Bordetella pertussis
gcgaugccggccagcag

SEQ ID NO: 2402193 - RNA, 13 nt, Bordetella pertussis
gcgaugccggcgc

SEQ ID NO: 2402194 - RNA, 16 nt, Bordetella pertussis
gcgaugccggcgcugc

SEQ ID NO: 2402195 - RNA, 21 nt, Bordetella pertussis
gcgaugccggcgcugcgcagc

SEQ ID NO: 2402196 - RNA, 16 nt, Bordetella pertussis
gcgaugccggcguggc

SEQ ID NO: 2402197 - RNA, 23 nt, Bordetella pertussis
gcgaugccguacuuggcgauggc

SEQ ID NO: 2402198 - RNA, 19 nt, Bordetella pertussis
gcgaugcgcagcagcagcg

SEQ ID NO: 2402199 - RNA, 13 nt, Bordetella pertussis
gcgaugcgcaggc

SEQ ID NO: 2402200 - RNA, 17 nt, Bordetella pertussis
gcgaugcgccaggcgcu

SEQ ID NO: 2402201 - RNA, 18 nt, Bordetella pertussis
gcgaugcgccaggcgcuc

SEQ ID NO: 2402202 - RNA, 13 nt, Bordetella pertussis
gcgaugcgcgcgc

SEQ ID NO: 2402203 - RNA, 23 nt, Bordetella pertussis
gcgaugcgcgcgcgggccagcag

SEQ ID NO: 2402204 - RNA, 13 nt, Bordetella pertussis
gcgaugcgcgcgu

SEQ ID NO: 2402205 - RNA, 16 nt, Bordetella pertussis
gcgaugcgcgcgugca

SEQ ID NO: 2402206 - RNA, 13 nt, Bordetella pertussis
gcgaugcgcggcc

SEQ ID NO: 2402207 - RNA, 17 nt, Bordetella pertussis
gcgaugcgcggcccggc

SEQ ID NO: 2402208 - RNA, 14 nt, Bordetella pertussis
gcgaugcggcggcc

SEQ ID NO: 2402209 - RNA, 18 nt, Bordetella pertussis
gcgaugcggcggccgaag

SEQ ID NO: 2402210 - RNA, 16 nt, Bordetella pertussis
gcgaugcgggccacgc

SEQ ID NO: 2402211 - RNA, 17 nt, Bordetella pertussis
gcgaugcgggccacgcc

SEQ ID NO: 2402212 - RNA, 20 nt, Bordetella pertussis
gcgaugcgggccacgccggc

SEQ ID NO: 2402213 - RNA, 15 nt, Bordetella pertussis
gcgaugcgggcggcg

SEQ ID NO: 2402214 - RNA, 16 nt, Bordetella pertussis
gcgaugcgggcggcgg

SEQ ID NO: 2402215 - RNA, 17 nt, Bordetella pertussis
gcgaugcgggcggcggu

SEQ ID NO: 2402216 - RNA, 16 nt, Bordetella pertussis
gcgaugcgggucuggc

SEQ ID NO: 2402217 - RNA, 15 nt, Bordetella pertussis
gcgaugcucacgccc

SEQ ID NO: 2402218 - RNA, 19 nt, Bordetella pertussis
gcgaugcugcagggccugg

SEQ ID NO: 2402219 - RNA, 20 nt, Bordetella pertussis
gcgaugcugcagggccugga

SEQ ID NO: 2402220 - RNA, 15 nt, Bordetella pertussis
gcgaugcugcgcaag

SEQ ID NO: 2402221 - RNA, 23 nt, Bordetella pertussis
gcgauggaacucguuggccagcg

SEQ ID NO: 2402222 - RNA, 13 nt, Bordetella pertussis
gugggacaggcac

SEQ ID NO: 2402223 - RNA, 16 nt, Bordetella pertussis
gugggcacccggccgc

SEQ ID NO: 2402224 - RNA, 21 nt, Bordetella pertussis
gugggcaccgugaugcgcgcc

SEQ ID NO: 2402225 - RNA, 15 nt, Bordetella pertussis
gugggcagcagcacg

SEQ ID NO: 2402226 - RNA, 18 nt, Bordetella pertussis
gugggcagcagcacgccc

SEQ ID NO: 2402227 - RNA, 23 nt, Bordetella pertussis
gugggcagggcggaaaacagcac

SEQ ID NO: 2402228 - RNA, 23 nt, Bordetella pertussis
gugggcauagcguuuuguacucu

SEQ ID NO: 2402229 - RNA, 21 nt, Bordetella pertussis
gugggccacucgaugggcgcg

SEQ ID NO: 2402230 - RNA, 12 nt, Bordetella pertussis
gugggccagcaa

SEQ ID NO: 2402231 - RNA, 15 nt, Bordetella pertussis
gugggccaguccgca

SEQ ID NO: 2402232 - RNA, 20 nt, Bordetella pertussis
gugggccaguucgcggcgca

SEQ ID NO: 2402233 - RNA, 16 nt, Bordetella pertussis
gugggccucgcuggag

SEQ ID NO: 2402234 - RNA, 23 nt, Bordetella pertussis
gugggccucgcuggagaccggca

SEQ ID NO: 2402235 - RNA, 19 nt, Bordetella pertussis
gugggcgaaccgcggcgca

SEQ ID NO: 2402236 - RNA, 13 nt, Bordetella pertussis
gugggcgacgcgg

SEQ ID NO: 2402237 - RNA, 21 nt, Bordetella pertussis
gugggcgaugcauucggcggc

SEQ ID NO: 2402238 - RNA, 18 nt, Bordetella pertussis
gugggcgccuacggcggc

SEQ ID NO: 2402239 - RNA, 19 nt, Bordetella pertussis
gugggcgccuacggcggcg

SEQ ID NO: 2402240 - RNA, 14 nt, Bordetella pertussis
gugggcggcguaga

SEQ ID NO: 2402241 - RNA, 22 nt, Bordetella pertussis
gugggcuccguuccgaugcugg

SEQ ID NO: 2402242 - RNA, 14 nt, Bordetella pertussis
gugggcugcggcgu

SEQ ID NO: 2402243 - RNA, 17 nt, Bordetella pertussis
gugggcugcggcguggc

SEQ ID NO: 2402244 - RNA, 12 nt, Bordetella pertussis
guggggacaggc

SEQ ID NO: 2402245 - RNA, 19 nt, Bordetella pertussis
guggggacaggcaccugcg

SEQ ID NO: 2402246 - RNA, 21 nt, Bordetella pertussis
guggggcagcaggccggcggc

SEQ ID NO: 2402247 - RNA, 22 nt, Bordetella pertussis
guggggcagcaggccggcggcg

SEQ ID NO: 2402248 - RNA, 21 nt, Bordetella pertussis
guggggcaggucgccagcagg

SEQ ID NO: 2402249 - RNA, 20 nt, Bordetella pertussis
guggggccggccgcgcgcgc

SEQ ID NO: 2402250 - RNA, 12 nt, Bordetella pertussis
guggggccgggc

SEQ ID NO: 2402251 - RNA, 13 nt, Bordetella pertussis
guggggccgggcu

SEQ ID NO: 2402252 - RNA, 15 nt, Bordetella pertussis
guggggcgcggcggc

SEQ ID NO: 2402253 - RNA, 19 nt, Bordetella pertussis
guggggcuggccgccgcgg

SEQ ID NO: 2402254 - RNA, 14 nt, Bordetella pertussis
gugggggacaggca

SEQ ID NO: 2402255 - RNA, 15 nt, Bordetella pertussis
gugggggacaggcac

SEQ ID NO: 2402256 - RNA, 23 nt, Bordetella pertussis
gugggggacaggcacgccggggu

SEQ ID NO: 2402257 - RNA, 20 nt, Bordetella pertussis
gugggggauuuuugggcagg

SEQ ID NO: 2402258 - RNA, 22 nt, Bordetella pertussis
guggggugauggcgaaacuggc

SEQ ID NO: 2402259 - RNA, 12 nt, Bordetella pertussis
gugggucucggc

SEQ ID NO: 2402260 - RNA, 23 nt, Bordetella pertussis
guggguguggccaugcaccagca

SEQ ID NO: 2402261 - RNA, 13 nt, Bordetella pertussis
gugguaggccgau

SEQ ID NO: 2402262 - RNA, 16 nt, Bordetella pertussis
gugguaguacaaggcg

SEQ ID NO: 2402263 - RNA, 20 nt, Bordetella pertussis
guggucaucgaugcgccgca

SEQ ID NO: 2402264 - RNA, 18 nt, Bordetella pertussis
guggucaucgauggccac

SEQ ID NO: 2402265 - RNA, 22 nt, Bordetella pertussis
gugguccacgaagcaggugaug

SEQ ID NO: 2402266 - RNA, 22 nt, Bordetella pertussis
guggucgccagcacgcgcagcu

SEQ ID NO: 2402267 - RNA, 13 nt, Bordetella pertussis
guggucgcgggug

SEQ ID NO: 2402268 - RNA, 13 nt, Bordetella pertussis
guggucggcgccg

SEQ ID NO: 2402269 - RNA, 23 nt, Bordetella pertussis
guggucggcgccgaggcggucga

SEQ ID NO: 2402270 - RNA, 19 nt, Bordetella pertussis
guggucuuccaggcgcagg

SEQ ID NO: 2402271 - RNA, 21 nt, Bordetella pertussis
guggucuuccaggcgcaggcg

SEQ ID NO: 2402272 - RNA, 13 nt, Bordetella pertussis
guggugauaaggc

SEQ ID NO: 2402273 - RNA, 15 nt, Bordetella pertussis
guggugcgccucgaa

SEQ ID NO: 2402274 - RNA, 15 nt, Bordetella pertussis
guggugcgcggucca

SEQ ID NO: 2402275 - RNA, 19 nt, Bordetella pertussis
guggugcgggccgcgcugg

SEQ ID NO: 2402276 - RNA, 17 nt, Bordetella pertussis
guggugcucaguuucuu

SEQ ID NO: 2402277 - RNA, 12 nt, Bordetella pertussis
guggugcuccca

SEQ ID NO: 2402278 - RNA, 13 nt, Bordetella pertussis
guggugcugacgg

SEQ ID NO: 2402279 - RNA, 11 nt, Bordetella pertussis
guggugcugcu

SEQ ID NO: 2402280 - RNA, 19 nt, Bordetella pertussis
guggugcugcucaacggcc

SEQ ID NO: 2402281 - RNA, 17 nt, Bordetella pertussis
guggugcugggcggcgg

SEQ ID NO: 2402282 - RNA, 20 nt, Bordetella pertussis
gugguggcgaaauggugcgg

SEQ ID NO: 2402283 - RNA, 16 nt, Bordetella pertussis
gugguggugcgggccg

SEQ ID NO: 2402284 - RNA, 15 nt, Bordetella pertussis
guggugucggcggcc

SEQ ID NO: 2402285 - RNA, 16 nt, Bordetella pertussis
guggugugcgaggacg

SEQ ID NO: 2402286 - RNA, 14 nt, Bordetella pertussis
gugguucaugacgu

SEQ ID NO: 2402287 - RNA, 17 nt, Bordetella pertussis
gugguuggcgcugcugc

SEQ ID NO: 2402288 - RNA, 12 nt, Bordetella pertussis
guguacagccgc

SEQ ID NO: 2402289 - RNA, 21 nt, Bordetella pertussis
guguacagccgccuggcgcgg

SEQ ID NO: 2402290 - RNA, 23 nt, Bordetella pertussis
guguacagccgccuggcgcggcg

SEQ ID NO: 2402291 - RNA, 15 nt, Bordetella pertussis
guguaccgggccgac

SEQ ID NO: 2402292 - RNA, 15 nt, Bordetella pertussis
guguagaccaccagc

SEQ ID NO: 2402293 - RNA, 16 nt, Bordetella pertussis
guguagaccaccagca

SEQ ID NO: 2402294 - RNA, 18 nt, Bordetella pertussis
guguagaccugcgggccg

SEQ ID NO: 2402295 - RNA, 19 nt, Bordetella pertussis
guguagagcaggccgccca

SEQ ID NO: 2402296 - RNA, 17 nt, Bordetella pertussis
gugucccagcuccagua

SEQ ID NO: 2402297 - RNA, 13 nt, Bordetella pertussis
gugucccggcggg

SEQ ID NO: 2402298 - RNA, 18 nt, Bordetella pertussis
guguccgccguagcgcgc

SEQ ID NO: 2402299 - RNA, 16 nt, Bordetella pertussis
gugucgccgcccaugc

SEQ ID NO: 2402300 - RNA, 12 nt, Bordetella pertussis
gugucgccgggg

SEQ ID NO: 2402301 - RNA, 20 nt, Bordetella pertussis
gugucgccguggcgggucca

SEQ ID NO: 2402302 - RNA, 22 nt, Bordetella pertussis
gugucgcgcagcgaguagacgc

SEQ ID NO: 2402303 - RNA, 14 nt, Bordetella pertussis
gugucggccaccac

SEQ ID NO: 2402304 - RNA, 12 nt, Bordetella pertussis
gugucggccagg

SEQ ID NO: 2402305 - RNA, 14 nt, Bordetella pertussis
gugucggccagggc

SEQ ID NO: 2402306 - RNA, 13 nt, Bordetella pertussis
gugucggcggcga

SEQ ID NO: 2402307 - RNA, 21 nt, Bordetella pertussis
gugucggcuuuuuugcguucg

SEQ ID NO: 2402308 - RNA, 22 nt, Bordetella pertussis
gugucggggccgggccggcggg

SEQ ID NO: 2402309 - RNA, 21 nt, Bordetella pertussis
gugucgguauccacguagcgc

SEQ ID NO: 2402310 - RNA, 19 nt, Bordetella pertussis
gugugaucgccgacgaugu

SEQ ID NO: 2402311 - RNA, 20 nt, Bordetella pertussis
gugugaucgccgacgauguc

SEQ ID NO: 2402312 - RNA, 23 nt, Bordetella pertussis
gugugcaggacgaacaggccgcc

SEQ ID NO: 2402313 - RNA, 22 nt, Bordetella pertussis
gugugccagcccccugcggggu

SEQ ID NO: 2402314 - RNA, 14 nt, Bordetella pertussis
gugugccagccgcu

SEQ ID NO: 2402315 - RNA, 22 nt, Bordetella pertussis
gugugccuguccccgcugggac

SEQ ID NO: 2402316 - RNA, 13 nt, Bordetella pertussis
guguggcaggcca

SEQ ID NO: 2402317 - RNA, 18 nt, Bordetella pertussis
guguggcaggccagcgcc

SEQ ID NO: 2402318 - RNA, 19 nt, Bordetella pertussis
guguggccaugcaccagca

SEQ ID NO: 2402319 - RNA, 20 nt, Bordetella pertussis
guguggccaugcaccagcac

SEQ ID NO: 2402320 - RNA, 16 nt, Bordetella pertussis
guguucgcgcaccagc

SEQ ID NO: 2402321 - RNA, 16 nt, Bordetella pertussis
guguucucgcugguga

SEQ ID NO: 2402322 - RNA, 19 nt, Bordetella pertussis
guguugaccaccacgcugg

SEQ ID NO: 2402323 - RNA, 21 nt, Bordetella pertussis
guguugagauuggccgagcgc

SEQ ID NO: 2402324 - RNA, 14 nt, Bordetella pertussis
guguugauccgcca

SEQ ID NO: 2402325 - RNA, 22 nt, Bordetella pertussis
guguugggaguucugguaggug

SEQ ID NO: 2402326 - RNA, 20 nt, Bordetella pertussis
guguuguucagguuggcaac

SEQ ID NO: 2402327 - RNA, 14 nt, Bordetella pertussis
guguuucggccugc

SEQ ID NO: 2402328 - RNA, 21 nt, Bordetella pertussis
guuacacuggcccuggcaugu

SEQ ID NO: 2402329 - RNA, 19 nt, Bordetella pertussis
guuacagcuuuucgcaccu

SEQ ID NO: 2402330 - RNA, 18 nt, Bordetella pertussis
guuacucuguucuaccug

SEQ ID NO: 2402331 - RNA, 21 nt, Bordetella pertussis
guucaccaggaagcgcgccug

SEQ ID NO: 2402332 - RNA, 18 nt, Bordetella pertussis
guucacgcccgagauggc

SEQ ID NO: 2402333 - RNA, 23 nt, Bordetella pertussis
guucacgcccgagauggcgcagg

SEQ ID NO: 2402334 - RNA, 15 nt, Bordetella pertussis
guucacgccggcgcg

SEQ ID NO: 2402335 - RNA, 11 nt, Bordetella pertussis
guucagcagca

SEQ ID NO: 2402336 - RNA, 15 nt, Bordetella pertussis
guucagcagcaggcc

SEQ ID NO: 2402337 - RNA, 16 nt, Bordetella pertussis
guucagcagcaggccc

SEQ ID NO: 2402338 - RNA, 16 nt, Bordetella pertussis
guucagcagcgccacg

SEQ ID NO: 2402339 - RNA, 16 nt, Bordetella pertussis
guucagcgcgcgcgcc

SEQ ID NO: 2402340 - RNA, 17 nt, Bordetella pertussis
guucagcgcgcgcgccg

SEQ ID NO: 2402341 - RNA, 17 nt, Bordetella pertussis
guucagcgggcgcgccc

SEQ ID NO: 2402342 - RNA, 19 nt, Bordetella pertussis
guucagcgucucgggcugg

SEQ ID NO: 2402343 - RNA, 17 nt, Bordetella pertussis
guucagcuucagccugg

SEQ ID NO: 2402344 - RNA, 20 nt, Bordetella pertussis
guucagcuucagccugggcc

SEQ ID NO: 2402345 - RNA, 23 nt, Bordetella pertussis
guucagcuucagccugggccugu

SEQ ID NO: 2402346 - RNA, 16 nt, Bordetella pertussis
guucagcuucuggauc

SEQ ID NO: 2402347 - RNA, 19 nt, Bordetella pertussis
guucaggccaugcugggcc

SEQ ID NO: 2402348 - RNA, 20 nt, Bordetella pertussis
guucaggccuguucggccgg

SEQ ID NO: 2402349 - RNA, 15 nt, Bordetella pertussis
guucaggcgagcggc

SEQ ID NO: 2402350 - RNA, 17 nt, Bordetella pertussis
guucaggcgcggcugga

SEQ ID NO: 2402351 - RNA, 20 nt, Bordetella pertussis
guucaggcgcggcuggauga

SEQ ID NO: 2402352 - RNA, 12 nt, Bordetella pertussis
guucaggcuggc

SEQ ID NO: 2402353 - RNA, 19 nt, Bordetella pertussis
guucagggacgggccagcc

SEQ ID NO: 2402354 - RNA, 20 nt, Bordetella pertussis
guucagggacgggccagccc

SEQ ID NO: 2402355 - RNA, 22 nt, Bordetella pertussis
guucagggcgccgcggcggcga

SEQ ID NO: 2402356 - RNA, 20 nt, Bordetella pertussis
guucagguguucgcgcacca

SEQ ID NO: 2402357 - RNA, 23 nt, Bordetella pertussis
guucagucgaguucgucgucgcc

SEQ ID NO: 2402358 - RNA, 20 nt, Bordetella pertussis
guucaucgcccauuuccugu

SEQ ID NO: 2402359 - RNA, 17 nt, Bordetella pertussis
guucaucgggccggcgg

SEQ ID NO: 2402360 - RNA, 17 nt, Bordetella pertussis
guucaugaccaucgcgc

SEQ ID NO: 2402361 - RNA, 20 nt, Bordetella pertussis
guucaugacguccggcgggc

SEQ ID NO: 2402362 - RNA, 21 nt, Bordetella pertussis
guucaugccgguguagcucag

SEQ ID NO: 2402363 - RNA, 18 nt, Bordetella pertussis
guucauggcgcaugacgg

SEQ ID NO: 2402364 - RNA, 11 nt, Bordetella pertussis
guuccaccugc

SEQ ID NO: 2402365 - RNA, 15 nt, Bordetella pertussis
guuccaccugcaugc

SEQ ID NO: 2402366 - RNA, 23 nt, Bordetella pertussis
guuccacgcggccguggcggccu

SEQ ID NO: 2402367 - RNA, 16 nt, Bordetella pertussis
guuccagaacggcgcg

SEQ ID NO: 2402368 - RNA, 15 nt, Bordetella pertussis
guuccagacgauggu

SEQ ID NO: 2402369 - RNA, 22 nt, Bordetella pertussis
guuccagacgauggugccggcc

SEQ ID NO: 2402370 - RNA, 16 nt, Bordetella pertussis
guuccagaugcgcagc

SEQ ID NO: 2402371 - RNA, 17 nt, Bordetella pertussis
guuccagaugcgcagca

SEQ ID NO: 2402372 - RNA, 19 nt, Bordetella pertussis
guuccagaugcgcagcagg

SEQ ID NO: 2402373 - RNA, 17 nt, Bordetella pertussis
guuccagcacgacgacg

SEQ ID NO: 2402374 - RNA, 11 nt, Bordetella pertussis
guuccagcaug

SEQ ID NO: 2402375 - RNA, 16 nt, Bordetella pertussis
guuccagcgccuggcg

SEQ ID NO: 2402376 - RNA, 20 nt, Bordetella pertussis
guuccaggucaucaccaggg

SEQ ID NO: 2402377 - RNA, 15 nt, Bordetella pertussis
guuccaguccagcgu

SEQ ID NO: 2402378 - RNA, 22 nt, Bordetella pertussis
guuccaugacguccagcgccac

SEQ ID NO: 2402379 - RNA, 22 nt, Bordetella pertussis
guucccgccgggccaaggugcc

SEQ ID NO: 2402380 - RNA, 21 nt, Bordetella pertussis
guucccgccgggcuccucgcc

SEQ ID NO: 2402381 - RNA, 19 nt, Bordetella pertussis
guucccggugccagucccc

SEQ ID NO: 2402382 - RNA, 12 nt, Bordetella pertussis
guucccuacccg

SEQ ID NO: 2402383 - RNA, 18 nt, Bordetella pertussis
guucccuacccgccgggc

SEQ ID NO: 2402384 - RNA, 19 nt, Bordetella pertussis
guucccuacccgccgggcg

SEQ ID NO: 2402385 - RNA, 14 nt, Bordetella pertussis
guuccgcgacgcgg

SEQ ID NO: 2402386 - RNA, 12 nt, Bordetella pertussis
guuccggcgcgc

SEQ ID NO: 2402387 - RNA, 18 nt, Bordetella pertussis
guuccggcgcgcgguggc

SEQ ID NO: 2402388 - RNA, 20 nt, Bordetella pertussis
guuccugcaaggccggcggc

SEQ ID NO: 2402389 - RNA, 12 nt, Bordetella pertussis
guuccuggcgcu

SEQ ID NO: 2402390 - RNA, 14 nt, Bordetella pertussis
guuccugggcacgc

SEQ ID NO: 2402391 - RNA, 22 nt, Bordetella pertussis
guucgaaguccgcgcgcagcgc

SEQ ID NO: 2402392 - RNA, 13 nt, Bordetella pertussis
guucgaccaggaa

SEQ ID NO: 2402393 - RNA, 15 nt, Bordetella pertussis
guucgaccugaaggu

SEQ ID NO: 2402394 - RNA, 15 nt, Bordetella pertussis
guucgaccugccgcc

SEQ ID NO: 2402395 - RNA, 23 nt, Bordetella pertussis
guucgacgcugaucucggccugc

SEQ ID NO: 2402396 - RNA, 17 nt, Bordetella pertussis
guucgacgggcaggccc

SEQ ID NO: 2402397 - RNA, 17 nt, Bordetella pertussis
guucgacuucguccggc

SEQ ID NO: 2402398 - RNA, 19 nt, Bordetella pertussis
guucgacuucguccggcgc

SEQ ID NO: 2402399 - RNA, 16 nt, Bordetella pertussis
guucgagcaggcgcgc

SEQ ID NO: 2402400 - RNA, 20 nt, Bordetella pertussis
guucgagcgcgcgcaugcgc

SEQ ID NO: 2402401 - RNA, 22 nt, Bordetella pertussis
guucgagcgcgcgcaugcgcac

SEQ ID NO: 2402402 - RNA, 16 nt, Bordetella pertussis
guucgauacggccacg

SEQ ID NO: 2402403 - RNA, 21 nt, Bordetella pertussis
guucgauguaguagccgccgc

SEQ ID NO: 2402404 - RNA, 20 nt, Bordetella pertussis
guucgcaccagucccgcacc

SEQ ID NO: 2402405 - RNA, 16 nt, Bordetella pertussis
guucgcauagcgccgg

SEQ ID NO: 2402406 - RNA, 13 nt, Bordetella pertussis
guucgcccaccac

SEQ ID NO: 2402407 - RNA, 14 nt, Bordetella pertussis
guucgcccaccacc

SEQ ID NO: 2402408 - RNA, 15 nt, Bordetella pertussis
guucgcccaccacca

SEQ ID NO: 2402409 - RNA, 19 nt, Bordetella pertussis
guucgcccaccaccagcgg

SEQ ID NO: 2402410 - RNA, 21 nt, Bordetella pertussis
guucgcccaccaccagcggcg

SEQ ID NO: 2402411 - RNA, 21 nt, Bordetella pertussis
guucgcccggcuccaggccgc

SEQ ID NO: 2402412 - RNA, 12 nt, Bordetella pertussis
guucgccgcacc

SEQ ID NO: 2402413 - RNA, 13 nt, Bordetella pertussis
guucgccggcgcc

SEQ ID NO: 2402414 - RNA, 23 nt, Bordetella pertussis
guucgccgucguugacggggacg

SEQ ID NO: 2402415 - RNA, 14 nt, Bordetella pertussis
guucgcgcaccagc

SEQ ID NO: 2402416 - RNA, 15 nt, Bordetella pertussis
guucgcgcaccagcg

SEQ ID NO: 2402417 - RNA, 21 nt, Bordetella pertussis
guucgcgcagaucccaggcgc

SEQ ID NO: 2402418 - RNA, 22 nt, Bordetella pertussis
guucgcgcagaucccaggcgcu

SEQ ID NO: 2402419 - RNA, 17 nt, Bordetella pertussis
guucgcgcagcaggccg

SEQ ID NO: 2402420 - RNA, 19 nt, Bordetella pertussis
guucgcgcagcaggccgcg

SEQ ID NO: 2402421 - RNA, 19 nt, Bordetella pertussis
guucgcgcaggcgugcgcg

SEQ ID NO: 2402422 - RNA, 20 nt, Bordetella pertussis
guucgcgcaggcgugcgcgg

SEQ ID NO: 2402423 - RNA, 20 nt, Bordetella pertussis
guucgcgccaggcgccgggc

SEQ ID NO: 2402424 - RNA, 15 nt, Bordetella pertussis
guucgcgccugcccg

SEQ ID NO: 2402425 - RNA, 14 nt, Bordetella pertussis
guucgcgcgccggc

SEQ ID NO: 2402426 - RNA, 17 nt, Bordetella pertussis
guucgcgcgccggcagg

SEQ ID NO: 2402427 - RNA, 19 nt, Bordetella pertussis
guucgcgcugcccaccgcc

SEQ ID NO: 2402428 - RNA, 19 nt, Bordetella pertussis
guucgcgcuugcggccguc

SEQ ID NO: 2402429 - RNA, 17 nt, Bordetella pertussis
guucgcggcccugggcg

SEQ ID NO: 2402430 - RNA, 20 nt, Bordetella pertussis
guucgcggcccugggcgcgg

SEQ ID NO: 2402431 - RNA, 12 nt, Bordetella pertussis
guucgcggccgg

SEQ ID NO: 2402432 - RNA, 20 nt, Bordetella pertussis
guucgcgguauucggcgacc

SEQ ID NO: 2402433 - RNA, 20 nt, Bordetella pertussis
guucgcggugucgcaccgca

SEQ ID NO: 2402434 - RNA, 12 nt, Bordetella pertussis
guucgcuuucca

SEQ ID NO: 2402435 - RNA, 21 nt, Bordetella pertussis
guucggagcacggaagaaauu

SEQ ID NO: 2402436 - RNA, 14 nt, Bordetella pertussis
guucggaugcgcgu

SEQ ID NO: 2402437 - RNA, 18 nt, Bordetella pertussis
guucggcagcgaggcgca

SEQ ID NO: 2402438 - RNA, 17 nt, Bordetella pertussis
guucggccacuuccugg

SEQ ID NO: 2402439 - RNA, 14 nt, Bordetella pertussis
guucggccagcagc

SEQ ID NO: 2402440 - RNA, 18 nt, Bordetella pertussis
guucggccagcagcuugg

SEQ ID NO: 2402441 - RNA, 16 nt, Bordetella pertussis
guucggccagcgcgcg

SEQ ID NO: 2402442 - RNA, 17 nt, Bordetella pertussis
guucggccagcgcgcgg

SEQ ID NO: 2402443 - RNA, 15 nt, Bordetella pertussis
guucggccagcggca

SEQ ID NO: 2402444 - RNA, 16 nt, Bordetella pertussis
guucggccagcggcag

SEQ ID NO: 2402445 - RNA, 21 nt, Bordetella pertussis
guucggccagcggcaggccca

SEQ ID NO: 2402446 - RNA, 16 nt, Bordetella pertussis
guucggccgccagguc

SEQ ID NO: 2402447 - RNA, 21 nt, Bordetella pertussis
guucggccgccaggucggcca

SEQ ID NO: 2402448 - RNA, 15 nt, Bordetella pertussis
guucggccggcggcc

SEQ ID NO: 2402449 - RNA, 17 nt, Bordetella pertussis
guucggccucgcccaug

SEQ ID NO: 2402450 - RNA, 21 nt, Bordetella pertussis
guucggcgagccgggcaccga

SEQ ID NO: 2402451 - RNA, 19 nt, Bordetella pertussis
guucggcgaugcgggcggc

SEQ ID NO: 2402452 - RNA, 18 nt, Bordetella pertussis
guucggcgccgggcgacg

SEQ ID NO: 2402453 - RNA, 15 nt, Bordetella pertussis
guucggcgcggccuu

SEQ ID NO: 2402454 - RNA, 15 nt, Bordetella pertussis
guucggcgcggcgcg

SEQ ID NO: 2402455 - RNA, 13 nt, Bordetella pertussis
guucggcgcgugc

SEQ ID NO: 2402456 - RNA, 20 nt, Bordetella pertussis
guucggcggcgcccaucagg

SEQ ID NO: 2402457 - RNA, 17 nt, Bordetella pertussis
guucggcgucggugccg

SEQ ID NO: 2402458 - RNA, 19 nt, Bordetella pertussis
guucggcuugcacgccggc

SEQ ID NO: 2402459 - RNA, 17 nt, Bordetella pertussis
guucgggcacgccguuc

SEQ ID NO: 2402460 - RNA, 15 nt, Bordetella pertussis
guucgggcggcaggu

SEQ ID NO: 2402461 - RNA, 16 nt, Bordetella pertussis
guucggggacaggcac

SEQ ID NO: 2402462 - RNA, 17 nt, Bordetella pertussis
guucggggacaggcacc

SEQ ID NO: 2402463 - RNA, 15 nt, Bordetella pertussis
guucgggguccagca

SEQ ID NO: 2402464 - RNA, 15 nt, Bordetella pertussis
guucggucagcgcgg

SEQ ID NO: 2402465 - RNA, 19 nt, Bordetella pertussis
guucggugcgcagcggcag

SEQ ID NO: 2402466 - RNA, 23 nt, Bordetella pertussis
guucggugcgcagcggcaggcgg

SEQ ID NO: 2402467 - RNA, 15 nt, Bordetella pertussis
guucgguggcguggu

SEQ ID NO: 2402468 - RNA, 23 nt, Bordetella pertussis
guucguagccgguaucgcggcgc

SEQ ID NO: 2402469 - RNA, 16 nt, Bordetella pertussis
guucguauugcugcug

SEQ ID NO: 2402470 - RNA, 15 nt, Bordetella pertussis
guucgucgcgcagca

SEQ ID NO: 2402471 - RNA, 17 nt, Bordetella pertussis
guucgucgcgcagcagg

SEQ ID NO: 2402472 - RNA, 14 nt, Bordetella pertussis
guucgucgucgcca

SEQ ID NO: 2402473 - RNA, 17 nt, Bordetella pertussis
guucgucgucggucggc

SEQ ID NO: 2402474 - RNA, 18 nt, Bordetella pertussis
guucgucgucggucggcu

SEQ ID NO: 2402475 - RNA, 20 nt, Bordetella pertussis
guucguggaugacucgggca

SEQ ID NO: 2402476 - RNA, 23 nt, Bordetella pertussis
guucguucuugagaauggcgcgg

SEQ ID NO: 2402477 - RNA, 15 nt, Bordetella pertussis
guucuaccugaucgc

SEQ ID NO: 2402478 - RNA, 16 nt, Bordetella pertussis
guucuaccugaucgcc

SEQ ID NO: 2402479 - RNA, 23 nt, Bordetella pertussis
guucucagccgcccgccgggccg

SEQ ID NO: 2402480 - RNA, 17 nt, Bordetella pertussis
guucuccuugagcacgu

SEQ ID NO: 2402481 - RNA, 12 nt, Bordetella pertussis
guucucgacccg

SEQ ID NO: 2402482 - RNA, 19 nt, Bordetella pertussis
guucucgacccgcucggcc

SEQ ID NO: 2402483 - RNA, 22 nt, Bordetella pertussis
guucucgacccgcucggccacg

SEQ ID NO: 2402484 - RNA, 21 nt, Bordetella pertussis
guucucgauguggcgcuggcg

SEQ ID NO: 2402485 - RNA, 14 nt, Bordetella pertussis
guucugcagcgcgg

SEQ ID NO: 2402486 - RNA, 15 nt, Bordetella pertussis
guucugcagcgugcg

SEQ ID NO: 2402487 - RNA, 16 nt, Bordetella pertussis
guucugcguggcggcg

SEQ ID NO: 2402488 - RNA, 14 nt, Bordetella pertussis
guucuggaucgcgc

SEQ ID NO: 2402489 - RNA, 18 nt, Bordetella pertussis
guucuggcagugcgccug

SEQ ID NO: 2402490 - RNA, 18 nt, Bordetella pertussis
guucuggcugcgcgccug

SEQ ID NO: 2402491 - RNA, 15 nt, Bordetella pertussis
guucugggagcgcgg

SEQ ID NO: 2402492 - RNA, 16 nt, Bordetella pertussis
guucuguccggcgcug

SEQ ID NO: 2402493 - RNA, 17 nt, Bordetella pertussis
guucuucaggcuccagu

SEQ ID NO: 2402494 - RNA, 21 nt, Bordetella pertussis
guucuuguugcucuugaccug

SEQ ID NO: 2402495 - RNA, 17 nt, Bordetella pertussis
guugaaauccuucaggu

SEQ ID NO: 2402496 - RNA, 21 nt, Bordetella pertussis
guugaaccgcaacgccagcag

SEQ ID NO: 2402497 - RNA, 14 nt, Bordetella pertussis
guugaacugcaggc

SEQ ID NO: 2402498 - RNA, 16 nt, Bordetella pertussis
guugaagcgcagccac

SEQ ID NO: 2402499 - RNA, 18 nt, Bordetella pertussis
guugaaggcgaugggcac

SEQ ID NO: 2402500 - RNA, 19 nt, Bordetella pertussis
guugaaucggcgcgagcgu

SEQ ID NO: 2402501 - RNA, 15 nt, Bordetella pertussis
guugaccaccacgcu

SEQ ID NO: 2402502 - RNA, 18 nt, Bordetella pertussis
guugaccaccacgcuggc

SEQ ID NO: 2402503 - RNA, 18 nt, Bordetella pertussis
guugaccacgcccuggau

SEQ ID NO: 2402504 - RNA, 18 nt, Bordetella pertussis
guugacccauaccagccc

SEQ ID NO: 2402505 - RNA, 20 nt, Bordetella pertussis
guugacccauaccagcccgg

SEQ ID NO: 2402506 - RNA, 16 nt, Bordetella pertussis
guugaccgagcccggc

SEQ ID NO: 2402507 - RNA, 20 nt, Bordetella pertussis
guugaccgagcccggcacca

SEQ ID NO: 2402508 - RNA, 21 nt, Bordetella pertussis
guugaccgcuuccgagaaggc

SEQ ID NO: 2402509 - RNA, 22 nt, Bordetella pertussis
guugaccugcuggggguuggcc

SEQ ID NO: 2402510 - RNA, 19 nt, Bordetella pertussis
guugacgaucucgcccugc

SEQ ID NO: 2402511 - RNA, 20 nt, Bordetella pertussis
guugacgaucucgcccugcu

SEQ ID NO: 2402512 - RNA, 16 nt, Bordetella pertussis
guugacgaugcccagg

SEQ ID NO: 2402513 - RNA, 15 nt, Bordetella pertussis
guugacggcccagcu

SEQ ID NO: 2402514 - RNA, 17 nt, Bordetella pertussis
guugagcacgguguuga

SEQ ID NO: 2402515 - RNA, 13 nt, Bordetella pertussis
guugagcgccgac

SEQ ID NO: 2402516 - RNA, 15 nt, Bordetella pertussis
guugauccagcgcuc

SEQ ID NO: 2402517 - RNA, 20 nt, Bordetella pertussis
guugauccagcgcucgggcu

SEQ ID NO: 2402518 - RNA, 20 nt, Bordetella pertussis
guugaucucgcccagcaggu

SEQ ID NO: 2402519 - RNA, 14 nt, Bordetella pertussis
guugcacagcacgu

SEQ ID NO: 2402520 - RNA, 13 nt, Bordetella pertussis
guugcagcgcgcc

SEQ ID NO: 2402521 - RNA, 17 nt, Bordetella pertussis
guugcagcgcgccaggc

SEQ ID NO: 2402522 - RNA, 13 nt, Bordetella pertussis
guugcagcggcuu

SEQ ID NO: 2402523 - RNA, 14 nt, Bordetella pertussis
guugcaggccaggc

SEQ ID NO: 2402524 - RNA, 18 nt, Bordetella pertussis
guugcauaccucgauggc

SEQ ID NO: 2402525 - RNA, 19 nt, Bordetella pertussis
guugcauaccucgauggcg

SEQ ID NO: 2402526 - RNA, 15 nt, Bordetella pertussis
guugcccaccagccg

SEQ ID NO: 2402527 - RNA, 24 nt, Bordetella pertussis
guugcccagauccagcuugcgucc

SEQ ID NO: 2402528 - RNA, 19 nt, Bordetella pertussis
guugccccauugcgggugg

SEQ ID NO: 2402529 - RNA, 16 nt, Bordetella pertussis
guugcccgaaggcagc

SEQ ID NO: 2402530 - RNA, 19 nt, Bordetella pertussis
guugcccgaaggcagcggc

SEQ ID NO: 2402531 - RNA, 15 nt, Bordetella pertussis
guugcccgcccgacg

SEQ ID NO: 2402532 - RNA, 17 nt, Bordetella pertussis
guugcccggcaggcaca

SEQ ID NO: 2402533 - RNA, 17 nt, Bordetella pertussis
guugccgaagcgucggc

SEQ ID NO: 2402534 - RNA, 20 nt, Bordetella pertussis
guugccgaagcgucggccug

SEQ ID NO: 2402535 - RNA, 23 nt, Bordetella pertussis
guugccgaugcgguaggcccagc

SEQ ID NO: 2402536 - RNA, 18 nt, Bordetella pertussis
guugccgccgccggcgcg

SEQ ID NO: 2402537 - RNA, 21 nt, Bordetella pertussis
guugccgcugcaugggcggcc

SEQ ID NO: 2402538 - RNA, 13 nt, Bordetella pertussis
guugccggccagg

SEQ ID NO: 2402539 - RNA, 14 nt, Bordetella pertussis
guugccggccagga

SEQ ID NO: 2402540 - RNA, 18 nt, Bordetella pertussis
guugccggccugaggccc

SEQ ID NO: 2402541 - RNA, 15 nt, Bordetella pertussis
guugccugggugcug

SEQ ID NO: 2402542 - RNA, 19 nt, Bordetella pertussis
guugccugggugcuggugc

SEQ ID NO: 2402543 - RNA, 20 nt, Bordetella pertussis
guugcgaaacccgcugggcc

SEQ ID NO: 2402544 - RNA, 16 nt, Bordetella pertussis
guugcgaggcggccuu

SEQ ID NO: 2402545 - RNA, 15 nt, Bordetella pertussis
guugcgcaucgcgca

SEQ ID NO: 2402546 - RNA, 19 nt, Bordetella pertussis
guugcgcaucgcgcacccg

SEQ ID NO: 2402547 - RNA, 13 nt, Bordetella pertussis
guugcgccagcgg

SEQ ID NO: 2402548 - RNA, 17 nt, Bordetella pertussis
guugcgccagcggcgac

SEQ ID NO: 2402549 - RNA, 22 nt, Bordetella pertussis
guugcgccgcaacgccgccggc

SEQ ID NO: 2402550 - RNA, 15 nt, Bordetella pertussis
guugcgcgacaggcc

SEQ ID NO: 2402551 - RNA, 11 nt, Bordetella pertussis
guugcgcgccg

SEQ ID NO: 2402552 - RNA, 20 nt, Bordetella pertussis
guugcgcgccgucggcgucg

SEQ ID NO: 2402553 - RNA, 15 nt, Bordetella pertussis
guugcgcuugcgcuu

SEQ ID NO: 2402554 - RNA, 21 nt, Bordetella pertussis
guugcgcuugcgcuuggcagg

SEQ ID NO: 2402555 - RNA, 14 nt, Bordetella pertussis
guugcggaucacgc

SEQ ID NO: 2402556 - RNA, 17 nt, Bordetella pertussis
guugcggcagcgccgca

SEQ ID NO: 2402557 - RNA, 13 nt, Bordetella pertussis
guugcggccgcca

SEQ ID NO: 2402558 - RNA, 21 nt, Bordetella pertussis
guugcgggcgcaccuggucca

SEQ ID NO: 2402559 - RNA, 19 nt, Bordetella pertussis
guugcgggcugcgcggguc

SEQ ID NO: 2402560 - RNA, 14 nt, Bordetella pertussis
guugcgucuccagc

SEQ ID NO: 2402561 - RNA, 16 nt, Bordetella pertussis
guugcgucucggccug

SEQ ID NO: 2402562 - RNA, 15 nt, Bordetella pertussis
guugcuccagccagg

SEQ ID NO: 2402563 - RNA, 22 nt, Bordetella pertussis
guugcuccagccaggcgcgcag

SEQ ID NO: 2402564 - RNA, 14 nt, Bordetella pertussis
guugcucgcgcgca

SEQ ID NO: 2402565 - RNA, 15 nt, Bordetella pertussis
guugcucgcgcgcag

SEQ ID NO: 2402566 - RNA, 14 nt, Bordetella pertussis
guugcucggcggca

SEQ ID NO: 2402567 - RNA, 16 nt, Bordetella pertussis
guugcucuugaccugg

SEQ ID NO: 2402568 - RNA, 17 nt, Bordetella pertussis
guugcucuugaccuggg

SEQ ID NO: 2402569 - RNA, 20 nt, Bordetella pertussis
guugcucuugaccugggcca

SEQ ID NO: 2402570 - RNA, 21 nt, Bordetella pertussis
guugcucuugaccugggccag

SEQ ID NO: 2402571 - RNA, 23 nt, Bordetella pertussis
guugcucuugaccugggccagca

SEQ ID NO: 2402572 - RNA, 23 nt, Bordetella pertussis
guugcuggcaaagcgcgcguccu

SEQ ID NO: 2402573 - RNA, 15 nt, Bordetella pertussis
guugcuggccacccg

SEQ ID NO: 2402574 - RNA, 14 nt, Bordetella pertussis
guugcuggcggccg

SEQ ID NO: 2402575 - RNA, 14 nt, Bordetella pertussis
guugcuuggcguca

SEQ ID NO: 2402576 - RNA, 16 nt, Bordetella pertussis
guugcuuucggcgacu

SEQ ID NO: 2402577 - RNA, 13 nt, Bordetella pertussis
guuggcaggccag

SEQ ID NO: 2402578 - RNA, 12 nt, Bordetella pertussis
guuggccagcgc

SEQ ID NO: 2402579 - RNA, 15 nt, Bordetella pertussis
guuggccagcuccag

SEQ ID NO: 2402580 - RNA, 18 nt, Bordetella pertussis
guuggcccuucuucagcu

SEQ ID NO: 2402581 - RNA, 15 nt, Bordetella pertussis
guuggccgccagccg

SEQ ID NO: 2402582 - RNA, 16 nt, Bordetella pertussis
guuggccgccagccgg

SEQ ID NO: 2402583 - RNA, 20 nt, Bordetella pertussis
guuggccgcguagcccaugu

SEQ ID NO: 2402584 - RNA, 14 nt, Bordetella pertussis
guuggccggcgcgc

SEQ ID NO: 2402585 - RNA, 16 nt, Bordetella pertussis
guuggccgggucgcgc

SEQ ID NO: 2402586 - RNA, 15 nt, Bordetella pertussis
guuggccugaccgga

SEQ ID NO: 2402587 - RNA, 17 nt, Bordetella pertussis
guuggccugccauccgg

SEQ ID NO: 2402588 - RNA, 20 nt, Bordetella pertussis
guuggccugccauccggccg

SEQ ID NO: 2402589 - RNA, 19 nt, Bordetella pertussis
guuggccuugacggcgcgg

SEQ ID NO: 2402590 - RNA, 19 nt, Bordetella pertussis
guuggcgaaugccugguag

SEQ ID NO: 2402591 - RNA, 20 nt, Bordetella pertussis
guuggcgaggacaggccagu

SEQ ID NO: 2402592 - RNA, 19 nt, Bordetella pertussis
guuggcgauggcgcggccg

SEQ ID NO: 2402593 - RNA, 13 nt, Bordetella pertussis
guuggcgcccagc

SEQ ID NO: 2402594 - RNA, 14 nt, Bordetella pertussis
guuggcgcccagcg

SEQ ID NO: 2402595 - RNA, 16 nt, Bordetella pertussis
guuggcgcccagcgcc

SEQ ID NO: 2402596 - RNA, 17 nt, Bordetella pertussis
guuggcgcccagcgcca

SEQ ID NO: 2402597 - RNA, 14 nt, Bordetella pertussis
guuggcgccggccg

SEQ ID NO: 2402598 - RNA, 14 nt, Bordetella pertussis
guuggcgcugcugc

SEQ ID NO: 2402599 - RNA, 18 nt, Bordetella pertussis
guuggcgcugcugcuggc

SEQ ID NO: 2402600 - RNA, 23 nt, Bordetella pertussis
guuggcgggcgcuucgucggccg

SEQ ID NO: 2402601 - RNA, 20 nt, Bordetella pertussis
guuggcguccaggcgcgcca

SEQ ID NO: 2402602 - RNA, 16 nt, Bordetella pertussis
guuggcgucgagcacc

SEQ ID NO: 2402603 - RNA, 17 nt, Bordetella pertussis
guuggcgucgagcaccg

SEQ ID NO: 2402604 - RNA, 21 nt, Bordetella pertussis
guugggaucgcgccaggcgua

SEQ ID NO: 2402605 - RNA, 23 nt, Bordetella pertussis
guugggauggaugccgucggccu

SEQ ID NO: 2402606 - RNA, 19 nt, Bordetella pertussis
guugggcaccaccaccgcc

SEQ ID NO: 2402607 - RNA, 24 nt, Bordetella pertussis
guugggccagggccucgcgggccu

SEQ ID NO: 2402608 - RNA, 13 nt, Bordetella pertussis
guugggcgcgccc

SEQ ID NO: 2402609 - RNA, 16 nt, Bordetella pertussis
guuggucaccacgccu

SEQ ID NO: 2402610 - RNA, 23 nt, Bordetella pertussis
guuggucaccacgccuucgagca

SEQ ID NO: 2402611 - RNA, 17 nt, Bordetella pertussis
guuggugccgaguucga

SEQ ID NO: 2402612 - RNA, 14 nt, Bordetella pertussis
guuggugcgcaccu

SEQ ID NO: 2402613 - RNA, 16 nt, Bordetella pertussis
guugguggcaggcgcc

SEQ ID NO: 2402614 - RNA, 21 nt, Bordetella pertussis
guuguccgaaccacccggcca

SEQ ID NO: 2402615 - RNA, 21 nt, Bordetella pertussis
guuguccgccugcggacggcg

SEQ ID NO: 2402616 - RNA, 14 nt, Bordetella pertussis
guuguccuggccgg

SEQ ID NO: 2402617 - RNA, 19 nt, Bordetella pertussis
guuguccuggcgcgccagg

SEQ ID NO: 2402618 - RNA, 15 nt, Bordetella pertussis
guugucgaugugcug

SEQ ID NO: 2402619 - RNA, 18 nt, Bordetella pertussis
guugucgcgcgcgcggau

SEQ ID NO: 2402620 - RNA, 16 nt, Bordetella pertussis
guuguucgggccggcu

SEQ ID NO: 2402621 - RNA, 18 nt, Bordetella pertussis
guuguugccgcgucgauc

SEQ ID NO: 2402622 - RNA, 21 nt, Bordetella pertussis
guuucaggccugcggcgccag

SEQ ID NO: 2402623 - RNA, 23 nt, Bordetella pertussis
guuuccaagcgcacgcgcagcac

SEQ ID NO: 2402624 - RNA, 13 nt, Bordetella pertussis
guuuccagggcgc

SEQ ID NO: 2402625 - RNA, 22 nt, Bordetella pertussis
guuuccagggcuugcggcgcug

SEQ ID NO: 2402626 - RNA, 18 nt, Bordetella pertussis
guuucccucggugcugcu

SEQ ID NO: 2402627 - RNA, 20 nt, Bordetella pertussis
guuucccucggugcugcugu

SEQ ID NO: 2402628 - RNA, 17 nt, Bordetella pertussis
guuucccuuccuggcca

SEQ ID NO: 2402629 - RNA, 16 nt, Bordetella pertussis
guuucgagcaucaugg

SEQ ID NO: 2402630 - RNA, 15 nt, Bordetella pertussis
guuucggccugcagg

SEQ ID NO: 2402631 - RNA, 18 nt, Bordetella pertussis
guuucggccugcaggccc

SEQ ID NO: 2402632 - RNA, 13 nt, Bordetella pertussis
guuucggccugcu

SEQ ID NO: 2402633 - RNA, 14 nt, Bordetella pertussis
guuucggcgacgac

SEQ ID NO: 2402634 - RNA, 23 nt, Bordetella pertussis
guuucggucagggcgaagcgcgc

SEQ ID NO: 2402635 - RNA, 15 nt, Bordetella pertussis
guuucggugcugccc

SEQ ID NO: 2402636 - RNA, 16 nt, Bordetella pertussis
guuucguagccgccga

SEQ ID NO: 2402637 - RNA, 15 nt, Bordetella pertussis
guuucgucggcgcgc

SEQ ID NO: 2402638 - RNA, 16 nt, Bordetella pertussis
guuucucaacccgccg

SEQ ID NO: 2402639 - RNA, 19 nt, Bordetella pertussis
guuucucaacccgccggcc

SEQ ID NO: 2402640 - RNA, 21 nt, Bordetella pertussis
guuucucaacccgccggccau

SEQ ID NO: 2402641 - RNA, 14 nt, Bordetella pertussis
guuucucagcgcgc

SEQ ID NO: 2402642 - RNA, 15 nt, Bordetella pertussis
guuucucagcgcgcu

SEQ ID NO: 2402643 - RNA, 22 nt, Bordetella pertussis
guuucucgacgcaaucggcgaa

SEQ ID NO: 2402644 - RNA, 15 nt, Bordetella pertussis
guuucucgcucuugg

SEQ ID NO: 2402645 - RNA, 20 nt, Bordetella pertussis
guuugcccuucgcggcuggu

SEQ ID NO: 2402646 - RNA, 15 nt, Bordetella pertussis
guuugcgcgcgcgcu

SEQ ID NO: 2402647 - RNA, 16 nt, Bordetella pertussis
guuugcggacgggcca

SEQ ID NO: 2402648 - RNA, 16 nt, Bordetella pertussis
guuuucagcgcaggcu

SEQ ID NO: 2402649 - RNA, 16 nt, Bordetella pertussis
guuuuccacagccagg

SEQ ID NO: 2402650 - RNA, 20 nt, Bordetella pertussis
guuuuccuuuugcgcggccg

SEQ ID NO: 2402651 - RNA, 13 nt, Bordetella pertussis
guuuucgcuggcg

SEQ ID NO: 2402652 - RNA, 15 nt, Bordetella pertussis
guuuuggcaggcugg

SEQ ID NO: 2402653 - RNA, 21 nt, Bordetella pertussis
guuuuuccggcucuuccaucu

SEQ ID NO: 2402654 - RNA, 21 nt, Bordetella pertussis
uaaaaacccggccugcgcgcc

SEQ ID NO: 2402655 - RNA, 14 nt, Bordetella pertussis
uaaagaugcgcgcc

SEQ ID NO: 2402656 - RNA, 16 nt, Bordetella pertussis
uaaagcgccggcccgc

SEQ ID NO: 2402657 - RNA, 23 nt, Bordetella pertussis
uaaagcggugcuugaugcccagc

SEQ ID NO: 2402658 - RNA, 21 nt, Bordetella pertussis
uaaauacgcuggcuaucgccu

SEQ ID NO: 2402659 - RNA, 14 nt, Bordetella pertussis
uaacgaaucgcugc

SEQ ID NO: 2402660 - RNA, 21 nt, Bordetella pertussis
uaacgccacuugcaggccgcg

SEQ ID NO: 2402661 - RNA, 21 nt, Bordetella pertussis
uaagcacaagcgcguggccgg

SEQ ID NO: 2402662 - RNA, 22 nt, Bordetella pertussis
uaagcaggucugcacgaggcgc

SEQ ID NO: 2402663 - RNA, 21 nt, Bordetella pertussis
uaagcccacucacgcaaggcc

SEQ ID NO: 2402664 - RNA, 23 nt, Bordetella pertussis
uaagccucacaugucacacgaag

SEQ ID NO: 2402665 - RNA, 19 nt, Bordetella pertussis
uaaggcuucucgaccaggc

SEQ ID NO: 2402666 - RNA, 13 nt, Bordetella pertussis
uaagugcccaggc

SEQ ID NO: 2402667 - RNA, 13 nt, Bordetella pertussis
uaagugggcugcg

SEQ ID NO: 2402668 - RNA, 18 nt, Bordetella pertussis
uaauagcuggcggcgcgc

SEQ ID NO: 2402669 - RNA, 17 nt, Bordetella pertussis
uaaugacgcagccgccc

SEQ ID NO: 2402670 - RNA, 17 nt, Bordetella pertussis
uaauggcgcuccagccc

SEQ ID NO: 2402671 - RNA, 14 nt, Bordetella pertussis
uaauugggcggcau

SEQ ID NO: 2402672 - RNA, 23 nt, Bordetella pertussis
uacaaaauacuuguccgccaccc

SEQ ID NO: 2402673 - RNA, 22 nt, Bordetella pertussis
uacaaccgcgccgaguuuccgc

SEQ ID NO: 2402674 - RNA, 12 nt, Bordetella pertussis
uacaaggcgcgg

SEQ ID NO: 2402675 - RNA, 16 nt, Bordetella pertussis
uacaaggugccugucc

SEQ ID NO: 2402676 - RNA, 19 nt, Bordetella pertussis
uacaaggugccuguccccg

SEQ ID NO: 2402677 - RNA, 20 nt, Bordetella pertussis
uacaccuuguuggcgccggc

SEQ ID NO: 2402678 - RNA, 14 nt, Bordetella pertussis
uacacggccgccac

SEQ ID NO: 2402679 - RNA, 21 nt, Bordetella pertussis
uacacggccgccaccugggcc

SEQ ID NO: 2402680 - RNA, 13 nt, Bordetella pertussis
uacacggcgcggg

SEQ ID NO: 2402681 - RNA, 15 nt, Bordetella pertussis
uacacuggcccuggc

SEQ ID NO: 2402682 - RNA, 17 nt, Bordetella pertussis
uacagaugggcggccua

SEQ ID NO: 2402683 - RNA, 23 nt, Bordetella pertussis
uacagcaaggacaaggcgcguau

SEQ ID NO: 2402684 - RNA, 13 nt, Bordetella pertussis
uacagccaggcca

SEQ ID NO: 2402685 - RNA, 16 nt, Bordetella pertussis
uacagccccagcgcca

SEQ ID NO: 2402686 - RNA, 18 nt, Bordetella pertussis
uacagccccagcgccagc

SEQ ID NO: 2402687 - RNA, 16 nt, Bordetella pertussis
uacagccgccuggcgc

SEQ ID NO: 2402688 - RNA, 19 nt, Bordetella pertussis
uacagccgccuggcgcggc

SEQ ID NO: 2402689 - RNA, 12 nt, Bordetella pertussis
uacagccgcggc

SEQ ID NO: 2402690 - RNA, 22 nt, Bordetella pertussis
uacagccugcccugguggcaga

SEQ ID NO: 2402691 - RNA, 15 nt, Bordetella pertussis
uacagcgcgcccgau

SEQ ID NO: 2402692 - RNA, 17 nt, Bordetella pertussis
uacagcggagccgcgca

SEQ ID NO: 2402693 - RNA, 23 nt, Bordetella pertussis
uacagcgucaugugcugcggcag

SEQ ID NO: 2402694 - RNA, 14 nt, Bordetella pertussis
uacagcuccuugac

SEQ ID NO: 2402695 - RNA, 17 nt, Bordetella pertussis
uacagcuucgcgguaac

SEQ ID NO: 2402696 - RNA, 19 nt, Bordetella pertussis
uacaggcagcggccgcgcg

SEQ ID NO: 2402697 - RNA, 20 nt, Bordetella pertussis
uacaggcccagcgccagcag

SEQ ID NO: 2402698 - RNA, 22 nt, Bordetella pertussis
uacaggcccagcgccagcagca

SEQ ID NO: 2402699 - RNA, 22 nt, Bordetella pertussis
uacaggccgccggucacugccg

SEQ ID NO: 2402700 - RNA, 14 nt, Bordetella pertussis
uacaggccggcggc

SEQ ID NO: 2402701 - RNA, 19 nt, Bordetella pertussis
uacaggcgcucgcgcugca

SEQ ID NO: 2402702 - RNA, 17 nt, Bordetella pertussis
uacaggcugccgucggc

SEQ ID NO: 2402703 - RNA, 13 nt, Bordetella pertussis
uacagggccgcga

SEQ ID NO: 2402704 - RNA, 16 nt, Bordetella pertussis
uacauauucacagcca

SEQ ID NO: 2402705 - RNA, 14 nt, Bordetella pertussis
uacaugcagccgcc

SEQ ID NO: 2402706 - RNA, 13 nt, Bordetella pertussis
uacaugccgcgcg

SEQ ID NO: 2402707 - RNA, 12 nt, Bordetella pertussis
uaccaacugccu

SEQ ID NO: 2402708 - RNA, 12 nt, Bordetella pertussis
uaccagcccagc

SEQ ID NO: 2402709 - RNA, 17 nt, Bordetella pertussis
uaccagcccggcgcgac

SEQ ID NO: 2402710 - RNA, 19 nt, Bordetella pertussis
uaccagcgcacguugagau

SEQ ID NO: 2402711 - RNA, 22 nt, Bordetella pertussis
uaccagcgcgaacgccugccag

SEQ ID NO: 2402712 - RNA, 14 nt, Bordetella pertussis
uaccaggccgacga

SEQ ID NO: 2402713 - RNA, 18 nt, Bordetella pertussis
uaccaggccgacgaggcg

SEQ ID NO: 2402714 - RNA, 17 nt, Bordetella pertussis
uaccaggugggcgcgcu

SEQ ID NO: 2402715 - RNA, 18 nt, Bordetella pertussis
uaccaguacaccggcgug

SEQ ID NO: 2402716 - RNA, 20 nt, Bordetella pertussis
uaccccauaguccucuacug

SEQ ID NO: 2402717 - RNA, 18 nt, Bordetella pertussis
uaccccucauuggcgcgc

SEQ ID NO: 2402718 - RNA, 13 nt, Bordetella pertussis
uacccgccgggcg

SEQ ID NO: 2402719 - RNA, 15 nt, Bordetella pertussis
uacccgccgggcggc

SEQ ID NO: 2402720 - RNA, 16 nt, Bordetella pertussis
uacccgccgggcggcg

SEQ ID NO: 2402721 - RNA, 19 nt, Bordetella pertussis
uacccgccgggcggcgccg

SEQ ID NO: 2402722 - RNA, 23 nt, Bordetella pertussis
uacccgcuucgacggcuugcgca

SEQ ID NO: 2402723 - RNA, 21 nt, Bordetella pertussis
uacccggcuucugggucagcu

SEQ ID NO: 2402724 - RNA, 21 nt, Bordetella pertussis
uacccggugcagcguggcgcg

SEQ ID NO: 2402725 - RNA, 16 nt, Bordetella pertussis
uacccugaacucuuca

SEQ ID NO: 2402726 - RNA, 19 nt, Bordetella pertussis
uacccugcccauucccgcc

SEQ ID NO: 2402727 - RNA, 23 nt, Bordetella pertussis
uaccgaaucgaacuuggcgcggu

SEQ ID NO: 2402728 - RNA, 22 nt, Bordetella pertussis
uaccgcaaacguggugucggcu

SEQ ID NO: 2402729 - RNA, 13 nt, Bordetella pertussis
uaccgccacaccg

SEQ ID NO: 2402730 - RNA, 19 nt, Bordetella pertussis
uaccgccagcucggccugc

SEQ ID NO: 2402731 - RNA, 13 nt, Bordetella pertussis
uaccgccgccgcu

SEQ ID NO: 2402732 - RNA, 18 nt, Bordetella pertussis
uaccgccgccugcgcgaa

SEQ ID NO: 2402733 - RNA, 21 nt, Bordetella pertussis
uaccgccuugccuugcgcggc

SEQ ID NO: 2402734 - RNA, 13 nt, Bordetella pertussis
uaccgcuggccag

SEQ ID NO: 2402735 - RNA, 15 nt, Bordetella pertussis
uaccgcuggccaggc

SEQ ID NO: 2402736 - RNA, 20 nt, Bordetella pertussis
uaccggcgccgacgcgcugg

SEQ ID NO: 2402737 - RNA, 15 nt, Bordetella pertussis
uaccgggcuggucag

SEQ ID NO: 2402738 - RNA, 16 nt, Bordetella pertussis
uaccguccuggcaguc

SEQ ID NO: 2402739 - RNA, 16 nt, Bordetella pertussis
uaccgucuuggcaguc

SEQ ID NO: 2402740 - RNA, 13 nt, Bordetella pertussis
uaccucagcaugg

SEQ ID NO: 2402741 - RNA, 18 nt, Bordetella pertussis
uaccucagccugcuggug

SEQ ID NO: 2402742 - RNA, 19 nt, Bordetella pertussis
uaccucagccugcuggugc

SEQ ID NO: 2402743 - RNA, 15 nt, Bordetella pertussis
uaccucgauggcggu

SEQ ID NO: 2402744 - RNA, 13 nt, Bordetella pertussis
uaccugcagcagg

SEQ ID NO: 2402745 - RNA, 14 nt, Bordetella pertussis
uaccuucagcccgg

SEQ ID NO: 2402746 - RNA, 16 nt, Bordetella pertussis
uaccuucugcaaggcc

SEQ ID NO: 2402747 - RNA, 12 nt, Bordetella pertussis
uacgaaaaccag

SEQ ID NO: 2402748 - RNA, 13 nt, Bordetella pertussis
uacgaaaccaggc

SEQ ID NO: 2402749 - RNA, 16 nt, Bordetella pertussis
uacgaaaccaggccgg

SEQ ID NO: 2402750 - RNA, 22 nt, Bordetella pertussis
uacgaaggggcggaaagcgauu

SEQ ID NO: 2402751 - RNA, 13 nt, Bordetella pertussis
uacgacacgccgc

SEQ ID NO: 2402752 - RNA, 14 nt, Bordetella pertussis
uacgacacgccgcg

SEQ ID NO: 2402753 - RNA, 12 nt, Bordetella pertussis
uacgcaccgccg

SEQ ID NO: 2402754 - RNA, 21 nt, Bordetella pertussis
uacgcaucggcgccggcgucc

SEQ ID NO: 2402755 - RNA, 16 nt, Bordetella pertussis
uacgccacuuccuugc

SEQ ID NO: 2402756 - RNA, 18 nt, Bordetella pertussis
uacgccaugaacgcuuga

SEQ ID NO: 2402757 - RNA, 17 nt, Bordetella pertussis
uacgccgauggcgcggc

SEQ ID NO: 2402758 - RNA, 23 nt, Bordetella pertussis
uacgccgauggcgcggccgccag

SEQ ID NO: 2402759 - RNA, 15 nt, Bordetella pertussis
uacgccugcaccgcc

SEQ ID NO: 2402760 - RNA, 15 nt, Bordetella pertussis
uacgcgacaguucgc

SEQ ID NO: 2402761 - RNA, 15 nt, Bordetella pertussis
uacgcgcgcgccggc

SEQ ID NO: 2402762 - RNA, 14 nt, Bordetella pertussis
uacgcgcuggcgca

SEQ ID NO: 2402763 - RNA, 15 nt, Bordetella pertussis
uacgcgcuggcgcag

SEQ ID NO: 2402764 - RNA, 11 nt, Bordetella pertussis
uacgcggcgcg

SEQ ID NO: 2402765 - RNA, 20 nt, Bordetella pertussis
uacgcgggcauugggcagcg

SEQ ID NO: 2402766 - RNA, 18 nt, Bordetella pertussis
uacgcgggcuugcugccc

SEQ ID NO: 2402767 - RNA, 20 nt, Bordetella pertussis
uacgcgggcuugcugccccc

SEQ ID NO: 2402768 - RNA, 14 nt, Bordetella pertussis
uacgcgugcgcggc

SEQ ID NO: 2402769 - RNA, 17 nt, Bordetella pertussis
uacgcgugcgcggccgc

SEQ ID NO: 2402770 - RNA, 20 nt, Bordetella pertussis
uacgcgugcgcggccgcgcg

SEQ ID NO: 2402771 - RNA, 15 nt, Bordetella pertussis
uacgcgugggcggcg

SEQ ID NO: 2402772 - RNA, 18 nt, Bordetella pertussis
uacgcuggcuaucgccuc

SEQ ID NO: 2402773 - RNA, 17 nt, Bordetella pertussis
uacggacgagcgcagca

SEQ ID NO: 2402774 - RNA, 23 nt, Bordetella pertussis
uacggauaauugggcggcaucuc

SEQ ID NO: 2402775 - RNA, 22 nt, Bordetella pertussis
uacggcaagcagaaaggaugcc

SEQ ID NO: 2402776 - RNA, 17 nt, Bordetella pertussis
uacggcaagguccaggc

SEQ ID NO: 2402777 - RNA, 17 nt, Bordetella pertussis
uacggccacgcagcgcg

SEQ ID NO: 2402778 - RNA, 14 nt, Bordetella pertussis
uacggccagcgcca

SEQ ID NO: 2402779 - RNA, 15 nt, Bordetella pertussis
uacggccagcgccag

SEQ ID NO: 2402780 - RNA, 12 nt, Bordetella pertussis
uacggcccuggu

SEQ ID NO: 2402781 - RNA, 14 nt, Bordetella pertussis
uacggcgaugccgg

SEQ ID NO: 2402782 - RNA, 16 nt, Bordetella pertussis
uacggcgaugccggcg

SEQ ID NO: 2402783 - RNA, 11 nt, Bordetella pertussis
uacggcgcggu

SEQ ID NO: 2402784 - RNA, 21 nt, Bordetella pertussis
uacggcggacuggccgcgccg

SEQ ID NO: 2402785 - RNA, 13 nt, Bordetella pertussis
uacgggcgcggcg

SEQ ID NO: 2402786 - RNA, 15 nt, Bordetella pertussis
uacggguaugcgcag

SEQ ID NO: 2402787 - RNA, 18 nt, Bordetella pertussis
uacgucgcagcacgccca

SEQ ID NO: 2402788 - RNA, 17 nt, Bordetella pertussis
uacgugcuggacccgcu

SEQ ID NO: 2402789 - RNA, 11 nt, Bordetella pertussis
uacguggcccc

SEQ ID NO: 2402790 - RNA, 18 nt, Bordetella pertussis
uacgugguggugcgggcc

SEQ ID NO: 2402791 - RNA, 23 nt, Bordetella pertussis
uacgugguggugcgggccgcgcu

SEQ ID NO: 2402792 - RNA, 11 nt, Bordetella pertussis
uacuccaucug

SEQ ID NO: 2402793 - RNA, 17 nt, Bordetella pertussis
uacucgaugcccagcac

SEQ ID NO: 2402794 - RNA, 18 nt, Bordetella pertussis
uacucgccggucgcggcg

SEQ ID NO: 2402795 - RNA, 20 nt, Bordetella pertussis
uacucgccggucgcggcguu

SEQ ID NO: 2402796 - RNA, 16 nt, Bordetella pertussis
uacucgggggcgggcc

SEQ ID NO: 2402797 - RNA, 14 nt, Bordetella pertussis
uacugcccucgccu

SEQ ID NO: 2402798 - RNA, 20 nt, Bordetella pertussis
uacugcgcaugggcgcaggc

SEQ ID NO: 2402799 - RNA, 21 nt, Bordetella pertussis
uacugcgcaugggcgcaggcc

SEQ ID NO: 2402800 - RNA, 15 nt, Bordetella pertussis
uacugcugcaaggac

SEQ ID NO: 2402801 - RNA, 16 nt, Bordetella pertussis
uacuggaucuuggccu

SEQ ID NO: 2402802 - RNA, 22 nt, Bordetella pertussis
uacuggcaacgggucgcgcagc

SEQ ID NO: 2402803 - RNA, 13 nt, Bordetella pertussis
uacuggcuggucu

SEQ ID NO: 2402804 - RNA, 21 nt, Bordetella pertussis
uacuggucgcgcagcugccug

SEQ ID NO: 2402805 - RNA, 19 nt, Bordetella pertussis
uacuucguggcgcagcucc

SEQ ID NO: 2402806 - RNA, 17 nt, Bordetella pertussis
uacuugcgcagcgcggc

SEQ ID NO: 2402807 - RNA, 20 nt, Bordetella pertussis
uacuuguacgacgucuugcu

SEQ ID NO: 2402808 - RNA, 22 nt, Bordetella pertussis
uacuuguacgacgucuugcugc

SEQ ID NO: 2402809 - RNA, 14 nt, Bordetella pertussis
uacuuguccgccac

SEQ ID NO: 2402810 - RNA, 15 nt, Bordetella pertussis
uacuuguccgccacc

SEQ ID NO: 2402811 - RNA, 16 nt, Bordetella pertussis
uagaagaacagcagau

SEQ ID NO: 2402812 - RNA, 17 nt, Bordetella pertussis
uagaaguaggcggccag

SEQ ID NO: 2402813 - RNA, 18 nt, Bordetella pertussis
uagaaguaggcggccagg

SEQ ID NO: 2402814 - RNA, 19 nt, Bordetella pertussis
uagaaguaggcggccaggc

SEQ ID NO: 2402815 - RNA, 20 nt, Bordetella pertussis
uagaaguaggcggccaggcc

SEQ ID NO: 2402816 - RNA, 19 nt, Bordetella pertussis
uagaaguaguucggcgcgu

SEQ ID NO: 2402817 - RNA, 20 nt, Bordetella pertussis
uagaaguucucgcgcuugcu

SEQ ID NO: 2402818 - RNA, 19 nt, Bordetella pertussis
uagacauugcccagcacca

SEQ ID NO: 2402819 - RNA, 13 nt, Bordetella pertussis
uagaccaccagca

SEQ ID NO: 2402820 - RNA, 19 nt, Bordetella pertussis
uagaccacgcgcugcgcgc

SEQ ID NO: 2402821 - RNA, 13 nt, Bordetella pertussis
uagaccagcagcu

SEQ ID NO: 2402822 - RNA, 19 nt, Bordetella pertussis
uagacgcgcagcggcaggc

SEQ ID NO: 2402823 - RNA, 17 nt, Bordetella pertussis
uagagcaggccgcccag

SEQ ID NO: 2402824 - RNA, 22 nt, Bordetella pertussis
uagagcagugugccugucccag

SEQ ID NO: 2402825 - RNA, 24 nt, Bordetella pertussis
uagagcugcggcgcggcgcgugcc

SEQ ID NO: 2402826 - RNA, 18 nt, Bordetella pertussis
uagagggucuggcggccg

SEQ ID NO: 2402827 - RNA, 16 nt, Bordetella pertussis
uagaucauccaggugg

SEQ ID NO: 2402828 - RNA, 21 nt, Bordetella pertussis
uagaugccgaacagccagggc

SEQ ID NO: 2402829 - RNA, 12 nt, Bordetella pertussis
uagaugcgcgcg

SEQ ID NO: 2402830 - RNA, 19 nt, Bordetella pertussis
uagaugcgcggggccaggc

SEQ ID NO: 2402831 - RNA, 21 nt, Bordetella pertussis
uagauggaaucauuggccagc

SEQ ID NO: 2402832 - RNA, 14 nt, Bordetella pertussis
uagaugggcaggcc

SEQ ID NO: 2402833 - RNA, 14 nt, Bordetella pertussis
uagcacacgccgau

SEQ ID NO: 2402834 - RNA, 21 nt, Bordetella pertussis
uagcaggcgcgcucaggccgc

SEQ ID NO: 2402835 - RNA, 20 nt, Bordetella pertussis
uagccaccgauaucgauacc

SEQ ID NO: 2402836 - RNA, 15 nt, Bordetella pertussis
uagccaggauuucau

SEQ ID NO: 2402837 - RNA, 23 nt, Bordetella pertussis
uagcccagcaccugcaggccgcc

SEQ ID NO: 2402838 - RNA, 17 nt, Bordetella pertussis
uagcccagguccagcgc

SEQ ID NO: 2402839 - RNA, 11 nt, Bordetella pertussis
uagcccauggc

SEQ ID NO: 2402840 - RNA, 16 nt, Bordetella pertussis
uagcccauggccaggg

SEQ ID NO: 2402841 - RNA, 13 nt, Bordetella pertussis
uagcccuggcgcu

SEQ ID NO: 2402842 - RNA, 18 nt, Bordetella pertussis
uagcccuggcgcugcagc

SEQ ID NO: 2402843 - RNA, 21 nt, Bordetella pertussis
uagcccuugaucagcggcggc

SEQ ID NO: 2402844 - RNA, 19 nt, Bordetella pertussis
uagccgaauccggccagca

SEQ ID NO: 2402845 - RNA, 15 nt, Bordetella pertussis
uagccgaucuggccc

SEQ ID NO: 2402846 - RNA, 16 nt, Bordetella pertussis
uagccgaucuggcccu

SEQ ID NO: 2402847 - RNA, 17 nt, Bordetella pertussis
uagccgaucuggcccuu

SEQ ID NO: 2402848 - RNA, 18 nt, Bordetella pertussis
uagccgaugaccggccag

SEQ ID NO: 2402849 - RNA, 14 nt, Bordetella pertussis
uagccgccgacgau

SEQ ID NO: 2402850 - RNA, 20 nt, Bordetella pertussis
uagccgccgacguagucgcg

SEQ ID NO: 2402851 - RNA, 14 nt, Bordetella pertussis
uagccgcggcgccg

SEQ ID NO: 2402852 - RNA, 15 nt, Bordetella pertussis
uagccgcugcgcgcg

SEQ ID NO: 2402853 - RNA, 21 nt, Bordetella pertussis
uagccgcugcgcgcggccugg

SEQ ID NO: 2402854 - RNA, 16 nt, Bordetella pertussis
uagccggaaugcacca

SEQ ID NO: 2402855 - RNA, 18 nt, Bordetella pertussis
uagccgggucuggccggc

SEQ ID NO: 2402856 - RNA, 13 nt, Bordetella pertussis
uagccggucuggu

SEQ ID NO: 2402857 - RNA, 19 nt, Bordetella pertussis
uagccguccucgcgggccu

SEQ ID NO: 2402858 - RNA, 21 nt, Bordetella pertussis
uagccucguuggucagcaccu

SEQ ID NO: 2402859 - RNA, 14 nt, Bordetella pertussis
uagcgcaagcccgu

SEQ ID NO: 2402860 - RNA, 17 nt, Bordetella pertussis
uagcgcaagcccgucag

SEQ ID NO: 2402861 - RNA, 21 nt, Bordetella pertussis
uagcgcacgcaccgcgccagc

SEQ ID NO: 2402862 - RNA, 16 nt, Bordetella pertussis
uagcgcagcagcgaca

SEQ ID NO: 2402863 - RNA, 22 nt, Bordetella pertussis
uagcgcaucgcgaugcgcagca

SEQ ID NO: 2402864 - RNA, 12 nt, Bordetella pertussis
uagcgccgcgcc

SEQ ID NO: 2402865 - RNA, 14 nt, Bordetella pertussis
uagcgccgcgccag

SEQ ID NO: 2402866 - RNA, 21 nt, Bordetella pertussis
uagcgccguaccagcgcgaac

SEQ ID NO: 2402867 - RNA, 15 nt, Bordetella pertussis
uagcgcgcagcuccc

SEQ ID NO: 2402868 - RNA, 15 nt, Bordetella pertussis
uagcgcguggccagc

SEQ ID NO: 2402869 - RNA, 15 nt, Bordetella pertussis
uagcgcugcagccau

SEQ ID NO: 2402870 - RNA, 17 nt, Bordetella pertussis
uagcgcugggcgccagc

SEQ ID NO: 2402871 - RNA, 18 nt, Bordetella pertussis
uagcggaucgcggcgcgg

SEQ ID NO: 2402872 - RNA, 17 nt, Bordetella pertussis
uagcggccggcgcgcgc

SEQ ID NO: 2402873 - RNA, 19 nt, Bordetella pertussis
uagcgggccugcagcauga

SEQ ID NO: 2402874 - RNA, 20 nt, Bordetella pertussis
uagcgguacucgcgcggguc

SEQ ID NO: 2402875 - RNA, 15 nt, Bordetella pertussis
uagcgguccagcugc

SEQ ID NO: 2402876 - RNA, 22 nt, Bordetella pertussis
uagcgguccggggcgggcgcgg

SEQ ID NO: 2402877 - RNA, 18 nt, Bordetella pertussis
uagcgguggcgggccagc

SEQ ID NO: 2402878 - RNA, 14 nt, Bordetella pertussis
uagcguucgccguc

SEQ ID NO: 2402879 - RNA, 17 nt, Bordetella pertussis
uagcguuggcggccggc

SEQ ID NO: 2402880 - RNA, 23 nt, Bordetella pertussis
uagcucgaccaucauggccaggg

SEQ ID NO: 2402881 - RNA, 16 nt, Bordetella pertussis
uagcuggcggcgcgcu

SEQ ID NO: 2402882 - RNA, 21 nt, Bordetella pertussis
uaggacagccccagcagcacg

SEQ ID NO: 2402883 - RNA, 19 nt, Bordetella pertussis
uaggagacggucaccgcgc

SEQ ID NO: 2402884 - RNA, 19 nt, Bordetella pertussis
uaggccaccccguugcagc

SEQ ID NO: 2402885 - RNA, 23 nt, Bordetella pertussis
uaggccggcacguccggcacggc

SEQ ID NO: 2402886 - RNA, 22 nt, Bordetella pertussis
uaggccggcgcgaccgccucca

SEQ ID NO: 2402887 - RNA, 13 nt, Bordetella pertussis
uaggccucgggcc

SEQ ID NO: 2402888 - RNA, 13 nt, Bordetella pertussis
uaggccuggucgg

SEQ ID NO: 2402889 - RNA, 14 nt, Bordetella pertussis
uaggccuggucggg

SEQ ID NO: 2402890 - RNA, 15 nt, Bordetella pertussis
uaggccuucaccuug

SEQ ID NO: 2402891 - RNA, 22 nt, Bordetella pertussis
uaggccuugccgccgccgcgcg

SEQ ID NO: 2402892 - RNA, 15 nt, Bordetella pertussis
uaggcgaagcgcggg

SEQ ID NO: 2402893 - RNA, 19 nt, Bordetella pertussis
uaggcgcagcaggccagga

SEQ ID NO: 2402894 - RNA, 13 nt, Bordetella pertussis
uaggcgcgcacca

SEQ ID NO: 2402895 - RNA, 17 nt, Bordetella pertussis
uaggcgcgcaccagccc

SEQ ID NO: 2402896 - RNA, 18 nt, Bordetella pertussis
uaggcgcgcaccagcccg

SEQ ID NO: 2402897 - RNA, 17 nt, Bordetella pertussis
uaggcgcgguccaccuc

SEQ ID NO: 2402898 - RNA, 11 nt, Bordetella pertussis
uaggcggccuu

SEQ ID NO: 2402899 - RNA, 16 nt, Bordetella pertussis
uaggcugcagccaguu

SEQ ID NO: 2402900 - RNA, 19 nt, Bordetella pertussis
uagggaaucgucaugaacg

SEQ ID NO: 2402901 - RNA, 16 nt, Bordetella pertussis
uagggccauggcaggg

SEQ ID NO: 2402902 - RNA, 18 nt, Bordetella pertussis
uagggccauggcagggcg

SEQ ID NO: 2402903 - RNA, 19 nt, Bordetella pertussis
uagggccauggcagggcgc

SEQ ID NO: 2402904 - RNA, 11 nt, Bordetella pertussis
uagggcgcggc

SEQ ID NO: 2402905 - RNA, 12 nt, Bordetella pertussis
uagggcgcggcc

SEQ ID NO: 2402906 - RNA, 19 nt, Bordetella pertussis
uagggcguggcgcgaugug

SEQ ID NO: 2402907 - RNA, 16 nt, Bordetella pertussis
uaggucagcgccuugc

SEQ ID NO: 2402908 - RNA, 13 nt, Bordetella pertussis
uaggucaggccca

SEQ ID NO: 2402909 - RNA, 18 nt, Bordetella pertussis
uagguggucagcaugguc

SEQ ID NO: 2402910 - RNA, 14 nt, Bordetella pertussis
uaguacagcagcag

SEQ ID NO: 2402911 - RNA, 18 nt, Bordetella pertussis
uaguacagcagcagcacg

SEQ ID NO: 2402912 - RNA, 18 nt, Bordetella pertussis
uaguagccgaauccggcc

SEQ ID NO: 2402913 - RNA, 13 nt, Bordetella pertussis
uaguagccgccgc

SEQ ID NO: 2402914 - RNA, 17 nt, Bordetella pertussis
uaguccagcagcagcgc

SEQ ID NO: 2402915 - RNA, 23 nt, Bordetella pertussis
uaguccagcagcagcgccgcgcc

SEQ ID NO: 2402916 - RNA, 21 nt, Bordetella pertussis
uaguccgagcccgggcgugcc

SEQ ID NO: 2402917 - RNA, 16 nt, Bordetella pertussis
uaguccucuacuggcu

SEQ ID NO: 2402918 - RNA, 15 nt, Bordetella pertussis
uaguccugccacucc

SEQ ID NO: 2402919 - RNA, 15 nt, Bordetella pertussis
uagucgagccaggug

SEQ ID NO: 2402920 - RNA, 22 nt, Bordetella pertussis
uagucgagccagguggacagcg

SEQ ID NO: 2402921 - RNA, 20 nt, Bordetella pertussis
uagucgccggcuuccagcag

SEQ ID NO: 2402922 - RNA, 22 nt, Bordetella pertussis
uagucggaguagggcagcgaca

SEQ ID NO: 2402923 - RNA, 15 nt, Bordetella pertussis
uagucggucaccguc

SEQ ID NO: 2402924 - RNA, 18 nt, Bordetella pertussis
uagucgucgcuggcccac

SEQ ID NO: 2402925 - RNA, 16 nt, Bordetella pertussis
uagugcaggccgcgca

SEQ ID NO: 2402926 - RNA, 17 nt, Bordetella pertussis
uagugcaggccgcgcag

SEQ ID NO: 2402927 - RNA, 19 nt, Bordetella pertussis
uagugcaggccgcgcagca

SEQ ID NO: 2402928 - RNA, 18 nt, Bordetella pertussis
uagugcccccacgcugcg

SEQ ID NO: 2402929 - RNA, 14 nt, Bordetella pertussis
uaguucuauauagg

SEQ ID NO: 2402930 - RNA, 16 nt, Bordetella pertussis
uauaauucguuggagc

SEQ ID NO: 2402931 - RNA, 19 nt, Bordetella pertussis
uauauagaggaccauaguu

SEQ ID NO: 2402932 - RNA, 18 nt, Bordetella pertussis
uauaugacguagagacca

SEQ ID NO: 2402933 - RNA, 17 nt, Bordetella pertussis
uaucaacuuccagcgcc

SEQ ID NO: 2402934 - RNA, 16 nt, Bordetella pertussis
uaucagcgccugcagg

SEQ ID NO: 2402935 - RNA, 17 nt, Bordetella pertussis
uauccacgccacuggcc

SEQ ID NO: 2402936 - RNA, 19 nt, Bordetella pertussis
uauccacgccuucggcgcg

SEQ ID NO: 2402937 - RNA, 23 nt, Bordetella pertussis
uaucccgcucggcuggagcucua

SEQ ID NO: 2402938 - RNA, 18 nt, Bordetella pertussis
uaucccugcggcagcgac

SEQ ID NO: 2402939 - RNA, 16 nt, Bordetella pertussis
uauccuggcgcggaca

SEQ ID NO: 2402940 - RNA, 22 nt, Bordetella pertussis
uaucgaacucgauccgggccug

SEQ ID NO: 2402941 - RNA, 22 nt, Bordetella pertussis
uaucgacccaggccggcgccag

SEQ ID NO: 2402942 - RNA, 23 nt, Bordetella pertussis
uaucgccucgacgggauccucgc

SEQ ID NO: 2402943 - RNA, 15 nt, Bordetella pertussis
uaucgcgccagcgcc

SEQ ID NO: 2402944 - RNA, 18 nt, Bordetella pertussis
uaucgcggcgcaggcggg

SEQ ID NO: 2402945 - RNA, 14 nt, Bordetella pertussis
uaucgcggcgcggc

SEQ ID NO: 2402946 - RNA, 15 nt, Bordetella pertussis
uaucgcggcgcggcg

SEQ ID NO: 2402947 - RNA, 16 nt, Bordetella pertussis
uaucgcguggcgcgcc

SEQ ID NO: 2402948 - RNA, 18 nt, Bordetella pertussis
uaucgcguggcgcgccag

SEQ ID NO: 2402949 - RNA, 21 nt, Bordetella pertussis
uaucggcagcguacgcacgcc

SEQ ID NO: 2402950 - RNA, 13 nt, Bordetella pertussis
uaucggccaggcg

SEQ ID NO: 2402951 - RNA, 17 nt, Bordetella pertussis
uaucggccaggcgcugc

SEQ ID NO: 2402952 - RNA, 21 nt, Bordetella pertussis
uaucggccaggcgcugcgcgg

SEQ ID NO: 2402953 - RNA, 16 nt, Bordetella pertussis
uaucggcccgcgccag

SEQ ID NO: 2402954 - RNA, 23 nt, Bordetella pertussis
uaucggccucgaaccagugcagg

SEQ ID NO: 2402955 - RNA, 15 nt, Bordetella pertussis
uaucguugucgcgcc

SEQ ID NO: 2402956 - RNA, 17 nt, Bordetella pertussis
uaucugcguuuucuggc

SEQ ID NO: 2402957 - RNA, 22 nt, Bordetella pertussis
uaucuggcaaugguccagcagg

SEQ ID NO: 2402958 - RNA, 20 nt, Bordetella pertussis
uaucuguccccgcggggaca

SEQ ID NO: 2402959 - RNA, 15 nt, Bordetella pertussis
uaugaccggcgcggc

SEQ ID NO: 2402960 - RNA, 16 nt, Bordetella pertussis
uaugaccggcgcggcc

SEQ ID NO: 2402961 - RNA, 13 nt, Bordetella pertussis
uaugcaaccggca

SEQ ID NO: 2402962 - RNA, 16 nt, Bordetella pertussis
uaugcacgaccaggcc

SEQ ID NO: 2402963 - RNA, 14 nt, Bordetella pertussis
uaugcacgaugccg

SEQ ID NO: 2402964 - RNA, 15 nt, Bordetella pertussis
uaugcacgaugccgu

SEQ ID NO: 2402965 - RNA, 19 nt, Bordetella pertussis
uaugcaggcuuugcuggcc

SEQ ID NO: 2402966 - RNA, 21 nt, Bordetella pertussis
uaugcaggcuuugcuggccau

SEQ ID NO: 2402967 - RNA, 19 nt, Bordetella pertussis
uaugcccucuucggcggcc

SEQ ID NO: 2402968 - RNA, 16 nt, Bordetella pertussis
uaugccguaggcgccg

SEQ ID NO: 2402969 - RNA, 13 nt, Bordetella pertussis
uaugccugccagc

SEQ ID NO: 2402970 - RNA, 14 nt, Bordetella pertussis
uaugcgcagcgagu

SEQ ID NO: 2402971 - RNA, 18 nt, Bordetella pertussis
uaugcgggcuugcugccc

SEQ ID NO: 2402972 - RNA, 17 nt, Bordetella pertussis
uauggagccaggcggcg

SEQ ID NO: 2402973 - RNA, 20 nt, Bordetella pertussis
uauggcccgccaccacggcg

SEQ ID NO: 2402974 - RNA, 13 nt, Bordetella pertussis
uauggccgcccag

SEQ ID NO: 2402975 - RNA, 20 nt, Bordetella pertussis
uauggccguuggccagcgcc

SEQ ID NO: 2402976 - RNA, 21 nt, Bordetella pertussis
uauggcggcaacgugcaggcc

SEQ ID NO: 2402977 - RNA, 15 nt, Bordetella pertussis
uaugguuucaaaguc

SEQ ID NO: 2402978 - RNA, 17 nt, Bordetella pertussis
uauguaggcgccgcgcc

SEQ ID NO: 2402979 - RNA, 18 nt, Bordetella pertussis
uaugucggcuaccacgug

SEQ ID NO: 2402980 - RNA, 22 nt, Bordetella pertussis
uaugugcaggccaccgacggcg

SEQ ID NO: 2402981 - RNA, 15 nt, Bordetella pertussis
uauucacgccgcgac

SEQ ID NO: 2402982 - RNA, 15 nt, Bordetella pertussis
uauucaucacgggcg

SEQ ID NO: 2402983 - RNA, 18 nt, Bordetella pertussis
uauuccaucuugccggcc

SEQ ID NO: 2402984 - RNA, 12 nt, Bordetella pertussis
uauuccugcugg

SEQ ID NO: 2402985 - RNA, 15 nt, Bordetella pertussis
uauucgaaggcagca

SEQ ID NO: 2402986 - RNA, 20 nt, Bordetella pertussis
uauucgcauacggacgagcg

SEQ ID NO: 2402987 - RNA, 15 nt, Bordetella pertussis
uauucgguggcgcgc

SEQ ID NO: 2402988 - RNA, 17 nt, Bordetella pertussis
uauugaugcagcacguc

SEQ ID NO: 2402989 - RNA, 19 nt, Bordetella pertussis
uauugcacggugccgcgcg

SEQ ID NO: 2402990 - RNA, 15 nt, Bordetella pertussis
uauugcugcugcugg

SEQ ID NO: 2402991 - RNA, 20 nt, Bordetella pertussis
uauuggcuguaucuggccug

SEQ ID NO: 2402992 - RNA, 22 nt, Bordetella pertussis
uauuuccggccgcacuggguga

SEQ ID NO: 2402993 - RNA, 20 nt, Bordetella pertussis
uauuuggcaaggcccgccgc

SEQ ID NO: 2402994 - RNA, 14 nt, Bordetella pertussis
uauuuggcggccug

SEQ ID NO: 2402995 - RNA, 21 nt, Bordetella pertussis
uauuuggcggccuggccgcgc

SEQ ID NO: 2402996 - RNA, 12 nt, Bordetella pertussis
ucaacaaggcga

SEQ ID NO: 2402997 - RNA, 17 nt, Bordetella pertussis
ucaacaucgcccugucg

SEQ ID NO: 2402998 - RNA, 13 nt, Bordetella pertussis
ucaacccgccggc

SEQ ID NO: 2402999 - RNA, 14 nt, Bordetella pertussis
ucaaccucgacgcg

SEQ ID NO: 2403000 - RNA, 19 nt, Bordetella pertussis
ucaaccuucucgaugcgcg

SEQ ID NO: 2403001 - RNA, 12 nt, Bordetella pertussis
ucaaccuugaau

SEQ ID NO: 2403002 - RNA, 22 nt, Bordetella pertussis
ucaacgaagaacagccgcugca

SEQ ID NO: 2403003 - RNA, 22 nt, Bordetella pertussis
ucaacgcccagguugcggccgc

SEQ ID NO: 2403004 - RNA, 14 nt, Bordetella pertussis
ucaacggcaagaag

SEQ ID NO: 2403005 - RNA, 12 nt, Bordetella pertussis
ucaacgggccgc

SEQ ID NO: 2403006 - RNA, 13 nt, Bordetella pertussis
ucaacgggccgcu

SEQ ID NO: 2403007 - RNA, 11 nt, Bordetella pertussis
ucaacguggcg

SEQ ID NO: 2403008 - RNA, 22 nt, Bordetella pertussis
ucaacuacacggugggcgacgc

SEQ ID NO: 2403009 - RNA, 23 nt, Bordetella pertussis
ucaacuggccggccuggcgcgca

SEQ ID NO: 2403010 - RNA, 16 nt, Bordetella pertussis
ucaagccagcggcgcg

SEQ ID NO: 2403011 - RNA, 17 nt, Bordetella pertussis
ucaagccagcggcgcgg

SEQ ID NO: 2403012 - RNA, 23 nt, Bordetella pertussis
ucaagccagcggcgcggcgcgcu

SEQ ID NO: 2403013 - RNA, 17 nt, Bordetella pertussis
ucaaggcaagaaucgac

SEQ ID NO: 2403014 - RNA, 20 nt, Bordetella pertussis
ucaaggccugcccgggcacc

SEQ ID NO: 2403015 - RNA, 14 nt, Bordetella pertussis
ucaaggcgcggccg

SEQ ID NO: 2403016 - RNA, 20 nt, Bordetella pertussis
ucaaggggcuguaccuggcg

SEQ ID NO: 2403017 - RNA, 21 nt, Bordetella pertussis
ucaaggggcuguaccuggcga

SEQ ID NO: 2403018 - RNA, 20 nt, Bordetella pertussis
ucaagggguggcuguccccg

SEQ ID NO: 2403019 - RNA, 13 nt, Bordetella pertussis
ucaaguccggcgc

SEQ ID NO: 2403020 - RNA, 16 nt, Bordetella pertussis
ucaauacgaaaaccag

SEQ ID NO: 2403021 - RNA, 15 nt, Bordetella pertussis
ucaauccgccgccag

SEQ ID NO: 2403022 - RNA, 24 nt, Bordetella pertussis
ucaaucuucgucuucgaccagguc

SEQ ID NO: 2403023 - RNA, 17 nt, Bordetella pertussis
ucaaugacauggccacg

SEQ ID NO: 2403024 - RNA, 16 nt, Bordetella pertussis
ucaaugcggcggcgcu

SEQ ID NO: 2403025 - RNA, 20 nt, Bordetella pertussis
ucaaugcggcggcgcuggcc

SEQ ID NO: 2403026 - RNA, 17 nt, Bordetella pertussis
ucaauguauuuggcggc

SEQ ID NO: 2403027 - RNA, 19 nt, Bordetella pertussis
ucaauguauuuggcggcuu

SEQ ID NO: 2403028 - RNA, 17 nt, Bordetella pertussis
ucacaggcccgcgcggc

SEQ ID NO: 2403029 - RNA, 17 nt, Bordetella pertussis
ucacagggucaaggcgc

SEQ ID NO: 2403030 - RNA, 20 nt, Bordetella pertussis
ucacauaggccggcaccccg

SEQ ID NO: 2403031 - RNA, 20 nt, Bordetella pertussis
ucacaugucacacgaagaac

SEQ ID NO: 2403032 - RNA, 19 nt, Bordetella pertussis
ucaccacccgcacgccggc

SEQ ID NO: 2403033 - RNA, 14 nt, Bordetella pertussis
ucaccaccggcaag

SEQ ID NO: 2403034 - RNA, 16 nt, Bordetella pertussis
ucaccaccggcaaggc

SEQ ID NO: 2403035 - RNA, 12 nt, Bordetella pertussis
ucaccacgcccg

SEQ ID NO: 2403036 - RNA, 20 nt, Bordetella pertussis
ucaccacgccuucgagcacc

SEQ ID NO: 2403037 - RNA, 19 nt, Bordetella pertussis
ucaccagcagguggcgcug

SEQ ID NO: 2403038 - RNA, 18 nt, Bordetella pertussis
ucaccagcucgcggcccu

SEQ ID NO: 2403039 - RNA, 20 nt, Bordetella pertussis
ucaccagcucgcggcccugg

SEQ ID NO: 2403040 - RNA, 19 nt, Bordetella pertussis
ucaccaggguggcgggcgc

SEQ ID NO: 2403041 - RNA, 15 nt, Bordetella pertussis
ucacccacagcagcg

SEQ ID NO: 2403042 - RNA, 18 nt, Bordetella pertussis
ucacccacagcagcgcgc

SEQ ID NO: 2403043 - RNA, 19 nt, Bordetella pertussis
ucacccacagcagcgcgcc

SEQ ID NO: 2403044 - RNA, 21 nt, Bordetella pertussis
ucacccaggguguagaccugc

SEQ ID NO: 2403045 - RNA, 20 nt, Bordetella pertussis
ucaccccgcccggcggcgcg

SEQ ID NO: 2403046 - RNA, 16 nt, Bordetella pertussis
ucaccccugcgcugca

SEQ ID NO: 2403047 - RNA, 22 nt, Bordetella pertussis
ucacccuggaugccaugccggg

SEQ ID NO: 2403048 - RNA, 14 nt, Bordetella pertussis
ucaccgaacuguca

SEQ ID NO: 2403049 - RNA, 19 nt, Bordetella pertussis
ucaccgacgccagcaugau

SEQ ID NO: 2403050 - RNA, 15 nt, Bordetella pertussis
ucaccgacuucaccg

SEQ ID NO: 2403051 - RNA, 19 nt, Bordetella pertussis
ucaccgagcugagcaccag

SEQ ID NO: 2403052 - RNA, 15 nt, Bordetella pertussis
ucaccgaggcgcugc

SEQ ID NO: 2403053 - RNA, 22 nt, Bordetella pertussis
ucaccgccauggcggccgccgc

SEQ ID NO: 2403054 - RNA, 15 nt, Bordetella pertussis
ucaccgccccgaccc

SEQ ID NO: 2403055 - RNA, 12 nt, Bordetella pertussis
ucaccgccgccc

SEQ ID NO: 2403056 - RNA, 17 nt, Bordetella pertussis
ucaccgccgccgcgccg

SEQ ID NO: 2403057 - RNA, 17 nt, Bordetella pertussis
ucaccgccgcgaccggg

SEQ ID NO: 2403058 - RNA, 14 nt, Bordetella pertussis
ucaccgccgcgccg

SEQ ID NO: 2403059 - RNA, 14 nt, Bordetella pertussis
ucaccgccggcggc

SEQ ID NO: 2403060 - RNA, 15 nt, Bordetella pertussis
ucaccgcgccgggcg

SEQ ID NO: 2403061 - RNA, 14 nt, Bordetella pertussis
ucaccggccccauc

SEQ ID NO: 2403062 - RNA, 18 nt, Bordetella pertussis
ucaccggccccaucaugu

SEQ ID NO: 2403063 - RNA, 17 nt, Bordetella pertussis
ucaccguuuggccugcc

SEQ ID NO: 2403064 - RNA, 13 nt, Bordetella pertussis
ucaccucgaucgc

SEQ ID NO: 2403065 - RNA, 21 nt, Bordetella pertussis
ucaccuuuccgaucagcugcg

SEQ ID NO: 2403066 - RNA, 18 nt, Bordetella pertussis
ucacgaaagcgcccaggc

SEQ ID NO: 2403067 - RNA, 15 nt, Bordetella pertussis
ucacgaacagcgcca

SEQ ID NO: 2403068 - RNA, 12 nt, Bordetella pertussis
ucacgagcaggu

SEQ ID NO: 2403069 - RNA, 22 nt, Bordetella pertussis
ucacgaucuggcaaucggggug

SEQ ID NO: 2403070 - RNA, 22 nt, Bordetella pertussis
ucacgaugcgaucgucgcugcg

SEQ ID NO: 2403071 - RNA, 22 nt, Bordetella pertussis
ucacgcccagucccaggccgac

SEQ ID NO: 2403072 - RNA, 17 nt, Bordetella pertussis
ucacgccccgcacgauc

SEQ ID NO: 2403073 - RNA, 20 nt, Bordetella pertussis
ucacgccccgcacgaucagc

SEQ ID NO: 2403074 - RNA, 20 nt, Bordetella pertussis
ucacgcccgagauggcgcag

SEQ ID NO: 2403075 - RNA, 19 nt, Bordetella pertussis
ucacgccgaugaccagggc

SEQ ID NO: 2403076 - RNA, 22 nt, Bordetella pertussis
ucacgccgaugaccagggcgcc

SEQ ID NO: 2403077 - RNA, 16 nt, Bordetella pertussis
ucacgccggcgcgccg

SEQ ID NO: 2403078 - RNA, 20 nt, Bordetella pertussis
ucacgccggcgcgccgggcc

SEQ ID NO: 2403079 - RNA, 15 nt, Bordetella pertussis
ucacgccgguguucu

SEQ ID NO: 2403080 - RNA, 21 nt, Bordetella pertussis
ucacgccgguguucucgcugg

SEQ ID NO: 2403081 - RNA, 18 nt, Bordetella pertussis
ucacgcgcaagccgcugg

SEQ ID NO: 2403082 - RNA, 15 nt, Bordetella pertussis
ucacgcgcaaggcgg

SEQ ID NO: 2403083 - RNA, 19 nt, Bordetella pertussis
ucacgcgcaaggcgggcug

SEQ ID NO: 2403084 - RNA, 19 nt, Bordetella pertussis
ucacgcgcuccggcugcgc

SEQ ID NO: 2403085 - RNA, 15 nt, Bordetella pertussis
ucacgcuggccgcgc

SEQ ID NO: 2403086 - RNA, 16 nt, Bordetella pertussis
ucacgcuggccgcgcc

SEQ ID NO: 2403087 - RNA, 20 nt, Bordetella pertussis
ucacgcuguucuucggcaac

SEQ ID NO: 2403088 - RNA, 16 nt, Bordetella pertussis
ucacggcaagacggcg

SEQ ID NO: 2403089 - RNA, 22 nt, Bordetella pertussis
ucacggcaagacggcgcucggc

SEQ ID NO: 2403090 - RNA, 13 nt, Bordetella pertussis
ucacggcgcgcgc

SEQ ID NO: 2403091 - RNA, 13 nt, Bordetella pertussis
ucacgggcgccag

SEQ ID NO: 2403092 - RNA, 15 nt, Bordetella pertussis
ucacgggcgccagca

SEQ ID NO: 2403093 - RNA, 17 nt, Bordetella pertussis
ucacgggcgccagcagc

SEQ ID NO: 2403094 - RNA, 19 nt, Bordetella pertussis
ucacgggcuguucgcgcag

SEQ ID NO: 2403095 - RNA, 23 nt, Bordetella pertussis
ucacgggcuguucgcgcagcagg

SEQ ID NO: 2403096 - RNA, 17 nt, Bordetella pertussis
ucacggucuggcccacg

SEQ ID NO: 2403097 - RNA, 19 nt, Bordetella pertussis
ucacugccgaaacgcuggc

SEQ ID NO: 2403098 - RNA, 21 nt, Bordetella pertussis
ucacuuucccauccuggccga

SEQ ID NO: 2403099 - RNA, 13 nt, Bordetella pertussis
ucagaaaggcagc

SEQ ID NO: 2403100 - RNA, 13 nt, Bordetella pertussis
ucagacugcugcc

SEQ ID NO: 2403101 - RNA, 17 nt, Bordetella pertussis
ucagcaagggccccagc

SEQ ID NO: 2403102 - RNA, 18 nt, Bordetella pertussis
ucagcacaucgcccggca

SEQ ID NO: 2403103 - RNA, 22 nt, Bordetella pertussis
ucagcaccacggcggccaggcc

SEQ ID NO: 2403104 - RNA, 14 nt, Bordetella pertussis
ucagcaccagcucc

SEQ ID NO: 2403105 - RNA, 19 nt, Bordetella pertussis
ucagcaccaggccgccggc

SEQ ID NO: 2403106 - RNA, 13 nt, Bordetella pertussis
ucagcaccgcgac

SEQ ID NO: 2403107 - RNA, 13 nt, Bordetella pertussis
ucagcaccgcggc

SEQ ID NO: 2403108 - RNA, 19 nt, Bordetella pertussis
ucagcaccucggcgcccag

SEQ ID NO: 2403109 - RNA, 19 nt, Bordetella pertussis
ucagcacgaucuggcgcgc

SEQ ID NO: 2403110 - RNA, 24 nt, Bordetella pertussis
ucagcacgaucuggcgcgcgacca

SEQ ID NO: 2403111 - RNA, 12 nt, Bordetella pertussis
ucagcacgcccu

SEQ ID NO: 2403112 - RNA, 13 nt, Bordetella pertussis
ucagcacgcucag

SEQ ID NO: 2403113 - RNA, 15 nt, Bordetella pertussis
ucagcacggucggcg

SEQ ID NO: 2403114 - RNA, 22 nt, Bordetella pertussis
ucagcacuugccggccgcccag

SEQ ID NO: 2403115 - RNA, 19 nt, Bordetella pertussis
ucagcagacccuggcgcgc

SEQ ID NO: 2403116 - RNA, 14 nt, Bordetella pertussis
ucagcagcaccuuc

SEQ ID NO: 2403117 - RNA, 14 nt, Bordetella pertussis
ucagcagcaggccc

SEQ ID NO: 2403118 - RNA, 16 nt, Bordetella pertussis
ucagcagcgccagggc

SEQ ID NO: 2403119 - RNA, 12 nt, Bordetella pertussis
ucagcagcgcgg

SEQ ID NO: 2403120 - RNA, 21 nt, Bordetella pertussis
ucagcaggcccaccagggacc

SEQ ID NO: 2403121 - RNA, 18 nt, Bordetella pertussis
ucagcagggcgccgacga

SEQ ID NO: 2403122 - RNA, 19 nt, Bordetella pertussis
ucagcagggucgagaccag

SEQ ID NO: 2403123 - RNA, 14 nt, Bordetella pertussis
ucagcaggucggcg

SEQ ID NO: 2403124 - RNA, 15 nt, Bordetella pertussis
ucagcaggucggcgc

SEQ ID NO: 2403125 - RNA, 17 nt, Bordetella pertussis
ucagcaggucggcgcgg

SEQ ID NO: 2403126 - RNA, 21 nt, Bordetella pertussis
ucagcaugaagcgguggcggc

SEQ ID NO: 2403127 - RNA, 23 nt, Bordetella pertussis
ucagcauuucgcaaagaagcugc

SEQ ID NO: 2403128 - RNA, 21 nt, Bordetella pertussis
ucagccacacgaucagcgccc

SEQ ID NO: 2403129 - RNA, 18 nt, Bordetella pertussis
ucagccacgugaagcgcc

SEQ ID NO: 2403130 - RNA, 13 nt, Bordetella pertussis
ucagccagccggc

SEQ ID NO: 2403131 - RNA, 16 nt, Bordetella pertussis
ucagccagccggcggc

SEQ ID NO: 2403132 - RNA, 14 nt, Bordetella pertussis
ucagccaucaucau

SEQ ID NO: 2403133 - RNA, 17 nt, Bordetella pertussis
ucagccaucaucaucgu

SEQ ID NO: 2403134 - RNA, 11 nt, Bordetella pertussis
ucagcccaggc

SEQ ID NO: 2403135 - RNA, 19 nt, Bordetella pertussis
ucagcccaggcgggcgugc

SEQ ID NO: 2403136 - RNA, 20 nt, Bordetella pertussis
ucagccccccguaggcggcc

SEQ ID NO: 2403137 - RNA, 14 nt, Bordetella pertussis
ucagcccgccuggc

SEQ ID NO: 2403138 - RNA, 19 nt, Bordetella pertussis
ucagcccgccuggcgccgc

SEQ ID NO: 2403139 - RNA, 21 nt, Bordetella pertussis
ucagcccgccuggcgccgcgc

SEQ ID NO: 2403140 - RNA, 22 nt, Bordetella pertussis
ucagcccgccuggcgccgcgcc

SEQ ID NO: 2403141 - RNA, 11 nt, Bordetella pertussis
ucagcccgcgu

SEQ ID NO: 2403142 - RNA, 19 nt, Bordetella pertussis
ucagcccgcguucaggcgc

SEQ ID NO: 2403143 - RNA, 15 nt, Bordetella pertussis
ucagcccggcgacgu

SEQ ID NO: 2403144 - RNA, 19 nt, Bordetella pertussis
ucagccgcaagcuggcggc

SEQ ID NO: 2403145 - RNA, 16 nt, Bordetella pertussis
ucagccgcccgccggg

SEQ ID NO: 2403146 - RNA, 23 nt, Bordetella pertussis
ucagccgcgcgcggccggcgcgc

SEQ ID NO: 2403147 - RNA, 16 nt, Bordetella pertussis
ucagccgcugcagcac

SEQ ID NO: 2403148 - RNA, 18 nt, Bordetella pertussis
ucagccgcugcagcacgc

SEQ ID NO: 2403149 - RNA, 19 nt, Bordetella pertussis
ucagccgcugcagcacgca

SEQ ID NO: 2403150 - RNA, 17 nt, Bordetella pertussis
ucagccgcuuggccugc

SEQ ID NO: 2403151 - RNA, 19 nt, Bordetella pertussis
ucagccgcuuggccugcgc

SEQ ID NO: 2403152 - RNA, 21 nt, Bordetella pertussis
ucagccgcuuggccugcgcca

SEQ ID NO: 2403153 - RNA, 18 nt, Bordetella pertussis
ucagccggccauggcccu

SEQ ID NO: 2403154 - RNA, 14 nt, Bordetella pertussis
ucagccggugccag

SEQ ID NO: 2403155 - RNA, 14 nt, Bordetella pertussis
ucagccgugccgcg

SEQ ID NO: 2403156 - RNA, 17 nt, Bordetella pertussis
ucagccgugccgcgcgc

SEQ ID NO: 2403157 - RNA, 14 nt, Bordetella pertussis
ucagccgugucgcc

SEQ ID NO: 2403158 - RNA, 15 nt, Bordetella pertussis
ucagccgugucgccc

SEQ ID NO: 2403159 - RNA, 20 nt, Bordetella pertussis
ucagccucgagguggcgcau

SEQ ID NO: 2403160 - RNA, 18 nt, Bordetella pertussis
ucagccugauucccaggc

SEQ ID NO: 2403161 - RNA, 19 nt, Bordetella pertussis
ucagccugauucccaggcc

SEQ ID NO: 2403162 - RNA, 23 nt, Bordetella pertussis
ucagccugauucccaggcccggc

SEQ ID NO: 2403163 - RNA, 21 nt, Bordetella pertussis
ucagccugccggcgcgcccag

SEQ ID NO: 2403164 - RNA, 15 nt, Bordetella pertussis
ucagccugcuggugc

SEQ ID NO: 2403165 - RNA, 16 nt, Bordetella pertussis
ucagccugggcgccug

SEQ ID NO: 2403166 - RNA, 22 nt, Bordetella pertussis
ucagccugggcgccuggcugca

SEQ ID NO: 2403167 - RNA, 14 nt, Bordetella pertussis
ucagccuggggcag

SEQ ID NO: 2403168 - RNA, 23 nt, Bordetella pertussis
ucagccugguagaguacugcguu

SEQ ID NO: 2403169 - RNA, 17 nt, Bordetella pertussis
ucagccuugucgcgggc

SEQ ID NO: 2403170 - RNA, 21 nt, Bordetella pertussis
ucagcgaaugcgacagcgaca

SEQ ID NO: 2403171 - RNA, 22 nt, Bordetella pertussis
ucagcgaaugcgacagcgacag

SEQ ID NO: 2403172 - RNA, 15 nt, Bordetella pertussis
ucagcgacagcaggg

SEQ ID NO: 2403173 - RNA, 20 nt, Bordetella pertussis
ucagcgacgcgcgccggcgc

SEQ ID NO: 2403174 - RNA, 17 nt, Bordetella pertussis
ucagcgcaggcugaucc

SEQ ID NO: 2403175 - RNA, 14 nt, Bordetella pertussis
ucagcgccaucauc

SEQ ID NO: 2403176 - RNA, 21 nt, Bordetella pertussis
ucagcgccaucaucgcgaucc

SEQ ID NO: 2403177 - RNA, 13 nt, Bordetella pertussis
ucagcgccgacga

SEQ ID NO: 2403178 - RNA, 15 nt, Bordetella pertussis
ucagcgccgagcgcc

SEQ ID NO: 2403179 - RNA, 16 nt, Bordetella pertussis
ucagcgccugcagguc

SEQ ID NO: 2403180 - RNA, 20 nt, Bordetella pertussis
ucagcgccuugccgccgugc

SEQ ID NO: 2403181 - RNA, 22 nt, Bordetella pertussis
ucagcgcgccgcgccgggcgcg

SEQ ID NO: 2403182 - RNA, 23 nt, Bordetella pertussis
ucagcgcgccgcgccgggcgcgc

SEQ ID NO: 2403183 - RNA, 15 nt, Bordetella pertussis
ucagcgcgcgcagcc

SEQ ID NO: 2403184 - RNA, 19 nt, Bordetella pertussis
ucagcgcggcgcacagggc

SEQ ID NO: 2403185 - RNA, 23 nt, Bordetella pertussis
ucagcgcggcgcacagggcgucg

SEQ ID NO: 2403186 - RNA, 17 nt, Bordetella pertussis
ucagcgcggcgccggcc

SEQ ID NO: 2403187 - RNA, 16 nt, Bordetella pertussis
ucagcgcggcgcggcc

SEQ ID NO: 2403188 - RNA, 23 nt, Bordetella pertussis
ucagcgcggcgcggccagcagcg

SEQ ID NO: 2403189 - RNA, 19 nt, Bordetella pertussis
ucagcgcgucacgcugaac

SEQ ID NO: 2403190 - RNA, 17 nt, Bordetella pertussis
ucagcggauugaccagc

SEQ ID NO: 2403191 - RNA, 19 nt, Bordetella pertussis
ucagcggauugaccagcgc

SEQ ID NO: 2403192 - RNA, 23 nt, Bordetella pertussis
ucagcggauugaccagcgcggcc

SEQ ID NO: 2403193 - RNA, 13 nt, Bordetella pertussis
ucagcggcagcac

SEQ ID NO: 2403194 - RNA, 23 nt, Bordetella pertussis
ucagcggcagcacgauggcgccc

SEQ ID NO: 2403195 - RNA, 15 nt, Bordetella pertussis
ucagcggccgcugcc

SEQ ID NO: 2403196 - RNA, 20 nt, Bordetella pertussis
ucagcggccgcugccgcgcg

SEQ ID NO: 2403197 - RNA, 12 nt, Bordetella pertussis
ucagcggcgcgc

SEQ ID NO: 2403198 - RNA, 14 nt, Bordetella pertussis
ucagcgggccggca

SEQ ID NO: 2403199 - RNA, 17 nt, Bordetella pertussis
ucagcgggccggcacca

SEQ ID NO: 2403200 - RNA, 16 nt, Bordetella pertussis
ucagcgugccgccggc

SEQ ID NO: 2403201 - RNA, 19 nt, Bordetella pertussis
ucagcguuuccagggcgcg

SEQ ID NO: 2403202 - RNA, 16 nt, Bordetella pertussis
ucagcugcuguuggcc

SEQ ID NO: 2403203 - RNA, 22 nt, Bordetella pertussis
ucagcuggaacgcgccgcuggc

SEQ ID NO: 2403204 - RNA, 16 nt, Bordetella pertussis
ucagcuucagccuggg

SEQ ID NO: 2403205 - RNA, 17 nt, Bordetella pertussis
ucagcuucagccugggc

SEQ ID NO: 2403206 - RNA, 18 nt, Bordetella pertussis
ucagcuucagccugggcc

SEQ ID NO: 2403207 - RNA, 19 nt, Bordetella pertussis
ucagcuucagccugggccu

SEQ ID NO: 2403208 - RNA, 12 nt, Bordetella pertussis
ucagcuuccaga

SEQ ID NO: 2403209 - RNA, 17 nt, Bordetella pertussis
ucagcuuccagguacag

SEQ ID NO: 2403210 - RNA, 23 nt, Bordetella pertussis
ucagcuucuggaucaccgccggc

SEQ ID NO: 2403211 - RNA, 16 nt, Bordetella pertussis
ucagcuugccgcccag

SEQ ID NO: 2403212 - RNA, 16 nt, Bordetella pertussis
ucagcuuggccaccac

SEQ ID NO: 2403213 - RNA, 21 nt, Bordetella pertussis
ucagcuuggccaccacgccca

SEQ ID NO: 2403214 - RNA, 22 nt, Bordetella pertussis
ucagcuugggcuugauggccag

SEQ ID NO: 2403215 - RNA, 18 nt, Bordetella pertussis
ucagcuuggucacggccu

SEQ ID NO: 2403216 - RNA, 21 nt, Bordetella pertussis
ucaggaaaaucgauacgccgg

SEQ ID NO: 2403217 - RNA, 20 nt, Bordetella pertussis
ucaggaacauguccaccagc

SEQ ID NO: 2403218 - RNA, 18 nt, Bordetella pertussis
ucaggaagucggucagcu

SEQ ID NO: 2403219 - RNA, 15 nt, Bordetella pertussis
ucaggaugccgccuu

SEQ ID NO: 2403220 - RNA, 16 nt, Bordetella pertussis
ucaggaugggcgcggc

SEQ ID NO: 2403221 - RNA, 20 nt, Bordetella pertussis
ucaggaugggcgcggcgcgc

SEQ ID NO: 2403222 - RNA, 22 nt, Bordetella pertussis
ucaggcccacgaugcgggcauc

SEQ ID NO: 2403223 - RNA, 14 nt, Bordetella pertussis
ucaggcccacgccg

SEQ ID NO: 2403224 - RNA, 20 nt, Bordetella pertussis
ucaggcccacgccgccgaag

SEQ ID NO: 2403225 - RNA, 16 nt, Bordetella pertussis
ucaggccccggccggu

SEQ ID NO: 2403226 - RNA, 16 nt, Bordetella pertussis
ucaggcccgcggcgcc

SEQ ID NO: 2403227 - RNA, 15 nt, Bordetella pertussis
ucaggcccuggggcc

SEQ ID NO: 2403228 - RNA, 17 nt, Bordetella pertussis
ucaggcccuggggccgc

SEQ ID NO: 2403229 - RNA, 18 nt, Bordetella pertussis
ucaggccgccccaacggc

SEQ ID NO: 2403230 - RNA, 17 nt, Bordetella pertussis
ucaggccgccggcgcgg

SEQ ID NO: 2403231 - RNA, 16 nt, Bordetella pertussis
ucaggccggcccgccc

SEQ ID NO: 2403232 - RNA, 13 nt, Bordetella pertussis
ucaggccggcgau

SEQ ID NO: 2403233 - RNA, 15 nt, Bordetella pertussis
ucaggccggcgccug

SEQ ID NO: 2403234 - RNA, 22 nt, Bordetella pertussis
ucaggccggcgccuggggcggg

SEQ ID NO: 2403235 - RNA, 18 nt, Bordetella pertussis
ucaggccguuggcgcgcc

SEQ ID NO: 2403236 - RNA, 20 nt, Bordetella pertussis
ucaggccguuggcgcgccuu

SEQ ID NO: 2403237 - RNA, 14 nt, Bordetella pertussis
ucaggccucgaaga

SEQ ID NO: 2403238 - RNA, 12 nt, Bordetella pertussis
ucaggccugcac

SEQ ID NO: 2403239 - RNA, 15 nt, Bordetella pertussis
ucaggccugcggcgc

SEQ ID NO: 2403240 - RNA, 16 nt, Bordetella pertussis
ucaggccugcggcgcc

SEQ ID NO: 2403241 - RNA, 18 nt, Bordetella pertussis
ucaggccugcggcgccag

SEQ ID NO: 2403242 - RNA, 16 nt, Bordetella pertussis
ucaggcgagcggcguc

SEQ ID NO: 2403243 - RNA, 20 nt, Bordetella pertussis
ucaggcgauccugcccaccg

SEQ ID NO: 2403244 - RNA, 20 nt, Bordetella pertussis
ucaggcgcgcggcagggcgu

SEQ ID NO: 2403245 - RNA, 22 nt, Bordetella pertussis
ucaggcgcgcggcagggcgucg

SEQ ID NO: 2403246 - RNA, 22 nt, Bordetella pertussis
ucaggcgcggauugaugucgcg

SEQ ID NO: 2403247 - RNA, 17 nt, Bordetella pertussis
ucaggcgcucgaucgga

SEQ ID NO: 2403248 - RNA, 18 nt, Bordetella pertussis
ucaggcgcucgaucggau

SEQ ID NO: 2403249 - RNA, 13 nt, Bordetella pertussis
ucaggcggccagg

SEQ ID NO: 2403250 - RNA, 16 nt, Bordetella pertussis
ucaggcggccagggcc

SEQ ID NO: 2403251 - RNA, 15 nt, Bordetella pertussis
ucaggcggcgcggcg

SEQ ID NO: 2403252 - RNA, 20 nt, Bordetella pertussis
ucaggcggcugcccaccuug

SEQ ID NO: 2403253 - RNA, 22 nt, Bordetella pertussis
ucaggcuccaguggugcuccca

SEQ ID NO: 2403254 - RNA, 13 nt, Bordetella pertussis
ucaggcuugcagc

SEQ ID NO: 2403255 - RNA, 18 nt, Bordetella pertussis
ucagggaggcuguccccg

SEQ ID NO: 2403256 - RNA, 14 nt, Bordetella pertussis
ucagggccacggcg

SEQ ID NO: 2403257 - RNA, 19 nt, Bordetella pertussis
ucagggccgcagcaccuug

SEQ ID NO: 2403258 - RNA, 21 nt, Bordetella pertussis
ucagggccgccagggcggcug

SEQ ID NO: 2403259 - RNA, 22 nt, Bordetella pertussis
ucagggcgaucuugccggccug

SEQ ID NO: 2403260 - RNA, 17 nt, Bordetella pertussis
ucagggcgaugccgcag

SEQ ID NO: 2403261 - RNA, 15 nt, Bordetella pertussis
ucagggcgccgcggc

SEQ ID NO: 2403262 - RNA, 16 nt, Bordetella pertussis
ucagggcgccggcgua

SEQ ID NO: 2403263 - RNA, 20 nt, Bordetella pertussis
ucaggggcucggccaggugc

SEQ ID NO: 2403264 - RNA, 15 nt, Bordetella pertussis
ucagggggcgcccca

SEQ ID NO: 2403265 - RNA, 22 nt, Bordetella pertussis
ucaggguacggcgaugccggcg

SEQ ID NO: 2403266 - RNA, 23 nt, Bordetella pertussis
ucaggguggagaauucggcgcgu

SEQ ID NO: 2403267 - RNA, 15 nt, Bordetella pertussis
ucaggguggccgcga

SEQ ID NO: 2403268 - RNA, 16 nt, Bordetella pertussis
ucagggugggcacgcg

SEQ ID NO: 2403269 - RNA, 19 nt, Bordetella pertussis
ucagguagguggacacgcc

SEQ ID NO: 2403270 - RNA, 15 nt, Bordetella pertussis
ucagguccaugaacg

SEQ ID NO: 2403271 - RNA, 14 nt, Bordetella pertussis
ucaggucgaugccg

SEQ ID NO: 2403272 - RNA, 21 nt, Bordetella pertussis
ucaggucgccguucuggcugc

SEQ ID NO: 2403273 - RNA, 15 nt, Bordetella pertussis
ucaggucgcugccca

SEQ ID NO: 2403274 - RNA, 18 nt, Bordetella pertussis
ucaggucgcugcccagca

SEQ ID NO: 2403275 - RNA, 16 nt, Bordetella pertussis
ucaggugaaacagcag

SEQ ID NO: 2403276 - RNA, 21 nt, Bordetella pertussis
ucaggugaaacagcagcgggc

SEQ ID NO: 2403277 - RNA, 21 nt, Bordetella pertussis
ucaggugcaggguuggcgcgc

SEQ ID NO: 2403278 - RNA, 22 nt, Bordetella pertussis
ucaggugcaggguuggcgcgcc

SEQ ID NO: 2403279 - RNA, 21 nt, Bordetella pertussis
ucagguguucgcgcaccagcg

SEQ ID NO: 2403280 - RNA, 24 nt, Bordetella pertussis
ucagguguucgcgcaccagcggaa

SEQ ID NO: 2403281 - RNA, 14 nt, Bordetella pertussis
ucagguuagccagu

SEQ ID NO: 2403282 - RNA, 19 nt, Bordetella pertussis
ucagguuagcggcaguguc

SEQ ID NO: 2403283 - RNA, 19 nt, Bordetella pertussis
ucagguucaugaccaucgc

SEQ ID NO: 2403284 - RNA, 15 nt, Bordetella pertussis
ucagguugcgccggc

SEQ ID NO: 2403285 - RNA, 16 nt, Bordetella pertussis
ucagguugcgccggcu

SEQ ID NO: 2403286 - RNA, 17 nt, Bordetella pertussis
ucagguuugcgggugcc

SEQ ID NO: 2403287 - RNA, 20 nt, Bordetella pertussis
ucagguuugcgggugccagu

SEQ ID NO: 2403288 - RNA, 20 nt, Bordetella pertussis
ucaguaucucggcgcccgcg

SEQ ID NO: 2403289 - RNA, 19 nt, Bordetella pertussis
ucaguccgcccagccaggc

SEQ ID NO: 2403290 - RNA, 23 nt, Bordetella pertussis
ucaguccguaguugcgccccgcc

SEQ ID NO: 2403291 - RNA, 21 nt, Bordetella pertussis
ucaguccucaugcgggacagg

SEQ ID NO: 2403292 - RNA, 16 nt, Bordetella pertussis
ucagucggccuggcgc

SEQ ID NO: 2403293 - RNA, 16 nt, Bordetella pertussis
ucagucgggcagcgcc

SEQ ID NO: 2403294 - RNA, 16 nt, Bordetella pertussis
ucaguuccaggcggau

SEQ ID NO: 2403295 - RNA, 20 nt, Bordetella pertussis
ucaguugggcgcgcccagcc

SEQ ID NO: 2403296 - RNA, 22 nt, Bordetella pertussis
ucaguugggcgcgcccagcccc

SEQ ID NO: 2403297 - RNA, 23 nt, Bordetella pertussis
ucaguugggcgcgcccagccccg

SEQ ID NO: 2403298 - RNA, 23 nt, Bordetella pertussis
ucaguugguagagcagcucacuu

SEQ ID NO: 2403299 - RNA, 20 nt, Bordetella pertussis
ucauaccgaaggaccaaguc

SEQ ID NO: 2403300 - RNA, 14 nt, Bordetella pertussis
ucauacgacgcggc

SEQ ID NO: 2403301 - RNA, 17 nt, Bordetella pertussis
ucaucaaacgcggcgcc

SEQ ID NO: 2403302 - RNA, 20 nt, Bordetella pertussis
ucaucaaacgcggcgccgcc

SEQ ID NO: 2403303 - RNA, 17 nt, Bordetella pertussis
ucaucaccaagggcgcc

SEQ ID NO: 2403304 - RNA, 21 nt, Bordetella pertussis
ucaucacgggcgccagcagcg

SEQ ID NO: 2403305 - RNA, 14 nt, Bordetella pertussis
ucaucagcgcgcgc

SEQ ID NO: 2403306 - RNA, 18 nt, Bordetella pertussis
ucaucagguccacuucac

SEQ ID NO: 2403307 - RNA, 16 nt, Bordetella pertussis
ucaucaucgccgacgc

SEQ ID NO: 2403308 - RNA, 12 nt, Bordetella pertussis
ucaucaucgcgc

SEQ ID NO: 2403309 - RNA, 16 nt, Bordetella pertussis
ucaucaucgcgcuggc

SEQ ID NO: 2403310 - RNA, 11 nt, Bordetella pertussis
ucauccaggcc

SEQ ID NO: 2403311 - RNA, 16 nt, Bordetella pertussis
ucauccaggccgugag

SEQ ID NO: 2403312 - RNA, 14 nt, Bordetella pertussis
ucauccaggcgcgu

SEQ ID NO: 2403313 - RNA, 12 nt, Bordetella pertussis
ucauccgcgcau

SEQ ID NO: 2403314 - RNA, 15 nt, Bordetella pertussis
ucauccugggcgcgc

SEQ ID NO: 2403315 - RNA, 18 nt, Bordetella pertussis
ucauccuguucgugaucc

SEQ ID NO: 2403316 - RNA, 21 nt, Bordetella pertussis
ucaucgaugcgccgcaccagc

SEQ ID NO: 2403317 - RNA, 13 nt, Bordetella pertussis
ucaucgccgacgc

SEQ ID NO: 2403318 - RNA, 22 nt, Bordetella pertussis
ucaucgccgacgcgccgggcca

SEQ ID NO: 2403319 - RNA, 20 nt, Bordetella pertussis
ucaucggcaggccggcgcgc

SEQ ID NO: 2403320 - RNA, 16 nt, Bordetella pertussis
ucaucgggccggcggc

SEQ ID NO: 2403321 - RNA, 21 nt, Bordetella pertussis
ucaucgggccggcggcagccg

SEQ ID NO: 2403322 - RNA, 15 nt, Bordetella pertussis
ucaucgggugcggcg

SEQ ID NO: 2403323 - RNA, 18 nt, Bordetella pertussis
ucaucgggugcggcgccu

SEQ ID NO: 2403324 - RNA, 16 nt, Bordetella pertussis
ucaucgucggcgccau

SEQ ID NO: 2403325 - RNA, 15 nt, Bordetella pertussis
ucaucguggccgcgc

SEQ ID NO: 2403326 - RNA, 18 nt, Bordetella pertussis
ucaucguggccgcgcaag

SEQ ID NO: 2403327 - RNA, 23 nt, Bordetella pertussis
ucaucugggcgucgaaggcggcc

SEQ ID NO: 2403328 - RNA, 20 nt, Bordetella pertussis
ucaugaacgucaccccgccc

SEQ ID NO: 2403329 - RNA, 14 nt, Bordetella pertussis
ucaugaccagcggc

SEQ ID NO: 2403330 - RNA, 20 nt, Bordetella pertussis
ucaugacgggcggcggcgcg

SEQ ID NO: 2403331 - RNA, 18 nt, Bordetella pertussis
ucaugaggccccuguccu

SEQ ID NO: 2403332 - RNA, 17 nt, Bordetella pertussis
ucaugaugcgcugggcc

SEQ ID NO: 2403333 - RNA, 18 nt, Bordetella pertussis
ucaugaugucggccaggg

SEQ ID NO: 2403334 - RNA, 23 nt, Bordetella pertussis
ucaugccgaacagcauggcggcg

SEQ ID NO: 2403335 - RNA, 19 nt, Bordetella pertussis
ucaugccgcugcccagcgu

SEQ ID NO: 2403336 - RNA, 14 nt, Bordetella pertussis
ucaugcgcaccuug

SEQ ID NO: 2403337 - RNA, 17 nt, Bordetella pertussis
ucaugcgcugcacggug

SEQ ID NO: 2403338 - RNA, 16 nt, Bordetella pertussis
ucaugcgcugcuggcc

SEQ ID NO: 2403339 - RNA, 19 nt, Bordetella pertussis
ucaugcgcugcuggccaag

SEQ ID NO: 2403340 - RNA, 15 nt, Bordetella pertussis
ucaugcgggacaggc

SEQ ID NO: 2403341 - RNA, 18 nt, Bordetella pertussis
ucaugcgggacaggcgcc

SEQ ID NO: 2403342 - RNA, 17 nt, Bordetella pertussis
ucaugcguucggccagc

SEQ ID NO: 2403343 - RNA, 14 nt, Bordetella pertussis
ucaugcucuugcuc

SEQ ID NO: 2403344 - RNA, 18 nt, Bordetella pertussis
ucauggaaaaucugggau

SEQ ID NO: 2403345 - RNA, 12 nt, Bordetella pertussis
ucauggccaggg

SEQ ID NO: 2403346 - RNA, 15 nt, Bordetella pertussis
ucauggccgcgccca

SEQ ID NO: 2403347 - RNA, 16 nt, Bordetella pertussis
ucauggcgccgauggc

SEQ ID NO: 2403348 - RNA, 20 nt, Bordetella pertussis
ucauggcgcgcgccgcgcug

SEQ ID NO: 2403349 - RNA, 15 nt, Bordetella pertussis
ucauggcggcaggcg

SEQ ID NO: 2403350 - RNA, 22 nt, Bordetella pertussis
ucauggcguagagcagugugcc

SEQ ID NO: 2403351 - RNA, 14 nt, Bordetella pertussis
ucaugggccugggc

SEQ ID NO: 2403352 - RNA, 16 nt, Bordetella pertussis
ucaugggccugggcgc

SEQ ID NO: 2403353 - RNA, 14 nt, Bordetella pertussis
ucaugggcggggcc

SEQ ID NO: 2403354 - RNA, 22 nt, Bordetella pertussis
ucauguaaggcgcaugccacca

SEQ ID NO: 2403355 - RNA, 19 nt, Bordetella pertussis
ucaugucguccucggccac

SEQ ID NO: 2403356 - RNA, 17 nt, Bordetella pertussis
ucaugugcugcggcagc

SEQ ID NO: 2403357 - RNA, 13 nt, Bordetella pertussis
ucauucggcgcgc

SEQ ID NO: 2403358 - RNA, 14 nt, Bordetella pertussis
ucauuuccugguuc

SEQ ID NO: 2403359 - RNA, 22 nt, Bordetella pertussis
uccaaccugguauccggcgcac

SEQ ID NO: 2403360 - RNA, 19 nt, Bordetella pertussis
uccaagcagacccgcgccc

SEQ ID NO: 2403361 - RNA, 21 nt, Bordetella pertussis
uccaagcagacccgcgcccag

SEQ ID NO: 2403362 - RNA, 23 nt, Bordetella pertussis
uccaagcgcacgcgcagcacgcu

SEQ ID NO: 2403363 - RNA, 22 nt, Bordetella pertussis
uccacagccacugcggcccgag

SEQ ID NO: 2403364 - RNA, 14 nt, Bordetella pertussis
uccacagccaggcc

SEQ ID NO: 2403365 - RNA, 13 nt, Bordetella pertussis
uccacagcccggc

SEQ ID NO: 2403366 - RNA, 21 nt, Bordetella pertussis
uccacagcccggcccccagcc

SEQ ID NO: 2403367 - RNA, 15 nt, Bordetella pertussis
uccacagcgccgacc

SEQ ID NO: 2403368 - RNA, 19 nt, Bordetella pertussis
uccacagcgccgaccgcac

SEQ ID NO: 2403369 - RNA, 22 nt, Bordetella pertussis
uccacagguauucgggaugggc

SEQ ID NO: 2403370 - RNA, 19 nt, Bordetella pertussis
uccacagucggucgccgca

SEQ ID NO: 2403371 - RNA, 16 nt, Bordetella pertussis
uccacauccgcgcugc

SEQ ID NO: 2403372 - RNA, 11 nt, Bordetella pertussis
uccaccaaggg

SEQ ID NO: 2403373 - RNA, 14 nt, Bordetella pertussis
uccaccaccaggcc

SEQ ID NO: 2403374 - RNA, 15 nt, Bordetella pertussis
uccaccaccaggccg

SEQ ID NO: 2403375 - RNA, 16 nt, Bordetella pertussis
uccaccaccaggccgg

SEQ ID NO: 2403376 - RNA, 21 nt, Bordetella pertussis
uccaccaccaggccggccagg

SEQ ID NO: 2403377 - RNA, 14 nt, Bordetella pertussis
uccaccacccaggc

SEQ ID NO: 2403378 - RNA, 18 nt, Bordetella pertussis
uccaccacccaggcccag

SEQ ID NO: 2403379 - RNA, 20 nt, Bordetella pertussis
uccaccaccuucagggcgcc

SEQ ID NO: 2403380 - RNA, 17 nt, Bordetella pertussis
uccaccagccggccgcc

SEQ ID NO: 2403381 - RNA, 17 nt, Bordetella pertussis
uccaccaucagccagcc

SEQ ID NO: 2403382 - RNA, 20 nt, Bordetella pertussis
uccaccaucagccagccgcu

SEQ ID NO: 2403383 - RNA, 15 nt, Bordetella pertussis
uccacccccgggcgc

SEQ ID NO: 2403384 - RNA, 15 nt, Bordetella pertussis
uccaccucgaacgca

SEQ ID NO: 2403385 - RNA, 14 nt, Bordetella pertussis
uccaccuugacgcg

SEQ ID NO: 2403386 - RNA, 14 nt, Bordetella pertussis
uccacgaacgcgau

SEQ ID NO: 2403387 - RNA, 23 nt, Bordetella pertussis
uccacgaagcaggugaugcgcgc

SEQ ID NO: 2403388 - RNA, 18 nt, Bordetella pertussis
uccacgaaggcagcaccu

SEQ ID NO: 2403389 - RNA, 19 nt, Bordetella pertussis
uccacgaaggcagcaccuc

SEQ ID NO: 2403390 - RNA, 18 nt, Bordetella pertussis
uccacgaaggcgccgaaa

SEQ ID NO: 2403391 - RNA, 23 nt, Bordetella pertussis
uccacgaggucuugccgaucggc

SEQ ID NO: 2403392 - RNA, 16 nt, Bordetella pertussis
uccacgaugcccaugg

SEQ ID NO: 2403393 - RNA, 19 nt, Bordetella pertussis
uccacgcccagcgccggca

SEQ ID NO: 2403394 - RNA, 22 nt, Bordetella pertussis
uccacgcccagcgccggcacgc

SEQ ID NO: 2403395 - RNA, 18 nt, Bordetella pertussis
uccacgcccugcaccguc

SEQ ID NO: 2403396 - RNA, 20 nt, Bordetella pertussis
uccacgcccuggcuggcggc

SEQ ID NO: 2403397 - RNA, 15 nt, Bordetella pertussis
uccacgccgccggcc

SEQ ID NO: 2403398 - RNA, 20 nt, Bordetella pertussis
uccacgccgcgcgcgucgcc

SEQ ID NO: 2403399 - RNA, 21 nt, Bordetella pertussis
uccacgccgcgcgcgucgccg

SEQ ID NO: 2403400 - RNA, 18 nt, Bordetella pertussis
uccacgccuucggcgcgc

SEQ ID NO: 2403401 - RNA, 22 nt, Bordetella pertussis
uccacgccuucggcgcgcgccg

SEQ ID NO: 2403402 - RNA, 22 nt, Bordetella pertussis
uccacgcggccguggcggccug

SEQ ID NO: 2403403 - RNA, 21 nt, Bordetella pertussis
uccacgcggguggugcugcuc

SEQ ID NO: 2403404 - RNA, 18 nt, Bordetella pertussis
uccacggcauggccagcu

SEQ ID NO: 2403405 - RNA, 20 nt, Bordetella pertussis
uccacggccggcgcacgccg

SEQ ID NO: 2403406 - RNA, 14 nt, Bordetella pertussis
uccacggcggcggc

SEQ ID NO: 2403407 - RNA, 23 nt, Bordetella pertussis
uccacgucaguccguggcgcggc

SEQ ID NO: 2403408 - RNA, 20 nt, Bordetella pertussis
uccacgugcggcagggccuc

SEQ ID NO: 2403409 - RNA, 18 nt, Bordetella pertussis
uccacucggccagcgcgc

SEQ ID NO: 2403410 - RNA, 22 nt, Bordetella pertussis
uccagaacgcgccguaccccag

SEQ ID NO: 2403411 - RNA, 15 nt, Bordetella pertussis
uccagaacggcgcgg

SEQ ID NO: 2403412 - RNA, 15 nt, Bordetella pertussis
uccagaacggcuugg

SEQ ID NO: 2403413 - RNA, 22 nt, Bordetella pertussis
uccagaagauauugggggucag

SEQ ID NO: 2403414 - RNA, 23 nt, Bordetella pertussis
uccagacccgaaucucccggcgc

SEQ ID NO: 2403415 - RNA, 14 nt, Bordetella pertussis
uccagacgggcugg

SEQ ID NO: 2403416 - RNA, 21 nt, Bordetella pertussis
uccagagggaaaacagcgcgg

SEQ ID NO: 2403417 - RNA, 16 nt, Bordetella pertussis
uccagaugcgcagcag

SEQ ID NO: 2403418 - RNA, 17 nt, Bordetella pertussis
uccagcaaaugggccgc

SEQ ID NO: 2403419 - RNA, 18 nt, Bordetella pertussis
uccagcaccagggcgcgc

SEQ ID NO: 2403420 - RNA, 22 nt, Bordetella pertussis
uccagcaccagggcgcgcagca

SEQ ID NO: 2403421 - RNA, 23 nt, Bordetella pertussis
uccagcaccagggcgcgcagcag

SEQ ID NO: 2403422 - RNA, 16 nt, Bordetella pertussis
uccagcaccggcugcc

SEQ ID NO: 2403423 - RNA, 20 nt, Bordetella pertussis
uccagcaccggcugccaggg

SEQ ID NO: 2403424 - RNA, 15 nt, Bordetella pertussis
uccagcacgacgacg

SEQ ID NO: 2403425 - RNA, 19 nt, Bordetella pertussis
uccagcacgacgacggccg

SEQ ID NO: 2403426 - RNA, 21 nt, Bordetella pertussis
uccagcacgacgacggccggc

SEQ ID NO: 2403427 - RNA, 14 nt, Bordetella pertussis
uccagcacgcggcg

SEQ ID NO: 2403428 - RNA, 18 nt, Bordetella pertussis
uccagcacgcggcgcagc

SEQ ID NO: 2403429 - RNA, 19 nt, Bordetella pertussis
uccagcacgcggcgcagca

SEQ ID NO: 2403430 - RNA, 22 nt, Bordetella pertussis
uccagcacgcggcgcagcaucu

SEQ ID NO: 2403431 - RNA, 14 nt, Bordetella pertussis
uccagcacggccgc

SEQ ID NO: 2403432 - RNA, 16 nt, Bordetella pertussis
uccagcagaucgcggc

SEQ ID NO: 2403433 - RNA, 16 nt, Bordetella pertussis
uccagcagcagcgccg

SEQ ID NO: 2403434 - RNA, 21 nt, Bordetella pertussis
uccagcagcagcgccgcgccg

SEQ ID NO: 2403435 - RNA, 16 nt, Bordetella pertussis
uccagcagcguggcca

SEQ ID NO: 2403436 - RNA, 22 nt, Bordetella pertussis
uccagcagcguggccaccaggc

SEQ ID NO: 2403437 - RNA, 15 nt, Bordetella pertussis
uccagcaggauggcg

SEQ ID NO: 2403438 - RNA, 13 nt, Bordetella pertussis
uccagcagggacu

SEQ ID NO: 2403439 - RNA, 23 nt, Bordetella pertussis
uccagcagggacuugggcaggcc

SEQ ID NO: 2403440 - RNA, 18 nt, Bordetella pertussis
uccagcauguacagcggu

SEQ ID NO: 2403441 - RNA, 14 nt, Bordetella pertussis
uccagccaggccgc

SEQ ID NO: 2403442 - RNA, 14 nt, Bordetella pertussis
uccagccaggccuc

SEQ ID NO: 2403443 - RNA, 13 nt, Bordetella pertussis
uccagccaggcgc

SEQ ID NO: 2403444 - RNA, 20 nt, Bordetella pertussis
uccagccaguacaggcugcc

SEQ ID NO: 2403445 - RNA, 18 nt, Bordetella pertussis
uccagccauggaagcggc

SEQ ID NO: 2403446 - RNA, 20 nt, Bordetella pertussis
uccagccauggaagcggcag

SEQ ID NO: 2403447 - RNA, 13 nt, Bordetella pertussis
uccagccccugcc

SEQ ID NO: 2403448 - RNA, 18 nt, Bordetella pertussis
uccagccgaucagccggc

SEQ ID NO: 2403449 - RNA, 13 nt, Bordetella pertussis
uccagccgcaggc

SEQ ID NO: 2403450 - RNA, 13 nt, Bordetella pertussis
uccagccgcccgu

SEQ ID NO: 2403451 - RNA, 19 nt, Bordetella pertussis
uccagccguuggcgcccag

SEQ ID NO: 2403452 - RNA, 23 nt, Bordetella pertussis
uccagccguuggcgcccagcgcc

SEQ ID NO: 2403453 - RNA, 20 nt, Bordetella pertussis
uccagccugcccgggcagca

SEQ ID NO: 2403454 - RNA, 18 nt, Bordetella pertussis
uccagcgacuccggccgg

SEQ ID NO: 2403455 - RNA, 23 nt, Bordetella pertussis
uccagcgacuccggccgggccag

SEQ ID NO: 2403456 - RNA, 19 nt, Bordetella pertussis
uccagcgacucggucagca

SEQ ID NO: 2403457 - RNA, 17 nt, Bordetella pertussis
uccagcgccaccagcag

SEQ ID NO: 2403458 - RNA, 18 nt, Bordetella pertussis
uccagcgccaccagcagc

SEQ ID NO: 2403459 - RNA, 14 nt, Bordetella pertussis
uccagcgccagcac

SEQ ID NO: 2403460 - RNA, 17 nt, Bordetella pertussis
uccagcgccagcaccgg

SEQ ID NO: 2403461 - RNA, 19 nt, Bordetella pertussis
uccagcgcccgcggaaagc

SEQ ID NO: 2403462 - RNA, 23 nt, Bordetella pertussis
uccagcgccgccuucaccggccc

SEQ ID NO: 2403463 - RNA, 14 nt, Bordetella pertussis
uccagcgccggcag

SEQ ID NO: 2403464 - RNA, 15 nt, Bordetella pertussis
uccagcgccggcagc

SEQ ID NO: 2403465 - RNA, 12 nt, Bordetella pertussis
uccagcgccugg

SEQ ID NO: 2403466 - RNA, 17 nt, Bordetella pertussis
uccagcgccuggcgggc

SEQ ID NO: 2403467 - RNA, 22 nt, Bordetella pertussis
uccagcgccuggcgggccuggg

SEQ ID NO: 2403468 - RNA, 23 nt, Bordetella pertussis
uccagcgccugggguaggcgcgg

SEQ ID NO: 2403469 - RNA, 21 nt, Bordetella pertussis
uccagcgcgaaaugcccagcg

SEQ ID NO: 2403470 - RNA, 12 nt, Bordetella pertussis
uccagcgcgccc

SEQ ID NO: 2403471 - RNA, 16 nt, Bordetella pertussis
uccagcgcgcccagau

SEQ ID NO: 2403472 - RNA, 19 nt, Bordetella pertussis
uccagcgcgcccagcgcgc

SEQ ID NO: 2403473 - RNA, 21 nt, Bordetella pertussis
uccagcgcgcccgaggcgcgc

SEQ ID NO: 2403474 - RNA, 22 nt, Bordetella pertussis
uccagcgcgcccgaggcgcgca

SEQ ID NO: 2403475 - RNA, 23 nt, Bordetella pertussis
uccagcgcgcccgaggcgcgcag

SEQ ID NO: 2403476 - RNA, 23 nt, Bordetella pertussis
uccagcgcgccgaagcgcaggcc

SEQ ID NO: 2403477 - RNA, 21 nt, Bordetella pertussis
uccagcgcgcgaucgccagca

SEQ ID NO: 2403478 - RNA, 13 nt, Bordetella pertussis
uccagcgcgcggc

SEQ ID NO: 2403479 - RNA, 15 nt, Bordetella pertussis
uccagcgcgcggccu

SEQ ID NO: 2403480 - RNA, 16 nt, Bordetella pertussis
uccagcgcgcggccuc

SEQ ID NO: 2403481 - RNA, 15 nt, Bordetella pertussis
uccagcgcggcaugc

SEQ ID NO: 2403482 - RNA, 22 nt, Bordetella pertussis
uccagcgcggccacggccugcc

SEQ ID NO: 2403483 - RNA, 15 nt, Bordetella pertussis
uccagcgcggcgggc

SEQ ID NO: 2403484 - RNA, 21 nt, Bordetella pertussis
uccagcgcggcgggcggcgcg

SEQ ID NO: 2403485 - RNA, 23 nt, Bordetella pertussis
uccagcgcggcgggcggcgcggc

SEQ ID NO: 2403486 - RNA, 15 nt, Bordetella pertussis
uccagcgcguccagg

SEQ ID NO: 2403487 - RNA, 21 nt, Bordetella pertussis
uccagcgcguccaggugcggc

SEQ ID NO: 2403488 - RNA, 18 nt, Bordetella pertussis
uccagcgcuucgugcagc

SEQ ID NO: 2403489 - RNA, 22 nt, Bordetella pertussis
uccagcgcuucgugcagcgcgu

SEQ ID NO: 2403490 - RNA, 23 nt, Bordetella pertussis
uccagcggaaguauucgcgcggc

SEQ ID NO: 2403491 - RNA, 14 nt, Bordetella pertussis
uccagcggacgggc

SEQ ID NO: 2403492 - RNA, 19 nt, Bordetella pertussis
uccagcggacgggccaggc

SEQ ID NO: 2403493 - RNA, 20 nt, Bordetella pertussis
uccagcggacgggccaggcc

SEQ ID NO: 2403494 - RNA, 13 nt, Bordetella pertussis
uccagcggcagcg

SEQ ID NO: 2403495 - RNA, 12 nt, Bordetella pertussis
uccagcggcgcg

SEQ ID NO: 2403496 - RNA, 13 nt, Bordetella pertussis
uccagcggcgcga

SEQ ID NO: 2403497 - RNA, 18 nt, Bordetella pertussis
uccagcgucauggccugg

SEQ ID NO: 2403498 - RNA, 20 nt, Bordetella pertussis
uccagcgucauggccuggcc

SEQ ID NO: 2403499 - RNA, 23 nt, Bordetella pertussis
uccagcgucggcguaaggccgcc

SEQ ID NO: 2403500 - RNA, 19 nt, Bordetella pertussis
uccagcguggagcugcuca

SEQ ID NO: 2403501 - RNA, 14 nt, Bordetella pertussis
uccagcguggcgca

SEQ ID NO: 2403502 - RNA, 18 nt, Bordetella pertussis
uccagcgugucgaacacc

SEQ ID NO: 2403503 - RNA, 20 nt, Bordetella pertussis
uccagcgugucgaacaccag

SEQ ID NO: 2403504 - RNA, 15 nt, Bordetella pertussis
uccagcucagcagcg

SEQ ID NO: 2403505 - RNA, 17 nt, Bordetella pertussis
uccagcucagcagcgcc

SEQ ID NO: 2403506 - RNA, 20 nt, Bordetella pertussis
uccagcucagcagcgccagg

SEQ ID NO: 2403507 - RNA, 14 nt, Bordetella pertussis
uccagcuccagcgc

SEQ ID NO: 2403508 - RNA, 16 nt, Bordetella pertussis
uccagcuccagcgcgc

SEQ ID NO: 2403509 - RNA, 18 nt, Bordetella pertussis
uccagcuccagcgcgccg

SEQ ID NO: 2403510 - RNA, 15 nt, Bordetella pertussis
uccagcugcgaaagc

SEQ ID NO: 2403511 - RNA, 19 nt, Bordetella pertussis
uccagcugcgaaagcgcgu

SEQ ID NO: 2403512 - RNA, 23 nt, Bordetella pertussis
uccagcugcuucaguuccaggcg

SEQ ID NO: 2403513 - RNA, 20 nt, Bordetella pertussis
uccagcuggcccuggcagac

SEQ ID NO: 2403514 - RNA, 18 nt, Bordetella pertussis
uccagcuggcgcaccagg

SEQ ID NO: 2403515 - RNA, 21 nt, Bordetella pertussis
uccagcuggcgcaccaggcug

SEQ ID NO: 2403516 - RNA, 18 nt, Bordetella pertussis
uccaggaaagaggccagg

SEQ ID NO: 2403517 - RNA, 19 nt, Bordetella pertussis
uccaggaaagaggccaggc

SEQ ID NO: 2403518 - RNA, 20 nt, Bordetella pertussis
uccaggaaagaggccaggcc

SEQ ID NO: 2403519 - RNA, 22 nt, Bordetella pertussis
uccaggaaagaggccaggcccu

SEQ ID NO: 2403520 - RNA, 14 nt, Bordetella pertussis
uccaggaagcagcc

SEQ ID NO: 2403521 - RNA, 17 nt, Bordetella pertussis
uccaggaagcagcccag

SEQ ID NO: 2403522 - RNA, 22 nt, Bordetella pertussis
uccaggacgcgaagaucccgcc

SEQ ID NO: 2403523 - RNA, 20 nt, Bordetella pertussis
uccaggagcucguccccacg

SEQ ID NO: 2403524 - RNA, 16 nt, Bordetella pertussis
uccaggaugagcgccu

SEQ ID NO: 2403525 - RNA, 17 nt, Bordetella pertussis
uccaggaugagcgccug

SEQ ID NO: 2403526 - RNA, 14 nt, Bordetella pertussis
uccaggaugcgcga

SEQ ID NO: 2403527 - RNA, 19 nt, Bordetella pertussis
uccaggcauucccgcccag

SEQ ID NO: 2403528 - RNA, 23 nt, Bordetella pertussis
uccaggccaccgcggcggaccac

SEQ ID NO: 2403529 - RNA, 20 nt, Bordetella pertussis
uccaggcccgaaacgcgcag

SEQ ID NO: 2403530 - RNA, 14 nt, Bordetella pertussis
uccaggcccggcag

SEQ ID NO: 2403531 - RNA, 19 nt, Bordetella pertussis
uccaggccgaucagcgaca

SEQ ID NO: 2403532 - RNA, 14 nt, Bordetella pertussis
uccaggccggccug

SEQ ID NO: 2403533 - RNA, 17 nt, Bordetella pertussis
uccaggccggccugcaa

SEQ ID NO: 2403534 - RNA, 23 nt, Bordetella pertussis
uccaggccggccugcaaugcggc

SEQ ID NO: 2403535 - RNA, 17 nt, Bordetella pertussis
uccaggccggggccgcc

SEQ ID NO: 2403536 - RNA, 19 nt, Bordetella pertussis
uccaggccggggccgccca

SEQ ID NO: 2403537 - RNA, 21 nt, Bordetella pertussis
uccaggccgugagcgccgccg

SEQ ID NO: 2403538 - RNA, 15 nt, Bordetella pertussis
uccaggccugggaac

SEQ ID NO: 2403539 - RNA, 18 nt, Bordetella pertussis
uccaggcgccgcacgccg

SEQ ID NO: 2403540 - RNA, 19 nt, Bordetella pertussis
uccaggcgcgcaagguggc

SEQ ID NO: 2403541 - RNA, 13 nt, Bordetella pertussis
uccaggcggccag

SEQ ID NO: 2403542 - RNA, 14 nt, Bordetella pertussis
uccaggcggccauc

SEQ ID NO: 2403543 - RNA, 15 nt, Bordetella pertussis
uccaggcgguccugg

SEQ ID NO: 2403544 - RNA, 14 nt, Bordetella pertussis
uccaggcugccggc

SEQ ID NO: 2403545 - RNA, 15 nt, Bordetella pertussis
uccaggcugccggcg

SEQ ID NO: 2403546 - RNA, 17 nt, Bordetella pertussis
uccaggcugccggcguu

SEQ ID NO: 2403547 - RNA, 16 nt, Bordetella pertussis
uccagggccacgccca

SEQ ID NO: 2403548 - RNA, 17 nt, Bordetella pertussis
uccagggccacgcccac

SEQ ID NO: 2403549 - RNA, 16 nt, Bordetella pertussis
uccagggccgccagca

SEQ ID NO: 2403550 - RNA, 19 nt, Bordetella pertussis
uccagggccgccagcaccu

SEQ ID NO: 2403551 - RNA, 19 nt, Bordetella pertussis
uccagggcgaucagcaccg

SEQ ID NO: 2403552 - RNA, 16 nt, Bordetella pertussis
uccagggcgucgcggc

SEQ ID NO: 2403553 - RNA, 19 nt, Bordetella pertussis
uccagggcuugcggcgcug

SEQ ID NO: 2403554 - RNA, 21 nt, Bordetella pertussis
uccagggcuugcggcgcuggc

SEQ ID NO: 2403555 - RNA, 17 nt, Bordetella pertussis
uccagguaggcggcgcg

SEQ ID NO: 2403556 - RNA, 18 nt, Bordetella pertussis
uccaggucaucaccaggg

SEQ ID NO: 2403557 - RNA, 21 nt, Bordetella pertussis
uccaggugccgcguaugcggc

SEQ ID NO: 2403558 - RNA, 20 nt, Bordetella pertussis
uccagguggcccgcaccggg

SEQ ID NO: 2403559 - RNA, 21 nt, Bordetella pertussis
uccagguggcggacaggcccu

SEQ ID NO: 2403560 - RNA, 17 nt, Bordetella pertussis
uccagguugagucugga

SEQ ID NO: 2403561 - RNA, 19 nt, Bordetella pertussis
uccagguugagucuggaga

SEQ ID NO: 2403562 - RNA, 20 nt, Bordetella pertussis
uccagguugagucuggagau

SEQ ID NO: 2403563 - RNA, 18 nt, Bordetella pertussis
uccagguugggcaccacc

SEQ ID NO: 2403564 - RNA, 16 nt, Bordetella pertussis
uccaguacgaaggggc

SEQ ID NO: 2403565 - RNA, 15 nt, Bordetella pertussis
uccagucccguggcg

SEQ ID NO: 2403566 - RNA, 16 nt, Bordetella pertussis
uccagucccguggcgc

SEQ ID NO: 2403567 - RNA, 18 nt, Bordetella pertussis
uccagucuggauggcgua

SEQ ID NO: 2403568 - RNA, 20 nt, Bordetella pertussis
uccaguucgcgcagauccca

SEQ ID NO: 2403569 - RNA, 17 nt, Bordetella pertussis
uccaguugcgggcgcac

SEQ ID NO: 2403570 - RNA, 15 nt, Bordetella pertussis
uccaguugcuguggg

SEQ ID NO: 2403571 - RNA, 14 nt, Bordetella pertussis
uccauagcgccgcu

SEQ ID NO: 2403572 - RNA, 19 nt, Bordetella pertussis
uccaucaucagcauggcgu

SEQ ID NO: 2403573 - RNA, 15 nt, Bordetella pertussis
uccauccgcauacaa

SEQ ID NO: 2403574 - RNA, 14 nt, Bordetella pertussis
uccaucgacgcggc

SEQ ID NO: 2403575 - RNA, 20 nt, Bordetella pertussis
uccaucgcguccaggcccag

SEQ ID NO: 2403576 - RNA, 21 nt, Bordetella pertussis
uccaucgcguccaggcccagc

SEQ ID NO: 2403577 - RNA, 14 nt, Bordetella pertussis
uccaucggcgcgcg

SEQ ID NO: 2403578 - RNA, 15 nt, Bordetella pertussis
uccaucggcgcgcgc

SEQ ID NO: 2403579 - RNA, 17 nt, Bordetella pertussis
uccaucggggggcaggc

SEQ ID NO: 2403580 - RNA, 18 nt, Bordetella pertussis
uccaucggggggcaggcu

SEQ ID NO: 2403581 - RNA, 17 nt, Bordetella pertussis
uccaucuggaccgcgcg

SEQ ID NO: 2403582 - RNA, 17 nt, Bordetella pertussis
uccaucuguucggcgcc

SEQ ID NO: 2403583 - RNA, 16 nt, Bordetella pertussis
uccaucuugccggccu

SEQ ID NO: 2403584 - RNA, 16 nt, Bordetella pertussis
uccaugacggugccga

SEQ ID NO: 2403585 - RNA, 20 nt, Bordetella pertussis
uccaugaggaacggcaccag

SEQ ID NO: 2403586 - RNA, 21 nt, Bordetella pertussis
uccaugaggaacggcaccagc

SEQ ID NO: 2403587 - RNA, 16 nt, Bordetella pertussis
uccaugccggccaugc

SEQ ID NO: 2403588 - RNA, 20 nt, Bordetella pertussis
uccaugcgaaagcggccagc

SEQ ID NO: 2403589 - RNA, 16 nt, Bordetella pertussis
uccaugcgauccaggg

SEQ ID NO: 2403590 - RNA, 11 nt, Bordetella pertussis
uccaugcggcg

SEQ ID NO: 2403591 - RNA, 17 nt, Bordetella pertussis
uccauggccugcaggaa

SEQ ID NO: 2403592 - RNA, 12 nt, Bordetella pertussis
uccauggcgccg

SEQ ID NO: 2403593 - RNA, 13 nt, Bordetella pertussis
uccauggcgugcc

SEQ ID NO: 2403594 - RNA, 20 nt, Bordetella pertussis
uccauggugggcaggucggg

SEQ ID NO: 2403595 - RNA, 20 nt, Bordetella pertussis
ucccaaccgggacaggcacc

SEQ ID NO: 2403596 - RNA, 16 nt, Bordetella pertussis
ucccagaaacuggcgc

SEQ ID NO: 2403597 - RNA, 15 nt, Bordetella pertussis
ucccagacagccacg

SEQ ID NO: 2403598 - RNA, 16 nt, Bordetella pertussis
ucccagaccugcgcgc

SEQ ID NO: 2403599 - RNA, 20 nt, Bordetella pertussis
ucccagaccugcgcgccggc

SEQ ID NO: 2403600 - RNA, 15 nt, Bordetella pertussis
ucccagauggcgccu

SEQ ID NO: 2403601 - RNA, 16 nt, Bordetella pertussis
ucccagccgucgcgcu

SEQ ID NO: 2403602 - RNA, 19 nt, Bordetella pertussis
ucccagccgucgcgcugca

SEQ ID NO: 2403603 - RNA, 18 nt, Bordetella pertussis
ucccagcgcacgcagcgc

SEQ ID NO: 2403604 - RNA, 19 nt, Bordetella pertussis
ucccagcgcacgcagcgcu

SEQ ID NO: 2403605 - RNA, 18 nt, Bordetella pertussis
ucccagcggggacaggca

SEQ ID NO: 2403606 - RNA, 20 nt, Bordetella pertussis
ucccagcggggacaggcaca

SEQ ID NO: 2403607 - RNA, 20 nt, Bordetella pertussis
ucccagcggggacaggcacc

SEQ ID NO: 2403608 - RNA, 17 nt, Bordetella pertussis
ucccaggaucaccgccg

SEQ ID NO: 2403609 - RNA, 18 nt, Bordetella pertussis
ucccaggaucaccgccgc

SEQ ID NO: 2403610 - RNA, 20 nt, Bordetella pertussis
ucccaggcccggccgcaggg

SEQ ID NO: 2403611 - RNA, 21 nt, Bordetella pertussis
ucccaggccgaagccaccguc

SEQ ID NO: 2403612 - RNA, 13 nt, Bordetella pertussis
ucccaggcgaggc

SEQ ID NO: 2403613 - RNA, 22 nt, Bordetella pertussis
ucccaggcgcucgcgggugcgc

SEQ ID NO: 2403614 - RNA, 18 nt, Bordetella pertussis
ucccaguccggcagcacc

SEQ ID NO: 2403615 - RNA, 20 nt, Bordetella pertussis
uccccaacggggacgggcgc

SEQ ID NO: 2403616 - RNA, 21 nt, Bordetella pertussis
uccccaacggggacgggcgcc

SEQ ID NO: 2403617 - RNA, 15 nt, Bordetella pertussis
uccccaaguacacgg

SEQ ID NO: 2403618 - RNA, 17 nt, Bordetella pertussis
uccccaauacccgccac

SEQ ID NO: 2403619 - RNA, 12 nt, Bordetella pertussis
uccccacagggg

SEQ ID NO: 2403620 - RNA, 20 nt, Bordetella pertussis
uccccacagggggacuggca

SEQ ID NO: 2403621 - RNA, 22 nt, Bordetella pertussis
uccccacagggggucuggcacc

SEQ ID NO: 2403622 - RNA, 20 nt, Bordetella pertussis
uccccacauggggacuggca

SEQ ID NO: 2403623 - RNA, 22 nt, Bordetella pertussis
uccccacauggggacuggcacc

SEQ ID NO: 2403624 - RNA, 16 nt, Bordetella pertussis
uccccaccgggacagg

SEQ ID NO: 2403625 - RNA, 18 nt, Bordetella pertussis
uccccaccgggacaggca

SEQ ID NO: 2403626 - RNA, 20 nt, Bordetella pertussis
uccccaccgggacaggcacc

SEQ ID NO: 2403627 - RNA, 17 nt, Bordetella pertussis
uccccacggggacaggc

SEQ ID NO: 2403628 - RNA, 19 nt, Bordetella pertussis
uccccacggggacaggcac

SEQ ID NO: 2403629 - RNA, 20 nt, Bordetella pertussis
uccccacggggacaggcacc

SEQ ID NO: 2403630 - RNA, 18 nt, Bordetella pertussis
uccccacggggacuggcu

SEQ ID NO: 2403631 - RNA, 21 nt, Bordetella pertussis
uccccacggggacuggcuccc

SEQ ID NO: 2403632 - RNA, 16 nt, Bordetella pertussis
uccccacguggacagg

SEQ ID NO: 2403633 - RNA, 18 nt, Bordetella pertussis
uccccacguggacaggca

SEQ ID NO: 2403634 - RNA, 19 nt, Bordetella pertussis
uccccacguggacaggcac

SEQ ID NO: 2403635 - RNA, 20 nt, Bordetella pertussis
uccccacguggacaggcacc

SEQ ID NO: 2403636 - RNA, 13 nt, Bordetella pertussis
uccccagcgccgc

SEQ ID NO: 2403637 - RNA, 13 nt, Bordetella pertussis
uccccaggccagc

SEQ ID NO: 2403638 - RNA, 12 nt, Bordetella pertussis
uccccaucaucu

SEQ ID NO: 2403639 - RNA, 15 nt, Bordetella pertussis
uccccaugcggggac

SEQ ID NO: 2403640 - RNA, 14 nt, Bordetella pertussis
uccccaugugggga

SEQ ID NO: 2403641 - RNA, 18 nt, Bordetella pertussis
uccccauguggggacagg

SEQ ID NO: 2403642 - RNA, 19 nt, Bordetella pertussis
uccccauguggggacaggc

SEQ ID NO: 2403643 - RNA, 20 nt, Bordetella pertussis
uccccauguggggacaggca

SEQ ID NO: 2403644 - RNA, 16 nt, Bordetella pertussis
ucccccaugcggggac

SEQ ID NO: 2403645 - RNA, 21 nt, Bordetella pertussis
ucccccaugcggggacaggca

SEQ ID NO: 2403646 - RNA, 18 nt, Bordetella pertussis
uccccccauggggacugg

SEQ ID NO: 2403647 - RNA, 16 nt, Bordetella pertussis
ucccccuacugcccuc

SEQ ID NO: 2403648 - RNA, 19 nt, Bordetella pertussis
uccccgaaggggacuggcu

SEQ ID NO: 2403649 - RNA, 22 nt, Bordetella pertussis
uccccgaaggggacuggcuccc

SEQ ID NO: 2403650 - RNA, 19 nt, Bordetella pertussis
uccccgcaagggggacugg

SEQ ID NO: 2403651 - RNA, 21 nt, Bordetella pertussis
uccccgcaagggggacuggca

SEQ ID NO: 2403652 - RNA, 18 nt, Bordetella pertussis
uccccgcacggggacagg

SEQ ID NO: 2403653 - RNA, 22 nt, Bordetella pertussis
uccccgcacggggacaggcacg

SEQ ID NO: 2403654 - RNA, 21 nt, Bordetella pertussis
uccccgcacggggacuggcac

SEQ ID NO: 2403655 - RNA, 22 nt, Bordetella pertussis
uccccgcacggggacuggcacc

SEQ ID NO: 2403656 - RNA, 18 nt, Bordetella pertussis
uccccgcagggacaggca

SEQ ID NO: 2403657 - RNA, 19 nt, Bordetella pertussis
uccccgcagggacaggcac

SEQ ID NO: 2403658 - RNA, 22 nt, Bordetella pertussis
uccccgcauggagaccggcgcc

SEQ ID NO: 2403659 - RNA, 18 nt, Bordetella pertussis
uccccgcauggggacugg

SEQ ID NO: 2403660 - RNA, 23 nt, Bordetella pertussis
uccccgcauggggacuggcgccu

SEQ ID NO: 2403661 - RNA, 11 nt, Bordetella pertussis
uccccgccggg

SEQ ID NO: 2403662 - RNA, 17 nt, Bordetella pertussis
uccccgccgggacaggc

SEQ ID NO: 2403663 - RNA, 18 nt, Bordetella pertussis
uccccgccgggacaggca

SEQ ID NO: 2403664 - RNA, 20 nt, Bordetella pertussis
uccccgccgggacaggcacc

SEQ ID NO: 2403665 - RNA, 20 nt, Bordetella pertussis
uccccgccggggcaggcucc

SEQ ID NO: 2403666 - RNA, 23 nt, Bordetella pertussis
uccccgcggaggugucgccgccc

SEQ ID NO: 2403667 - RNA, 14 nt, Bordetella pertussis
uccccgcggggaca

SEQ ID NO: 2403668 - RNA, 19 nt, Bordetella pertussis
uccccgcggggacaggcac

SEQ ID NO: 2403669 - RNA, 20 nt, Bordetella pertussis
uccccgcggggacaggcacc

SEQ ID NO: 2403670 - RNA, 18 nt, Bordetella pertussis
uccccgcggggacaggcu

SEQ ID NO: 2403671 - RNA, 19 nt, Bordetella pertussis
uccccgcggggacaggcuc

SEQ ID NO: 2403672 - RNA, 20 nt, Bordetella pertussis
uccccgcggggacaggcucc

SEQ ID NO: 2403673 - RNA, 21 nt, Bordetella pertussis
uccccgcggggacaggcuccc

SEQ ID NO: 2403674 - RNA, 16 nt, Bordetella pertussis
uccccgcgugccuguc

SEQ ID NO: 2403675 - RNA, 15 nt, Bordetella pertussis
uccccgcugggacag

SEQ ID NO: 2403676 - RNA, 16 nt, Bordetella pertussis
uccccgcugggacagg

SEQ ID NO: 2403677 - RNA, 18 nt, Bordetella pertussis
uccccgcugggacaggca

SEQ ID NO: 2403678 - RNA, 20 nt, Bordetella pertussis
uccccgcugggacaggcaca

SEQ ID NO: 2403679 - RNA, 20 nt, Bordetella pertussis
uccccgcugggacaggcacu

SEQ ID NO: 2403680 - RNA, 19 nt, Bordetella pertussis
uccccgucgggacaggcuc

SEQ ID NO: 2403681 - RNA, 16 nt, Bordetella pertussis
uccccgugcggggacc

SEQ ID NO: 2403682 - RNA, 20 nt, Bordetella pertussis
uccccgugcggggaccggca

SEQ ID NO: 2403683 - RNA, 12 nt, Bordetella pertussis
uccccgugggga

SEQ ID NO: 2403684 - RNA, 16 nt, Bordetella pertussis
uccccguggggacagg

SEQ ID NO: 2403685 - RNA, 14 nt, Bordetella pertussis
uccccguucgggga

SEQ ID NO: 2403686 - RNA, 22 nt, Bordetella pertussis
uccccuccggugccuggcuccc

SEQ ID NO: 2403687 - RNA, 17 nt, Bordetella pertussis
uccccugcggggacagg

SEQ ID NO: 2403688 - RNA, 19 nt, Bordetella pertussis
uccccugcggggacaggca

SEQ ID NO: 2403689 - RNA, 20 nt, Bordetella pertussis
uccccugcggggacaggcac

SEQ ID NO: 2403690 - RNA, 21 nt, Bordetella pertussis
uccccugcggggacaggcacc

SEQ ID NO: 2403691 - RNA, 15 nt, Bordetella pertussis
uccccugcuaaggga

SEQ ID NO: 2403692 - RNA, 15 nt, Bordetella pertussis
uccccuucucggccg

SEQ ID NO: 2403693 - RNA, 17 nt, Bordetella pertussis
ucccgacccccggcccg

SEQ ID NO: 2403694 - RNA, 22 nt, Bordetella pertussis
ucccgacccccggcccgcgccg

SEQ ID NO: 2403695 - RNA, 23 nt, Bordetella pertussis
ucccgacgaggccgaguagcggc

SEQ ID NO: 2403696 - RNA, 16 nt, Bordetella pertussis
ucccgacgauccgcgg

SEQ ID NO: 2403697 - RNA, 17 nt, Bordetella pertussis
ucccgacggggacaggc

SEQ ID NO: 2403698 - RNA, 18 nt, Bordetella pertussis
ucccgacggggacaggcu

SEQ ID NO: 2403699 - RNA, 21 nt, Bordetella pertussis
ucccgagcgcucccgccaaca

SEQ ID NO: 2403700 - RNA, 19 nt, Bordetella pertussis
ucccgauauaugacguaga

SEQ ID NO: 2403701 - RNA, 23 nt, Bordetella pertussis
ucccgauuccaggacgacaggca

SEQ ID NO: 2403702 - RNA, 24 nt, Bordetella pertussis
ucccgcaccgaccagcgcgcgccg

SEQ ID NO: 2403703 - RNA, 15 nt, Bordetella pertussis
ucccgcacgcagccc

SEQ ID NO: 2403704 - RNA, 12 nt, Bordetella pertussis
ucccgcaggccc

SEQ ID NO: 2403705 - RNA, 13 nt, Bordetella pertussis
ucccgcaggccca

SEQ ID NO: 2403706 - RNA, 15 nt, Bordetella pertussis
ucccgccaacacgau

SEQ ID NO: 2403707 - RNA, 23 nt, Bordetella pertussis
ucccgccaacacgauccacggcc

SEQ ID NO: 2403708 - RNA, 18 nt, Bordetella pertussis
ucccgcccagcgacgagg

SEQ ID NO: 2403709 - RNA, 20 nt, Bordetella pertussis
ucccgcgccgagcggggccg

SEQ ID NO: 2403710 - RNA, 15 nt, Bordetella pertussis
ucccgcuggcggcac

SEQ ID NO: 2403711 - RNA, 22 nt, Bordetella pertussis
ucccggaccagcaguugcgcca

SEQ ID NO: 2403712 - RNA, 13 nt, Bordetella pertussis
ucccggccaggcg

SEQ ID NO: 2403713 - RNA, 20 nt, Bordetella pertussis
ucccggcgacaccgcggccu

SEQ ID NO: 2403714 - RNA, 11 nt, Bordetella pertussis
ucccggcgcgg

SEQ ID NO: 2403715 - RNA, 19 nt, Bordetella pertussis
ucccggcgcucagcgcgcc

SEQ ID NO: 2403716 - RNA, 20 nt, Bordetella pertussis
ucccggcgcucagcgcgccg

SEQ ID NO: 2403717 - RNA, 15 nt, Bordetella pertussis
ucccggcgcuggccg

SEQ ID NO: 2403718 - RNA, 20 nt, Bordetella pertussis
ucccggcggggacaggcgcc

SEQ ID NO: 2403719 - RNA, 14 nt, Bordetella pertussis
ucccggcggggcag

SEQ ID NO: 2403720 - RNA, 18 nt, Bordetella pertussis
ucccggcugggacaggca

SEQ ID NO: 2403721 - RNA, 20 nt, Bordetella pertussis
ucccggcugggacaggcacc

SEQ ID NO: 2403722 - RNA, 22 nt, Bordetella pertussis
ucccggcugggacaggcacccu

SEQ ID NO: 2403723 - RNA, 21 nt, Bordetella pertussis
ucccgggggcgccuguccccg

SEQ ID NO: 2403724 - RNA, 16 nt, Bordetella pertussis
ucccgguaggccuggu

SEQ ID NO: 2403725 - RNA, 14 nt, Bordetella pertussis
ucccgguccaggcc

SEQ ID NO: 2403726 - RNA, 14 nt, Bordetella pertussis
ucccgugccggccg

SEQ ID NO: 2403727 - RNA, 14 nt, Bordetella pertussis
ucccguggcgcuca

SEQ ID NO: 2403728 - RNA, 17 nt, Bordetella pertussis
ucccugaucccggcgcu

SEQ ID NO: 2403729 - RNA, 15 nt, Bordetella pertussis
ucccugccgggacag

SEQ ID NO: 2403730 - RNA, 17 nt, Bordetella pertussis
ucccugccgggacaggc

SEQ ID NO: 2403731 - RNA, 18 nt, Bordetella pertussis
ucccugccgggacaggca

SEQ ID NO: 2403732 - RNA, 14 nt, Bordetella pertussis
ucccugcggggacu

SEQ ID NO: 2403733 - RNA, 16 nt, Bordetella pertussis
ucccugcgggggcagg

SEQ ID NO: 2403734 - RNA, 18 nt, Bordetella pertussis
ucccugcgggggcaggca

SEQ ID NO: 2403735 - RNA, 20 nt, Bordetella pertussis
ucccugcgggggcaggcacg

SEQ ID NO: 2403736 - RNA, 16 nt, Bordetella pertussis
ucccuggcccuggcgg

SEQ ID NO: 2403737 - RNA, 19 nt, Bordetella pertussis
ucccuggcccuggcgggcc

SEQ ID NO: 2403738 - RNA, 18 nt, Bordetella pertussis
ucccugugggggacaggc

SEQ ID NO: 2403739 - RNA, 19 nt, Bordetella pertussis
ucccugugggggacaggca

SEQ ID NO: 2403740 - RNA, 20 nt, Bordetella pertussis
ucccugugggggacaggcac

SEQ ID NO: 2403741 - RNA, 21 nt, Bordetella pertussis
ucccugugggggacaggcacg

SEQ ID NO: 2403742 - RNA, 14 nt, Bordetella pertussis
ucccuuccuggcca

SEQ ID NO: 2403743 - RNA, 15 nt, Bordetella pertussis
ucccuuccuggccaa

SEQ ID NO: 2403744 - RNA, 19 nt, Bordetella pertussis
uccgaaagacugcggcgcg

SEQ ID NO: 2403745 - RNA, 22 nt, Bordetella pertussis
uccgaaccacccggccaucgaa

SEQ ID NO: 2403746 - RNA, 17 nt, Bordetella pertussis
uccgaacgcgacagcgc

SEQ ID NO: 2403747 - RNA, 14 nt, Bordetella pertussis
uccgaaucuucgau

SEQ ID NO: 2403748 - RNA, 23 nt, Bordetella pertussis
uccgaauuccugaacgccgggcc

SEQ ID NO: 2403749 - RNA, 18 nt, Bordetella pertussis
uccgacaccgucaggaag

SEQ ID NO: 2403750 - RNA, 15 nt, Bordetella pertussis
uccgacaggcgccgc

SEQ ID NO: 2403751 - RNA, 18 nt, Bordetella pertussis
uccgacaggcgccgcaac

SEQ ID NO: 2403752 - RNA, 20 nt, Bordetella pertussis
uccgacgguagccgggucug

SEQ ID NO: 2403753 - RNA, 11 nt, Bordetella pertussis
uccgaugaugc

SEQ ID NO: 2403754 - RNA, 13 nt, Bordetella pertussis
uccgaugcuggug

SEQ ID NO: 2403755 - RNA, 23 nt, Bordetella pertussis
uccgauguuacagaugggcggcc

SEQ ID NO: 2403756 - RNA, 15 nt, Bordetella pertussis
uccgcaacccagcag

SEQ ID NO: 2403757 - RNA, 19 nt, Bordetella pertussis
uccgcaacccagcagcggc

SEQ ID NO: 2403758 - RNA, 18 nt, Bordetella pertussis
uccgcaaguucggcagcg

SEQ ID NO: 2403759 - RNA, 15 nt, Bordetella pertussis
uccgcaccggcgugc

SEQ ID NO: 2403760 - RNA, 18 nt, Bordetella pertussis
uccgcaccggcgugcgcu

SEQ ID NO: 2403761 - RNA, 21 nt, Bordetella pertussis
uccgcaccggcgugcgcuggc

SEQ ID NO: 2403762 - RNA, 12 nt, Bordetella pertussis
uccgcagcgcag

SEQ ID NO: 2403763 - RNA, 15 nt, Bordetella pertussis
uccgcagcgcagcgc

SEQ ID NO: 2403764 - RNA, 18 nt, Bordetella pertussis
uccgcauggacggaggcu

SEQ ID NO: 2403765 - RNA, 19 nt, Bordetella pertussis
uccgcauggguucgagguc

SEQ ID NO: 2403766 - RNA, 16 nt, Bordetella pertussis
uccgccaacucgcucc

SEQ ID NO: 2403767 - RNA, 13 nt, Bordetella pertussis
uccgccacccugg

SEQ ID NO: 2403768 - RNA, 15 nt, Bordetella pertussis
uccgccaccgcgccg

SEQ ID NO: 2403769 - RNA, 20 nt, Bordetella pertussis
uccgccaccgcgccgcccac

SEQ ID NO: 2403770 - RNA, 18 nt, Bordetella pertussis
uccgccacgccggccacg

SEQ ID NO: 2403771 - RNA, 16 nt, Bordetella pertussis
uccgccaugcggcgcc

SEQ ID NO: 2403772 - RNA, 19 nt, Bordetella pertussis
uccgccauggaggcgcagc

SEQ ID NO: 2403773 - RNA, 21 nt, Bordetella pertussis
uccgccauggaggcgcagcgc

SEQ ID NO: 2403774 - RNA, 24 nt, Bordetella pertussis
uccgccauggaggcgcagcgcggc

SEQ ID NO: 2403775 - RNA, 18 nt, Bordetella pertussis
uccgccccauccacggcg

SEQ ID NO: 2403776 - RNA, 20 nt, Bordetella pertussis
uccgccccauccacggcgcc

SEQ ID NO: 2403777 - RNA, 16 nt, Bordetella pertussis
uccgccccccugcaua

SEQ ID NO: 2403778 - RNA, 17 nt, Bordetella pertussis
uccgcccguugcggcgc

SEQ ID NO: 2403779 - RNA, 22 nt, Bordetella pertussis
uccgccgagaaauccagcgcgc

SEQ ID NO: 2403780 - RNA, 17 nt, Bordetella pertussis
uccgccgccagcacgcc

SEQ ID NO: 2403781 - RNA, 13 nt, Bordetella pertussis
uccgccgcggcca

SEQ ID NO: 2403782 - RNA, 17 nt, Bordetella pertussis
uccgccgcggccagcgc

SEQ ID NO: 2403783 - RNA, 22 nt, Bordetella pertussis
uccgccggcgauauggccaggg

SEQ ID NO: 2403784 - RNA, 19 nt, Bordetella pertussis
uccgccggugucggggccg

SEQ ID NO: 2403785 - RNA, 14 nt, Bordetella pertussis
uccgccgugcaggc

SEQ ID NO: 2403786 - RNA, 15 nt, Bordetella pertussis
uccgccgugcaggcc

SEQ ID NO: 2403787 - RNA, 22 nt, Bordetella pertussis
uccgccgugcaggcccgggcgc

SEQ ID NO: 2403788 - RNA, 20 nt, Bordetella pertussis
uccgccuacuggcgcgcgca

SEQ ID NO: 2403789 - RNA, 21 nt, Bordetella pertussis
uccgcgaaacggcgggcgcgc

SEQ ID NO: 2403790 - RNA, 22 nt, Bordetella pertussis
uccgcgaaacggcgggcgcgca

SEQ ID NO: 2403791 - RNA, 17 nt, Bordetella pertussis
uccgcgaagugccuguc

SEQ ID NO: 2403792 - RNA, 16 nt, Bordetella pertussis
uccgcgacgcccuggc

SEQ ID NO: 2403793 - RNA, 18 nt, Bordetella pertussis
uccgcgacgguccugcgc

SEQ ID NO: 2403794 - RNA, 21 nt, Bordetella pertussis
uccgcgacgguccugcgcgcc

SEQ ID NO: 2403795 - RNA, 17 nt, Bordetella pertussis
uccgcgcacagcgcggc

SEQ ID NO: 2403796 - RNA, 21 nt, Bordetella pertussis
uccgcgcaugauuccugucgc

SEQ ID NO: 2403797 - RNA, 20 nt, Bordetella pertussis
uccgcgcauggacugcaggc

SEQ ID NO: 2403798 - RNA, 18 nt, Bordetella pertussis
uccgcgccacacgggcgc

SEQ ID NO: 2403799 - RNA, 19 nt, Bordetella pertussis
uccgcgccacacgggcgcc

SEQ ID NO: 2403800 - RNA, 13 nt, Bordetella pertussis
uccgcgccaggcg

SEQ ID NO: 2403801 - RNA, 13 nt, Bordetella pertussis
uccgcgcgcagcg

SEQ ID NO: 2403802 - RNA, 17 nt, Bordetella pertussis
uccgcgcucgcccagcc

SEQ ID NO: 2403803 - RNA, 20 nt, Bordetella pertussis
uccgcgcugcugccgucggc

SEQ ID NO: 2403804 - RNA, 21 nt, Bordetella pertussis
uccgcggcccgcccgcggauc

SEQ ID NO: 2403805 - RNA, 17 nt, Bordetella pertussis
uccgcgggcgggccgcg

SEQ ID NO: 2403806 - RNA, 11 nt, Bordetella pertussis
uccgcggggga

SEQ ID NO: 2403807 - RNA, 12 nt, Bordetella pertussis
uccgcgucgccg

SEQ ID NO: 2403808 - RNA, 16 nt, Bordetella pertussis
uccgcguugcgcugcc

SEQ ID NO: 2403809 - RNA, 17 nt, Bordetella pertussis
uccgcuaccaggcgcgc

SEQ ID NO: 2403810 - RNA, 16 nt, Bordetella pertussis
uccgcucaugccggca

SEQ ID NO: 2403811 - RNA, 17 nt, Bordetella pertussis
uccgcucaugccggcaa

SEQ ID NO: 2403812 - RNA, 19 nt, Bordetella pertussis
uccgcuucgucgggcagcg

SEQ ID NO: 2403813 - RNA, 19 nt, Bordetella pertussis
uccggacugaacgcgucca

SEQ ID NO: 2403814 - RNA, 22 nt, Bordetella pertussis
uccggaugcacguagcgcagca

SEQ ID NO: 2403815 - RNA, 21 nt, Bordetella pertussis
uccggcaaagaucaccugggc

SEQ ID NO: 2403816 - RNA, 16 nt, Bordetella pertussis
uccggcaacagcaggu

SEQ ID NO: 2403817 - RNA, 14 nt, Bordetella pertussis
uccggcagcagcag

SEQ ID NO: 2403818 - RNA, 17 nt, Bordetella pertussis
uccggcagcagcagcgu

SEQ ID NO: 2403819 - RNA, 15 nt, Bordetella pertussis
uccggcagcggccag

SEQ ID NO: 2403820 - RNA, 16 nt, Bordetella pertussis
uccggcagcggccagc

SEQ ID NO: 2403821 - RNA, 21 nt, Bordetella pertussis
uccggcaggaucugcaccuug

SEQ ID NO: 2403822 - RNA, 21 nt, Bordetella pertussis
uccggcaucaguucaggcugg

SEQ ID NO: 2403823 - RNA, 19 nt, Bordetella pertussis
uccggcaugaccgcggacg

SEQ ID NO: 2403824 - RNA, 13 nt, Bordetella pertussis
uccggccagcacg

SEQ ID NO: 2403825 - RNA, 20 nt, Bordetella pertussis
uccggccagcacgccggcgg

SEQ ID NO: 2403826 - RNA, 16 nt, Bordetella pertussis
uccggcccggugcagc

SEQ ID NO: 2403827 - RNA, 14 nt, Bordetella pertussis
uccggccgcacgcg

SEQ ID NO: 2403828 - RNA, 18 nt, Bordetella pertussis
uccggccgcacgcggccg

SEQ ID NO: 2403829 - RNA, 19 nt, Bordetella pertussis
uccggccgcacgcggccgc

SEQ ID NO: 2403830 - RNA, 17 nt, Bordetella pertussis
uccggccgcgcaaggcg

SEQ ID NO: 2403831 - RNA, 18 nt, Bordetella pertussis
uccggccgcgcaaggcgg

SEQ ID NO: 2403832 - RNA, 19 nt, Bordetella pertussis
uccggccgcgcaaggcggc

SEQ ID NO: 2403833 - RNA, 14 nt, Bordetella pertussis
uccggccgcgccag

SEQ ID NO: 2403834 - RNA, 18 nt, Bordetella pertussis
uccggccgcgccagcccu

SEQ ID NO: 2403835 - RNA, 13 nt, Bordetella pertussis
uccggccgggcca

SEQ ID NO: 2403836 - RNA, 14 nt, Bordetella pertussis
uccggccgggccag

SEQ ID NO: 2403837 - RNA, 16 nt, Bordetella pertussis
uccggccgggccagcg

SEQ ID NO: 2403838 - RNA, 13 nt, Bordetella pertussis
uccggccgugccg

SEQ ID NO: 2403839 - RNA, 16 nt, Bordetella pertussis
uccggccgugccgccc

SEQ ID NO: 2403840 - RNA, 19 nt, Bordetella pertussis
uccggcgaccgacggcauc

SEQ ID NO: 2403841 - RNA, 20 nt, Bordetella pertussis
uccggcgcaugauggccggc

SEQ ID NO: 2403842 - RNA, 16 nt, Bordetella pertussis
uccggcgccagcaugc

SEQ ID NO: 2403843 - RNA, 20 nt, Bordetella pertussis
uccggcgccagcaugcgcgc

SEQ ID NO: 2403844 - RNA, 18 nt, Bordetella pertussis
uccggcgcccgccgccgg

SEQ ID NO: 2403845 - RNA, 15 nt, Bordetella pertussis
uccggcgccuggccg

SEQ ID NO: 2403846 - RNA, 16 nt, Bordetella pertussis
uccggcgccuggccgu

SEQ ID NO: 2403847 - RNA, 10 nt, Bordetella pertussis
uccggcgcga

SEQ ID NO: 2403848 - RNA, 22 nt, Bordetella pertussis
uccggcgcgcgguggcacgacg

SEQ ID NO: 2403849 - RNA, 22 nt, Bordetella pertussis
uccggcgcucgccccggcgcgc

SEQ ID NO: 2403850 - RNA, 21 nt, Bordetella pertussis
uccggcgcuggcgcauggcug

SEQ ID NO: 2403851 - RNA, 14 nt, Bordetella pertussis
uccggcgcuggcuu

SEQ ID NO: 2403852 - RNA, 18 nt, Bordetella pertussis
uccggcggcagcgcgaac

SEQ ID NO: 2403853 - RNA, 20 nt, Bordetella pertussis
uccggcggcagcgcgaacgg

SEQ ID NO: 2403854 - RNA, 22 nt, Bordetella pertussis
uccggcggcagcgcgaacggcg

SEQ ID NO: 2403855 - RNA, 16 nt, Bordetella pertussis
uccggcgugccaugga

SEQ ID NO: 2403856 - RNA, 22 nt, Bordetella pertussis
uccggcucggaccuggccagcg

SEQ ID NO: 2403857 - RNA, 13 nt, Bordetella pertussis
uccggcucuucca

SEQ ID NO: 2403858 - RNA, 22 nt, Bordetella pertussis
uccggcugcgcgcgcagccagg

SEQ ID NO: 2403859 - RNA, 21 nt, Bordetella pertussis
uccggcuggauggugccgccg

SEQ ID NO: 2403860 - RNA, 16 nt, Bordetella pertussis
uccggcuugccgaagg

SEQ ID NO: 2403861 - RNA, 15 nt, Bordetella pertussis
uccgggccuggcguu

SEQ ID NO: 2403862 - RNA, 19 nt, Bordetella pertussis
uccgggcgcugcgccggcg

SEQ ID NO: 2403863 - RNA, 14 nt, Bordetella pertussis
uccggggcgggcgc

SEQ ID NO: 2403864 - RNA, 17 nt, Bordetella pertussis
uccggggcgggcgcggu

SEQ ID NO: 2403865 - RNA, 13 nt, Bordetella pertussis
uccggguccagcc

SEQ ID NO: 2403866 - RNA, 14 nt, Bordetella pertussis
uccggguccagccc

SEQ ID NO: 2403867 - RNA, 21 nt, Bordetella pertussis
uccggucgcgcgugcaggccg

SEQ ID NO: 2403868 - RNA, 16 nt, Bordetella pertussis
uccggucguggccagc

SEQ ID NO: 2403869 - RNA, 21 nt, Bordetella pertussis
uccggucguuccagaacggcg

SEQ ID NO: 2403870 - RNA, 17 nt, Bordetella pertussis
uccggugccuggcuccc

SEQ ID NO: 2403871 - RNA, 20 nt, Bordetella pertussis
uccgucaccgacgccagcau

SEQ ID NO: 2403872 - RNA, 14 nt, Bordetella pertussis
uccguccuggccac

SEQ ID NO: 2403873 - RNA, 23 nt, Bordetella pertussis
uccgucucgcccaggcccagcau

SEQ ID NO: 2403874 - RNA, 18 nt, Bordetella pertussis
uccgucucggcuucuccu

SEQ ID NO: 2403875 - RNA, 13 nt, Bordetella pertussis
uccgucugguucc

SEQ ID NO: 2403876 - RNA, 15 nt, Bordetella pertussis
uccgugagugcagcg

SEQ ID NO: 2403877 - RNA, 23 nt, Bordetella pertussis
uccgugcaucggcacgggucagg

SEQ ID NO: 2403878 - RNA, 13 nt, Bordetella pertussis
uccgugcgcgccc

SEQ ID NO: 2403879 - RNA, 19 nt, Bordetella pertussis
uccgugcggcgcgcacggg

SEQ ID NO: 2403880 - RNA, 17 nt, Bordetella pertussis
uccguggccggcgcggc

SEQ ID NO: 2403881 - RNA, 15 nt, Bordetella pertussis
uccguggcgcggcca

SEQ ID NO: 2403882 - RNA, 16 nt, Bordetella pertussis
uccguggcggccgcgg

SEQ ID NO: 2403883 - RNA, 15 nt, Bordetella pertussis
uccuaaauugccgcg

SEQ ID NO: 2403884 - RNA, 20 nt, Bordetella pertussis
uccucagccugguauugccu

SEQ ID NO: 2403885 - RNA, 13 nt, Bordetella pertussis
uccucaggcccgc

SEQ ID NO: 2403886 - RNA, 20 nt, Bordetella pertussis
uccucaggcccgcggcgcca

SEQ ID NO: 2403887 - RNA, 19 nt, Bordetella pertussis
uccucccagaccugcgcgc

SEQ ID NO: 2403888 - RNA, 15 nt, Bordetella pertussis
uccuccccaacgggg

SEQ ID NO: 2403889 - RNA, 19 nt, Bordetella pertussis
uccuccccaacggggacgg

SEQ ID NO: 2403890 - RNA, 16 nt, Bordetella pertussis
uccuccugucaugguu

SEQ ID NO: 2403891 - RNA, 18 nt, Bordetella pertussis
uccuccugucaugguuuc

SEQ ID NO: 2403892 - RNA, 23 nt, Bordetella pertussis
uccucgaacaggccaucgccgcc

SEQ ID NO: 2403893 - RNA, 22 nt, Bordetella pertussis
uccucgaccagcccggccgcca

SEQ ID NO: 2403894 - RNA, 14 nt, Bordetella pertussis
uccucgaccagcgc

SEQ ID NO: 2403895 - RNA, 16 nt, Bordetella pertussis
uccucgaccagcgcgc

SEQ ID NO: 2403896 - RNA, 13 nt, Bordetella pertussis
uccucgaccagga

SEQ ID NO: 2403897 - RNA, 23 nt, Bordetella pertussis
uccucgacgauggcgggguuggc

SEQ ID NO: 2403898 - RNA, 20 nt, Bordetella pertussis
uccucgccacacgccagaac

SEQ ID NO: 2403899 - RNA, 14 nt, Bordetella pertussis
uccucgccagcggc

SEQ ID NO: 2403900 - RNA, 16 nt, Bordetella pertussis
uccucgccagcggcag

SEQ ID NO: 2403901 - RNA, 15 nt, Bordetella pertussis
uccucgcccagcggc

SEQ ID NO: 2403902 - RNA, 23 nt, Bordetella pertussis
uccucgcccagcggcgccgacca

SEQ ID NO: 2403903 - RNA, 13 nt, Bordetella pertussis
uccucgcgcacca

SEQ ID NO: 2403904 - RNA, 17 nt, Bordetella pertussis
uccucgcgggccuggcg

SEQ ID NO: 2403905 - RNA, 15 nt, Bordetella pertussis
uccucgcucuuggga

SEQ ID NO: 2403906 - RNA, 17 nt, Bordetella pertussis
uccucggcacggccagc

SEQ ID NO: 2403907 - RNA, 15 nt, Bordetella pertussis
uccucgucgcggaag

SEQ ID NO: 2403908 - RNA, 14 nt, Bordetella pertussis
uccucgucggccau

SEQ ID NO: 2403909 - RNA, 15 nt, Bordetella pertussis
uccucgucggccaug

SEQ ID NO: 2403910 - RNA, 22 nt, Bordetella pertussis
uccucgucggccaugcgcgcca

SEQ ID NO: 2403911 - RNA, 16 nt, Bordetella pertussis
uccucgucggcgaagc

SEQ ID NO: 2403912 - RNA, 15 nt, Bordetella pertussis
uccucguugcccgcg

SEQ ID NO: 2403913 - RNA, 16 nt, Bordetella pertussis
uccucuacuggcugau

SEQ ID NO: 2403914 - RNA, 22 nt, Bordetella pertussis
uccugaacgccgcgcugccuga

SEQ ID NO: 2403915 - RNA, 18 nt, Bordetella pertussis
uccugaucgaauaccugc

SEQ ID NO: 2403916 - RNA, 14 nt, Bordetella pertussis
uccugcaaccagcu

SEQ ID NO: 2403917 - RNA, 22 nt, Bordetella pertussis
uccugcaaccagcucagcuugg

SEQ ID NO: 2403918 - RNA, 15 nt, Bordetella pertussis
uccugcaaggccggc

SEQ ID NO: 2403919 - RNA, 16 nt, Bordetella pertussis
uccugcagcacgcugg

SEQ ID NO: 2403920 - RNA, 15 nt, Bordetella pertussis
uccugcagcgugcug

SEQ ID NO: 2403921 - RNA, 14 nt, Bordetella pertussis
uccugcaggauggg

SEQ ID NO: 2403922 - RNA, 10 nt, Bordetella pertussis
uccugcaggc

SEQ ID NO: 2403923 - RNA, 15 nt, Bordetella pertussis
uccugcaggcccggc

SEQ ID NO: 2403924 - RNA, 17 nt, Bordetella pertussis
uccugcaggcccggcgc

SEQ ID NO: 2403925 - RNA, 20 nt, Bordetella pertussis
uccugcaggcccggcgcgac

SEQ ID NO: 2403926 - RNA, 19 nt, Bordetella pertussis
uccugcaggcggcgcauca

SEQ ID NO: 2403927 - RNA, 22 nt, Bordetella pertussis
uccugcagggcgucugcucgcc

SEQ ID NO: 2403928 - RNA, 22 nt, Bordetella pertussis
uccugccacuccugguugaccg

SEQ ID NO: 2403929 - RNA, 19 nt, Bordetella pertussis
uccugccauugcgcggccu

SEQ ID NO: 2403930 - RNA, 20 nt, Bordetella pertussis
uccugcccaccgccgcccgc

SEQ ID NO: 2403931 - RNA, 15 nt, Bordetella pertussis
uccugcgccaguugc

SEQ ID NO: 2403932 - RNA, 13 nt, Bordetella pertussis
uccugcggcgcgg

SEQ ID NO: 2403933 - RNA, 15 nt, Bordetella pertussis
uccugcgugauggcg

SEQ ID NO: 2403934 - RNA, 19 nt, Bordetella pertussis
uccugcucgauccgggcac

SEQ ID NO: 2403935 - RNA, 22 nt, Bordetella pertussis
uccugcuggcgcgucggcgcgc

SEQ ID NO: 2403936 - RNA, 13 nt, Bordetella pertussis
uccugcugguggc

SEQ ID NO: 2403937 - RNA, 15 nt, Bordetella pertussis
uccugcugugcccca

SEQ ID NO: 2403938 - RNA, 19 nt, Bordetella pertussis
uccugcugugccccacacg

SEQ ID NO: 2403939 - RNA, 16 nt, Bordetella pertussis
uccuggaacuugggau

SEQ ID NO: 2403940 - RNA, 21 nt, Bordetella pertussis
uccuggagacguagccgcugc

SEQ ID NO: 2403941 - RNA, 11 nt, Bordetella pertussis
uccuggagcuu

SEQ ID NO: 2403942 - RNA, 23 nt, Bordetella pertussis
uccuggagcuuggccggugccag

SEQ ID NO: 2403943 - RNA, 20 nt, Bordetella pertussis
uccuggagucugcgugugcc

SEQ ID NO: 2403944 - RNA, 12 nt, Bordetella pertussis
uccuggcaggcc

SEQ ID NO: 2403945 - RNA, 17 nt, Bordetella pertussis
uccuggcaggccgcuuc

SEQ ID NO: 2403946 - RNA, 17 nt, Bordetella pertussis
uccuggcagucagccgu

SEQ ID NO: 2403947 - RNA, 13 nt, Bordetella pertussis
uccuggccacugc

SEQ ID NO: 2403948 - RNA, 22 nt, Bordetella pertussis
uccuggccgauuucgcgcgcca

SEQ ID NO: 2403949 - RNA, 23 nt, Bordetella pertussis
uccuggccgccgcgggcgccgcg

SEQ ID NO: 2403950 - RNA, 21 nt, Bordetella pertussis
uccuggccggcgccgacaacg

SEQ ID NO: 2403951 - RNA, 14 nt, Bordetella pertussis
uccuggcgaccggc

SEQ ID NO: 2403952 - RNA, 13 nt, Bordetella pertussis
uccuggcgcgcca

SEQ ID NO: 2403953 - RNA, 16 nt, Bordetella pertussis
uccuggcgcggacauc

SEQ ID NO: 2403954 - RNA, 19 nt, Bordetella pertussis
uccuggcggccgcccagca

SEQ ID NO: 2403955 - RNA, 21 nt, Bordetella pertussis
uccuggcucugaucgcgcugg

SEQ ID NO: 2403956 - RNA, 15 nt, Bordetella pertussis
uccugggccgagcgc

SEQ ID NO: 2403957 - RNA, 22 nt, Bordetella pertussis
uccugggccgagcgcgccagca

SEQ ID NO: 2403958 - RNA, 23 nt, Bordetella pertussis
uccugggccgagcgcgccagcac

SEQ ID NO: 2403959 - RNA, 13 nt, Bordetella pertussis
uccugggcgccgg

SEQ ID NO: 2403960 - RNA, 13 nt, Bordetella pertussis
uccugggugcgcc

SEQ ID NO: 2403961 - RNA, 22 nt, Bordetella pertussis
uccugggugcgccaaucggcgu

SEQ ID NO: 2403962 - RNA, 18 nt, Bordetella pertussis
uccugguaagaaaccugg

SEQ ID NO: 2403963 - RNA, 21 nt, Bordetella pertussis
uccugguaucccucgcccagc

SEQ ID NO: 2403964 - RNA, 16 nt, Bordetella pertussis
uccuggucgaccaggc

SEQ ID NO: 2403965 - RNA, 21 nt, Bordetella pertussis
uccuggucgaucgagaaguug

SEQ ID NO: 2403966 - RNA, 15 nt, Bordetella pertussis
uccuggucggcgcgg

SEQ ID NO: 2403967 - RNA, 16 nt, Bordetella pertussis
uccuggucggcgcggc

SEQ ID NO: 2403968 - RNA, 22 nt, Bordetella pertussis
uccuggucuuccgguacgcgca

SEQ ID NO: 2403969 - RNA, 13 nt, Bordetella pertussis
uccugguucaggc

SEQ ID NO: 2403970 - RNA, 23 nt, Bordetella pertussis
uccugguugaccgagcccggcac

SEQ ID NO: 2403971 - RNA, 18 nt, Bordetella pertussis
uccugguugccgaggacg

SEQ ID NO: 2403972 - RNA, 15 nt, Bordetella pertussis
uccuguauuccugac

SEQ ID NO: 2403973 - RNA, 16 nt, Bordetella pertussis
uccugugggggcgcgg

SEQ ID NO: 2403974 - RNA, 17 nt, Bordetella pertussis
uccugugggggcgcggc

SEQ ID NO: 2403975 - RNA, 16 nt, Bordetella pertussis
uccuguucgccaaucu

SEQ ID NO: 2403976 - RNA, 18 nt, Bordetella pertussis
uccuucaucguggcugcc

SEQ ID NO: 2403977 - RNA, 17 nt, Bordetella pertussis
uccuucugggucggcau

SEQ ID NO: 2403978 - RNA, 15 nt, Bordetella pertussis
uccuugaacgccuug

SEQ ID NO: 2403979 - RNA, 21 nt, Bordetella pertussis
uccuugaggaacuggacggcg

SEQ ID NO: 2403980 - RNA, 15 nt, Bordetella pertussis
uccuugcgaugccag

SEQ ID NO: 2403981 - RNA, 16 nt, Bordetella pertussis
uccuuggaguucuucu

SEQ ID NO: 2403982 - RNA, 17 nt, Bordetella pertussis
uccuuggaguucuucuu

SEQ ID NO: 2403983 - RNA, 18 nt, Bordetella pertussis
uccuuggugccguaaucc

SEQ ID NO: 2403984 - RNA, 22 nt, Bordetella pertussis
ucgaaacccuuguagccggacu

SEQ ID NO: 2403985 - RNA, 15 nt, Bordetella pertussis
ucgaaaccggcgcgc

SEQ ID NO: 2403986 - RNA, 23 nt, Bordetella pertussis
ucgaaagccagcgccugcgcggc

SEQ ID NO: 2403987 - RNA, 19 nt, Bordetella pertussis
ucgaacaaggcgguggcca

SEQ ID NO: 2403988 - RNA, 21 nt, Bordetella pertussis
ucgaacaaggcgguggccagc

SEQ ID NO: 2403989 - RNA, 15 nt, Bordetella pertussis
ucgaacaccagguuu

SEQ ID NO: 2403990 - RNA, 19 nt, Bordetella pertussis
ucgaacaccggcuuggccu

SEQ ID NO: 2403991 - RNA, 15 nt, Bordetella pertussis
ucgaacagcagcuug

SEQ ID NO: 2403992 - RNA, 16 nt, Bordetella pertussis
ucgaacagcaucagcu

SEQ ID NO: 2403993 - RNA, 17 nt, Bordetella pertussis
ucgaacagcugcagcga

SEQ ID NO: 2403994 - RNA, 18 nt, Bordetella pertussis
ucgaacagcugcagcgac

SEQ ID NO: 2403995 - RNA, 18 nt, Bordetella pertussis
ucgaacaggccaucgccg

SEQ ID NO: 2403996 - RNA, 22 nt, Bordetella pertussis
ucgaacaggccaucgccgccgc

SEQ ID NO: 2403997 - RNA, 17 nt, Bordetella pertussis
ucgaacgccucgggcgc

SEQ ID NO: 2403998 - RNA, 23 nt, Bordetella pertussis
ucgaacggaaacccuucgcgcag

SEQ ID NO: 2403999 - RNA, 14 nt, Bordetella pertussis
ucgaacguccgccc

SEQ ID NO: 2404000 - RNA, 21 nt, Bordetella pertussis
ucgaacgugcugacgguaagc

SEQ ID NO: 2404001 - RNA, 13 nt, Bordetella pertussis
ucgaacguggcgg

SEQ ID NO: 2404002 - RNA, 21 nt, Bordetella pertussis
ucgaacuccucgacgucgccc

SEQ ID NO: 2404003 - RNA, 13 nt, Bordetella pertussis
ucgaacucgccga

SEQ ID NO: 2404004 - RNA, 23 nt, Bordetella pertussis
ucgaagacaugcugcgacagcag

SEQ ID NO: 2404005 - RNA, 22 nt, Bordetella pertussis
ucgaagaccucggcgcucagga

SEQ ID NO: 2404006 - RNA, 22 nt, Bordetella pertussis
ucgaagaggguuauuuccggcc

SEQ ID NO: 2404007 - RNA, 19 nt, Bordetella pertussis
ucgaagaucaacaaggcga

SEQ ID NO: 2404008 - RNA, 12 nt, Bordetella pertussis
ucgaagaucucg

SEQ ID NO: 2404009 - RNA, 14 nt, Bordetella pertussis
ucgaagcccggcag

SEQ ID NO: 2404010 - RNA, 13 nt, Bordetella pertussis
ucgaagccgggcg

SEQ ID NO: 2404011 - RNA, 14 nt, Bordetella pertussis
ucgaagccggugau

SEQ ID NO: 2404012 - RNA, 18 nt, Bordetella pertussis
ucgaagcggcucaggcgc

SEQ ID NO: 2404013 - RNA, 20 nt, Bordetella pertussis
ucgaaggcagcgcggccggc

SEQ ID NO: 2404014 - RNA, 16 nt, Bordetella pertussis
ucgaaggcgccgacgg

SEQ ID NO: 2404015 - RNA, 19 nt, Bordetella pertussis
ucgaaggcgcgcuccagca

SEQ ID NO: 2404016 - RNA, 15 nt, Bordetella pertussis
ucgaaggcggccggc

SEQ ID NO: 2404017 - RNA, 17 nt, Bordetella pertussis
ucgaaggcggccggcag

SEQ ID NO: 2404018 - RNA, 19 nt, Bordetella pertussis
ucgaaggcggccggcaggc

SEQ ID NO: 2404019 - RNA, 21 nt, Bordetella pertussis
ucgaaggcggccggcaggccg

SEQ ID NO: 2404020 - RNA, 17 nt, Bordetella pertussis
ucgaauccucucgcccc

SEQ ID NO: 2404021 - RNA, 19 nt, Bordetella pertussis
ucgaaugcacgggcgcugc

SEQ ID NO: 2404022 - RNA, 17 nt, Bordetella pertussis
ucgaauggcugcgcgcc

SEQ ID NO: 2404023 - RNA, 20 nt, Bordetella pertussis
ucgacaacaagccgggcgcc

SEQ ID NO: 2404024 - RNA, 17 nt, Bordetella pertussis
ucgacaccaaccugcug

SEQ ID NO: 2404025 - RNA, 20 nt, Bordetella pertussis
ucgacaccuacauccuggau

SEQ ID NO: 2404026 - RNA, 22 nt, Bordetella pertussis
ucgacaccuacauccuggaugu

SEQ ID NO: 2404027 - RNA, 20 nt, Bordetella pertussis
ucgacacggggcaaccggcc

SEQ ID NO: 2404028 - RNA, 20 nt, Bordetella pertussis
ucgacagcagcccgcuggcc

SEQ ID NO: 2404029 - RNA, 20 nt, Bordetella pertussis
ucgacagcaugaacggcagc

SEQ ID NO: 2404030 - RNA, 13 nt, Bordetella pertussis
ucgacagcgcgcc

SEQ ID NO: 2404031 - RNA, 14 nt, Bordetella pertussis
ucgacagcgcgccc

SEQ ID NO: 2404032 - RNA, 12 nt, Bordetella pertussis
ucgacagguagc

SEQ ID NO: 2404033 - RNA, 14 nt, Bordetella pertussis
ucgacauacgcgau

SEQ ID NO: 2404034 - RNA, 17 nt, Bordetella pertussis
ucgacauagacgcgcag

SEQ ID NO: 2404035 - RNA, 20 nt, Bordetella pertussis
ucgacauagagauuguccag

SEQ ID NO: 2404036 - RNA, 17 nt, Bordetella pertussis
ucgacaugcccgccggc

SEQ ID NO: 2404037 - RNA, 16 nt, Bordetella pertussis
ucgacaugcuggccca

SEQ ID NO: 2404038 - RNA, 23 nt, Bordetella pertussis
ucgaccaccggcuugggcgugcc

SEQ ID NO: 2404039 - RNA, 14 nt, Bordetella pertussis
ucgaccacgcgcgc

SEQ ID NO: 2404040 - RNA, 19 nt, Bordetella pertussis
ucgaccacgcguccccgca

SEQ ID NO: 2404041 - RNA, 13 nt, Bordetella pertussis
ucgaccagcagcc

SEQ ID NO: 2404042 - RNA, 14 nt, Bordetella pertussis
ucgaccagcauccu

SEQ ID NO: 2404043 - RNA, 18 nt, Bordetella pertussis
ucgaccagcccggccgcc

SEQ ID NO: 2404044 - RNA, 20 nt, Bordetella pertussis
ucgaccagcccggccgccag

SEQ ID NO: 2404045 - RNA, 17 nt, Bordetella pertussis
ucgaccagcgacagcac

SEQ ID NO: 2404046 - RNA, 15 nt, Bordetella pertussis
ucgaccagcgcacgg

SEQ ID NO: 2404047 - RNA, 15 nt, Bordetella pertussis
ucgaccagcgcgcgg

SEQ ID NO: 2404048 - RNA, 22 nt, Bordetella pertussis
ucgaccagcgcgcggugccgcc

SEQ ID NO: 2404049 - RNA, 15 nt, Bordetella pertussis
ucgaccaggaaguug

SEQ ID NO: 2404050 - RNA, 18 nt, Bordetella pertussis
ucgaccaggccggugcgc

SEQ ID NO: 2404051 - RNA, 20 nt, Bordetella pertussis
ucgaccaggccggugcgcac

SEQ ID NO: 2404052 - RNA, 16 nt, Bordetella pertussis
ucgaccaggucgaagc

SEQ ID NO: 2404053 - RNA, 23 nt, Bordetella pertussis
ucgaccaggucgccguacucgcc

SEQ ID NO: 2404054 - RNA, 18 nt, Bordetella pertussis
ucgaccaucauggccagg

SEQ ID NO: 2404055 - RNA, 19 nt, Bordetella pertussis
ucgaccaucauggccaggg

SEQ ID NO: 2404056 - RNA, 21 nt, Bordetella pertussis
ucgaccaucauggccagggcc

SEQ ID NO: 2404057 - RNA, 16 nt, Bordetella pertussis
ucgaccauguccgcgc

SEQ ID NO: 2404058 - RNA, 17 nt, Bordetella pertussis
ucgaccauguccgcgcc

SEQ ID NO: 2404059 - RNA, 18 nt, Bordetella pertussis
ucgaccauguccgcgccc

SEQ ID NO: 2404060 - RNA, 20 nt, Bordetella pertussis
ucgacccacuugagcagcgc

SEQ ID NO: 2404061 - RNA, 21 nt, Bordetella pertussis
ucgacccacuugagcagcgcc

SEQ ID NO: 2404062 - RNA, 22 nt, Bordetella pertussis
ucgacccacuugagcagcgccu

SEQ ID NO: 2404063 - RNA, 17 nt, Bordetella pertussis
ucgacccaggccggcgc

SEQ ID NO: 2404064 - RNA, 18 nt, Bordetella pertussis
ucgacccaggccggcgcc

SEQ ID NO: 2404065 - RNA, 15 nt, Bordetella pertussis
ucgaccccgucgacc

SEQ ID NO: 2404066 - RNA, 19 nt, Bordetella pertussis
ucgacccgaaggcgcggcc

SEQ ID NO: 2404067 - RNA, 14 nt, Bordetella pertussis
ucgacccgcgccuc

SEQ ID NO: 2404068 - RNA, 17 nt, Bordetella pertussis
ucgacccgcucggccac

SEQ ID NO: 2404069 - RNA, 16 nt, Bordetella pertussis
ucgacccggacaacgc

SEQ ID NO: 2404070 - RNA, 17 nt, Bordetella pertussis
ucgacccggacaacgcg

SEQ ID NO: 2404071 - RNA, 20 nt, Bordetella pertussis
ucgacccggacaacgcgcgc

SEQ ID NO: 2404072 - RNA, 23 nt, Bordetella pertussis
ucgacccggacaacgcgcgccac

SEQ ID NO: 2404073 - RNA, 13 nt, Bordetella pertussis
ucgaccgcaugcg

SEQ ID NO: 2404074 - RNA, 16 nt, Bordetella pertussis
ucgaccgcgggcgcgc

SEQ ID NO: 2404075 - RNA, 19 nt, Bordetella pertussis
ucgaccgcuucggucagcu

SEQ ID NO: 2404076 - RNA, 20 nt, Bordetella pertussis
ucgaccugcuugcccagcag

SEQ ID NO: 2404077 - RNA, 16 nt, Bordetella pertussis
ucgaccuugcugacgc

SEQ ID NO: 2404078 - RNA, 15 nt, Bordetella pertussis
ucgaccuugucgccc

SEQ ID NO: 2404079 - RNA, 18 nt, Bordetella pertussis
ucgacgaacacgcgcgcc

SEQ ID NO: 2404080 - RNA, 14 nt, Bordetella pertussis
ucgacgaagcgcgu

SEQ ID NO: 2404081 - RNA, 18 nt, Bordetella pertussis
ucgacgacggcaagucga

SEQ ID NO: 2404082 - RNA, 21 nt, Bordetella pertussis
ucgacgacggcaagucgacgc

SEQ ID NO: 2404083 - RNA, 22 nt, Bordetella pertussis
ucgacgacggcaagucgacgcu

SEQ ID NO: 2404084 - RNA, 15 nt, Bordetella pertussis
ucgacgagaugccga

SEQ ID NO: 2404085 - RNA, 21 nt, Bordetella pertussis
ucgacgagaugccgaugaugg

SEQ ID NO: 2404086 - RNA, 18 nt, Bordetella pertussis
ucgacgaggggguguucu

SEQ ID NO: 2404087 - RNA, 14 nt, Bordetella pertussis
ucgacgauggcggg

SEQ ID NO: 2404088 - RNA, 19 nt, Bordetella pertussis
ucgacgcagcagccgcuag

SEQ ID NO: 2404089 - RNA, 22 nt, Bordetella pertussis
ucgacgcagccuucguccugcc

SEQ ID NO: 2404090 - RNA, 19 nt, Bordetella pertussis
ucgacgccaucucgcgcgc

SEQ ID NO: 2404091 - RNA, 14 nt, Bordetella pertussis
ucgacgcccgggcg

SEQ ID NO: 2404092 - RNA, 13 nt, Bordetella pertussis
ucgacgccggcag

SEQ ID NO: 2404093 - RNA, 16 nt, Bordetella pertussis
ucgacgccggcgacgu

SEQ ID NO: 2404094 - RNA, 19 nt, Bordetella pertussis
ucgacgccguacugggcac

SEQ ID NO: 2404095 - RNA, 20 nt, Bordetella pertussis
ucgacgcgaugcccgcgcac

SEQ ID NO: 2404096 - RNA, 20 nt, Bordetella pertussis
ucgacgcgcgucgugcccgc

SEQ ID NO: 2404097 - RNA, 16 nt, Bordetella pertussis
ucgacgcggccgaccc

SEQ ID NO: 2404098 - RNA, 16 nt, Bordetella pertussis
ucgacggccgcaagcu

SEQ ID NO: 2404099 - RNA, 22 nt, Bordetella pertussis
ucgacggcgccuauugcgacgc

SEQ ID NO: 2404100 - RNA, 16 nt, Bordetella pertussis
ucgacggugcgcgcca

SEQ ID NO: 2404101 - RNA, 16 nt, Bordetella pertussis
ucgacguaagugccca

SEQ ID NO: 2404102 - RNA, 19 nt, Bordetella pertussis
ucgacguaagugcccaggc

SEQ ID NO: 2404103 - RNA, 15 nt, Bordetella pertussis
ucgacguccuggugg

SEQ ID NO: 2404104 - RNA, 20 nt, Bordetella pertussis
ucgacguccugguggaccug

SEQ ID NO: 2404105 - RNA, 18 nt, Bordetella pertussis
ucgacgucguaccccgag

SEQ ID NO: 2404106 - RNA, 14 nt, Bordetella pertussis
ucgacuucgacccg

SEQ ID NO: 2404107 - RNA, 19 nt, Bordetella pertussis
ucgacuucguccggcgcgu

SEQ ID NO: 2404108 - RNA, 14 nt, Bordetella pertussis
ucgagaaaccagcc

SEQ ID NO: 2404109 - RNA, 19 nt, Bordetella pertussis
ucgagaaguuggcgggcgc

SEQ ID NO: 2404110 - RNA, 22 nt, Bordetella pertussis
ucgagaaguuggcgggcgcuuc

SEQ ID NO: 2404111 - RNA, 23 nt, Bordetella pertussis
ucgagagccugggcgcgcgccca

SEQ ID NO: 2404112 - RNA, 15 nt, Bordetella pertussis
ucgagcaagggccag

SEQ ID NO: 2404113 - RNA, 13 nt, Bordetella pertussis
ucgagcaccgcgc

SEQ ID NO: 2404114 - RNA, 14 nt, Bordetella pertussis
ucgagcaccgcgcg

SEQ ID NO: 2404115 - RNA, 17 nt, Bordetella pertussis
ucgagcaccgugaccug

SEQ ID NO: 2404116 - RNA, 16 nt, Bordetella pertussis
ucgagcacgcggcgcg

SEQ ID NO: 2404117 - RNA, 18 nt, Bordetella pertussis
ucgagcacgcggcgcggc

SEQ ID NO: 2404118 - RNA, 22 nt, Bordetella pertussis
ucgagcacgguuucgccgugcu

SEQ ID NO: 2404119 - RNA, 20 nt, Bordetella pertussis
ucgagcacuucgagcgacgg

SEQ ID NO: 2404120 - RNA, 13 nt, Bordetella pertussis
ucgagcagcgcau

SEQ ID NO: 2404121 - RNA, 16 nt, Bordetella pertussis
ucgagcaggccgccgc

SEQ ID NO: 2404122 - RNA, 13 nt, Bordetella pertussis
ucgagcaggcgca

SEQ ID NO: 2404123 - RNA, 16 nt, Bordetella pertussis
ucgagcaggcgcaggc

SEQ ID NO: 2404124 - RNA, 22 nt, Bordetella pertussis
ucgagcaggcgcaggccgcgcg

SEQ ID NO: 2404125 - RNA, 14 nt, Bordetella pertussis
ucgagcaggcgcgc

SEQ ID NO: 2404126 - RNA, 15 nt, Bordetella pertussis
ucgagcaggcgcgcg

SEQ ID NO: 2404127 - RNA, 16 nt, Bordetella pertussis
ucgagcaggcgcgcgg

SEQ ID NO: 2404128 - RNA, 19 nt, Bordetella pertussis
ucgagcaucauggcgcgcg

SEQ ID NO: 2404129 - RNA, 21 nt, Bordetella pertussis
ucgagcaucauggcgcgcgcc

SEQ ID NO: 2404130 - RNA, 15 nt, Bordetella pertussis
ucgagcaugcgggcc

SEQ ID NO: 2404131 - RNA, 23 nt, Bordetella pertussis
ucgagcaugcgggccaugucggc

SEQ ID NO: 2404132 - RNA, 20 nt, Bordetella pertussis
ucgagcauugccgcggcaaa

SEQ ID NO: 2404133 - RNA, 14 nt, Bordetella pertussis
ucgagccaggugga

SEQ ID NO: 2404134 - RNA, 19 nt, Bordetella pertussis
ucgagccagguggacagcg

SEQ ID NO: 2404135 - RNA, 21 nt, Bordetella pertussis
ucgagccgcagaacagcagcg

SEQ ID NO: 2404136 - RNA, 22 nt, Bordetella pertussis
ucgagccgcagaacagcagcgu

SEQ ID NO: 2404137 - RNA, 16 nt, Bordetella pertussis
ucgagccggacguggg

SEQ ID NO: 2404138 - RNA, 20 nt, Bordetella pertussis
ucgagccggacgugggcgcc

SEQ ID NO: 2404139 - RNA, 14 nt, Bordetella pertussis
ucgagccgggcgcc

SEQ ID NO: 2404140 - RNA, 15 nt, Bordetella pertussis
ucgagccgguacagc

SEQ ID NO: 2404141 - RNA, 23 nt, Bordetella pertussis
ucgagcgccgaagucggcucguc

SEQ ID NO: 2404142 - RNA, 20 nt, Bordetella pertussis
ucgagcgccugcgccacguc

SEQ ID NO: 2404143 - RNA, 23 nt, Bordetella pertussis
ucgagcgccugcgccacguccag

SEQ ID NO: 2404144 - RNA, 17 nt, Bordetella pertussis
ucgagcgccugggcggc

SEQ ID NO: 2404145 - RNA, 20 nt, Bordetella pertussis
ucgagcgccugggcggccac

SEQ ID NO: 2404146 - RNA, 13 nt, Bordetella pertussis
ucgagcgcgcgca

SEQ ID NO: 2404147 - RNA, 15 nt, Bordetella pertussis
ucgagcgcggccagg

SEQ ID NO: 2404148 - RNA, 18 nt, Bordetella pertussis
ucgagcgcggccaggcgc

SEQ ID NO: 2404149 - RNA, 22 nt, Bordetella pertussis
ucgagcgcggccaggcgcgugc

SEQ ID NO: 2404150 - RNA, 15 nt, Bordetella pertussis
ucgagcgcggcgcgc

SEQ ID NO: 2404151 - RNA, 16 nt, Bordetella pertussis
ucgagcggcagcagcg

SEQ ID NO: 2404152 - RNA, 11 nt, Bordetella pertussis
ucgagcuggcc

SEQ ID NO: 2404153 - RNA, 14 nt, Bordetella pertussis
ucgaggaaagcggc

SEQ ID NO: 2404154 - RNA, 15 nt, Bordetella pertussis
ucgaggaaggcccgc

SEQ ID NO: 2404155 - RNA, 19 nt, Bordetella pertussis
ucgaggaccugaccgugca

SEQ ID NO: 2404156 - RNA, 20 nt, Bordetella pertussis
ucgaggagcugcugugcgcc

SEQ ID NO: 2404157 - RNA, 18 nt, Bordetella pertussis
ucgaggaucaaggcccgg

SEQ ID NO: 2404158 - RNA, 19 nt, Bordetella pertussis
ucgaggcaaucagccccag

SEQ ID NO: 2404159 - RNA, 12 nt, Bordetella pertussis
ucgaggccaggc

SEQ ID NO: 2404160 - RNA, 15 nt, Bordetella pertussis
ucgaggccaggcuga

SEQ ID NO: 2404161 - RNA, 12 nt, Bordetella pertussis
ucgaggcgcugg

SEQ ID NO: 2404162 - RNA, 13 nt, Bordetella pertussis
ucgaggcgcuggc

SEQ ID NO: 2404163 - RNA, 13 nt, Bordetella pertussis
ucgaggcggcgca

SEQ ID NO: 2404164 - RNA, 16 nt, Bordetella pertussis
ucgaggucagcggcuu

SEQ ID NO: 2404165 - RNA, 13 nt, Bordetella pertussis
ucgagguggcgca

SEQ ID NO: 2404166 - RNA, 14 nt, Bordetella pertussis
ucgagguggcgcau

SEQ ID NO: 2404167 - RNA, 23 nt, Bordetella pertussis
ucgaguagaaguaggcggccagg

SEQ ID NO: 2404168 - RNA, 17 nt, Bordetella pertussis
ucgaguuccgcgacgcg

SEQ ID NO: 2404169 - RNA, 16 nt, Bordetella pertussis
ucgaguucggcgcgcc

SEQ ID NO: 2404170 - RNA, 21 nt, Bordetella pertussis
ucgaguuugcgguccaugucg

SEQ ID NO: 2404171 - RNA, 20 nt, Bordetella pertussis
ucgauaccaacugccugcag

SEQ ID NO: 2404172 - RNA, 21 nt, Bordetella pertussis
gugcacacgccuucggcgacu

SEQ ID NO: 2404173 - RNA, 17 nt, Bordetella pertussis
gugcaccacgcgcucca

SEQ ID NO: 2404174 - RNA, 21 nt, Bordetella pertussis
gugcaccacgcgcuccaugau

SEQ ID NO: 2404175 - RNA, 20 nt, Bordetella pertussis
gugcaccaggccacccgccg

SEQ ID NO: 2404176 - RNA, 17 nt, Bordetella pertussis
gugcacgaugcccaggg

SEQ ID NO: 2404177 - RNA, 14 nt, Bordetella pertussis
gugcacgcccgcgg

SEQ ID NO: 2404178 - RNA, 18 nt, Bordetella pertussis
gugcacgcccgcggcgcc

SEQ ID NO: 2404179 - RNA, 19 nt, Bordetella pertussis
gugcacgcccgcggcgccc

SEQ ID NO: 2404180 - RNA, 20 nt, Bordetella pertussis
gugcacgcguaugcccugcg

SEQ ID NO: 2404181 - RNA, 14 nt, Bordetella pertussis
gugcacgugggcac

SEQ ID NO: 2404182 - RNA, 16 nt, Bordetella pertussis
gugcagaucugcacgc

SEQ ID NO: 2404183 - RNA, 17 nt, Bordetella pertussis
gugcagaucugcacgcu

SEQ ID NO: 2404184 - RNA, 16 nt, Bordetella pertussis
gugcagcaacgccggc

SEQ ID NO: 2404185 - RNA, 17 nt, Bordetella pertussis
gugcagcaacgccggcg

SEQ ID NO: 2404186 - RNA, 20 nt, Bordetella pertussis
gugcagcaacgccggcggca

SEQ ID NO: 2404187 - RNA, 13 nt, Bordetella pertussis
gugcagccacgcc

SEQ ID NO: 2404188 - RNA, 18 nt, Bordetella pertussis
gugcagccacgccuggcc

SEQ ID NO: 2404189 - RNA, 13 nt, Bordetella pertussis
gugcagccagcgg

SEQ ID NO: 2404190 - RNA, 16 nt, Bordetella pertussis
gugcagccagcggccg

SEQ ID NO: 2404191 - RNA, 18 nt, Bordetella pertussis
gugcagccagcggccgau

SEQ ID NO: 2404192 - RNA, 14 nt, Bordetella pertussis
gugcagcccagcac

SEQ ID NO: 2404193 - RNA, 16 nt, Bordetella pertussis
gugcagcccagcacca

SEQ ID NO: 2404194 - RNA, 16 nt, Bordetella pertussis
gugcagccgccgcagg

SEQ ID NO: 2404195 - RNA, 20 nt, Bordetella pertussis
gugcagcgacuugucgcgcc

SEQ ID NO: 2404196 - RNA, 21 nt, Bordetella pertussis
gugcagcgacuugucgcgccc

SEQ ID NO: 2404197 - RNA, 14 nt, Bordetella pertussis
gugcagcgcacggu

SEQ ID NO: 2404198 - RNA, 15 nt, Bordetella pertussis
gugcagcgccgcgcg

SEQ ID NO: 2404199 - RNA, 19 nt, Bordetella pertussis
gugcagcggcagcauggcg

SEQ ID NO: 2404200 - RNA, 22 nt, Bordetella pertussis
gugcaggacgaacaggccgccg

SEQ ID NO: 2404201 - RNA, 23 nt, Bordetella pertussis
gugcaggccaacgggauccggca

SEQ ID NO: 2404202 - RNA, 13 nt, Bordetella pertussis
gugcaggcccggg

SEQ ID NO: 2404203 - RNA, 23 nt, Bordetella pertussis
gugcaggcccgggcgccugcgcc

SEQ ID NO: 2404204 - RNA, 14 nt, Bordetella pertussis
gugcagggccaggu

SEQ ID NO: 2404205 - RNA, 17 nt, Bordetella pertussis
gugcaggggccgcacgc

SEQ ID NO: 2404206 - RNA, 21 nt, Bordetella pertussis
gugcaggggccgcacgcgcgg

SEQ ID NO: 2404207 - RNA, 19 nt, Bordetella pertussis
gugcaggggguggcggccg

SEQ ID NO: 2404208 - RNA, 21 nt, Bordetella pertussis
gugcaggggguggcggccguc

SEQ ID NO: 2404209 - RNA, 19 nt, Bordetella pertussis
gugcaggguuggcgcgccg

SEQ ID NO: 2404210 - RNA, 16 nt, Bordetella pertussis
gugcagguaggacggc

SEQ ID NO: 2404211 - RNA, 15 nt, Bordetella pertussis
gugcaucaucugggc

SEQ ID NO: 2404212 - RNA, 14 nt, Bordetella pertussis
gugcaucggccggc

SEQ ID NO: 2404213 - RNA, 16 nt, Bordetella pertussis
gugcaugacggccagg

SEQ ID NO: 2404214 - RNA, 17 nt, Bordetella pertussis
gugcaugacggccagga

SEQ ID NO: 2404215 - RNA, 20 nt, Bordetella pertussis
gugcaugacggccaggaugg

SEQ ID NO: 2404216 - RNA, 20 nt, Bordetella pertussis
gugccagcaggucgcgcacg

SEQ ID NO: 2404217 - RNA, 21 nt, Bordetella pertussis
gugccagcaggucgcgcacgc

SEQ ID NO: 2404218 - RNA, 23 nt, Bordetella pertussis
gugccagcccccugcggggucug

SEQ ID NO: 2404219 - RNA, 15 nt, Bordetella pertussis
gugccagccgcuggc

SEQ ID NO: 2404220 - RNA, 16 nt, Bordetella pertussis
gugccaggugaacacc

SEQ ID NO: 2404221 - RNA, 18 nt, Bordetella pertussis
gugccaguccccaugcgg

SEQ ID NO: 2404222 - RNA, 22 nt, Bordetella pertussis
gugccagucccccugcggggac

SEQ ID NO: 2404223 - RNA, 22 nt, Bordetella pertussis
gugccaguccccguucggggac

SEQ ID NO: 2404224 - RNA, 16 nt, Bordetella pertussis
gugccaguccccugcg

SEQ ID NO: 2404225 - RNA, 19 nt, Bordetella pertussis
gugccagucuccaggcuca

SEQ ID NO: 2404226 - RNA, 18 nt, Bordetella pertussis
gugccauggacgccggua

SEQ ID NO: 2404227 - RNA, 13 nt, Bordetella pertussis
gugcccagcacca

SEQ ID NO: 2404228 - RNA, 15 nt, Bordetella pertussis
gugcccagcaccagg

SEQ ID NO: 2404229 - RNA, 19 nt, Bordetella pertussis
gugcccagcaccaggccga

SEQ ID NO: 2404230 - RNA, 12 nt, Bordetella pertussis
gugcccaggccc

SEQ ID NO: 2404231 - RNA, 14 nt, Bordetella pertussis
gugcccagggccac

SEQ ID NO: 2404232 - RNA, 17 nt, Bordetella pertussis
gugcccaguucgcggcc

SEQ ID NO: 2404233 - RNA, 18 nt, Bordetella pertussis
gugcccaguucgcggccg

SEQ ID NO: 2404234 - RNA, 21 nt, Bordetella pertussis
gugcccaguuucgcgaccacc

SEQ ID NO: 2404235 - RNA, 15 nt, Bordetella pertussis
gugccccacacgcgc

SEQ ID NO: 2404236 - RNA, 13 nt, Bordetella pertussis
gugccccaugcgc

SEQ ID NO: 2404237 - RNA, 15 nt, Bordetella pertussis
gugccccaugcgcgg

SEQ ID NO: 2404238 - RNA, 15 nt, Bordetella pertussis
gugccccgccggagg

SEQ ID NO: 2404239 - RNA, 14 nt, Bordetella pertussis
gugccccggccucg

SEQ ID NO: 2404240 - RNA, 17 nt, Bordetella pertussis
gugccccggccucgcgg

SEQ ID NO: 2404241 - RNA, 13 nt, Bordetella pertussis
gugcccgacggac

SEQ ID NO: 2404242 - RNA, 17 nt, Bordetella pertussis
gugcccgacggacuggc

SEQ ID NO: 2404243 - RNA, 19 nt, Bordetella pertussis
gugcccgagggcgcgucga

SEQ ID NO: 2404244 - RNA, 17 nt, Bordetella pertussis
gugcccgcgaagcagcc

SEQ ID NO: 2404245 - RNA, 22 nt, Bordetella pertussis
gugcccgcgaagcagccggcca

SEQ ID NO: 2404246 - RNA, 13 nt, Bordetella pertussis
gugcccgcuggcc

SEQ ID NO: 2404247 - RNA, 11 nt, Bordetella pertussis
gugcccggcgg

SEQ ID NO: 2404248 - RNA, 15 nt, Bordetella pertussis
gugcccguagcagau

SEQ ID NO: 2404249 - RNA, 17 nt, Bordetella pertussis
gugcccguugccgcgcg

SEQ ID NO: 2404250 - RNA, 19 nt, Bordetella pertussis
gugcccucgcugcgcguca

SEQ ID NO: 2404251 - RNA, 18 nt, Bordetella pertussis
gugcccugacccgcuggc

SEQ ID NO: 2404252 - RNA, 20 nt, Bordetella pertussis
gugcccugacccgcuggcug

SEQ ID NO: 2404253 - RNA, 22 nt, Bordetella pertussis
gugcccugacccgcuggcuggc

SEQ ID NO: 2404254 - RNA, 14 nt, Bordetella pertussis
gugcccugcggcgc

SEQ ID NO: 2404255 - RNA, 23 nt, Bordetella pertussis
gugcccugcucccacgaacgcca

SEQ ID NO: 2404256 - RNA, 21 nt, Bordetella pertussis
gugccgcacgguggcgccguc

SEQ ID NO: 2404257 - RNA, 22 nt, Bordetella pertussis
gugccgcacgguggcgccgucg

SEQ ID NO: 2404258 - RNA, 16 nt, Bordetella pertussis
gugccgcagcgaggug

SEQ ID NO: 2404259 - RNA, 17 nt, Bordetella pertussis
gugccgcaggccagccc

SEQ ID NO: 2404260 - RNA, 13 nt, Bordetella pertussis
gugccgcccagga

SEQ ID NO: 2404261 - RNA, 15 nt, Bordetella pertussis
gugccgcccaggagc

SEQ ID NO: 2404262 - RNA, 20 nt, Bordetella pertussis
gugccgcccgguucgccguc

SEQ ID NO: 2404263 - RNA, 15 nt, Bordetella pertussis
gugccgcccuugggc

SEQ ID NO: 2404264 - RNA, 14 nt, Bordetella pertussis
gugccgccgagcag

SEQ ID NO: 2404265 - RNA, 13 nt, Bordetella pertussis
gugccgccgagga

SEQ ID NO: 2404266 - RNA, 18 nt, Bordetella pertussis
gugccgccgaggaucagc

SEQ ID NO: 2404267 - RNA, 22 nt, Bordetella pertussis
gugccgccgcccgacagcacgc

SEQ ID NO: 2404268 - RNA, 15 nt, Bordetella pertussis
gugccgccggcgcgg

SEQ ID NO: 2404269 - RNA, 16 nt, Bordetella pertussis
gugccgccggcgcggc

SEQ ID NO: 2404270 - RNA, 19 nt, Bordetella pertussis
gugccgccggcgcggcugc

SEQ ID NO: 2404271 - RNA, 17 nt, Bordetella pertussis
gugccgccuggccagau

SEQ ID NO: 2404272 - RNA, 13 nt, Bordetella pertussis
gugccgccuucgc

SEQ ID NO: 2404273 - RNA, 15 nt, Bordetella pertussis
gugccgcgagaaaau

SEQ ID NO: 2404274 - RNA, 17 nt, Bordetella pertussis
gugccgcgcacccaggc

SEQ ID NO: 2404275 - RNA, 16 nt, Bordetella pertussis
gugccgcgcaggcccu

SEQ ID NO: 2404276 - RNA, 14 nt, Bordetella pertussis
gugccgcgcagguc

SEQ ID NO: 2404277 - RNA, 21 nt, Bordetella pertussis
gugccgcgccggucgccgcgg

SEQ ID NO: 2404278 - RNA, 15 nt, Bordetella pertussis
gugccgcgcgcaccg

SEQ ID NO: 2404279 - RNA, 18 nt, Bordetella pertussis
gugccgcgcgcggccggc

SEQ ID NO: 2404280 - RNA, 19 nt, Bordetella pertussis
gugccgcgcgcggccggca

SEQ ID NO: 2404281 - RNA, 22 nt, Bordetella pertussis
gugccgcgcgcggccggcacca

SEQ ID NO: 2404282 - RNA, 22 nt, Bordetella pertussis
gugccgcgcugggcgcugcugc

SEQ ID NO: 2404283 - RNA, 23 nt, Bordetella pertussis
gugccgcguaugcggcagcaggg

SEQ ID NO: 2404284 - RNA, 24 nt, Bordetella pertussis
gugccgcuggcggcccugccgauc

SEQ ID NO: 2404285 - RNA, 15 nt, Bordetella pertussis
gugccggacgcccug

SEQ ID NO: 2404286 - RNA, 14 nt, Bordetella pertussis
gugccggacgccga

SEQ ID NO: 2404287 - RNA, 22 nt, Bordetella pertussis
gugccggagcccgucaggcgga

SEQ ID NO: 2404288 - RNA, 16 nt, Bordetella pertussis
gugccggauggcgcgg

SEQ ID NO: 2404289 - RNA, 22 nt, Bordetella pertussis
gugccggccgccuccaggcggc

SEQ ID NO: 2404290 - RNA, 18 nt, Bordetella pertussis
gugccggccggaccgcug

SEQ ID NO: 2404291 - RNA, 16 nt, Bordetella pertussis
gugccgggaugcugcu

SEQ ID NO: 2404292 - RNA, 18 nt, Bordetella pertussis
gugccgggaugcugcucg

SEQ ID NO: 2404293 - RNA, 16 nt, Bordetella pertussis
gugccgggcagcauca

SEQ ID NO: 2404294 - RNA, 13 nt, Bordetella pertussis
gugccgggccugg

SEQ ID NO: 2404295 - RNA, 20 nt, Bordetella pertussis
gugccgggcuugcgcacccc

SEQ ID NO: 2404296 - RNA, 18 nt, Bordetella pertussis
gugccgguugcgcgccga

SEQ ID NO: 2404297 - RNA, 15 nt, Bordetella pertussis
gugccguucccgccg

SEQ ID NO: 2404298 - RNA, 16 nt, Bordetella pertussis
gugccguucccgccgg

SEQ ID NO: 2404299 - RNA, 18 nt, Bordetella pertussis
gugccguucccgccgggc

SEQ ID NO: 2404300 - RNA, 17 nt, Bordetella pertussis
gugccguucggccagcg

SEQ ID NO: 2404301 - RNA, 18 nt, Bordetella pertussis
gugccguucggccagcgc

SEQ ID NO: 2404302 - RNA, 21 nt, Bordetella pertussis
gugccguucggccagcgcgcg

SEQ ID NO: 2404303 - RNA, 21 nt, Bordetella pertussis
gugccucaacuggccggccug

SEQ ID NO: 2404304 - RNA, 23 nt, Bordetella pertussis
gugccucaacuggccggccuggc

SEQ ID NO: 2404305 - RNA, 16 nt, Bordetella pertussis
gugccugccaagcgcc

SEQ ID NO: 2404306 - RNA, 15 nt, Bordetella pertussis
gugccugccccugcg

SEQ ID NO: 2404307 - RNA, 20 nt, Bordetella pertussis
gugccugccccugcggggac

SEQ ID NO: 2404308 - RNA, 21 nt, Bordetella pertussis
gugccugccccugcggggaca

SEQ ID NO: 2404309 - RNA, 22 nt, Bordetella pertussis
gugccugccccugcggggacag

SEQ ID NO: 2404310 - RNA, 19 nt, Bordetella pertussis
gugccugcgaacgcccggc

SEQ ID NO: 2404311 - RNA, 21 nt, Bordetella pertussis
gugccugcgaacgcccggccc

SEQ ID NO: 2404312 - RNA, 12 nt, Bordetella pertussis
gugccugcuugc

SEQ ID NO: 2404313 - RNA, 19 nt, Bordetella pertussis
gugccugcuugcaggaagc

SEQ ID NO: 2404314 - RNA, 21 nt, Bordetella pertussis
gugccugcuuguacaggcgcg

SEQ ID NO: 2404315 - RNA, 17 nt, Bordetella pertussis
gugccuggcuccccggg

SEQ ID NO: 2404316 - RNA, 21 nt, Bordetella pertussis
gugccugucccaaccgggaca

SEQ ID NO: 2404317 - RNA, 16 nt, Bordetella pertussis
gugccugucccagcgg

SEQ ID NO: 2404318 - RNA, 20 nt, Bordetella pertussis
gugccugucccagcggggac

SEQ ID NO: 2404319 - RNA, 23 nt, Bordetella pertussis
gugccugucccagcggggacagg

SEQ ID NO: 2404320 - RNA, 15 nt, Bordetella pertussis
gugccuguccccaca

SEQ ID NO: 2404321 - RNA, 17 nt, Bordetella pertussis
gugccuguccccacagg

SEQ ID NO: 2404322 - RNA, 22 nt, Bordetella pertussis
gugccuguccccacagggggac

SEQ ID NO: 2404323 - RNA, 16 nt, Bordetella pertussis
gugccuguccccacau

SEQ ID NO: 2404324 - RNA, 18 nt, Bordetella pertussis
gugccuguccccacaugg

SEQ ID NO: 2404325 - RNA, 21 nt, Bordetella pertussis
gugccuguccccaccgggaca

SEQ ID NO: 2404326 - RNA, 15 nt, Bordetella pertussis
gugccuguccccacg

SEQ ID NO: 2404327 - RNA, 23 nt, Bordetella pertussis
gugccuguccccacggggacagg

SEQ ID NO: 2404328 - RNA, 21 nt, Bordetella pertussis
gugccuguccccacguggaca

SEQ ID NO: 2404329 - RNA, 22 nt, Bordetella pertussis
gugccuguccccgaacggggac

SEQ ID NO: 2404330 - RNA, 18 nt, Bordetella pertussis
gugccuguccccgcacgg

SEQ ID NO: 2404331 - RNA, 19 nt, Bordetella pertussis
gugccuguccccgcacggg

SEQ ID NO: 2404332 - RNA, 17 nt, Bordetella pertussis
gugccuguccccgccgg

SEQ ID NO: 2404333 - RNA, 19 nt, Bordetella pertussis
gugccuguccccgccggga

SEQ ID NO: 2404334 - RNA, 16 nt, Bordetella pertussis
gugccuguccccgcgg

SEQ ID NO: 2404335 - RNA, 17 nt, Bordetella pertussis
gugccuguccccgcggg

SEQ ID NO: 2404336 - RNA, 19 nt, Bordetella pertussis
gugccuguccccgcgggga

SEQ ID NO: 2404337 - RNA, 21 nt, Bordetella pertussis
gugccuguccccgcggggaca

SEQ ID NO: 2404338 - RNA, 23 nt, Bordetella pertussis
gugccuguccccgcggggacagg

SEQ ID NO: 2404339 - RNA, 19 nt, Bordetella pertussis
gugccuguccccgcuggga

SEQ ID NO: 2404340 - RNA, 20 nt, Bordetella pertussis
gugccuguccccgcugggac

SEQ ID NO: 2404341 - RNA, 23 nt, Bordetella pertussis
gugccuguccccguggggacagg

SEQ ID NO: 2404342 - RNA, 16 nt, Bordetella pertussis
gugccugucccggcug

SEQ ID NO: 2404343 - RNA, 16 nt, Bordetella pertussis
gugccugucccugccg

SEQ ID NO: 2404344 - RNA, 23 nt, Bordetella pertussis
gugccugucccugccgggacagg

SEQ ID NO: 2404345 - RNA, 20 nt, Bordetella pertussis
gugccugucccugcgggggc

SEQ ID NO: 2404346 - RNA, 22 nt, Bordetella pertussis
gugccuguccuccccgcugacc

SEQ ID NO: 2404347 - RNA, 14 nt, Bordetella pertussis
gugccuugccggcc

SEQ ID NO: 2404348 - RNA, 16 nt, Bordetella pertussis
gugccuugcggcgccg

SEQ ID NO: 2404349 - RNA, 20 nt, Bordetella pertussis
gugcgaauuccgguucacca

SEQ ID NO: 2404350 - RNA, 14 nt, Bordetella pertussis
gugcgacugcagga

SEQ ID NO: 2404351 - RNA, 22 nt, Bordetella pertussis
gugcgacugcaggaugaggcgc

SEQ ID NO: 2404352 - RNA, 20 nt, Bordetella pertussis
gugcgagagcuccagccggg

SEQ ID NO: 2404353 - RNA, 22 nt, Bordetella pertussis
gugcgagcacggcguggcgcgc

SEQ ID NO: 2404354 - RNA, 15 nt, Bordetella pertussis
gugcgaggacgacca

SEQ ID NO: 2404355 - RNA, 19 nt, Bordetella pertussis
gugcgaggcgaacaggcac

SEQ ID NO: 2404356 - RNA, 14 nt, Bordetella pertussis
gugcgauggcacgg

SEQ ID NO: 2404357 - RNA, 17 nt, Bordetella pertussis
gugcgcaacgcgcgcgc

SEQ ID NO: 2404358 - RNA, 22 nt, Bordetella pertussis
gugcgcaacgcgcgcgcgcaca

SEQ ID NO: 2404359 - RNA, 19 nt, Bordetella pertussis
gugcgcaccuugcccacgc

SEQ ID NO: 2404360 - RNA, 15 nt, Bordetella pertussis
gugcgcagcaccagc

SEQ ID NO: 2404361 - RNA, 19 nt, Bordetella pertussis
gugcgcagcaccagcaugu

SEQ ID NO: 2404362 - RNA, 13 nt, Bordetella pertussis
gugcgcagccggg

SEQ ID NO: 2404363 - RNA, 18 nt, Bordetella pertussis
gugcgcaggcgcguggcc

SEQ ID NO: 2404364 - RNA, 19 nt, Bordetella pertussis
gugcgcaggcgcguggcca

SEQ ID NO: 2404365 - RNA, 19 nt, Bordetella pertussis
gugcgcauacagggcggug

SEQ ID NO: 2404366 - RNA, 12 nt, Bordetella pertussis
gugcgcaucagc

SEQ ID NO: 2404367 - RNA, 15 nt, Bordetella pertussis
gugcgccacagcaug

SEQ ID NO: 2404368 - RNA, 20 nt, Bordetella pertussis
gugcgccacgauguagccga

SEQ ID NO: 2404369 - RNA, 12 nt, Bordetella pertussis
gugcgccagcgc

SEQ ID NO: 2404370 - RNA, 14 nt, Bordetella pertussis
gugcgccagcgcca

SEQ ID NO: 2404371 - RNA, 14 nt, Bordetella pertussis
gugcgccagcgcga

SEQ ID NO: 2404372 - RNA, 12 nt, Bordetella pertussis
gugcgccaggca

SEQ ID NO: 2404373 - RNA, 22 nt, Bordetella pertussis
gugcgccaggcaaaggcccagg

SEQ ID NO: 2404374 - RNA, 23 nt, Bordetella pertussis
gugcgccaggcaaaggcccaggc

SEQ ID NO: 2404375 - RNA, 14 nt, Bordetella pertussis
gugcgcccauggcg

SEQ ID NO: 2404376 - RNA, 15 nt, Bordetella pertussis
gugcgcccauggcgc

SEQ ID NO: 2404377 - RNA, 23 nt, Bordetella pertussis
gugcgccgccgccgcggccuggc

SEQ ID NO: 2404378 - RNA, 13 nt, Bordetella pertussis
gugcgccgccggc

SEQ ID NO: 2404379 - RNA, 12 nt, Bordetella pertussis
gugcgccgcgcc

SEQ ID NO: 2404380 - RNA, 13 nt, Bordetella pertussis
gugcgccggcgcg

SEQ ID NO: 2404381 - RNA, 14 nt, Bordetella pertussis
gugcgccggcgcgg

SEQ ID NO: 2404382 - RNA, 15 nt, Bordetella pertussis
gugcgccggcgcggc

SEQ ID NO: 2404383 - RNA, 16 nt, Bordetella pertussis
gugcgccggcgcggcg

SEQ ID NO: 2404384 - RNA, 14 nt, Bordetella pertussis
gugcgccggcggcg

SEQ ID NO: 2404385 - RNA, 20 nt, Bordetella pertussis
gugcgccgugcccggcgggc

SEQ ID NO: 2404386 - RNA, 17 nt, Bordetella pertussis
gugcgccugcagcgccg

SEQ ID NO: 2404387 - RNA, 16 nt, Bordetella pertussis
gugcgcgaccgcgcgg

SEQ ID NO: 2404388 - RNA, 20 nt, Bordetella pertussis
gugcgcgaccgcgcggcgcu

SEQ ID NO: 2404389 - RNA, 22 nt, Bordetella pertussis
gugcgcgccaggucgcgcacca

SEQ ID NO: 2404390 - RNA, 23 nt, Bordetella pertussis
gugcgcgccaggucgcgcaccag

SEQ ID NO: 2404391 - RNA, 20 nt, Bordetella pertussis
gugcgcgcgcccccagcgcc

SEQ ID NO: 2404392 - RNA, 12 nt, Bordetella pertussis
gugcgcggccgc

SEQ ID NO: 2404393 - RNA, 12 nt, Bordetella pertussis
gugcgcggcgca

SEQ ID NO: 2404394 - RNA, 17 nt, Bordetella pertussis
gugcgcggcgcagccca

SEQ ID NO: 2404395 - RNA, 13 nt, Bordetella pertussis
gugcgcggcgccc

SEQ ID NO: 2404396 - RNA, 15 nt, Bordetella pertussis
gugcgcggcgcgccg

SEQ ID NO: 2404397 - RNA, 17 nt, Bordetella pertussis
gugcgcggcgcgccguc

SEQ ID NO: 2404398 - RNA, 13 nt, Bordetella pertussis
gugcgcggcgugu

SEQ ID NO: 2404399 - RNA, 14 nt, Bordetella pertussis
gugcgcggcguuga

SEQ ID NO: 2404400 - RNA, 14 nt, Bordetella pertussis
gugcgcgggcgcgg

SEQ ID NO: 2404401 - RNA, 19 nt, Bordetella pertussis
gugcgcgggcgcggcaggc

SEQ ID NO: 2404402 - RNA, 20 nt, Bordetella pertussis
gugcgcgggcgcggcaggcg

SEQ ID NO: 2404403 - RNA, 14 nt, Bordetella pertussis
gugcgcgugggcac

SEQ ID NO: 2404404 - RNA, 22 nt, Bordetella pertussis
gugcgcguuaaccucccgauau

SEQ ID NO: 2404405 - RNA, 16 nt, Bordetella pertussis
gugcgcguuccggccg

SEQ ID NO: 2404406 - RNA, 22 nt, Bordetella pertussis
gugcgcuaccgcuucccuggca

SEQ ID NO: 2404407 - RNA, 17 nt, Bordetella pertussis
gugcgcuggcugggccu

SEQ ID NO: 2404408 - RNA, 19 nt, Bordetella pertussis
gugcgcuggcugggccugc

SEQ ID NO: 2404409 - RNA, 15 nt, Bordetella pertussis
gugcggaggcggccg

SEQ ID NO: 2404410 - RNA, 16 nt, Bordetella pertussis
gugcggaggcggccgc

SEQ ID NO: 2404411 - RNA, 19 nt, Bordetella pertussis
gugcggaucaagcggcccg

SEQ ID NO: 2404412 - RNA, 20 nt, Bordetella pertussis
gugcggaucaagcggcccgc

SEQ ID NO: 2404413 - RNA, 15 nt, Bordetella pertussis
gugcggaucaugggc

SEQ ID NO: 2404414 - RNA, 20 nt, Bordetella pertussis
gugcggauggucgagcgccu

SEQ ID NO: 2404415 - RNA, 19 nt, Bordetella pertussis
gugcggcacgcacagcaug

SEQ ID NO: 2404416 - RNA, 13 nt, Bordetella pertussis
gugcggccaugau

SEQ ID NO: 2404417 - RNA, 14 nt, Bordetella pertussis
gugcggcccagccg

SEQ ID NO: 2404418 - RNA, 16 nt, Bordetella pertussis
gugcggcccagccgcu

SEQ ID NO: 2404419 - RNA, 14 nt, Bordetella pertussis
gugcggccgcagcg

SEQ ID NO: 2404420 - RNA, 17 nt, Bordetella pertussis
gugcggccucggcgggc

SEQ ID NO: 2404421 - RNA, 21 nt, Bordetella pertussis
gugcggccucggcgggcggcg

SEQ ID NO: 2404422 - RNA, 24 nt, Bordetella pertussis
gugcggccucggcgggcggcgcca

SEQ ID NO: 2404423 - RNA, 21 nt, Bordetella pertussis
gugcggcgccacugccaggcg

SEQ ID NO: 2404424 - RNA, 15 nt, Bordetella pertussis
gugcggcgccagcug

SEQ ID NO: 2404425 - RNA, 16 nt, Bordetella pertussis
gugcggcgccugcguc

SEQ ID NO: 2404426 - RNA, 14 nt, Bordetella pertussis
gugcggcguggcgg

SEQ ID NO: 2404427 - RNA, 14 nt, Bordetella pertussis
gugcgggacaggca

SEQ ID NO: 2404428 - RNA, 18 nt, Bordetella pertussis
gugcgggcaaacggcggc

SEQ ID NO: 2404429 - RNA, 13 nt, Bordetella pertussis
gugcgggccggcg

SEQ ID NO: 2404430 - RNA, 16 nt, Bordetella pertussis
gugcgggccggcgcgc

SEQ ID NO: 2404431 - RNA, 15 nt, Bordetella pertussis
gugcggggaccggca

SEQ ID NO: 2404432 - RNA, 14 nt, Bordetella pertussis
gugcggggcggcag

SEQ ID NO: 2404433 - RNA, 16 nt, Bordetella pertussis
gugcggggcggcaggu

SEQ ID NO: 2404434 - RNA, 14 nt, Bordetella pertussis
gugcggggugccug

SEQ ID NO: 2404435 - RNA, 15 nt, Bordetella pertussis
gugcgggugggcgcg

SEQ ID NO: 2404436 - RNA, 18 nt, Bordetella pertussis
gugcgguaggcgcccgac

SEQ ID NO: 2404437 - RNA, 17 nt, Bordetella pertussis
gugcgguucgucagggc

SEQ ID NO: 2404438 - RNA, 16 nt, Bordetella pertussis
gugcguaccagcccag

SEQ ID NO: 2404439 - RNA, 15 nt, Bordetella pertussis
gugcgucacgcacag

SEQ ID NO: 2404440 - RNA, 20 nt, Bordetella pertussis
gugcgucacgcacagcaccu

SEQ ID NO: 2404441 - RNA, 12 nt, Bordetella pertussis
gugcguccagga

SEQ ID NO: 2404442 - RNA, 13 nt, Bordetella pertussis
gugcgugcggcug

SEQ ID NO: 2404443 - RNA, 19 nt, Bordetella pertussis
gugcguggugacccguccg

SEQ ID NO: 2404444 - RNA, 21 nt, Bordetella pertussis
gugcguuccaugacguccagc

SEQ ID NO: 2404445 - RNA, 21 nt, Bordetella pertussis
gugcucaucggcaggccggcg

SEQ ID NO: 2404446 - RNA, 23 nt, Bordetella pertussis
gugcucccaggaaaucaggcgca

SEQ ID NO: 2404447 - RNA, 15 nt, Bordetella pertussis
gugcuccugccaggc

SEQ ID NO: 2404448 - RNA, 17 nt, Bordetella pertussis
gugcucuggcccgccuc

SEQ ID NO: 2404449 - RNA, 18 nt, Bordetella pertussis
gugcugaacgccucgggc

SEQ ID NO: 2404450 - RNA, 21 nt, Bordetella pertussis
gugcugacgguaagcaccagg

SEQ ID NO: 2404451 - RNA, 14 nt, Bordetella pertussis
gugcugcaccugcg

SEQ ID NO: 2404452 - RNA, 18 nt, Bordetella pertussis
gugcugcaccugcgucug

SEQ ID NO: 2404453 - RNA, 22 nt, Bordetella pertussis
gugcugcaccugcgucugcacg

SEQ ID NO: 2404454 - RNA, 13 nt, Bordetella pertussis
gugcugcccugca

SEQ ID NO: 2404455 - RNA, 15 nt, Bordetella pertussis
gugcugcccugcaug

SEQ ID NO: 2404456 - RNA, 14 nt, Bordetella pertussis
gugcugcgccgccu

SEQ ID NO: 2404457 - RNA, 23 nt, Bordetella pertussis
gugcugcgccgccucgaccggcg

SEQ ID NO: 2404458 - RNA, 15 nt, Bordetella pertussis
gugcugcggcagcca

SEQ ID NO: 2404459 - RNA, 15 nt, Bordetella pertussis
gugcugcugcacgug

SEQ ID NO: 2404460 - RNA, 17 nt, Bordetella pertussis
gugcugcugcaggcgcg

SEQ ID NO: 2404461 - RNA, 23 nt, Bordetella pertussis
gugcugcuggagaucgccgagcg

SEQ ID NO: 2404462 - RNA, 13 nt, Bordetella pertussis
gugcugcugggcg

SEQ ID NO: 2404463 - RNA, 14 nt, Bordetella pertussis
gugcugcugggcgc

SEQ ID NO: 2404464 - RNA, 16 nt, Bordetella pertussis
gugcugcugggcgcca

SEQ ID NO: 2404465 - RNA, 19 nt, Bordetella pertussis
gugcugcuguucgccacgc

SEQ ID NO: 2404466 - RNA, 14 nt, Bordetella pertussis
gugcuggacccgcu

SEQ ID NO: 2404467 - RNA, 15 nt, Bordetella pertussis
gugcuggacccgcug

SEQ ID NO: 2404468 - RNA, 16 nt, Bordetella pertussis
gugcuggcacugucgg

SEQ ID NO: 2404469 - RNA, 12 nt, Bordetella pertussis
gugcuggcccgc

SEQ ID NO: 2404470 - RNA, 13 nt, Bordetella pertussis
gugcuggcccgcc

SEQ ID NO: 2404471 - RNA, 15 nt, Bordetella pertussis
gugcuggcccgccag

SEQ ID NO: 2404472 - RNA, 12 nt, Bordetella pertussis
gugcuggccgac

SEQ ID NO: 2404473 - RNA, 14 nt, Bordetella pertussis
gugcuggcgcagca

SEQ ID NO: 2404474 - RNA, 15 nt, Bordetella pertussis
gugcuggcgcagcag

SEQ ID NO: 2404475 - RNA, 14 nt, Bordetella pertussis
gugcuggcgcgugc

SEQ ID NO: 2404476 - RNA, 18 nt, Bordetella pertussis
gugcuggcugagcaggcc

SEQ ID NO: 2404477 - RNA, 21 nt, Bordetella pertussis
gugcuggcugagcaggccgau

SEQ ID NO: 2404478 - RNA, 14 nt, Bordetella pertussis
gugcugggccaugc

SEQ ID NO: 2404479 - RNA, 18 nt, Bordetella pertussis
gugcugggcggccaggcg

SEQ ID NO: 2404480 - RNA, 20 nt, Bordetella pertussis
gugcugggcggccaggcgga

SEQ ID NO: 2404481 - RNA, 18 nt, Bordetella pertussis
gugcugggcggcgggcac

SEQ ID NO: 2404482 - RNA, 13 nt, Bordetella pertussis
gugcuggugcugg

SEQ ID NO: 2404483 - RNA, 18 nt, Bordetella pertussis
gugcuggugcuggugcug

SEQ ID NO: 2404484 - RNA, 23 nt, Bordetella pertussis
gugcuguaccucagccugcuggu

SEQ ID NO: 2404485 - RNA, 16 nt, Bordetella pertussis
gugcuguucggcgacc

SEQ ID NO: 2404486 - RNA, 17 nt, Bordetella pertussis
gugcuguucggcgaccg

SEQ ID NO: 2404487 - RNA, 22 nt, Bordetella pertussis
gugcuguucggcgaccgccggc

SEQ ID NO: 2404488 - RNA, 22 nt, Bordetella pertussis
gugcuugaugcccagcucaugg

SEQ ID NO: 2404489 - RNA, 15 nt, Bordetella pertussis
gugcuugccgcagcg

SEQ ID NO: 2404490 - RNA, 23 nt, Bordetella pertussis
gugcuugccgcagcggccaugga

SEQ ID NO: 2404491 - RNA, 14 nt, Bordetella pertussis
guggaacgaccacg

SEQ ID NO: 2404492 - RNA, 23 nt, Bordetella pertussis
guggaagaucacauaggccggca

SEQ ID NO: 2404493 - RNA, 17 nt, Bordetella pertussis
guggaagguccacggca

SEQ ID NO: 2404494 - RNA, 24 nt, Bordetella pertussis
guggacaggaacuccggcggcgca

SEQ ID NO: 2404495 - RNA, 17 nt, Bordetella pertussis
guggaccgcgcgguggc

SEQ ID NO: 2404496 - RNA, 14 nt, Bordetella pertussis
guggaccugccguu

SEQ ID NO: 2404497 - RNA, 23 nt, Bordetella pertussis
guggaccugccguucgcgcugcc

SEQ ID NO: 2404498 - RNA, 18 nt, Bordetella pertussis
guggacgaauacgcuggc

SEQ ID NO: 2404499 - RNA, 19 nt, Bordetella pertussis
guggacgccaagaccgcgg

SEQ ID NO: 2404500 - RNA, 20 nt, Bordetella pertussis
guggacgccaagaccgcggc

SEQ ID NO: 2404501 - RNA, 22 nt, Bordetella pertussis
guggacgccaagaccgcggccg

SEQ ID NO: 2404502 - RNA, 20 nt, Bordetella pertussis
guggacgccgccggcccagg

SEQ ID NO: 2404503 - RNA, 13 nt, Bordetella pertussis
guggacggccagc

SEQ ID NO: 2404504 - RNA, 16 nt, Bordetella pertussis
guggacggccagcagg

SEQ ID NO: 2404505 - RNA, 15 nt, Bordetella pertussis
guggacucgauggcg

SEQ ID NO: 2404506 - RNA, 18 nt, Bordetella pertussis
guggacucgauggcgcag

SEQ ID NO: 2404507 - RNA, 15 nt, Bordetella pertussis
guggagcgcggcgcu

SEQ ID NO: 2404508 - RNA, 14 nt, Bordetella pertussis
guggaggacgccga

SEQ ID NO: 2404509 - RNA, 20 nt, Bordetella pertussis
guggaggacgccgaccucgg

SEQ ID NO: 2404510 - RNA, 13 nt, Bordetella pertussis
guggaggcggcgg

SEQ ID NO: 2404511 - RNA, 20 nt, Bordetella pertussis
guggauccgccggugucggg

SEQ ID NO: 2404512 - RNA, 15 nt, Bordetella pertussis
guggaugauggucug

SEQ ID NO: 2404513 - RNA, 15 nt, Bordetella pertussis
guggaugggcuuuga

SEQ ID NO: 2404514 - RNA, 22 nt, Bordetella pertussis
guggaugggcuuugacgccggc

SEQ ID NO: 2404515 - RNA, 20 nt, Bordetella pertussis
guggcacagccgcagccguc

SEQ ID NO: 2404516 - RNA, 17 nt, Bordetella pertussis
guggcagagggcgacgg

SEQ ID NO: 2404517 - RNA, 19 nt, Bordetella pertussis
guggcaggcgucggccagc

SEQ ID NO: 2404518 - RNA, 17 nt, Bordetella pertussis
guggcaggugcggccgc

SEQ ID NO: 2404519 - RNA, 22 nt, Bordetella pertussis
guggccaacgauuccgcgucca

SEQ ID NO: 2404520 - RNA, 14 nt, Bordetella pertussis
guggccaagggcgc

SEQ ID NO: 2404521 - RNA, 12 nt, Bordetella pertussis
guggccaccagc

SEQ ID NO: 2404522 - RNA, 16 nt, Bordetella pertussis
guggccaccagcccca

SEQ ID NO: 2404523 - RNA, 16 nt, Bordetella pertussis
guggccaccaggcgcg

SEQ ID NO: 2404524 - RNA, 21 nt, Bordetella pertussis
guggccaccaggcgcgcgcca

SEQ ID NO: 2404525 - RNA, 21 nt, Bordetella pertussis
guggccacgcccaucugguug

SEQ ID NO: 2404526 - RNA, 13 nt, Bordetella pertussis
guggccacggccg

SEQ ID NO: 2404527 - RNA, 12 nt, Bordetella pertussis
guggccagcacg

SEQ ID NO: 2404528 - RNA, 19 nt, Bordetella pertussis
guggccagcacggcgcaca

SEQ ID NO: 2404529 - RNA, 15 nt, Bordetella pertussis
guggccagccaggcg

SEQ ID NO: 2404530 - RNA, 18 nt, Bordetella pertussis
guggccagcgccgccagc

SEQ ID NO: 2404531 - RNA, 20 nt, Bordetella pertussis
guggccagcgccgccagccg

SEQ ID NO: 2404532 - RNA, 23 nt, Bordetella pertussis
guggccagcgccgccagccgcug

SEQ ID NO: 2404533 - RNA, 16 nt, Bordetella pertussis
guggccaugcaccagc

SEQ ID NO: 2404534 - RNA, 17 nt, Bordetella pertussis
guggccaugcaccagca

SEQ ID NO: 2404535 - RNA, 16 nt, Bordetella pertussis
guggccaugcugggcg

SEQ ID NO: 2404536 - RNA, 17 nt, Bordetella pertussis
guggccaugcugggcgg

SEQ ID NO: 2404537 - RNA, 23 nt, Bordetella pertussis
guggccaugcugggcgggcuggu

SEQ ID NO: 2404538 - RNA, 18 nt, Bordetella pertussis
guggccauggacagcacc

SEQ ID NO: 2404539 - RNA, 19 nt, Bordetella pertussis
guggccauggacagcaccg

SEQ ID NO: 2404540 - RNA, 20 nt, Bordetella pertussis
guggccauggacagcaccga

SEQ ID NO: 2404541 - RNA, 13 nt, Bordetella pertussis
guggcccaagccc

SEQ ID NO: 2404542 - RNA, 20 nt, Bordetella pertussis
guggcccaagcccguggcgg

SEQ ID NO: 2404543 - RNA, 12 nt, Bordetella pertussis
guggcccagcac

SEQ ID NO: 2404544 - RNA, 15 nt, Bordetella pertussis
guggcccagcaccgc

SEQ ID NO: 2404545 - RNA, 17 nt, Bordetella pertussis
guggcccagcaccgccg

SEQ ID NO: 2404546 - RNA, 21 nt, Bordetella pertussis
guggcccagcaccgccgccag

SEQ ID NO: 2404547 - RNA, 13 nt, Bordetella pertussis
guggcccagccgc

SEQ ID NO: 2404548 - RNA, 14 nt, Bordetella pertussis
guggccccaggcgu

SEQ ID NO: 2404549 - RNA, 14 nt, Bordetella pertussis
guggcccgcaccgg

SEQ ID NO: 2404550 - RNA, 23 nt, Bordetella pertussis
guggcccgcaccgggcggcccgg

SEQ ID NO: 2404551 - RNA, 13 nt, Bordetella pertussis
guggcccgcgccg

SEQ ID NO: 2404552 - RNA, 20 nt, Bordetella pertussis
guggcccgcgugacggccgc

SEQ ID NO: 2404553 - RNA, 14 nt, Bordetella pertussis
guggccgagcgcac

SEQ ID NO: 2404554 - RNA, 17 nt, Bordetella pertussis
guggccgagcgcacccc

SEQ ID NO: 2404555 - RNA, 15 nt, Bordetella pertussis
guggccgcagucagg

SEQ ID NO: 2404556 - RNA, 14 nt, Bordetella pertussis
guggccgccgaacg

SEQ ID NO: 2404557 - RNA, 13 nt, Bordetella pertussis
guggccgccgggu

SEQ ID NO: 2404558 - RNA, 20 nt, Bordetella pertussis
guggccgccgggucgcugug

SEQ ID NO: 2404559 - RNA, 11 nt, Bordetella pertussis
guggccgcgcu

SEQ ID NO: 2404560 - RNA, 15 nt, Bordetella pertussis
guggccgcgcugcug

SEQ ID NO: 2404561 - RNA, 23 nt, Bordetella pertussis
guggccgcgcugcugcaggccgg

SEQ ID NO: 2404562 - RNA, 13 nt, Bordetella pertussis
guggccgcggucc

SEQ ID NO: 2404563 - RNA, 17 nt, Bordetella pertussis
guggccgcgguccgggc

SEQ ID NO: 2404564 - RNA, 19 nt, Bordetella pertussis
guggccgcgguccgggcca

SEQ ID NO: 2404565 - RNA, 12 nt, Bordetella pertussis
guggccgcucca

SEQ ID NO: 2404566 - RNA, 13 nt, Bordetella pertussis
guggccgcuccag

SEQ ID NO: 2404567 - RNA, 18 nt, Bordetella pertussis
guggccgcuccagagcgc

SEQ ID NO: 2404568 - RNA, 23 nt, Bordetella pertussis
guggccgcuguucggcgagccgg

SEQ ID NO: 2404569 - RNA, 15 nt, Bordetella pertussis
guggccgcuucggcg

SEQ ID NO: 2404570 - RNA, 17 nt, Bordetella pertussis
guggccgcuucggcggc

SEQ ID NO: 2404571 - RNA, 19 nt, Bordetella pertussis
guggccgcuucggcggcca

SEQ ID NO: 2404572 - RNA, 21 nt, Bordetella pertussis
guggccgcuucggcggccaug

SEQ ID NO: 2404573 - RNA, 20 nt, Bordetella pertussis
guggccgcuucggcggccgc

SEQ ID NO: 2404574 - RNA, 19 nt, Bordetella pertussis
guggccggaucgagcgcgg

SEQ ID NO: 2404575 - RNA, 14 nt, Bordetella pertussis
guggccggcgacgg

SEQ ID NO: 2404576 - RNA, 18 nt, Bordetella pertussis
guggccggcgacggcauc

SEQ ID NO: 2404577 - RNA, 15 nt, Bordetella pertussis
guggccggcgcggca

SEQ ID NO: 2404578 - RNA, 16 nt, Bordetella pertussis
guggccggcgcggcag

SEQ ID NO: 2404579 - RNA, 16 nt, Bordetella pertussis
guggccggcgggggcg

SEQ ID NO: 2404580 - RNA, 18 nt, Bordetella pertussis
guggccgggcccggcgcg

SEQ ID NO: 2404581 - RNA, 20 nt, Bordetella pertussis
guggccguagagggucuggc

SEQ ID NO: 2404582 - RNA, 13 nt, Bordetella pertussis
guggccguggcgg

SEQ ID NO: 2404583 - RNA, 16 nt, Bordetella pertussis
guggccguggcggcca

SEQ ID NO: 2404584 - RNA, 17 nt, Bordetella pertussis
guggccguggcggccac

SEQ ID NO: 2404585 - RNA, 21 nt, Bordetella pertussis
guggccucguaucgccugacg

SEQ ID NO: 2404586 - RNA, 22 nt, Bordetella pertussis
guggcgaagguggcacaucagc

SEQ ID NO: 2404587 - RNA, 19 nt, Bordetella pertussis
guggcgacgcccagccugc

SEQ ID NO: 2404588 - RNA, 21 nt, Bordetella pertussis
guggcgacgcccagccugccg

SEQ ID NO: 2404589 - RNA, 22 nt, Bordetella pertussis
guggcgacgcccagccugccgg

SEQ ID NO: 2404590 - RNA, 18 nt, Bordetella pertussis
guggcgacgcgcugccgg

SEQ ID NO: 2404591 - RNA, 18 nt, Bordetella pertussis
guggcgacgucgggcagg

SEQ ID NO: 2404592 - RNA, 15 nt, Bordetella pertussis
guggcgauagcgcuc

SEQ ID NO: 2404593 - RNA, 17 nt, Bordetella pertussis
guggcgauagcgcucca

SEQ ID NO: 2404594 - RNA, 18 nt, Bordetella pertussis
guggcgauagcgcuccag

SEQ ID NO: 2404595 - RNA, 19 nt, Bordetella pertussis
guggcgauagcgcuccagc

SEQ ID NO: 2404596 - RNA, 21 nt, Bordetella pertussis
guggcgauccagggccgccag

SEQ ID NO: 2404597 - RNA, 22 nt, Bordetella pertussis
guggcgauccauguggccagcu

SEQ ID NO: 2404598 - RNA, 13 nt, Bordetella pertussis
guggcgaugccgg

SEQ ID NO: 2404599 - RNA, 17 nt, Bordetella pertussis
guggcgauguucacgcg

SEQ ID NO: 2404600 - RNA, 19 nt, Bordetella pertussis
guggcgauuccuuccauga

SEQ ID NO: 2404601 - RNA, 20 nt, Bordetella pertussis
guggcgcaaggcaugcgcca

SEQ ID NO: 2404602 - RNA, 12 nt, Bordetella pertussis
guggcgcacccu

SEQ ID NO: 2404603 - RNA, 18 nt, Bordetella pertussis
guggcgcaccgcgcuggg

SEQ ID NO: 2404604 - RNA, 13 nt, Bordetella pertussis
guggcgcagaugg

SEQ ID NO: 2404605 - RNA, 18 nt, Bordetella pertussis
guggcgcagaugggcggc

SEQ ID NO: 2404606 - RNA, 20 nt, Bordetella pertussis
guggcgcagaugggcggcga

SEQ ID NO: 2404607 - RNA, 21 nt, Bordetella pertussis
guggcgcagaugggcggcgac

SEQ ID NO: 2404608 - RNA, 18 nt, Bordetella pertussis
guggcgcagcuccggguc

SEQ ID NO: 2404609 - RNA, 17 nt, Bordetella pertussis
guggcgcagugggccag

SEQ ID NO: 2404610 - RNA, 18 nt, Bordetella pertussis
guggcgcagugggccagu

SEQ ID NO: 2404611 - RNA, 14 nt, Bordetella pertussis
guggcgcauucgcc

SEQ ID NO: 2404612 - RNA, 19 nt, Bordetella pertussis
guggcgccgaaggcggcgc

SEQ ID NO: 2404613 - RNA, 20 nt, Bordetella pertussis
guggcgccgacccugcccgg

SEQ ID NO: 2404614 - RNA, 23 nt, Bordetella pertussis
guggcgccgacccugcccggcag

SEQ ID NO: 2404615 - RNA, 15 nt, Bordetella pertussis
guggcgccgcgggcc

SEQ ID NO: 2404616 - RNA, 14 nt, Bordetella pertussis
guggcgccggccac

SEQ ID NO: 2404617 - RNA, 13 nt, Bordetella pertussis
guggcgccguucc

SEQ ID NO: 2404618 - RNA, 22 nt, Bordetella pertussis
guggcgcgcacacuggccagca

SEQ ID NO: 2404619 - RNA, 23 nt, Bordetella pertussis
guggcgcgcacacuggccagcaa

SEQ ID NO: 2404620 - RNA, 19 nt, Bordetella pertussis
guggcgcgcaccugggagg

SEQ ID NO: 2404621 - RNA, 13 nt, Bordetella pertussis
guggcgcggcugc

SEQ ID NO: 2404622 - RNA, 20 nt, Bordetella pertussis
guggcgcuccaugcggcggc

SEQ ID NO: 2404623 - RNA, 16 nt, Bordetella pertussis
guggcgcucgcgccca

SEQ ID NO: 2404624 - RNA, 18 nt, Bordetella pertussis
guggcgcugcguccgguc

SEQ ID NO: 2404625 - RNA, 19 nt, Bordetella pertussis
guggcgcuguccggcgcuc

SEQ ID NO: 2404626 - RNA, 14 nt, Bordetella pertussis
guggcggacaggcc

SEQ ID NO: 2404627 - RNA, 12 nt, Bordetella pertussis
guggcggccagg

SEQ ID NO: 2404628 - RNA, 13 nt, Bordetella pertussis
guggcggccgcgg

SEQ ID NO: 2404629 - RNA, 18 nt, Bordetella pertussis
guggcggccgcgggcagc

SEQ ID NO: 2404630 - RNA, 13 nt, Bordetella pertussis
guggcggccgucg

SEQ ID NO: 2404631 - RNA, 12 nt, Bordetella pertussis
guggcggccugc

SEQ ID NO: 2404632 - RNA, 14 nt, Bordetella pertussis
guggcggcgacggc

SEQ ID NO: 2404633 - RNA, 12 nt, Bordetella pertussis
guggcgggccag

SEQ ID NO: 2404634 - RNA, 17 nt, Bordetella pertussis
guggcgggccagcuccc

SEQ ID NO: 2404635 - RNA, 22 nt, Bordetella pertussis
guggcgggcgccugcggcaggc

SEQ ID NO: 2404636 - RNA, 20 nt, Bordetella pertussis
guggcgggucccaaccaggg

SEQ ID NO: 2404637 - RNA, 21 nt, Bordetella pertussis
guggcgguagacgccgggacg

SEQ ID NO: 2404638 - RNA, 20 nt, Bordetella pertussis
guggcguaauagcuggcggc

SEQ ID NO: 2404639 - RNA, 22 nt, Bordetella pertussis
guggcguaguagcccaggccca

SEQ ID NO: 2404640 - RNA, 14 nt, Bordetella pertussis
guggcgugcagcag

SEQ ID NO: 2404641 - RNA, 15 nt, Bordetella pertussis
guggcgugcagcagg

SEQ ID NO: 2404642 - RNA, 17 nt, Bordetella pertussis
guggcgugcaggccggc

SEQ ID NO: 2404643 - RNA, 15 nt, Bordetella pertussis
guggcguucgcggug

SEQ ID NO: 2404644 - RNA, 19 nt, Bordetella pertussis
guggcguugacggcccagc

SEQ ID NO: 2404645 - RNA, 15 nt, Bordetella pertussis
guggcguuggccugc

SEQ ID NO: 2404646 - RNA, 20 nt, Bordetella pertussis
guggcugaaaucccccgcgu

SEQ ID NO: 2404647 - RNA, 16 nt, Bordetella pertussis
guggcugaacaucagc

SEQ ID NO: 2404648 - RNA, 23 nt, Bordetella pertussis
guggcugcgcaggucggccagga

SEQ ID NO: 2404649 - RNA, 15 nt, Bordetella pertussis
guggcuggcgaggac

SEQ ID NO: 2404650 - RNA, 16 nt, Bordetella pertussis
guggcuggcgaggacc

SEQ ID NO: 2404651 - RNA, 14 nt, Bordetella pertussis
guggcuggcgucga

SEQ ID NO: 2404652 - RNA, 23 nt, Bordetella pertussis
gugggaagacuucgucaacgccc

SEQ ID NO: 2404653 - RNA, 15 nt, Bordetella pertussis
ucgauaccgucgcgc

SEQ ID NO: 2404654 - RNA, 15 nt, Bordetella pertussis
ucgauacggccacgc

SEQ ID NO: 2404655 - RNA, 17 nt, Bordetella pertussis
ucgauacggccacgcag

SEQ ID NO: 2404656 - RNA, 19 nt, Bordetella pertussis
ucgauaugggcggccucgg

SEQ ID NO: 2404657 - RNA, 19 nt, Bordetella pertussis
ucgaucaccaccggcaagg

SEQ ID NO: 2404658 - RNA, 16 nt, Bordetella pertussis
ucgaucacgaagccca

SEQ ID NO: 2404659 - RNA, 18 nt, Bordetella pertussis
ucgaucacggcgcgcgcc

SEQ ID NO: 2404660 - RNA, 23 nt, Bordetella pertussis
ucgaucagccacgugaagcgccg

SEQ ID NO: 2404661 - RNA, 17 nt, Bordetella pertussis
ucgaucagccagccggc

SEQ ID NO: 2404662 - RNA, 14 nt, Bordetella pertussis
ucgaucagcgcgcc

SEQ ID NO: 2404663 - RNA, 22 nt, Bordetella pertussis
ucgaucaggcccagcacgauga

SEQ ID NO: 2404664 - RNA, 22 nt, Bordetella pertussis
ucgaucagggcgaacggggugg

SEQ ID NO: 2404665 - RNA, 16 nt, Bordetella pertussis
ucgaucaucaggucca

SEQ ID NO: 2404666 - RNA, 22 nt, Bordetella pertussis
ucgaucaugaugcgcugggcca

SEQ ID NO: 2404667 - RNA, 14 nt, Bordetella pertussis
ucgaucaugcccgc

SEQ ID NO: 2404668 - RNA, 15 nt, Bordetella pertussis
ucgaucaugcccgcc

SEQ ID NO: 2404669 - RNA, 19 nt, Bordetella pertussis
ucgaucauggccagccgcu

SEQ ID NO: 2404670 - RNA, 14 nt, Bordetella pertussis
ucgaucauggcgcc

SEQ ID NO: 2404671 - RNA, 17 nt, Bordetella pertussis
ucgauccggcagcagca

SEQ ID NO: 2404672 - RNA, 13 nt, Bordetella pertussis
ucgauccgggccu

SEQ ID NO: 2404673 - RNA, 15 nt, Bordetella pertussis
ucgauccgggccugg

SEQ ID NO: 2404674 - RNA, 19 nt, Bordetella pertussis
ucgaucgcaucgcggcagc

SEQ ID NO: 2404675 - RNA, 21 nt, Bordetella pertussis
ucgaucgccaggucggccagc

SEQ ID NO: 2404676 - RNA, 17 nt, Bordetella pertussis
ucgaucgccgccggcac

SEQ ID NO: 2404677 - RNA, 13 nt, Bordetella pertussis
ucgaucggcgcgc

SEQ ID NO: 2404678 - RNA, 14 nt, Bordetella pertussis
ucgaucggcgcgcc

SEQ ID NO: 2404679 - RNA, 18 nt, Bordetella pertussis
ucgaucgucuugaccagc

SEQ ID NO: 2404680 - RNA, 13 nt, Bordetella pertussis
ucgaucuggcuca

SEQ ID NO: 2404681 - RNA, 14 nt, Bordetella pertussis
ucgaucuggcucac

SEQ ID NO: 2404682 - RNA, 23 nt, Bordetella pertussis
ucgaugaacaagguacccgcgcc

SEQ ID NO: 2404683 - RNA, 23 nt, Bordetella pertussis
ucgaugaagaucaggcggcugcc

SEQ ID NO: 2404684 - RNA, 20 nt, Bordetella pertussis
ucgaugaauuccagccaggc

SEQ ID NO: 2404685 - RNA, 13 nt, Bordetella pertussis
ucgaugaccagcc

SEQ ID NO: 2404686 - RNA, 20 nt, Bordetella pertussis
ucgaugaccagcgccggcgc

SEQ ID NO: 2404687 - RNA, 15 nt, Bordetella pertussis
ucgaugaggccaggg

SEQ ID NO: 2404688 - RNA, 16 nt, Bordetella pertussis
ucgaugcccagcaccg

SEQ ID NO: 2404689 - RNA, 18 nt, Bordetella pertussis
ucgaugcccucgcgcacg

SEQ ID NO: 2404690 - RNA, 16 nt, Bordetella pertussis
ucgaugccgaccaggc

SEQ ID NO: 2404691 - RNA, 23 nt, Bordetella pertussis
ucgaugccgaccaggcugcgcgc

SEQ ID NO: 2404692 - RNA, 12 nt, Bordetella pertussis
ucgaugccggcg

SEQ ID NO: 2404693 - RNA, 15 nt, Bordetella pertussis
ucgaugcgcaccaug

SEQ ID NO: 2404694 - RNA, 19 nt, Bordetella pertussis
ucgaugcgccgcaccagcg

SEQ ID NO: 2404695 - RNA, 14 nt, Bordetella pertussis
ucgaugcgcuugcc

SEQ ID NO: 2404696 - RNA, 18 nt, Bordetella pertussis
ucgaugcgcuugccgacc

SEQ ID NO: 2404697 - RNA, 23 nt, Bordetella pertussis
ucgaugcgcuugccgaccuccag

SEQ ID NO: 2404698 - RNA, 17 nt, Bordetella pertussis
ucgaugcggucggccgc

SEQ ID NO: 2404699 - RNA, 19 nt, Bordetella pertussis
ucgaugcggucggccgcgc

SEQ ID NO: 2404700 - RNA, 21 nt, Bordetella pertussis
ucgaugcggucggccgcgccg

SEQ ID NO: 2404701 - RNA, 18 nt, Bordetella pertussis
ucgaugcguucgcccgug

SEQ ID NO: 2404702 - RNA, 13 nt, Bordetella pertussis
ucgaugcuggcgc

SEQ ID NO: 2404703 - RNA, 22 nt, Bordetella pertussis
ucgaugcuggcgcggaccugcu

SEQ ID NO: 2404704 - RNA, 15 nt, Bordetella pertussis
ucgauggccagggcg

SEQ ID NO: 2404705 - RNA, 16 nt, Bordetella pertussis
ucgauggccaggugca

SEQ ID NO: 2404706 - RNA, 16 nt, Bordetella pertussis
ucgauggcggccaggg

SEQ ID NO: 2404707 - RNA, 18 nt, Bordetella pertussis
ucgauggcggccagggca

SEQ ID NO: 2404708 - RNA, 23 nt, Bordetella pertussis
ucgauggcguacagcagggugcc

SEQ ID NO: 2404709 - RNA, 15 nt, Bordetella pertussis
ucgaugggcccgggc

SEQ ID NO: 2404710 - RNA, 17 nt, Bordetella pertussis
ucgaugggcccgggcag

SEQ ID NO: 2404711 - RNA, 19 nt, Bordetella pertussis
ucgaugggcccgggcaggc

SEQ ID NO: 2404712 - RNA, 13 nt, Bordetella pertussis
ucgaugggcgcgc

SEQ ID NO: 2404713 - RNA, 14 nt, Bordetella pertussis
ucgaugggcgcgcg

SEQ ID NO: 2404714 - RNA, 20 nt, Bordetella pertussis
ucgauggggucgggccgcgc

SEQ ID NO: 2404715 - RNA, 21 nt, Bordetella pertussis
ucgauggucaguccgcccagc

SEQ ID NO: 2404716 - RNA, 19 nt, Bordetella pertussis
ucgauguagagggucuggc

SEQ ID NO: 2404717 - RNA, 17 nt, Bordetella pertussis
ucgauguggccuaccgc

SEQ ID NO: 2404718 - RNA, 15 nt, Bordetella pertussis
ucgauguggcgcugg

SEQ ID NO: 2404719 - RNA, 17 nt, Bordetella pertussis
ucgauguggcgcuggcg

SEQ ID NO: 2404720 - RNA, 22 nt, Bordetella pertussis
ucgcaagugcuggcccgccagc

SEQ ID NO: 2404721 - RNA, 22 nt, Bordetella pertussis
ucgcaauacgucgcgaccgccg

SEQ ID NO: 2404722 - RNA, 16 nt, Bordetella pertussis
ucgcaaucgacgaaca

SEQ ID NO: 2404723 - RNA, 19 nt, Bordetella pertussis
ucgcacagccggggcgagc

SEQ ID NO: 2404724 - RNA, 20 nt, Bordetella pertussis
ucgcacagccggggcgagcg

SEQ ID NO: 2404725 - RNA, 24 nt, Bordetella pertussis
ucgcacagccggggcgagcgcagc

SEQ ID NO: 2404726 - RNA, 20 nt, Bordetella pertussis
ucgcacaguucgugcaccag

SEQ ID NO: 2404727 - RNA, 20 nt, Bordetella pertussis
ucgcacaucaggucgaccug

SEQ ID NO: 2404728 - RNA, 21 nt, Bordetella pertussis
ucgcaccagucccgcaccgac

SEQ ID NO: 2404729 - RNA, 21 nt, Bordetella pertussis
ucgcaccgcaaggaaguggcc

SEQ ID NO: 2404730 - RNA, 16 nt, Bordetella pertussis
ucgcacgacagcaucu

SEQ ID NO: 2404731 - RNA, 22 nt, Bordetella pertussis
ucgcacgcggcuucgcccggau

SEQ ID NO: 2404732 - RNA, 17 nt, Bordetella pertussis
ucgcacgugacgccggc

SEQ ID NO: 2404733 - RNA, 18 nt, Bordetella pertussis
ucgcacuggguggccagc

SEQ ID NO: 2404734 - RNA, 20 nt, Bordetella pertussis
ucgcacuggguuuuuccggc

SEQ ID NO: 2404735 - RNA, 22 nt, Bordetella pertussis
ucgcacuggguuuuuccggcuc

SEQ ID NO: 2404736 - RNA, 19 nt, Bordetella pertussis
ucgcagaaggucugggcca

SEQ ID NO: 2404737 - RNA, 13 nt, Bordetella pertussis
ucgcagcacgccc

SEQ ID NO: 2404738 - RNA, 16 nt, Bordetella pertussis
ucgcagcacgcccaga

SEQ ID NO: 2404739 - RNA, 16 nt, Bordetella pertussis
ucgcagcggaugccgc

SEQ ID NO: 2404740 - RNA, 20 nt, Bordetella pertussis
ucgcaggaauccuggugcca

SEQ ID NO: 2404741 - RNA, 14 nt, Bordetella pertussis
ucgcaggccgcggc

SEQ ID NO: 2404742 - RNA, 19 nt, Bordetella pertussis
ucgcaggccgcggccaggc

SEQ ID NO: 2404743 - RNA, 20 nt, Bordetella pertussis
ucgcaggccgcggccaggcc

SEQ ID NO: 2404744 - RNA, 23 nt, Bordetella pertussis
ucgcaucgcggcagcccggcacg

SEQ ID NO: 2404745 - RNA, 18 nt, Bordetella pertussis
ucgcaugcgguuucucag

SEQ ID NO: 2404746 - RNA, 16 nt, Bordetella pertussis
ucgcauuggccgccgc

SEQ ID NO: 2404747 - RNA, 16 nt, Bordetella pertussis
ucgccaaagcgcagcg

SEQ ID NO: 2404748 - RNA, 21 nt, Bordetella pertussis
ucgccaaucugccgcugaccg

SEQ ID NO: 2404749 - RNA, 23 nt, Bordetella pertussis
ucgccaccucgaucaccaccggc

SEQ ID NO: 2404750 - RNA, 23 nt, Bordetella pertussis
ucgccacgcuguugcgccugucc

SEQ ID NO: 2404751 - RNA, 20 nt, Bordetella pertussis
ucgccacgggcgucaccggc

SEQ ID NO: 2404752 - RNA, 21 nt, Bordetella pertussis
ucgccacgggcgucaccggcg

SEQ ID NO: 2404753 - RNA, 13 nt, Bordetella pertussis
ucgccagcaggcc

SEQ ID NO: 2404754 - RNA, 15 nt, Bordetella pertussis
ucgccagcaggcgcu

SEQ ID NO: 2404755 - RNA, 12 nt, Bordetella pertussis
ucgccagcgccg

SEQ ID NO: 2404756 - RNA, 14 nt, Bordetella pertussis
ucgccagcggcagc

SEQ ID NO: 2404757 - RNA, 17 nt, Bordetella pertussis
ucgccagcggcagcgcg

SEQ ID NO: 2404758 - RNA, 18 nt, Bordetella pertussis
ucgccagcggcagcgcgc

SEQ ID NO: 2404759 - RNA, 21 nt, Bordetella pertussis
ucgccaggacguccaggccuu

SEQ ID NO: 2404760 - RNA, 20 nt, Bordetella pertussis
ucgccagggcgaugaccggc

SEQ ID NO: 2404761 - RNA, 21 nt, Bordetella pertussis
ucgccaggucggccagccggc

SEQ ID NO: 2404762 - RNA, 16 nt, Bordetella pertussis
ucgccauccagguacg

SEQ ID NO: 2404763 - RNA, 15 nt, Bordetella pertussis
ucgccaucggccggc

SEQ ID NO: 2404764 - RNA, 15 nt, Bordetella pertussis
ucgccaucugcugcg

SEQ ID NO: 2404765 - RNA, 15 nt, Bordetella pertussis
ucgccaugccggccc

SEQ ID NO: 2404766 - RNA, 13 nt, Bordetella pertussis
ucgccaugcggcu

SEQ ID NO: 2404767 - RNA, 15 nt, Bordetella pertussis
ucgccaugcggcugg

SEQ ID NO: 2404768 - RNA, 13 nt, Bordetella pertussis
ucgccaugcugcc

SEQ ID NO: 2404769 - RNA, 14 nt, Bordetella pertussis
ucgcccaacccggc

SEQ ID NO: 2404770 - RNA, 20 nt, Bordetella pertussis
ucgcccacauagcggccggc

SEQ ID NO: 2404771 - RNA, 22 nt, Bordetella pertussis
ucgcccacauagcggccggcgc

SEQ ID NO: 2404772 - RNA, 20 nt, Bordetella pertussis
ucgcccaccaccagcggcgu

SEQ ID NO: 2404773 - RNA, 20 nt, Bordetella pertussis
ucgcccaccacgccgcccag

SEQ ID NO: 2404774 - RNA, 20 nt, Bordetella pertussis
ucgcccacccccggcaccag

SEQ ID NO: 2404775 - RNA, 13 nt, Bordetella pertussis
ucgcccagcaccu

SEQ ID NO: 2404776 - RNA, 21 nt, Bordetella pertussis
ucgcccagccgccugagcaca

SEQ ID NO: 2404777 - RNA, 21 nt, Bordetella pertussis
ucgcccagcgagccggccagc

SEQ ID NO: 2404778 - RNA, 16 nt, Bordetella pertussis
ucgcccagcggcgccg

SEQ ID NO: 2404779 - RNA, 19 nt, Bordetella pertussis
ucgcccagcggcgccgacc

SEQ ID NO: 2404780 - RNA, 20 nt, Bordetella pertussis
ucgcccaggccgggcgagcc

SEQ ID NO: 2404781 - RNA, 14 nt, Bordetella pertussis
ucgcccaugcgggc

SEQ ID NO: 2404782 - RNA, 20 nt, Bordetella pertussis
ucgcccauugcggcgggcgg

SEQ ID NO: 2404783 - RNA, 22 nt, Bordetella pertussis
ucgccccccaugccggaacagg

SEQ ID NO: 2404784 - RNA, 20 nt, Bordetella pertussis
ucgcccccgauccccugccc

SEQ ID NO: 2404785 - RNA, 14 nt, Bordetella pertussis
ucgccccgacgcgc

SEQ ID NO: 2404786 - RNA, 19 nt, Bordetella pertussis
ucgccccggcgcgcagcgc

SEQ ID NO: 2404787 - RNA, 20 nt, Bordetella pertussis
ucgccccggcgcgcagcgcc

SEQ ID NO: 2404788 - RNA, 17 nt, Bordetella pertussis
ucgcccgaccugcuggc

SEQ ID NO: 2404789 - RNA, 18 nt, Bordetella pertussis
ucgcccgaccugcuggcg

SEQ ID NO: 2404790 - RNA, 20 nt, Bordetella pertussis
ucgcccgaccugcuggcgcg

SEQ ID NO: 2404791 - RNA, 16 nt, Bordetella pertussis
ucgcccgaucggccgg

SEQ ID NO: 2404792 - RNA, 17 nt, Bordetella pertussis
ucgcccgaucggccggc

SEQ ID NO: 2404793 - RNA, 18 nt, Bordetella pertussis
ucgcccgcccacauggcg

SEQ ID NO: 2404794 - RNA, 13 nt, Bordetella pertussis
ucgcccgggcgcc

SEQ ID NO: 2404795 - RNA, 19 nt, Bordetella pertussis
ucgcccgggcgccggcacg

SEQ ID NO: 2404796 - RNA, 17 nt, Bordetella pertussis
ucgcccggguacggcag

SEQ ID NO: 2404797 - RNA, 14 nt, Bordetella pertussis
ucgcccucgcgcca

SEQ ID NO: 2404798 - RNA, 17 nt, Bordetella pertussis
ucgcccugcucgaucug

SEQ ID NO: 2404799 - RNA, 22 nt, Bordetella pertussis
ucgcccugcucgcgcagcgugg

SEQ ID NO: 2404800 - RNA, 22 nt, Bordetella pertussis
ucgcccugcuuguuccacgagg

SEQ ID NO: 2404801 - RNA, 12 nt, Bordetella pertussis
ucgcccuggaug

SEQ ID NO: 2404802 - RNA, 18 nt, Bordetella pertussis
ucgcccuggauggcggcc

SEQ ID NO: 2404803 - RNA, 20 nt, Bordetella pertussis
ucgcccuggauggcggccgc

SEQ ID NO: 2404804 - RNA, 23 nt, Bordetella pertussis
ucgcccuggauggcggccgccag

SEQ ID NO: 2404805 - RNA, 12 nt, Bordetella pertussis
ucgcccuggcgg

SEQ ID NO: 2404806 - RNA, 21 nt, Bordetella pertussis
ucgcccugucggugaugaucc

SEQ ID NO: 2404807 - RNA, 21 nt, Bordetella pertussis
ucgcccuucagguagccgaag

SEQ ID NO: 2404808 - RNA, 18 nt, Bordetella pertussis
ucgcccuugagcacggcg

SEQ ID NO: 2404809 - RNA, 22 nt, Bordetella pertussis
ucgcccuugagcacggcgcggc

SEQ ID NO: 2404810 - RNA, 18 nt, Bordetella pertussis
ucgcccuugauggccucg

SEQ ID NO: 2404811 - RNA, 16 nt, Bordetella pertussis
ucgccgaacugccggc

SEQ ID NO: 2404812 - RNA, 18 nt, Bordetella pertussis
ucgccgaacugccggcgc

SEQ ID NO: 2404813 - RNA, 20 nt, Bordetella pertussis
ucgccgaacugccggcgcgg

SEQ ID NO: 2404814 - RNA, 16 nt, Bordetella pertussis
ucgccgaagcaaugca

SEQ ID NO: 2404815 - RNA, 21 nt, Bordetella pertussis
ucgccgaagcaaugcagcgcg

SEQ ID NO: 2404816 - RNA, 17 nt, Bordetella pertussis
ucgccgacaggaugaag

SEQ ID NO: 2404817 - RNA, 18 nt, Bordetella pertussis
ucgccgacccgggcgggc

SEQ ID NO: 2404818 - RNA, 13 nt, Bordetella pertussis
ucgccgacgcgcc

SEQ ID NO: 2404819 - RNA, 15 nt, Bordetella pertussis
ucgccgagccgggcc

SEQ ID NO: 2404820 - RNA, 16 nt, Bordetella pertussis
ucgccgagccgggcca

SEQ ID NO: 2404821 - RNA, 12 nt, Bordetella pertussis
ucgccgaucggc

SEQ ID NO: 2404822 - RNA, 14 nt, Bordetella pertussis
ucgccgaucggcaa

SEQ ID NO: 2404823 - RNA, 24 nt, Bordetella pertussis
ucgccgaucggcuugccgcgcggc

SEQ ID NO: 2404824 - RNA, 15 nt, Bordetella pertussis
ucgccgcaccaggcc

SEQ ID NO: 2404825 - RNA, 16 nt, Bordetella pertussis
ucgccgcccagccggc

SEQ ID NO: 2404826 - RNA, 20 nt, Bordetella pertussis
ucgccgcccagccggccgau

SEQ ID NO: 2404827 - RNA, 14 nt, Bordetella pertussis
ucgccgcccugcug

SEQ ID NO: 2404828 - RNA, 21 nt, Bordetella pertussis
ucgccgcccugcugcccgccg

SEQ ID NO: 2404829 - RNA, 19 nt, Bordetella pertussis
ucgccgccgaagccgccgc

SEQ ID NO: 2404830 - RNA, 13 nt, Bordetella pertussis
ucgccgccgccau

SEQ ID NO: 2404831 - RNA, 17 nt, Bordetella pertussis
ucgccgccgccgggcug

SEQ ID NO: 2404832 - RNA, 22 nt, Bordetella pertussis
ucgccgccgccgggcuggaucc

SEQ ID NO: 2404833 - RNA, 16 nt, Bordetella pertussis
ucgccgccgcgcacca

SEQ ID NO: 2404834 - RNA, 13 nt, Bordetella pertussis
ucgccgccgcgcc

SEQ ID NO: 2404835 - RNA, 14 nt, Bordetella pertussis
ucgccgccgcgccg

SEQ ID NO: 2404836 - RNA, 22 nt, Bordetella pertussis
ucgccgccgcgcucggcgcugc

SEQ ID NO: 2404837 - RNA, 12 nt, Bordetella pertussis
ucgccgccugca

SEQ ID NO: 2404838 - RNA, 23 nt, Bordetella pertussis
ucgccgcgcacagcccgaucgac

SEQ ID NO: 2404839 - RNA, 14 nt, Bordetella pertussis
ucgccgcgcacgau

SEQ ID NO: 2404840 - RNA, 19 nt, Bordetella pertussis
ucgccgcgccagcugcgca

SEQ ID NO: 2404841 - RNA, 12 nt, Bordetella pertussis
ucgccgcgcccg

SEQ ID NO: 2404842 - RNA, 19 nt, Bordetella pertussis
ucgccgcgcgacagccgcg

SEQ ID NO: 2404843 - RNA, 23 nt, Bordetella pertussis
ucgccgcgcgacagccgcgccag

SEQ ID NO: 2404844 - RNA, 23 nt, Bordetella pertussis
ucgccgcgcgugcugacggaaua

SEQ ID NO: 2404845 - RNA, 16 nt, Bordetella pertussis
ucgccgcggccggcgc

SEQ ID NO: 2404846 - RNA, 19 nt, Bordetella pertussis
ucgccgcggccggcgcagu

SEQ ID NO: 2404847 - RNA, 23 nt, Bordetella pertussis
ucgccgcgucguucaucgcccau

SEQ ID NO: 2404848 - RNA, 22 nt, Bordetella pertussis
ucgccgcucaggauacgugcug

SEQ ID NO: 2404849 - RNA, 13 nt, Bordetella pertussis
ucgccgcugcgca

SEQ ID NO: 2404850 - RNA, 14 nt, Bordetella pertussis
ucgccgcugcgcag

SEQ ID NO: 2404851 - RNA, 13 nt, Bordetella pertussis
ucgccgcuggcca

SEQ ID NO: 2404852 - RNA, 15 nt, Bordetella pertussis
ucgccgcuggccagc

SEQ ID NO: 2404853 - RNA, 16 nt, Bordetella pertussis
ucgccgcuggccagcc

SEQ ID NO: 2404854 - RNA, 17 nt, Bordetella pertussis
ucgccgcugucgcagua

SEQ ID NO: 2404855 - RNA, 23 nt, Bordetella pertussis
ucgccggacacguacaaccgcgc

SEQ ID NO: 2404856 - RNA, 17 nt, Bordetella pertussis
ucgccggaggcgcgcag

SEQ ID NO: 2404857 - RNA, 17 nt, Bordetella pertussis
ucgccggcaacguggug

SEQ ID NO: 2404858 - RNA, 14 nt, Bordetella pertussis
ucgccggccagcgc

SEQ ID NO: 2404859 - RNA, 14 nt, Bordetella pertussis
ucgccggcccugcc

SEQ ID NO: 2404860 - RNA, 13 nt, Bordetella pertussis
ucgccggccgcgc

SEQ ID NO: 2404861 - RNA, 14 nt, Bordetella pertussis
ucgccggccgcgcc

SEQ ID NO: 2404862 - RNA, 17 nt, Bordetella pertussis
ucgccggccuggcgcgc

SEQ ID NO: 2404863 - RNA, 18 nt, Bordetella pertussis
ucgccggcgaugacggcu

SEQ ID NO: 2404864 - RNA, 20 nt, Bordetella pertussis
ucgccggcgaugacggcuuc

SEQ ID NO: 2404865 - RNA, 14 nt, Bordetella pertussis
ucgccggcgcaacg

SEQ ID NO: 2404866 - RNA, 19 nt, Bordetella pertussis
ucgccggcgcaacgggccg

SEQ ID NO: 2404867 - RNA, 12 nt, Bordetella pertussis
ucgccggcgccc

SEQ ID NO: 2404868 - RNA, 15 nt, Bordetella pertussis
ucgccggcgccccca

SEQ ID NO: 2404869 - RNA, 16 nt, Bordetella pertussis
ucgccggcgcccccag

SEQ ID NO: 2404870 - RNA, 14 nt, Bordetella pertussis
ucgccggcgccgcc

SEQ ID NO: 2404871 - RNA, 14 nt, Bordetella pertussis
ucgccggcgccguc

SEQ ID NO: 2404872 - RNA, 17 nt, Bordetella pertussis
ucgccggcgcgcaggca

SEQ ID NO: 2404873 - RNA, 15 nt, Bordetella pertussis
ucgccggcgcugcug

SEQ ID NO: 2404874 - RNA, 20 nt, Bordetella pertussis
ucgccggcgcugcugucgcg

SEQ ID NO: 2404875 - RNA, 16 nt, Bordetella pertussis
ucgccggcggcguggc

SEQ ID NO: 2404876 - RNA, 17 nt, Bordetella pertussis
ucgccggcguucuucag

SEQ ID NO: 2404877 - RNA, 18 nt, Bordetella pertussis
ucgccggcuacggcaagg

SEQ ID NO: 2404878 - RNA, 19 nt, Bordetella pertussis
ucgccggcuuccagcagca

SEQ ID NO: 2404879 - RNA, 16 nt, Bordetella pertussis
ucgccgggcagcgggc

SEQ ID NO: 2404880 - RNA, 12 nt, Bordetella pertussis
ucgccgggcggc

SEQ ID NO: 2404881 - RNA, 16 nt, Bordetella pertussis
ucgccgggcggcgcgg

SEQ ID NO: 2404882 - RNA, 18 nt, Bordetella pertussis
ucgccggggcgcaccggc

SEQ ID NO: 2404883 - RNA, 15 nt, Bordetella pertussis
ucgccgguagcgcug

SEQ ID NO: 2404884 - RNA, 22 nt, Bordetella pertussis
ucgccgguagcgcugggcgcca

SEQ ID NO: 2404885 - RNA, 16 nt, Bordetella pertussis
ucgccggucgcggcgu

SEQ ID NO: 2404886 - RNA, 15 nt, Bordetella pertussis
ucgccggucggccgc

SEQ ID NO: 2404887 - RNA, 18 nt, Bordetella pertussis
ucgccgucgaaacacgau

SEQ ID NO: 2404888 - RNA, 17 nt, Bordetella pertussis
ucgccgugcagggccag

SEQ ID NO: 2404889 - RNA, 18 nt, Bordetella pertussis
ucgccgugcugggcggcc

SEQ ID NO: 2404890 - RNA, 22 nt, Bordetella pertussis
ucgccguucuucgaucgccugg

SEQ ID NO: 2404891 - RNA, 17 nt, Bordetella pertussis
ucgccuccccaggccag

SEQ ID NO: 2404892 - RNA, 13 nt, Bordetella pertussis
ucgccucgaccuc

SEQ ID NO: 2404893 - RNA, 14 nt, Bordetella pertussis
ucgccucgaugaag

SEQ ID NO: 2404894 - RNA, 23 nt, Bordetella pertussis
ucgccucggcuugcgcggcgcgu

SEQ ID NO: 2404895 - RNA, 19 nt, Bordetella pertussis
ucgccugacguucggggcg

SEQ ID NO: 2404896 - RNA, 23 nt, Bordetella pertussis
ucgccugacguucggggcgucgc

SEQ ID NO: 2404897 - RNA, 12 nt, Bordetella pertussis
ucgccuggggca

SEQ ID NO: 2404898 - RNA, 15 nt, Bordetella pertussis
ucgccuggggcgggc

SEQ ID NO: 2404899 - RNA, 23 nt, Bordetella pertussis
ucgccuggggcgggcgcugcgcg

SEQ ID NO: 2404900 - RNA, 19 nt, Bordetella pertussis
ucgccuggucgacgccggc

SEQ ID NO: 2404901 - RNA, 14 nt, Bordetella pertussis
ucgcgaaagcacgc

SEQ ID NO: 2404902 - RNA, 22 nt, Bordetella pertussis
ucgcgaaagcgcugcgccgcgg

SEQ ID NO: 2404903 - RNA, 15 nt, Bordetella pertussis
ucgcgaaagcggcgu

SEQ ID NO: 2404904 - RNA, 16 nt, Bordetella pertussis
ucgcgaccaccagguc

SEQ ID NO: 2404905 - RNA, 14 nt, Bordetella pertussis
ucgcgaccaccgug

SEQ ID NO: 2404906 - RNA, 17 nt, Bordetella pertussis
ucgcgaccgccaagcag

SEQ ID NO: 2404907 - RNA, 21 nt, Bordetella pertussis
ucgcgaccgccaagcagaccu

SEQ ID NO: 2404908 - RNA, 13 nt, Bordetella pertussis
ucgcgaccucggc

SEQ ID NO: 2404909 - RNA, 20 nt, Bordetella pertussis
ucgcgaccugcgggcgcagc

SEQ ID NO: 2404910 - RNA, 13 nt, Bordetella pertussis
ucgcgaucgucga

SEQ ID NO: 2404911 - RNA, 18 nt, Bordetella pertussis
ucgcgaugcgcagcagca

SEQ ID NO: 2404912 - RNA, 22 nt, Bordetella pertussis
ucgcgaugcgcagcagcagcgc

SEQ ID NO: 2404913 - RNA, 16 nt, Bordetella pertussis
ucgcgaugcgccaggc

SEQ ID NO: 2404914 - RNA, 23 nt, Bordetella pertussis
ucgcgaugcgucaggggcaugcc

SEQ ID NO: 2404915 - RNA, 23 nt, Bordetella pertussis
ucgcgaugcucgauaugcagcac

SEQ ID NO: 2404916 - RNA, 18 nt, Bordetella pertussis
ucgcgcaacgccgggucg

SEQ ID NO: 2404917 - RNA, 15 nt, Bordetella pertussis
ucgcgcaagggccag

SEQ ID NO: 2404918 - RNA, 22 nt, Bordetella pertussis
ucgcgcacagcauggccaccag

SEQ ID NO: 2404919 - RNA, 18 nt, Bordetella pertussis
ucgcgcacagcgcgcaac

SEQ ID NO: 2404920 - RNA, 14 nt, Bordetella pertussis
ucgcgcacauccag

SEQ ID NO: 2404921 - RNA, 17 nt, Bordetella pertussis
ucgcgcaccaccuggcu

SEQ ID NO: 2404922 - RNA, 13 nt, Bordetella pertussis
ucgcgcaccagcg

SEQ ID NO: 2404923 - RNA, 14 nt, Bordetella pertussis
ucgcgcacccgcag

SEQ ID NO: 2404924 - RNA, 16 nt, Bordetella pertussis
ucgcgcacccgcaggc

SEQ ID NO: 2404925 - RNA, 18 nt, Bordetella pertussis
ucgcgcacccgcaggccg

SEQ ID NO: 2404926 - RNA, 15 nt, Bordetella pertussis
ucgcgcaccgaggug

SEQ ID NO: 2404927 - RNA, 21 nt, Bordetella pertussis
ucgcgcaccgaggugccggcg

SEQ ID NO: 2404928 - RNA, 19 nt, Bordetella pertussis
ucgcgcaccgcaugggcca

SEQ ID NO: 2404929 - RNA, 22 nt, Bordetella pertussis
ucgcgcaccgcaugggccaggc

SEQ ID NO: 2404930 - RNA, 21 nt, Bordetella pertussis
ucgcgcaccgccugcgggaac

SEQ ID NO: 2404931 - RNA, 23 nt, Bordetella pertussis
ucgcgcaccuguucggcggcgcc

SEQ ID NO: 2404932 - RNA, 15 nt, Bordetella pertussis
ucgcgcacgcuggca

SEQ ID NO: 2404933 - RNA, 20 nt, Bordetella pertussis
ucgcgcacggugcgcacgau

SEQ ID NO: 2404934 - RNA, 19 nt, Bordetella pertussis
ucgcgcagcaacccgcccg

SEQ ID NO: 2404935 - RNA, 20 nt, Bordetella pertussis
ucgcgcagcaacccgcccgg

SEQ ID NO: 2404936 - RNA, 16 nt, Bordetella pertussis
ucgcgcagcaccgcca

SEQ ID NO: 2404937 - RNA, 17 nt, Bordetella pertussis
ucgcgcagcaccgccag

SEQ ID NO: 2404938 - RNA, 20 nt, Bordetella pertussis
ucgcgcagcaccgccagcgc

SEQ ID NO: 2404939 - RNA, 16 nt, Bordetella pertussis
ucgcgcagcacgaugg

SEQ ID NO: 2404940 - RNA, 13 nt, Bordetella pertussis
ucgcgcagcagcu

SEQ ID NO: 2404941 - RNA, 21 nt, Bordetella pertussis
ucgcgcagcagcuugccgacc

SEQ ID NO: 2404942 - RNA, 18 nt, Bordetella pertussis
ucgcgcagcaggccgcgc

SEQ ID NO: 2404943 - RNA, 23 nt, Bordetella pertussis
ucgcgcagcaggccguugccgcu

SEQ ID NO: 2404944 - RNA, 18 nt, Bordetella pertussis
ucgcgcagcagggccugg

SEQ ID NO: 2404945 - RNA, 22 nt, Bordetella pertussis
ucgcgcagcaggguggccacgc

SEQ ID NO: 2404946 - RNA, 12 nt, Bordetella pertussis
ucgcgcagccac

SEQ ID NO: 2404947 - RNA, 12 nt, Bordetella pertussis
ucgcgcagcgcc

SEQ ID NO: 2404948 - RNA, 20 nt, Bordetella pertussis
ucgcgcagcgccgccaccuc

SEQ ID NO: 2404949 - RNA, 13 nt, Bordetella pertussis
ucgcgcagcgccu

SEQ ID NO: 2404950 - RNA, 18 nt, Bordetella pertussis
ucgcgcagcgccuggccg

SEQ ID NO: 2404951 - RNA, 13 nt, Bordetella pertussis
ucgcgcagcggcg

SEQ ID NO: 2404952 - RNA, 16 nt, Bordetella pertussis
ucgcgcagcggcgcgc

SEQ ID NO: 2404953 - RNA, 21 nt, Bordetella pertussis
ucgcgcagcggcgcgcgcagg

SEQ ID NO: 2404954 - RNA, 23 nt, Bordetella pertussis
ucgcgcagcgugcggaccagcgg

SEQ ID NO: 2404955 - RNA, 23 nt, Bordetella pertussis
ucgcgcagcugccugagcaccgc

SEQ ID NO: 2404956 - RNA, 21 nt, Bordetella pertussis
ucgcgcaggcgugcgcgggcg

SEQ ID NO: 2404957 - RNA, 22 nt, Bordetella pertussis
ucgcgcaggcgugcgcgggcgc

SEQ ID NO: 2404958 - RNA, 14 nt, Bordetella pertussis
ucgcgcagggcggc

SEQ ID NO: 2404959 - RNA, 15 nt, Bordetella pertussis
ucgcgcagggcggcc

SEQ ID NO: 2404960 - RNA, 18 nt, Bordetella pertussis
ucgcgcagggcggccucg

SEQ ID NO: 2404961 - RNA, 13 nt, Bordetella pertussis
ucgcgcagggugg

SEQ ID NO: 2404962 - RNA, 22 nt, Bordetella pertussis
ucgcgcauuucgaacaaggcgg

SEQ ID NO: 2404963 - RNA, 22 nt, Bordetella pertussis
ucgcgccagaacgacagcgaca

SEQ ID NO: 2404964 - RNA, 21 nt, Bordetella pertussis
ucgcgccagcgccgcgcgcgu

SEQ ID NO: 2404965 - RNA, 13 nt, Bordetella pertussis
ucgcgccagcggc

SEQ ID NO: 2404966 - RNA, 17 nt, Bordetella pertussis
ucgcgccagcggccguc

SEQ ID NO: 2404967 - RNA, 19 nt, Bordetella pertussis
ucgcgccagcggccgucgc

SEQ ID NO: 2404968 - RNA, 18 nt, Bordetella pertussis
ucgcgccaggccccgccg

SEQ ID NO: 2404969 - RNA, 20 nt, Bordetella pertussis
ucgcgccaggccccgccggg

SEQ ID NO: 2404970 - RNA, 12 nt, Bordetella pertussis
ucgcgccaggcg

SEQ ID NO: 2404971 - RNA, 19 nt, Bordetella pertussis
ucgcgccaggcgccgggcc

SEQ ID NO: 2404972 - RNA, 21 nt, Bordetella pertussis
ucgcgccaggcgccgggccgc

SEQ ID NO: 2404973 - RNA, 21 nt, Bordetella pertussis
ucgcgccagggccccuccggc

SEQ ID NO: 2404974 - RNA, 16 nt, Bordetella pertussis
ucgcgcccagcgagcu

SEQ ID NO: 2404975 - RNA, 19 nt, Bordetella pertussis
ucgcgcccaucucggccgc

SEQ ID NO: 2404976 - RNA, 15 nt, Bordetella pertussis
ucgcgcccgagcgcc

SEQ ID NO: 2404977 - RNA, 17 nt, Bordetella pertussis
ucgcgcccgccguggcc

SEQ ID NO: 2404978 - RNA, 19 nt, Bordetella pertussis
ucgcgcccggucugccaca

SEQ ID NO: 2404979 - RNA, 23 nt, Bordetella pertussis
ucgcgccgcgucuucggcgcggc

SEQ ID NO: 2404980 - RNA, 17 nt, Bordetella pertussis
ucgcgccggccgacggc

SEQ ID NO: 2404981 - RNA, 18 nt, Bordetella pertussis
ucgcgccggccgacggcg

SEQ ID NO: 2404982 - RNA, 20 nt, Bordetella pertussis
ucgcgccggccgacggcgcu

SEQ ID NO: 2404983 - RNA, 12 nt, Bordetella pertussis
ucgcgccggccu

SEQ ID NO: 2404984 - RNA, 22 nt, Bordetella pertussis
ucgcgccggucaugcaccugca

SEQ ID NO: 2404985 - RNA, 19 nt, Bordetella pertussis
ucgcgccguccgagcccga

SEQ ID NO: 2404986 - RNA, 22 nt, Bordetella pertussis
ucgcgccuaccggcgccgacgc

SEQ ID NO: 2404987 - RNA, 17 nt, Bordetella pertussis
ucgcgccuucggcgcgc

SEQ ID NO: 2404988 - RNA, 16 nt, Bordetella pertussis
ucgcgcgaccacuggc

SEQ ID NO: 2404989 - RNA, 17 nt, Bordetella pertussis
ucgcgcgacuggcccag

SEQ ID NO: 2404990 - RNA, 22 nt, Bordetella pertussis
ucgcgcgagaccagcggaucgc

SEQ ID NO: 2404991 - RNA, 20 nt, Bordetella pertussis
ucgcgcgauugcaucuccag

SEQ ID NO: 2404992 - RNA, 15 nt, Bordetella pertussis
ucgcgcgcacgcgcu

SEQ ID NO: 2404993 - RNA, 18 nt, Bordetella pertussis
ucgcgcgcaucgccgaac

SEQ ID NO: 2404994 - RNA, 16 nt, Bordetella pertussis
ucgcgcgccaggugca

SEQ ID NO: 2404995 - RNA, 22 nt, Bordetella pertussis
ucgcgcgccaggugcacggugg

SEQ ID NO: 2404996 - RNA, 14 nt, Bordetella pertussis
ucgcgcgccggcag

SEQ ID NO: 2404997 - RNA, 20 nt, Bordetella pertussis
ucgcgcgccggcagggcggc

SEQ ID NO: 2404998 - RNA, 17 nt, Bordetella pertussis
ucgcgcgccugcgcgcc

SEQ ID NO: 2404999 - RNA, 21 nt, Bordetella pertussis
ucgcgcgcgccggcaucggcg

SEQ ID NO: 2405000 - RNA, 22 nt, Bordetella pertussis
ucgcgcgcgccugccccgccug

SEQ ID NO: 2405001 - RNA, 23 nt, Bordetella pertussis
ucgcgcgcgccugccccgccugc

SEQ ID NO: 2405002 - RNA, 14 nt, Bordetella pertussis
ucgcgcgcgcggau

SEQ ID NO: 2405003 - RNA, 16 nt, Bordetella pertussis
ucgcgcgcgcgggcgc

SEQ ID NO: 2405004 - RNA, 18 nt, Bordetella pertussis
ucgcgcgcgcgggcgcgc

SEQ ID NO: 2405005 - RNA, 20 nt, Bordetella pertussis
ucgcgcgcgcgggcgcgcag

SEQ ID NO: 2405006 - RNA, 12 nt, Bordetella pertussis
ucgcgcgcggac

SEQ ID NO: 2405007 - RNA, 18 nt, Bordetella pertussis
ucgcgcggauccuugacg

SEQ ID NO: 2405008 - RNA, 20 nt, Bordetella pertussis
ucgcgcggcgacacccccag

SEQ ID NO: 2405009 - RNA, 15 nt, Bordetella pertussis
ucgcgcggcggcacc

SEQ ID NO: 2405010 - RNA, 13 nt, Bordetella pertussis
ucgcgcuccagca

SEQ ID NO: 2405011 - RNA, 15 nt, Bordetella pertussis
ucgcgcuccaugggc

SEQ ID NO: 2405012 - RNA, 23 nt, Bordetella pertussis
ucgcgcucgagcaucuggcgcau

SEQ ID NO: 2405013 - RNA, 19 nt, Bordetella pertussis
ucgcgcucggccagcgcgc

SEQ ID NO: 2405014 - RNA, 14 nt, Bordetella pertussis
ucgcgcucggcgac

SEQ ID NO: 2405015 - RNA, 16 nt, Bordetella pertussis
ucgcgcugcagcauga

SEQ ID NO: 2405016 - RNA, 13 nt, Bordetella pertussis
ucgcgcugcaggc

SEQ ID NO: 2405017 - RNA, 15 nt, Bordetella pertussis
ucgcgcugcaggcgu

SEQ ID NO: 2405018 - RNA, 22 nt, Bordetella pertussis
ucgcgcugcccaccgccguggc

SEQ ID NO: 2405019 - RNA, 23 nt, Bordetella pertussis
ucgcgcugcccaccgccguggcc

SEQ ID NO: 2405020 - RNA, 19 nt, Bordetella pertussis
ucgcgcugcgacagcagca

SEQ ID NO: 2405021 - RNA, 20 nt, Bordetella pertussis
ucgcgcugcgacagcagcau

SEQ ID NO: 2405022 - RNA, 14 nt, Bordetella pertussis
ucgcgcugcgcgcc

SEQ ID NO: 2405023 - RNA, 17 nt, Bordetella pertussis
ucgcgcuggcccgcgcg

SEQ ID NO: 2405024 - RNA, 18 nt, Bordetella pertussis
ucgcgcuggcgcgagaac

SEQ ID NO: 2405025 - RNA, 19 nt, Bordetella pertussis
ucgcgcuggcgguggccgc

SEQ ID NO: 2405026 - RNA, 21 nt, Bordetella pertussis
ucgcgcuggcgguggccgcgc

SEQ ID NO: 2405027 - RNA, 23 nt, Bordetella pertussis
ucgcgcuggcgguggccgcgcau

SEQ ID NO: 2405028 - RNA, 13 nt, Bordetella pertussis
ucgcgcuggggca

SEQ ID NO: 2405029 - RNA, 20 nt, Bordetella pertussis
ucgcgcuguucgggcgcggu

SEQ ID NO: 2405030 - RNA, 23 nt, Bordetella pertussis
ucgcggaagcugacgaaacgcgc

SEQ ID NO: 2405031 - RNA, 14 nt, Bordetella pertussis
ucgcggaugaccug

SEQ ID NO: 2405032 - RNA, 15 nt, Bordetella pertussis
ucgcggaugcgcgcc

SEQ ID NO: 2405033 - RNA, 18 nt, Bordetella pertussis
ucgcggaugcgcgccuug

SEQ ID NO: 2405034 - RNA, 19 nt, Bordetella pertussis
ucgcggaugucaguuucca

SEQ ID NO: 2405035 - RNA, 13 nt, Bordetella pertussis
ucgcggcagcccg

SEQ ID NO: 2405036 - RNA, 15 nt, Bordetella pertussis
ucgcggccagccggg

SEQ ID NO: 2405037 - RNA, 14 nt, Bordetella pertussis
ucgcggccagcggc

SEQ ID NO: 2405038 - RNA, 16 nt, Bordetella pertussis
ucgcggccagcggcag

SEQ ID NO: 2405039 - RNA, 14 nt, Bordetella pertussis
ucgcggcccacggc

SEQ ID NO: 2405040 - RNA, 18 nt, Bordetella pertussis
ucgcggcccacggccagc

SEQ ID NO: 2405041 - RNA, 16 nt, Bordetella pertussis
ucgcggcccgccaggg

SEQ ID NO: 2405042 - RNA, 12 nt, Bordetella pertussis
ucgcggccgagc

SEQ ID NO: 2405043 - RNA, 24 nt, Bordetella pertussis
ucgcggccgagcuccucgagcgug

SEQ ID NO: 2405044 - RNA, 14 nt, Bordetella pertussis
ucgcggcgcaggcg

SEQ ID NO: 2405045 - RNA, 12 nt, Bordetella pertussis
ucgcggcgcggc

SEQ ID NO: 2405046 - RNA, 16 nt, Bordetella pertussis
ucgcggcuccagcuca

SEQ ID NO: 2405047 - RNA, 19 nt, Bordetella pertussis
ucgcggcugguggugccgc

SEQ ID NO: 2405048 - RNA, 23 nt, Bordetella pertussis
ucgcggcugguggugccgcgcac

SEQ ID NO: 2405049 - RNA, 13 nt, Bordetella pertussis
ucgcgggccaggc

SEQ ID NO: 2405050 - RNA, 23 nt, Bordetella pertussis
ucgcgggccaggccggcccaguc

SEQ ID NO: 2405051 - RNA, 17 nt, Bordetella pertussis
ucgcgggcccgcucggc

SEQ ID NO: 2405052 - RNA, 21 nt, Bordetella pertussis
ucgcgggcccgcucggccagc

SEQ ID NO: 2405053 - RNA, 23 nt, Bordetella pertussis
ucgcgggcccgcucggccagcag

SEQ ID NO: 2405054 - RNA, 15 nt, Bordetella pertussis
ucgcgggccuuggcc

SEQ ID NO: 2405055 - RNA, 16 nt, Bordetella pertussis
ucgcgggccuuggcca

SEQ ID NO: 2405056 - RNA, 16 nt, Bordetella pertussis
ucgcgguacgcccagc

SEQ ID NO: 2405057 - RNA, 19 nt, Bordetella pertussis
ucgcgguacgcccagcugg

SEQ ID NO: 2405058 - RNA, 15 nt, Bordetella pertussis
ucgcgguaggacggc

SEQ ID NO: 2405059 - RNA, 17 nt, Bordetella pertussis
ucgcggucaucggcgac

SEQ ID NO: 2405060 - RNA, 21 nt, Bordetella pertussis
ucgcggucgggaucauccugu

SEQ ID NO: 2405061 - RNA, 15 nt, Bordetella pertussis
ucgcggugcaagcgg

SEQ ID NO: 2405062 - RNA, 16 nt, Bordetella pertussis
ucgcggugcaagcggc

SEQ ID NO: 2405063 - RNA, 20 nt, Bordetella pertussis
ucgcggugcaagcggccggc

SEQ ID NO: 2405064 - RNA, 13 nt, Bordetella pertussis
ucgcggugcgcca

SEQ ID NO: 2405065 - RNA, 16 nt, Bordetella pertussis
ucgcggugggcagcgg

SEQ ID NO: 2405066 - RNA, 18 nt, Bordetella pertussis
ucgcggugggcagcggca

SEQ ID NO: 2405067 - RNA, 18 nt, Bordetella pertussis
ucgcggugucgcaccgca

SEQ ID NO: 2405068 - RNA, 23 nt, Bordetella pertussis
ucgcgguucaggguggccgcgac

SEQ ID NO: 2405069 - RNA, 15 nt, Bordetella pertussis
ucgcguagcgcggcc

SEQ ID NO: 2405070 - RNA, 19 nt, Bordetella pertussis
ucgcguccaggcccagcgc

SEQ ID NO: 2405071 - RNA, 17 nt, Bordetella pertussis
ucgcgucgguugcccgu

SEQ ID NO: 2405072 - RNA, 19 nt, Bordetella pertussis
ucgcuaugcagcugcgcca

SEQ ID NO: 2405073 - RNA, 21 nt, Bordetella pertussis
ucgcucaacagcuugcccacg

SEQ ID NO: 2405074 - RNA, 22 nt, Bordetella pertussis
ucgcucaggguacggcgaugcc

SEQ ID NO: 2405075 - RNA, 15 nt, Bordetella pertussis
ucgcucccccaugcg

SEQ ID NO: 2405076 - RNA, 21 nt, Bordetella pertussis
ucgcucccccaugcggggaca

SEQ ID NO: 2405077 - RNA, 13 nt, Bordetella pertussis
ucgcucggcgucc

SEQ ID NO: 2405078 - RNA, 23 nt, Bordetella pertussis
ucgcugaccggcguauggcccgc

SEQ ID NO: 2405079 - RNA, 18 nt, Bordetella pertussis
ucgcugacgcguucuuca

SEQ ID NO: 2405080 - RNA, 19 nt, Bordetella pertussis
ucgcugacgcguucuucag

SEQ ID NO: 2405081 - RNA, 12 nt, Bordetella pertussis
ucgcugcccagc

SEQ ID NO: 2405082 - RNA, 20 nt, Bordetella pertussis
ucgcugcccuacgacacgcu

SEQ ID NO: 2405083 - RNA, 15 nt, Bordetella pertussis
ucgcugccggcgccc

SEQ ID NO: 2405084 - RNA, 18 nt, Bordetella pertussis
ucgcugccgggauccgcu

SEQ ID NO: 2405085 - RNA, 19 nt, Bordetella pertussis
ucgcugcgaaacagcagcg

SEQ ID NO: 2405086 - RNA, 21 nt, Bordetella pertussis
ucgcugcgaaacagcagcgga

SEQ ID NO: 2405087 - RNA, 16 nt, Bordetella pertussis
ucgcugcgcacgcugg

SEQ ID NO: 2405088 - RNA, 15 nt, Bordetella pertussis
ucgcugcgggcggcc

SEQ ID NO: 2405089 - RNA, 13 nt, Bordetella pertussis
ucgcugcugaccg

SEQ ID NO: 2405090 - RNA, 17 nt, Bordetella pertussis
ucgcugcuggcggcgcu

SEQ ID NO: 2405091 - RNA, 15 nt, Bordetella pertussis
ucgcuggagaccggc

SEQ ID NO: 2405092 - RNA, 15 nt, Bordetella pertussis
ucgcuggcagccuug

SEQ ID NO: 2405093 - RNA, 11 nt, Bordetella pertussis
ucgcuggccau

SEQ ID NO: 2405094 - RNA, 16 nt, Bordetella pertussis
ucgcuggcgaagaccg

SEQ ID NO: 2405095 - RNA, 22 nt, Bordetella pertussis
ucgcugggauggguacgccggc

SEQ ID NO: 2405096 - RNA, 13 nt, Bordetella pertussis
ucgcugggcgcgc

SEQ ID NO: 2405097 - RNA, 11 nt, Bordetella pertussis
ucgcuggggcg

SEQ ID NO: 2405098 - RNA, 19 nt, Bordetella pertussis
ucgcuggugaagucggccc

SEQ ID NO: 2405099 - RNA, 13 nt, Bordetella pertussis
ucgcugugcgcgg

SEQ ID NO: 2405100 - RNA, 15 nt, Bordetella pertussis
ucgcuguucggggca

SEQ ID NO: 2405101 - RNA, 17 nt, Bordetella pertussis
ucgcuucgguggcgcgc

SEQ ID NO: 2405102 - RNA, 13 nt, Bordetella pertussis
ucgcuuuccaggg

SEQ ID NO: 2405103 - RNA, 21 nt, Bordetella pertussis
ucgcuuuccaggguggccagu

SEQ ID NO: 2405104 - RNA, 19 nt, Bordetella pertussis
ucggaaacacguccagcgc

SEQ ID NO: 2405105 - RNA, 19 nt, Bordetella pertussis
ucggaaacagguucacgcc

SEQ ID NO: 2405106 - RNA, 16 nt, Bordetella pertussis
ucggacaggucggcgc

SEQ ID NO: 2405107 - RNA, 22 nt, Bordetella pertussis
ucggacaggucggcgcccacgc

SEQ ID NO: 2405108 - RNA, 22 nt, Bordetella pertussis
ucggacccgaaacccagaucgc

SEQ ID NO: 2405109 - RNA, 15 nt, Bordetella pertussis
ucggaccuggccagc

SEQ ID NO: 2405110 - RNA, 22 nt, Bordetella pertussis
ucggacgagacaggcgcgccau

SEQ ID NO: 2405111 - RNA, 17 nt, Bordetella pertussis
ucggacgcgccgggcga

SEQ ID NO: 2405112 - RNA, 21 nt, Bordetella pertussis
ucggacgcgccgggcgaaccg

SEQ ID NO: 2405113 - RNA, 20 nt, Bordetella pertussis
ucggagaaaucgccgccggc

SEQ ID NO: 2405114 - RNA, 18 nt, Bordetella pertussis
ucggagccaguccccgca

SEQ ID NO: 2405115 - RNA, 15 nt, Bordetella pertussis
ucggagcccaguguc

SEQ ID NO: 2405116 - RNA, 17 nt, Bordetella pertussis
ucggcaaccugcacgcg

SEQ ID NO: 2405117 - RNA, 14 nt, Bordetella pertussis
ucggcaaggcgcac

SEQ ID NO: 2405118 - RNA, 19 nt, Bordetella pertussis
ucggcaccaucguugccug

SEQ ID NO: 2405119 - RNA, 22 nt, Bordetella pertussis
ucggcacccgcaugguggcgca

SEQ ID NO: 2405120 - RNA, 15 nt, Bordetella pertussis
ucggcaccgaggccg

SEQ ID NO: 2405121 - RNA, 23 nt, Bordetella pertussis
ucggcaccgaggccgaguggccg

SEQ ID NO: 2405122 - RNA, 11 nt, Bordetella pertussis
ucggcaccggc

SEQ ID NO: 2405123 - RNA, 18 nt, Bordetella pertussis
ucggcaccggcagccauc

SEQ ID NO: 2405124 - RNA, 13 nt, Bordetella pertussis
ucggcacggccag

SEQ ID NO: 2405125 - RNA, 21 nt, Bordetella pertussis
ucggcacgggucaggcugcgg

SEQ ID NO: 2405126 - RNA, 20 nt, Bordetella pertussis
ucggcagcgaggcgcagcgc

SEQ ID NO: 2405127 - RNA, 17 nt, Bordetella pertussis
ucggcagcgaggcgcgg

SEQ ID NO: 2405128 - RNA, 14 nt, Bordetella pertussis
ucggcaggccggcg

SEQ ID NO: 2405129 - RNA, 18 nt, Bordetella pertussis
ucggcaggccggcgcgcg

SEQ ID NO: 2405130 - RNA, 19 nt, Bordetella pertussis
ucggcaggcgccggcuggc

SEQ ID NO: 2405131 - RNA, 17 nt, Bordetella pertussis
ucggcaggugcagaaac

SEQ ID NO: 2405132 - RNA, 14 nt, Bordetella pertussis
ucggcaucggccac

SEQ ID NO: 2405133 - RNA, 20 nt, Bordetella pertussis
ucggcaucggccacgcugcc

SEQ ID NO: 2405134 - RNA, 16 nt, Bordetella pertussis
ucggcauggccaggaa

SEQ ID NO: 2405135 - RNA, 13 nt, Bordetella pertussis
ucggcauggccau

SEQ ID NO: 2405136 - RNA, 18 nt, Bordetella pertussis
ucggcauggccaucgcgg

SEQ ID NO: 2405137 - RNA, 22 nt, Bordetella pertussis
ucggcauggguaaagcgccggc

SEQ ID NO: 2405138 - RNA, 19 nt, Bordetella pertussis
ucggcaugguagcggucca

SEQ ID NO: 2405139 - RNA, 13 nt, Bordetella pertussis
ucggcauggucgg

SEQ ID NO: 2405140 - RNA, 19 nt, Bordetella pertussis
ucggcauggucggcauggc

SEQ ID NO: 2405141 - RNA, 16 nt, Bordetella pertussis
ucggccaaggccggcg

SEQ ID NO: 2405142 - RNA, 20 nt, Bordetella pertussis
ucggccaaggccggcgcguc

SEQ ID NO: 2405143 - RNA, 20 nt, Bordetella pertussis
ucggccacccggcccaugac

SEQ ID NO: 2405144 - RNA, 23 nt, Bordetella pertussis
ucggccaccgccguggcauagaa

SEQ ID NO: 2405145 - RNA, 16 nt, Bordetella pertussis
ucggccaccuggcgca

SEQ ID NO: 2405146 - RNA, 13 nt, Bordetella pertussis
ucggccacgcccu

SEQ ID NO: 2405147 - RNA, 21 nt, Bordetella pertussis
ucggccacgcucacgcccgug

SEQ ID NO: 2405148 - RNA, 14 nt, Bordetella pertussis
ucggccacgcugcc

SEQ ID NO: 2405149 - RNA, 19 nt, Bordetella pertussis
ucggccacgcugcccugcu

SEQ ID NO: 2405150 - RNA, 15 nt, Bordetella pertussis
ucggccacggcugga

SEQ ID NO: 2405151 - RNA, 15 nt, Bordetella pertussis
ucggccacgucggcg

SEQ ID NO: 2405152 - RNA, 17 nt, Bordetella pertussis
ucggccacgucggcggc

SEQ ID NO: 2405153 - RNA, 18 nt, Bordetella pertussis
ucggccacuuccuggugg

SEQ ID NO: 2405154 - RNA, 17 nt, Bordetella pertussis
ucggccacuucgcggcc

SEQ ID NO: 2405155 - RNA, 15 nt, Bordetella pertussis
ucggccagcagcgcc

SEQ ID NO: 2405156 - RNA, 17 nt, Bordetella pertussis
ucggccagcagcgccug

SEQ ID NO: 2405157 - RNA, 13 nt, Bordetella pertussis
ucggccagcagcu

SEQ ID NO: 2405158 - RNA, 22 nt, Bordetella pertussis
ucggccagcauacccugcgcgc

SEQ ID NO: 2405159 - RNA, 23 nt, Bordetella pertussis
ucggccagcauacccugcgcgcc

SEQ ID NO: 2405160 - RNA, 15 nt, Bordetella pertussis
ucggccagccccacc

SEQ ID NO: 2405161 - RNA, 18 nt, Bordetella pertussis
ucggccagccccaccuug

SEQ ID NO: 2405162 - RNA, 19 nt, Bordetella pertussis
ucggccagccccaccuugc

SEQ ID NO: 2405163 - RNA, 11 nt, Bordetella pertussis
ucggccagcgc

SEQ ID NO: 2405164 - RNA, 15 nt, Bordetella pertussis
ucggccagcgcgaag

SEQ ID NO: 2405165 - RNA, 16 nt, Bordetella pertussis
ucggccagcgcgcgcc

SEQ ID NO: 2405166 - RNA, 15 nt, Bordetella pertussis
ucggccagcgcgcgg

SEQ ID NO: 2405167 - RNA, 18 nt, Bordetella pertussis
ucggccagcgcgcggccg

SEQ ID NO: 2405168 - RNA, 20 nt, Bordetella pertussis
ucggccagcgcgcggccggc

SEQ ID NO: 2405169 - RNA, 19 nt, Bordetella pertussis
ucggccagcgcgcggcgca

SEQ ID NO: 2405170 - RNA, 14 nt, Bordetella pertussis
ucggccagcggcag

SEQ ID NO: 2405171 - RNA, 18 nt, Bordetella pertussis
ucggccaggaaagccggc

SEQ ID NO: 2405172 - RNA, 14 nt, Bordetella pertussis
ucggccaggccggc

SEQ ID NO: 2405173 - RNA, 22 nt, Bordetella pertussis
ucggccaggccggccugcaggc

SEQ ID NO: 2405174 - RNA, 15 nt, Bordetella pertussis
ucggccaggcgcugc

SEQ ID NO: 2405175 - RNA, 14 nt, Bordetella pertussis
ucggccagggcggc

SEQ ID NO: 2405176 - RNA, 15 nt, Bordetella pertussis
ucggccaggucgcgc

SEQ ID NO: 2405177 - RNA, 18 nt, Bordetella pertussis
ucggccaggucgcgcauc

SEQ ID NO: 2405178 - RNA, 14 nt, Bordetella pertussis
ucggccaugcgcgc

SEQ ID NO: 2405179 - RNA, 15 nt, Bordetella pertussis
ucggccaugcgcgcc

SEQ ID NO: 2405180 - RNA, 16 nt, Bordetella pertussis
ucggccaugcgcgcca

SEQ ID NO: 2405181 - RNA, 21 nt, Bordetella pertussis
ucggccauguagauggccgcc

SEQ ID NO: 2405182 - RNA, 16 nt, Bordetella pertussis
ucggccaugugcgcca

SEQ ID NO: 2405183 - RNA, 20 nt, Bordetella pertussis
ucggcccauugcggcaccug

SEQ ID NO: 2405184 - RNA, 16 nt, Bordetella pertussis
ucggccccugcccugc

SEQ ID NO: 2405185 - RNA, 22 nt, Bordetella pertussis
ucggcccgcccgcccugggcag

SEQ ID NO: 2405186 - RNA, 13 nt, Bordetella pertussis
ucggcccgcgcca

SEQ ID NO: 2405187 - RNA, 21 nt, Bordetella pertussis
ucggcccguuccacaggcgau

SEQ ID NO: 2405188 - RNA, 21 nt, Bordetella pertussis
ucggcccuagagcaugcggcg

SEQ ID NO: 2405189 - RNA, 16 nt, Bordetella pertussis
ucggcccugucggccg

SEQ ID NO: 2405190 - RNA, 19 nt, Bordetella pertussis
ucggccgaaccgcgcagcc

SEQ ID NO: 2405191 - RNA, 12 nt, Bordetella pertussis
ucggccgcgccc

SEQ ID NO: 2405192 - RNA, 13 nt, Bordetella pertussis
ucggccgcgccca

SEQ ID NO: 2405193 - RNA, 14 nt, Bordetella pertussis
ucggccgcgccgcc

SEQ ID NO: 2405194 - RNA, 16 nt, Bordetella pertussis
ucggccgcgcgcauca

SEQ ID NO: 2405195 - RNA, 22 nt, Bordetella pertussis
ucggccgcggcguugcggcagc

SEQ ID NO: 2405196 - RNA, 13 nt, Bordetella pertussis
ucggccgcgucga

SEQ ID NO: 2405197 - RNA, 20 nt, Bordetella pertussis
ucggccgcuccgccauggag

SEQ ID NO: 2405198 - RNA, 23 nt, Bordetella pertussis
ucggccggcagcgcgaccggcgc

SEQ ID NO: 2405199 - RNA, 17 nt, Bordetella pertussis
ucggccggccgggccgc

SEQ ID NO: 2405200 - RNA, 13 nt, Bordetella pertussis
ucggccggcggcc

SEQ ID NO: 2405201 - RNA, 17 nt, Bordetella pertussis
ucggccggcggcccauc

SEQ ID NO: 2405202 - RNA, 12 nt, Bordetella pertussis
ucggccggcggu

SEQ ID NO: 2405203 - RNA, 21 nt, Bordetella pertussis
ucggccggcggucgcgcuggc

SEQ ID NO: 2405204 - RNA, 17 nt, Bordetella pertussis
ucggccggcugcgcgcc

SEQ ID NO: 2405205 - RNA, 20 nt, Bordetella pertussis
ucggccgggccgggcacgau

SEQ ID NO: 2405206 - RNA, 16 nt, Bordetella pertussis
ucggccgucagcagca

SEQ ID NO: 2405207 - RNA, 19 nt, Bordetella pertussis
ucggccgucagcagcaggc

SEQ ID NO: 2405208 - RNA, 18 nt, Bordetella pertussis
ucggccucaucgagcgcc

SEQ ID NO: 2405209 - RNA, 22 nt, Bordetella pertussis
ucggccucgcgcagggcggccu

SEQ ID NO: 2405210 - RNA, 15 nt, Bordetella pertussis
ucggccucgcggcgc

SEQ ID NO: 2405211 - RNA, 14 nt, Bordetella pertussis
ucggccucgcuggc

SEQ ID NO: 2405212 - RNA, 19 nt, Bordetella pertussis
ucggccucgguggucaggu

SEQ ID NO: 2405213 - RNA, 20 nt, Bordetella pertussis
ucggccugaaccaggccgcc

SEQ ID NO: 2405214 - RNA, 22 nt, Bordetella pertussis
ucggccugaaccaggccgccag

SEQ ID NO: 2405215 - RNA, 16 nt, Bordetella pertussis
ucggccugcaccggcg

SEQ ID NO: 2405216 - RNA, 13 nt, Bordetella pertussis
ucggccugcaggc

SEQ ID NO: 2405217 - RNA, 20 nt, Bordetella pertussis
ucggccugccaccagcgcgc

SEQ ID NO: 2405218 - RNA, 21 nt, Bordetella pertussis
ucggccugccaccagcgcgcc

SEQ ID NO: 2405219 - RNA, 15 nt, Bordetella pertussis
ucggccugccagccu

SEQ ID NO: 2405220 - RNA, 14 nt, Bordetella pertussis
ucggccugccggcg

SEQ ID NO: 2405221 - RNA, 16 nt, Bordetella pertussis
ucggccugcgccacca

SEQ ID NO: 2405222 - RNA, 19 nt, Bordetella pertussis
ucggccugcgccaccagcu

SEQ ID NO: 2405223 - RNA, 19 nt, Bordetella pertussis
ucggccugcucgcaggccu

SEQ ID NO: 2405224 - RNA, 23 nt, Bordetella pertussis
ucggccugcucgcaggccugcug

SEQ ID NO: 2405225 - RNA, 15 nt, Bordetella pertussis
ucggccuggcgcucc

SEQ ID NO: 2405226 - RNA, 17 nt, Bordetella pertussis
ucggccuggcgcuccuc

SEQ ID NO: 2405227 - RNA, 15 nt, Bordetella pertussis
ucggccugggcgcga

SEQ ID NO: 2405228 - RNA, 22 nt, Bordetella pertussis
ucggccugggcgcgaugggccu

SEQ ID NO: 2405229 - RNA, 23 nt, Bordetella pertussis
ucggccugggcgcgaugggccug

SEQ ID NO: 2405230 - RNA, 22 nt, Bordetella pertussis
ucggccugguccgccgcgacca

SEQ ID NO: 2405231 - RNA, 16 nt, Bordetella pertussis
ucggccuugggcgcgg

SEQ ID NO: 2405232 - RNA, 17 nt, Bordetella pertussis
ucggccuugggcgcggc

SEQ ID NO: 2405233 - RNA, 20 nt, Bordetella pertussis
ucggccuugggcgcggcggc

SEQ ID NO: 2405234 - RNA, 18 nt, Bordetella pertussis
ucggcgaacugggcgucg

SEQ ID NO: 2405235 - RNA, 13 nt, Bordetella pertussis
ucggcgaagccgc

SEQ ID NO: 2405236 - RNA, 21 nt, Bordetella pertussis
ucggcgaagccgcagcggcag

SEQ ID NO: 2405237 - RNA, 24 nt, Bordetella pertussis
ucggcgaagccgcagcggcagcgc

SEQ ID NO: 2405238 - RNA, 21 nt, Bordetella pertussis
ucggcgaagccuugcgcggcc

SEQ ID NO: 2405239 - RNA, 16 nt, Bordetella pertussis
ucggcgaagugcccgc

SEQ ID NO: 2405240 - RNA, 20 nt, Bordetella pertussis
ucggcgaagugcccgcuggc

SEQ ID NO: 2405241 - RNA, 15 nt, Bordetella pertussis
ucggcgaccaggugc

SEQ ID NO: 2405242 - RNA, 21 nt, Bordetella pertussis
ucggcgaccaggugcgggccg

SEQ ID NO: 2405243 - RNA, 13 nt, Bordetella pertussis
ucggcgaccgccg

SEQ ID NO: 2405244 - RNA, 22 nt, Bordetella pertussis
ucggcgacgacuacgcgcuggc

SEQ ID NO: 2405245 - RNA, 20 nt, Bordetella pertussis
ucggcgacgugaugcucgau

SEQ ID NO: 2405246 - RNA, 19 nt, Bordetella pertussis
ucggcgacuucggcggccu

SEQ ID NO: 2405247 - RNA, 15 nt, Bordetella pertussis
ucggcgagccgggca

SEQ ID NO: 2405248 - RNA, 16 nt, Bordetella pertussis
ucggcgagccgggcac

SEQ ID NO: 2405249 - RNA, 21 nt, Bordetella pertussis
ucggcgaucaccugcguggcc

SEQ ID NO: 2405250 - RNA, 23 nt, Bordetella pertussis
ucggcgaucugcgcggcggugcc

SEQ ID NO: 2405251 - RNA, 14 nt, Bordetella pertussis
ucggcgaugcgggc

SEQ ID NO: 2405252 - RNA, 15 nt, Bordetella pertussis
ucggcgauggcccgg

SEQ ID NO: 2405253 - RNA, 17 nt, Bordetella pertussis
ucggcgauggcccggua

SEQ ID NO: 2405254 - RNA, 17 nt, Bordetella pertussis
ucggcgcaucggcgcca

SEQ ID NO: 2405255 - RNA, 19 nt, Bordetella pertussis
ucggcgccaagcggcaggc

SEQ ID NO: 2405256 - RNA, 21 nt, Bordetella pertussis
ucggcgccacaggugcgcggc

SEQ ID NO: 2405257 - RNA, 17 nt, Bordetella pertussis
ucggcgccaguagcgcc

SEQ ID NO: 2405258 - RNA, 20 nt, Bordetella pertussis
ucggcgccaguagcgccggc

SEQ ID NO: 2405259 - RNA, 17 nt, Bordetella pertussis
ucggcgccaugaccacg

SEQ ID NO: 2405260 - RNA, 18 nt, Bordetella pertussis
ucggcgccaugaucgccg

SEQ ID NO: 2405261 - RNA, 20 nt, Bordetella pertussis
ucggcgccaugcuggccgcc

SEQ ID NO: 2405262 - RNA, 22 nt, Bordetella pertussis
ucggcgccaugcuggccgccgc

SEQ ID NO: 2405263 - RNA, 16 nt, Bordetella pertussis
ucggcgcccacgccga

SEQ ID NO: 2405264 - RNA, 18 nt, Bordetella pertussis
ucggcgcccgcggccugc

SEQ ID NO: 2405265 - RNA, 13 nt, Bordetella pertussis
ucggcgcccggcg

SEQ ID NO: 2405266 - RNA, 20 nt, Bordetella pertussis
ucggcgcccggcgccgcgcg

SEQ ID NO: 2405267 - RNA, 14 nt, Bordetella pertussis
ucggcgccgagcag

SEQ ID NO: 2405268 - RNA, 20 nt, Bordetella pertussis
ucggcgccgaucagcagguc

SEQ ID NO: 2405269 - RNA, 13 nt, Bordetella pertussis
ucggcgccgcgcg

SEQ ID NO: 2405270 - RNA, 16 nt, Bordetella pertussis
ucggcgccgcgcgcgg

SEQ ID NO: 2405271 - RNA, 13 nt, Bordetella pertussis
ucggcgccgcggc

SEQ ID NO: 2405272 - RNA, 16 nt, Bordetella pertussis
ucggcgccgcggcgcu

SEQ ID NO: 2405273 - RNA, 18 nt, Bordetella pertussis
ucggcgccgcggcgcuuc

SEQ ID NO: 2405274 - RNA, 22 nt, Bordetella pertussis
ucggcgccggcguccacggcau

SEQ ID NO: 2405275 - RNA, 13 nt, Bordetella pertussis
ucggcgccgggcg

SEQ ID NO: 2405276 - RNA, 19 nt, Bordetella pertussis
ucggcgccgggcgacggcg

SEQ ID NO: 2405277 - RNA, 22 nt, Bordetella pertussis
ucggcgccuggccgcccagcgc

SEQ ID NO: 2405278 - RNA, 17 nt, Bordetella pertussis
ucggcgcgagcgaugcc

SEQ ID NO: 2405279 - RNA, 19 nt, Bordetella pertussis
ucggcgcgcagcagacgcu

SEQ ID NO: 2405280 - RNA, 11 nt, Bordetella pertussis
ucggcgcgcgc

SEQ ID NO: 2405281 - RNA, 12 nt, Bordetella pertussis
ucggcgcgcgcc

SEQ ID NO: 2405282 - RNA, 13 nt, Bordetella pertussis
ucggcgcgcgcca

SEQ ID NO: 2405283 - RNA, 18 nt, Bordetella pertussis
ucggcgcgcgccaggccc

SEQ ID NO: 2405284 - RNA, 23 nt, Bordetella pertussis
ucggcgcgcgccaggcccagggc

SEQ ID NO: 2405285 - RNA, 15 nt, Bordetella pertussis
ucggcgcgcgccggc

SEQ ID NO: 2405286 - RNA, 12 nt, Bordetella pertussis
ucggcgcgcgcu

SEQ ID NO: 2405287 - RNA, 15 nt, Bordetella pertussis
ucggcgcgcucggcg

SEQ ID NO: 2405288 - RNA, 17 nt, Bordetella pertussis
ucggcgcggcgcguuca

SEQ ID NO: 2405289 - RNA, 14 nt, Bordetella pertussis
ucggcgcggcgggc

SEQ ID NO: 2405290 - RNA, 20 nt, Bordetella pertussis
ucggcgcggcgggcgcuggc

SEQ ID NO: 2405291 - RNA, 18 nt, Bordetella pertussis
ucggcgcgguauucgcgc

SEQ ID NO: 2405292 - RNA, 14 nt, Bordetella pertussis
ucggcgcuggccau

SEQ ID NO: 2405293 - RNA, 23 nt, Bordetella pertussis
ucggcgcuggccuggccgccggc

SEQ ID NO: 2405294 - RNA, 15 nt, Bordetella pertussis
ucggcgcuggcgcgc

SEQ ID NO: 2405295 - RNA, 16 nt, Bordetella pertussis
ucggcgcugggcgcau

SEQ ID NO: 2405296 - RNA, 18 nt, Bordetella pertussis
ucggcggccagcagcggc

SEQ ID NO: 2405297 - RNA, 20 nt, Bordetella pertussis
ucggcggccagcagcggcag

SEQ ID NO: 2405298 - RNA, 16 nt, Bordetella pertussis
ucggcggccagccggc

SEQ ID NO: 2405299 - RNA, 16 nt, Bordetella pertussis
ucggcggccagcgcgc

SEQ ID NO: 2405300 - RNA, 18 nt, Bordetella pertussis
ucggcggccagcgcgccc

SEQ ID NO: 2405301 - RNA, 13 nt, Bordetella pertussis
ucggcggccaggc

SEQ ID NO: 2405302 - RNA, 19 nt, Bordetella pertussis
ucggcggccaugccgacgg

SEQ ID NO: 2405303 - RNA, 16 nt, Bordetella pertussis
ucggcggcccacagcg

SEQ ID NO: 2405304 - RNA, 19 nt, Bordetella pertussis
ucggcggccgccugcgccg

SEQ ID NO: 2405305 - RNA, 15 nt, Bordetella pertussis
ucggcggccuccggc

SEQ ID NO: 2405306 - RNA, 16 nt, Bordetella pertussis
ucggcggccugggcca

SEQ ID NO: 2405307 - RNA, 17 nt, Bordetella pertussis
ucggcggccugggccau

SEQ ID NO: 2405308 - RNA, 20 nt, Bordetella pertussis
ucggcggccugggccauggc

SEQ ID NO: 2405309 - RNA, 15 nt, Bordetella pertussis
ucggcggcgcccauc

SEQ ID NO: 2405310 - RNA, 13 nt, Bordetella pertussis
ucggcggcgcgcu

SEQ ID NO: 2405311 - RNA, 23 nt, Bordetella pertussis
ucggcggcgucgcuggcagccuu

SEQ ID NO: 2405312 - RNA, 24 nt, Bordetella pertussis
ucggcggcgucgcuggcagccuug

SEQ ID NO: 2405313 - RNA, 15 nt, Bordetella pertussis
ucggcgggcggcgcc

SEQ ID NO: 2405314 - RNA, 20 nt, Bordetella pertussis
ucggcgguccacagcccggc

SEQ ID NO: 2405315 - RNA, 18 nt, Bordetella pertussis
ucggcggugaugucgccg

SEQ ID NO: 2405316 - RNA, 18 nt, Bordetella pertussis
ucggcgguuccagccugg

SEQ ID NO: 2405317 - RNA, 19 nt, Bordetella pertussis
ucggcguaaggccgccggc

SEQ ID NO: 2405318 - RNA, 13 nt, Bordetella pertussis
ucggcgucagcgc

SEQ ID NO: 2405319 - RNA, 15 nt, Bordetella pertussis
ucggcgucagcgccc

SEQ ID NO: 2405320 - RNA, 19 nt, Bordetella pertussis
ucggcguccucgcgguccu

SEQ ID NO: 2405321 - RNA, 17 nt, Bordetella pertussis
ucggcgucggugccguc

SEQ ID NO: 2405322 - RNA, 23 nt, Bordetella pertussis
ucggcgucggugccguccagcgc

SEQ ID NO: 2405323 - RNA, 13 nt, Bordetella pertussis
ucggcgugcagca

SEQ ID NO: 2405324 - RNA, 16 nt, Bordetella pertussis
ucggcgugcagcaagc

SEQ ID NO: 2405325 - RNA, 17 nt, Bordetella pertussis
ucggcguggucgcaguc

SEQ ID NO: 2405326 - RNA, 16 nt, Bordetella pertussis
ucggcguuccuggcgc

SEQ ID NO: 2405327 - RNA, 23 nt, Bordetella pertussis
ucggcguugcuggcaaagcgcgc

SEQ ID NO: 2405328 - RNA, 17 nt, Bordetella pertussis
ucggcguugugccggcg

SEQ ID NO: 2405329 - RNA, 18 nt, Bordetella pertussis
ucggcguugugccggcgc

SEQ ID NO: 2405330 - RNA, 17 nt, Bordetella pertussis
ucggcucaguccaaggu

SEQ ID NO: 2405331 - RNA, 20 nt, Bordetella pertussis
ucggcuccgccauugcgccg

SEQ ID NO: 2405332 - RNA, 22 nt, Bordetella pertussis
ucggcucggugaugauggccag

SEQ ID NO: 2405333 - RNA, 22 nt, Bordetella pertussis
ucggcuggcgcaagacgcggca

SEQ ID NO: 2405334 - RNA, 17 nt, Bordetella pertussis
ucggcuuccugccgcac

SEQ ID NO: 2405335 - RNA, 15 nt, Bordetella pertussis
ucggcuugcacgccg

SEQ ID NO: 2405336 - RNA, 20 nt, Bordetella pertussis
ucggcuugcacgccggccac

SEQ ID NO: 2405337 - RNA, 14 nt, Bordetella pertussis
ucggcuugccgcgc

SEQ ID NO: 2405338 - RNA, 15 nt, Bordetella pertussis
ucggcuugccgcgcg

SEQ ID NO: 2405339 - RNA, 18 nt, Bordetella pertussis
ucggcuugccgcgcggcg

SEQ ID NO: 2405340 - RNA, 15 nt, Bordetella pertussis
ucggcuugcgcggcg

SEQ ID NO: 2405341 - RNA, 21 nt, Bordetella pertussis
ucggcuugcguuggcauggcg

SEQ ID NO: 2405342 - RNA, 19 nt, Bordetella pertussis
ucggcuuguucgagcgcgc

SEQ ID NO: 2405343 - RNA, 16 nt, Bordetella pertussis
ucggcuuuuuugcguu

SEQ ID NO: 2405344 - RNA, 16 nt, Bordetella pertussis
ucgggaaacaggccca

SEQ ID NO: 2405345 - RNA, 18 nt, Bordetella pertussis
ucgggaaacaggcccacg

SEQ ID NO: 2405346 - RNA, 18 nt, Bordetella pertussis
ucgggaaugaugcagcug

SEQ ID NO: 2405347 - RNA, 21 nt, Bordetella pertussis
ucgggaccgaacaccaccgag

SEQ ID NO: 2405348 - RNA, 15 nt, Bordetella pertussis
ucgggaccggcgcgu

SEQ ID NO: 2405349 - RNA, 17 nt, Bordetella pertussis
ucgggacgcaggagucg

SEQ ID NO: 2405350 - RNA, 16 nt, Bordetella pertussis
ucgggacgcaggccca

SEQ ID NO: 2405351 - RNA, 21 nt, Bordetella pertussis
ucgggauaguccagcaccggc

SEQ ID NO: 2405352 - RNA, 17 nt, Bordetella pertussis
ucgggaucauccuguuc

SEQ ID NO: 2405353 - RNA, 18 nt, Bordetella pertussis
ucgggauccgugcggcgc

SEQ ID NO: 2405354 - RNA, 14 nt, Bordetella pertussis
ucgggcaagcggcg

SEQ ID NO: 2405355 - RNA, 12 nt, Bordetella pertussis
ucgggcacggcc

SEQ ID NO: 2405356 - RNA, 13 nt, Bordetella pertussis
ucgggcagcacgc

SEQ ID NO: 2405357 - RNA, 16 nt, Bordetella pertussis
ucgggcagcacgcgca

SEQ ID NO: 2405358 - RNA, 19 nt, Bordetella pertussis
ucgggcagcacgcgcacca

SEQ ID NO: 2405359 - RNA, 17 nt, Bordetella pertussis
ucgggcagcagcagggc

SEQ ID NO: 2405360 - RNA, 20 nt, Bordetella pertussis
ucgggcagcagcagggccag

SEQ ID NO: 2405361 - RNA, 22 nt, Bordetella pertussis
ucgggcagcagcagggccaggc

SEQ ID NO: 2405362 - RNA, 19 nt, Bordetella pertussis
ucgggcagcgcccgcgcca

SEQ ID NO: 2405363 - RNA, 21 nt, Bordetella pertussis
ucgggcagcgcccgcgccauc

SEQ ID NO: 2405364 - RNA, 12 nt, Bordetella pertussis
ucgggcagcgcg

SEQ ID NO: 2405365 - RNA, 19 nt, Bordetella pertussis
ucgggcaggucggcgcggg

SEQ ID NO: 2405366 - RNA, 16 nt, Bordetella pertussis
ucgggcaguugcuggc

SEQ ID NO: 2405367 - RNA, 23 nt, Bordetella pertussis
ucgggcaguugcuggcggccgug

SEQ ID NO: 2405368 - RNA, 17 nt, Bordetella pertussis
ucgggcaugucgcggcc

SEQ ID NO: 2405369 - RNA, 18 nt, Bordetella pertussis
ucgggcaugucgcggccc

SEQ ID NO: 2405370 - RNA, 15 nt, Bordetella pertussis
ucgggccacccgccg

SEQ ID NO: 2405371 - RNA, 21 nt, Bordetella pertussis
ucgggccacccgccgccggcg

SEQ ID NO: 2405372 - RNA, 20 nt, Bordetella pertussis
ucgggccgcgcgcgggcgcc

SEQ ID NO: 2405373 - RNA, 13 nt, Bordetella pertussis
ucgggccggcggc

SEQ ID NO: 2405374 - RNA, 16 nt, Bordetella pertussis
ucgggccggcggcagc

SEQ ID NO: 2405375 - RNA, 14 nt, Bordetella pertussis
ucgggccggcugcc

SEQ ID NO: 2405376 - RNA, 19 nt, Bordetella pertussis
ucgggcgacaggcgcgccc

SEQ ID NO: 2405377 - RNA, 18 nt, Bordetella pertussis
ucgggcgacuccagcccg

SEQ ID NO: 2405378 - RNA, 12 nt, Bordetella pertussis
ucgggcgcaacg

SEQ ID NO: 2405379 - RNA, 13 nt, Bordetella pertussis
ucgggcugcugcc

SEQ ID NO: 2405380 - RNA, 20 nt, Bordetella pertussis
ucggggaaauugacggcgcu

SEQ ID NO: 2405381 - RNA, 23 nt, Bordetella pertussis
ucggggacaggcaccgaaguguc

SEQ ID NO: 2405382 - RNA, 22 nt, Bordetella pertussis
ucggggcaacgacgcaggcgcc

SEQ ID NO: 2405383 - RNA, 13 nt, Bordetella pertussis
ucggggccaagau

SEQ ID NO: 2405384 - RNA, 18 nt, Bordetella pertussis
ucggggggugcgaggcga

SEQ ID NO: 2405385 - RNA, 19 nt, Bordetella pertussis
ucggggucggccaccacca

SEQ ID NO: 2405386 - RNA, 18 nt, Bordetella pertussis
ucgggguuccacagcgcc

SEQ ID NO: 2405387 - RNA, 23 nt, Bordetella pertussis
ucgggguucuccuugagcacguc

SEQ ID NO: 2405388 - RNA, 15 nt, Bordetella pertussis
ucggguaaagcggug

SEQ ID NO: 2405389 - RNA, 14 nt, Bordetella pertussis
ucggguagcugcug

SEQ ID NO: 2405390 - RNA, 16 nt, Bordetella pertussis
ucgggugcugcggguc

SEQ ID NO: 2405391 - RNA, 18 nt, Bordetella pertussis
ucggguugcaaauucugc

SEQ ID NO: 2405392 - RNA, 16 nt, Bordetella pertussis
ucgguauggcggcaac

SEQ ID NO: 2405393 - RNA, 17 nt, Bordetella pertussis
ucggucacguucagcgc

SEQ ID NO: 2405394 - RNA, 14 nt, Bordetella pertussis
ucggucagcacgaa

SEQ ID NO: 2405395 - RNA, 14 nt, Bordetella pertussis
ucggucagcgcggc

SEQ ID NO: 2405396 - RNA, 15 nt, Bordetella pertussis
ucggucagcgcggcg

SEQ ID NO: 2405397 - RNA, 14 nt, Bordetella pertussis
ucggucagcugcug

SEQ ID NO: 2405398 - RNA, 16 nt, Bordetella pertussis
ucggucaugcccaugc

SEQ ID NO: 2405399 - RNA, 15 nt, Bordetella pertussis
ucgguccagcggaag

SEQ ID NO: 2405400 - RNA, 23 nt, Bordetella pertussis
ucggucgccuguaucagcgccug

SEQ ID NO: 2405401 - RNA, 16 nt, Bordetella pertussis
ucggucgcuuccagcg

SEQ ID NO: 2405402 - RNA, 16 nt, Bordetella pertussis
ucggucgucagcacgc

SEQ ID NO: 2405403 - RNA, 13 nt, Bordetella pertussis
ucggugacggcgu

SEQ ID NO: 2405404 - RNA, 15 nt, Bordetella pertussis
ucggugagcggcacg

SEQ ID NO: 2405405 - RNA, 17 nt, Bordetella pertussis
ucggugaugauccugcu

SEQ ID NO: 2405406 - RNA, 16 nt, Bordetella pertussis
ucggugcagcccagca

SEQ ID NO: 2405407 - RNA, 17 nt, Bordetella pertussis
ucggugccgccgagcag

SEQ ID NO: 2405408 - RNA, 13 nt, Bordetella pertussis
ucggugcgcgcgc

SEQ ID NO: 2405409 - RNA, 17 nt, Bordetella pertussis
ucggugcggaagacgau

SEQ ID NO: 2405410 - RNA, 14 nt, Bordetella pertussis
ucggugcggccggu

SEQ ID NO: 2405411 - RNA, 19 nt, Bordetella pertussis
ucggugcgggccggcgcgc

SEQ ID NO: 2405412 - RNA, 21 nt, Bordetella pertussis
ucggugcgggccggcgcgccu

SEQ ID NO: 2405413 - RNA, 12 nt, Bordetella pertussis
ucggugcugcug

SEQ ID NO: 2405414 - RNA, 15 nt, Bordetella pertussis
ucgguggccagccag

SEQ ID NO: 2405415 - RNA, 17 nt, Bordetella pertussis
ucgguggccagccaggc

SEQ ID NO: 2405416 - RNA, 13 nt, Bordetella pertussis
ucgguggcgcgca

SEQ ID NO: 2405417 - RNA, 23 nt, Bordetella pertussis
ucggugguggugacguugaccuu

SEQ ID NO: 2405418 - RNA, 13 nt, Bordetella pertussis
ucguaaggcugcg

SEQ ID NO: 2405419 - RNA, 19 nt, Bordetella pertussis
ucguacagccugcccuggu

SEQ ID NO: 2405420 - RNA, 20 nt, Bordetella pertussis
ucguacagcgccugcgcggc

SEQ ID NO: 2405421 - RNA, 17 nt, Bordetella pertussis
ucguacaugucgaggua

SEQ ID NO: 2405422 - RNA, 14 nt, Bordetella pertussis
ucguacgaagcaua

SEQ ID NO: 2405423 - RNA, 16 nt, Bordetella pertussis
ucguacgagccgacgc

SEQ ID NO: 2405424 - RNA, 21 nt, Bordetella pertussis
ucguacgagccgacgcuccag

SEQ ID NO: 2405425 - RNA, 15 nt, Bordetella pertussis
ucguagcccucgccc

SEQ ID NO: 2405426 - RNA, 19 nt, Bordetella pertussis
ucguagcccucgcccagga

SEQ ID NO: 2405427 - RNA, 14 nt, Bordetella pertussis
ucguagugcgcgcc

SEQ ID NO: 2405428 - RNA, 22 nt, Bordetella pertussis
ucguauggcggggugccugucc

SEQ ID NO: 2405429 - RNA, 16 nt, Bordetella pertussis
ucguauugcugcugcu

SEQ ID NO: 2405430 - RNA, 18 nt, Bordetella pertussis
ucgucaacccgucgacgc

SEQ ID NO: 2405431 - RNA, 19 nt, Bordetella pertussis
ucgucagcacgcccuggcu

SEQ ID NO: 2405432 - RNA, 12 nt, Bordetella pertussis
ucgucagcagca

SEQ ID NO: 2405433 - RNA, 18 nt, Bordetella pertussis
ucgucaggcaggcgcgcc

SEQ ID NO: 2405434 - RNA, 16 nt, Bordetella pertussis
ucgucaugaacgucac

SEQ ID NO: 2405435 - RNA, 21 nt, Bordetella pertussis
ucgucaugauguagcccaugu

SEQ ID NO: 2405436 - RNA, 16 nt, Bordetella pertussis
ucgucauggucgacca

SEQ ID NO: 2405437 - RNA, 18 nt, Bordetella pertussis
ucgucauugaagcgguau

SEQ ID NO: 2405438 - RNA, 23 nt, Bordetella pertussis
ucguccacccccgucagcacggu

SEQ ID NO: 2405439 - RNA, 12 nt, Bordetella pertussis
ucguccagcacg

SEQ ID NO: 2405440 - RNA, 20 nt, Bordetella pertussis
ucguccagcacgcggcgcag

SEQ ID NO: 2405441 - RNA, 16 nt, Bordetella pertussis
ucguccagcgucaugc

SEQ ID NO: 2405442 - RNA, 17 nt, Bordetella pertussis
ucguccagcguggcgca

SEQ ID NO: 2405443 - RNA, 14 nt, Bordetella pertussis
ucguccagcuccag

SEQ ID NO: 2405444 - RNA, 21 nt, Bordetella pertussis
ucguccagguugagucuggag

SEQ ID NO: 2405445 - RNA, 16 nt, Bordetella pertussis
ucguccaucgccugca

SEQ ID NO: 2405446 - RNA, 23 nt, Bordetella pertussis
ucguccaucgccugcacgaccug

SEQ ID NO: 2405447 - RNA, 15 nt, Bordetella pertussis
ucgucccagcgcacg

SEQ ID NO: 2405448 - RNA, 22 nt, Bordetella pertussis
ucguccccaauacccgccacag

SEQ ID NO: 2405449 - RNA, 14 nt, Bordetella pertussis
ucguccccacgggg

SEQ ID NO: 2405450 - RNA, 17 nt, Bordetella pertussis
ucguccccacggggacu

SEQ ID NO: 2405451 - RNA, 21 nt, Bordetella pertussis
ucgucccccuacugcccucgc

SEQ ID NO: 2405452 - RNA, 23 nt, Bordetella pertussis
ucguccgcuucgucgggcagcgc

SEQ ID NO: 2405453 - RNA, 19 nt, Bordetella pertussis
ucguccguggccggcgcgg

SEQ ID NO: 2405454 - RNA, 19 nt, Bordetella pertussis
ucguccguuucgucggcgc

SEQ ID NO: 2405455 - RNA, 21 nt, Bordetella pertussis
ucguccguuucgucggcgcgc

SEQ ID NO: 2405456 - RNA, 16 nt, Bordetella pertussis
ucguccucggcacggc

SEQ ID NO: 2405457 - RNA, 17 nt, Bordetella pertussis
ucguccucggcacggcc

SEQ ID NO: 2405458 - RNA, 18 nt, Bordetella pertussis
ucguccucgucggcgaag

SEQ ID NO: 2405459 - RNA, 14 nt, Bordetella pertussis
ucgucgaacagcau

SEQ ID NO: 2405460 - RNA, 13 nt, Bordetella pertussis
ucgucgaaggcgc

SEQ ID NO: 2405461 - RNA, 15 nt, Bordetella pertussis
ucgucgaaggcgcgc

SEQ ID NO: 2405462 - RNA, 22 nt, Bordetella pertussis
ucgucgaccaccagcaucgcgc

SEQ ID NO: 2405463 - RNA, 17 nt, Bordetella pertussis
ucgucgacguccuggug

SEQ ID NO: 2405464 - RNA, 16 nt, Bordetella pertussis
ucgucgaggucagcgg

SEQ ID NO: 2405465 - RNA, 18 nt, Bordetella pertussis
ucgucgaucauggcgccg

SEQ ID NO: 2405466 - RNA, 13 nt, Bordetella pertussis
ucgucgaugccga

SEQ ID NO: 2405467 - RNA, 15 nt, Bordetella pertussis
ucgucgccggcgcug

SEQ ID NO: 2405468 - RNA, 14 nt, Bordetella pertussis
ucgucgccggcguu

SEQ ID NO: 2405469 - RNA, 15 nt, Bordetella pertussis
ucgucgcgcaacgcc

SEQ ID NO: 2405470 - RNA, 13 nt, Bordetella pertussis
ucgucgcgcaugg

SEQ ID NO: 2405471 - RNA, 23 nt, Bordetella pertussis
ucgucgcgcugcgacagcagcau

SEQ ID NO: 2405472 - RNA, 20 nt, Bordetella pertussis
ucgucggcaccuucgcgcag

SEQ ID NO: 2405473 - RNA, 13 nt, Bordetella pertussis
ucgucggccacgc

SEQ ID NO: 2405474 - RNA, 15 nt, Bordetella pertussis
ucgucggccacgccc

SEQ ID NO: 2405475 - RNA, 18 nt, Bordetella pertussis
ucgucggccaugcgcgcc

SEQ ID NO: 2405476 - RNA, 14 nt, Bordetella pertussis
ucgucggccgccag

SEQ ID NO: 2405477 - RNA, 13 nt, Bordetella pertussis
ucgucggcgccau

SEQ ID NO: 2405478 - RNA, 13 nt, Bordetella pertussis
ucgucggcgcugc

SEQ ID NO: 2405479 - RNA, 14 nt, Bordetella pertussis
ucgucggcgcugca

SEQ ID NO: 2405480 - RNA, 20 nt, Bordetella pertussis
ucgucggcgcugcagcgcag

SEQ ID NO: 2405481 - RNA, 20 nt, Bordetella pertussis
ucgucggcgggacgcaggcc

SEQ ID NO: 2405482 - RNA, 11 nt, Bordetella pertussis
ucgucgguggg

SEQ ID NO: 2405483 - RNA, 19 nt, Bordetella pertussis
ucgucguagccgccgacgu

SEQ ID NO: 2405484 - RNA, 18 nt, Bordetella pertussis
ucgucguagcgccagcgu

SEQ ID NO: 2405485 - RNA, 16 nt, Bordetella pertussis
ucgucguagcgggcgg

SEQ ID NO: 2405486 - RNA, 22 nt, Bordetella pertussis
ucgucgucaugauguagcccau

SEQ ID NO: 2405487 - RNA, 20 nt, Bordetella pertussis
ucgucguggucgucccgcag

SEQ ID NO: 2405488 - RNA, 16 nt, Bordetella pertussis
ucgucguuucccagca

SEQ ID NO: 2405489 - RNA, 19 nt, Bordetella pertussis
ucgucguuucccagcaagc

SEQ ID NO: 2405490 - RNA, 18 nt, Bordetella pertussis
ucgucuuuuuacaggcag

SEQ ID NO: 2405491 - RNA, 15 nt, Bordetella pertussis
ucgugauccugacca

SEQ ID NO: 2405492 - RNA, 19 nt, Bordetella pertussis
ucgugauccugaccaucau

SEQ ID NO: 2405493 - RNA, 15 nt, Bordetella pertussis
ucgugcaccagcccg

SEQ ID NO: 2405494 - RNA, 17 nt, Bordetella pertussis
ucgugcagcaggggcug

SEQ ID NO: 2405495 - RNA, 18 nt, Bordetella pertussis
ucgugcagcaggggcugc

SEQ ID NO: 2405496 - RNA, 19 nt, Bordetella pertussis
ucgugcaucaucugggcgu

SEQ ID NO: 2405497 - RNA, 15 nt, Bordetella pertussis
ucgugcccagcuggc

SEQ ID NO: 2405498 - RNA, 20 nt, Bordetella pertussis
ucgugcccagcuggcaccgc

SEQ ID NO: 2405499 - RNA, 12 nt, Bordetella pertussis
ucgugccggaga

SEQ ID NO: 2405500 - RNA, 22 nt, Bordetella pertussis
ucgugccggagauccggccuuc

SEQ ID NO: 2405501 - RNA, 14 nt, Bordetella pertussis
ucgugccgggcagc

SEQ ID NO: 2405502 - RNA, 15 nt, Bordetella pertussis
ucgugccgggcagca

SEQ ID NO: 2405503 - RNA, 20 nt, Bordetella pertussis
ucgugcgaggccacggcaau

SEQ ID NO: 2405504 - RNA, 17 nt, Bordetella pertussis
ucgugcugcugcaggcg

SEQ ID NO: 2405505 - RNA, 18 nt, Bordetella pertussis
ucguggcccagcaccgcc

SEQ ID NO: 2405506 - RNA, 13 nt, Bordetella pertussis
ucguggcgcagcu

SEQ ID NO: 2405507 - RNA, 11 nt, Bordetella pertussis
ucguggcgccg

SEQ ID NO: 2405508 - RNA, 12 nt, Bordetella pertussis
ucguggcgcgcc

SEQ ID NO: 2405509 - RNA, 13 nt, Bordetella pertussis
ucguggcgcgccu

SEQ ID NO: 2405510 - RNA, 21 nt, Bordetella pertussis
ucguggcgcgccuccagcucc

SEQ ID NO: 2405511 - RNA, 14 nt, Bordetella pertussis
ucguggggcgcggc

SEQ ID NO: 2405512 - RNA, 15 nt, Bordetella pertussis
ucguggggcgcggcg

SEQ ID NO: 2405513 - RNA, 23 nt, Bordetella pertussis
ucguggguucgaaucccaccauc

SEQ ID NO: 2405514 - RNA, 16 nt, Bordetella pertussis
ucguggucgugcuggc

SEQ ID NO: 2405515 - RNA, 23 nt, Bordetella pertussis
ucguguagggccuggcguaugcc

SEQ ID NO: 2405516 - RNA, 14 nt, Bordetella pertussis
ucguguucgcggcc

SEQ ID NO: 2405517 - RNA, 15 nt, Bordetella pertussis
ucguucacgcccgag

SEQ ID NO: 2405518 - RNA, 12 nt, Bordetella pertussis
ucguuccagaac

SEQ ID NO: 2405519 - RNA, 22 nt, Bordetella pertussis
ucguuccagaugcgcagcaggc

SEQ ID NO: 2405520 - RNA, 14 nt, Bordetella pertussis
ucguucguauugcu

SEQ ID NO: 2405521 - RNA, 14 nt, Bordetella pertussis
ucguugacgccgac

SEQ ID NO: 2405522 - RNA, 22 nt, Bordetella pertussis
ucguugcauugcacaacgggca

SEQ ID NO: 2405523 - RNA, 21 nt, Bordetella pertussis
ucguugccccgauccgcgggc

SEQ ID NO: 2405524 - RNA, 13 nt, Bordetella pertussis
ucguuggccgcgu

SEQ ID NO: 2405525 - RNA, 16 nt, Bordetella pertussis
ucguuucccagcaagc

SEQ ID NO: 2405526 - RNA, 15 nt, Bordetella pertussis
ucuacacggccgcca

SEQ ID NO: 2405527 - RNA, 23 nt, Bordetella pertussis
ucuacacggccgccaccugggcc

SEQ ID NO: 2405528 - RNA, 22 nt, Bordetella pertussis
ucuacgccgaauugcuggagcg

SEQ ID NO: 2405529 - RNA, 11 nt, Bordetella pertussis
ucuacgcgcgc

SEQ ID NO: 2405530 - RNA, 14 nt, Bordetella pertussis
ucuacgcgcgcgcc

SEQ ID NO: 2405531 - RNA, 22 nt, Bordetella pertussis
ucuaggccguuuccucuggaga

SEQ ID NO: 2405532 - RNA, 16 nt, Bordetella pertussis
ucuaucugccgcgcau

SEQ ID NO: 2405533 - RNA, 18 nt, Bordetella pertussis
ucucaacccgccggccau

SEQ ID NO: 2405534 - RNA, 14 nt, Bordetella pertussis
ucuccacgaaggcg

SEQ ID NO: 2405535 - RNA, 15 nt, Bordetella pertussis
ucuccagcgccagca

SEQ ID NO: 2405536 - RNA, 21 nt, Bordetella pertussis
ucuccagcgccggcagcccca

SEQ ID NO: 2405537 - RNA, 24 nt, Bordetella pertussis
ucuccagcgcgucggccaggcgcc

SEQ ID NO: 2405538 - RNA, 19 nt, Bordetella pertussis
ucuccaugcgauagcgggc

SEQ ID NO: 2405539 - RNA, 13 nt, Bordetella pertussis
ucucccgcaggcc

SEQ ID NO: 2405540 - RNA, 13 nt, Bordetella pertussis
ucucccggcgccc

SEQ ID NO: 2405541 - RNA, 23 nt, Bordetella pertussis
ucuccgccucuucgaugaugagc

SEQ ID NO: 2405542 - RNA, 16 nt, Bordetella pertussis
ucuccgggagccuguc

SEQ ID NO: 2405543 - RNA, 17 nt, Bordetella pertussis
ucuccgggagccugucc

SEQ ID NO: 2405544 - RNA, 21 nt, Bordetella pertussis
ucuccgguucggcgcggcgcg

SEQ ID NO: 2405545 - RNA, 16 nt, Bordetella pertussis
ucucgaccaggcgggc

SEQ ID NO: 2405546 - RNA, 18 nt, Bordetella pertussis
ucucgacgcaaucggcga

SEQ ID NO: 2405547 - RNA, 14 nt, Bordetella pertussis
ucucgacggcgcgc

SEQ ID NO: 2405548 - RNA, 14 nt, Bordetella pertussis
ucucgaugcgcgcc

SEQ ID NO: 2405549 - RNA, 15 nt, Bordetella pertussis
ucucgaugcgcgcca

SEQ ID NO: 2405550 - RNA, 23 nt, Bordetella pertussis
ucucgcaagugcuggcccgccag

SEQ ID NO: 2405551 - RNA, 14 nt, Bordetella pertussis
ucucgcccaggccc

SEQ ID NO: 2405552 - RNA, 13 nt, Bordetella pertussis
ucucgcccugcuc

SEQ ID NO: 2405553 - RNA, 18 nt, Bordetella pertussis
ucucgcgcgcgcggucca

SEQ ID NO: 2405554 - RNA, 16 nt, Bordetella pertussis
ucucggaaaacuggcg

SEQ ID NO: 2405555 - RNA, 12 nt, Bordetella pertussis
ucucggccacgg

SEQ ID NO: 2405556 - RNA, 13 nt, Bordetella pertussis
ucucggccagcag

SEQ ID NO: 2405557 - RNA, 21 nt, Bordetella pertussis
ucucggccucgcggcgcagca

SEQ ID NO: 2405558 - RNA, 15 nt, Bordetella pertussis
ucucggcgcccgcgg

SEQ ID NO: 2405559 - RNA, 21 nt, Bordetella pertussis
ucucgggauaggccucggcca

SEQ ID NO: 2405560 - RNA, 19 nt, Bordetella pertussis
ucucgggcaggucggccag

SEQ ID NO: 2405561 - RNA, 24 nt, Bordetella pertussis
ucucgggcaggucggccagcgugc

SEQ ID NO: 2405562 - RNA, 20 nt, Bordetella pertussis
ucucgguggaggacgccgac

SEQ ID NO: 2405563 - RNA, 22 nt, Bordetella pertussis
ucucgguggaggacgccgaccu

SEQ ID NO: 2405564 - RNA, 18 nt, Bordetella pertussis
ucucgugccccgcaugcg

SEQ ID NO: 2405565 - RNA, 15 nt, Bordetella pertussis
ucucguuccagaugc

SEQ ID NO: 2405566 - RNA, 21 nt, Bordetella pertussis
ucugacgggucacccgccgca

SEQ ID NO: 2405567 - RNA, 20 nt, Bordetella pertussis
ucugaucggacugggucaga

SEQ ID NO: 2405568 - RNA, 16 nt, Bordetella pertussis
ucugcaaggccugcug

SEQ ID NO: 2405569 - RNA, 17 nt, Bordetella pertussis
ucugcaaggccugcugc

SEQ ID NO: 2405570 - RNA, 21 nt, Bordetella pertussis
ucugcaagguggcgugcagca

SEQ ID NO: 2405571 - RNA, 16 nt, Bordetella pertussis
ucugcaccggcgccac

SEQ ID NO: 2405572 - RNA, 17 nt, Bordetella pertussis
ucugcaccuugggcgcc

SEQ ID NO: 2405573 - RNA, 22 nt, Bordetella pertussis
ucugcaccuugggcgccugcgg

SEQ ID NO: 2405574 - RNA, 21 nt, Bordetella pertussis
ucugcacgccgggcgcgcugc

SEQ ID NO: 2405575 - RNA, 21 nt, Bordetella pertussis
ucugcaggugccugucccagc

SEQ ID NO: 2405576 - RNA, 22 nt, Bordetella pertussis
ucugccacagcgugacggcggc

SEQ ID NO: 2405577 - RNA, 18 nt, Bordetella pertussis
ucugccacaucacgccgg

SEQ ID NO: 2405578 - RNA, 19 nt, Bordetella pertussis
ucugcccgcgguccagcac

SEQ ID NO: 2405579 - RNA, 23 nt, Bordetella pertussis
ucugcccgcgguccagcacggcg

SEQ ID NO: 2405580 - RNA, 17 nt, Bordetella pertussis
ucugcccgugcgugcgc

SEQ ID NO: 2405581 - RNA, 14 nt, Bordetella pertussis
ucugccgccaggca

SEQ ID NO: 2405582 - RNA, 20 nt, Bordetella pertussis
ucugccgcgcauuugccgcg

SEQ ID NO: 2405583 - RNA, 23 nt, Bordetella pertussis
ucugccgguaaccgacgcagcgc

SEQ ID NO: 2405584 - RNA, 23 nt, Bordetella pertussis
ucugcgagccuucggccggcugc

SEQ ID NO: 2405585 - RNA, 22 nt, Bordetella pertussis
ucugcgcaucgaugcggccuuc

SEQ ID NO: 2405586 - RNA, 14 nt, Bordetella pertussis
ucugcgccacggcg

SEQ ID NO: 2405587 - RNA, 13 nt, Bordetella pertussis
ucugcgccugcug

SEQ ID NO: 2405588 - RNA, 15 nt, Bordetella pertussis
ucugcggaaacagau

SEQ ID NO: 2405589 - RNA, 12 nt, Bordetella pertussis
ucugcggcgugg

SEQ ID NO: 2405590 - RNA, 18 nt, Bordetella pertussis
ucugcgugugccgccagc

SEQ ID NO: 2405591 - RNA, 24 nt, Bordetella pertussis
ucugcuacaccgugcuggccgacg

SEQ ID NO: 2405592 - RNA, 23 nt, Bordetella pertussis
ucugcucgccgcgcgacagccgc

SEQ ID NO: 2405593 - RNA, 11 nt, Bordetella pertussis
ucugcuggcuc

SEQ ID NO: 2405594 - RNA, 23 nt, Bordetella pertussis
ucugcugguacagccccagcgcc

SEQ ID NO: 2405595 - RNA, 21 nt, Bordetella pertussis
ucugcuggucgcgggccaggc

SEQ ID NO: 2405596 - RNA, 18 nt, Bordetella pertussis
ucuggaucaccgccggcg

SEQ ID NO: 2405597 - RNA, 19 nt, Bordetella pertussis
ucuggaucaccgccggcgg

SEQ ID NO: 2405598 - RNA, 15 nt, Bordetella pertussis
ucuggaucgcgccca

SEQ ID NO: 2405599 - RNA, 18 nt, Bordetella pertussis
ucuggauggcguauggaa

SEQ ID NO: 2405600 - RNA, 23 nt, Bordetella pertussis
ucuggcaacguugcugcagcguc

SEQ ID NO: 2405601 - RNA, 15 nt, Bordetella pertussis
ucuggcacaccagcg

SEQ ID NO: 2405602 - RNA, 16 nt, Bordetella pertussis
ucuggcacgcuugccg

SEQ ID NO: 2405603 - RNA, 15 nt, Bordetella pertussis
ucuggcaucagggcg

SEQ ID NO: 2405604 - RNA, 24 nt, Bordetella pertussis
ucuggccgauggccucgcugccag

SEQ ID NO: 2405605 - RNA, 13 nt, Bordetella pertussis
ucuggccggugau

SEQ ID NO: 2405606 - RNA, 22 nt, Bordetella pertussis
ucuggccggugaugcggcgcgc

SEQ ID NO: 2405607 - RNA, 16 nt, Bordetella pertussis
ucuggccgucgagccg

SEQ ID NO: 2405608 - RNA, 12 nt, Bordetella pertussis
ucuggccuuccu

SEQ ID NO: 2405609 - RNA, 23 nt, Bordetella pertussis
ucuggcgcagcaaggcgcgccac

SEQ ID NO: 2405610 - RNA, 12 nt, Bordetella pertussis
ucuggcgcguca

SEQ ID NO: 2405611 - RNA, 23 nt, Bordetella pertussis
ucuggcgcgucaggccgggcagc

SEQ ID NO: 2405612 - RNA, 16 nt, Bordetella pertussis
ucuggcucacgaugcg

SEQ ID NO: 2405613 - RNA, 14 nt, Bordetella pertussis
ucuggcugcgcgcc

SEQ ID NO: 2405614 - RNA, 15 nt, Bordetella pertussis
ucugggccagcaggc

SEQ ID NO: 2405615 - RNA, 20 nt, Bordetella pertussis
ucugggccucggccagcugg

SEQ ID NO: 2405616 - RNA, 23 nt, Bordetella pertussis
ucugggccucggccagcugggcc

SEQ ID NO: 2405617 - RNA, 17 nt, Bordetella pertussis
ucugggcgucccaggcc

SEQ ID NO: 2405618 - RNA, 19 nt, Bordetella pertussis
ucugggcgucgaaggcggc

SEQ ID NO: 2405619 - RNA, 13 nt, Bordetella pertussis
ucugguaguuggc

SEQ ID NO: 2405620 - RNA, 18 nt, Bordetella pertussis
ucugguaguuggccaggg

SEQ ID NO: 2405621 - RNA, 12 nt, Bordetella pertussis
ucuggucggcga

SEQ ID NO: 2405622 - RNA, 15 nt, Bordetella pertussis
ucuggucuggcaacg

SEQ ID NO: 2405623 - RNA, 13 nt, Bordetella pertussis
ucuggugaaacag

SEQ ID NO: 2405624 - RNA, 13 nt, Bordetella pertussis
ucuggugcagcgg

SEQ ID NO: 2405625 - RNA, 15 nt, Bordetella pertussis
ucuggugcgcguccu

SEQ ID NO: 2405626 - RNA, 23 nt, Bordetella pertussis
ucugguggcgauccauguggcca

SEQ ID NO: 2405627 - RNA, 22 nt, Bordetella pertussis
ucuggugggcauagcgcgccac

SEQ ID NO: 2405628 - RNA, 15 nt, Bordetella pertussis
ucugguugagcagca

SEQ ID NO: 2405629 - RNA, 16 nt, Bordetella pertussis
ucugguugagcagcac

SEQ ID NO: 2405630 - RNA, 19 nt, Bordetella pertussis
ucugguuuuucgaagagca

SEQ ID NO: 2405631 - RNA, 13 nt, Bordetella pertussis
ucuguaccagcau

SEQ ID NO: 2405632 - RNA, 14 nt, Bordetella pertussis
ucuguaccgccggg

SEQ ID NO: 2405633 - RNA, 23 nt, Bordetella pertussis
ucugucacucaacaguacuacag

SEQ ID NO: 2405634 - RNA, 15 nt, Bordetella pertussis
ucuguccccgcgggg

SEQ ID NO: 2405635 - RNA, 20 nt, Bordetella pertussis
ucuguccccgcggggacagg

SEQ ID NO: 2405636 - RNA, 19 nt, Bordetella pertussis
ucuguccugauucacaggc

SEQ ID NO: 2405637 - RNA, 19 nt, Bordetella pertussis
ucugucgcggaugucaguu

SEQ ID NO: 2405638 - RNA, 15 nt, Bordetella pertussis
ucugugcgccccgcu

SEQ ID NO: 2405639 - RNA, 17 nt, Bordetella pertussis
ucuucaggcuccagugg

SEQ ID NO: 2405640 - RNA, 14 nt, Bordetella pertussis
ucuuccagcagggc

SEQ ID NO: 2405641 - RNA, 21 nt, Bordetella pertussis
ucuuccaguugcgggcgcacc

SEQ ID NO: 2405642 - RNA, 22 nt, Bordetella pertussis
ucuuccucccagaccugcgcgc

SEQ ID NO: 2405643 - RNA, 16 nt, Bordetella pertussis
ucuucgaucgccuggg

SEQ ID NO: 2405644 - RNA, 13 nt, Bordetella pertussis
ucuucgaugauga

SEQ ID NO: 2405645 - RNA, 23 nt, Bordetella pertussis
ucuucgccgaccagcucgacgcc

SEQ ID NO: 2405646 - RNA, 18 nt, Bordetella pertussis
ucuucgccggacagcugc

SEQ ID NO: 2405647 - RNA, 21 nt, Bordetella pertussis
ucuucgccuggccggcuugca

SEQ ID NO: 2405648 - RNA, 17 nt, Bordetella pertussis
ucuucggcgcggcgggc

SEQ ID NO: 2405649 - RNA, 22 nt, Bordetella pertussis
ucuucgggauuucgcuggccau

SEQ ID NO: 2405650 - RNA, 23 nt, Bordetella pertussis
ucuucgggauuucgcuggccauc

SEQ ID NO: 2405651 - RNA, 16 nt, Bordetella pertussis
ucuucgugcuggccau

SEQ ID NO: 2405652 - RNA, 14 nt, Bordetella pertussis
ucuucguugucgcg

SEQ ID NO: 2405653 - RNA, 17 nt, Bordetella pertussis
ucuucucgacggcgcgc

SEQ ID NO: 2405654 - RNA, 13 nt, Bordetella pertussis
ucuucuucagcau

SEQ ID NO: 2405655 - RNA, 13 nt, Bordetella pertussis
ucuucuuggccag

SEQ ID NO: 2405656 - RNA, 21 nt, Bordetella pertussis
ucuugaaaaagcugccggcau

SEQ ID NO: 2405657 - RNA, 15 nt, Bordetella pertussis
ucuugaacucggcca

SEQ ID NO: 2405658 - RNA, 20 nt, Bordetella pertussis
ucuugaacucggccagcagc

SEQ ID NO: 2405659 - RNA, 16 nt, Bordetella pertussis
ucuugaccagcaggcc

SEQ ID NO: 2405660 - RNA, 18 nt, Bordetella pertussis
ucuugaccugggccagca

SEQ ID NO: 2405661 - RNA, 15 nt, Bordetella pertussis
ucuugagaauggcgc

SEQ ID NO: 2405662 - RNA, 16 nt, Bordetella pertussis
ucuugagcgcggccuc

SEQ ID NO: 2405663 - RNA, 12 nt, Bordetella pertussis
ucuugaugccgc

SEQ ID NO: 2405664 - RNA, 17 nt, Bordetella pertussis
ucuugccaggcccggcg

SEQ ID NO: 2405665 - RNA, 12 nt, Bordetella pertussis
ucuugccgcgca

SEQ ID NO: 2405666 - RNA, 13 nt, Bordetella pertussis
ucuugccgcgcag

SEQ ID NO: 2405667 - RNA, 17 nt, Bordetella pertussis
ucuugccgcgcagcguc

SEQ ID NO: 2405668 - RNA, 16 nt, Bordetella pertussis
ucuugccggccuguuc

SEQ ID NO: 2405669 - RNA, 15 nt, Bordetella pertussis
ucuugccuuggcgaa

SEQ ID NO: 2405670 - RNA, 15 nt, Bordetella pertussis
ucuugcgcaucggcg

SEQ ID NO: 2405671 - RNA, 23 nt, Bordetella pertussis
ucuugcgcuggaucccggcgauc

SEQ ID NO: 2405672 - RNA, 22 nt, Bordetella pertussis
ucuugcgugacccggggcagga

SEQ ID NO: 2405673 - RNA, 13 nt, Bordetella pertussis
ucuuggccgucaa

SEQ ID NO: 2405674 - RNA, 13 nt, Bordetella pertussis
ucuuggccuguuc

SEQ ID NO: 2405675 - RNA, 17 nt, Bordetella pertussis
ucuuggcgaccaggccc

SEQ ID NO: 2405676 - RNA, 22 nt, Bordetella pertussis
ucuuggugaaaucccccgccac

SEQ ID NO: 2405677 - RNA, 21 nt, Bordetella pertussis
ucuugugcaucucgaagcgcu

SEQ ID NO: 2405678 - RNA, 16 nt, Bordetella pertussis
ucuuucaaagaucugc

SEQ ID NO: 2405679 - RNA, 15 nt, Bordetella pertussis
ucuuuuuacaggcag

SEQ ID NO: 2405680 - RNA, 19 nt, Bordetella pertussis
ugaaacggcaagagccugg

SEQ ID NO: 2405681 - RNA, 20 nt, Bordetella pertussis
ugaaacguacuccauugauu

SEQ ID NO: 2405682 - RNA, 14 nt, Bordetella pertussis
ugaaacugcaaaau

SEQ ID NO: 2405683 - RNA, 14 nt, Bordetella pertussis
ugaaagccgccggc

SEQ ID NO: 2405684 - RNA, 20 nt, Bordetella pertussis
ugaaagccgccggcgcgcgg

SEQ ID NO: 2405685 - RNA, 23 nt, Bordetella pertussis
ugaaagccgccggcgcgcggaug

SEQ ID NO: 2405686 - RNA, 20 nt, Bordetella pertussis
ugaacaccaggguggcgccg

SEQ ID NO: 2405687 - RNA, 22 nt, Bordetella pertussis
ugaacaccaggguggcgccggc

SEQ ID NO: 2405688 - RNA, 18 nt, Bordetella pertussis
ugaacaccccggucagca

SEQ ID NO: 2405689 - RNA, 20 nt, Bordetella pertussis
ugaacaccccggucagcagg

SEQ ID NO: 2405690 - RNA, 15 nt, Bordetella pertussis
ugaacaccggcgcgc

SEQ ID NO: 2405691 - RNA, 22 nt, Bordetella pertussis
ugaacaccggcgcgccuggcgc

SEQ ID NO: 2405692 - RNA, 19 nt, Bordetella pertussis
ugaacacgcggugcaucuc

SEQ ID NO: 2405693 - RNA, 21 nt, Bordetella pertussis
ugaacagccgccccagcagca

SEQ ID NO: 2405694 - RNA, 22 nt, Bordetella pertussis
ugaacagccgccccagcagcag

SEQ ID NO: 2405695 - RNA, 19 nt, Bordetella pertussis
ugaacagcuggaagcgcgc

SEQ ID NO: 2405696 - RNA, 20 nt, Bordetella pertussis
ugaacagcuggaagcgcgcc

SEQ ID NO: 2405697 - RNA, 22 nt, Bordetella pertussis
ugaacagcuggaagcgcgccag

SEQ ID NO: 2405698 - RNA, 16 nt, Bordetella pertussis
ugaaccaggccgccag

SEQ ID NO: 2405699 - RNA, 18 nt, Bordetella pertussis
ugaaccccggcugcgcgg

SEQ ID NO: 2405700 - RNA, 14 nt, Bordetella pertussis
ugaaccgcagcgcc

SEQ ID NO: 2405701 - RNA, 20 nt, Bordetella pertussis
ugaaccgcagcgccaccggc

SEQ ID NO: 2405702 - RNA, 20 nt, Bordetella pertussis
ugaacgauucuuuccuggcc

SEQ ID NO: 2405703 - RNA, 22 nt, Bordetella pertussis
ugaacgauucuuuccuggccgg

SEQ ID NO: 2405704 - RNA, 19 nt, Bordetella pertussis
ugaacgauuucuucgccug

SEQ ID NO: 2405705 - RNA, 14 nt, Bordetella pertussis
ugaacgccgcgccc

SEQ ID NO: 2405706 - RNA, 14 nt, Bordetella pertussis
ugaacgccgcgcug

SEQ ID NO: 2405707 - RNA, 14 nt, Bordetella pertussis
ugaacgccuugccc

SEQ ID NO: 2405708 - RNA, 15 nt, Bordetella pertussis
ugaacgcuugacggc

SEQ ID NO: 2405709 - RNA, 22 nt, Bordetella pertussis
ugaacggccccgccagggcggg

SEQ ID NO: 2405710 - RNA, 14 nt, Bordetella pertussis
ugaacggcgcggcc

SEQ ID NO: 2405711 - RNA, 19 nt, Bordetella pertussis
ugaacguggcguccacgcg

SEQ ID NO: 2405712 - RNA, 14 nt, Bordetella pertussis
ugaacuauggcgcg

SEQ ID NO: 2405713 - RNA, 19 nt, Bordetella pertussis
ugaacugcaggccgccggc
